United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 30

SEQ ID NO: 1089415 - RNA, 15 nt, Mycobacterium bovis subsp bovis AF2122/97
gcccauuucggcacg

SEQ ID NO: 1089416 - RNA, 16 nt, Mycobacterium bovis subsp bovis AF2122/97
gcccauuucgagcucg

SEQ ID NO: 1089417 - RNA, 19 nt, Mycobacterium bovis subsp bovis AF2122/97
gcccauuggguaaccagcg

SEQ ID NO: 1089418 - RNA, 15 nt, Mycobacterium bovis subsp bovis AF2122/97
gcccauugacguaga

SEQ ID NO: 1089419 - RNA, 14 nt, Mycobacterium bovis subsp bovis AF2122/97
gccccaagcgccug

SEQ ID NO: 1089420 - RNA, 14 nt, Mycobacterium bovis subsp bovis AF2122/97
gccccaguucgacg

SEQ ID NO: 1089421 - RNA, 16 nt, Mycobacterium bovis subsp bovis AF2122/97
gccccaguucgacggc

SEQ ID NO: 1089422 - RNA, 17 nt, Mycobacterium bovis subsp bovis AF2122/97
gccccaguucgacggcg

SEQ ID NO: 1089423 - RNA, 22 nt, Mycobacterium bovis subsp bovis AF2122/97
gccccaucgccuggaugccgau

SEQ ID NO: 1089424 - RNA, 21 nt, Mycobacterium bovis subsp bovis AF2122/97
gccccaugaucuggugcgcgg

SEQ ID NO: 1089425 - RNA, 15 nt, Mycobacterium bovis subsp bovis AF2122/97
gccccaucaccaccg

SEQ ID NO: 1089426 - RNA, 16 nt, Mycobacterium bovis subsp bovis AF2122/97
gccccaucaccaccgg

SEQ ID NO: 1089427 - RNA, 17 nt, Mycobacterium bovis subsp bovis AF2122/97
gccccaucaccaccggc

SEQ ID NO: 1089428 - RNA, 22 nt, Mycobacterium bovis subsp bovis AF2122/97
gccccaugcaacacaccgcgga

SEQ ID NO: 1089429 - RNA, 16 nt, Mycobacterium bovis subsp bovis AF2122/97
gccccaugccgaccgg

SEQ ID NO: 1089430 - RNA, 17 nt, Mycobacterium bovis subsp bovis AF2122/97
gccccaugccgaccggc

SEQ ID NO: 1089431 - RNA, 23 nt, Mycobacterium bovis subsp bovis AF2122/97
gccccaugccgaccggcacccgc

SEQ ID NO: 1089432 - RNA, 18 nt, Mycobacterium bovis subsp bovis AF2122/97
gcccccagcagcugcgau

SEQ ID NO: 1089433 - RNA, 15 nt, Mycobacterium bovis subsp bovis AF2122/97
aagacgcuguccagg

SEQ ID NO: 1089434 - RNA, 20 nt, Mycobacterium bovis subsp bovis AF2122/97
aagacgucggcguggucgcg

SEQ ID NO: 1089435 - RNA, 13 nt, Mycobacterium bovis subsp bovis AF2122/97
aagacggccaccg

SEQ ID NO: 1089436 - RNA, 16 nt, Mycobacterium bovis subsp bovis AF2122/97
gccccgacugacagaa

SEQ ID NO: 1089437 - RNA, 17 nt, Mycobacterium bovis subsp bovis AF2122/97
gccccgacugccgcggg

SEQ ID NO: 1089438 - RNA, 22 nt, Mycobacterium bovis subsp bovis AF2122/97
gccccgaccagcagaccaagcc

SEQ ID NO: 1089439 - RNA, 17 nt, Mycobacterium bovis subsp bovis AF2122/97
gcccccgccacgccgaa

SEQ ID NO: 1089440 - RNA, 17 nt, Mycobacterium bovis subsp bovis AF2122/97
gcccccgcacgcucgcc

SEQ ID NO: 1089441 - RNA, 21 nt, Mycobacterium bovis subsp bovis AF2122/97
gcccccgacuccggcaggccc

SEQ ID NO: 1089442 - RNA, 13 nt, Mycobacterium bovis subsp bovis AF2122/97
aagacugcgccgc

SEQ ID NO: 1089443 - RNA, 18 nt, Mycobacterium bovis subsp bovis AF2122/97
aagacugcgccgccggcg

SEQ ID NO: 1089444 - RNA, 17 nt, Mycobacterium bovis subsp bovis AF2122/97
gccccgaucaucgacga

SEQ ID NO: 1089445 - RNA, 13 nt, Mycobacterium bovis subsp bovis AF2122/97
gccccgacgguca

SEQ ID NO: 1089446 - RNA, 15 nt, Mycobacterium bovis subsp bovis AF2122/97
gccccgaugaccgcc

SEQ ID NO: 1089447 - RNA, 18 nt, Mycobacterium bovis subsp bovis AF2122/97
gccccgcauugccgucgg

SEQ ID NO: 1089448 - RNA, 19 nt, Mycobacterium bovis subsp bovis AF2122/97
gccccgcauugccgucggg

SEQ ID NO: 1089449 - RNA, 13 nt, Mycobacterium bovis subsp bovis AF2122/97
gccccgccagcgc

SEQ ID NO: 1089450 - RNA, 21 nt, Mycobacterium bovis subsp bovis AF2122/97
gccccgcaggggguggugucg

SEQ ID NO: 1089451 - RNA, 14 nt, Mycobacterium bovis subsp bovis AF2122/97
gccccgccagcgcc

SEQ ID NO: 1089452 - RNA, 15 nt, Mycobacterium bovis subsp bovis AF2122/97
gccccgccagcgccg

SEQ ID NO: 1089453 - RNA, 19 nt, Mycobacterium bovis subsp bovis AF2122/97
gccccgccagcgccgccgg

SEQ ID NO: 1089454 - RNA, 16 nt, Mycobacterium bovis subsp bovis AF2122/97
gccccgccaccucgcc

SEQ ID NO: 1089455 - RNA, 19 nt, Mycobacterium bovis subsp bovis AF2122/97
gccccgccaccucgccggc

SEQ ID NO: 1089456 - RNA, 13 nt, Mycobacterium bovis subsp bovis AF2122/97
gccccgccggcgc

SEQ ID NO: 1089457 - RNA, 11 nt, Mycobacterium bovis subsp bovis AF2122/97
gccccgccgau

SEQ ID NO: 1089458 - RNA, 13 nt, Mycobacterium bovis subsp bovis AF2122/97
gccccgccgaugc

SEQ ID NO: 1089459 - RNA, 19 nt, Mycobacterium bovis subsp bovis AF2122/97
gccccgccgaugccgccgg

SEQ ID NO: 1089460 - RNA, 12 nt, Mycobacterium bovis subsp bovis AF2122/97
gccccgccgagc

SEQ ID NO: 1089461 - RNA, 15 nt, Mycobacterium bovis subsp bovis AF2122/97
gccccgccgagcacc

SEQ ID NO: 1089462 - RNA, 17 nt, Mycobacterium bovis subsp bovis AF2122/97
gccccgccagcggcagc

SEQ ID NO: 1089463 - RNA, 12 nt, Mycobacterium bovis subsp bovis AF2122/97
gccccgcccgcg

SEQ ID NO: 1089464 - RNA, 15 nt, Mycobacterium bovis subsp bovis AF2122/97
gccccgccgguggcc

SEQ ID NO: 1089465 - RNA, 14 nt, Mycobacterium bovis subsp bovis AF2122/97
gccccgccgagcgg

SEQ ID NO: 1089466 - RNA, 14 nt, Mycobacterium bovis subsp bovis AF2122/97
gccccgccggcgcc

SEQ ID NO: 1089467 - RNA, 16 nt, Mycobacterium bovis subsp bovis AF2122/97
aagagccgcagccacg

SEQ ID NO: 1089468 - RNA, 17 nt, Mycobacterium bovis subsp bovis AF2122/97
aagagcuccgucgcggc

SEQ ID NO: 1089469 - RNA, 19 nt, Mycobacterium bovis subsp bovis AF2122/97
gagcacgccgagcccgccg

SEQ ID NO: 1089470 - RNA, 18 nt, Mycobacterium bovis subsp bovis AF2122/97
gagcacgacgacgucggg

SEQ ID NO: 1089471 - RNA, 14 nt, Mycobacterium bovis subsp bovis AF2122/97
gagcacgcugcugc

SEQ ID NO: 1089472 - RNA, 19 nt, Mycobacterium bovis subsp bovis AF2122/97
gagcacgcugcugcgggug

SEQ ID NO: 1089473 - RNA, 14 nt, Mycobacterium bovis subsp bovis AF2122/97
gagcaccgacaccg

SEQ ID NO: 1089474 - RNA, 15 nt, Mycobacterium bovis subsp bovis AF2122/97
gagcaccgacaccgg

SEQ ID NO: 1089475 - RNA, 19 nt, Mycobacterium bovis subsp bovis AF2122/97
gagcaccgacaccggccgc

SEQ ID NO: 1089476 - RNA, 21 nt, Mycobacterium bovis subsp bovis AF2122/97
gagcaccgacaccggccgcga

SEQ ID NO: 1089477 - RNA, 13 nt, Mycobacterium bovis subsp bovis AF2122/97
gagcaccucggcc

SEQ ID NO: 1089478 - RNA, 24 nt, Mycobacterium bovis subsp bovis AF2122/97
gagcaccucggccucgucgugcac

SEQ ID NO: 1089479 - RNA, 22 nt, Mycobacterium bovis subsp bovis AF2122/97
gagcaccgggcucagacuuucg

SEQ ID NO: 1089480 - RNA, 15 nt, Mycobacterium bovis subsp bovis AF2122/97
gagcaccggcugcgg

SEQ ID NO: 1089481 - RNA, 13 nt, Mycobacterium bovis subsp bovis AF2122/97
gagcaccgcucgg

SEQ ID NO: 1089482 - RNA, 20 nt, Mycobacterium bovis subsp bovis AF2122/97
gagcagacgcgaaagcaccc

SEQ ID NO: 1089483 - RNA, 22 nt, Mycobacterium bovis subsp bovis AF2122/97
gagcagacgcgaaagcacccca

SEQ ID NO: 1089484 - RNA, 21 nt, Mycobacterium bovis subsp bovis AF2122/97
gagcagacgcagaaucgcacg

SEQ ID NO: 1089485 - RNA, 23 nt, Mycobacterium bovis subsp bovis AF2122/97
gagcagacgcagagucgcacugc

SEQ ID NO: 1089486 - RNA, 21 nt, Mycobacterium bovis subsp bovis AF2122/97
gagcagacccaguccgguagc

SEQ ID NO: 1089487 - RNA, 22 nt, Mycobacterium bovis subsp bovis AF2122/97
gagcagaaggccagcgaaucgc

SEQ ID NO: 1089488 - RNA, 18 nt, Mycobacterium bovis subsp bovis AF2122/97
gagcagacgcaaaauccc

SEQ ID NO: 1089489 - RNA, 20 nt, Mycobacterium bovis subsp bovis AF2122/97
gagcagacgcaaaauccccu

SEQ ID NO: 1089490 - RNA, 13 nt, Mycobacterium bovis subsp bovis AF2122/97
gagcagacgcaga

SEQ ID NO: 1089491 - RNA, 18 nt, Mycobacterium bovis subsp bovis AF2122/97
gagcagacgcagaagccc

SEQ ID NO: 1089492 - RNA, 21 nt, Mycobacterium bovis subsp bovis AF2122/97
gagcagacgcagaagccccca

SEQ ID NO: 1089493 - RNA, 18 nt, Mycobacterium bovis subsp bovis AF2122/97
gagcagacgcagaaucgc

SEQ ID NO: 1089494 - RNA, 18 nt, Mycobacterium bovis subsp bovis AF2122/97
gagcagacgcuaaagccc

SEQ ID NO: 1089495 - RNA, 19 nt, Mycobacterium bovis subsp bovis AF2122/97
gagcagacgcuaaagcccc

SEQ ID NO: 1089496 - RNA, 20 nt, Mycobacterium bovis subsp bovis AF2122/97
gagcagaucuuccgagcacu

SEQ ID NO: 1089497 - RNA, 14 nt, Mycobacterium bovis subsp bovis AF2122/97
gagcagcaagccgc

SEQ ID NO: 1089498 - RNA, 17 nt, Mycobacterium bovis subsp bovis AF2122/97
gagcagacgcaaaagcc

SEQ ID NO: 1089499 - RNA, 23 nt, Mycobacterium bovis subsp bovis AF2122/97
gagcagacgcaaaagccaccgca

SEQ ID NO: 1089500 - RNA, 18 nt, Mycobacterium bovis subsp bovis AF2122/97
gagcagacacagaaucgc

SEQ ID NO: 1089501 - RNA, 21 nt, Mycobacterium bovis subsp bovis AF2122/97
gagcagacacagaaucgcacg

SEQ ID NO: 1089502 - RNA, 18 nt, Mycobacterium bovis subsp bovis AF2122/97
gagcagacacuaaagccc

SEQ ID NO: 1089503 - RNA, 20 nt, Mycobacterium bovis subsp bovis AF2122/97
gagcagacacuaaagcccuc

SEQ ID NO: 1089504 - RNA, 14 nt, Mycobacterium bovis subsp bovis AF2122/97
gagcacucggccac

SEQ ID NO: 1089505 - RNA, 19 nt, Mycobacterium bovis subsp bovis AF2122/97
gagcacucggccacgacga

SEQ ID NO: 1089506 - RNA, 16 nt, Mycobacterium bovis subsp bovis AF2122/97
gagcagaaacaacguc

SEQ ID NO: 1089507 - RNA, 20 nt, Mycobacterium bovis subsp bovis AF2122/97
gagauggucgggcggcgucg

SEQ ID NO: 1089508 - RNA, 13 nt, Mycobacterium bovis subsp bovis AF2122/97
gagaucgucgcga

SEQ ID NO: 1089509 - RNA, 17 nt, Mycobacterium bovis subsp bovis AF2122/97
gagaugcuggucggcga

SEQ ID NO: 1089510 - RNA, 17 nt, Mycobacterium bovis subsp bovis AF2122/97
gagaucugcgaugggga

SEQ ID NO: 1089511 - RNA, 20 nt, Mycobacterium bovis subsp bovis AF2122/97
gagaucucacgugcccgcgc

SEQ ID NO: 1089512 - RNA, 21 nt, Mycobacterium bovis subsp bovis AF2122/97
gagaucucacgugcccgcgcg

SEQ ID NO: 1089513 - RNA, 23 nt, Mycobacterium bovis subsp bovis AF2122/97
gagaucucacgugcccgcgcggc

SEQ ID NO: 1089514 - RNA, 20 nt, Mycobacterium bovis subsp bovis AF2122/97
gagauucggagucaccagca

SEQ ID NO: 1089515 - RNA, 19 nt, Mycobacterium bovis subsp bovis AF2122/97
gagaugucggugaucacgg

SEQ ID NO: 1089516 - RNA, 15 nt, Mycobacterium bovis subsp bovis AF2122/97
gagcaacaccgucgg

SEQ ID NO: 1089517 - RNA, 22 nt, Mycobacterium bovis subsp bovis AF2122/97
gagcaacaccgucggcagcagc

SEQ ID NO: 1089518 - RNA, 15 nt, Mycobacterium bovis subsp bovis AF2122/97
gagcaacacgagcgc

SEQ ID NO: 1089519 - RNA, 15 nt, Mycobacterium bovis subsp bovis AF2122/97
gagcaaaauggccac

SEQ ID NO: 1089520 - RNA, 16 nt, Mycobacterium bovis subsp bovis AF2122/97
gagauuggguccagcg

SEQ ID NO: 1089521 - RNA, 15 nt, Mycobacterium bovis subsp bovis AF2122/97
gagcacccgcugguc

SEQ ID NO: 1089522 - RNA, 22 nt, Mycobacterium bovis subsp bovis AF2122/97
gagcaccccagggguugcggag

SEQ ID NO: 1089523 - RNA, 18 nt, Mycobacterium bovis subsp bovis AF2122/97
gagcacaagauccgccac

SEQ ID NO: 1089524 - RNA, 23 nt, Mycobacterium bovis subsp bovis AF2122/97
gagcaccacccgggccucggcgc

SEQ ID NO: 1089525 - RNA, 13 nt, Mycobacterium bovis subsp bovis AF2122/97
gagcaauggcgcg

SEQ ID NO: 1089526 - RNA, 19 nt, Mycobacterium bovis subsp bovis AF2122/97
gagcaaaauggccaccggc

SEQ ID NO: 1089527 - RNA, 17 nt, Mycobacterium bovis subsp bovis AF2122/97
gagcaacgccacgccga

SEQ ID NO: 1089528 - RNA, 21 nt, Mycobacterium bovis subsp bovis AF2122/97
gagcaacgcgaccaucucgac

SEQ ID NO: 1089529 - RNA, 24 nt, Mycobacterium bovis subsp bovis AF2122/97
gagcaacgcgaccaucucgacguc

SEQ ID NO: 1089530 - RNA, 15 nt, Mycobacterium bovis subsp bovis AF2122/97
gagcaacucguccag

SEQ ID NO: 1089531 - RNA, 14 nt, Mycobacterium bovis subsp bovis AF2122/97
gagcaacggcggca

SEQ ID NO: 1089532 - RNA, 19 nt, Mycobacterium bovis subsp bovis AF2122/97
gagacugguugcggaucga

SEQ ID NO: 1089533 - RNA, 18 nt, Mycobacterium bovis subsp bovis AF2122/97
gagacuucgacgcggcga

SEQ ID NO: 1089534 - RNA, 18 nt, Mycobacterium bovis subsp bovis AF2122/97
gagagccugcucgcagcg

SEQ ID NO: 1089535 - RNA, 15 nt, Mycobacterium bovis subsp bovis AF2122/97
gagagcaccgcucgg

SEQ ID NO: 1089536 - RNA, 18 nt, Mycobacterium bovis subsp bovis AF2122/97
gagagcaguacgucugcg

SEQ ID NO: 1089537 - RNA, 20 nt, Mycobacterium bovis subsp bovis AF2122/97
gagagcgaucaacggaucga

SEQ ID NO: 1089538 - RNA, 14 nt, Mycobacterium bovis subsp bovis AF2122/97
gagaguucgcaugc

SEQ ID NO: 1089539 - RNA, 22 nt, Mycobacterium bovis subsp bovis AF2122/97
gagauaccgacgcgcucggcga

SEQ ID NO: 1089540 - RNA, 20 nt, Mycobacterium bovis subsp bovis AF2122/97
gagauaccgaccaucgggac

SEQ ID NO: 1089541 - RNA, 17 nt, Mycobacterium bovis subsp bovis AF2122/97
gagauacggccaccagg

SEQ ID NO: 1089542 - RNA, 17 nt, Mycobacterium bovis subsp bovis AF2122/97
gagauagccgacgucgc

SEQ ID NO: 1089543 - RNA, 21 nt, Mycobacterium bovis subsp bovis AF2122/97
gagaucagcaccgugacagcg

SEQ ID NO: 1089544 - RNA, 16 nt, Mycobacterium bovis subsp bovis AF2122/97
gagaucacgccgacga

SEQ ID NO: 1089545 - RNA, 14 nt, Mycobacterium bovis subsp bovis AF2122/97
gagaucgcuucccg

SEQ ID NO: 1089546 - RNA, 11 nt, Mycobacterium bovis subsp bovis AF2122/97
gagaucgcccg

SEQ ID NO: 1089547 - RNA, 20 nt, Mycobacterium bovis subsp bovis AF2122/97
gagaucgaucgacagcggga

SEQ ID NO: 1089548 - RNA, 23 nt, Mycobacterium bovis subsp bovis AF2122/97
gagaucgccgccggcgccaucgg

SEQ ID NO: 1089549 - RNA, 21 nt, Mycobacterium bovis subsp bovis AF2122/97
gagauccugguaaggccggcc

SEQ ID NO: 1089550 - RNA, 14 nt, Mycobacterium bovis subsp bovis AF2122/97
gagauccagggagc

SEQ ID NO: 1089551 - RNA, 17 nt, Mycobacterium bovis subsp bovis AF2122/97
gagaucccccaggcgaa

SEQ ID NO: 1089552 - RNA, 17 nt, Mycobacterium bovis subsp bovis AF2122/97
gagauccacgccagagc

SEQ ID NO: 1089553 - RNA, 16 nt, Mycobacterium bovis subsp bovis AF2122/97
gagaucagccucgcgg

SEQ ID NO: 1089554 - RNA, 22 nt, Mycobacterium bovis subsp bovis AF2122/97
gagaucaugaggugagcugcgg

SEQ ID NO: 1089555 - RNA, 23 nt, Mycobacterium bovis subsp bovis AF2122/97
gagacguuaucgguucgcucggg

SEQ ID NO: 1089556 - RNA, 18 nt, Mycobacterium bovis subsp bovis AF2122/97
gagacguuuugcggcccg

SEQ ID NO: 1089557 - RNA, 13 nt, Mycobacterium bovis subsp bovis AF2122/97
gagacgucgccgc

SEQ ID NO: 1089558 - RNA, 12 nt, Mycobacterium bovis subsp bovis AF2122/97
gagacggcgucg

SEQ ID NO: 1089559 - RNA, 15 nt, Mycobacterium bovis subsp bovis AF2122/97
gagacgcugcgcgcc

SEQ ID NO: 1089560 - RNA, 15 nt, Mycobacterium bovis subsp bovis AF2122/97
gagacgcaaaaucgc

SEQ ID NO: 1089561 - RNA, 16 nt, Mycobacterium bovis subsp bovis AF2122/97
gagacgcuccaguggc

SEQ ID NO: 1089562 - RNA, 16 nt, Mycobacterium bovis subsp bovis AF2122/97
gagaccccgcgcgcuu

SEQ ID NO: 1089563 - RNA, 19 nt, Mycobacterium bovis subsp bovis AF2122/97
gagaccgccucgucgaugc

SEQ ID NO: 1089564 - RNA, 14 nt, Mycobacterium bovis subsp bovis AF2122/97
gagaccaugccgac

SEQ ID NO: 1089565 - RNA, 15 nt, Mycobacterium bovis subsp bovis AF2122/97
gagaccugucgguac

SEQ ID NO: 1089566 - RNA, 22 nt, Mycobacterium bovis subsp bovis AF2122/97
gagaccuagcagggugccggcg

SEQ ID NO: 1089567 - RNA, 15 nt, Mycobacterium bovis subsp bovis AF2122/97
gagacgaaaagccgc

SEQ ID NO: 1089568 - RNA, 18 nt, Mycobacterium bovis subsp bovis AF2122/97
gagacgaaaagccgcguc

SEQ ID NO: 1089569 - RNA, 23 nt, Mycobacterium bovis subsp bovis AF2122/97
gagacgaaaagccgcgucgcgau

SEQ ID NO: 1089570 - RNA, 16 nt, Mycobacterium bovis subsp bovis AF2122/97
gagacgaaccgccgac

SEQ ID NO: 1089571 - RNA, 19 nt, Mycobacterium bovis subsp bovis AF2122/97
gagacgaucaucucgucgu

SEQ ID NO: 1089572 - RNA, 21 nt, Mycobacterium bovis subsp bovis AF2122/97
gagacgaucaucucgucgucg

SEQ ID NO: 1089573 - RNA, 17 nt, Mycobacterium bovis subsp bovis AF2122/97
gagacagcagcguucgg

SEQ ID NO: 1089574 - RNA, 23 nt, Mycobacterium bovis subsp bovis AF2122/97
gagacacccgccaggccgcgcga

SEQ ID NO: 1089575 - RNA, 16 nt, Mycobacterium bovis subsp bovis AF2122/97
gagacaaaggugccga

SEQ ID NO: 1089576 - RNA, 23 nt, Mycobacterium bovis subsp bovis AF2122/97
gagaccagguucucggucgguac

SEQ ID NO: 1089577 - RNA, 17 nt, Mycobacterium bovis subsp bovis AF2122/97
gagaccacgcgcgucgg

SEQ ID NO: 1089578 - RNA, 18 nt, Mycobacterium bovis subsp bovis AF2122/97
gagacauugacgaggcga

SEQ ID NO: 1089579 - RNA, 14 nt, Mycobacterium bovis subsp bovis AF2122/97
gagacaugccggcg

SEQ ID NO: 1089580 - RNA, 19 nt, Mycobacterium bovis subsp bovis AF2122/97
gagacaugucgcugccgcc

SEQ ID NO: 1089581 - RNA, 22 nt, Mycobacterium bovis subsp bovis AF2122/97
gagacaugucgcugccgccgcc

SEQ ID NO: 1089582 - RNA, 19 nt, Mycobacterium bovis subsp bovis AF2122/97
gagaaggcggcgucgagca

SEQ ID NO: 1089583 - RNA, 13 nt, Mycobacterium bovis subsp bovis AF2122/97
gagaaggcgacca

SEQ ID NO: 1089584 - RNA, 15 nt, Mycobacterium bovis subsp bovis AF2122/97
gagaagucucgcggc

SEQ ID NO: 1089585 - RNA, 14 nt, Mycobacterium bovis subsp bovis AF2122/97
gagaaguccgggcc

SEQ ID NO: 1089586 - RNA, 14 nt, Mycobacterium bovis subsp bovis AF2122/97
gagccggugccacu

SEQ ID NO: 1089587 - RNA, 13 nt, Mycobacterium bovis subsp bovis AF2122/97
gagccggugccga

SEQ ID NO: 1089588 - RNA, 19 nt, Mycobacterium bovis subsp bovis AF2122/97
gagccgguagaucagcgcc

SEQ ID NO: 1089589 - RNA, 15 nt, Mycobacterium bovis subsp bovis AF2122/97
gagccgguagcuguc

SEQ ID NO: 1089590 - RNA, 13 nt, Mycobacterium bovis subsp bovis AF2122/97
gagcgaacggcgc

SEQ ID NO: 1089591 - RNA, 20 nt, Mycobacterium bovis subsp bovis AF2122/97
gagccgucgagcagccgagc

SEQ ID NO: 1089592 - RNA, 13 nt, Mycobacterium bovis subsp bovis AF2122/97
gagccgccgacuc

SEQ ID NO: 1089593 - RNA, 14 nt, Mycobacterium bovis subsp bovis AF2122/97
gagcgaacggcgca

SEQ ID NO: 1089594 - RNA, 20 nt, Mycobacterium bovis subsp bovis AF2122/97
gagccgccaggugcucgucg

SEQ ID NO: 1089595 - RNA, 17 nt, Mycobacterium bovis subsp bovis AF2122/97
gagccgcagcucgccga

SEQ ID NO: 1089596 - RNA, 16 nt, Mycobacterium bovis subsp bovis AF2122/97
gagccgcaucuggccg

SEQ ID NO: 1089597 - RNA, 15 nt, Mycobacterium bovis subsp bovis AF2122/97
gagccgcccgcccgg

SEQ ID NO: 1089598 - RNA, 17 nt, Mycobacterium bovis subsp bovis AF2122/97
gagccgcccgcccggac

SEQ ID NO: 1089599 - RNA, 19 nt, Mycobacterium bovis subsp bovis AF2122/97
gagccgcccgcccggacgc

SEQ ID NO: 1089600 - RNA, 10 nt, Mycobacterium bovis subsp bovis AF2122/97
gagccgguga

SEQ ID NO: 1089601 - RNA, 15 nt, Mycobacterium bovis subsp bovis AF2122/97
gagccggugacggug

SEQ ID NO: 1089602 - RNA, 19 nt, Mycobacterium bovis subsp bovis AF2122/97
gagccggugauccggucgu

SEQ ID NO: 1089603 - RNA, 17 nt, Mycobacterium bovis subsp bovis AF2122/97
gagccgguagaucagcg

SEQ ID NO: 1089604 - RNA, 17 nt, Mycobacterium bovis subsp bovis AF2122/97
gagccgguaaccgcguc

SEQ ID NO: 1089605 - RNA, 18 nt, Mycobacterium bovis subsp bovis AF2122/97
gagccgggcuauccgcgg

SEQ ID NO: 1089606 - RNA, 15 nt, Mycobacterium bovis subsp bovis AF2122/97
gagccgggcucgucg

SEQ ID NO: 1089607 - RNA, 19 nt, Mycobacterium bovis subsp bovis AF2122/97
gagcgaccccacacgccga

SEQ ID NO: 1089608 - RNA, 19 nt, Mycobacterium bovis subsp bovis AF2122/97
gagcgaccgcgagggccag

SEQ ID NO: 1089609 - RNA, 18 nt, Mycobacterium bovis subsp bovis AF2122/97
gagcgaggcucccccacc

SEQ ID NO: 1089610 - RNA, 19 nt, Mycobacterium bovis subsp bovis AF2122/97
gagcgauacgucgucagcc

SEQ ID NO: 1089611 - RNA, 19 nt, Mycobacterium bovis subsp bovis AF2122/97
gagcgacccccagcgcccg

SEQ ID NO: 1089612 - RNA, 19 nt, Mycobacterium bovis subsp bovis AF2122/97
gagcgacugcagcggcgca

SEQ ID NO: 1089613 - RNA, 21 nt, Mycobacterium bovis subsp bovis AF2122/97
gagcgacugcagcggcgcaua

SEQ ID NO: 1089614 - RNA, 13 nt, Mycobacterium bovis subsp bovis AF2122/97
gagcgagccaacu

SEQ ID NO: 1089615 - RNA, 12 nt, Mycobacterium bovis subsp bovis AF2122/97
gagcgaccuggg

SEQ ID NO: 1089616 - RNA, 14 nt, Mycobacterium bovis subsp bovis AF2122/97
gagcgauccggcaa

SEQ ID NO: 1089617 - RNA, 15 nt, Mycobacterium bovis subsp bovis AF2122/97
gagcgcaaucgacca

SEQ ID NO: 1089618 - RNA, 20 nt, Mycobacterium bovis subsp bovis AF2122/97
gagcgccgcggacucgggca

SEQ ID NO: 1089619 - RNA, 18 nt, Mycobacterium bovis subsp bovis AF2122/97
gagcgccuuuggcgguga

SEQ ID NO: 1089620 - RNA, 13 nt, Mycobacterium bovis subsp bovis AF2122/97
gagcgccggccgc

SEQ ID NO: 1089621 - RNA, 19 nt, Mycobacterium bovis subsp bovis AF2122/97
gagccgcagcaccucgucg

SEQ ID NO: 1089622 - RNA, 18 nt, Mycobacterium bovis subsp bovis AF2122/97
gagccgagccagcuccgg

SEQ ID NO: 1089623 - RNA, 14 nt, Mycobacterium bovis subsp bovis AF2122/97
gagccgaucgcccg

SEQ ID NO: 1089624 - RNA, 16 nt, Mycobacterium bovis subsp bovis AF2122/97
gagccgagccucgcuc

SEQ ID NO: 1089625 - RNA, 13 nt, Mycobacterium bovis subsp bovis AF2122/97
gagccgaucaccg

SEQ ID NO: 1089626 - RNA, 14 nt, Mycobacterium bovis subsp bovis AF2122/97
gagccgaucaccgc

SEQ ID NO: 1089627 - RNA, 21 nt, Mycobacterium bovis subsp bovis AF2122/97
gagccgaucaccgccggggcu

SEQ ID NO: 1089628 - RNA, 16 nt, Mycobacterium bovis subsp bovis AF2122/97
gagccgacgugcggcg

SEQ ID NO: 1089629 - RNA, 16 nt, Mycobacterium bovis subsp bovis AF2122/97
gagccgaccggcggca

SEQ ID NO: 1089630 - RNA, 15 nt, Mycobacterium bovis subsp bovis AF2122/97
gagccgacccgacgc

SEQ ID NO: 1089631 - RNA, 13 nt, Mycobacterium bovis subsp bovis AF2122/97
gagcccggcggcc

SEQ ID NO: 1089632 - RNA, 22 nt, Mycobacterium bovis subsp bovis AF2122/97
gagcccggcggcccgauagauc

SEQ ID NO: 1089633 - RNA, 20 nt, Mycobacterium bovis subsp bovis AF2122/97
gagccccugucaacgccgcg

SEQ ID NO: 1089634 - RNA, 19 nt, Mycobacterium bovis subsp bovis AF2122/97
gagcccgggccugaaccac

SEQ ID NO: 1089635 - RNA, 13 nt, Mycobacterium bovis subsp bovis AF2122/97
gagcccgucagcu

SEQ ID NO: 1089636 - RNA, 21 nt, Mycobacterium bovis subsp bovis AF2122/97
gagcccgucagcuccccgucg

SEQ ID NO: 1089637 - RNA, 14 nt, Mycobacterium bovis subsp bovis AF2122/97
gagcccguccaggc

SEQ ID NO: 1089638 - RNA, 19 nt, Mycobacterium bovis subsp bovis AF2122/97
gagccgaaguugaugucgc

SEQ ID NO: 1089639 - RNA, 19 nt, Mycobacterium bovis subsp bovis AF2122/97
gagccgacaacgacgucgc

SEQ ID NO: 1089640 - RNA, 18 nt, Mycobacterium bovis subsp bovis AF2122/97
gagcccgaaccaccgcgu

SEQ ID NO: 1089641 - RNA, 22 nt, Mycobacterium bovis subsp bovis AF2122/97
gagcccgaugguggugccgacc

SEQ ID NO: 1089642 - RNA, 12 nt, Mycobacterium bovis subsp bovis AF2122/97
gagcccgccgcg

SEQ ID NO: 1089643 - RNA, 13 nt, Mycobacterium bovis subsp bovis AF2122/97
gagcccgccgcga

SEQ ID NO: 1089644 - RNA, 13 nt, Mycobacterium bovis subsp bovis AF2122/97
gagcccagguggu

SEQ ID NO: 1089645 - RNA, 13 nt, Mycobacterium bovis subsp bovis AF2122/97
gagccccagcgac

SEQ ID NO: 1089646 - RNA, 15 nt, Mycobacterium bovis subsp bovis AF2122/97
gagccagcacccgca

SEQ ID NO: 1089647 - RNA, 23 nt, Mycobacterium bovis subsp bovis AF2122/97
gagccacggcacuggguccacgc

SEQ ID NO: 1089648 - RNA, 14 nt, Mycobacterium bovis subsp bovis AF2122/97
gagccagcggagca

SEQ ID NO: 1089649 - RNA, 15 nt, Mycobacterium bovis subsp bovis AF2122/97
gagccagcggcacug

SEQ ID NO: 1089650 - RNA, 20 nt, Mycobacterium bovis subsp bovis AF2122/97
gagcccaccuggggccgcac

SEQ ID NO: 1089651 - RNA, 13 nt, Mycobacterium bovis subsp bovis AF2122/97
gagcccagcgccu

SEQ ID NO: 1089652 - RNA, 19 nt, Mycobacterium bovis subsp bovis AF2122/97
gagccagcuucccgcuggu

SEQ ID NO: 1089653 - RNA, 16 nt, Mycobacterium bovis subsp bovis AF2122/97
gagccaugccgcucgg

SEQ ID NO: 1089654 - RNA, 20 nt, Mycobacterium bovis subsp bovis AF2122/97
gagcaggcuggcguugggcg

SEQ ID NO: 1089655 - RNA, 17 nt, Mycobacterium bovis subsp bovis AF2122/97
gagcagggccggcaccg

SEQ ID NO: 1089656 - RNA, 21 nt, Mycobacterium bovis subsp bovis AF2122/97
gagcagggccggcaccgcagc

SEQ ID NO: 1089657 - RNA, 11 nt, Mycobacterium bovis subsp bovis AF2122/97
gagcagggcgg

SEQ ID NO: 1089658 - RNA, 15 nt, Mycobacterium bovis subsp bovis AF2122/97
gagcagguaggcgcg

SEQ ID NO: 1089659 - RNA, 16 nt, Mycobacterium bovis subsp bovis AF2122/97
gagcagguuccgcacg

SEQ ID NO: 1089660 - RNA, 22 nt, Mycobacterium bovis subsp bovis AF2122/97
gagcagguuccgcacgaucggg

SEQ ID NO: 1089661 - RNA, 18 nt, Mycobacterium bovis subsp bovis AF2122/97
gagcagucgcaaaagccc

SEQ ID NO: 1089662 - RNA, 21 nt, Mycobacterium bovis subsp bovis AF2122/97
gagcagucgcaaaagccccca

SEQ ID NO: 1089663 - RNA, 21 nt, Mycobacterium bovis subsp bovis AF2122/97
gagcaguucucggucccgccg

SEQ ID NO: 1089664 - RNA, 22 nt, Mycobacterium bovis subsp bovis AF2122/97
gagcaguucucggucccgccgg

SEQ ID NO: 1089665 - RNA, 16 nt, Mycobacterium bovis subsp bovis AF2122/97
gagcagugccgugcgg

SEQ ID NO: 1089666 - RNA, 15 nt, Mycobacterium bovis subsp bovis AF2122/97
gagcaguggccgccg

SEQ ID NO: 1089667 - RNA, 18 nt, Mycobacterium bovis subsp bovis AF2122/97
gagcaguuccagcucgcg

SEQ ID NO: 1089668 - RNA, 14 nt, Mycobacterium bovis subsp bovis AF2122/97
gagcauaccgccgc

SEQ ID NO: 1089669 - RNA, 16 nt, Mycobacterium bovis subsp bovis AF2122/97
gagcagcacgucgaac

SEQ ID NO: 1089670 - RNA, 20 nt, Mycobacterium bovis subsp bovis AF2122/97
gagcagcacgucgaacucgu

SEQ ID NO: 1089671 - RNA, 20 nt, Mycobacterium bovis subsp bovis AF2122/97
gagcagcagaaacggcgacu

SEQ ID NO: 1089672 - RNA, 16 nt, Mycobacterium bovis subsp bovis AF2122/97
gagcagaucagcacgu

SEQ ID NO: 1089673 - RNA, 23 nt, Mycobacterium bovis subsp bovis AF2122/97
gagcagcaauccaaggcucagca

SEQ ID NO: 1089674 - RNA, 15 nt, Mycobacterium bovis subsp bovis AF2122/97
gagcagccgaaccgg

SEQ ID NO: 1089675 - RNA, 18 nt, Mycobacterium bovis subsp bovis AF2122/97
gagcagccgaaccggcac

SEQ ID NO: 1089676 - RNA, 12 nt, Mycobacterium bovis subsp bovis AF2122/97
gagcagcagcgg

SEQ ID NO: 1089677 - RNA, 16 nt, Mycobacterium bovis subsp bovis AF2122/97
gagcagccagccaccg

SEQ ID NO: 1089678 - RNA, 14 nt, Mycobacterium bovis subsp bovis AF2122/97
gagcagcuggacca

SEQ ID NO: 1089679 - RNA, 20 nt, Mycobacterium bovis subsp bovis AF2122/97
gagcagcucggugacaagcg

SEQ ID NO: 1089680 - RNA, 15 nt, Mycobacterium bovis subsp bovis AF2122/97
gagcagcgcggccag

SEQ ID NO: 1089681 - RNA, 19 nt, Mycobacterium bovis subsp bovis AF2122/97
gagcagcgcggccagagcc

SEQ ID NO: 1089682 - RNA, 23 nt, Mycobacterium bovis subsp bovis AF2122/97
gagcagccgaaccggcaccagcg

SEQ ID NO: 1089683 - RNA, 18 nt, Mycobacterium bovis subsp bovis AF2122/97
gagcagcuagcccggcag

SEQ ID NO: 1089684 - RNA, 13 nt, Mycobacterium bovis subsp bovis AF2122/97
gagcaucuggggu

SEQ ID NO: 1089685 - RNA, 20 nt, Mycobacterium bovis subsp bovis AF2122/97
aacucgaggucgagcgccgc

SEQ ID NO: 1089686 - RNA, 11 nt, Mycobacterium bovis subsp bovis AF2122/97
aacuccgcgau

SEQ ID NO: 1089687 - RNA, 18 nt, Mycobacterium bovis subsp bovis AF2122/97
aacuccuuaucgucgacg

SEQ ID NO: 1089688 - RNA, 19 nt, Mycobacterium bovis subsp bovis AF2122/97
aacucccagaacgccgucc

SEQ ID NO: 1089689 - RNA, 13 nt, Mycobacterium bovis subsp bovis AF2122/97
aacuccgcggcgc

SEQ ID NO: 1089690 - RNA, 14 nt, Mycobacterium bovis subsp bovis AF2122/97
aacuccgcggcgcg

SEQ ID NO: 1089691 - RNA, 20 nt, Mycobacterium bovis subsp bovis AF2122/97
gagccaacuccacccaacgc

SEQ ID NO: 1089692 - RNA, 18 nt, Mycobacterium bovis subsp bovis AF2122/97
gagccacggcuucgccgc

SEQ ID NO: 1089693 - RNA, 19 nt, Mycobacterium bovis subsp bovis AF2122/97
gagccacggcuucgccgcg

SEQ ID NO: 1089694 - RNA, 20 nt, Mycobacterium bovis subsp bovis AF2122/97
gagccacggcuucgccgcgg

SEQ ID NO: 1089695 - RNA, 14 nt, Mycobacterium bovis subsp bovis AF2122/97
gagccacguucgcg

SEQ ID NO: 1089696 - RNA, 15 nt, Mycobacterium bovis subsp bovis AF2122/97
gagccacguucgcgg

SEQ ID NO: 1089697 - RNA, 20 nt, Mycobacterium bovis subsp bovis AF2122/97
gagccacugcggcauggcag

SEQ ID NO: 1089698 - RNA, 17 nt, Mycobacterium bovis subsp bovis AF2122/97
gagccaaaggcggcuug

SEQ ID NO: 1089699 - RNA, 15 nt, Mycobacterium bovis subsp bovis AF2122/97
gagccaacgcgcaga

SEQ ID NO: 1089700 - RNA, 14 nt, Mycobacterium bovis subsp bovis AF2122/97
gagccaccaccgcc

SEQ ID NO: 1089701 - RNA, 16 nt, Mycobacterium bovis subsp bovis AF2122/97
gagccaccaccgccga

SEQ ID NO: 1089702 - RNA, 18 nt, Mycobacterium bovis subsp bovis AF2122/97
gagccaccaccgccgacc

SEQ ID NO: 1089703 - RNA, 18 nt, Mycobacterium bovis subsp bovis AF2122/97
gagccaccggcgucgacg

SEQ ID NO: 1089704 - RNA, 19 nt, Mycobacterium bovis subsp bovis AF2122/97
gagcauggcuagggcgaug

SEQ ID NO: 1089705 - RNA, 14 nt, Mycobacterium bovis subsp bovis AF2122/97
gagcaugcccagcg

SEQ ID NO: 1089706 - RNA, 18 nt, Mycobacterium bovis subsp bovis AF2122/97
gagcaugccgcccgcgcc

SEQ ID NO: 1089707 - RNA, 23 nt, Mycobacterium bovis subsp bovis AF2122/97
gagcaugccgcccgcgccgccgg

SEQ ID NO: 1089708 - RNA, 21 nt, Mycobacterium bovis subsp bovis AF2122/97
gagcaugcgauacacggcggc

SEQ ID NO: 1089709 - RNA, 15 nt, Mycobacterium bovis subsp bovis AF2122/97
gagcaucucgacauc

SEQ ID NO: 1089710 - RNA, 18 nt, Mycobacterium bovis subsp bovis AF2122/97
gagcaucucgacaucggc

SEQ ID NO: 1089711 - RNA, 19 nt, Mycobacterium bovis subsp bovis AF2122/97
gagcaucgauucgaugucc

SEQ ID NO: 1089712 - RNA, 12 nt, Mycobacterium bovis subsp bovis AF2122/97
gagcauccaccc

SEQ ID NO: 1089713 - RNA, 14 nt, Mycobacterium bovis subsp bovis AF2122/97
gagcauaugacguc

SEQ ID NO: 1089714 - RNA, 16 nt, Mycobacterium bovis subsp bovis AF2122/97
aacucaugggccaacu

SEQ ID NO: 1089715 - RNA, 22 nt, Mycobacterium bovis subsp bovis AF2122/97
aacucacccgagccaucaccgc

SEQ ID NO: 1089716 - RNA, 20 nt, Mycobacterium bovis subsp bovis AF2122/97
gacgaccacaccacgauggc

SEQ ID NO: 1089717 - RNA, 22 nt, Mycobacterium bovis subsp bovis AF2122/97
gacgaccaccuucugacgcggc

SEQ ID NO: 1089718 - RNA, 14 nt, Mycobacterium bovis subsp bovis AF2122/97
gacgaccacgucga

SEQ ID NO: 1089719 - RNA, 22 nt, Mycobacterium bovis subsp bovis AF2122/97
gacgaccagcagauccaggcgu

SEQ ID NO: 1089720 - RNA, 13 nt, Mycobacterium bovis subsp bovis AF2122/97
gacgacaccgcga

SEQ ID NO: 1089721 - RNA, 15 nt, Mycobacterium bovis subsp bovis AF2122/97
gacgacaucgguggc

SEQ ID NO: 1089722 - RNA, 19 nt, Mycobacterium bovis subsp bovis AF2122/97
gacgacacguugaccguga

SEQ ID NO: 1089723 - RNA, 20 nt, Mycobacterium bovis subsp bovis AF2122/97
gacgaccccggugagcucuu

SEQ ID NO: 1089724 - RNA, 12 nt, Mycobacterium bovis subsp bovis AF2122/97
gacgaccggcua

SEQ ID NO: 1089725 - RNA, 15 nt, Mycobacterium bovis subsp bovis AF2122/97
gacgaccgcgcggca

SEQ ID NO: 1089726 - RNA, 18 nt, Mycobacterium bovis subsp bovis AF2122/97
gacguagaaugcgccguc

SEQ ID NO: 1089727 - RNA, 20 nt, Mycobacterium bovis subsp bovis AF2122/97
gacguagaccacgccgguga

SEQ ID NO: 1089728 - RNA, 21 nt, Mycobacterium bovis subsp bovis AF2122/97
gacguagaccacgccggugac

SEQ ID NO: 1089729 - RNA, 17 nt, Mycobacterium bovis subsp bovis AF2122/97
gacguagacgacgucgg

SEQ ID NO: 1089730 - RNA, 21 nt, Mycobacterium bovis subsp bovis AF2122/97
gacguagaugguggucaccac

SEQ ID NO: 1089731 - RNA, 22 nt, Mycobacterium bovis subsp bovis AF2122/97
gacguagaugguggucaccacc

SEQ ID NO: 1089732 - RNA, 20 nt, Mycobacterium bovis subsp bovis AF2122/97
gacguagauguugccgcccg

SEQ ID NO: 1089733 - RNA, 20 nt, Mycobacterium bovis subsp bovis AF2122/97
gacguagauguugccgccug

SEQ ID NO: 1089734 - RNA, 18 nt, Mycobacterium bovis subsp bovis AF2122/97
gacgaccuccucgaugac

SEQ ID NO: 1089735 - RNA, 14 nt, Mycobacterium bovis subsp bovis AF2122/97
gacgaccgucggcu

SEQ ID NO: 1089736 - RNA, 17 nt, Mycobacterium bovis subsp bovis AF2122/97
gacgaccgugcugggcg

SEQ ID NO: 1089737 - RNA, 22 nt, Mycobacterium bovis subsp bovis AF2122/97
gacgaccgucacaagucgacac

SEQ ID NO: 1089738 - RNA, 16 nt, Mycobacterium bovis subsp bovis AF2122/97
gacguaggcggcggcc

SEQ ID NO: 1089739 - RNA, 18 nt, Mycobacterium bovis subsp bovis AF2122/97
gacguagggcagcgccag

SEQ ID NO: 1089740 - RNA, 17 nt, Mycobacterium bovis subsp bovis AF2122/97
gacguaggacugccagc

SEQ ID NO: 1089741 - RNA, 18 nt, Mycobacterium bovis subsp bovis AF2122/97
gacguaggacugccagcg

SEQ ID NO: 1089742 - RNA, 15 nt, Mycobacterium bovis subsp bovis AF2122/97
gacguaccacggcga

SEQ ID NO: 1089743 - RNA, 21 nt, Mycobacterium bovis subsp bovis AF2122/97
gacguaguugccggcuucggc

SEQ ID NO: 1089744 - RNA, 20 nt, Mycobacterium bovis subsp bovis AF2122/97
gacguccagggccacgaucu

SEQ ID NO: 1089745 - RNA, 19 nt, Mycobacterium bovis subsp bovis AF2122/97
gacguacggggucgccggc

SEQ ID NO: 1089746 - RNA, 19 nt, Mycobacterium bovis subsp bovis AF2122/97
gacgucacguucggcgcaa

SEQ ID NO: 1089747 - RNA, 14 nt, Mycobacterium bovis subsp bovis AF2122/97
gacguccucgacga

SEQ ID NO: 1089748 - RNA, 16 nt, Mycobacterium bovis subsp bovis AF2122/97
gacgugaucgcggucc

SEQ ID NO: 1089749 - RNA, 19 nt, Mycobacterium bovis subsp bovis AF2122/97
gacgugaguuucaccacuc

SEQ ID NO: 1089750 - RNA, 23 nt, Mycobacterium bovis subsp bovis AF2122/97
gacgugacgucguggcgcucggc

SEQ ID NO: 1089751 - RNA, 23 nt, Mycobacterium bovis subsp bovis AF2122/97
gacgugaaugguggugucggcga

SEQ ID NO: 1089752 - RNA, 18 nt, Mycobacterium bovis subsp bovis AF2122/97
gacgugacaacugcgccg

SEQ ID NO: 1089753 - RNA, 22 nt, Mycobacterium bovis subsp bovis AF2122/97
gacgugacaacugcgccggugc

SEQ ID NO: 1089754 - RNA, 23 nt, Mycobacterium bovis subsp bovis AF2122/97
gacgugacaacugcgccggugcc

SEQ ID NO: 1089755 - RNA, 13 nt, Mycobacterium bovis subsp bovis AF2122/97
gacgugaccagcu

SEQ ID NO: 1089756 - RNA, 18 nt, Mycobacterium bovis subsp bovis AF2122/97
gacgugaccagcuucggc

SEQ ID NO: 1089757 - RNA, 23 nt, Mycobacterium bovis subsp bovis AF2122/97
gacgugaccagcuucggcuggcg

SEQ ID NO: 1089758 - RNA, 20 nt, Mycobacterium bovis subsp bovis AF2122/97
gacgucucgcaugcucacga

SEQ ID NO: 1089759 - RNA, 22 nt, Mycobacterium bovis subsp bovis AF2122/97
gacgucuucgggcucguccagc

SEQ ID NO: 1089760 - RNA, 23 nt, Mycobacterium bovis subsp bovis AF2122/97
gacgucuucgggcucguccagca

SEQ ID NO: 1089761 - RNA, 17 nt, Mycobacterium bovis subsp bovis AF2122/97
gacgucguugccgucca

SEQ ID NO: 1089762 - RNA, 19 nt, Mycobacterium bovis subsp bovis AF2122/97
gacgucguugccguccacc

SEQ ID NO: 1089763 - RNA, 13 nt, Mycobacterium bovis subsp bovis AF2122/97
gacgucggcgagc

SEQ ID NO: 1089764 - RNA, 22 nt, Mycobacterium bovis subsp bovis AF2122/97
gacgucggcgagcucggccccg

SEQ ID NO: 1089765 - RNA, 13 nt, Mycobacterium bovis subsp bovis AF2122/97
gacgucggcggcc

SEQ ID NO: 1089766 - RNA, 13 nt, Mycobacterium bovis subsp bovis AF2122/97
gacgucggugaaa

SEQ ID NO: 1089767 - RNA, 23 nt, Mycobacterium bovis subsp bovis AF2122/97
gacgucgguaagcgccaaggcga

SEQ ID NO: 1089768 - RNA, 23 nt, Mycobacterium bovis subsp bovis AF2122/97
gacgucguuacuggagauaccga

SEQ ID NO: 1089769 - RNA, 22 nt, Mycobacterium bovis subsp bovis AF2122/97
gacgucguucuuugucgggauc

SEQ ID NO: 1089770 - RNA, 22 nt, Mycobacterium bovis subsp bovis AF2122/97
gacgucggcguggucgcgcggc

SEQ ID NO: 1089771 - RNA, 22 nt, Mycobacterium bovis subsp bovis AF2122/97
gacgucguggcgcucggcgagc

SEQ ID NO: 1089772 - RNA, 23 nt, Mycobacterium bovis subsp bovis AF2122/97
gacgucgucgaauccugccgcac

SEQ ID NO: 1089773 - RNA, 23 nt, Mycobacterium bovis subsp bovis AF2122/97
gacgucguagacaccuucgacgu

SEQ ID NO: 1089774 - RNA, 13 nt, Mycobacterium bovis subsp bovis AF2122/97
gacgucgccgccg

SEQ ID NO: 1089775 - RNA, 14 nt, Mycobacterium bovis subsp bovis AF2122/97
gacgucgccgccgc

SEQ ID NO: 1089776 - RNA, 19 nt, Mycobacterium bovis subsp bovis AF2122/97
gacgucgacgccggccagc

SEQ ID NO: 1089777 - RNA, 22 nt, Mycobacterium bovis subsp bovis AF2122/97
gacgucgauuucggcgaccggc

SEQ ID NO: 1089778 - RNA, 21 nt, Mycobacterium bovis subsp bovis AF2122/97
gacgucgcggaguagccgcag

SEQ ID NO: 1089779 - RNA, 20 nt, Mycobacterium bovis subsp bovis AF2122/97
gacgucggaccagcugccgg

SEQ ID NO: 1089780 - RNA, 23 nt, Mycobacterium bovis subsp bovis AF2122/97
gacgucggaccagcugccggcga

SEQ ID NO: 1089781 - RNA, 15 nt, Mycobacterium bovis subsp bovis AF2122/97
gacgucgaccguguc

SEQ ID NO: 1089782 - RNA, 20 nt, Mycobacterium bovis subsp bovis AF2122/97
gacgucgacggcgauggcgc

SEQ ID NO: 1089783 - RNA, 16 nt, Mycobacterium bovis subsp bovis AF2122/97
gacguccucgacgauc

SEQ ID NO: 1089784 - RNA, 19 nt, Mycobacterium bovis subsp bovis AF2122/97
gacgucgacaacgaucgcg

SEQ ID NO: 1089785 - RNA, 20 nt, Mycobacterium bovis subsp bovis AF2122/97
gacgucgacaacgaucgcgc

SEQ ID NO: 1089786 - RNA, 23 nt, Mycobacterium bovis subsp bovis AF2122/97
gacgucgacaaucaguagcagcg

SEQ ID NO: 1089787 - RNA, 14 nt, Mycobacterium bovis subsp bovis AF2122/97
gacguccuucgcug

SEQ ID NO: 1089788 - RNA, 15 nt, Mycobacterium bovis subsp bovis AF2122/97
gacguugaagccgcc

SEQ ID NO: 1089789 - RNA, 17 nt, Mycobacterium bovis subsp bovis AF2122/97
gacguugaagccgccgg

SEQ ID NO: 1089790 - RNA, 14 nt, Mycobacterium bovis subsp bovis AF2122/97
gacguugcagccgg

SEQ ID NO: 1089791 - RNA, 12 nt, Mycobacterium bovis subsp bovis AF2122/97
gacguugccaac

SEQ ID NO: 1089792 - RNA, 17 nt, Mycobacterium bovis subsp bovis AF2122/97
gacguugccgggcuugu

SEQ ID NO: 1089793 - RNA, 15 nt, Mycobacterium bovis subsp bovis AF2122/97
gacguugccucgcga

SEQ ID NO: 1089794 - RNA, 21 nt, Mycobacterium bovis subsp bovis AF2122/97
gacguugguugcguccgccga

SEQ ID NO: 1089795 - RNA, 22 nt, Mycobacterium bovis subsp bovis AF2122/97
gacguuguccaccgccaccacg

SEQ ID NO: 1089796 - RNA, 23 nt, Mycobacterium bovis subsp bovis AF2122/97
gacguuguccaccgccaccacgg

SEQ ID NO: 1089797 - RNA, 14 nt, Mycobacterium bovis subsp bovis AF2122/97
gacguuggcgcggu

SEQ ID NO: 1089798 - RNA, 20 nt, Mycobacterium bovis subsp bovis AF2122/97
gacguuggcgugcaccgcau

SEQ ID NO: 1089799 - RNA, 16 nt, Mycobacterium bovis subsp bovis AF2122/97
gacguucgacgacagc

SEQ ID NO: 1089800 - RNA, 21 nt, Mycobacterium bovis subsp bovis AF2122/97
gacguuaucgguucgcucggg

SEQ ID NO: 1089801 - RNA, 23 nt, Mycobacterium bovis subsp bovis AF2122/97
gacguuccagcaguacaccgccc

SEQ ID NO: 1089802 - RNA, 20 nt, Mycobacterium bovis subsp bovis AF2122/97
gacgugguagccggcgacac

SEQ ID NO: 1089803 - RNA, 23 nt, Mycobacterium bovis subsp bovis AF2122/97
gacgugguguaucgacggcggcc

SEQ ID NO: 1089804 - RNA, 19 nt, Mycobacterium bovis subsp bovis AF2122/97
gacguuaucgguucgcucg

SEQ ID NO: 1089805 - RNA, 22 nt, Mycobacterium bovis subsp bovis AF2122/97
gacgugguguaucgacggcggc

SEQ ID NO: 1089806 - RNA, 16 nt, Mycobacterium bovis subsp bovis AF2122/97
gacgugggcgcuggug

SEQ ID NO: 1089807 - RNA, 23 nt, Mycobacterium bovis subsp bovis AF2122/97
gacgugggcgcuggugcgcccau

SEQ ID NO: 1089808 - RNA, 16 nt, Mycobacterium bovis subsp bovis AF2122/97
gacguggccagcccgc

SEQ ID NO: 1089809 - RNA, 21 nt, Mycobacterium bovis subsp bovis AF2122/97
gacguggcugcguucgccgga

SEQ ID NO: 1089810 - RNA, 17 nt, Mycobacterium bovis subsp bovis AF2122/97
gacguggcugcguucgc

SEQ ID NO: 1089811 - RNA, 17 nt, Mycobacterium bovis subsp bovis AF2122/97
gacgucuuugacgaacu

SEQ ID NO: 1089812 - RNA, 12 nt, Mycobacterium bovis subsp bovis AF2122/97
gacgugcagccg

SEQ ID NO: 1089813 - RNA, 18 nt, Mycobacterium bovis subsp bovis AF2122/97
gacgugcagccgcaggug

SEQ ID NO: 1089814 - RNA, 12 nt, Mycobacterium bovis subsp bovis AF2122/97
gacgugccgggu

SEQ ID NO: 1089815 - RNA, 12 nt, Mycobacterium bovis subsp bovis AF2122/97
gacgugcgcggc

SEQ ID NO: 1089816 - RNA, 13 nt, Mycobacterium bovis subsp bovis AF2122/97
gacgugcgcggca

SEQ ID NO: 1089817 - RNA, 14 nt, Mycobacterium bovis subsp bovis AF2122/97
gacgugcgcggcau

SEQ ID NO: 1089818 - RNA, 14 nt, Mycobacterium bovis subsp bovis AF2122/97
gacgugcgcgccaa

SEQ ID NO: 1089819 - RNA, 17 nt, Mycobacterium bovis subsp bovis AF2122/97
gacgugcggcgcggcga

SEQ ID NO: 1089820 - RNA, 15 nt, Mycobacterium bovis subsp bovis AF2122/97
gacuaccgccggcgg

SEQ ID NO: 1089821 - RNA, 16 nt, Mycobacterium bovis subsp bovis AF2122/97
gacuaccgccggcggc

SEQ ID NO: 1089822 - RNA, 22 nt, Mycobacterium bovis subsp bovis AF2122/97
gacuaccgccggcggcggccgc

SEQ ID NO: 1089823 - RNA, 16 nt, Mycobacterium bovis subsp bovis AF2122/97
gacuagacgccgccgc

SEQ ID NO: 1089824 - RNA, 20 nt, Mycobacterium bovis subsp bovis AF2122/97
gacuaguccgagggcgucgc

SEQ ID NO: 1089825 - RNA, 16 nt, Mycobacterium bovis subsp bovis AF2122/97
gacuacggccucgcug

SEQ ID NO: 1089826 - RNA, 15 nt, Mycobacterium bovis subsp bovis AF2122/97
gacuaucggccgccg

SEQ ID NO: 1089827 - RNA, 18 nt, Mycobacterium bovis subsp bovis AF2122/97
gacuaucggccgccggau

SEQ ID NO: 1089828 - RNA, 23 nt, Mycobacterium bovis subsp bovis AF2122/97
gacuaucggccgccggaucagga

SEQ ID NO: 1089829 - RNA, 14 nt, Mycobacterium bovis subsp bovis AF2122/97
gacuaccacccgca

SEQ ID NO: 1089830 - RNA, 16 nt, Mycobacterium bovis subsp bovis AF2122/97
gacuaccacccgcagg

SEQ ID NO: 1089831 - RNA, 23 nt, Mycobacterium bovis subsp bovis AF2122/97
gacuaaccacuguuucugagcgc

SEQ ID NO: 1089832 - RNA, 14 nt, Mycobacterium bovis subsp bovis AF2122/97
gacguuucagccgg

SEQ ID NO: 1089833 - RNA, 23 nt, Mycobacterium bovis subsp bovis AF2122/97
gacuccggcuggaagcggcgacu

SEQ ID NO: 1089834 - RNA, 22 nt, Mycobacterium bovis subsp bovis AF2122/97
gacuccggucagcgcggcgacc

SEQ ID NO: 1089835 - RNA, 20 nt, Mycobacterium bovis subsp bovis AF2122/97
gacuccguugccaccuuggu

SEQ ID NO: 1089836 - RNA, 14 nt, Mycobacterium bovis subsp bovis AF2122/97
gacuccgcgcgcug

SEQ ID NO: 1089837 - RNA, 18 nt, Mycobacterium bovis subsp bovis AF2122/97
gacuccggccgcacgccg

SEQ ID NO: 1089838 - RNA, 20 nt, Mycobacterium bovis subsp bovis AF2122/97
gacuccggccgcacgccgac

SEQ ID NO: 1089839 - RNA, 22 nt, Mycobacterium bovis subsp bovis AF2122/97
gacuccggccggccuagccgau

SEQ ID NO: 1089840 - RNA, 20 nt, Mycobacterium bovis subsp bovis AF2122/97
gacucccucgaucacggcgg

SEQ ID NO: 1089841 - RNA, 21 nt, Mycobacterium bovis subsp bovis AF2122/97
gacucccucgaucacggcggc

SEQ ID NO: 1089842 - RNA, 22 nt, Mycobacterium bovis subsp bovis AF2122/97
gacuccgaucgggcccaccgcu

SEQ ID NO: 1089843 - RNA, 19 nt, Mycobacterium bovis subsp bovis AF2122/97
gacuccagcaccagcacgg

SEQ ID NO: 1089844 - RNA, 20 nt, Mycobacterium bovis subsp bovis AF2122/97
gacuccaaagccgugccagc

SEQ ID NO: 1089845 - RNA, 22 nt, Mycobacterium bovis subsp bovis AF2122/97
gacucccaaaugucguaggccg

SEQ ID NO: 1089846 - RNA, 13 nt, Mycobacterium bovis subsp bovis AF2122/97
gacucaucggccg

SEQ ID NO: 1089847 - RNA, 14 nt, Mycobacterium bovis subsp bovis AF2122/97
gacucaucggccgc

SEQ ID NO: 1089848 - RNA, 21 nt, Mycobacterium bovis subsp bovis AF2122/97
gacucaucggccgcggucggc

SEQ ID NO: 1089849 - RNA, 16 nt, Mycobacterium bovis subsp bovis AF2122/97
gacuccagcaccagca

SEQ ID NO: 1089850 - RNA, 17 nt, Mycobacterium bovis subsp bovis AF2122/97
gacucaucccgagauca

SEQ ID NO: 1089851 - RNA, 17 nt, Mycobacterium bovis subsp bovis AF2122/97
gacucagcccggcacug

SEQ ID NO: 1089852 - RNA, 18 nt, Mycobacterium bovis subsp bovis AF2122/97
gacucacccacccgcacc

SEQ ID NO: 1089853 - RNA, 13 nt, Mycobacterium bovis subsp bovis AF2122/97
gacuccugcggca

SEQ ID NO: 1089854 - RNA, 20 nt, Mycobacterium bovis subsp bovis AF2122/97
gacucgaccgcgacggcaaa

SEQ ID NO: 1089855 - RNA, 17 nt, Mycobacterium bovis subsp bovis AF2122/97
gacuccugcggcaccgc

SEQ ID NO: 1089856 - RNA, 20 nt, Mycobacterium bovis subsp bovis AF2122/97
gacuccugcggcaccgcuga

SEQ ID NO: 1089857 - RNA, 19 nt, Mycobacterium bovis subsp bovis AF2122/97
gacuccugugcggagccgc

SEQ ID NO: 1089858 - RNA, 21 nt, Mycobacterium bovis subsp bovis AF2122/97
gacuccugugcggagccgcca

SEQ ID NO: 1089859 - RNA, 14 nt, Mycobacterium bovis subsp bovis AF2122/97
gacucgagagcgau

SEQ ID NO: 1089860 - RNA, 22 nt, Mycobacterium bovis subsp bovis AF2122/97
gacucgagagggaucacgccac

SEQ ID NO: 1089861 - RNA, 18 nt, Mycobacterium bovis subsp bovis AF2122/97
gacucgaggaccugcucg

SEQ ID NO: 1089862 - RNA, 13 nt, Mycobacterium bovis subsp bovis AF2122/97
gacucgccaccgc

SEQ ID NO: 1089863 - RNA, 14 nt, Mycobacterium bovis subsp bovis AF2122/97
gacucgccaccgcg

SEQ ID NO: 1089864 - RNA, 18 nt, Mycobacterium bovis subsp bovis AF2122/97
gacucgccaccgcggcga

SEQ ID NO: 1089865 - RNA, 16 nt, Mycobacterium bovis subsp bovis AF2122/97
gacucguggcgccacg

SEQ ID NO: 1089866 - RNA, 17 nt, Mycobacterium bovis subsp bovis AF2122/97
gacucguggcgccacgg

SEQ ID NO: 1089867 - RNA, 22 nt, Mycobacterium bovis subsp bovis AF2122/97
gacucguggcgccacggcagcg

SEQ ID NO: 1089868 - RNA, 14 nt, Mycobacterium bovis subsp bovis AF2122/97
gacucgucgaugcg

SEQ ID NO: 1089869 - RNA, 18 nt, Mycobacterium bovis subsp bovis AF2122/97
gacucggaauucggcguc

SEQ ID NO: 1089870 - RNA, 16 nt, Mycobacterium bovis subsp bovis AF2122/97
gacucggcaccgcggc

SEQ ID NO: 1089871 - RNA, 12 nt, Mycobacterium bovis subsp bovis AF2122/97
gacucggcaccu

SEQ ID NO: 1089872 - RNA, 14 nt, Mycobacterium bovis subsp bovis AF2122/97
gacucggcggucuu

SEQ ID NO: 1089873 - RNA, 23 nt, Mycobacterium bovis subsp bovis AF2122/97
gacucggcggucuuggcgcgccc

SEQ ID NO: 1089874 - RNA, 23 nt, Mycobacterium bovis subsp bovis AF2122/97
gacucgggcaggccccacuggug

SEQ ID NO: 1089875 - RNA, 20 nt, Mycobacterium bovis subsp bovis AF2122/97
gacucgauauaacccggcuc

SEQ ID NO: 1089876 - RNA, 15 nt, Mycobacterium bovis subsp bovis AF2122/97
gacucggccgcacca

SEQ ID NO: 1089877 - RNA, 21 nt, Mycobacterium bovis subsp bovis AF2122/97
gacucggccgugaccgagccg

SEQ ID NO: 1089878 - RNA, 19 nt, Mycobacterium bovis subsp bovis AF2122/97
gacucgcgguggccgaaca

SEQ ID NO: 1089879 - RNA, 17 nt, Mycobacterium bovis subsp bovis AF2122/97
gacucgcuccgaccggu

SEQ ID NO: 1089880 - RNA, 15 nt, Mycobacterium bovis subsp bovis AF2122/97
gacucugcguccacc

SEQ ID NO: 1089881 - RNA, 18 nt, Mycobacterium bovis subsp bovis AF2122/97
gacucugcgucugcucac

SEQ ID NO: 1089882 - RNA, 21 nt, Mycobacterium bovis subsp bovis AF2122/97
gacugaacaguugcacaccgg

SEQ ID NO: 1089883 - RNA, 18 nt, Mycobacterium bovis subsp bovis AF2122/97
gacucuucggaccggcuc

SEQ ID NO: 1089884 - RNA, 17 nt, Mycobacterium bovis subsp bovis AF2122/97
gacugaccgucugcgac

SEQ ID NO: 1089885 - RNA, 14 nt, Mycobacterium bovis subsp bovis AF2122/97
gacugaaucgaccg

SEQ ID NO: 1089886 - RNA, 16 nt, Mycobacterium bovis subsp bovis AF2122/97
gacugacaacggccac

SEQ ID NO: 1089887 - RNA, 17 nt, Mycobacterium bovis subsp bovis AF2122/97
gacugcagcgcggccgg

SEQ ID NO: 1089888 - RNA, 20 nt, Mycobacterium bovis subsp bovis AF2122/97
gacugcagaaacagccgcag

SEQ ID NO: 1089889 - RNA, 15 nt, Mycobacterium bovis subsp bovis AF2122/97
gacugaucgccaccc

SEQ ID NO: 1089890 - RNA, 18 nt, Mycobacterium bovis subsp bovis AF2122/97
gacugauccucgaugaca

SEQ ID NO: 1089891 - RNA, 14 nt, Mycobacterium bovis subsp bovis AF2122/97
gacugacgucgaag

SEQ ID NO: 1089892 - RNA, 14 nt, Mycobacterium bovis subsp bovis AF2122/97
gacugcgccaccgg

SEQ ID NO: 1089893 - RNA, 22 nt, Mycobacterium bovis subsp bovis AF2122/97
gacugcgcccauagcugccggc

SEQ ID NO: 1089894 - RNA, 12 nt, Mycobacterium bovis subsp bovis AF2122/97
gacugccgccgc

SEQ ID NO: 1089895 - RNA, 17 nt, Mycobacterium bovis subsp bovis AF2122/97
gacugccguucagcggc

SEQ ID NO: 1089896 - RNA, 20 nt, Mycobacterium bovis subsp bovis AF2122/97
gacugccguucagcggcggg

SEQ ID NO: 1089897 - RNA, 15 nt, Mycobacterium bovis subsp bovis AF2122/97
gacugcagcgcggug

SEQ ID NO: 1089898 - RNA, 15 nt, Mycobacterium bovis subsp bovis AF2122/97
gacugcagcggcgca

SEQ ID NO: 1089899 - RNA, 21 nt, Mycobacterium bovis subsp bovis AF2122/97
gacugcaguaguagcgcaacc

SEQ ID NO: 1089900 - RNA, 15 nt, Mycobacterium bovis subsp bovis AF2122/97
gacugcccgauggcu

SEQ ID NO: 1089901 - RNA, 15 nt, Mycobacterium bovis subsp bovis AF2122/97
gacuggaaggcgggc

SEQ ID NO: 1089902 - RNA, 16 nt, Mycobacterium bovis subsp bovis AF2122/97
gacuggaaggcgggca

SEQ ID NO: 1089903 - RNA, 15 nt, Mycobacterium bovis subsp bovis AF2122/97
gacuggaccgcggug

SEQ ID NO: 1089904 - RNA, 16 nt, Mycobacterium bovis subsp bovis AF2122/97
gacugcgucggcggcu

SEQ ID NO: 1089905 - RNA, 12 nt, Mycobacterium bovis subsp bovis AF2122/97
gacugcgcggca

SEQ ID NO: 1089906 - RNA, 14 nt, Mycobacterium bovis subsp bovis AF2122/97
gacugcgcggcacu

SEQ ID NO: 1089907 - RNA, 19 nt, Mycobacterium bovis subsp bovis AF2122/97
gacugcggcccgacccggc

SEQ ID NO: 1089908 - RNA, 17 nt, Mycobacterium bovis subsp bovis AF2122/97
gacugcguuccgaucgg

SEQ ID NO: 1089909 - RNA, 19 nt, Mycobacterium bovis subsp bovis AF2122/97
gacugcgaccgguucggcg

SEQ ID NO: 1089910 - RNA, 18 nt, Mycobacterium bovis subsp bovis AF2122/97
gacugcgaaaauccgugc

SEQ ID NO: 1089911 - RNA, 14 nt, Mycobacterium bovis subsp bovis AF2122/97
gacugcgccgccgg

SEQ ID NO: 1089912 - RNA, 17 nt, Mycobacterium bovis subsp bovis AF2122/97
gacugcgccgccggcgc

SEQ ID NO: 1089913 - RNA, 16 nt, Mycobacterium bovis subsp bovis AF2122/97
gacugcggaagccacc

SEQ ID NO: 1089914 - RNA, 17 nt, Mycobacterium bovis subsp bovis AF2122/97
gacugcggaagccaccg

SEQ ID NO: 1089915 - RNA, 12 nt, Mycobacterium bovis subsp bovis AF2122/97
gacugguggcgc

SEQ ID NO: 1089916 - RNA, 17 nt, Mycobacterium bovis subsp bovis AF2122/97
gacuggggcgccaccac

SEQ ID NO: 1089917 - RNA, 14 nt, Mycobacterium bovis subsp bovis AF2122/97
gacugggacgacgc

SEQ ID NO: 1089918 - RNA, 16 nt, Mycobacterium bovis subsp bovis AF2122/97
gacugggcaaacccgg

SEQ ID NO: 1089919 - RNA, 17 nt, Mycobacterium bovis subsp bovis AF2122/97
gacugggcaaacccgga

SEQ ID NO: 1089920 - RNA, 12 nt, Mycobacterium bovis subsp bovis AF2122/97
gacuggccgccc

SEQ ID NO: 1089921 - RNA, 14 nt, Mycobacterium bovis subsp bovis AF2122/97
gacuggccgcccgg

SEQ ID NO: 1089922 - RNA, 19 nt, Mycobacterium bovis subsp bovis AF2122/97
gacuggccgcccggcgagc

SEQ ID NO: 1089923 - RNA, 15 nt, Mycobacterium bovis subsp bovis AF2122/97
gacugggcgcuggag

SEQ ID NO: 1089924 - RNA, 18 nt, Mycobacterium bovis subsp bovis AF2122/97
gacugggccaggucggcg

SEQ ID NO: 1089925 - RNA, 20 nt, Mycobacterium bovis subsp bovis AF2122/97
gacuggcauccgccccgccc

SEQ ID NO: 1089926 - RNA, 15 nt, Mycobacterium bovis subsp bovis AF2122/97
gacuggaucgcgaug

SEQ ID NO: 1089927 - RNA, 15 nt, Mycobacterium bovis subsp bovis AF2122/97
gacuggcaccgccag

SEQ ID NO: 1089928 - RNA, 18 nt, Mycobacterium bovis subsp bovis AF2122/97
gacuucgacgcggcgacc

SEQ ID NO: 1089929 - RNA, 17 nt, Mycobacterium bovis subsp bovis AF2122/97
gacuucgagauugccga

SEQ ID NO: 1089930 - RNA, 18 nt, Mycobacterium bovis subsp bovis AF2122/97
gacuucgggaacgcucgu

SEQ ID NO: 1089931 - RNA, 20 nt, Mycobacterium bovis subsp bovis AF2122/97
gacuucgggaacgcucgucg

SEQ ID NO: 1089932 - RNA, 19 nt, Mycobacterium bovis subsp bovis AF2122/97
gacuucgguguagcccagc

SEQ ID NO: 1089933 - RNA, 22 nt, Mycobacterium bovis subsp bovis AF2122/97
gacuucggaaaggucggccugc

SEQ ID NO: 1089934 - RNA, 22 nt, Mycobacterium bovis subsp bovis AF2122/97
gacuucgucaaccaccaggagc

SEQ ID NO: 1089935 - RNA, 16 nt, Mycobacterium bovis subsp bovis AF2122/97
gacuucccgcgcgagc

SEQ ID NO: 1089936 - RNA, 18 nt, Mycobacterium bovis subsp bovis AF2122/97
gacuucagcaggcccagc

SEQ ID NO: 1089937 - RNA, 13 nt, Mycobacterium bovis subsp bovis AF2122/97
gacuucagcggcc

SEQ ID NO: 1089938 - RNA, 21 nt, Mycobacterium bovis subsp bovis AF2122/97
gacuuggcaucgcgagccagc

SEQ ID NO: 1089939 - RNA, 16 nt, Mycobacterium bovis subsp bovis AF2122/97
gacuuggugauccgag

SEQ ID NO: 1089940 - RNA, 21 nt, Mycobacterium bovis subsp bovis AF2122/97
gacuugcugcuccuucucgcg

SEQ ID NO: 1089941 - RNA, 15 nt, Mycobacterium bovis subsp bovis AF2122/97
gacuugcuggcccgc

SEQ ID NO: 1089942 - RNA, 19 nt, Mycobacterium bovis subsp bovis AF2122/97
gacuugcgacccgucgaac

SEQ ID NO: 1089943 - RNA, 16 nt, Mycobacterium bovis subsp bovis AF2122/97
gacuuggcaucgcgag

SEQ ID NO: 1089944 - RNA, 14 nt, Mycobacterium bovis subsp bovis AF2122/97
gacuugauuucgau

SEQ ID NO: 1089945 - RNA, 15 nt, Mycobacterium bovis subsp bovis AF2122/97
gacuucuucgacgcg

SEQ ID NO: 1089946 - RNA, 23 nt, Mycobacterium bovis subsp bovis AF2122/97
gagaaaagcgcgcuacgcggccg

SEQ ID NO: 1089947 - RNA, 20 nt, Mycobacterium bovis subsp bovis AF2122/97
gagaacaacgggauccgcgc

SEQ ID NO: 1089948 - RNA, 20 nt, Mycobacterium bovis subsp bovis AF2122/97
gagaacacauccgcuugcgg

SEQ ID NO: 1089949 - RNA, 18 nt, Mycobacterium bovis subsp bovis AF2122/97
gacuuugggucggcgaug

SEQ ID NO: 1089950 - RNA, 18 nt, Mycobacterium bovis subsp bovis AF2122/97
gagaacacguucggcguc

SEQ ID NO: 1089951 - RNA, 19 nt, Mycobacterium bovis subsp bovis AF2122/97
gagaacgcccgcaggacgc

SEQ ID NO: 1089952 - RNA, 15 nt, Mycobacterium bovis subsp bovis AF2122/97
gagaagacaccgcgc

SEQ ID NO: 1089953 - RNA, 14 nt, Mycobacterium bovis subsp bovis AF2122/97
gagaacggcgggcg

SEQ ID NO: 1089954 - RNA, 17 nt, Mycobacterium bovis subsp bovis AF2122/97
gagaacuccgccaccau

SEQ ID NO: 1089955 - RNA, 19 nt, Mycobacterium bovis subsp bovis AF2122/97
gagaacuccgggaccaggc

SEQ ID NO: 1089956 - RNA, 19 nt, Mycobacterium bovis subsp bovis AF2122/97
aacguguugaccgggucgu

SEQ ID NO: 1089957 - RNA, 18 nt, Mycobacterium bovis subsp bovis AF2122/97
aacuacggcguccccgac

SEQ ID NO: 1089958 - RNA, 15 nt, Mycobacterium bovis subsp bovis AF2122/97
aacuacccgccagca

SEQ ID NO: 1089959 - RNA, 14 nt, Mycobacterium bovis subsp bovis AF2122/97
aacuacggugcccu

SEQ ID NO: 1089960 - RNA, 22 nt, Mycobacterium bovis subsp bovis AF2122/97
aacuacucauccagaagccggc

SEQ ID NO: 1089961 - RNA, 21 nt, Mycobacterium bovis subsp bovis AF2122/97
aacuacucccccgcgaaguug

SEQ ID NO: 1089962 - RNA, 18 nt, Mycobacterium bovis subsp bovis AF2122/97
gacuguggcgccgccggc

SEQ ID NO: 1089963 - RNA, 20 nt, Mycobacterium bovis subsp bovis AF2122/97
gacugugaaucucacgacgc

SEQ ID NO: 1089964 - RNA, 21 nt, Mycobacterium bovis subsp bovis AF2122/97
gacugugaaucugacgacgcg

SEQ ID NO: 1089965 - RNA, 22 nt, Mycobacterium bovis subsp bovis AF2122/97
gacugugaaucugacgacgcga

SEQ ID NO: 1089966 - RNA, 21 nt, Mycobacterium bovis subsp bovis AF2122/97
gacugucuggucggcuacggc

SEQ ID NO: 1089967 - RNA, 19 nt, Mycobacterium bovis subsp bovis AF2122/97
aacuacggcguccccgaca

SEQ ID NO: 1089968 - RNA, 20 nt, Mycobacterium bovis subsp bovis AF2122/97
aacuaucgcaccuccggcgu

SEQ ID NO: 1089969 - RNA, 13 nt, Mycobacterium bovis subsp bovis AF2122/97
gaggcgucggcaa

SEQ ID NO: 1089970 - RNA, 14 nt, Mycobacterium bovis subsp bovis AF2122/97
gaggcguccggcuc

SEQ ID NO: 1089971 - RNA, 20 nt, Mycobacterium bovis subsp bovis AF2122/97
gaggcggcgacgaccgucgg

SEQ ID NO: 1089972 - RNA, 20 nt, Mycobacterium bovis subsp bovis AF2122/97
gaggcggugacgaagccgac

SEQ ID NO: 1089973 - RNA, 15 nt, Mycobacterium bovis subsp bovis AF2122/97
gaggcgggucgccgc

SEQ ID NO: 1089974 - RNA, 22 nt, Mycobacterium bovis subsp bovis AF2122/97
gaggcgcucucguguaucgagc

SEQ ID NO: 1089975 - RNA, 19 nt, Mycobacterium bovis subsp bovis AF2122/97
gaggcgcccagcgacaaca

SEQ ID NO: 1089976 - RNA, 14 nt, Mycobacterium bovis subsp bovis AF2122/97
gaggcgcuggcccg

SEQ ID NO: 1089977 - RNA, 17 nt, Mycobacterium bovis subsp bovis AF2122/97
gaggcggcccccggcag

SEQ ID NO: 1089978 - RNA, 21 nt, Mycobacterium bovis subsp bovis AF2122/97
gaggcgcaagaaugccgccga

SEQ ID NO: 1089979 - RNA, 13 nt, Mycobacterium bovis subsp bovis AF2122/97
gaggcgagcggcc

SEQ ID NO: 1089980 - RNA, 13 nt, Mycobacterium bovis subsp bovis AF2122/97
gaggccgccgagg

SEQ ID NO: 1089981 - RNA, 17 nt, Mycobacterium bovis subsp bovis AF2122/97
gaggccgccaucgccgc

SEQ ID NO: 1089982 - RNA, 22 nt, Mycobacterium bovis subsp bovis AF2122/97
gaggccggcuaccgcgcucccg

SEQ ID NO: 1089983 - RNA, 16 nt, Mycobacterium bovis subsp bovis AF2122/97
gaggccuaccaggcgc

SEQ ID NO: 1089984 - RNA, 11 nt, Mycobacterium bovis subsp bovis AF2122/97
gaggccgguga

SEQ ID NO: 1089985 - RNA, 18 nt, Mycobacterium bovis subsp bovis AF2122/97
gaggccggugaacggcag

SEQ ID NO: 1089986 - RNA, 18 nt, Mycobacterium bovis subsp bovis AF2122/97
gaggccggugaacgguag

SEQ ID NO: 1089987 - RNA, 15 nt, Mycobacterium bovis subsp bovis AF2122/97
gaggccucggcggcc

SEQ ID NO: 1089988 - RNA, 22 nt, Mycobacterium bovis subsp bovis AF2122/97
gaggaagcccgaugcgccaccg

SEQ ID NO: 1089989 - RNA, 14 nt, Mycobacterium bovis subsp bovis AF2122/97
gaggaagcggcggc

SEQ ID NO: 1089990 - RNA, 15 nt, Mycobacterium bovis subsp bovis AF2122/97
gaggaagcggcggca

SEQ ID NO: 1089991 - RNA, 23 nt, Mycobacterium bovis subsp bovis AF2122/97
gagcgcgccguugccgcccacgc

SEQ ID NO: 1089992 - RNA, 22 nt, Mycobacterium bovis subsp bovis AF2122/97
gagcgcgcgcaacccugccgcg

SEQ ID NO: 1089993 - RNA, 20 nt, Mycobacterium bovis subsp bovis AF2122/97
gagcgcgaaguacgacgacc

SEQ ID NO: 1089994 - RNA, 18 nt, Mycobacterium bovis subsp bovis AF2122/97
gagcgcgcguagcggggg

SEQ ID NO: 1089995 - RNA, 19 nt, Mycobacterium bovis subsp bovis AF2122/97
gagcgcgccgcgcucgccg

SEQ ID NO: 1089996 - RNA, 22 nt, Mycobacterium bovis subsp bovis AF2122/97
gagcgcgccgcgcucgccgaua

SEQ ID NO: 1089997 - RNA, 16 nt, Mycobacterium bovis subsp bovis AF2122/97
gagcgcgcucagguca

SEQ ID NO: 1089998 - RNA, 18 nt, Mycobacterium bovis subsp bovis AF2122/97
gaggaaucguucggggug

SEQ ID NO: 1089999 - RNA, 23 nt, Mycobacterium bovis subsp bovis AF2122/97
gaggaauuccgcuaccgcacagg

SEQ ID NO: 1090000 - RNA, 14 nt, Mycobacterium bovis subsp bovis AF2122/97
gaggaaguccagcu

SEQ ID NO: 1090001 - RNA, 16 nt, Mycobacterium bovis subsp bovis AF2122/97
gaggacauccggcgcc

SEQ ID NO: 1090002 - RNA, 20 nt, Mycobacterium bovis subsp bovis AF2122/97
gaggaccaccuggucgcguc

SEQ ID NO: 1090003 - RNA, 17 nt, Mycobacterium bovis subsp bovis AF2122/97
gaggaugccgaaccgcg

SEQ ID NO: 1090004 - RNA, 12 nt, Mycobacterium bovis subsp bovis AF2122/97
gagcgcgccacu

SEQ ID NO: 1090005 - RNA, 15 nt, Mycobacterium bovis subsp bovis AF2122/97
gaggcaccgacaucg

SEQ ID NO: 1090006 - RNA, 19 nt, Mycobacterium bovis subsp bovis AF2122/97
gaggcacaaucaccgccgc

SEQ ID NO: 1090007 - RNA, 16 nt, Mycobacterium bovis subsp bovis AF2122/97
gaggcaccgacaucgu

SEQ ID NO: 1090008 - RNA, 17 nt, Mycobacterium bovis subsp bovis AF2122/97
gaggcagcgucgucgac

SEQ ID NO: 1090009 - RNA, 22 nt, Mycobacterium bovis subsp bovis AF2122/97
gaggccgaccucguucgucacc

SEQ ID NO: 1090010 - RNA, 21 nt, Mycobacterium bovis subsp bovis AF2122/97
gaggcacuuaccgagccguca

SEQ ID NO: 1090011 - RNA, 20 nt, Mycobacterium bovis subsp bovis AF2122/97
gaggaugucgagcccgucga

SEQ ID NO: 1090012 - RNA, 22 nt, Mycobacterium bovis subsp bovis AF2122/97
gaggauucggccguaucgucga

SEQ ID NO: 1090013 - RNA, 22 nt, Mycobacterium bovis subsp bovis AF2122/97
gaggcaagcaaccggugcgcau

SEQ ID NO: 1090014 - RNA, 19 nt, Mycobacterium bovis subsp bovis AF2122/97
gagggcggaauaucggccg

SEQ ID NO: 1090015 - RNA, 22 nt, Mycobacterium bovis subsp bovis AF2122/97
gagggccgucacaggccgccug

SEQ ID NO: 1090016 - RNA, 15 nt, Mycobacterium bovis subsp bovis AF2122/97
gagggccagcagccg

SEQ ID NO: 1090017 - RNA, 14 nt, Mycobacterium bovis subsp bovis AF2122/97
gagggcggcgucga

SEQ ID NO: 1090018 - RNA, 21 nt, Mycobacterium bovis subsp bovis AF2122/97
gagggcggcgucgauggccac

SEQ ID NO: 1090019 - RNA, 15 nt, Mycobacterium bovis subsp bovis AF2122/97
gagggaccacccggu

SEQ ID NO: 1090020 - RNA, 15 nt, Mycobacterium bovis subsp bovis AF2122/97
gagggauugccgugc

SEQ ID NO: 1090021 - RNA, 12 nt, Mycobacterium bovis subsp bovis AF2122/97
gagggcagccgc

SEQ ID NO: 1090022 - RNA, 19 nt, Mycobacterium bovis subsp bovis AF2122/97
gaggugugccgacccuacu

SEQ ID NO: 1090023 - RNA, 17 nt, Mycobacterium bovis subsp bovis AF2122/97
gagguguggucgagcgg

SEQ ID NO: 1090024 - RNA, 15 nt, Mycobacterium bovis subsp bovis AF2122/97
gagguggcgcggggc

SEQ ID NO: 1090025 - RNA, 15 nt, Mycobacterium bovis subsp bovis AF2122/97
gagggcgucgccgcc

SEQ ID NO: 1090026 - RNA, 13 nt, Mycobacterium bovis subsp bovis AF2122/97
gaggugccgcgca

SEQ ID NO: 1090027 - RNA, 22 nt, Mycobacterium bovis subsp bovis AF2122/97
gaggugacggugacgaucaggc

SEQ ID NO: 1090028 - RNA, 15 nt, Mycobacterium bovis subsp bovis AF2122/97
gagguggacaaaucg

SEQ ID NO: 1090029 - RNA, 20 nt, Mycobacterium bovis subsp bovis AF2122/97
gaggugccggggccccaugc

SEQ ID NO: 1090030 - RNA, 20 nt, Mycobacterium bovis subsp bovis AF2122/97
gaggugccgggguggcgcgc

SEQ ID NO: 1090031 - RNA, 16 nt, Mycobacterium bovis subsp bovis AF2122/97
gagucaccagcaacag

SEQ ID NO: 1090032 - RNA, 17 nt, Mycobacterium bovis subsp bovis AF2122/97
gagucaccagcaacagc

SEQ ID NO: 1090033 - RNA, 14 nt, Mycobacterium bovis subsp bovis AF2122/97
gaguagucgacguc

SEQ ID NO: 1090034 - RNA, 14 nt, Mycobacterium bovis subsp bovis AF2122/97
gaguagccggucgg

SEQ ID NO: 1090035 - RNA, 18 nt, Mycobacterium bovis subsp bovis AF2122/97
gagugcacagacacggca

SEQ ID NO: 1090036 - RNA, 21 nt, Mycobacterium bovis subsp bovis AF2122/97
gagugaccacgcugcugguga

SEQ ID NO: 1090037 - RNA, 15 nt, Mycobacterium bovis subsp bovis AF2122/97
gagugaggcgcuggc

SEQ ID NO: 1090038 - RNA, 17 nt, Mycobacterium bovis subsp bovis AF2122/97
gagugcgacggcgacgu

SEQ ID NO: 1090039 - RNA, 23 nt, Mycobacterium bovis subsp bovis AF2122/97
gagugcauguccgaccucugcgu

SEQ ID NO: 1090040 - RNA, 16 nt, Mycobacterium bovis subsp bovis AF2122/97
gagugcccauagccgg

SEQ ID NO: 1090041 - RNA, 15 nt, Mycobacterium bovis subsp bovis AF2122/97
gagugccgccgucgc

SEQ ID NO: 1090042 - RNA, 20 nt, Mycobacterium bovis subsp bovis AF2122/97
gagugccgcgucaaccgauc

SEQ ID NO: 1090043 - RNA, 21 nt, Mycobacterium bovis subsp bovis AF2122/97
gagucgucguccgacgggccg

SEQ ID NO: 1090044 - RNA, 15 nt, Mycobacterium bovis subsp bovis AF2122/97
gagucgugacaacca

SEQ ID NO: 1090045 - RNA, 21 nt, Mycobacterium bovis subsp bovis AF2122/97
gagucgucccagucccgcguc

SEQ ID NO: 1090046 - RNA, 14 nt, Mycobacterium bovis subsp bovis AF2122/97
gagucgugccgccg

SEQ ID NO: 1090047 - RNA, 19 nt, Mycobacterium bovis subsp bovis AF2122/97
gagucguuggacggcaccg

SEQ ID NO: 1090048 - RNA, 15 nt, Mycobacterium bovis subsp bovis AF2122/97
gagucggcgggcgac

SEQ ID NO: 1090049 - RNA, 12 nt, Mycobacterium bovis subsp bovis AF2122/97
gagucggcgucg

SEQ ID NO: 1090050 - RNA, 13 nt, Mycobacterium bovis subsp bovis AF2122/97
gagucggcgucga

SEQ ID NO: 1090051 - RNA, 18 nt, Mycobacterium bovis subsp bovis AF2122/97
gagucggucuggaucaga

SEQ ID NO: 1090052 - RNA, 19 nt, Mycobacterium bovis subsp bovis AF2122/97
gagucggugaaaugacggc

SEQ ID NO: 1090053 - RNA, 14 nt, Mycobacterium bovis subsp bovis AF2122/97
gaguccaggccggc

SEQ ID NO: 1090054 - RNA, 14 nt, Mycobacterium bovis subsp bovis AF2122/97
gaguccagccggcg

SEQ ID NO: 1090055 - RNA, 17 nt, Mycobacterium bovis subsp bovis AF2122/97
gagugcggcacgaucgc

SEQ ID NO: 1090056 - RNA, 17 nt, Mycobacterium bovis subsp bovis AF2122/97
gagucuucaacgucgag

SEQ ID NO: 1090057 - RNA, 22 nt, Mycobacterium bovis subsp bovis AF2122/97
gagugcggcguauugcggccug

SEQ ID NO: 1090058 - RNA, 20 nt, Mycobacterium bovis subsp bovis AF2122/97
gagugcgucucgguggcugc

SEQ ID NO: 1090059 - RNA, 13 nt, Mycobacterium bovis subsp bovis AF2122/97
gagugcgauaccu

SEQ ID NO: 1090060 - RNA, 17 nt, Mycobacterium bovis subsp bovis AF2122/97
gagugguugcccgcacc

SEQ ID NO: 1090061 - RNA, 22 nt, Mycobacterium bovis subsp bovis AF2122/97
gaguggcucgcucugcgcggcu

SEQ ID NO: 1090062 - RNA, 14 nt, Mycobacterium bovis subsp bovis AF2122/97
gaguggccgguggg

SEQ ID NO: 1090063 - RNA, 22 nt, Mycobacterium bovis subsp bovis AF2122/97
gaguggaugcgccgcacggcga

SEQ ID NO: 1090064 - RNA, 19 nt, Mycobacterium bovis subsp bovis AF2122/97
gaguggcaaucccgccauc

SEQ ID NO: 1090065 - RNA, 20 nt, Mycobacterium bovis subsp bovis AF2122/97
gaguggccaguuggccggcc

SEQ ID NO: 1090066 - RNA, 16 nt, Mycobacterium bovis subsp bovis AF2122/97
gagugugacggcggcc

SEQ ID NO: 1090067 - RNA, 15 nt, Mycobacterium bovis subsp bovis AF2122/97
gagugucagcgccac

SEQ ID NO: 1090068 - RNA, 16 nt, Mycobacterium bovis subsp bovis AF2122/97
gaguggaaacccgccg

SEQ ID NO: 1090069 - RNA, 16 nt, Mycobacterium bovis subsp bovis AF2122/97
gaguguccccccgcgc

SEQ ID NO: 1090070 - RNA, 21 nt, Mycobacterium bovis subsp bovis AF2122/97
gagugucccgaugguggccgc

SEQ ID NO: 1090071 - RNA, 13 nt, Mycobacterium bovis subsp bovis AF2122/97
gaguucccgaaac

SEQ ID NO: 1090072 - RNA, 18 nt, Mycobacterium bovis subsp bovis AF2122/97
gaguucccgaaacccgau

SEQ ID NO: 1090073 - RNA, 18 nt, Mycobacterium bovis subsp bovis AF2122/97
gauagguggucuuggcgg

SEQ ID NO: 1090074 - RNA, 18 nt, Mycobacterium bovis subsp bovis AF2122/97
gauagguuccaccgggcg

SEQ ID NO: 1090075 - RNA, 17 nt, Mycobacterium bovis subsp bovis AF2122/97
gauagucauucgcuccg

SEQ ID NO: 1090076 - RNA, 21 nt, Mycobacterium bovis subsp bovis AF2122/97
gauaguggcgcgcggcgccgc

SEQ ID NO: 1090077 - RNA, 18 nt, Mycobacterium bovis subsp bovis AF2122/97
gauagggauggcgauggc

SEQ ID NO: 1090078 - RNA, 23 nt, Mycobacterium bovis subsp bovis AF2122/97
gauaucggcccccaagcucugcg

SEQ ID NO: 1090079 - RNA, 16 nt, Mycobacterium bovis subsp bovis AF2122/97
gauaucgaugcggcga

SEQ ID NO: 1090080 - RNA, 13 nt, Mycobacterium bovis subsp bovis AF2122/97
gauauccggucgc

SEQ ID NO: 1090081 - RNA, 15 nt, Mycobacterium bovis subsp bovis AF2122/97
gauagacccuggggu

SEQ ID NO: 1090082 - RNA, 23 nt, Mycobacterium bovis subsp bovis AF2122/97
gauagacccugggguccagcguc

SEQ ID NO: 1090083 - RNA, 18 nt, Mycobacterium bovis subsp bovis AF2122/97
gauagaccuuggugccca

SEQ ID NO: 1090084 - RNA, 14 nt, Mycobacterium bovis subsp bovis AF2122/97
gauagacgacccgg

SEQ ID NO: 1090085 - RNA, 15 nt, Mycobacterium bovis subsp bovis AF2122/97
gauagacggcgacga

SEQ ID NO: 1090086 - RNA, 20 nt, Mycobacterium bovis subsp bovis AF2122/97
gauacgccccugguccaccc

SEQ ID NO: 1090087 - RNA, 21 nt, Mycobacterium bovis subsp bovis AF2122/97
gauagaagaucuugucgagca

SEQ ID NO: 1090088 - RNA, 16 nt, Mycobacterium bovis subsp bovis AF2122/97
gauaggccgcgcggcg

SEQ ID NO: 1090089 - RNA, 18 nt, Mycobacterium bovis subsp bovis AF2122/97
gauaggccgcgcggcggc

SEQ ID NO: 1090090 - RNA, 14 nt, Mycobacterium bovis subsp bovis AF2122/97
gauagcccgccacc

SEQ ID NO: 1090091 - RNA, 19 nt, Mycobacterium bovis subsp bovis AF2122/97
gauagcaccggcacccgca

SEQ ID NO: 1090092 - RNA, 21 nt, Mycobacterium bovis subsp bovis AF2122/97
gauagcauccgcccgagccgg

SEQ ID NO: 1090093 - RNA, 13 nt, Mycobacterium bovis subsp bovis AF2122/97
gaucaccgagucg

SEQ ID NO: 1090094 - RNA, 16 nt, Mycobacterium bovis subsp bovis AF2122/97
gaucacccgccgcgug

SEQ ID NO: 1090095 - RNA, 23 nt, Mycobacterium bovis subsp bovis AF2122/97
gaucaccgccagcugggcagcca

SEQ ID NO: 1090096 - RNA, 15 nt, Mycobacterium bovis subsp bovis AF2122/97
gaucaccgccaccac

SEQ ID NO: 1090097 - RNA, 17 nt, Mycobacterium bovis subsp bovis AF2122/97
gaucaccgccaccacca

SEQ ID NO: 1090098 - RNA, 14 nt, Mycobacterium bovis subsp bovis AF2122/97
gaucacgaccgcgc

SEQ ID NO: 1090099 - RNA, 11 nt, Mycobacterium bovis subsp bovis AF2122/97
gaucacgacgu

SEQ ID NO: 1090100 - RNA, 20 nt, Mycobacterium bovis subsp bovis AF2122/97
gaucaccgccggggcuggug

SEQ ID NO: 1090101 - RNA, 12 nt, Mycobacterium bovis subsp bovis AF2122/97
gaucaccgcgcc

SEQ ID NO: 1090102 - RNA, 13 nt, Mycobacterium bovis subsp bovis AF2122/97
gaucaccgcgccc

SEQ ID NO: 1090103 - RNA, 16 nt, Mycobacterium bovis subsp bovis AF2122/97
gaucaccgcgcccgcc

SEQ ID NO: 1090104 - RNA, 15 nt, Mycobacterium bovis subsp bovis AF2122/97
gaucaccgacaccgu

SEQ ID NO: 1090105 - RNA, 15 nt, Mycobacterium bovis subsp bovis AF2122/97
gaucaccccggccgg

SEQ ID NO: 1090106 - RNA, 17 nt, Mycobacterium bovis subsp bovis AF2122/97
gaucaccccggucggcc

SEQ ID NO: 1090107 - RNA, 20 nt, Mycobacterium bovis subsp bovis AF2122/97
gaucaccccggucggcccgc

SEQ ID NO: 1090108 - RNA, 20 nt, Mycobacterium bovis subsp bovis AF2122/97
gaucaagccuucgucgaugc

SEQ ID NO: 1090109 - RNA, 19 nt, Mycobacterium bovis subsp bovis AF2122/97
gaucaagaaggccagcgcg

SEQ ID NO: 1090110 - RNA, 23 nt, Mycobacterium bovis subsp bovis AF2122/97
gaucaagaaggccagcgcgcccg

SEQ ID NO: 1090111 - RNA, 21 nt, Mycobacterium bovis subsp bovis AF2122/97
gaucaaggaccgcucugcggc

SEQ ID NO: 1090112 - RNA, 22 nt, Mycobacterium bovis subsp bovis AF2122/97
gaucaacaccaacgacagcgac

SEQ ID NO: 1090113 - RNA, 15 nt, Mycobacterium bovis subsp bovis AF2122/97
gaucaacaugccggu

SEQ ID NO: 1090114 - RNA, 19 nt, Mycobacterium bovis subsp bovis AF2122/97
gaucaacggaacaucguca

SEQ ID NO: 1090115 - RNA, 16 nt, Mycobacterium bovis subsp bovis AF2122/97
gaucaacucgggcagc

SEQ ID NO: 1090116 - RNA, 16 nt, Mycobacterium bovis subsp bovis AF2122/97
gaucaacucgugcggg

SEQ ID NO: 1090117 - RNA, 19 nt, Mycobacterium bovis subsp bovis AF2122/97
gaucaacaugccggucauc

SEQ ID NO: 1090118 - RNA, 23 nt, Mycobacterium bovis subsp bovis AF2122/97
gaucaaccccacacccgggacga

SEQ ID NO: 1090119 - RNA, 21 nt, Mycobacterium bovis subsp bovis AF2122/97
gaucaacccgguccagccggu

SEQ ID NO: 1090120 - RNA, 16 nt, Mycobacterium bovis subsp bovis AF2122/97
gaucaaagccagcacc

SEQ ID NO: 1090121 - RNA, 13 nt, Mycobacterium bovis subsp bovis AF2122/97
gauaugcacccgc

SEQ ID NO: 1090122 - RNA, 15 nt, Mycobacterium bovis subsp bovis AF2122/97
gauaugcacccgcac

SEQ ID NO: 1090123 - RNA, 20 nt, Mycobacterium bovis subsp bovis AF2122/97
gauaucggugaccguggcgg

SEQ ID NO: 1090124 - RNA, 19 nt, Mycobacterium bovis subsp bovis AF2122/97
gauaaugaucucggcaagg

SEQ ID NO: 1090125 - RNA, 22 nt, Mycobacterium bovis subsp bovis AF2122/97
gauaccggcggcgagcggccuc

SEQ ID NO: 1090126 - RNA, 16 nt, Mycobacterium bovis subsp bovis AF2122/97
gauaccgucagcgccg

SEQ ID NO: 1090127 - RNA, 15 nt, Mycobacterium bovis subsp bovis AF2122/97
gauacgccaccggca

SEQ ID NO: 1090128 - RNA, 22 nt, Mycobacterium bovis subsp bovis AF2122/97
gauacgaagccgccgcgaccaa

SEQ ID NO: 1090129 - RNA, 19 nt, Mycobacterium bovis subsp bovis AF2122/97
gauaauucaacagcaccgc

SEQ ID NO: 1090130 - RNA, 12 nt, Mycobacterium bovis subsp bovis AF2122/97
gauaccgccggc

SEQ ID NO: 1090131 - RNA, 22 nt, Mycobacterium bovis subsp bovis AF2122/97
gauaccgccggccccaccggug

SEQ ID NO: 1090132 - RNA, 20 nt, Mycobacterium bovis subsp bovis AF2122/97
gauacagacggggaucgguc

SEQ ID NO: 1090133 - RNA, 18 nt, Mycobacterium bovis subsp bovis AF2122/97
gauaccgacgcgcucggc

SEQ ID NO: 1090134 - RNA, 19 nt, Mycobacterium bovis subsp bovis AF2122/97
gauaccgacgcgcucggcg

SEQ ID NO: 1090135 - RNA, 13 nt, Mycobacterium bovis subsp bovis AF2122/97
gaguuggcugccg

SEQ ID NO: 1090136 - RNA, 16 nt, Mycobacterium bovis subsp bovis AF2122/97
gaguuggugcagcgac

SEQ ID NO: 1090137 - RNA, 15 nt, Mycobacterium bovis subsp bovis AF2122/97
gaguuggcccgacgc

SEQ ID NO: 1090138 - RNA, 19 nt, Mycobacterium bovis subsp bovis AF2122/97
gaguugcccguucaugcgg

SEQ ID NO: 1090139 - RNA, 20 nt, Mycobacterium bovis subsp bovis AF2122/97
gaguugcccucuggcucgcg

SEQ ID NO: 1090140 - RNA, 22 nt, Mycobacterium bovis subsp bovis AF2122/97
gaguugcgaaccaugaccacca

SEQ ID NO: 1090141 - RNA, 22 nt, Mycobacterium bovis subsp bovis AF2122/97
gaguuuggcgacgaggcgacgu

SEQ ID NO: 1090142 - RNA, 15 nt, Mycobacterium bovis subsp bovis AF2122/97
gaguuuaugcccggc

SEQ ID NO: 1090143 - RNA, 15 nt, Mycobacterium bovis subsp bovis AF2122/97
gaguuguugcugccc

SEQ ID NO: 1090144 - RNA, 16 nt, Mycobacterium bovis subsp bovis AF2122/97
gaguuguucagcccgu

SEQ ID NO: 1090145 - RNA, 22 nt, Mycobacterium bovis subsp bovis AF2122/97
gaguuguucgcccacaugccgg

SEQ ID NO: 1090146 - RNA, 23 nt, Mycobacterium bovis subsp bovis AF2122/97
gaguuccuugaugcggccgcgga

SEQ ID NO: 1090147 - RNA, 17 nt, Mycobacterium bovis subsp bovis AF2122/97
gaguucgcgcacgucgg

SEQ ID NO: 1090148 - RNA, 16 nt, Mycobacterium bovis subsp bovis AF2122/97
gaguucggcagcgggc

SEQ ID NO: 1090149 - RNA, 14 nt, Mycobacterium bovis subsp bovis AF2122/97
gaguucggccacca

SEQ ID NO: 1090150 - RNA, 13 nt, Mycobacterium bovis subsp bovis AF2122/97
gaguucggccagc

SEQ ID NO: 1090151 - RNA, 15 nt, Mycobacterium bovis subsp bovis AF2122/97
gaguucggcccgcaa

SEQ ID NO: 1090152 - RNA, 23 nt, Mycobacterium bovis subsp bovis AF2122/97
gaguucggcccgcaaacagucgg

SEQ ID NO: 1090153 - RNA, 17 nt, Mycobacterium bovis subsp bovis AF2122/97
gaguucgucaccguugg

SEQ ID NO: 1090154 - RNA, 18 nt, Mycobacterium bovis subsp bovis AF2122/97
gaguucggggugcgccca

SEQ ID NO: 1090155 - RNA, 17 nt, Mycobacterium bovis subsp bovis AF2122/97
gaguucguagucggcau

SEQ ID NO: 1090156 - RNA, 22 nt, Mycobacterium bovis subsp bovis AF2122/97
gaguucguagucggcaucgucg

SEQ ID NO: 1090157 - RNA, 16 nt, Mycobacterium bovis subsp bovis AF2122/97
gaguugagcaugucgu

SEQ ID NO: 1090158 - RNA, 14 nt, Mycobacterium bovis subsp bovis AF2122/97
gaguugagcgccaa

SEQ ID NO: 1090159 - RNA, 20 nt, Mycobacterium bovis subsp bovis AF2122/97
gaguugaacaauccgguguu

SEQ ID NO: 1090160 - RNA, 22 nt, Mycobacterium bovis subsp bovis AF2122/97
gaguugaacaauccgguguuga

SEQ ID NO: 1090161 - RNA, 20 nt, Mycobacterium bovis subsp bovis AF2122/97
gaguugaacguucccucggc

SEQ ID NO: 1090162 - RNA, 22 nt, Mycobacterium bovis subsp bovis AF2122/97
gaguugaagaagccgguguuga

SEQ ID NO: 1090163 - RNA, 16 nt, Mycobacterium bovis subsp bovis AF2122/97
gauaacuccgcggcga

SEQ ID NO: 1090164 - RNA, 15 nt, Mycobacterium bovis subsp bovis AF2122/97
gauaaagccgcugaa

SEQ ID NO: 1090165 - RNA, 17 nt, Mycobacterium bovis subsp bovis AF2122/97
gauaaacugccgcggca

SEQ ID NO: 1090166 - RNA, 20 nt, Mycobacterium bovis subsp bovis AF2122/97
gaucgccaggccgagcccgg

SEQ ID NO: 1090167 - RNA, 18 nt, Mycobacterium bovis subsp bovis AF2122/97
gaucgccaggccgucggg

SEQ ID NO: 1090168 - RNA, 18 nt, Mycobacterium bovis subsp bovis AF2122/97
gaucgcaucgacgugcgc

SEQ ID NO: 1090169 - RNA, 21 nt, Mycobacterium bovis subsp bovis AF2122/97
gaucgcaucgacgugcgcggc

SEQ ID NO: 1090170 - RNA, 13 nt, Mycobacterium bovis subsp bovis AF2122/97
gaucgccacccgg

SEQ ID NO: 1090171 - RNA, 15 nt, Mycobacterium bovis subsp bovis AF2122/97
gaucgccaccggcgc

SEQ ID NO: 1090172 - RNA, 16 nt, Mycobacterium bovis subsp bovis AF2122/97
gaucgccaccgguacc

SEQ ID NO: 1090173 - RNA, 16 nt, Mycobacterium bovis subsp bovis AF2122/97
gaucgcgagcgagcca

SEQ ID NO: 1090174 - RNA, 15 nt, Mycobacterium bovis subsp bovis AF2122/97
gaucgcgacccgauc

SEQ ID NO: 1090175 - RNA, 14 nt, Mycobacterium bovis subsp bovis AF2122/97
gaucgcgcagcgcc

SEQ ID NO: 1090176 - RNA, 17 nt, Mycobacterium bovis subsp bovis AF2122/97
gaucgcgcagcgccgcc

SEQ ID NO: 1090177 - RNA, 18 nt, Mycobacterium bovis subsp bovis AF2122/97
gaucgcgcagcgccgcca

SEQ ID NO: 1090178 - RNA, 21 nt, Mycobacterium bovis subsp bovis AF2122/97
gaucgcgcccaccgaugcgau

SEQ ID NO: 1090179 - RNA, 18 nt, Mycobacterium bovis subsp bovis AF2122/97
gaucgcgcccgcugagcc

SEQ ID NO: 1090180 - RNA, 20 nt, Mycobacterium bovis subsp bovis AF2122/97
gaucgccugagcgccgcggc

SEQ ID NO: 1090181 - RNA, 18 nt, Mycobacterium bovis subsp bovis AF2122/97
gaucgccugggcuuggcg

SEQ ID NO: 1090182 - RNA, 23 nt, Mycobacterium bovis subsp bovis AF2122/97
gaucgcgaacaucgccagcgccg

SEQ ID NO: 1090183 - RNA, 24 nt, Mycobacterium bovis subsp bovis AF2122/97
gaucgcgaacaucgccagcgccgg

SEQ ID NO: 1090184 - RNA, 17 nt, Mycobacterium bovis subsp bovis AF2122/97
gaucgcgaacaucgcca

SEQ ID NO: 1090185 - RNA, 14 nt, Mycobacterium bovis subsp bovis AF2122/97
gaucgacggccagc

SEQ ID NO: 1090186 - RNA, 20 nt, Mycobacterium bovis subsp bovis AF2122/97
gaucgacggugucaugaacg

SEQ ID NO: 1090187 - RNA, 22 nt, Mycobacterium bovis subsp bovis AF2122/97
gaucgacguucgggucgagccg

SEQ ID NO: 1090188 - RNA, 23 nt, Mycobacterium bovis subsp bovis AF2122/97
gaucgacgccgccacccggcggg

SEQ ID NO: 1090189 - RNA, 20 nt, Mycobacterium bovis subsp bovis AF2122/97
gauccggccgguuggccagc

SEQ ID NO: 1090190 - RNA, 15 nt, Mycobacterium bovis subsp bovis AF2122/97
gaucgacuucggugg

SEQ ID NO: 1090191 - RNA, 20 nt, Mycobacterium bovis subsp bovis AF2122/97
gaucgagcaggccgcccagc

SEQ ID NO: 1090192 - RNA, 22 nt, Mycobacterium bovis subsp bovis AF2122/97
gaucgagcaguuccagcucgcg

SEQ ID NO: 1090193 - RNA, 22 nt, Mycobacterium bovis subsp bovis AF2122/97
gaucgcagggaucaccccggcc

SEQ ID NO: 1090194 - RNA, 17 nt, Mycobacterium bovis subsp bovis AF2122/97
gaucgcagugagcagcc

SEQ ID NO: 1090195 - RNA, 16 nt, Mycobacterium bovis subsp bovis AF2122/97
gaucgagaaccgugac

SEQ ID NO: 1090196 - RNA, 19 nt, Mycobacterium bovis subsp bovis AF2122/97
gaucgauuuggaucggcug

SEQ ID NO: 1090197 - RNA, 14 nt, Mycobacterium bovis subsp bovis AF2122/97
gaucgcaucgacgu

SEQ ID NO: 1090198 - RNA, 19 nt, Mycobacterium bovis subsp bovis AF2122/97
gaucgcagugagcagccgg

SEQ ID NO: 1090199 - RNA, 14 nt, Mycobacterium bovis subsp bovis AF2122/97
gaucgagacuucuu

SEQ ID NO: 1090200 - RNA, 14 nt, Mycobacterium bovis subsp bovis AF2122/97
gaucgauuccgccg

SEQ ID NO: 1090201 - RNA, 21 nt, Mycobacterium bovis subsp bovis AF2122/97
gaucgauuccgccgcacucgg

SEQ ID NO: 1090202 - RNA, 17 nt, Mycobacterium bovis subsp bovis AF2122/97
gaucgauuccgcucguu

SEQ ID NO: 1090203 - RNA, 19 nt, Mycobacterium bovis subsp bovis AF2122/97
gaucgauucgucgcggauc

SEQ ID NO: 1090204 - RNA, 15 nt, Mycobacterium bovis subsp bovis AF2122/97
gaucccgucgggcac

SEQ ID NO: 1090205 - RNA, 22 nt, Mycobacterium bovis subsp bovis AF2122/97
gaucccgucgggcacaccgacg

SEQ ID NO: 1090206 - RNA, 14 nt, Mycobacterium bovis subsp bovis AF2122/97
gauccgcgcgcugg

SEQ ID NO: 1090207 - RNA, 19 nt, Mycobacterium bovis subsp bovis AF2122/97
gauccggccaacggcaccc

SEQ ID NO: 1090208 - RNA, 12 nt, Mycobacterium bovis subsp bovis AF2122/97
gauccggccagg

SEQ ID NO: 1090209 - RNA, 13 nt, Mycobacterium bovis subsp bovis AF2122/97
gauccgcugggcc

SEQ ID NO: 1090210 - RNA, 18 nt, Mycobacterium bovis subsp bovis AF2122/97
gauccgcugggccgggga

SEQ ID NO: 1090211 - RNA, 14 nt, Mycobacterium bovis subsp bovis AF2122/97
gaucagggcucgcu

SEQ ID NO: 1090212 - RNA, 18 nt, Mycobacterium bovis subsp bovis AF2122/97
gaucagggcucgcucgcc

SEQ ID NO: 1090213 - RNA, 19 nt, Mycobacterium bovis subsp bovis AF2122/97
gaucagggcucgcucgccg

SEQ ID NO: 1090214 - RNA, 21 nt, Mycobacterium bovis subsp bovis AF2122/97
gaucagggcucgcucgccgag

SEQ ID NO: 1090215 - RNA, 16 nt, Mycobacterium bovis subsp bovis AF2122/97
gaucagacccagcgcg

SEQ ID NO: 1090216 - RNA, 21 nt, Mycobacterium bovis subsp bovis AF2122/97
gaucagaugcggcccgggcuc

SEQ ID NO: 1090217 - RNA, 16 nt, Mycobacterium bovis subsp bovis AF2122/97
gaucagcaacggcagc

SEQ ID NO: 1090218 - RNA, 17 nt, Mycobacterium bovis subsp bovis AF2122/97
gaucagcaacucggcca

SEQ ID NO: 1090219 - RNA, 17 nt, Mycobacterium bovis subsp bovis AF2122/97
gaucagaacgcggccuc

SEQ ID NO: 1090220 - RNA, 13 nt, Mycobacterium bovis subsp bovis AF2122/97
gaucagguuggcg

SEQ ID NO: 1090221 - RNA, 22 nt, Mycobacterium bovis subsp bovis AF2122/97
gaucagguuggcggcugcacgc

SEQ ID NO: 1090222 - RNA, 16 nt, Mycobacterium bovis subsp bovis AF2122/97
gaucaggguggcgcgg

SEQ ID NO: 1090223 - RNA, 16 nt, Mycobacterium bovis subsp bovis AF2122/97
gaucagggucagcgcc

SEQ ID NO: 1090224 - RNA, 20 nt, Mycobacterium bovis subsp bovis AF2122/97
gaucagcaccgacagcccga

SEQ ID NO: 1090225 - RNA, 23 nt, Mycobacterium bovis subsp bovis AF2122/97
gaucacggugggcgccgacaccg

SEQ ID NO: 1090226 - RNA, 22 nt, Mycobacterium bovis subsp bovis AF2122/97
gaucaccgcgccggagaucguc

SEQ ID NO: 1090227 - RNA, 13 nt, Mycobacterium bovis subsp bovis AF2122/97
gaucacgucggcg

SEQ ID NO: 1090228 - RNA, 20 nt, Mycobacterium bovis subsp bovis AF2122/97
gaucacgccggccucgccga

SEQ ID NO: 1090229 - RNA, 16 nt, Mycobacterium bovis subsp bovis AF2122/97
gaucacgccgggcgag

SEQ ID NO: 1090230 - RNA, 18 nt, Mycobacterium bovis subsp bovis AF2122/97
gaucacgggcuaccggca

SEQ ID NO: 1090231 - RNA, 17 nt, Mycobacterium bovis subsp bovis AF2122/97
gaucacguacgccgccg

SEQ ID NO: 1090232 - RNA, 20 nt, Mycobacterium bovis subsp bovis AF2122/97
gaucacguacgccgccgauc

SEQ ID NO: 1090233 - RNA, 21 nt, Mycobacterium bovis subsp bovis AF2122/97
gaucacguacgccgccgauca

SEQ ID NO: 1090234 - RNA, 12 nt, Mycobacterium bovis subsp bovis AF2122/97
gaucacugucgg

SEQ ID NO: 1090235 - RNA, 13 nt, Mycobacterium bovis subsp bovis AF2122/97
gaucacgugccgg

SEQ ID NO: 1090236 - RNA, 22 nt, Mycobacterium bovis subsp bovis AF2122/97
gaucacgugguccaaccgggcc

SEQ ID NO: 1090237 - RNA, 19 nt, Mycobacterium bovis subsp bovis AF2122/97
gaucacucacccgggcagc

SEQ ID NO: 1090238 - RNA, 22 nt, Mycobacterium bovis subsp bovis AF2122/97
gaucacucccccacacacccga

SEQ ID NO: 1090239 - RNA, 14 nt, Mycobacterium bovis subsp bovis AF2122/97
gaucacugcucguc

SEQ ID NO: 1090240 - RNA, 16 nt, Mycobacterium bovis subsp bovis AF2122/97
gaucacggccgucgau

SEQ ID NO: 1090241 - RNA, 16 nt, Mycobacterium bovis subsp bovis AF2122/97
gaucacggcggccccg

SEQ ID NO: 1090242 - RNA, 19 nt, Mycobacterium bovis subsp bovis AF2122/97
gaucacggcggccccggca

SEQ ID NO: 1090243 - RNA, 18 nt, Mycobacterium bovis subsp bovis AF2122/97
gaucacgaucacaccacg

SEQ ID NO: 1090244 - RNA, 12 nt, Mycobacterium bovis subsp bovis AF2122/97
gaucacgccgcc

SEQ ID NO: 1090245 - RNA, 14 nt, Mycobacterium bovis subsp bovis AF2122/97
gaucacgccgccgg

SEQ ID NO: 1090246 - RNA, 13 nt, Mycobacterium bovis subsp bovis AF2122/97
gaucccgccgggg

SEQ ID NO: 1090247 - RNA, 16 nt, Mycobacterium bovis subsp bovis AF2122/97
gaucccgccgcugccg

SEQ ID NO: 1090248 - RNA, 18 nt, Mycobacterium bovis subsp bovis AF2122/97
gaucccgccgcugccgcc

SEQ ID NO: 1090249 - RNA, 20 nt, Mycobacterium bovis subsp bovis AF2122/97
gaucccgccgcugccgccgg

SEQ ID NO: 1090250 - RNA, 13 nt, Mycobacterium bovis subsp bovis AF2122/97
gaucccggccagg

SEQ ID NO: 1090251 - RNA, 16 nt, Mycobacterium bovis subsp bovis AF2122/97
gaucccggccaggccg

SEQ ID NO: 1090252 - RNA, 18 nt, Mycobacterium bovis subsp bovis AF2122/97
gaucccggccgucgccgg

SEQ ID NO: 1090253 - RNA, 13 nt, Mycobacterium bovis subsp bovis AF2122/97
gaucccggcgagc

SEQ ID NO: 1090254 - RNA, 18 nt, Mycobacterium bovis subsp bovis AF2122/97
gaucccggcgagcacccg

SEQ ID NO: 1090255 - RNA, 20 nt, Mycobacterium bovis subsp bovis AF2122/97
gauccccgcgcugagcacgc

SEQ ID NO: 1090256 - RNA, 15 nt, Mycobacterium bovis subsp bovis AF2122/97
gaucccgaaccguuc

SEQ ID NO: 1090257 - RNA, 13 nt, Mycobacterium bovis subsp bovis AF2122/97
gaucccgaugguc

SEQ ID NO: 1090258 - RNA, 22 nt, Mycobacterium bovis subsp bovis AF2122/97
gaucccgccgaucgaaccgcug

SEQ ID NO: 1090259 - RNA, 13 nt, Mycobacterium bovis subsp bovis AF2122/97
gauccccacgaua

SEQ ID NO: 1090260 - RNA, 18 nt, Mycobacterium bovis subsp bovis AF2122/97
gaucccaguccgauggug

SEQ ID NO: 1090261 - RNA, 12 nt, Mycobacterium bovis subsp bovis AF2122/97
gaucccagcggg

SEQ ID NO: 1090262 - RNA, 16 nt, Mycobacterium bovis subsp bovis AF2122/97
gaucccacgaguuggc

SEQ ID NO: 1090263 - RNA, 23 nt, Mycobacterium bovis subsp bovis AF2122/97
gaucccaacgcccgggcgaaucc

SEQ ID NO: 1090264 - RNA, 16 nt, Mycobacterium bovis subsp bovis AF2122/97
gauccaugcggguggu

SEQ ID NO: 1090265 - RNA, 14 nt, Mycobacterium bovis subsp bovis AF2122/97
gauccacuccggcg

SEQ ID NO: 1090266 - RNA, 21 nt, Mycobacterium bovis subsp bovis AF2122/97
gauccaccacgcuggccucgu

SEQ ID NO: 1090267 - RNA, 20 nt, Mycobacterium bovis subsp bovis AF2122/97
gauccacugccgcgcgcccg

SEQ ID NO: 1090268 - RNA, 14 nt, Mycobacterium bovis subsp bovis AF2122/97
gauccacgccgacc

SEQ ID NO: 1090269 - RNA, 16 nt, Mycobacterium bovis subsp bovis AF2122/97
gauccacgccgaccau

SEQ ID NO: 1090270 - RNA, 22 nt, Mycobacterium bovis subsp bovis AF2122/97
gaucauguccaucgcgcggcug

SEQ ID NO: 1090271 - RNA, 23 nt, Mycobacterium bovis subsp bovis AF2122/97
gaucaugucggccggggccaccc

SEQ ID NO: 1090272 - RNA, 22 nt, Mycobacterium bovis subsp bovis AF2122/97
gaucaugugguggcgccggccg

SEQ ID NO: 1090273 - RNA, 14 nt, Mycobacterium bovis subsp bovis AF2122/97
gaucauguucggcc

SEQ ID NO: 1090274 - RNA, 22 nt, Mycobacterium bovis subsp bovis AF2122/97
gaucagucgugggcugugcggg

SEQ ID NO: 1090275 - RNA, 19 nt, Mycobacterium bovis subsp bovis AF2122/97
gaucagucugggcgaucgc

SEQ ID NO: 1090276 - RNA, 15 nt, Mycobacterium bovis subsp bovis AF2122/97
gaucaugccggcgaa

SEQ ID NO: 1090277 - RNA, 17 nt, Mycobacterium bovis subsp bovis AF2122/97
gaucaggucuggcgcgg

SEQ ID NO: 1090278 - RNA, 20 nt, Mycobacterium bovis subsp bovis AF2122/97
gaucaggucuucgauggcca

SEQ ID NO: 1090279 - RNA, 14 nt, Mycobacterium bovis subsp bovis AF2122/97
gaucaguccggcgu

SEQ ID NO: 1090280 - RNA, 22 nt, Mycobacterium bovis subsp bovis AF2122/97
gaucggcuugggaaacccggcc

SEQ ID NO: 1090281 - RNA, 20 nt, Mycobacterium bovis subsp bovis AF2122/97
gaucggcuugggaaacccgg

SEQ ID NO: 1090282 - RNA, 19 nt, Mycobacterium bovis subsp bovis AF2122/97
gaucggcuugccugcgccg

SEQ ID NO: 1090283 - RNA, 18 nt, Mycobacterium bovis subsp bovis AF2122/97
gaucggcuugggaaaccc

SEQ ID NO: 1090284 - RNA, 21 nt, Mycobacterium bovis subsp bovis AF2122/97
gaucggcguuagucgaucacg

SEQ ID NO: 1090285 - RNA, 21 nt, Mycobacterium bovis subsp bovis AF2122/97
gaucggcuaccuaacccgcac

SEQ ID NO: 1090286 - RNA, 20 nt, Mycobacterium bovis subsp bovis AF2122/97
gaucggcugcgcgcucggcc

SEQ ID NO: 1090287 - RNA, 14 nt, Mycobacterium bovis subsp bovis AF2122/97
gaucggcuccgccg

SEQ ID NO: 1090288 - RNA, 16 nt, Mycobacterium bovis subsp bovis AF2122/97
gaucggcgucacgagc

SEQ ID NO: 1090289 - RNA, 19 nt, Mycobacterium bovis subsp bovis AF2122/97
gaucggcggcgcgccgauc

SEQ ID NO: 1090290 - RNA, 16 nt, Mycobacterium bovis subsp bovis AF2122/97
gaucgggccggcgcgg

SEQ ID NO: 1090291 - RNA, 18 nt, Mycobacterium bovis subsp bovis AF2122/97
gaucgggcuucggccaga

SEQ ID NO: 1090292 - RNA, 15 nt, Mycobacterium bovis subsp bovis AF2122/97
gaucgggcaccccga

SEQ ID NO: 1090293 - RNA, 21 nt, Mycobacterium bovis subsp bovis AF2122/97
gaucgggcaccccgaccacca

SEQ ID NO: 1090294 - RNA, 22 nt, Mycobacterium bovis subsp bovis AF2122/97
gaucgggaauuucgucggccau

SEQ ID NO: 1090295 - RNA, 18 nt, Mycobacterium bovis subsp bovis AF2122/97
gaucgggcccagcagcgc

SEQ ID NO: 1090296 - RNA, 21 nt, Mycobacterium bovis subsp bovis AF2122/97
gaucgggcccuccggcgcagc

SEQ ID NO: 1090297 - RNA, 13 nt, Mycobacterium bovis subsp bovis AF2122/97
gaucgggccgauc

SEQ ID NO: 1090298 - RNA, 14 nt, Mycobacterium bovis subsp bovis AF2122/97
gaucgggcccaccg

SEQ ID NO: 1090299 - RNA, 15 nt, Mycobacterium bovis subsp bovis AF2122/97
gaucgggccggccgc

SEQ ID NO: 1090300 - RNA, 20 nt, Mycobacterium bovis subsp bovis AF2122/97
gaucgguaccgacggcacca

SEQ ID NO: 1090301 - RNA, 17 nt, Mycobacterium bovis subsp bovis AF2122/97
gaucggugcgggcgccg

SEQ ID NO: 1090302 - RNA, 17 nt, Mycobacterium bovis subsp bovis AF2122/97
gaucgguugaucggcca

SEQ ID NO: 1090303 - RNA, 16 nt, Mycobacterium bovis subsp bovis AF2122/97
gaucgggucguuggcg

SEQ ID NO: 1090304 - RNA, 17 nt, Mycobacterium bovis subsp bovis AF2122/97
gaucgggucguuggcgg

SEQ ID NO: 1090305 - RNA, 13 nt, Mycobacterium bovis subsp bovis AF2122/97
gaucgguccggcg

SEQ ID NO: 1090306 - RNA, 16 nt, Mycobacterium bovis subsp bovis AF2122/97
gaucgguccggcgaac

SEQ ID NO: 1090307 - RNA, 18 nt, Mycobacterium bovis subsp bovis AF2122/97
gaucggucggcaccaggu

SEQ ID NO: 1090308 - RNA, 16 nt, Mycobacterium bovis subsp bovis AF2122/97
gaucguccaccgccga

SEQ ID NO: 1090309 - RNA, 16 nt, Mycobacterium bovis subsp bovis AF2122/97
gaucgucgacucggcg

SEQ ID NO: 1090310 - RNA, 18 nt, Mycobacterium bovis subsp bovis AF2122/97
gaucgucgagccgaucgc

SEQ ID NO: 1090311 - RNA, 19 nt, Mycobacterium bovis subsp bovis AF2122/97
gaucgucgaacagcaccgc

SEQ ID NO: 1090312 - RNA, 18 nt, Mycobacterium bovis subsp bovis AF2122/97
gaucguagugcgcgccaa

SEQ ID NO: 1090313 - RNA, 13 nt, Mycobacterium bovis subsp bovis AF2122/97
gaucggugggcgg

SEQ ID NO: 1090314 - RNA, 15 nt, Mycobacterium bovis subsp bovis AF2122/97
gaucgucaagccggg

SEQ ID NO: 1090315 - RNA, 14 nt, Mycobacterium bovis subsp bovis AF2122/97
gaucgucgccgauc

SEQ ID NO: 1090316 - RNA, 15 nt, Mycobacterium bovis subsp bovis AF2122/97
gaucgucucggccac

SEQ ID NO: 1090317 - RNA, 21 nt, Mycobacterium bovis subsp bovis AF2122/97
gaucgucguugucagcgaacg

SEQ ID NO: 1090318 - RNA, 17 nt, Mycobacterium bovis subsp bovis AF2122/97
gaucgucucgcgcaccu

SEQ ID NO: 1090319 - RNA, 20 nt, Mycobacterium bovis subsp bovis AF2122/97
gaucgucgucaacccggugu

SEQ ID NO: 1090320 - RNA, 17 nt, Mycobacterium bovis subsp bovis AF2122/97
gaucgucgugcacggcg

SEQ ID NO: 1090321 - RNA, 18 nt, Mycobacterium bovis subsp bovis AF2122/97
gaucgucgugcacggcgg

SEQ ID NO: 1090322 - RNA, 22 nt, Mycobacterium bovis subsp bovis AF2122/97
gaucgugugaggccuucgccga

SEQ ID NO: 1090323 - RNA, 15 nt, Mycobacterium bovis subsp bovis AF2122/97
gaucgugccggcgaa

SEQ ID NO: 1090324 - RNA, 16 nt, Mycobacterium bovis subsp bovis AF2122/97
gaucgugccgggaccg

SEQ ID NO: 1090325 - RNA, 21 nt, Mycobacterium bovis subsp bovis AF2122/97
gaucgugccgggaccggugug

SEQ ID NO: 1090326 - RNA, 17 nt, Mycobacterium bovis subsp bovis AF2122/97
gaucgugagacgccguc

SEQ ID NO: 1090327 - RNA, 16 nt, Mycobacterium bovis subsp bovis AF2122/97
gaucgugaucgaccgg

SEQ ID NO: 1090328 - RNA, 19 nt, Mycobacterium bovis subsp bovis AF2122/97
gaucgugaacacgucgcgg

SEQ ID NO: 1090329 - RNA, 22 nt, Mycobacterium bovis subsp bovis AF2122/97
gaucucgcgggcccgcgcggcg

SEQ ID NO: 1090330 - RNA, 14 nt, Mycobacterium bovis subsp bovis AF2122/97
gaucucgcgcgcgg

SEQ ID NO: 1090331 - RNA, 16 nt, Mycobacterium bovis subsp bovis AF2122/97
gaucucgcgcgcggcg

SEQ ID NO: 1090332 - RNA, 19 nt, Mycobacterium bovis subsp bovis AF2122/97
gaucucgcgcgcggcgacg

SEQ ID NO: 1090333 - RNA, 19 nt, Mycobacterium bovis subsp bovis AF2122/97
gaucucgauguacagcggg

SEQ ID NO: 1090334 - RNA, 13 nt, Mycobacterium bovis subsp bovis AF2122/97
gaucucgcccagc

SEQ ID NO: 1090335 - RNA, 14 nt, Mycobacterium bovis subsp bovis AF2122/97
gaucucgcccagcg

SEQ ID NO: 1090336 - RNA, 17 nt, Mycobacterium bovis subsp bovis AF2122/97
gaucucgcccagcgagc

SEQ ID NO: 1090337 - RNA, 17 nt, Mycobacterium bovis subsp bovis AF2122/97
gaucucgagccgcggca

SEQ ID NO: 1090338 - RNA, 23 nt, Mycobacterium bovis subsp bovis AF2122/97
gaucucgaucaucaugucggcgc

SEQ ID NO: 1090339 - RNA, 18 nt, Mycobacterium bovis subsp bovis AF2122/97
gaucucgaucgacccggu

SEQ ID NO: 1090340 - RNA, 13 nt, Mycobacterium bovis subsp bovis AF2122/97
gaucucggccagg

SEQ ID NO: 1090341 - RNA, 14 nt, Mycobacterium bovis subsp bovis AF2122/97
gaucucggcgagca

SEQ ID NO: 1090342 - RNA, 13 nt, Mycobacterium bovis subsp bovis AF2122/97
gaucucgccgcca

SEQ ID NO: 1090343 - RNA, 17 nt, Mycobacterium bovis subsp bovis AF2122/97
gaucucggcaaggacgu

SEQ ID NO: 1090344 - RNA, 18 nt, Mycobacterium bovis subsp bovis AF2122/97
gaucucggugguuuggcg

SEQ ID NO: 1090345 - RNA, 16 nt, Mycobacterium bovis subsp bovis AF2122/97
gaucgugcugcccgca

SEQ ID NO: 1090346 - RNA, 22 nt, Mycobacterium bovis subsp bovis AF2122/97
gaucgugcuggugguaucggcg

SEQ ID NO: 1090347 - RNA, 19 nt, Mycobacterium bovis subsp bovis AF2122/97
gaucguuaugaccucgacg

SEQ ID NO: 1090348 - RNA, 14 nt, Mycobacterium bovis subsp bovis AF2122/97
gaucguuggccagu

SEQ ID NO: 1090349 - RNA, 19 nt, Mycobacterium bovis subsp bovis AF2122/97
gaucguugccucgucgccg

SEQ ID NO: 1090350 - RNA, 22 nt, Mycobacterium bovis subsp bovis AF2122/97
gaucucgagcaggcgcaccagg

SEQ ID NO: 1090351 - RNA, 23 nt, Mycobacterium bovis subsp bovis AF2122/97
gaucucaccacccgucggcccgc

SEQ ID NO: 1090352 - RNA, 22 nt, Mycobacterium bovis subsp bovis AF2122/97
gaucuagaggcggcccccggca

SEQ ID NO: 1090353 - RNA, 22 nt, Mycobacterium bovis subsp bovis AF2122/97
gaucggccuguccaccgaugcc

SEQ ID NO: 1090354 - RNA, 21 nt, Mycobacterium bovis subsp bovis AF2122/97
gaucggccugcagcgaugacg

SEQ ID NO: 1090355 - RNA, 12 nt, Mycobacterium bovis subsp bovis AF2122/97
gaucggcgacgc

SEQ ID NO: 1090356 - RNA, 22 nt, Mycobacterium bovis subsp bovis AF2122/97
gaucggcgauccgacgaccucg

SEQ ID NO: 1090357 - RNA, 15 nt, Mycobacterium bovis subsp bovis AF2122/97
gaucggcgcgccgau

SEQ ID NO: 1090358 - RNA, 17 nt, Mycobacterium bovis subsp bovis AF2122/97
gaucggcggccgcgacc

SEQ ID NO: 1090359 - RNA, 19 nt, Mycobacterium bovis subsp bovis AF2122/97
gaucggcggccgcgaccag

SEQ ID NO: 1090360 - RNA, 13 nt, Mycobacterium bovis subsp bovis AF2122/97
gaucggcggccgg

SEQ ID NO: 1090361 - RNA, 15 nt, Mycobacterium bovis subsp bovis AF2122/97
gaucggcggccggca

SEQ ID NO: 1090362 - RNA, 15 nt, Mycobacterium bovis subsp bovis AF2122/97
gaucggcgcuagcca

SEQ ID NO: 1090363 - RNA, 14 nt, Mycobacterium bovis subsp bovis AF2122/97
gaucggcgcggccg

SEQ ID NO: 1090364 - RNA, 17 nt, Mycobacterium bovis subsp bovis AF2122/97
gaucggcgcggccguag

SEQ ID NO: 1090365 - RNA, 20 nt, Mycobacterium bovis subsp bovis AF2122/97
gaucggccaccaucgccccg

SEQ ID NO: 1090366 - RNA, 13 nt, Mycobacterium bovis subsp bovis AF2122/97
gaucggcgcccgg

SEQ ID NO: 1090367 - RNA, 16 nt, Mycobacterium bovis subsp bovis AF2122/97
gaucggcgcgccgauc

SEQ ID NO: 1090368 - RNA, 12 nt, Mycobacterium bovis subsp bovis AF2122/97
gaucggcggaua

SEQ ID NO: 1090369 - RNA, 22 nt, Mycobacterium bovis subsp bovis AF2122/97
gaucggcggauagucgcgggcc

SEQ ID NO: 1090370 - RNA, 17 nt, Mycobacterium bovis subsp bovis AF2122/97
gaucggcggcaaccgcc

SEQ ID NO: 1090371 - RNA, 21 nt, Mycobacterium bovis subsp bovis AF2122/97
gaucggcggcaaccgccgcca

SEQ ID NO: 1090372 - RNA, 19 nt, Mycobacterium bovis subsp bovis AF2122/97
gaucggcaggguggccagc

SEQ ID NO: 1090373 - RNA, 24 nt, Mycobacterium bovis subsp bovis AF2122/97
gaucggcaggguggccagcaggcg

SEQ ID NO: 1090374 - RNA, 17 nt, Mycobacterium bovis subsp bovis AF2122/97
gaucggcagccagggcg

SEQ ID NO: 1090375 - RNA, 14 nt, Mycobacterium bovis subsp bovis AF2122/97
gaucggcagcccgg

SEQ ID NO: 1090376 - RNA, 22 nt, Mycobacterium bovis subsp bovis AF2122/97
gaucggcacgcgcaguuuggcg

SEQ ID NO: 1090377 - RNA, 19 nt, Mycobacterium bovis subsp bovis AF2122/97
gaucggcacuagcgagccg

SEQ ID NO: 1090378 - RNA, 22 nt, Mycobacterium bovis subsp bovis AF2122/97
gaucggcacuagcgagccggcg

SEQ ID NO: 1090379 - RNA, 19 nt, Mycobacterium bovis subsp bovis AF2122/97
gaucggcacuuagcccgau

SEQ ID NO: 1090380 - RNA, 23 nt, Mycobacterium bovis subsp bovis AF2122/97
gaucggcagucccagcgccgcac

SEQ ID NO: 1090381 - RNA, 17 nt, Mycobacterium bovis subsp bovis AF2122/97
gaucggcaaaccgucgg

SEQ ID NO: 1090382 - RNA, 18 nt, Mycobacterium bovis subsp bovis AF2122/97
gaucggcaacccgcacca

SEQ ID NO: 1090383 - RNA, 19 nt, Mycobacterium bovis subsp bovis AF2122/97
gaucggcaacccgcaccag

SEQ ID NO: 1090384 - RNA, 22 nt, Mycobacterium bovis subsp bovis AF2122/97
gaucggcaacccgcaccagggu

SEQ ID NO: 1090385 - RNA, 21 nt, Mycobacterium bovis subsp bovis AF2122/97
gaucggacucggaauucggcg

SEQ ID NO: 1090386 - RNA, 13 nt, Mycobacterium bovis subsp bovis AF2122/97
gaucggaucgaag

SEQ ID NO: 1090387 - RNA, 13 nt, Mycobacterium bovis subsp bovis AF2122/97
gaucggaucggca

SEQ ID NO: 1090388 - RNA, 18 nt, Mycobacterium bovis subsp bovis AF2122/97
gaucggauggugugucgg

SEQ ID NO: 1090389 - RNA, 19 nt, Mycobacterium bovis subsp bovis AF2122/97
gaucggauggugugucggg

SEQ ID NO: 1090390 - RNA, 13 nt, Mycobacterium bovis subsp bovis AF2122/97
gaucgcggcgacc

SEQ ID NO: 1090391 - RNA, 20 nt, Mycobacterium bovis subsp bovis AF2122/97
gaucgcggcgacccggucgc

SEQ ID NO: 1090392 - RNA, 20 nt, Mycobacterium bovis subsp bovis AF2122/97
gaucgcgcccugcggaucgg

SEQ ID NO: 1090393 - RNA, 22 nt, Mycobacterium bovis subsp bovis AF2122/97
gaucgcggcaaugaggccgucu

SEQ ID NO: 1090394 - RNA, 17 nt, Mycobacterium bovis subsp bovis AF2122/97
gaucgcggcgagcacca

SEQ ID NO: 1090395 - RNA, 18 nt, Mycobacterium bovis subsp bovis AF2122/97
gaucgcggcgagcaccac

SEQ ID NO: 1090396 - RNA, 18 nt, Mycobacterium bovis subsp bovis AF2122/97
gaucgcggcggcgauccg

SEQ ID NO: 1090397 - RNA, 15 nt, Mycobacterium bovis subsp bovis AF2122/97
gaucgcggcggcgug

SEQ ID NO: 1090398 - RNA, 23 nt, Mycobacterium bovis subsp bovis AF2122/97
gaucgcgccgucgucgaccacga

SEQ ID NO: 1090399 - RNA, 16 nt, Mycobacterium bovis subsp bovis AF2122/97
gaucgcgccgucggcg

SEQ ID NO: 1090400 - RNA, 18 nt, Mycobacterium bovis subsp bovis AF2122/97
gaucgcgccgucggcgau

SEQ ID NO: 1090401 - RNA, 13 nt, Mycobacterium bovis subsp bovis AF2122/97
gaucgcgcugauc

SEQ ID NO: 1090402 - RNA, 21 nt, Mycobacterium bovis subsp bovis AF2122/97
gaucgcgcugaaggccgguag

SEQ ID NO: 1090403 - RNA, 19 nt, Mycobacterium bovis subsp bovis AF2122/97
gaucgcgcugaucagccca

SEQ ID NO: 1090404 - RNA, 14 nt, Mycobacterium bovis subsp bovis AF2122/97
gaucgcgcugcggg

SEQ ID NO: 1090405 - RNA, 13 nt, Mycobacterium bovis subsp bovis AF2122/97
gaucgcgcuggcg

SEQ ID NO: 1090406 - RNA, 18 nt, Mycobacterium bovis subsp bovis AF2122/97
gaucgcggacacugcgaa

SEQ ID NO: 1090407 - RNA, 16 nt, Mycobacterium bovis subsp bovis AF2122/97
gaucgcggacccgucg

SEQ ID NO: 1090408 - RNA, 19 nt, Mycobacterium bovis subsp bovis AF2122/97
gaucgcggacccgucggcg

SEQ ID NO: 1090409 - RNA, 19 nt, Mycobacterium bovis subsp bovis AF2122/97
gaucgcuccgcggcgcagc

SEQ ID NO: 1090410 - RNA, 21 nt, Mycobacterium bovis subsp bovis AF2122/97
gaucgcuccggcccugccgcc

SEQ ID NO: 1090411 - RNA, 13 nt, Mycobacterium bovis subsp bovis AF2122/97
gaucgcugccagc

SEQ ID NO: 1090412 - RNA, 23 nt, Mycobacterium bovis subsp bovis AF2122/97
gaucgcugccagcggccgggcgg

SEQ ID NO: 1090413 - RNA, 20 nt, Mycobacterium bovis subsp bovis AF2122/97
gaucgcguuagccaggucga

SEQ ID NO: 1090414 - RNA, 15 nt, Mycobacterium bovis subsp bovis AF2122/97
gaucgcuacgucgac

SEQ ID NO: 1090415 - RNA, 20 nt, Mycobacterium bovis subsp bovis AF2122/97
gaucgcucauucgugcccgg

SEQ ID NO: 1090416 - RNA, 14 nt, Mycobacterium bovis subsp bovis AF2122/97
gaucgcuggcgacc

SEQ ID NO: 1090417 - RNA, 19 nt, Mycobacterium bovis subsp bovis AF2122/97
gaucgcugcgaagccgagc

SEQ ID NO: 1090418 - RNA, 19 nt, Mycobacterium bovis subsp bovis AF2122/97
gaucgcuggccgcgaggua

SEQ ID NO: 1090419 - RNA, 15 nt, Mycobacterium bovis subsp bovis AF2122/97
gaucgcguggaucgc

SEQ ID NO: 1090420 - RNA, 17 nt, Mycobacterium bovis subsp bovis AF2122/97
gaucgcguggcgcacca

SEQ ID NO: 1090421 - RNA, 18 nt, Mycobacterium bovis subsp bovis AF2122/97
gaucgcguggcgcaccac

SEQ ID NO: 1090422 - RNA, 23 nt, Mycobacterium bovis subsp bovis AF2122/97
gaucgcguggcgcaccaccgccc

SEQ ID NO: 1090423 - RNA, 15 nt, Mycobacterium bovis subsp bovis AF2122/97
gaucgcgucgggcuc

SEQ ID NO: 1090424 - RNA, 16 nt, Mycobacterium bovis subsp bovis AF2122/97
gaucgcgucgggcucg

SEQ ID NO: 1090425 - RNA, 17 nt, Mycobacterium bovis subsp bovis AF2122/97
gaucgcgucgggcucgg

SEQ ID NO: 1090426 - RNA, 19 nt, Mycobacterium bovis subsp bovis AF2122/97
gaucgcgucgggcucggcg

SEQ ID NO: 1090427 - RNA, 19 nt, Mycobacterium bovis subsp bovis AF2122/97
gaucgcggugggccccgau

SEQ ID NO: 1090428 - RNA, 17 nt, Mycobacterium bovis subsp bovis AF2122/97
gaucgcguccgccucgg

SEQ ID NO: 1090429 - RNA, 21 nt, Mycobacterium bovis subsp bovis AF2122/97
gaucgcguccgccucgggugc

SEQ ID NO: 1090430 - RNA, 17 nt, Mycobacterium bovis subsp bovis AF2122/97
gaucgcggugaccggcu

SEQ ID NO: 1090431 - RNA, 15 nt, Mycobacterium bovis subsp bovis AF2122/97
gaucgcgguccaaca

SEQ ID NO: 1090432 - RNA, 20 nt, Mycobacterium bovis subsp bovis AF2122/97
gaucgcgguccgagcggcau

SEQ ID NO: 1090433 - RNA, 13 nt, Mycobacterium bovis subsp bovis AF2122/97
gcacggcgucggc

SEQ ID NO: 1090434 - RNA, 15 nt, Mycobacterium bovis subsp bovis AF2122/97
gcacggcgucggcca

SEQ ID NO: 1090435 - RNA, 17 nt, Mycobacterium bovis subsp bovis AF2122/97
gcacggcgucggccacc

SEQ ID NO: 1090436 - RNA, 13 nt, Mycobacterium bovis subsp bovis AF2122/97
gcacggcuggcgu

SEQ ID NO: 1090437 - RNA, 15 nt, Mycobacterium bovis subsp bovis AF2122/97
gcacggcgugucgag

SEQ ID NO: 1090438 - RNA, 14 nt, Mycobacterium bovis subsp bovis AF2122/97
gcacgggccaccag

SEQ ID NO: 1090439 - RNA, 17 nt, Mycobacterium bovis subsp bovis AF2122/97
gcacggcuuuucgacgc

SEQ ID NO: 1090440 - RNA, 16 nt, Mycobacterium bovis subsp bovis AF2122/97
gcacggcuucgaccau

SEQ ID NO: 1090441 - RNA, 13 nt, Mycobacterium bovis subsp bovis AF2122/97
gcacggcuucggc

SEQ ID NO: 1090442 - RNA, 20 nt, Mycobacterium bovis subsp bovis AF2122/97
gcacgggcggggacggcggc

SEQ ID NO: 1090443 - RNA, 19 nt, Mycobacterium bovis subsp bovis AF2122/97
gcacgggcucgcugcacca

SEQ ID NO: 1090444 - RNA, 15 nt, Mycobacterium bovis subsp bovis AF2122/97
gcacggcuucggcga

SEQ ID NO: 1090445 - RNA, 15 nt, Mycobacterium bovis subsp bovis AF2122/97
gcacgggcggccaug

SEQ ID NO: 1090446 - RNA, 20 nt, Mycobacterium bovis subsp bovis AF2122/97
gcacggugaugaggaucgcg

SEQ ID NO: 1090447 - RNA, 17 nt, Mycobacterium bovis subsp bovis AF2122/97
gcacggugaucagcagc

SEQ ID NO: 1090448 - RNA, 18 nt, Mycobacterium bovis subsp bovis AF2122/97
gcacggugaacggcaagg

SEQ ID NO: 1090449 - RNA, 22 nt, Mycobacterium bovis subsp bovis AF2122/97
gcacggugagccgguggcccgc

SEQ ID NO: 1090450 - RNA, 14 nt, Mycobacterium bovis subsp bovis AF2122/97
gcacggugaucagc

SEQ ID NO: 1090451 - RNA, 24 nt, Mycobacterium bovis subsp bovis AF2122/97
gcacggugcugaucgguccggcga

SEQ ID NO: 1090452 - RNA, 14 nt, Mycobacterium bovis subsp bovis AF2122/97
gcacgguggccgag

SEQ ID NO: 1090453 - RNA, 17 nt, Mycobacterium bovis subsp bovis AF2122/97
gcacgguggccgagccg

SEQ ID NO: 1090454 - RNA, 21 nt, Mycobacterium bovis subsp bovis AF2122/97
gcacgguggcuucgacggcgg

SEQ ID NO: 1090455 - RNA, 22 nt, Mycobacterium bovis subsp bovis AF2122/97
gcacgguggcuucgacggcggc

SEQ ID NO: 1090456 - RNA, 20 nt, Mycobacterium bovis subsp bovis AF2122/97
gcacgguggcuucgacggcg

SEQ ID NO: 1090457 - RNA, 16 nt, Mycobacterium bovis subsp bovis AF2122/97
gcacgguguacgcccg

SEQ ID NO: 1090458 - RNA, 20 nt, Mycobacterium bovis subsp bovis AF2122/97
gcacggugugcacggcgaau

SEQ ID NO: 1090459 - RNA, 13 nt, Mycobacterium bovis subsp bovis AF2122/97
gcacgguguacgc

SEQ ID NO: 1090460 - RNA, 16 nt, Mycobacterium bovis subsp bovis AF2122/97
gcacggugucgcgcga

SEQ ID NO: 1090461 - RNA, 14 nt, Mycobacterium bovis subsp bovis AF2122/97
gcacgguguauccg

SEQ ID NO: 1090462 - RNA, 17 nt, Mycobacterium bovis subsp bovis AF2122/97
gcacggugggcgcuggg

SEQ ID NO: 1090463 - RNA, 13 nt, Mycobacterium bovis subsp bovis AF2122/97
gcacgucccggua

SEQ ID NO: 1090464 - RNA, 22 nt, Mycobacterium bovis subsp bovis AF2122/97
gcacguccgaucggcgcgccga

SEQ ID NO: 1090465 - RNA, 13 nt, Mycobacterium bovis subsp bovis AF2122/97
gcacgucgagcag

SEQ ID NO: 1090466 - RNA, 14 nt, Mycobacterium bovis subsp bovis AF2122/97
gcacgucgaccucg

SEQ ID NO: 1090467 - RNA, 16 nt, Mycobacterium bovis subsp bovis AF2122/97
gcacgucgaccucggc

SEQ ID NO: 1090468 - RNA, 21 nt, Mycobacterium bovis subsp bovis AF2122/97
gcacgucgagcaggcuggcug

SEQ ID NO: 1090469 - RNA, 13 nt, Mycobacterium bovis subsp bovis AF2122/97
gcacgucgaggcg

SEQ ID NO: 1090470 - RNA, 23 nt, Mycobacterium bovis subsp bovis AF2122/97
gcacgucgaaaucggugcacaac

SEQ ID NO: 1090471 - RNA, 14 nt, Mycobacterium bovis subsp bovis AF2122/97
gcacgucgaacucg

SEQ ID NO: 1090472 - RNA, 20 nt, Mycobacterium bovis subsp bovis AF2122/97
gcacgcgcgcaggccgccgc

SEQ ID NO: 1090473 - RNA, 21 nt, Mycobacterium bovis subsp bovis AF2122/97
gcacgcgcgcaggccgccgcc

SEQ ID NO: 1090474 - RNA, 14 nt, Mycobacterium bovis subsp bovis AF2122/97
gcacgccggcggcg

SEQ ID NO: 1090475 - RNA, 15 nt, Mycobacterium bovis subsp bovis AF2122/97
gcacgccggcggcgg

SEQ ID NO: 1090476 - RNA, 13 nt, Mycobacterium bovis subsp bovis AF2122/97
gcacgccggcggc

SEQ ID NO: 1090477 - RNA, 16 nt, Mycobacterium bovis subsp bovis AF2122/97
gcacgcgggaagugca

SEQ ID NO: 1090478 - RNA, 21 nt, Mycobacterium bovis subsp bovis AF2122/97
gcacgcgggaagugcacccgg

SEQ ID NO: 1090479 - RNA, 17 nt, Mycobacterium bovis subsp bovis AF2122/97
gcacgcgggcacuggug

SEQ ID NO: 1090480 - RNA, 12 nt, Mycobacterium bovis subsp bovis AF2122/97
gcacgccggcgc

SEQ ID NO: 1090481 - RNA, 12 nt, Mycobacterium bovis subsp bovis AF2122/97
gcacgccggcca

SEQ ID NO: 1090482 - RNA, 12 nt, Mycobacterium bovis subsp bovis AF2122/97
gcacgccgccgg

SEQ ID NO: 1090483 - RNA, 17 nt, Mycobacterium bovis subsp bovis AF2122/97
gcacgccgccggccgcc

SEQ ID NO: 1090484 - RNA, 14 nt, Mycobacterium bovis subsp bovis AF2122/97
gcacgccgccgacg

SEQ ID NO: 1090485 - RNA, 17 nt, Mycobacterium bovis subsp bovis AF2122/97
gcacggaccgcgucgcg

SEQ ID NO: 1090486 - RNA, 18 nt, Mycobacterium bovis subsp bovis AF2122/97
gcacggaccgcgucgcgg

SEQ ID NO: 1090487 - RNA, 15 nt, Mycobacterium bovis subsp bovis AF2122/97
gcacggagccgccgg

SEQ ID NO: 1090488 - RNA, 16 nt, Mycobacterium bovis subsp bovis AF2122/97
gcacggagccgccggc

SEQ ID NO: 1090489 - RNA, 18 nt, Mycobacterium bovis subsp bovis AF2122/97
gcacggagccgccggcgg

SEQ ID NO: 1090490 - RNA, 21 nt, Mycobacterium bovis subsp bovis AF2122/97
gcacgcuggcguuguugacga

SEQ ID NO: 1090491 - RNA, 21 nt, Mycobacterium bovis subsp bovis AF2122/97
gcacggaaggcccggcgcggc

SEQ ID NO: 1090492 - RNA, 15 nt, Mycobacterium bovis subsp bovis AF2122/97
gcacggaaggucgac

SEQ ID NO: 1090493 - RNA, 15 nt, Mycobacterium bovis subsp bovis AF2122/97
gcacggaaucgcauc

SEQ ID NO: 1090494 - RNA, 17 nt, Mycobacterium bovis subsp bovis AF2122/97
gcacggaugaugccggu

SEQ ID NO: 1090495 - RNA, 20 nt, Mycobacterium bovis subsp bovis AF2122/97
gcacggaugaugccgguguu

SEQ ID NO: 1090496 - RNA, 19 nt, Mycobacterium bovis subsp bovis AF2122/97
gcacggaugcgauggccga

SEQ ID NO: 1090497 - RNA, 21 nt, Mycobacterium bovis subsp bovis AF2122/97
gcacggaugcgauggccgacg

SEQ ID NO: 1090498 - RNA, 16 nt, Mycobacterium bovis subsp bovis AF2122/97
gcacggaugucgccca

SEQ ID NO: 1090499 - RNA, 21 nt, Mycobacterium bovis subsp bovis AF2122/97
gcacggcggccagggugcccu

SEQ ID NO: 1090500 - RNA, 16 nt, Mycobacterium bovis subsp bovis AF2122/97
gcacgcguucaacgaa

SEQ ID NO: 1090501 - RNA, 22 nt, Mycobacterium bovis subsp bovis AF2122/97
gcacgcgguucaccacgucguc

SEQ ID NO: 1090502 - RNA, 23 nt, Mycobacterium bovis subsp bovis AF2122/97
gcacgcgguucaccacgucgucg

SEQ ID NO: 1090503 - RNA, 15 nt, Mycobacterium bovis subsp bovis AF2122/97
gcacgcuggcgggca

SEQ ID NO: 1090504 - RNA, 12 nt, Mycobacterium bovis subsp bovis AF2122/97
gcacgcuggcgu

SEQ ID NO: 1090505 - RNA, 13 nt, Mycobacterium bovis subsp bovis AF2122/97
gcacgcagccgau

SEQ ID NO: 1090506 - RNA, 14 nt, Mycobacterium bovis subsp bovis AF2122/97
gcacgcacagcccg

SEQ ID NO: 1090507 - RNA, 15 nt, Mycobacterium bovis subsp bovis AF2122/97
gcacgccgaccagca

SEQ ID NO: 1090508 - RNA, 19 nt, Mycobacterium bovis subsp bovis AF2122/97
gcacgccgaccagcacccg

SEQ ID NO: 1090509 - RNA, 22 nt, Mycobacterium bovis subsp bovis AF2122/97
gcacgccgaccggcccgcaucc

SEQ ID NO: 1090510 - RNA, 16 nt, Mycobacterium bovis subsp bovis AF2122/97
gcacgauggccgucga

SEQ ID NO: 1090511 - RNA, 15 nt, Mycobacterium bovis subsp bovis AF2122/97
gcacgauggugugca

SEQ ID NO: 1090512 - RNA, 21 nt, Mycobacterium bovis subsp bovis AF2122/97
gcacgauuucgagcgcugcuc

SEQ ID NO: 1090513 - RNA, 21 nt, Mycobacterium bovis subsp bovis AF2122/97
gcacgcaacaccgccaacucc

SEQ ID NO: 1090514 - RNA, 14 nt, Mycobacterium bovis subsp bovis AF2122/97
gcacgaccaccgga

SEQ ID NO: 1090515 - RNA, 15 nt, Mycobacterium bovis subsp bovis AF2122/97
gcacgcaaugcgggc

SEQ ID NO: 1090516 - RNA, 18 nt, Mycobacterium bovis subsp bovis AF2122/97
gcacgcaaugcgggcccu

SEQ ID NO: 1090517 - RNA, 21 nt, Mycobacterium bovis subsp bovis AF2122/97
gcacgcaaugucggcagggcc

SEQ ID NO: 1090518 - RNA, 20 nt, Mycobacterium bovis subsp bovis AF2122/97
gcacgaaagucaaucgcguc

SEQ ID NO: 1090519 - RNA, 18 nt, Mycobacterium bovis subsp bovis AF2122/97
gcacgaaaucagcccgcc

SEQ ID NO: 1090520 - RNA, 22 nt, Mycobacterium bovis subsp bovis AF2122/97
gcacgaacaucagaucgccgac

SEQ ID NO: 1090521 - RNA, 16 nt, Mycobacterium bovis subsp bovis AF2122/97
gcacgacccgcugguc

SEQ ID NO: 1090522 - RNA, 13 nt, Mycobacterium bovis subsp bovis AF2122/97
gcacgaccgcucc

SEQ ID NO: 1090523 - RNA, 15 nt, Mycobacterium bovis subsp bovis AF2122/97
gcacgacgacaaccg

SEQ ID NO: 1090524 - RNA, 20 nt, Mycobacterium bovis subsp bovis AF2122/97
gcacgacgacaaccggccag

SEQ ID NO: 1090525 - RNA, 15 nt, Mycobacterium bovis subsp bovis AF2122/97
gcacgacgacaucga

SEQ ID NO: 1090526 - RNA, 15 nt, Mycobacterium bovis subsp bovis AF2122/97
gcacgacgguguccg

SEQ ID NO: 1090527 - RNA, 22 nt, Mycobacterium bovis subsp bovis AF2122/97
gcacgacgcgacacgccggcgg

SEQ ID NO: 1090528 - RNA, 18 nt, Mycobacterium bovis subsp bovis AF2122/97
gcacgacugcaucgucga

SEQ ID NO: 1090529 - RNA, 20 nt, Mycobacterium bovis subsp bovis AF2122/97
gcacgacugugcgccgcagc

SEQ ID NO: 1090530 - RNA, 23 nt, Mycobacterium bovis subsp bovis AF2122/97
gcacgacugugcgccgcagccug

SEQ ID NO: 1090531 - RNA, 12 nt, Mycobacterium bovis subsp bovis AF2122/97
gcaccucgaccg

SEQ ID NO: 1090532 - RNA, 14 nt, Mycobacterium bovis subsp bovis AF2122/97
gcaccucggccucg

SEQ ID NO: 1090533 - RNA, 19 nt, Mycobacterium bovis subsp bovis AF2122/97
gcaccucggucccguugcc

SEQ ID NO: 1090534 - RNA, 17 nt, Mycobacterium bovis subsp bovis AF2122/97
gcaccucgucgaucgcc

SEQ ID NO: 1090535 - RNA, 21 nt, Mycobacterium bovis subsp bovis AF2122/97
gcaccucgucgaucgccgcgc

SEQ ID NO: 1090536 - RNA, 15 nt, Mycobacterium bovis subsp bovis AF2122/97
gcaccucccgggcga

SEQ ID NO: 1090537 - RNA, 21 nt, Mycobacterium bovis subsp bovis AF2122/97
gcaccuccgacggccgcggcg

SEQ ID NO: 1090538 - RNA, 16 nt, Mycobacterium bovis subsp bovis AF2122/97
gcaccuagucgcggcc

SEQ ID NO: 1090539 - RNA, 20 nt, Mycobacterium bovis subsp bovis AF2122/97
gcaccguuguaugcugcgcg

SEQ ID NO: 1090540 - RNA, 14 nt, Mycobacterium bovis subsp bovis AF2122/97
gcaccuccaccgcg

SEQ ID NO: 1090541 - RNA, 18 nt, Mycobacterium bovis subsp bovis AF2122/97
gcaccuccaccgcgccgg

SEQ ID NO: 1090542 - RNA, 17 nt, Mycobacterium bovis subsp bovis AF2122/97
gcaccuccagcaccacc

SEQ ID NO: 1090543 - RNA, 19 nt, Mycobacterium bovis subsp bovis AF2122/97
gcaccugcgcgcggccgcg

SEQ ID NO: 1090544 - RNA, 17 nt, Mycobacterium bovis subsp bovis AF2122/97
gcaccuugaccgucgcg

SEQ ID NO: 1090545 - RNA, 16 nt, Mycobacterium bovis subsp bovis AF2122/97
gcaccugccgaucggg

SEQ ID NO: 1090546 - RNA, 17 nt, Mycobacterium bovis subsp bovis AF2122/97
gcaccugaaggcggcga

SEQ ID NO: 1090547 - RNA, 12 nt, Mycobacterium bovis subsp bovis AF2122/97
gcaccucggcga

SEQ ID NO: 1090548 - RNA, 14 nt, Mycobacterium bovis subsp bovis AF2122/97
gcaccugagccuca

SEQ ID NO: 1090549 - RNA, 12 nt, Mycobacterium bovis subsp bovis AF2122/97
gcaccuuggccg

SEQ ID NO: 1090550 - RNA, 16 nt, Mycobacterium bovis subsp bovis AF2122/97
gcaccuuggccggccc

SEQ ID NO: 1090551 - RNA, 18 nt, Mycobacterium bovis subsp bovis AF2122/97
gcaccuuggccggccccg

SEQ ID NO: 1090552 - RNA, 15 nt, Mycobacterium bovis subsp bovis AF2122/97
gcacgaaaccgcagc

SEQ ID NO: 1090553 - RNA, 15 nt, Mycobacterium bovis subsp bovis AF2122/97
gcacgaaaaccgguu

SEQ ID NO: 1090554 - RNA, 14 nt, Mycobacterium bovis subsp bovis AF2122/97
gcaccgcggccgcg

SEQ ID NO: 1090555 - RNA, 19 nt, Mycobacterium bovis subsp bovis AF2122/97
gcaccgcggccagcgggaa

SEQ ID NO: 1090556 - RNA, 20 nt, Mycobacterium bovis subsp bovis AF2122/97
gcaccgcgggaucgguggcg

SEQ ID NO: 1090557 - RNA, 13 nt, Mycobacterium bovis subsp bovis AF2122/97
gcaccggcggcga

SEQ ID NO: 1090558 - RNA, 14 nt, Mycobacterium bovis subsp bovis AF2122/97
gcaccggcggcgac

SEQ ID NO: 1090559 - RNA, 15 nt, Mycobacterium bovis subsp bovis AF2122/97
gcaccggcggcgacg

SEQ ID NO: 1090560 - RNA, 23 nt, Mycobacterium bovis subsp bovis AF2122/97
gcaccggcggcgacggugccacc

SEQ ID NO: 1090561 - RNA, 14 nt, Mycobacterium bovis subsp bovis AF2122/97
gcaccggcgaucgu

SEQ ID NO: 1090562 - RNA, 15 nt, Mycobacterium bovis subsp bovis AF2122/97
gcaccggcgaucgug

SEQ ID NO: 1090563 - RNA, 19 nt, Mycobacterium bovis subsp bovis AF2122/97
gcaccggccgugccgccga

SEQ ID NO: 1090564 - RNA, 20 nt, Mycobacterium bovis subsp bovis AF2122/97
gcaccggccgugccgccgac

SEQ ID NO: 1090565 - RNA, 12 nt, Mycobacterium bovis subsp bovis AF2122/97
gcaccggcgcaa

SEQ ID NO: 1090566 - RNA, 14 nt, Mycobacterium bovis subsp bovis AF2122/97
gcaccggcggucug

SEQ ID NO: 1090567 - RNA, 21 nt, Mycobacterium bovis subsp bovis AF2122/97
gcaccggcgugguagacggcc

SEQ ID NO: 1090568 - RNA, 17 nt, Mycobacterium bovis subsp bovis AF2122/97
gcaccggcugcggggcg

SEQ ID NO: 1090569 - RNA, 18 nt, Mycobacterium bovis subsp bovis AF2122/97
gcaccggcugcggggcga

SEQ ID NO: 1090570 - RNA, 17 nt, Mycobacterium bovis subsp bovis AF2122/97
gcaccggcuggcccagc

SEQ ID NO: 1090571 - RNA, 14 nt, Mycobacterium bovis subsp bovis AF2122/97
gcaccggcgucggc

SEQ ID NO: 1090572 - RNA, 15 nt, Mycobacterium bovis subsp bovis AF2122/97
gcaccggcgucggcg

SEQ ID NO: 1090573 - RNA, 18 nt, Mycobacterium bovis subsp bovis AF2122/97
gcaccgcccccgucggcc

SEQ ID NO: 1090574 - RNA, 18 nt, Mycobacterium bovis subsp bovis AF2122/97
gcaccgccccgccguuga

SEQ ID NO: 1090575 - RNA, 17 nt, Mycobacterium bovis subsp bovis AF2122/97
gcaccgcgccggcggaa

SEQ ID NO: 1090576 - RNA, 14 nt, Mycobacterium bovis subsp bovis AF2122/97
gcaccgcgccgugg

SEQ ID NO: 1090577 - RNA, 17 nt, Mycobacterium bovis subsp bovis AF2122/97
gcaccgcggccagcggg

SEQ ID NO: 1090578 - RNA, 16 nt, Mycobacterium bovis subsp bovis AF2122/97
gcaccgccaguuccgg

SEQ ID NO: 1090579 - RNA, 15 nt, Mycobacterium bovis subsp bovis AF2122/97
gcaccgccaggucga

SEQ ID NO: 1090580 - RNA, 16 nt, Mycobacterium bovis subsp bovis AF2122/97
gcaccggggcugcccg

SEQ ID NO: 1090581 - RNA, 22 nt, Mycobacterium bovis subsp bovis AF2122/97
gcaccgggaagucggggucgcg

SEQ ID NO: 1090582 - RNA, 15 nt, Mycobacterium bovis subsp bovis AF2122/97
gcaccgggucaacgc

SEQ ID NO: 1090583 - RNA, 15 nt, Mycobacterium bovis subsp bovis AF2122/97
gcaccggggugugcg

SEQ ID NO: 1090584 - RNA, 18 nt, Mycobacterium bovis subsp bovis AF2122/97
gcaccggggugugcgggc

SEQ ID NO: 1090585 - RNA, 23 nt, Mycobacterium bovis subsp bovis AF2122/97
gcaccggggugugcgggcggugc

SEQ ID NO: 1090586 - RNA, 19 nt, Mycobacterium bovis subsp bovis AF2122/97
gcaccgguuugacguccag

SEQ ID NO: 1090587 - RNA, 13 nt, Mycobacterium bovis subsp bovis AF2122/97
gcaccgucacguc

SEQ ID NO: 1090588 - RNA, 15 nt, Mycobacterium bovis subsp bovis AF2122/97
gcaccgucagaccau

SEQ ID NO: 1090589 - RNA, 19 nt, Mycobacterium bovis subsp bovis AF2122/97
gcaccgucagcccgacguu

SEQ ID NO: 1090590 - RNA, 16 nt, Mycobacterium bovis subsp bovis AF2122/97
gcaccggguugagccg

SEQ ID NO: 1090591 - RNA, 18 nt, Mycobacterium bovis subsp bovis AF2122/97
gcaccggguugagccgcc

SEQ ID NO: 1090592 - RNA, 21 nt, Mycobacterium bovis subsp bovis AF2122/97
gcaccggguugagccgccgcg

SEQ ID NO: 1090593 - RNA, 22 nt, Mycobacterium bovis subsp bovis AF2122/97
gcaccggguugagccgccgcga

SEQ ID NO: 1090594 - RNA, 21 nt, Mycobacterium bovis subsp bovis AF2122/97
gcaccggugcucgucgagcau

SEQ ID NO: 1090595 - RNA, 23 nt, Mycobacterium bovis subsp bovis AF2122/97
gcaccggugcccaccaccgacag

SEQ ID NO: 1090596 - RNA, 19 nt, Mycobacterium bovis subsp bovis AF2122/97
gcaccgucucgcaccgcgu

SEQ ID NO: 1090597 - RNA, 22 nt, Mycobacterium bovis subsp bovis AF2122/97
gcaccgucgcuaugcgccgcau

SEQ ID NO: 1090598 - RNA, 12 nt, Mycobacterium bovis subsp bovis AF2122/97
gcaccgucggca

SEQ ID NO: 1090599 - RNA, 21 nt, Mycobacterium bovis subsp bovis AF2122/97
gcaccguccucggucacgauc

SEQ ID NO: 1090600 - RNA, 19 nt, Mycobacterium bovis subsp bovis AF2122/97
gcaccgugcggggggcagc

SEQ ID NO: 1090601 - RNA, 18 nt, Mycobacterium bovis subsp bovis AF2122/97
gcaccgugacagcggcau

SEQ ID NO: 1090602 - RNA, 15 nt, Mycobacterium bovis subsp bovis AF2122/97
gcaccguccucgguc

SEQ ID NO: 1090603 - RNA, 20 nt, Mycobacterium bovis subsp bovis AF2122/97
gcaccgugaguacucgguca

SEQ ID NO: 1090604 - RNA, 17 nt, Mycobacterium bovis subsp bovis AF2122/97
gcaccguggcggaucgc

SEQ ID NO: 1090605 - RNA, 17 nt, Mycobacterium bovis subsp bovis AF2122/97
gcaccgugucgacgguc

SEQ ID NO: 1090606 - RNA, 15 nt, Mycobacterium bovis subsp bovis AF2122/97
gcaccgugccgacgc

SEQ ID NO: 1090607 - RNA, 20 nt, Mycobacterium bovis subsp bovis AF2122/97
gcaccgugucuacgccggga

SEQ ID NO: 1090608 - RNA, 17 nt, Mycobacterium bovis subsp bovis AF2122/97
gcaccgugugggccccg

SEQ ID NO: 1090609 - RNA, 18 nt, Mycobacterium bovis subsp bovis AF2122/97
gcaccgugugggccccgc

SEQ ID NO: 1090610 - RNA, 16 nt, Mycobacterium bovis subsp bovis AF2122/97
gcaccguuuccggcgc

SEQ ID NO: 1090611 - RNA, 21 nt, Mycobacterium bovis subsp bovis AF2122/97
gcaccguuuccggcgcuccgc

SEQ ID NO: 1090612 - RNA, 20 nt, Mycobacterium bovis subsp bovis AF2122/97
gcaccguuaccgccgucgcc

SEQ ID NO: 1090613 - RNA, 21 nt, Mycobacterium bovis subsp bovis AF2122/97
gcaccguuaccgccgucgcca

SEQ ID NO: 1090614 - RNA, 22 nt, Mycobacterium bovis subsp bovis AF2122/97
gcaccguuaccgccgucgccac

SEQ ID NO: 1090615 - RNA, 17 nt, Mycobacterium bovis subsp bovis AF2122/97
gcaccuauggucaaccg

SEQ ID NO: 1090616 - RNA, 22 nt, Mycobacterium bovis subsp bovis AF2122/97
gcaccgaacguguucuggucgc

SEQ ID NO: 1090617 - RNA, 18 nt, Mycobacterium bovis subsp bovis AF2122/97
gcaccgaaaccaugccgc

SEQ ID NO: 1090618 - RNA, 19 nt, Mycobacterium bovis subsp bovis AF2122/97
gcaccgaaaccaugccgcc

SEQ ID NO: 1090619 - RNA, 21 nt, Mycobacterium bovis subsp bovis AF2122/97
gcaccgaaaccaugccgccga

SEQ ID NO: 1090620 - RNA, 22 nt, Mycobacterium bovis subsp bovis AF2122/97
gcaccgaaaccaugccgccgaa

SEQ ID NO: 1090621 - RNA, 17 nt, Mycobacterium bovis subsp bovis AF2122/97
gcaccgaaacgccgacc

SEQ ID NO: 1090622 - RNA, 23 nt, Mycobacterium bovis subsp bovis AF2122/97
gcaccgaaacgccgaccuucggc

SEQ ID NO: 1090623 - RNA, 18 nt, Mycobacterium bovis subsp bovis AF2122/97
gcaccgaacccgccaccg

SEQ ID NO: 1090624 - RNA, 22 nt, Mycobacterium bovis subsp bovis AF2122/97
gcaccgaacccgccaccgcgac

SEQ ID NO: 1090625 - RNA, 14 nt, Mycobacterium bovis subsp bovis AF2122/97
gcaccgaagauggc

SEQ ID NO: 1090626 - RNA, 18 nt, Mycobacterium bovis subsp bovis AF2122/97
gcaccgaagauggccagc

SEQ ID NO: 1090627 - RNA, 20 nt, Mycobacterium bovis subsp bovis AF2122/97
gcaccgaagauggccagcgc

SEQ ID NO: 1090628 - RNA, 13 nt, Mycobacterium bovis subsp bovis AF2122/97
gcaccgacaccgg

SEQ ID NO: 1090629 - RNA, 21 nt, Mycobacterium bovis subsp bovis AF2122/97
gcaccgacaccggccgcgacg

SEQ ID NO: 1090630 - RNA, 23 nt, Mycobacterium bovis subsp bovis AF2122/97
gcaccgacaccggccgcgacgga

SEQ ID NO: 1090631 - RNA, 15 nt, Mycobacterium bovis subsp bovis AF2122/97
gcaccgaccagggcc

SEQ ID NO: 1090632 - RNA, 12 nt, Mycobacterium bovis subsp bovis AF2122/97
gcaccgaccgca

SEQ ID NO: 1090633 - RNA, 13 nt, Mycobacterium bovis subsp bovis AF2122/97
gcaccgaccgcac

SEQ ID NO: 1090634 - RNA, 15 nt, Mycobacterium bovis subsp bovis AF2122/97
gcaccgaccgcaccg

SEQ ID NO: 1090635 - RNA, 19 nt, Mycobacterium bovis subsp bovis AF2122/97
gcaccgaccgcaccgugcc

SEQ ID NO: 1090636 - RNA, 14 nt, Mycobacterium bovis subsp bovis AF2122/97
gcaccgacaucguc

SEQ ID NO: 1090637 - RNA, 20 nt, Mycobacterium bovis subsp bovis AF2122/97
gcaccgaccugagucggcau

SEQ ID NO: 1090638 - RNA, 17 nt, Mycobacterium bovis subsp bovis AF2122/97
gcaccgacagcaguuuc

SEQ ID NO: 1090639 - RNA, 22 nt, Mycobacterium bovis subsp bovis AF2122/97
gcaccgacagcaguuucaccuu

SEQ ID NO: 1090640 - RNA, 15 nt, Mycobacterium bovis subsp bovis AF2122/97
gcaccgcagcgacca

SEQ ID NO: 1090641 - RNA, 21 nt, Mycobacterium bovis subsp bovis AF2122/97
gcaccgcagcgaccaccguca

SEQ ID NO: 1090642 - RNA, 15 nt, Mycobacterium bovis subsp bovis AF2122/97
gcaccgcagcggaac

SEQ ID NO: 1090643 - RNA, 22 nt, Mycobacterium bovis subsp bovis AF2122/97
gcaccgacugcugucaccgcaa

SEQ ID NO: 1090644 - RNA, 19 nt, Mycobacterium bovis subsp bovis AF2122/97
gcaccgacugcugucaccg

SEQ ID NO: 1090645 - RNA, 18 nt, Mycobacterium bovis subsp bovis AF2122/97
gcacccguucgugagcgg

SEQ ID NO: 1090646 - RNA, 16 nt, Mycobacterium bovis subsp bovis AF2122/97
gcacccguugaucgcg

SEQ ID NO: 1090647 - RNA, 20 nt, Mycobacterium bovis subsp bovis AF2122/97
gcacccguugcgacaccucc

SEQ ID NO: 1090648 - RNA, 16 nt, Mycobacterium bovis subsp bovis AF2122/97
gcacccguccgccgca

SEQ ID NO: 1090649 - RNA, 19 nt, Mycobacterium bovis subsp bovis AF2122/97
gcacccguccgccgcagac

SEQ ID NO: 1090650 - RNA, 22 nt, Mycobacterium bovis subsp bovis AF2122/97
gcacccguccgccgcagacgcc

SEQ ID NO: 1090651 - RNA, 18 nt, Mycobacterium bovis subsp bovis AF2122/97
gcacccguugcgacaccu

SEQ ID NO: 1090652 - RNA, 14 nt, Mycobacterium bovis subsp bovis AF2122/97
gcacccugcggcac

SEQ ID NO: 1090653 - RNA, 21 nt, Mycobacterium bovis subsp bovis AF2122/97
gcaccgaaaaacaccagcgag

SEQ ID NO: 1090654 - RNA, 17 nt, Mycobacterium bovis subsp bovis AF2122/97
gcacccuugccgauucc

SEQ ID NO: 1090655 - RNA, 19 nt, Mycobacterium bovis subsp bovis AF2122/97
gcacccuugccgauuccgg

SEQ ID NO: 1090656 - RNA, 13 nt, Mycobacterium bovis subsp bovis AF2122/97
gcacccgcuggcg

SEQ ID NO: 1090657 - RNA, 17 nt, Mycobacterium bovis subsp bovis AF2122/97
gcacccgcuggcgguaa

SEQ ID NO: 1090658 - RNA, 19 nt, Mycobacterium bovis subsp bovis AF2122/97
gcacccgcuggucgagcag

SEQ ID NO: 1090659 - RNA, 14 nt, Mycobacterium bovis subsp bovis AF2122/97
gcacccgcugcacg

SEQ ID NO: 1090660 - RNA, 20 nt, Mycobacterium bovis subsp bovis AF2122/97
gcacccgcuccagcucggcg

SEQ ID NO: 1090661 - RNA, 15 nt, Mycobacterium bovis subsp bovis AF2122/97
gcacccgcucggcgc

SEQ ID NO: 1090662 - RNA, 16 nt, Mycobacterium bovis subsp bovis AF2122/97
gcacccgcucggcgcg

SEQ ID NO: 1090663 - RNA, 17 nt, Mycobacterium bovis subsp bovis AF2122/97
gcacccgcuccagcucg

SEQ ID NO: 1090664 - RNA, 18 nt, Mycobacterium bovis subsp bovis AF2122/97
gcacccgcaguggucggc

SEQ ID NO: 1090665 - RNA, 18 nt, Mycobacterium bovis subsp bovis AF2122/97
gcacccgcacggccuccg

SEQ ID NO: 1090666 - RNA, 18 nt, Mycobacterium bovis subsp bovis AF2122/97
gcacccgccagggcggca

SEQ ID NO: 1090667 - RNA, 14 nt, Mycobacterium bovis subsp bovis AF2122/97
gcacccgcgcgacg

SEQ ID NO: 1090668 - RNA, 21 nt, Mycobacterium bovis subsp bovis AF2122/97
gcacccgccggauucgcccgg

SEQ ID NO: 1090669 - RNA, 17 nt, Mycobacterium bovis subsp bovis AF2122/97
gcacccagccgugccca

SEQ ID NO: 1090670 - RNA, 16 nt, Mycobacterium bovis subsp bovis AF2122/97
gcacccaggugucgcu

SEQ ID NO: 1090671 - RNA, 22 nt, Mycobacterium bovis subsp bovis AF2122/97
gcacccaggugucgcugcugaa

SEQ ID NO: 1090672 - RNA, 15 nt, Mycobacterium bovis subsp bovis AF2122/97
gcacccccugcaccg

SEQ ID NO: 1090673 - RNA, 23 nt, Mycobacterium bovis subsp bovis AF2122/97
gcaccccauacucggcggcuucg

SEQ ID NO: 1090674 - RNA, 14 nt, Mycobacterium bovis subsp bovis AF2122/97
gcaccccgaccacc

SEQ ID NO: 1090675 - RNA, 13 nt, Mycobacterium bovis subsp bovis AF2122/97
gcaccccgccggg

SEQ ID NO: 1090676 - RNA, 12 nt, Mycobacterium bovis subsp bovis AF2122/97
gcacccgcaccg

SEQ ID NO: 1090677 - RNA, 18 nt, Mycobacterium bovis subsp bovis AF2122/97
gcacccgcaccggugacg

SEQ ID NO: 1090678 - RNA, 17 nt, Mycobacterium bovis subsp bovis AF2122/97
gcacccgcacggccucc

SEQ ID NO: 1090679 - RNA, 17 nt, Mycobacterium bovis subsp bovis AF2122/97
gcacccccgucgaucag

SEQ ID NO: 1090680 - RNA, 15 nt, Mycobacterium bovis subsp bovis AF2122/97
gcacccccgucgcca

SEQ ID NO: 1090681 - RNA, 17 nt, Mycobacterium bovis subsp bovis AF2122/97
gcaccccauggccaccg

SEQ ID NO: 1090682 - RNA, 21 nt, Mycobacterium bovis subsp bovis AF2122/97
gcaccccauggccaccgaacg

SEQ ID NO: 1090683 - RNA, 23 nt, Mycobacterium bovis subsp bovis AF2122/97
gcaccccauggccaccgaacgcg

SEQ ID NO: 1090684 - RNA, 13 nt, Mycobacterium bovis subsp bovis AF2122/97
gcacagcaccacg

SEQ ID NO: 1090685 - RNA, 14 nt, Mycobacterium bovis subsp bovis AF2122/97
gcacagcagcaccg

SEQ ID NO: 1090686 - RNA, 17 nt, Mycobacterium bovis subsp bovis AF2122/97
gcacagcauuguccggc

SEQ ID NO: 1090687 - RNA, 18 nt, Mycobacterium bovis subsp bovis AF2122/97
gcacagcauuguccggcg

SEQ ID NO: 1090688 - RNA, 17 nt, Mycobacterium bovis subsp bovis AF2122/97
gcacagcaccacaucga

SEQ ID NO: 1090689 - RNA, 21 nt, Mycobacterium bovis subsp bovis AF2122/97
gcaccagucgucgcgcucgac

SEQ ID NO: 1090690 - RNA, 13 nt, Mycobacterium bovis subsp bovis AF2122/97
gcaccagucgccc

SEQ ID NO: 1090691 - RNA, 19 nt, Mycobacterium bovis subsp bovis AF2122/97
gcaccauacucaccgacgc

SEQ ID NO: 1090692 - RNA, 21 nt, Mycobacterium bovis subsp bovis AF2122/97
gcaccaguuugugccgccgcg

SEQ ID NO: 1090693 - RNA, 22 nt, Mycobacterium bovis subsp bovis AF2122/97
gcaccaguuugugccgccgcgg

SEQ ID NO: 1090694 - RNA, 16 nt, Mycobacterium bovis subsp bovis AF2122/97
gcagcgaggagcccgg

SEQ ID NO: 1090695 - RNA, 17 nt, Mycobacterium bovis subsp bovis AF2122/97
gcagcgaggcucgcagg

SEQ ID NO: 1090696 - RNA, 14 nt, Mycobacterium bovis subsp bovis AF2122/97
gcagcgagucgacg

SEQ ID NO: 1090697 - RNA, 20 nt, Mycobacterium bovis subsp bovis AF2122/97
gcagcgccacccgaucgggc

SEQ ID NO: 1090698 - RNA, 19 nt, Mycobacterium bovis subsp bovis AF2122/97
gcagcgccacccgcgucag

SEQ ID NO: 1090699 - RNA, 14 nt, Mycobacterium bovis subsp bovis AF2122/97
gcagcgccagcagc

SEQ ID NO: 1090700 - RNA, 19 nt, Mycobacterium bovis subsp bovis AF2122/97
gcagcgcccagaucgccga

SEQ ID NO: 1090701 - RNA, 13 nt, Mycobacterium bovis subsp bovis AF2122/97
gcagcgccaucga

SEQ ID NO: 1090702 - RNA, 16 nt, Mycobacterium bovis subsp bovis AF2122/97
gcagcgccaucgaggu

SEQ ID NO: 1090703 - RNA, 15 nt, Mycobacterium bovis subsp bovis AF2122/97
gcagccugcagcgaa

SEQ ID NO: 1090704 - RNA, 18 nt, Mycobacterium bovis subsp bovis AF2122/97
gcagcgacggcagcucgg

SEQ ID NO: 1090705 - RNA, 17 nt, Mycobacterium bovis subsp bovis AF2122/97
gcagcgacuccagcgcc

SEQ ID NO: 1090706 - RNA, 21 nt, Mycobacterium bovis subsp bovis AF2122/97
gcagcgacuccagcgcccggu

SEQ ID NO: 1090707 - RNA, 17 nt, Mycobacterium bovis subsp bovis AF2122/97
gcagccgcgacgcggcg

SEQ ID NO: 1090708 - RNA, 15 nt, Mycobacterium bovis subsp bovis AF2122/97
gcagcgagacuucga

SEQ ID NO: 1090709 - RNA, 22 nt, Mycobacterium bovis subsp bovis AF2122/97
gcagccugccgaugacgauggc

SEQ ID NO: 1090710 - RNA, 21 nt, Mycobacterium bovis subsp bovis AF2122/97
gcagccuggucgcgcagcucc

SEQ ID NO: 1090711 - RNA, 21 nt, Mycobacterium bovis subsp bovis AF2122/97
gcagccguagcugggcacccc

SEQ ID NO: 1090712 - RNA, 22 nt, Mycobacterium bovis subsp bovis AF2122/97
gcagccgaucgucucggccacg

SEQ ID NO: 1090713 - RNA, 13 nt, Mycobacterium bovis subsp bovis AF2122/97
gcagccgaccgaa

SEQ ID NO: 1090714 - RNA, 13 nt, Mycobacterium bovis subsp bovis AF2122/97
gcagccgagcuca

SEQ ID NO: 1090715 - RNA, 14 nt, Mycobacterium bovis subsp bovis AF2122/97
gcagccgaugucgc

SEQ ID NO: 1090716 - RNA, 19 nt, Mycobacterium bovis subsp bovis AF2122/97
gcagccgaugucgcgcgcu

SEQ ID NO: 1090717 - RNA, 24 nt, Mycobacterium bovis subsp bovis AF2122/97
gcagccgaugucgcgcgcuaggug

SEQ ID NO: 1090718 - RNA, 13 nt, Mycobacterium bovis subsp bovis AF2122/97
gcagccgcaccgg

SEQ ID NO: 1090719 - RNA, 12 nt, Mycobacterium bovis subsp bovis AF2122/97
gcagccgcagcc

SEQ ID NO: 1090720 - RNA, 17 nt, Mycobacterium bovis subsp bovis AF2122/97
gcagccgcgacauccgc

SEQ ID NO: 1090721 - RNA, 20 nt, Mycobacterium bovis subsp bovis AF2122/97
gcagccgcgacacgugcauc

SEQ ID NO: 1090722 - RNA, 13 nt, Mycobacterium bovis subsp bovis AF2122/97
gcagcccggggau

SEQ ID NO: 1090723 - RNA, 16 nt, Mycobacterium bovis subsp bovis AF2122/97
gcagccgaagcgcccg

SEQ ID NO: 1090724 - RNA, 21 nt, Mycobacterium bovis subsp bovis AF2122/97
gcagccgaaccggcaccagcg

SEQ ID NO: 1090725 - RNA, 14 nt, Mycobacterium bovis subsp bovis AF2122/97
gcagccgaaccggc

SEQ ID NO: 1090726 - RNA, 17 nt, Mycobacterium bovis subsp bovis AF2122/97
gcagccgaaccggcacc

SEQ ID NO: 1090727 - RNA, 20 nt, Mycobacterium bovis subsp bovis AF2122/97
gcagccgaaccggcaccagc

SEQ ID NO: 1090728 - RNA, 16 nt, Mycobacterium bovis subsp bovis AF2122/97
gcagcccgucggcgcc

SEQ ID NO: 1090729 - RNA, 21 nt, Mycobacterium bovis subsp bovis AF2122/97
gcagcccgucggcgccgaaca

SEQ ID NO: 1090730 - RNA, 12 nt, Mycobacterium bovis subsp bovis AF2122/97
gcagccgaaccg

SEQ ID NO: 1090731 - RNA, 23 nt, Mycobacterium bovis subsp bovis AF2122/97
gcagcccgguggugcugucgugg

SEQ ID NO: 1090732 - RNA, 18 nt, Mycobacterium bovis subsp bovis AF2122/97
gcagcccguucgugccgu

SEQ ID NO: 1090733 - RNA, 21 nt, Mycobacterium bovis subsp bovis AF2122/97
gcagcccguucgugccguuga

SEQ ID NO: 1090734 - RNA, 13 nt, Mycobacterium bovis subsp bovis AF2122/97
gcagcccugcgca

SEQ ID NO: 1090735 - RNA, 19 nt, Mycobacterium bovis subsp bovis AF2122/97
gcagcccugcgcagccgcc

SEQ ID NO: 1090736 - RNA, 20 nt, Mycobacterium bovis subsp bovis AF2122/97
gcagcccugcgcagccgccu

SEQ ID NO: 1090737 - RNA, 16 nt, Mycobacterium bovis subsp bovis AF2122/97
gcagccaggcugcgga

SEQ ID NO: 1090738 - RNA, 21 nt, Mycobacterium bovis subsp bovis AF2122/97
gcagccagcguccauggucgc

SEQ ID NO: 1090739 - RNA, 15 nt, Mycobacterium bovis subsp bovis AF2122/97
gcagccagcugaaca

SEQ ID NO: 1090740 - RNA, 16 nt, Mycobacterium bovis subsp bovis AF2122/97
gcagccagggcgccga

SEQ ID NO: 1090741 - RNA, 15 nt, Mycobacterium bovis subsp bovis AF2122/97
gcagccagcccagcc

SEQ ID NO: 1090742 - RNA, 18 nt, Mycobacterium bovis subsp bovis AF2122/97
gcagccagcccagccgcc

SEQ ID NO: 1090743 - RNA, 12 nt, Mycobacterium bovis subsp bovis AF2122/97
gcagccagcaac

SEQ ID NO: 1090744 - RNA, 18 nt, Mycobacterium bovis subsp bovis AF2122/97
gcagccagcaacaccaga

SEQ ID NO: 1090745 - RNA, 16 nt, Mycobacterium bovis subsp bovis AF2122/97
gcagccaccgucaugc

SEQ ID NO: 1090746 - RNA, 15 nt, Mycobacterium bovis subsp bovis AF2122/97
gcagccacgauccuu

SEQ ID NO: 1090747 - RNA, 13 nt, Mycobacterium bovis subsp bovis AF2122/97
gcagccaccagcg

SEQ ID NO: 1090748 - RNA, 20 nt, Mycobacterium bovis subsp bovis AF2122/97
gcagccacguuacgcucgcg

SEQ ID NO: 1090749 - RNA, 16 nt, Mycobacterium bovis subsp bovis AF2122/97
gcagccacgucucgcg

SEQ ID NO: 1090750 - RNA, 17 nt, Mycobacterium bovis subsp bovis AF2122/97
gcagccacgucucgcga

SEQ ID NO: 1090751 - RNA, 15 nt, Mycobacterium bovis subsp bovis AF2122/97
gcagccacguuacgc

SEQ ID NO: 1090752 - RNA, 19 nt, Mycobacterium bovis subsp bovis AF2122/97
gcagccacguuacgcucgc

SEQ ID NO: 1090753 - RNA, 20 nt, Mycobacterium bovis subsp bovis AF2122/97
gcagcauggugcggcggcgu

SEQ ID NO: 1090754 - RNA, 19 nt, Mycobacterium bovis subsp bovis AF2122/97
gcagcauguggccgccguc

SEQ ID NO: 1090755 - RNA, 15 nt, Mycobacterium bovis subsp bovis AF2122/97
gcagccaaugccgga

SEQ ID NO: 1090756 - RNA, 21 nt, Mycobacterium bovis subsp bovis AF2122/97
gcagccaaaaacgcugccgcc

SEQ ID NO: 1090757 - RNA, 15 nt, Mycobacterium bovis subsp bovis AF2122/97
gcagccaaccggcgc

SEQ ID NO: 1090758 - RNA, 16 nt, Mycobacterium bovis subsp bovis AF2122/97
gcagccaaccggcgca

SEQ ID NO: 1090759 - RNA, 15 nt, Mycobacterium bovis subsp bovis AF2122/97
gcagcaucucgucga

SEQ ID NO: 1090760 - RNA, 16 nt, Mycobacterium bovis subsp bovis AF2122/97
gcagcauguccgcagc

SEQ ID NO: 1090761 - RNA, 22 nt, Mycobacterium bovis subsp bovis AF2122/97
gcagcauguccgcagcggugcg

SEQ ID NO: 1090762 - RNA, 16 nt, Mycobacterium bovis subsp bovis AF2122/97
gcagcauggccaucgg

SEQ ID NO: 1090763 - RNA, 13 nt, Mycobacterium bovis subsp bovis AF2122/97
gcagcagugccgu

SEQ ID NO: 1090764 - RNA, 15 nt, Mycobacterium bovis subsp bovis AF2122/97
gcagcaguuggucgc

SEQ ID NO: 1090765 - RNA, 21 nt, Mycobacterium bovis subsp bovis AF2122/97
gcagcaggugagccaguuggc

SEQ ID NO: 1090766 - RNA, 15 nt, Mycobacterium bovis subsp bovis AF2122/97
gcagcaucuccgccg

SEQ ID NO: 1090767 - RNA, 17 nt, Mycobacterium bovis subsp bovis AF2122/97
gcagcaucuccgucggc

SEQ ID NO: 1090768 - RNA, 15 nt, Mycobacterium bovis subsp bovis AF2122/97
gcagcaucgucgcca

SEQ ID NO: 1090769 - RNA, 13 nt, Mycobacterium bovis subsp bovis AF2122/97
gcagcaucggcga

SEQ ID NO: 1090770 - RNA, 20 nt, Mycobacterium bovis subsp bovis AF2122/97
gcagcaucggcaccccggcc

SEQ ID NO: 1090771 - RNA, 20 nt, Mycobacterium bovis subsp bovis AF2122/97
gcagcaucggcacgucguug

SEQ ID NO: 1090772 - RNA, 13 nt, Mycobacterium bovis subsp bovis AF2122/97
gcagcaucacguc

SEQ ID NO: 1090773 - RNA, 15 nt, Mycobacterium bovis subsp bovis AF2122/97
gcagcaucaacaccg

SEQ ID NO: 1090774 - RNA, 18 nt, Mycobacterium bovis subsp bovis AF2122/97
gcagcaucacguccgcgg

SEQ ID NO: 1090775 - RNA, 17 nt, Mycobacterium bovis subsp bovis AF2122/97
gcagcauaaagaggucg

SEQ ID NO: 1090776 - RNA, 17 nt, Mycobacterium bovis subsp bovis AF2122/97
gcagcaggggacgacca

SEQ ID NO: 1090777 - RNA, 20 nt, Mycobacterium bovis subsp bovis AF2122/97
gcagcaggaaguagccgagc

SEQ ID NO: 1090778 - RNA, 14 nt, Mycobacterium bovis subsp bovis AF2122/97
gcagcaggcccacc

SEQ ID NO: 1090779 - RNA, 23 nt, Mycobacterium bovis subsp bovis AF2122/97
gcagcagcgugaccaccgccgac

SEQ ID NO: 1090780 - RNA, 16 nt, Mycobacterium bovis subsp bovis AF2122/97
gcagcagcgccgcgug

SEQ ID NO: 1090781 - RNA, 14 nt, Mycobacterium bovis subsp bovis AF2122/97
gcagcagcgcgcgg

SEQ ID NO: 1090782 - RNA, 12 nt, Mycobacterium bovis subsp bovis AF2122/97
gcagcagcggca

SEQ ID NO: 1090783 - RNA, 14 nt, Mycobacterium bovis subsp bovis AF2122/97
gcagcacgccagcc

SEQ ID NO: 1090784 - RNA, 15 nt, Mycobacterium bovis subsp bovis AF2122/97
gcagcacggcgccgc

SEQ ID NO: 1090785 - RNA, 16 nt, Mycobacterium bovis subsp bovis AF2122/97
gcagcacggcgccgcc

SEQ ID NO: 1090786 - RNA, 17 nt, Mycobacterium bovis subsp bovis AF2122/97
gcagcacggcgccgcca

SEQ ID NO: 1090787 - RNA, 20 nt, Mycobacterium bovis subsp bovis AF2122/97
gcagcacggcgccgccacgg

SEQ ID NO: 1090788 - RNA, 13 nt, Mycobacterium bovis subsp bovis AF2122/97
gcagcacgcgugg

SEQ ID NO: 1090789 - RNA, 19 nt, Mycobacterium bovis subsp bovis AF2122/97
gcagcagacccgguggcgu

SEQ ID NO: 1090790 - RNA, 18 nt, Mycobacterium bovis subsp bovis AF2122/97
gcagcacuuggacccggc

SEQ ID NO: 1090791 - RNA, 17 nt, Mycobacterium bovis subsp bovis AF2122/97
gcagcacucuucgauga

SEQ ID NO: 1090792 - RNA, 23 nt, Mycobacterium bovis subsp bovis AF2122/97
gcagcacuccggcgacgaucucg

SEQ ID NO: 1090793 - RNA, 14 nt, Mycobacterium bovis subsp bovis AF2122/97
gcagcacucgccca

SEQ ID NO: 1090794 - RNA, 16 nt, Mycobacterium bovis subsp bovis AF2122/97
gcagcacucgcccaag

SEQ ID NO: 1090795 - RNA, 15 nt, Mycobacterium bovis subsp bovis AF2122/97
gcagcacucgguguc

SEQ ID NO: 1090796 - RNA, 18 nt, Mycobacterium bovis subsp bovis AF2122/97
gcagcacguccgcggagc

SEQ ID NO: 1090797 - RNA, 17 nt, Mycobacterium bovis subsp bovis AF2122/97
gcagcacgucgaacucg

SEQ ID NO: 1090798 - RNA, 19 nt, Mycobacterium bovis subsp bovis AF2122/97
gcagcacggcuucgaccau

SEQ ID NO: 1090799 - RNA, 14 nt, Mycobacterium bovis subsp bovis AF2122/97
gcagcacgucacgc

SEQ ID NO: 1090800 - RNA, 20 nt, Mycobacterium bovis subsp bovis AF2122/97
gcagcacgucacgcaaccgg

SEQ ID NO: 1090801 - RNA, 16 nt, Mycobacterium bovis subsp bovis AF2122/97
gcagcacguccgcgga

SEQ ID NO: 1090802 - RNA, 21 nt, Mycobacterium bovis subsp bovis AF2122/97
gcagcagcgcuucggcggucg

SEQ ID NO: 1090803 - RNA, 13 nt, Mycobacterium bovis subsp bovis AF2122/97
gcagcagcgcagu

SEQ ID NO: 1090804 - RNA, 22 nt, Mycobacterium bovis subsp bovis AF2122/97
gcagcacuuggacccggccggc

SEQ ID NO: 1090805 - RNA, 20 nt, Mycobacterium bovis subsp bovis AF2122/97
gcagcagacgacgaucagcc

SEQ ID NO: 1090806 - RNA, 15 nt, Mycobacterium bovis subsp bovis AF2122/97
gcagcagauccuggc

SEQ ID NO: 1090807 - RNA, 22 nt, Mycobacterium bovis subsp bovis AF2122/97
gcagcagcaaaacccgagccug

SEQ ID NO: 1090808 - RNA, 16 nt, Mycobacterium bovis subsp bovis AF2122/97
gcagcagcccgggcag

SEQ ID NO: 1090809 - RNA, 17 nt, Mycobacterium bovis subsp bovis AF2122/97
gcagcagcccgggcagc

SEQ ID NO: 1090810 - RNA, 21 nt, Mycobacterium bovis subsp bovis AF2122/97
gcagcagcaucuggggguagc

SEQ ID NO: 1090811 - RNA, 21 nt, Mycobacterium bovis subsp bovis AF2122/97
gcagauggcgaggucggugag

SEQ ID NO: 1090812 - RNA, 21 nt, Mycobacterium bovis subsp bovis AF2122/97
gcagcacauccugcagcucgg

SEQ ID NO: 1090813 - RNA, 14 nt, Mycobacterium bovis subsp bovis AF2122/97
gcagcacccgcgcc

SEQ ID NO: 1090814 - RNA, 23 nt, Mycobacterium bovis subsp bovis AF2122/97
gcagcacccacaucagccgcacc

SEQ ID NO: 1090815 - RNA, 20 nt, Mycobacterium bovis subsp bovis AF2122/97
gcagcaccaggguggcccgg

SEQ ID NO: 1090816 - RNA, 14 nt, Mycobacterium bovis subsp bovis AF2122/97
gcagcaccgucggg

SEQ ID NO: 1090817 - RNA, 13 nt, Mycobacterium bovis subsp bovis AF2122/97
gcagcacccgggc

SEQ ID NO: 1090818 - RNA, 15 nt, Mycobacterium bovis subsp bovis AF2122/97
gcagcaccggcucga

SEQ ID NO: 1090819 - RNA, 18 nt, Mycobacterium bovis subsp bovis AF2122/97
gcagaucgauaccgucgu

SEQ ID NO: 1090820 - RNA, 17 nt, Mycobacterium bovis subsp bovis AF2122/97
gcagauccuggccggug

SEQ ID NO: 1090821 - RNA, 17 nt, Mycobacterium bovis subsp bovis AF2122/97
gcagaucgaaaucagcc

SEQ ID NO: 1090822 - RNA, 13 nt, Mycobacterium bovis subsp bovis AF2122/97
gcagaucccacgc

SEQ ID NO: 1090823 - RNA, 18 nt, Mycobacterium bovis subsp bovis AF2122/97
gcagauccccgccaccga

SEQ ID NO: 1090824 - RNA, 14 nt, Mycobacterium bovis subsp bovis AF2122/97
gcagaucucacgga

SEQ ID NO: 1090825 - RNA, 14 nt, Mycobacterium bovis subsp bovis AF2122/97
gcagaucgucgccg

SEQ ID NO: 1090826 - RNA, 15 nt, Mycobacterium bovis subsp bovis AF2122/97
gcagaucgucgccga

SEQ ID NO: 1090827 - RNA, 19 nt, Mycobacterium bovis subsp bovis AF2122/97
gcagaucguagugcgcgcc

SEQ ID NO: 1090828 - RNA, 19 nt, Mycobacterium bovis subsp bovis AF2122/97
gcagaucguccaccgccga

SEQ ID NO: 1090829 - RNA, 18 nt, Mycobacterium bovis subsp bovis AF2122/97
gcagaucggcucaccgaa

SEQ ID NO: 1090830 - RNA, 19 nt, Mycobacterium bovis subsp bovis AF2122/97
gcagaugaugccguucgga

SEQ ID NO: 1090831 - RNA, 23 nt, Mycobacterium bovis subsp bovis AF2122/97
gcagaugcggcugaauucggcga

SEQ ID NO: 1090832 - RNA, 16 nt, Mycobacterium bovis subsp bovis AF2122/97
gcagaugagcgcggcg

SEQ ID NO: 1090833 - RNA, 20 nt, Mycobacterium bovis subsp bovis AF2122/97
gcagaugagucaaaauccgc

SEQ ID NO: 1090834 - RNA, 20 nt, Mycobacterium bovis subsp bovis AF2122/97
gcagacccguucgccgucgg

SEQ ID NO: 1090835 - RNA, 20 nt, Mycobacterium bovis subsp bovis AF2122/97
gcagacccgguaguccgcgc

SEQ ID NO: 1090836 - RNA, 13 nt, Mycobacterium bovis subsp bovis AF2122/97
gcagacccggugg

SEQ ID NO: 1090837 - RNA, 15 nt, Mycobacterium bovis subsp bovis AF2122/97
gcagaauucggcgcg

SEQ ID NO: 1090838 - RNA, 15 nt, Mycobacterium bovis subsp bovis AF2122/97
gcagaccggcaucga

SEQ ID NO: 1090839 - RNA, 12 nt, Mycobacterium bovis subsp bovis AF2122/97
gcagaccgggug

SEQ ID NO: 1090840 - RNA, 19 nt, Mycobacterium bovis subsp bovis AF2122/97
gcagaccggugcugucgac

SEQ ID NO: 1090841 - RNA, 19 nt, Mycobacterium bovis subsp bovis AF2122/97
gcagaccggugagcaccgg

SEQ ID NO: 1090842 - RNA, 13 nt, Mycobacterium bovis subsp bovis AF2122/97
gcagaccgggugg

SEQ ID NO: 1090843 - RNA, 18 nt, Mycobacterium bovis subsp bovis AF2122/97
gcagaccgaccucggcga

SEQ ID NO: 1090844 - RNA, 16 nt, Mycobacterium bovis subsp bovis AF2122/97
gcagaaucggugggcg

SEQ ID NO: 1090845 - RNA, 22 nt, Mycobacterium bovis subsp bovis AF2122/97
gcagaaucgcauugggcgggcu

SEQ ID NO: 1090846 - RNA, 15 nt, Mycobacterium bovis subsp bovis AF2122/97
gcagaaucgcccaau

SEQ ID NO: 1090847 - RNA, 14 nt, Mycobacterium bovis subsp bovis AF2122/97
gcagaaucgccugc

SEQ ID NO: 1090848 - RNA, 23 nt, Mycobacterium bovis subsp bovis AF2122/97
gcagaaugucguaggcgccguug

SEQ ID NO: 1090849 - RNA, 14 nt, Mycobacterium bovis subsp bovis AF2122/97
gcagaauucggcgc

SEQ ID NO: 1090850 - RNA, 14 nt, Mycobacterium bovis subsp bovis AF2122/97
gcagaaggccagcg

SEQ ID NO: 1090851 - RNA, 16 nt, Mycobacterium bovis subsp bovis AF2122/97
gcagaaggccagcgaa

SEQ ID NO: 1090852 - RNA, 22 nt, Mycobacterium bovis subsp bovis AF2122/97
gcagaagcccccaaaccggcgg

SEQ ID NO: 1090853 - RNA, 15 nt, Mycobacterium bovis subsp bovis AF2122/97
gcagaauccggucgg

SEQ ID NO: 1090854 - RNA, 16 nt, Mycobacterium bovis subsp bovis AF2122/97
gcagaauccggucggc

SEQ ID NO: 1090855 - RNA, 18 nt, Mycobacterium bovis subsp bovis AF2122/97
gcagaauccguucgacga

SEQ ID NO: 1090856 - RNA, 15 nt, Mycobacterium bovis subsp bovis AF2122/97
gcagaaguccucggc

SEQ ID NO: 1090857 - RNA, 19 nt, Mycobacterium bovis subsp bovis AF2122/97
gcagaacggaccucggcgg

SEQ ID NO: 1090858 - RNA, 18 nt, Mycobacterium bovis subsp bovis AF2122/97
gcacguugugaucgucag

SEQ ID NO: 1090859 - RNA, 16 nt, Mycobacterium bovis subsp bovis AF2122/97
gcacguggaccggcac

SEQ ID NO: 1090860 - RNA, 20 nt, Mycobacterium bovis subsp bovis AF2122/97
gcacguucacgcgcggaucg

SEQ ID NO: 1090861 - RNA, 15 nt, Mycobacterium bovis subsp bovis AF2122/97
gcacguuggcggcca

SEQ ID NO: 1090862 - RNA, 23 nt, Mycobacterium bovis subsp bovis AF2122/97
gcacguuggcggccagcgcaccg

SEQ ID NO: 1090863 - RNA, 14 nt, Mycobacterium bovis subsp bovis AF2122/97
gcacguucggcgau

SEQ ID NO: 1090864 - RNA, 15 nt, Mycobacterium bovis subsp bovis AF2122/97
gcacguucggcgaug

SEQ ID NO: 1090865 - RNA, 15 nt, Mycobacterium bovis subsp bovis AF2122/97
gcacguucggcgcac

SEQ ID NO: 1090866 - RNA, 23 nt, Mycobacterium bovis subsp bovis AF2122/97
gcacguucggcgcacagcgagca

SEQ ID NO: 1090867 - RNA, 15 nt, Mycobacterium bovis subsp bovis AF2122/97
gcacguucggcgugu

SEQ ID NO: 1090868 - RNA, 23 nt, Mycobacterium bovis subsp bovis AF2122/97
gcacguccgaucggcgcgccgau

SEQ ID NO: 1090869 - RNA, 15 nt, Mycobacterium bovis subsp bovis AF2122/97
gcacgucgaggcggc

SEQ ID NO: 1090870 - RNA, 15 nt, Mycobacterium bovis subsp bovis AF2122/97
gcacguggccacggc

SEQ ID NO: 1090871 - RNA, 20 nt, Mycobacterium bovis subsp bovis AF2122/97
gcacguggcgaccggcgacc

SEQ ID NO: 1090872 - RNA, 20 nt, Mycobacterium bovis subsp bovis AF2122/97
gcacguggcgguacaccgac

SEQ ID NO: 1090873 - RNA, 19 nt, Mycobacterium bovis subsp bovis AF2122/97
gcagacgcggaaucgcauc

SEQ ID NO: 1090874 - RNA, 18 nt, Mycobacterium bovis subsp bovis AF2122/97
gcagacgcguuucgucga

SEQ ID NO: 1090875 - RNA, 19 nt, Mycobacterium bovis subsp bovis AF2122/97
gcagacgcuaaagcccccg

SEQ ID NO: 1090876 - RNA, 20 nt, Mycobacterium bovis subsp bovis AF2122/97
gcagacgcuaaagcccccgc

SEQ ID NO: 1090877 - RNA, 20 nt, Mycobacterium bovis subsp bovis AF2122/97
gcagacgcgaaagcacccca

SEQ ID NO: 1090878 - RNA, 21 nt, Mycobacterium bovis subsp bovis AF2122/97
gcagacgcgaaagcaccccaa

SEQ ID NO: 1090879 - RNA, 17 nt, Mycobacterium bovis subsp bovis AF2122/97
gcagacgcggaaucgca

SEQ ID NO: 1090880 - RNA, 17 nt, Mycobacterium bovis subsp bovis AF2122/97
gcagacgccgacuccgc

SEQ ID NO: 1090881 - RNA, 21 nt, Mycobacterium bovis subsp bovis AF2122/97
gcagacgcagagucgcacugc

SEQ ID NO: 1090882 - RNA, 19 nt, Mycobacterium bovis subsp bovis AF2122/97
gcagacgcauaagcccccg

SEQ ID NO: 1090883 - RNA, 20 nt, Mycobacterium bovis subsp bovis AF2122/97
gcagacgcauaagcccccga

SEQ ID NO: 1090884 - RNA, 20 nt, Mycobacterium bovis subsp bovis AF2122/97
gcagacgcauaagcccccgc

SEQ ID NO: 1090885 - RNA, 19 nt, Mycobacterium bovis subsp bovis AF2122/97
gcagacgcaaaaucgcacg

SEQ ID NO: 1090886 - RNA, 19 nt, Mycobacterium bovis subsp bovis AF2122/97
gcagacgcaaaaucgccca

SEQ ID NO: 1090887 - RNA, 19 nt, Mycobacterium bovis subsp bovis AF2122/97
gcagacgcaaaagcccccu

SEQ ID NO: 1090888 - RNA, 20 nt, Mycobacterium bovis subsp bovis AF2122/97
gcagacgcaaaaucgcccau

SEQ ID NO: 1090889 - RNA, 13 nt, Mycobacterium bovis subsp bovis AF2122/97
gcagacgcagaag

SEQ ID NO: 1090890 - RNA, 19 nt, Mycobacterium bovis subsp bovis AF2122/97
gcagacgcagaagccccca

SEQ ID NO: 1090891 - RNA, 21 nt, Mycobacterium bovis subsp bovis AF2122/97
gcagacgcagaaucgcacgcg

SEQ ID NO: 1090892 - RNA, 19 nt, Mycobacterium bovis subsp bovis AF2122/97
gcagacgcagaaucgccca

SEQ ID NO: 1090893 - RNA, 20 nt, Mycobacterium bovis subsp bovis AF2122/97
gcagacgaaguagccgacca

SEQ ID NO: 1090894 - RNA, 18 nt, Mycobacterium bovis subsp bovis AF2122/97
gcagaccuguccggcaua

SEQ ID NO: 1090895 - RNA, 20 nt, Mycobacterium bovis subsp bovis AF2122/97
gcagaccggugagcaccgga

SEQ ID NO: 1090896 - RNA, 17 nt, Mycobacterium bovis subsp bovis AF2122/97
gcagacgacaaccgagc

SEQ ID NO: 1090897 - RNA, 20 nt, Mycobacterium bovis subsp bovis AF2122/97
gcagacgacgaucagcccca

SEQ ID NO: 1090898 - RNA, 21 nt, Mycobacterium bovis subsp bovis AF2122/97
gcagauauugccugccacccg

SEQ ID NO: 1090899 - RNA, 16 nt, Mycobacterium bovis subsp bovis AF2122/97
gcagaucacgggugug

SEQ ID NO: 1090900 - RNA, 14 nt, Mycobacterium bovis subsp bovis AF2122/97
gcagaucagcacgu

SEQ ID NO: 1090901 - RNA, 17 nt, Mycobacterium bovis subsp bovis AF2122/97
gcagaucaggacgcgau

SEQ ID NO: 1090902 - RNA, 19 nt, Mycobacterium bovis subsp bovis AF2122/97
gcagaucaggacgcgaucg

SEQ ID NO: 1090903 - RNA, 21 nt, Mycobacterium bovis subsp bovis AF2122/97
gcagaucaggacgcgaucggc

SEQ ID NO: 1090904 - RNA, 14 nt, Mycobacterium bovis subsp bovis AF2122/97
gcagaucaccgcca

SEQ ID NO: 1090905 - RNA, 16 nt, Mycobacterium bovis subsp bovis AF2122/97
gcagaucaccgccagc

SEQ ID NO: 1090906 - RNA, 16 nt, Mycobacterium bovis subsp bovis AF2122/97
gcagauccaggcgucg

SEQ ID NO: 1090907 - RNA, 17 nt, Mycobacterium bovis subsp bovis AF2122/97
gcagauccaggcgucgg

SEQ ID NO: 1090908 - RNA, 21 nt, Mycobacterium bovis subsp bovis AF2122/97
gcagauccaggcgucggugac

SEQ ID NO: 1090909 - RNA, 20 nt, Mycobacterium bovis subsp bovis AF2122/97
gcagagccaacucccgcggu

SEQ ID NO: 1090910 - RNA, 12 nt, Mycobacterium bovis subsp bovis AF2122/97
gcagagccccgg

SEQ ID NO: 1090911 - RNA, 22 nt, Mycobacterium bovis subsp bovis AF2122/97
gcagagccgccguugccgccgg

SEQ ID NO: 1090912 - RNA, 16 nt, Mycobacterium bovis subsp bovis AF2122/97
gcagagccgucaccga

SEQ ID NO: 1090913 - RNA, 17 nt, Mycobacterium bovis subsp bovis AF2122/97
gcagagacaugccggcg

SEQ ID NO: 1090914 - RNA, 17 nt, Mycobacterium bovis subsp bovis AF2122/97
gcagagcaccgcgaaca

SEQ ID NO: 1090915 - RNA, 17 nt, Mycobacterium bovis subsp bovis AF2122/97
gcagagcacgcgcggcg

SEQ ID NO: 1090916 - RNA, 18 nt, Mycobacterium bovis subsp bovis AF2122/97
gcagagcacgcgcggcgu

SEQ ID NO: 1090917 - RNA, 19 nt, Mycobacterium bovis subsp bovis AF2122/97
gcagacguaaaagcccccg

SEQ ID NO: 1090918 - RNA, 17 nt, Mycobacterium bovis subsp bovis AF2122/97
gcagacgugguagccgg

SEQ ID NO: 1090919 - RNA, 21 nt, Mycobacterium bovis subsp bovis AF2122/97
gcagacgugguagccggcgac

SEQ ID NO: 1090920 - RNA, 19 nt, Mycobacterium bovis subsp bovis AF2122/97
gcagagaacuccgccacca

SEQ ID NO: 1090921 - RNA, 15 nt, Mycobacterium bovis subsp bovis AF2122/97
gcagacucgccaccg

SEQ ID NO: 1090922 - RNA, 21 nt, Mycobacterium bovis subsp bovis AF2122/97
gcagacucgccaccgcggcga

SEQ ID NO: 1090923 - RNA, 21 nt, Mycobacterium bovis subsp bovis AF2122/97
gcaacgaucagguuggcggcu

SEQ ID NO: 1090924 - RNA, 23 nt, Mycobacterium bovis subsp bovis AF2122/97
gcaacgaucagguuggcggcugc

SEQ ID NO: 1090925 - RNA, 16 nt, Mycobacterium bovis subsp bovis AF2122/97
gcaacgaucgacacca

SEQ ID NO: 1090926 - RNA, 20 nt, Mycobacterium bovis subsp bovis AF2122/97
gcaacgaggucugcggccga

SEQ ID NO: 1090927 - RNA, 17 nt, Mycobacterium bovis subsp bovis AF2122/97
gcaacgacccgccgccc

SEQ ID NO: 1090928 - RNA, 18 nt, Mycobacterium bovis subsp bovis AF2122/97
gcaacgagagcggcuccg

SEQ ID NO: 1090929 - RNA, 17 nt, Mycobacterium bovis subsp bovis AF2122/97
gcaacgacggccgucgc

SEQ ID NO: 1090930 - RNA, 19 nt, Mycobacterium bovis subsp bovis AF2122/97
gcaacgacgucgucgccgc

SEQ ID NO: 1090931 - RNA, 20 nt, Mycobacterium bovis subsp bovis AF2122/97
gcaaccuaaauugccgggcc

SEQ ID NO: 1090932 - RNA, 22 nt, Mycobacterium bovis subsp bovis AF2122/97
gcaaccugccgggccacggcug

SEQ ID NO: 1090933 - RNA, 14 nt, Mycobacterium bovis subsp bovis AF2122/97
gcaaccugaaucca

SEQ ID NO: 1090934 - RNA, 18 nt, Mycobacterium bovis subsp bovis AF2122/97
gcaaccucgccgucgucg

SEQ ID NO: 1090935 - RNA, 22 nt, Mycobacterium bovis subsp bovis AF2122/97
gcaaccucgguugguccucggc

SEQ ID NO: 1090936 - RNA, 19 nt, Mycobacterium bovis subsp bovis AF2122/97
gcaacgaagagggcgccgc

SEQ ID NO: 1090937 - RNA, 14 nt, Mycobacterium bovis subsp bovis AF2122/97
gcaacgaagccggc

SEQ ID NO: 1090938 - RNA, 22 nt, Mycobacterium bovis subsp bovis AF2122/97
gcaaccgguggaugaacaccuc

SEQ ID NO: 1090939 - RNA, 17 nt, Mycobacterium bovis subsp bovis AF2122/97
gcaaccgguaucgccgc

SEQ ID NO: 1090940 - RNA, 14 nt, Mycobacterium bovis subsp bovis AF2122/97
gcaaccggucagcc

SEQ ID NO: 1090941 - RNA, 17 nt, Mycobacterium bovis subsp bovis AF2122/97
gcaaccgcucaucgauc

SEQ ID NO: 1090942 - RNA, 12 nt, Mycobacterium bovis subsp bovis AF2122/97
gcaaccgcaccg

SEQ ID NO: 1090943 - RNA, 20 nt, Mycobacterium bovis subsp bovis AF2122/97
gcaaccgccggugccgauga

SEQ ID NO: 1090944 - RNA, 18 nt, Mycobacterium bovis subsp bovis AF2122/97
gcaaccgggaggccaccg

SEQ ID NO: 1090945 - RNA, 17 nt, Mycobacterium bovis subsp bovis AF2122/97
gcaaccggcgaucgguu

SEQ ID NO: 1090946 - RNA, 12 nt, Mycobacterium bovis subsp bovis AF2122/97
gcaaccggcgga

SEQ ID NO: 1090947 - RNA, 15 nt, Mycobacterium bovis subsp bovis AF2122/97
gcaacccgccguugc

SEQ ID NO: 1090948 - RNA, 13 nt, Mycobacterium bovis subsp bovis AF2122/97
gcaacccugccgc

SEQ ID NO: 1090949 - RNA, 16 nt, Mycobacterium bovis subsp bovis AF2122/97
gcaacccugccgcgau

SEQ ID NO: 1090950 - RNA, 16 nt, Mycobacterium bovis subsp bovis AF2122/97
gcaacccggacgaacg

SEQ ID NO: 1090951 - RNA, 17 nt, Mycobacterium bovis subsp bovis AF2122/97
gcaacccggugauggug

SEQ ID NO: 1090952 - RNA, 17 nt, Mycobacterium bovis subsp bovis AF2122/97
gcaaccgccggugccga

SEQ ID NO: 1090953 - RNA, 17 nt, Mycobacterium bovis subsp bovis AF2122/97
gcaaccgccaucgucga

SEQ ID NO: 1090954 - RNA, 18 nt, Mycobacterium bovis subsp bovis AF2122/97
gcaacccugccgcgauga

SEQ ID NO: 1090955 - RNA, 22 nt, Mycobacterium bovis subsp bovis AF2122/97
gcaaccgacacugggaucccga

SEQ ID NO: 1090956 - RNA, 14 nt, Mycobacterium bovis subsp bovis AF2122/97
gcaacgggcgaacu

SEQ ID NO: 1090957 - RNA, 15 nt, Mycobacterium bovis subsp bovis AF2122/97
gcaacgggucggcau

SEQ ID NO: 1090958 - RNA, 18 nt, Mycobacterium bovis subsp bovis AF2122/97
gcaacgucacgucgacgg

SEQ ID NO: 1090959 - RNA, 19 nt, Mycobacterium bovis subsp bovis AF2122/97
gcaacgucacgucgacggc

SEQ ID NO: 1090960 - RNA, 20 nt, Mycobacterium bovis subsp bovis AF2122/97
gcaacgucacgucgacggcg

SEQ ID NO: 1090961 - RNA, 14 nt, Mycobacterium bovis subsp bovis AF2122/97
gcaacgguacgcgc

SEQ ID NO: 1090962 - RNA, 18 nt, Mycobacterium bovis subsp bovis AF2122/97
gcaacgugugcaccauca

SEQ ID NO: 1090963 - RNA, 15 nt, Mycobacterium bovis subsp bovis AF2122/97
gcaacggcggcgucg

SEQ ID NO: 1090964 - RNA, 14 nt, Mycobacterium bovis subsp bovis AF2122/97
gcaacggcggcaac

SEQ ID NO: 1090965 - RNA, 17 nt, Mycobacterium bovis subsp bovis AF2122/97
gcaacggcggcaacggc

SEQ ID NO: 1090966 - RNA, 16 nt, Mycobacterium bovis subsp bovis AF2122/97
gcaacggcggcaucgg

SEQ ID NO: 1090967 - RNA, 17 nt, Mycobacterium bovis subsp bovis AF2122/97
gcaacggcggcaucggc

SEQ ID NO: 1090968 - RNA, 13 nt, Mycobacterium bovis subsp bovis AF2122/97
gcaacggcggcga

SEQ ID NO: 1090969 - RNA, 14 nt, Mycobacterium bovis subsp bovis AF2122/97
gcaacggcggcgac

SEQ ID NO: 1090970 - RNA, 17 nt, Mycobacterium bovis subsp bovis AF2122/97
gcaacggcgcgccgacc

SEQ ID NO: 1090971 - RNA, 21 nt, Mycobacterium bovis subsp bovis AF2122/97
gcaacggcacuagcccgaccg

SEQ ID NO: 1090972 - RNA, 20 nt, Mycobacterium bovis subsp bovis AF2122/97
gcaacggcggggccggcggc

SEQ ID NO: 1090973 - RNA, 14 nt, Mycobacterium bovis subsp bovis AF2122/97
gcaacggcggugaa

SEQ ID NO: 1090974 - RNA, 20 nt, Mycobacterium bovis subsp bovis AF2122/97
gcaacgggggcgccggagcc

SEQ ID NO: 1090975 - RNA, 21 nt, Mycobacterium bovis subsp bovis AF2122/97
gcaacggguacacccgcucgc

SEQ ID NO: 1090976 - RNA, 16 nt, Mycobacterium bovis subsp bovis AF2122/97
gcaacggguccgacgg

SEQ ID NO: 1090977 - RNA, 18 nt, Mycobacterium bovis subsp bovis AF2122/97
gcaacggguccgacggug

SEQ ID NO: 1090978 - RNA, 17 nt, Mycobacterium bovis subsp bovis AF2122/97
gcaacgcgucggucgcg

SEQ ID NO: 1090979 - RNA, 14 nt, Mycobacterium bovis subsp bovis AF2122/97
gcaacgcgucgucg

SEQ ID NO: 1090980 - RNA, 22 nt, Mycobacterium bovis subsp bovis AF2122/97
gcaacgcggucugcuccaggcg

SEQ ID NO: 1090981 - RNA, 20 nt, Mycobacterium bovis subsp bovis AF2122/97
gcaacgcgguggaccgcucg

SEQ ID NO: 1090982 - RNA, 21 nt, Mycobacterium bovis subsp bovis AF2122/97
gcaacgcgguggaccgcucga

SEQ ID NO: 1090983 - RNA, 21 nt, Mycobacterium bovis subsp bovis AF2122/97
gcaacgcuggaggcgaucugc

SEQ ID NO: 1090984 - RNA, 16 nt, Mycobacterium bovis subsp bovis AF2122/97
gcaacgcuucggcagc

SEQ ID NO: 1090985 - RNA, 17 nt, Mycobacterium bovis subsp bovis AF2122/97
gcaacgcuucggcagcu

SEQ ID NO: 1090986 - RNA, 15 nt, Mycobacterium bovis subsp bovis AF2122/97
gcaacggagcgagcu

SEQ ID NO: 1090987 - RNA, 18 nt, Mycobacterium bovis subsp bovis AF2122/97
gcaacggaggugccggcg

SEQ ID NO: 1090988 - RNA, 19 nt, Mycobacterium bovis subsp bovis AF2122/97
gcaacggaggugccggcgc

SEQ ID NO: 1090989 - RNA, 21 nt, Mycobacterium bovis subsp bovis AF2122/97
gcaacggaggugccggcgcca

SEQ ID NO: 1090990 - RNA, 22 nt, Mycobacterium bovis subsp bovis AF2122/97
gcaacggaggugccggcgccac

SEQ ID NO: 1090991 - RNA, 23 nt, Mycobacterium bovis subsp bovis AF2122/97
gcaacggaggugccggcgccacc

SEQ ID NO: 1090992 - RNA, 20 nt, Mycobacterium bovis subsp bovis AF2122/97
gcaacggauaacccguggcg

SEQ ID NO: 1090993 - RNA, 14 nt, Mycobacterium bovis subsp bovis AF2122/97
gcaacgccgcgccg

SEQ ID NO: 1090994 - RNA, 15 nt, Mycobacterium bovis subsp bovis AF2122/97
gcaacgccucgagca

SEQ ID NO: 1090995 - RNA, 18 nt, Mycobacterium bovis subsp bovis AF2122/97
gcaagauuauggcgagcg

SEQ ID NO: 1090996 - RNA, 18 nt, Mycobacterium bovis subsp bovis AF2122/97
gcaagcaaauucuggugu

SEQ ID NO: 1090997 - RNA, 12 nt, Mycobacterium bovis subsp bovis AF2122/97
gcaagcacaccg

SEQ ID NO: 1090998 - RNA, 14 nt, Mycobacterium bovis subsp bovis AF2122/97
gcaagcacaccgcc

SEQ ID NO: 1090999 - RNA, 15 nt, Mycobacterium bovis subsp bovis AF2122/97
gcaagcacaccgcca

SEQ ID NO: 1091000 - RNA, 19 nt, Mycobacterium bovis subsp bovis AF2122/97
gcaagcacaccgccagcgg

SEQ ID NO: 1091001 - RNA, 20 nt, Mycobacterium bovis subsp bovis AF2122/97
gcaagcacaccgccagcggc

SEQ ID NO: 1091002 - RNA, 17 nt, Mycobacterium bovis subsp bovis AF2122/97
gcaagcacgcgacggcg

SEQ ID NO: 1091003 - RNA, 15 nt, Mycobacterium bovis subsp bovis AF2122/97
gcaagcacggcgucg

SEQ ID NO: 1091004 - RNA, 19 nt, Mycobacterium bovis subsp bovis AF2122/97
gcaagccacgccggucgcg

SEQ ID NO: 1091005 - RNA, 22 nt, Mycobacterium bovis subsp bovis AF2122/97
gcaagccauucacgagccgcuc

SEQ ID NO: 1091006 - RNA, 20 nt, Mycobacterium bovis subsp bovis AF2122/97
gcaagcccaaaaagaccgcc

SEQ ID NO: 1091007 - RNA, 15 nt, Mycobacterium bovis subsp bovis AF2122/97
gcaagccgacaucgg

SEQ ID NO: 1091008 - RNA, 18 nt, Mycobacterium bovis subsp bovis AF2122/97
gcaagccgacaucggcgg

SEQ ID NO: 1091009 - RNA, 15 nt, Mycobacterium bovis subsp bovis AF2122/97
gcaagccgaacaccg

SEQ ID NO: 1091010 - RNA, 20 nt, Mycobacterium bovis subsp bovis AF2122/97
gcaagccgaacaccgucagc

SEQ ID NO: 1091011 - RNA, 21 nt, Mycobacterium bovis subsp bovis AF2122/97
gcaagccgaacaccgucagcg

SEQ ID NO: 1091012 - RNA, 19 nt, Mycobacterium bovis subsp bovis AF2122/97
gcaagcgugacccgccggc

SEQ ID NO: 1091013 - RNA, 21 nt, Mycobacterium bovis subsp bovis AF2122/97
gcaagcggacccgaccgucgu

SEQ ID NO: 1091014 - RNA, 15 nt, Mycobacterium bovis subsp bovis AF2122/97
gcaagcgccgcgcuu

SEQ ID NO: 1091015 - RNA, 18 nt, Mycobacterium bovis subsp bovis AF2122/97
gcaagcgccgcgcuugcg

SEQ ID NO: 1091016 - RNA, 14 nt, Mycobacterium bovis subsp bovis AF2122/97
gcaagcggacccga

SEQ ID NO: 1091017 - RNA, 16 nt, Mycobacterium bovis subsp bovis AF2122/97
gcaagcggacccgacc

SEQ ID NO: 1091018 - RNA, 16 nt, Mycobacterium bovis subsp bovis AF2122/97
gcaagcgcagacacga

SEQ ID NO: 1091019 - RNA, 19 nt, Mycobacterium bovis subsp bovis AF2122/97
gcaagcgcagacacgaccc

SEQ ID NO: 1091020 - RNA, 22 nt, Mycobacterium bovis subsp bovis AF2122/97
gcaagccguucugucccggcgc

SEQ ID NO: 1091021 - RNA, 18 nt, Mycobacterium bovis subsp bovis AF2122/97
gcaagccuaaaaccccga

SEQ ID NO: 1091022 - RNA, 17 nt, Mycobacterium bovis subsp bovis AF2122/97
gcaagccugcgcuguuc

SEQ ID NO: 1091023 - RNA, 22 nt, Mycobacterium bovis subsp bovis AF2122/97
gcaaggaaaagccuggccguug

SEQ ID NO: 1091024 - RNA, 14 nt, Mycobacterium bovis subsp bovis AF2122/97
gcaaggaauuccgg

SEQ ID NO: 1091025 - RNA, 19 nt, Mycobacterium bovis subsp bovis AF2122/97
gcaaggaccugugcggccg

SEQ ID NO: 1091026 - RNA, 16 nt, Mycobacterium bovis subsp bovis AF2122/97
gcaagcuaccggcccg

SEQ ID NO: 1091027 - RNA, 22 nt, Mycobacterium bovis subsp bovis AF2122/97
gcaagcuccaguagucggccga

SEQ ID NO: 1091028 - RNA, 19 nt, Mycobacterium bovis subsp bovis AF2122/97
gcaacucuucccauuucgg

SEQ ID NO: 1091029 - RNA, 23 nt, Mycobacterium bovis subsp bovis AF2122/97
gcaacucggccacggcgucggcc

SEQ ID NO: 1091030 - RNA, 12 nt, Mycobacterium bovis subsp bovis AF2122/97
gcaacucggcag

SEQ ID NO: 1091031 - RNA, 20 nt, Mycobacterium bovis subsp bovis AF2122/97
gcaacucgccgaaaucggcc

SEQ ID NO: 1091032 - RNA, 21 nt, Mycobacterium bovis subsp bovis AF2122/97
gcaacucgccgaaaucggcca

SEQ ID NO: 1091033 - RNA, 19 nt, Mycobacterium bovis subsp bovis AF2122/97
gcaacuacggcguccccga

SEQ ID NO: 1091034 - RNA, 16 nt, Mycobacterium bovis subsp bovis AF2122/97
gcaacugggcggccug

SEQ ID NO: 1091035 - RNA, 15 nt, Mycobacterium bovis subsp bovis AF2122/97
gcaacugcucgacga

SEQ ID NO: 1091036 - RNA, 22 nt, Mycobacterium bovis subsp bovis AF2122/97
gcaacuucuucagcagcggcgg

SEQ ID NO: 1091037 - RNA, 23 nt, Mycobacterium bovis subsp bovis AF2122/97
gcaagaaacagguaagcagccag

SEQ ID NO: 1091038 - RNA, 14 nt, Mycobacterium bovis subsp bovis AF2122/97
gcaagaaugccgcc

SEQ ID NO: 1091039 - RNA, 18 nt, Mycobacterium bovis subsp bovis AF2122/97
gcaagacgcggucgacga

SEQ ID NO: 1091040 - RNA, 16 nt, Mycobacterium bovis subsp bovis AF2122/97
gcaagaccgaacagcg

SEQ ID NO: 1091041 - RNA, 16 nt, Mycobacterium bovis subsp bovis AF2122/97
gcaagaccgcgccaac

SEQ ID NO: 1091042 - RNA, 21 nt, Mycobacterium bovis subsp bovis AF2122/97
gcaagaccgcgccaacuccga

SEQ ID NO: 1091043 - RNA, 20 nt, Mycobacterium bovis subsp bovis AF2122/97
gcaagaccguuacaccauca

SEQ ID NO: 1091044 - RNA, 18 nt, Mycobacterium bovis subsp bovis AF2122/97
gcaagaucggcagcgugg

SEQ ID NO: 1091045 - RNA, 21 nt, Mycobacterium bovis subsp bovis AF2122/97
gcaagaucguuuccguagacg

SEQ ID NO: 1091046 - RNA, 14 nt, Mycobacterium bovis subsp bovis AF2122/97
gcaagagccgcagc

SEQ ID NO: 1091047 - RNA, 21 nt, Mycobacterium bovis subsp bovis AF2122/97
gcaaugcguugaccgauacgc

SEQ ID NO: 1091048 - RNA, 14 nt, Mycobacterium bovis subsp bovis AF2122/97
gcaaugcgcgcgau

SEQ ID NO: 1091049 - RNA, 12 nt, Mycobacterium bovis subsp bovis AF2122/97
gcaaugccgcgg

SEQ ID NO: 1091050 - RNA, 23 nt, Mycobacterium bovis subsp bovis AF2122/97
gcaaugcccgaccggucuggcga

SEQ ID NO: 1091051 - RNA, 15 nt, Mycobacterium bovis subsp bovis AF2122/97
gcaaugucgacaccg

SEQ ID NO: 1091052 - RNA, 17 nt, Mycobacterium bovis subsp bovis AF2122/97
gcaaugugggcgcgucg

SEQ ID NO: 1091053 - RNA, 15 nt, Mycobacterium bovis subsp bovis AF2122/97
gcaauggcggccuug

SEQ ID NO: 1091054 - RNA, 16 nt, Mycobacterium bovis subsp bovis AF2122/97
gcaauggccagcacca

SEQ ID NO: 1091055 - RNA, 16 nt, Mycobacterium bovis subsp bovis AF2122/97
gcaaucucaugcccgg

SEQ ID NO: 1091056 - RNA, 21 nt, Mycobacterium bovis subsp bovis AF2122/97
gcaaucucccgaaucgugcgg

SEQ ID NO: 1091057 - RNA, 19 nt, Mycobacterium bovis subsp bovis AF2122/97
gcaaucgugguucggcguc

SEQ ID NO: 1091058 - RNA, 20 nt, Mycobacterium bovis subsp bovis AF2122/97
gcaaucgugguucggcgucg

SEQ ID NO: 1091059 - RNA, 22 nt, Mycobacterium bovis subsp bovis AF2122/97
gcaaucggcggcacccgggugg

SEQ ID NO: 1091060 - RNA, 15 nt, Mycobacterium bovis subsp bovis AF2122/97
gcaaugcccgaccgg

SEQ ID NO: 1091061 - RNA, 17 nt, Mycobacterium bovis subsp bovis AF2122/97
gcaaugcaucgcggcgg

SEQ ID NO: 1091062 - RNA, 19 nt, Mycobacterium bovis subsp bovis AF2122/97
gcaaugcaucgcggcggcg

SEQ ID NO: 1091063 - RNA, 14 nt, Mycobacterium bovis subsp bovis AF2122/97
gcaaugccaacggu

SEQ ID NO: 1091064 - RNA, 18 nt, Mycobacterium bovis subsp bovis AF2122/97
gcaaugacuugcgacccg

SEQ ID NO: 1091065 - RNA, 17 nt, Mycobacterium bovis subsp bovis AF2122/97
gcaaugacccgcgggug

SEQ ID NO: 1091066 - RNA, 19 nt, Mycobacterium bovis subsp bovis AF2122/97
gcaaugaccuggccgcccg

SEQ ID NO: 1091067 - RNA, 22 nt, Mycobacterium bovis subsp bovis AF2122/97
gcaaugacguacggggucgccg

SEQ ID NO: 1091068 - RNA, 16 nt, Mycobacterium bovis subsp bovis AF2122/97
gcaaugacgucgucgg

SEQ ID NO: 1091069 - RNA, 15 nt, Mycobacterium bovis subsp bovis AF2122/97
gcaaugacuugcgac

SEQ ID NO: 1091070 - RNA, 21 nt, Mycobacterium bovis subsp bovis AF2122/97
gcacaccgggcaccagucgcc

SEQ ID NO: 1091071 - RNA, 14 nt, Mycobacterium bovis subsp bovis AF2122/97
gcacaccgguggac

SEQ ID NO: 1091072 - RNA, 22 nt, Mycobacterium bovis subsp bovis AF2122/97
gcacaccgguggacccggcggu

SEQ ID NO: 1091073 - RNA, 13 nt, Mycobacterium bovis subsp bovis AF2122/97
gcacaccgguggc

SEQ ID NO: 1091074 - RNA, 16 nt, Mycobacterium bovis subsp bovis AF2122/97
gcacacccgcaccgga

SEQ ID NO: 1091075 - RNA, 17 nt, Mycobacterium bovis subsp bovis AF2122/97
gcacaccgccagcggca

SEQ ID NO: 1091076 - RNA, 15 nt, Mycobacterium bovis subsp bovis AF2122/97
gcacaccgccagcgg

SEQ ID NO: 1091077 - RNA, 20 nt, Mycobacterium bovis subsp bovis AF2122/97
gcacacugaccccgccgcca

SEQ ID NO: 1091078 - RNA, 20 nt, Mycobacterium bovis subsp bovis AF2122/97
gcacacuggccacaaucgcg

SEQ ID NO: 1091079 - RNA, 16 nt, Mycobacterium bovis subsp bovis AF2122/97
gcacacugaccccgcc

SEQ ID NO: 1091080 - RNA, 20 nt, Mycobacterium bovis subsp bovis AF2122/97
gcacacuaccgccgcgaccg

SEQ ID NO: 1091081 - RNA, 20 nt, Mycobacterium bovis subsp bovis AF2122/97
gcacacccgguuggccccca

SEQ ID NO: 1091082 - RNA, 23 nt, Mycobacterium bovis subsp bovis AF2122/97
gcacacccgucaugcccaccgcc

SEQ ID NO: 1091083 - RNA, 20 nt, Mycobacterium bovis subsp bovis AF2122/97
gcacacccaucaccgccagc

SEQ ID NO: 1091084 - RNA, 17 nt, Mycobacterium bovis subsp bovis AF2122/97
gcacacccaucaccgcc

SEQ ID NO: 1091085 - RNA, 17 nt, Mycobacterium bovis subsp bovis AF2122/97
gcacacccuccacagcg

SEQ ID NO: 1091086 - RNA, 14 nt, Mycobacterium bovis subsp bovis AF2122/97
gcacaccgaggucg

SEQ ID NO: 1091087 - RNA, 18 nt, Mycobacterium bovis subsp bovis AF2122/97
gcacaccgaggucgccaa

SEQ ID NO: 1091088 - RNA, 12 nt, Mycobacterium bovis subsp bovis AF2122/97
gcacaacccguc

SEQ ID NO: 1091089 - RNA, 17 nt, Mycobacterium bovis subsp bovis AF2122/97
gcacaacccgucgagcc

SEQ ID NO: 1091090 - RNA, 18 nt, Mycobacterium bovis subsp bovis AF2122/97
gcacaacccgucgagccg

SEQ ID NO: 1091091 - RNA, 21 nt, Mycobacterium bovis subsp bovis AF2122/97
gcacaacccgugcaggaucgg

SEQ ID NO: 1091092 - RNA, 18 nt, Mycobacterium bovis subsp bovis AF2122/97
gcacaacaucgccgcagu

SEQ ID NO: 1091093 - RNA, 13 nt, Mycobacterium bovis subsp bovis AF2122/97
gcacaaccagauc

SEQ ID NO: 1091094 - RNA, 16 nt, Mycobacterium bovis subsp bovis AF2122/97
gcaauuccacgaucgg

SEQ ID NO: 1091095 - RNA, 17 nt, Mycobacterium bovis subsp bovis AF2122/97
gcaauuccacgaucggc

SEQ ID NO: 1091096 - RNA, 18 nt, Mycobacterium bovis subsp bovis AF2122/97
gcaauucccaucggccug

SEQ ID NO: 1091097 - RNA, 13 nt, Mycobacterium bovis subsp bovis AF2122/97
gcaauuccgccga

SEQ ID NO: 1091098 - RNA, 14 nt, Mycobacterium bovis subsp bovis AF2122/97
gcaaucgaccacga

SEQ ID NO: 1091099 - RNA, 20 nt, Mycobacterium bovis subsp bovis AF2122/97
gcaauccgcaaaacgagcuu

SEQ ID NO: 1091100 - RNA, 19 nt, Mycobacterium bovis subsp bovis AF2122/97
gcaauccgcacagcgacga

SEQ ID NO: 1091101 - RNA, 14 nt, Mycobacterium bovis subsp bovis AF2122/97
gcaaucccgccauc

SEQ ID NO: 1091102 - RNA, 19 nt, Mycobacterium bovis subsp bovis AF2122/97
gcaaucaucucccgaccgc

SEQ ID NO: 1091103 - RNA, 16 nt, Mycobacterium bovis subsp bovis AF2122/97
gcaaucaugucagcgc

SEQ ID NO: 1091104 - RNA, 21 nt, Mycobacterium bovis subsp bovis AF2122/97
gcaaucauccgaucgccgcga

SEQ ID NO: 1091105 - RNA, 20 nt, Mycobacterium bovis subsp bovis AF2122/97
gcaaucaucucccgaccgcc

SEQ ID NO: 1091106 - RNA, 17 nt, Mycobacterium bovis subsp bovis AF2122/97
gcaaucgaccacgacgu

SEQ ID NO: 1091107 - RNA, 23 nt, Mycobacterium bovis subsp bovis AF2122/97
gcaaucgaccacgacguggacuc

SEQ ID NO: 1091108 - RNA, 13 nt, Mycobacterium bovis subsp bovis AF2122/97
gcaaucgcgacgg

SEQ ID NO: 1091109 - RNA, 21 nt, Mycobacterium bovis subsp bovis AF2122/97
gcaaucgcucugugucgccga

SEQ ID NO: 1091110 - RNA, 17 nt, Mycobacterium bovis subsp bovis AF2122/97
gcaaucggauacccagc

SEQ ID NO: 1091111 - RNA, 19 nt, Mycobacterium bovis subsp bovis AF2122/97
gcaauaccugagcgcgcgc

SEQ ID NO: 1091112 - RNA, 15 nt, Mycobacterium bovis subsp bovis AF2122/97
gcaauacccgccgcg

SEQ ID NO: 1091113 - RNA, 16 nt, Mycobacterium bovis subsp bovis AF2122/97
gcaauacccgccgcga

SEQ ID NO: 1091114 - RNA, 15 nt, Mycobacterium bovis subsp bovis AF2122/97
gcaauacggcggcgc

SEQ ID NO: 1091115 - RNA, 18 nt, Mycobacterium bovis subsp bovis AF2122/97
gcaauacggcggcgccgc

SEQ ID NO: 1091116 - RNA, 21 nt, Mycobacterium bovis subsp bovis AF2122/97
gcaauacggcggcgccgccca

SEQ ID NO: 1091117 - RNA, 19 nt, Mycobacterium bovis subsp bovis AF2122/97
gcaauacguagucgccgau

SEQ ID NO: 1091118 - RNA, 18 nt, Mycobacterium bovis subsp bovis AF2122/97
gcaauacguagucgccga

SEQ ID NO: 1091119 - RNA, 15 nt, Mycobacterium bovis subsp bovis AF2122/97
gcaauagcgacagca

SEQ ID NO: 1091120 - RNA, 17 nt, Mycobacterium bovis subsp bovis AF2122/97
gcaauagaccgcagucg

SEQ ID NO: 1091121 - RNA, 15 nt, Mycobacterium bovis subsp bovis AF2122/97
gcaauagcugcgcga

SEQ ID NO: 1091122 - RNA, 14 nt, Mycobacterium bovis subsp bovis AF2122/97
gcaauaccgccagc

SEQ ID NO: 1091123 - RNA, 14 nt, Mycobacterium bovis subsp bovis AF2122/97
gcaaucagacggcg

SEQ ID NO: 1091124 - RNA, 14 nt, Mycobacterium bovis subsp bovis AF2122/97
gcaauaugccacag

SEQ ID NO: 1091125 - RNA, 23 nt, Mycobacterium bovis subsp bovis AF2122/97
gcaauauccgggagugcgccggc

SEQ ID NO: 1091126 - RNA, 16 nt, Mycobacterium bovis subsp bovis AF2122/97
gcaaggacguggcgcu

SEQ ID NO: 1091127 - RNA, 15 nt, Mycobacterium bovis subsp bovis AF2122/97
gcaaggcggcggcca

SEQ ID NO: 1091128 - RNA, 20 nt, Mycobacterium bovis subsp bovis AF2122/97
gcaaggcccgcaccgcugac

SEQ ID NO: 1091129 - RNA, 23 nt, Mycobacterium bovis subsp bovis AF2122/97
gcaaggccaccggcggugccggu

SEQ ID NO: 1091130 - RNA, 15 nt, Mycobacterium bovis subsp bovis AF2122/97
gcaaggucaacccgc

SEQ ID NO: 1091131 - RNA, 19 nt, Mycobacterium bovis subsp bovis AF2122/97
gcaaggguggggccggcgg

SEQ ID NO: 1091132 - RNA, 14 nt, Mycobacterium bovis subsp bovis AF2122/97
gcaaggggcgucgc

SEQ ID NO: 1091133 - RNA, 19 nt, Mycobacterium bovis subsp bovis AF2122/97
gcaaggggcgucgcaacgc

SEQ ID NO: 1091134 - RNA, 22 nt, Mycobacterium bovis subsp bovis AF2122/97
gcaaggcgccgcagggccgcgc

SEQ ID NO: 1091135 - RNA, 23 nt, Mycobacterium bovis subsp bovis AF2122/97
gcaagggcauacagcaugucgcg

SEQ ID NO: 1091136 - RNA, 20 nt, Mycobacterium bovis subsp bovis AF2122/97
gcaagucgagauagaccuug

SEQ ID NO: 1091137 - RNA, 15 nt, Mycobacterium bovis subsp bovis AF2122/97
gcaaguccugcagcu

SEQ ID NO: 1091138 - RNA, 14 nt, Mycobacterium bovis subsp bovis AF2122/97
gcaagucaacaccg

SEQ ID NO: 1091139 - RNA, 19 nt, Mycobacterium bovis subsp bovis AF2122/97
gcaagucaacaccgcggcc

SEQ ID NO: 1091140 - RNA, 12 nt, Mycobacterium bovis subsp bovis AF2122/97
gcaaguccaccg

SEQ ID NO: 1091141 - RNA, 22 nt, Mycobacterium bovis subsp bovis AF2122/97
gcaagugucuccggcaacagca

SEQ ID NO: 1091142 - RNA, 15 nt, Mycobacterium bovis subsp bovis AF2122/97
gcaaguucugcgcuc

SEQ ID NO: 1091143 - RNA, 18 nt, Mycobacterium bovis subsp bovis AF2122/97
gcaaguucugcgcucccg

SEQ ID NO: 1091144 - RNA, 18 nt, Mycobacterium bovis subsp bovis AF2122/97
gcaaguucgucgggaucg

SEQ ID NO: 1091145 - RNA, 19 nt, Mycobacterium bovis subsp bovis AF2122/97
gauggccagcgcggcgucg

SEQ ID NO: 1091146 - RNA, 17 nt, Mycobacterium bovis subsp bovis AF2122/97
gauggacaccaccucgu

SEQ ID NO: 1091147 - RNA, 14 nt, Mycobacterium bovis subsp bovis AF2122/97
gauggacaccagcc

SEQ ID NO: 1091148 - RNA, 15 nt, Mycobacterium bovis subsp bovis AF2122/97
gauggacagcugcgg

SEQ ID NO: 1091149 - RNA, 20 nt, Mycobacterium bovis subsp bovis AF2122/97
gauggccagcgcggcgucgc

SEQ ID NO: 1091150 - RNA, 18 nt, Mycobacterium bovis subsp bovis AF2122/97
gauggccccgggcgguga

SEQ ID NO: 1091151 - RNA, 14 nt, Mycobacterium bovis subsp bovis AF2122/97
gauggccgaccagc

SEQ ID NO: 1091152 - RNA, 21 nt, Mycobacterium bovis subsp bovis AF2122/97
gauggccgaccagccgaucau

SEQ ID NO: 1091153 - RNA, 22 nt, Mycobacterium bovis subsp bovis AF2122/97
gauggccgacgcugcugauggu

SEQ ID NO: 1091154 - RNA, 12 nt, Mycobacterium bovis subsp bovis AF2122/97
gauggccgccga

SEQ ID NO: 1091155 - RNA, 17 nt, Mycobacterium bovis subsp bovis AF2122/97
gauggccgccgacaacc

SEQ ID NO: 1091156 - RNA, 18 nt, Mycobacterium bovis subsp bovis AF2122/97
gauggccgccgacaaccc

SEQ ID NO: 1091157 - RNA, 16 nt, Mycobacterium bovis subsp bovis AF2122/97
gauggccgccaggcgc

SEQ ID NO: 1091158 - RNA, 21 nt, Mycobacterium bovis subsp bovis AF2122/97
gaugcuuucguauucggccgc

SEQ ID NO: 1091159 - RNA, 13 nt, Mycobacterium bovis subsp bovis AF2122/97
gauggaaggcggc

SEQ ID NO: 1091160 - RNA, 16 nt, Mycobacterium bovis subsp bovis AF2122/97
gauggaaggcggccag

SEQ ID NO: 1091161 - RNA, 17 nt, Mycobacterium bovis subsp bovis AF2122/97
gauggaaggcggccagg

SEQ ID NO: 1091162 - RNA, 21 nt, Mycobacterium bovis subsp bovis AF2122/97
gaugcggucgucacggaccgc

SEQ ID NO: 1091163 - RNA, 22 nt, Mycobacterium bovis subsp bovis AF2122/97
gaugcggucgucacggaccgcc

SEQ ID NO: 1091164 - RNA, 16 nt, Mycobacterium bovis subsp bovis AF2122/97
gaugcguagugcggcg

SEQ ID NO: 1091165 - RNA, 18 nt, Mycobacterium bovis subsp bovis AF2122/97
gaugcguagugcggcgug

SEQ ID NO: 1091166 - RNA, 22 nt, Mycobacterium bovis subsp bovis AF2122/97
gaugcguagacauuggcuccga

SEQ ID NO: 1091167 - RNA, 17 nt, Mycobacterium bovis subsp bovis AF2122/97
gaugcgucucgcgcgau

SEQ ID NO: 1091168 - RNA, 21 nt, Mycobacterium bovis subsp bovis AF2122/97
gaucugcgacaagaccggcgg

SEQ ID NO: 1091169 - RNA, 13 nt, Mycobacterium bovis subsp bovis AF2122/97
gaucugcgccauc

SEQ ID NO: 1091170 - RNA, 22 nt, Mycobacterium bovis subsp bovis AF2122/97
gaucugcuaccagagccgcgau

SEQ ID NO: 1091171 - RNA, 14 nt, Mycobacterium bovis subsp bovis AF2122/97
gaucugcuccgcag

SEQ ID NO: 1091172 - RNA, 12 nt, Mycobacterium bovis subsp bovis AF2122/97
gaucugcucgcc

SEQ ID NO: 1091173 - RNA, 18 nt, Mycobacterium bovis subsp bovis AF2122/97
gaucugcgccgcgcgcgg

SEQ ID NO: 1091174 - RNA, 19 nt, Mycobacterium bovis subsp bovis AF2122/97
gaucugcguugcggcaaca

SEQ ID NO: 1091175 - RNA, 17 nt, Mycobacterium bovis subsp bovis AF2122/97
gaucugcggaggcgacc

SEQ ID NO: 1091176 - RNA, 18 nt, Mycobacterium bovis subsp bovis AF2122/97
gaucugcggaggcgaccc

SEQ ID NO: 1091177 - RNA, 16 nt, Mycobacterium bovis subsp bovis AF2122/97
gaucugcggcgcccgg

SEQ ID NO: 1091178 - RNA, 14 nt, Mycobacterium bovis subsp bovis AF2122/97
gaucuggcgcagca

SEQ ID NO: 1091179 - RNA, 20 nt, Mycobacterium bovis subsp bovis AF2122/97
gaucuggcggauggccgccu

SEQ ID NO: 1091180 - RNA, 16 nt, Mycobacterium bovis subsp bovis AF2122/97
gaugcggcgcagcgac

SEQ ID NO: 1091181 - RNA, 18 nt, Mycobacterium bovis subsp bovis AF2122/97
gaugcggcgcagcgacgc

SEQ ID NO: 1091182 - RNA, 14 nt, Mycobacterium bovis subsp bovis AF2122/97
gaugcggcgaccac

SEQ ID NO: 1091183 - RNA, 18 nt, Mycobacterium bovis subsp bovis AF2122/97
gaucuggcguucagcggc

SEQ ID NO: 1091184 - RNA, 21 nt, Mycobacterium bovis subsp bovis AF2122/97
gaucugcucguagcggcggcg

SEQ ID NO: 1091185 - RNA, 22 nt, Mycobacterium bovis subsp bovis AF2122/97
gaucugcucguagcggcggcgc

SEQ ID NO: 1091186 - RNA, 16 nt, Mycobacterium bovis subsp bovis AF2122/97
gaucugcucgccgagc

SEQ ID NO: 1091187 - RNA, 20 nt, Mycobacterium bovis subsp bovis AF2122/97
gaucuggccgaagcccgauc

SEQ ID NO: 1091188 - RNA, 22 nt, Mycobacterium bovis subsp bovis AF2122/97
gaugcggcugaauucggcgagc

SEQ ID NO: 1091189 - RNA, 13 nt, Mycobacterium bovis subsp bovis AF2122/97
gaugcggucgcgg

SEQ ID NO: 1091190 - RNA, 22 nt, Mycobacterium bovis subsp bovis AF2122/97
gaugcgggcugugaacagcgcg

SEQ ID NO: 1091191 - RNA, 16 nt, Mycobacterium bovis subsp bovis AF2122/97
gauguccgcggccacc

SEQ ID NO: 1091192 - RNA, 17 nt, Mycobacterium bovis subsp bovis AF2122/97
gauguccgacgccaccg

SEQ ID NO: 1091193 - RNA, 16 nt, Mycobacterium bovis subsp bovis AF2122/97
gauguccgcagcaccg

SEQ ID NO: 1091194 - RNA, 20 nt, Mycobacterium bovis subsp bovis AF2122/97
gauguccgcagcaccgucgg

SEQ ID NO: 1091195 - RNA, 12 nt, Mycobacterium bovis subsp bovis AF2122/97
gauguccgacgc

SEQ ID NO: 1091196 - RNA, 17 nt, Mycobacterium bovis subsp bovis AF2122/97
gaugucccaugcacggc

SEQ ID NO: 1091197 - RNA, 15 nt, Mycobacterium bovis subsp bovis AF2122/97
gauguccccggcggc

SEQ ID NO: 1091198 - RNA, 18 nt, Mycobacterium bovis subsp bovis AF2122/97
gauguccccggcggcagc

SEQ ID NO: 1091199 - RNA, 13 nt, Mycobacterium bovis subsp bovis AF2122/97
gaugucgagcgcg

SEQ ID NO: 1091200 - RNA, 15 nt, Mycobacterium bovis subsp bovis AF2122/97
gaugucgagcguggc

SEQ ID NO: 1091201 - RNA, 19 nt, Mycobacterium bovis subsp bovis AF2122/97
gauguccucgagcaccgcg

SEQ ID NO: 1091202 - RNA, 14 nt, Mycobacterium bovis subsp bovis AF2122/97
gauguccucgaugc

SEQ ID NO: 1091203 - RNA, 15 nt, Mycobacterium bovis subsp bovis AF2122/97
gaugucucggcacca

SEQ ID NO: 1091204 - RNA, 15 nt, Mycobacterium bovis subsp bovis AF2122/97
gaugucguucgcguc

SEQ ID NO: 1091205 - RNA, 17 nt, Mycobacterium bovis subsp bovis AF2122/97
gaugucucggcaccaca

SEQ ID NO: 1091206 - RNA, 21 nt, Mycobacterium bovis subsp bovis AF2122/97
gaugugacuuauccggccagu

SEQ ID NO: 1091207 - RNA, 22 nt, Mycobacterium bovis subsp bovis AF2122/97
gaugucgugcgggcgcaccagg

SEQ ID NO: 1091208 - RNA, 14 nt, Mycobacterium bovis subsp bovis AF2122/97
gaugucgugcgggc

SEQ ID NO: 1091209 - RNA, 23 nt, Mycobacterium bovis subsp bovis AF2122/97
gauguaaccguagcccugcucag

SEQ ID NO: 1091210 - RNA, 21 nt, Mycobacterium bovis subsp bovis AF2122/97
gaugucccaucgcgucggcga

SEQ ID NO: 1091211 - RNA, 15 nt, Mycobacterium bovis subsp bovis AF2122/97
gauguccagguggcg

SEQ ID NO: 1091212 - RNA, 17 nt, Mycobacterium bovis subsp bovis AF2122/97
gauggugguggcccggc

SEQ ID NO: 1091213 - RNA, 20 nt, Mycobacterium bovis subsp bovis AF2122/97
gaugguguccucgucgaggu

SEQ ID NO: 1091214 - RNA, 23 nt, Mycobacterium bovis subsp bovis AF2122/97
gauggugugcacggcuucggcga

SEQ ID NO: 1091215 - RNA, 18 nt, Mycobacterium bovis subsp bovis AF2122/97
gauggugugcccgcaccg

SEQ ID NO: 1091216 - RNA, 19 nt, Mycobacterium bovis subsp bovis AF2122/97
gaugguggcaacggguccg

SEQ ID NO: 1091217 - RNA, 19 nt, Mycobacterium bovis subsp bovis AF2122/97
gauggugcgcccgccggcg

SEQ ID NO: 1091218 - RNA, 17 nt, Mycobacterium bovis subsp bovis AF2122/97
gaugguguacacgucgc

SEQ ID NO: 1091219 - RNA, 20 nt, Mycobacterium bovis subsp bovis AF2122/97
gaugguggugccaaccuggg

SEQ ID NO: 1091220 - RNA, 21 nt, Mycobacterium bovis subsp bovis AF2122/97
gaugguggugccaaccugggc

SEQ ID NO: 1091221 - RNA, 14 nt, Mycobacterium bovis subsp bovis AF2122/97
gaugguggucacca

SEQ ID NO: 1091222 - RNA, 17 nt, Mycobacterium bovis subsp bovis AF2122/97
gaugguggucaccacca

SEQ ID NO: 1091223 - RNA, 22 nt, Mycobacterium bovis subsp bovis AF2122/97
gaugguggcgguuccggccggc

SEQ ID NO: 1091224 - RNA, 23 nt, Mycobacterium bovis subsp bovis AF2122/97
gauggcggcucguugcgggcggg

SEQ ID NO: 1091225 - RNA, 12 nt, Mycobacterium bovis subsp bovis AF2122/97
gauggcgguggc

SEQ ID NO: 1091226 - RNA, 19 nt, Mycobacterium bovis subsp bovis AF2122/97
gauggcgguggugccgcgg

SEQ ID NO: 1091227 - RNA, 18 nt, Mycobacterium bovis subsp bovis AF2122/97
gauggcgcccugcgccac

SEQ ID NO: 1091228 - RNA, 19 nt, Mycobacterium bovis subsp bovis AF2122/97
gauggcgcaccggcgucgg

SEQ ID NO: 1091229 - RNA, 18 nt, Mycobacterium bovis subsp bovis AF2122/97
gauggcgauacgcgcguc

SEQ ID NO: 1091230 - RNA, 16 nt, Mycobacterium bovis subsp bovis AF2122/97
gauggcgucggccagg

SEQ ID NO: 1091231 - RNA, 15 nt, Mycobacterium bovis subsp bovis AF2122/97
gauggcgucgaccac

SEQ ID NO: 1091232 - RNA, 13 nt, Mycobacterium bovis subsp bovis AF2122/97
gauggcgucgccg

SEQ ID NO: 1091233 - RNA, 15 nt, Mycobacterium bovis subsp bovis AF2122/97
gauggcgucgccggc

SEQ ID NO: 1091234 - RNA, 16 nt, Mycobacterium bovis subsp bovis AF2122/97
gauggcgucgccggcc

SEQ ID NO: 1091235 - RNA, 12 nt, Mycobacterium bovis subsp bovis AF2122/97
gauggcgucggc

SEQ ID NO: 1091236 - RNA, 20 nt, Mycobacterium bovis subsp bovis AF2122/97
gauggcguagcccaugccga

SEQ ID NO: 1091237 - RNA, 17 nt, Mycobacterium bovis subsp bovis AF2122/97
gaugggggagccgguga

SEQ ID NO: 1091238 - RNA, 20 nt, Mycobacterium bovis subsp bovis AF2122/97
gaugggcgucgaagaccgcc

SEQ ID NO: 1091239 - RNA, 16 nt, Mycobacterium bovis subsp bovis AF2122/97
gauggggacggcggcg

SEQ ID NO: 1091240 - RNA, 23 nt, Mycobacterium bovis subsp bovis AF2122/97
gaugguaccgccacuggcgcuga

SEQ ID NO: 1091241 - RNA, 18 nt, Mycobacterium bovis subsp bovis AF2122/97
gauggucaaugccggccg

SEQ ID NO: 1091242 - RNA, 22 nt, Mycobacterium bovis subsp bovis AF2122/97
gauggucaaugcgcuggcgccg

SEQ ID NO: 1091243 - RNA, 17 nt, Mycobacterium bovis subsp bovis AF2122/97
gauggucaccggauagc

SEQ ID NO: 1091244 - RNA, 17 nt, Mycobacterium bovis subsp bovis AF2122/97
gauggucaccgucugca

SEQ ID NO: 1091245 - RNA, 17 nt, Mycobacterium bovis subsp bovis AF2122/97
gaugguagucgcgaccg

SEQ ID NO: 1091246 - RNA, 23 nt, Mycobacterium bovis subsp bovis AF2122/97
gcaaccccgagcggagccgccga

SEQ ID NO: 1091247 - RNA, 22 nt, Mycobacterium bovis subsp bovis AF2122/97
gcaacccacacgcccucgacgc

SEQ ID NO: 1091248 - RNA, 16 nt, Mycobacterium bovis subsp bovis AF2122/97
gcaacccacacgcccu

SEQ ID NO: 1091249 - RNA, 16 nt, Mycobacterium bovis subsp bovis AF2122/97
gcaacccagccgcgcc

SEQ ID NO: 1091250 - RNA, 18 nt, Mycobacterium bovis subsp bovis AF2122/97
gcaaccacgccccgaucg

SEQ ID NO: 1091251 - RNA, 22 nt, Mycobacterium bovis subsp bovis AF2122/97
gcaaccacgccccgaucgguga

SEQ ID NO: 1091252 - RNA, 21 nt, Mycobacterium bovis subsp bovis AF2122/97
gcaaccaauaggugucgacgc

SEQ ID NO: 1091253 - RNA, 22 nt, Mycobacterium bovis subsp bovis AF2122/97
gcaaccaauaggugucgacgcg

SEQ ID NO: 1091254 - RNA, 13 nt, Mycobacterium bovis subsp bovis AF2122/97
gcaaccaccggcc

SEQ ID NO: 1091255 - RNA, 16 nt, Mycobacterium bovis subsp bovis AF2122/97
gcaaccaccggccgcg

SEQ ID NO: 1091256 - RNA, 15 nt, Mycobacterium bovis subsp bovis AF2122/97
gcaaccaccucgugg

SEQ ID NO: 1091257 - RNA, 13 nt, Mycobacterium bovis subsp bovis AF2122/97
gcaacaccgcacc

SEQ ID NO: 1091258 - RNA, 14 nt, Mycobacterium bovis subsp bovis AF2122/97
gcaacaccgcaccg

SEQ ID NO: 1091259 - RNA, 18 nt, Mycobacterium bovis subsp bovis AF2122/97
gcaacaucgggucgcugc

SEQ ID NO: 1091260 - RNA, 18 nt, Mycobacterium bovis subsp bovis AF2122/97
gcaacaucuugccgucgg

SEQ ID NO: 1091261 - RNA, 20 nt, Mycobacterium bovis subsp bovis AF2122/97
gcaacaucuugccgucggcc

SEQ ID NO: 1091262 - RNA, 20 nt, Mycobacterium bovis subsp bovis AF2122/97
gcaacaucggaugaccagug

SEQ ID NO: 1091263 - RNA, 16 nt, Mycobacterium bovis subsp bovis AF2122/97
gcaacauuuucgcccg

SEQ ID NO: 1091264 - RNA, 17 nt, Mycobacterium bovis subsp bovis AF2122/97
gcaacauuuucgcccgc

SEQ ID NO: 1091265 - RNA, 21 nt, Mycobacterium bovis subsp bovis AF2122/97
gcaacauuuucgcccgcuccg

SEQ ID NO: 1091266 - RNA, 22 nt, Mycobacterium bovis subsp bovis AF2122/97
gcaaccaaccgcgcgagccucg

SEQ ID NO: 1091267 - RNA, 21 nt, Mycobacterium bovis subsp bovis AF2122/97
gcaacaccaucagcgacaagu

SEQ ID NO: 1091268 - RNA, 16 nt, Mycobacterium bovis subsp bovis AF2122/97
gcaacaccaccucgac

SEQ ID NO: 1091269 - RNA, 14 nt, Mycobacterium bovis subsp bovis AF2122/97
gcaacacaccgaac

SEQ ID NO: 1091270 - RNA, 22 nt, Mycobacterium bovis subsp bovis AF2122/97
gcaacaaccgguuggcgauccg

SEQ ID NO: 1091271 - RNA, 15 nt, Mycobacterium bovis subsp bovis AF2122/97
gcaacaaagucgcca

SEQ ID NO: 1091272 - RNA, 23 nt, Mycobacterium bovis subsp bovis AF2122/97
gcaaaggaucaguacgcugcggc

SEQ ID NO: 1091273 - RNA, 15 nt, Mycobacterium bovis subsp bovis AF2122/97
gcaaaguaucgcagc

SEQ ID NO: 1091274 - RNA, 15 nt, Mycobacterium bovis subsp bovis AF2122/97
gcaaauucugguguc

SEQ ID NO: 1091275 - RNA, 13 nt, Mycobacterium bovis subsp bovis AF2122/97
gcaaagcagcgca

SEQ ID NO: 1091276 - RNA, 19 nt, Mycobacterium bovis subsp bovis AF2122/97
gcaaaccccggaccaucga

SEQ ID NO: 1091277 - RNA, 18 nt, Mycobacterium bovis subsp bovis AF2122/97
gcaaaccccggaccaucg

SEQ ID NO: 1091278 - RNA, 12 nt, Mycobacterium bovis subsp bovis AF2122/97
gcaaacccgccg

SEQ ID NO: 1091279 - RNA, 21 nt, Mycobacterium bovis subsp bovis AF2122/97
gcaaaaucgucagcgccgccg

SEQ ID NO: 1091280 - RNA, 19 nt, Mycobacterium bovis subsp bovis AF2122/97
gcaaaauggccaccggcgg

SEQ ID NO: 1091281 - RNA, 13 nt, Mycobacterium bovis subsp bovis AF2122/97
gcaaacaccagcc

SEQ ID NO: 1091282 - RNA, 17 nt, Mycobacterium bovis subsp bovis AF2122/97
gcaaacaccagcccggc

SEQ ID NO: 1091283 - RNA, 23 nt, Mycobacterium bovis subsp bovis AF2122/97
gcaaacagauucggugccagcag

SEQ ID NO: 1091284 - RNA, 13 nt, Mycobacterium bovis subsp bovis AF2122/97
gcaaaccauugcg

SEQ ID NO: 1091285 - RNA, 14 nt, Mycobacterium bovis subsp bovis AF2122/97
gcaaacaucgcagg

SEQ ID NO: 1091286 - RNA, 15 nt, Mycobacterium bovis subsp bovis AF2122/97
gcaaacaucgcaggc

SEQ ID NO: 1091287 - RNA, 20 nt, Mycobacterium bovis subsp bovis AF2122/97
gcaaaaucgcccaauucggc

SEQ ID NO: 1091288 - RNA, 13 nt, Mycobacterium bovis subsp bovis AF2122/97
gcaaaagccgcga

SEQ ID NO: 1091289 - RNA, 13 nt, Mycobacterium bovis subsp bovis AF2122/97
gcaaaacacaccg

SEQ ID NO: 1091290 - RNA, 22 nt, Mycobacterium bovis subsp bovis AF2122/97
gaugugcacggugugcacggcg

SEQ ID NO: 1091291 - RNA, 14 nt, Mycobacterium bovis subsp bovis AF2122/97
gaugugcagcgagu

SEQ ID NO: 1091292 - RNA, 16 nt, Mycobacterium bovis subsp bovis AF2122/97
gauguccacgccgugc

SEQ ID NO: 1091293 - RNA, 12 nt, Mycobacterium bovis subsp bovis AF2122/97
gaugugccgcgc

SEQ ID NO: 1091294 - RNA, 22 nt, Mycobacterium bovis subsp bovis AF2122/97
gaugugcucaggucgcagacca

SEQ ID NO: 1091295 - RNA, 14 nt, Mycobacterium bovis subsp bovis AF2122/97
gaugugcgccaccu

SEQ ID NO: 1091296 - RNA, 20 nt, Mycobacterium bovis subsp bovis AF2122/97
gaugugcgccaccucgacgc

SEQ ID NO: 1091297 - RNA, 13 nt, Mycobacterium bovis subsp bovis AF2122/97
gauuacggccagu

SEQ ID NO: 1091298 - RNA, 17 nt, Mycobacterium bovis subsp bovis AF2122/97
gauuacggugaucgccg

SEQ ID NO: 1091299 - RNA, 14 nt, Mycobacterium bovis subsp bovis AF2122/97
gauuauucgcggua

SEQ ID NO: 1091300 - RNA, 16 nt, Mycobacterium bovis subsp bovis AF2122/97
gauuauucgcgguagc

SEQ ID NO: 1091301 - RNA, 13 nt, Mycobacterium bovis subsp bovis AF2122/97
gauuccaugcgac

SEQ ID NO: 1091302 - RNA, 15 nt, Mycobacterium bovis subsp bovis AF2122/97
gauuccagcagccug

SEQ ID NO: 1091303 - RNA, 14 nt, Mycobacterium bovis subsp bovis AF2122/97
gauucccgcccagc

SEQ ID NO: 1091304 - RNA, 21 nt, Mycobacterium bovis subsp bovis AF2122/97
gauuccggcggccacgccggc

SEQ ID NO: 1091305 - RNA, 21 nt, Mycobacterium bovis subsp bovis AF2122/97
gauucgagcaacugcucgacg

SEQ ID NO: 1091306 - RNA, 15 nt, Mycobacterium bovis subsp bovis AF2122/97
gauucggugccagca

SEQ ID NO: 1091307 - RNA, 20 nt, Mycobacterium bovis subsp bovis AF2122/97
gauucgguuagcgcggccag

SEQ ID NO: 1091308 - RNA, 20 nt, Mycobacterium bovis subsp bovis AF2122/97
gauuccgcgucugcucggcg

SEQ ID NO: 1091309 - RNA, 22 nt, Mycobacterium bovis subsp bovis AF2122/97
gauuccgcgcguccgucggcga

SEQ ID NO: 1091310 - RNA, 23 nt, Mycobacterium bovis subsp bovis AF2122/97
gauuccggcggccacgccggcgu

SEQ ID NO: 1091311 - RNA, 18 nt, Mycobacterium bovis subsp bovis AF2122/97
gauuccgggugcgaucgc

SEQ ID NO: 1091312 - RNA, 19 nt, Mycobacterium bovis subsp bovis AF2122/97
gauuccgggugcgaucgca

SEQ ID NO: 1091313 - RNA, 14 nt, Mycobacterium bovis subsp bovis AF2122/97
gauucgaagccgag

SEQ ID NO: 1091314 - RNA, 14 nt, Mycobacterium bovis subsp bovis AF2122/97
gauucgaaggcacc

SEQ ID NO: 1091315 - RNA, 20 nt, Mycobacterium bovis subsp bovis AF2122/97
gauuucgcgucugcucgcca

SEQ ID NO: 1091316 - RNA, 18 nt, Mycobacterium bovis subsp bovis AF2122/97
gauuucgcgucugcucgc

SEQ ID NO: 1091317 - RNA, 23 nt, Mycobacterium bovis subsp bovis AF2122/97
gauuucgcacggaaggcccggcg

SEQ ID NO: 1091318 - RNA, 14 nt, Mycobacterium bovis subsp bovis AF2122/97
gauuggcgcugccc

SEQ ID NO: 1091319 - RNA, 15 nt, Mycobacterium bovis subsp bovis AF2122/97
gauuggcgcugcccg

SEQ ID NO: 1091320 - RNA, 21 nt, Mycobacterium bovis subsp bovis AF2122/97
gauuggcgcugcccgccgccc

SEQ ID NO: 1091321 - RNA, 12 nt, Mycobacterium bovis subsp bovis AF2122/97
gauuggcucgcc

SEQ ID NO: 1091322 - RNA, 13 nt, Mycobacterium bovis subsp bovis AF2122/97
gauuggcucgccg

SEQ ID NO: 1091323 - RNA, 17 nt, Mycobacterium bovis subsp bovis AF2122/97
gauuggcucgccgaacc

SEQ ID NO: 1091324 - RNA, 12 nt, Mycobacterium bovis subsp bovis AF2122/97
gauuggcucggg

SEQ ID NO: 1091325 - RNA, 16 nt, Mycobacterium bovis subsp bovis AF2122/97
gauuucggcgccggcg

SEQ ID NO: 1091326 - RNA, 22 nt, Mycobacterium bovis subsp bovis AF2122/97
gauuucgucgcugagcacggcg

SEQ ID NO: 1091327 - RNA, 16 nt, Mycobacterium bovis subsp bovis AF2122/97
gauuucuugaccgcgg

SEQ ID NO: 1091328 - RNA, 22 nt, Mycobacterium bovis subsp bovis AF2122/97
gauuugccccguugagcagcac

SEQ ID NO: 1091329 - RNA, 23 nt, Mycobacterium bovis subsp bovis AF2122/97
gauuugacgacaaacggcgaccc

SEQ ID NO: 1091330 - RNA, 22 nt, Mycobacterium bovis subsp bovis AF2122/97
gauuucuuuaaaccccuggcga

SEQ ID NO: 1091331 - RNA, 20 nt, Mycobacterium bovis subsp bovis AF2122/97
gauugcuugggugccucgcc

SEQ ID NO: 1091332 - RNA, 12 nt, Mycobacterium bovis subsp bovis AF2122/97
gauuggcgacgu

SEQ ID NO: 1091333 - RNA, 20 nt, Mycobacterium bovis subsp bovis AF2122/97
gauuggcgaucuugcgacgc

SEQ ID NO: 1091334 - RNA, 16 nt, Mycobacterium bovis subsp bovis AF2122/97
gauuggccaaccccau

SEQ ID NO: 1091335 - RNA, 15 nt, Mycobacterium bovis subsp bovis AF2122/97
gauuggcccaccgcc

SEQ ID NO: 1091336 - RNA, 18 nt, Mycobacterium bovis subsp bovis AF2122/97
gauuggcccgaguuggcg

SEQ ID NO: 1091337 - RNA, 11 nt, Mycobacterium bovis subsp bovis AF2122/97
gauugagcccg

SEQ ID NO: 1091338 - RNA, 14 nt, Mycobacterium bovis subsp bovis AF2122/97
gauugaguucggcg

SEQ ID NO: 1091339 - RNA, 20 nt, Mycobacterium bovis subsp bovis AF2122/97
gauugcggucguccccgucg

SEQ ID NO: 1091340 - RNA, 14 nt, Mycobacterium bovis subsp bovis AF2122/97
gauugaccugcugg

SEQ ID NO: 1091341 - RNA, 13 nt, Mycobacterium bovis subsp bovis AF2122/97
gauugaagccccc

SEQ ID NO: 1091342 - RNA, 17 nt, Mycobacterium bovis subsp bovis AF2122/97
gauucugcgucugcucg

SEQ ID NO: 1091343 - RNA, 15 nt, Mycobacterium bovis subsp bovis AF2122/97
gauucugcguccugc

SEQ ID NO: 1091344 - RNA, 20 nt, Mycobacterium bovis subsp bovis AF2122/97
gauucugcguccugcucgcg

SEQ ID NO: 1091345 - RNA, 16 nt, Mycobacterium bovis subsp bovis AF2122/97
gauucugcgucugcuc

SEQ ID NO: 1091346 - RNA, 20 nt, Mycobacterium bovis subsp bovis AF2122/97
gauucuggccggaugccacg

SEQ ID NO: 1091347 - RNA, 19 nt, Mycobacterium bovis subsp bovis AF2122/97
gauucugcgucugcucgcg

SEQ ID NO: 1091348 - RNA, 20 nt, Mycobacterium bovis subsp bovis AF2122/97
gauucugcgucugcucggcg

SEQ ID NO: 1091349 - RNA, 22 nt, Mycobacterium bovis subsp bovis AF2122/97
gauucugcgucugcucggcgga

SEQ ID NO: 1091350 - RNA, 22 nt, Mycobacterium bovis subsp bovis AF2122/97
gauucuggucgaaauugggugc

SEQ ID NO: 1091351 - RNA, 20 nt, Mycobacterium bovis subsp bovis AF2122/97
gauucugugucugcucgcgc

SEQ ID NO: 1091352 - RNA, 22 nt, Mycobacterium bovis subsp bovis AF2122/97
cugggcgcgcucaucgaccgcg

SEQ ID NO: 1091353 - RNA, 18 nt, Mycobacterium bovis subsp bovis AF2122/97
cugggcgcgcucaucgac

SEQ ID NO: 1091354 - RNA, 13 nt, Mycobacterium bovis subsp bovis AF2122/97
cugggcggccggg

SEQ ID NO: 1091355 - RNA, 16 nt, Mycobacterium bovis subsp bovis AF2122/97
cugggcgccgcgcucg

SEQ ID NO: 1091356 - RNA, 22 nt, Mycobacterium bovis subsp bovis AF2122/97
cugggcgguagcuuccgcgacg

SEQ ID NO: 1091357 - RNA, 17 nt, Mycobacterium bovis subsp bovis AF2122/97
cuggggcgccaccaccc

SEQ ID NO: 1091358 - RNA, 22 nt, Mycobacterium bovis subsp bovis AF2122/97
cuggggcgccaccacccggcgc

SEQ ID NO: 1091359 - RNA, 22 nt, Mycobacterium bovis subsp bovis AF2122/97
cuggggcggauaugaugaucgg

SEQ ID NO: 1091360 - RNA, 21 nt, Mycobacterium bovis subsp bovis AF2122/97
cuggggcggcaugcucaccga

SEQ ID NO: 1091361 - RNA, 18 nt, Mycobacterium bovis subsp bovis AF2122/97
cuggggccccgcgccggc

SEQ ID NO: 1091362 - RNA, 22 nt, Mycobacterium bovis subsp bovis AF2122/97
cuggggccccgcgccggccgca

SEQ ID NO: 1091363 - RNA, 18 nt, Mycobacterium bovis subsp bovis AF2122/97
cugggcguaaaccguggc

SEQ ID NO: 1091364 - RNA, 15 nt, Mycobacterium bovis subsp bovis AF2122/97
cugggcggugaaggc

SEQ ID NO: 1091365 - RNA, 15 nt, Mycobacterium bovis subsp bovis AF2122/97
cugguaaggccggcc

SEQ ID NO: 1091366 - RNA, 14 nt, Mycobacterium bovis subsp bovis AF2122/97
cuggguuggcaucc

SEQ ID NO: 1091367 - RNA, 23 nt, Mycobacterium bovis subsp bovis AF2122/97
cuggguuggugauugcggccgcc

SEQ ID NO: 1091368 - RNA, 21 nt, Mycobacterium bovis subsp bovis AF2122/97
cuggguuucaaagcgacagcg

SEQ ID NO: 1091369 - RNA, 18 nt, Mycobacterium bovis subsp bovis AF2122/97
cuggggguagccgccggc

SEQ ID NO: 1091370 - RNA, 20 nt, Mycobacterium bovis subsp bovis AF2122/97
cuggggguagccgccggcgc

SEQ ID NO: 1091371 - RNA, 19 nt, Mycobacterium bovis subsp bovis AF2122/97
cuggggugcugcgcgcggc

SEQ ID NO: 1091372 - RNA, 19 nt, Mycobacterium bovis subsp bovis AF2122/97
cugggguuggcucggcgca

SEQ ID NO: 1091373 - RNA, 17 nt, Mycobacterium bovis subsp bovis AF2122/97
cugggguccggugacga

SEQ ID NO: 1091374 - RNA, 16 nt, Mycobacterium bovis subsp bovis AF2122/97
cuggguaguucaccgc

SEQ ID NO: 1091375 - RNA, 16 nt, Mycobacterium bovis subsp bovis AF2122/97
cuggguauccaccgcg

SEQ ID NO: 1091376 - RNA, 17 nt, Mycobacterium bovis subsp bovis AF2122/97
cuggguauccaccgcga

SEQ ID NO: 1091377 - RNA, 14 nt, Mycobacterium bovis subsp bovis AF2122/97
cuggccgucggcgu

SEQ ID NO: 1091378 - RNA, 22 nt, Mycobacterium bovis subsp bovis AF2122/97
cuggccguccuaccgaugaacc

SEQ ID NO: 1091379 - RNA, 21 nt, Mycobacterium bovis subsp bovis AF2122/97
cuggccggguuccagcggcac

SEQ ID NO: 1091380 - RNA, 23 nt, Mycobacterium bovis subsp bovis AF2122/97
cuggccguauaggcccgggcggc

SEQ ID NO: 1091381 - RNA, 19 nt, Mycobacterium bovis subsp bovis AF2122/97
cuggccgucagcgucggcg

SEQ ID NO: 1091382 - RNA, 17 nt, Mycobacterium bovis subsp bovis AF2122/97
cugggaugugccgcgca

SEQ ID NO: 1091383 - RNA, 16 nt, Mycobacterium bovis subsp bovis AF2122/97
cugggauguucgauca

SEQ ID NO: 1091384 - RNA, 16 nt, Mycobacterium bovis subsp bovis AF2122/97
cugggauucugggcga

SEQ ID NO: 1091385 - RNA, 13 nt, Mycobacterium bovis subsp bovis AF2122/97
cugggauagcgcg

SEQ ID NO: 1091386 - RNA, 13 nt, Mycobacterium bovis subsp bovis AF2122/97
cugggaucccgac

SEQ ID NO: 1091387 - RNA, 23 nt, Mycobacterium bovis subsp bovis AF2122/97
cugggcaaugacuugcgacccgu

SEQ ID NO: 1091388 - RNA, 21 nt, Mycobacterium bovis subsp bovis AF2122/97
cugggcaaacugggcaccggc

SEQ ID NO: 1091389 - RNA, 14 nt, Mycobacterium bovis subsp bovis AF2122/97
cugggcaccggcgg

SEQ ID NO: 1091390 - RNA, 14 nt, Mycobacterium bovis subsp bovis AF2122/97
cugggcacucggcc

SEQ ID NO: 1091391 - RNA, 16 nt, Mycobacterium bovis subsp bovis AF2122/97
cugggcaucaccgacg

SEQ ID NO: 1091392 - RNA, 16 nt, Mycobacterium bovis subsp bovis AF2122/97
cugggcaucaccgccg

SEQ ID NO: 1091393 - RNA, 18 nt, Mycobacterium bovis subsp bovis AF2122/97
cugggcaucaccgccgcg

SEQ ID NO: 1091394 - RNA, 23 nt, Mycobacterium bovis subsp bovis AF2122/97
cugggcaucaccgccgcggccgc

SEQ ID NO: 1091395 - RNA, 19 nt, Mycobacterium bovis subsp bovis AF2122/97
cugggcaucaucagcggcg

SEQ ID NO: 1091396 - RNA, 21 nt, Mycobacterium bovis subsp bovis AF2122/97
cugggcaucaucagcggcgcc

SEQ ID NO: 1091397 - RNA, 17 nt, Mycobacterium bovis subsp bovis AF2122/97
cugggcaggaucgaggc

SEQ ID NO: 1091398 - RNA, 13 nt, Mycobacterium bovis subsp bovis AF2122/97
cugggcaucaccg

SEQ ID NO: 1091399 - RNA, 15 nt, Mycobacterium bovis subsp bovis AF2122/97
cugggcaucaccgac

SEQ ID NO: 1091400 - RNA, 12 nt, Mycobacterium bovis subsp bovis AF2122/97
cugggccagggu

SEQ ID NO: 1091401 - RNA, 15 nt, Mycobacterium bovis subsp bovis AF2122/97
cugggccaggguguu

SEQ ID NO: 1091402 - RNA, 11 nt, Mycobacterium bovis subsp bovis AF2122/97
cugggccagcc

SEQ ID NO: 1091403 - RNA, 21 nt, Mycobacterium bovis subsp bovis AF2122/97
cugggccaaagcgcgggcggu

SEQ ID NO: 1091404 - RNA, 19 nt, Mycobacterium bovis subsp bovis AF2122/97
cugggcccgagcgcgcgcu

SEQ ID NO: 1091405 - RNA, 16 nt, Mycobacterium bovis subsp bovis AF2122/97
cugggccgagcgcgcc

SEQ ID NO: 1091406 - RNA, 17 nt, Mycobacterium bovis subsp bovis AF2122/97
cugggccgacgggacaa

SEQ ID NO: 1091407 - RNA, 19 nt, Mycobacterium bovis subsp bovis AF2122/97
cugggcccgccgucaccgc

SEQ ID NO: 1091408 - RNA, 23 nt, Mycobacterium bovis subsp bovis AF2122/97
cugggcccccaaucagugcagcg

SEQ ID NO: 1091409 - RNA, 13 nt, Mycobacterium bovis subsp bovis AF2122/97
cugguuggcuggc

SEQ ID NO: 1091410 - RNA, 18 nt, Mycobacterium bovis subsp bovis AF2122/97
cugguugggagcuacggu

SEQ ID NO: 1091411 - RNA, 14 nt, Mycobacterium bovis subsp bovis AF2122/97
cugguugggcgaga

SEQ ID NO: 1091412 - RNA, 20 nt, Mycobacterium bovis subsp bovis AF2122/97
cugguugcgcucacccgguu

SEQ ID NO: 1091413 - RNA, 22 nt, Mycobacterium bovis subsp bovis AF2122/97
cugguugccuuugcggcgggca

SEQ ID NO: 1091414 - RNA, 20 nt, Mycobacterium bovis subsp bovis AF2122/97
cuggugugccgcguugccgg

SEQ ID NO: 1091415 - RNA, 20 nt, Mycobacterium bovis subsp bovis AF2122/97
cugguuaccgaaggucauca

SEQ ID NO: 1091416 - RNA, 13 nt, Mycobacterium bovis subsp bovis AF2122/97
cuggugucgaucg

SEQ ID NO: 1091417 - RNA, 22 nt, Mycobacterium bovis subsp bovis AF2122/97
cuggugucggcucgagucgcag

SEQ ID NO: 1091418 - RNA, 13 nt, Mycobacterium bovis subsp bovis AF2122/97
cuggugucgucgg

SEQ ID NO: 1091419 - RNA, 23 nt, Mycobacterium bovis subsp bovis AF2122/97
cuggugucguuuauuguccugcc

SEQ ID NO: 1091420 - RNA, 16 nt, Mycobacterium bovis subsp bovis AF2122/97
cugguucaacaccggu

SEQ ID NO: 1091421 - RNA, 21 nt, Mycobacterium bovis subsp bovis AF2122/97
cugguugaaccgguacaaccc

SEQ ID NO: 1091422 - RNA, 16 nt, Mycobacterium bovis subsp bovis AF2122/97
cugguggucagucacc

SEQ ID NO: 1091423 - RNA, 17 nt, Mycobacterium bovis subsp bovis AF2122/97
cuggugggggagcggcc

SEQ ID NO: 1091424 - RNA, 19 nt, Mycobacterium bovis subsp bovis AF2122/97
cuggugggggagcggccgc

SEQ ID NO: 1091425 - RNA, 20 nt, Mycobacterium bovis subsp bovis AF2122/97
cuggugggggagcggccgcc

SEQ ID NO: 1091426 - RNA, 22 nt, Mycobacterium bovis subsp bovis AF2122/97
cuggugggggagcggccgccgc

SEQ ID NO: 1091427 - RNA, 14 nt, Mycobacterium bovis subsp bovis AF2122/97
cugguggcagcgca

SEQ ID NO: 1091428 - RNA, 13 nt, Mycobacterium bovis subsp bovis AF2122/97
cugguggcgaucc

SEQ ID NO: 1091429 - RNA, 22 nt, Mycobacterium bovis subsp bovis AF2122/97
cugguggcgcugaagccgacga

SEQ ID NO: 1091430 - RNA, 16 nt, Mycobacterium bovis subsp bovis AF2122/97
cugguggcggcgacac

SEQ ID NO: 1091431 - RNA, 20 nt, Mycobacterium bovis subsp bovis AF2122/97
cuggugggagaccugucggu

SEQ ID NO: 1091432 - RNA, 22 nt, Mycobacterium bovis subsp bovis AF2122/97
cuggugcguagcccacccgggu

SEQ ID NO: 1091433 - RNA, 21 nt, Mycobacterium bovis subsp bovis AF2122/97
cuggugcuacuggugugacga

SEQ ID NO: 1091434 - RNA, 14 nt, Mycobacterium bovis subsp bovis AF2122/97
cuggugccugccgc

SEQ ID NO: 1091435 - RNA, 22 nt, Mycobacterium bovis subsp bovis AF2122/97
cuggugcgccacgccaccgcgg

SEQ ID NO: 1091436 - RNA, 18 nt, Mycobacterium bovis subsp bovis AF2122/97
cuggugccaacugcgccg

SEQ ID NO: 1091437 - RNA, 15 nt, Mycobacterium bovis subsp bovis AF2122/97
cuggugcgcccgacg

SEQ ID NO: 1091438 - RNA, 17 nt, Mycobacterium bovis subsp bovis AF2122/97
cuggugcagcgccgaca

SEQ ID NO: 1091439 - RNA, 16 nt, Mycobacterium bovis subsp bovis AF2122/97
cuggugcccgacccgc

SEQ ID NO: 1091440 - RNA, 19 nt, Mycobacterium bovis subsp bovis AF2122/97
cuggugcccgacccgccga

SEQ ID NO: 1091441 - RNA, 21 nt, Mycobacterium bovis subsp bovis AF2122/97
cuggugcccgacccgccgaug

SEQ ID NO: 1091442 - RNA, 16 nt, Mycobacterium bovis subsp bovis AF2122/97
cugguaggugucgugg

SEQ ID NO: 1091443 - RNA, 16 nt, Mycobacterium bovis subsp bovis AF2122/97
cugguagcgcaccaca

SEQ ID NO: 1091444 - RNA, 15 nt, Mycobacterium bovis subsp bovis AF2122/97
cugguaggcggccau

SEQ ID NO: 1091445 - RNA, 19 nt, Mycobacterium bovis subsp bovis AF2122/97
cuggucgccaacgccagca

SEQ ID NO: 1091446 - RNA, 20 nt, Mycobacterium bovis subsp bovis AF2122/97
cuggucgagcacgcugcugc

SEQ ID NO: 1091447 - RNA, 14 nt, Mycobacterium bovis subsp bovis AF2122/97
cuggucgccgcggc

SEQ ID NO: 1091448 - RNA, 17 nt, Mycobacterium bovis subsp bovis AF2122/97
cuggucgccgcggcagc

SEQ ID NO: 1091449 - RNA, 13 nt, Mycobacterium bovis subsp bovis AF2122/97
cuggucggccgca

SEQ ID NO: 1091450 - RNA, 19 nt, Mycobacterium bovis subsp bovis AF2122/97
cuggucggcuaccgccgac

SEQ ID NO: 1091451 - RNA, 13 nt, Mycobacterium bovis subsp bovis AF2122/97
cuggucgcgucca

SEQ ID NO: 1091452 - RNA, 15 nt, Mycobacterium bovis subsp bovis AF2122/97
cuggucgcguccacc

SEQ ID NO: 1091453 - RNA, 18 nt, Mycobacterium bovis subsp bovis AF2122/97
cuggucgcguccacccac

SEQ ID NO: 1091454 - RNA, 20 nt, Mycobacterium bovis subsp bovis AF2122/97
cuggucggcuaccgccgacc

SEQ ID NO: 1091455 - RNA, 14 nt, Mycobacterium bovis subsp bovis AF2122/97
cuggucgcugcugc

SEQ ID NO: 1091456 - RNA, 13 nt, Mycobacterium bovis subsp bovis AF2122/97
cuggucggcuucg

SEQ ID NO: 1091457 - RNA, 23 nt, Mycobacterium bovis subsp bovis AF2122/97
cuggucggugggcuugccgcgca

SEQ ID NO: 1091458 - RNA, 18 nt, Mycobacterium bovis subsp bovis AF2122/97
cuggucugcaggcggccu

SEQ ID NO: 1091459 - RNA, 16 nt, Mycobacterium bovis subsp bovis AF2122/97
cuggucgucgaacggc

SEQ ID NO: 1091460 - RNA, 15 nt, Mycobacterium bovis subsp bovis AF2122/97
cuggucgggucgcac

SEQ ID NO: 1091461 - RNA, 21 nt, Mycobacterium bovis subsp bovis AF2122/97
cuggucgggucgcaccccggc

SEQ ID NO: 1091462 - RNA, 22 nt, Mycobacterium bovis subsp bovis AF2122/97
cuggucggucaauucggugcgc

SEQ ID NO: 1091463 - RNA, 18 nt, Mycobacterium bovis subsp bovis AF2122/97
cuggugaucugguccggc

SEQ ID NO: 1091464 - RNA, 19 nt, Mycobacterium bovis subsp bovis AF2122/97
cuggugcagaauucggcgc

SEQ ID NO: 1091465 - RNA, 20 nt, Mycobacterium bovis subsp bovis AF2122/97
cuggugcagaauucggcgcg

SEQ ID NO: 1091466 - RNA, 16 nt, Mycobacterium bovis subsp bovis AF2122/97
cuggucuugccgugca

SEQ ID NO: 1091467 - RNA, 20 nt, Mycobacterium bovis subsp bovis AF2122/97
cuggucuacccgcggcgcga

SEQ ID NO: 1091468 - RNA, 14 nt, Mycobacterium bovis subsp bovis AF2122/97
cuguucccacaucg

SEQ ID NO: 1091469 - RNA, 13 nt, Mycobacterium bovis subsp bovis AF2122/97
cuguucgccgucg

SEQ ID NO: 1091470 - RNA, 16 nt, Mycobacterium bovis subsp bovis AF2122/97
cuguucgccgacgcga

SEQ ID NO: 1091471 - RNA, 19 nt, Mycobacterium bovis subsp bovis AF2122/97
cuguuccuugugaccccgg

SEQ ID NO: 1091472 - RNA, 15 nt, Mycobacterium bovis subsp bovis AF2122/97
cuguucggccaaccc

SEQ ID NO: 1091473 - RNA, 21 nt, Mycobacterium bovis subsp bovis AF2122/97
cuguucggccaacccgggccg

SEQ ID NO: 1091474 - RNA, 21 nt, Mycobacterium bovis subsp bovis AF2122/97
cuguucggccauggcggcgcc

SEQ ID NO: 1091475 - RNA, 19 nt, Mycobacterium bovis subsp bovis AF2122/97
cugucguaccgcggaucgg

SEQ ID NO: 1091476 - RNA, 19 nt, Mycobacterium bovis subsp bovis AF2122/97
cugucguaccgcucggcgg

SEQ ID NO: 1091477 - RNA, 16 nt, Mycobacterium bovis subsp bovis AF2122/97
cugucgcccucgaucg

SEQ ID NO: 1091478 - RNA, 17 nt, Mycobacterium bovis subsp bovis AF2122/97
cugucgaucagcgaccc

SEQ ID NO: 1091479 - RNA, 17 nt, Mycobacterium bovis subsp bovis AF2122/97
cugucgcaacgcaucga

SEQ ID NO: 1091480 - RNA, 16 nt, Mycobacterium bovis subsp bovis AF2122/97
cugucggugccgucga

SEQ ID NO: 1091481 - RNA, 16 nt, Mycobacterium bovis subsp bovis AF2122/97
cugucgucuuggcgau

SEQ ID NO: 1091482 - RNA, 20 nt, Mycobacterium bovis subsp bovis AF2122/97
cugucgucuuggcgaucggg

SEQ ID NO: 1091483 - RNA, 23 nt, Mycobacterium bovis subsp bovis AF2122/97
cugucgugauacagcucggugca

SEQ ID NO: 1091484 - RNA, 18 nt, Mycobacterium bovis subsp bovis AF2122/97
cugugaaucugacgacgc

SEQ ID NO: 1091485 - RNA, 20 nt, Mycobacterium bovis subsp bovis AF2122/97
cugucgugguggcauaaccg

SEQ ID NO: 1091486 - RNA, 16 nt, Mycobacterium bovis subsp bovis AF2122/97
cugucgagccggugcc

SEQ ID NO: 1091487 - RNA, 20 nt, Mycobacterium bovis subsp bovis AF2122/97
cuguccgguggaauccacca

SEQ ID NO: 1091488 - RNA, 16 nt, Mycobacterium bovis subsp bovis AF2122/97
cuguccgaccucgccg

SEQ ID NO: 1091489 - RNA, 18 nt, Mycobacterium bovis subsp bovis AF2122/97
cuguccgaccucgccgcg

SEQ ID NO: 1091490 - RNA, 20 nt, Mycobacterium bovis subsp bovis AF2122/97
cuguccgaccucgccgcgcg

SEQ ID NO: 1091491 - RNA, 21 nt, Mycobacterium bovis subsp bovis AF2122/97
cuguccgaccucgccgcgcgu

SEQ ID NO: 1091492 - RNA, 13 nt, Mycobacterium bovis subsp bovis AF2122/97
cugucccgccggc

SEQ ID NO: 1091493 - RNA, 15 nt, Mycobacterium bovis subsp bovis AF2122/97
cugucccgccggccc

SEQ ID NO: 1091494 - RNA, 17 nt, Mycobacterium bovis subsp bovis AF2122/97
cugucccgcgcaaccag

SEQ ID NO: 1091495 - RNA, 19 nt, Mycobacterium bovis subsp bovis AF2122/97
cugucccgcgggccagcac

SEQ ID NO: 1091496 - RNA, 13 nt, Mycobacterium bovis subsp bovis AF2122/97
cugucccggcgcg

SEQ ID NO: 1091497 - RNA, 18 nt, Mycobacterium bovis subsp bovis AF2122/97
cuguccacguccagcccg

SEQ ID NO: 1091498 - RNA, 21 nt, Mycobacterium bovis subsp bovis AF2122/97
cuguccaccgaugccacaucg

SEQ ID NO: 1091499 - RNA, 20 nt, Mycobacterium bovis subsp bovis AF2122/97
cugucauguccugggccgcc

SEQ ID NO: 1091500 - RNA, 23 nt, Mycobacterium bovis subsp bovis AF2122/97
cugucauguccugggccgccgcc

SEQ ID NO: 1091501 - RNA, 13 nt, Mycobacterium bovis subsp bovis AF2122/97
cuguaacacccgg

SEQ ID NO: 1091502 - RNA, 18 nt, Mycobacterium bovis subsp bovis AF2122/97
cuguaacacccggccgcc

SEQ ID NO: 1091503 - RNA, 14 nt, Mycobacterium bovis subsp bovis AF2122/97
cuucaccggccggu

SEQ ID NO: 1091504 - RNA, 16 nt, Mycobacterium bovis subsp bovis AF2122/97
cuucaccggccggugc

SEQ ID NO: 1091505 - RNA, 15 nt, Mycobacterium bovis subsp bovis AF2122/97
cuucaccagccaccc

SEQ ID NO: 1091506 - RNA, 23 nt, Mycobacterium bovis subsp bovis AF2122/97
cuucacgccgccccugcgcggcc

SEQ ID NO: 1091507 - RNA, 17 nt, Mycobacterium bovis subsp bovis AF2122/97
cuucacggucgacgaug

SEQ ID NO: 1091508 - RNA, 18 nt, Mycobacterium bovis subsp bovis AF2122/97
cuucacggucgacgauga

SEQ ID NO: 1091509 - RNA, 14 nt, Mycobacterium bovis subsp bovis AF2122/97
cuucaccucgucga

SEQ ID NO: 1091510 - RNA, 16 nt, Mycobacterium bovis subsp bovis AF2122/97
cuucaccggcucgucg

SEQ ID NO: 1091511 - RNA, 21 nt, Mycobacterium bovis subsp bovis AF2122/97
aaccggguguggucgguggcg

SEQ ID NO: 1091512 - RNA, 23 nt, Mycobacterium bovis subsp bovis AF2122/97
aaccggguguggucgguggcggg

SEQ ID NO: 1091513 - RNA, 13 nt, Mycobacterium bovis subsp bovis AF2122/97
cuuagggucgccg

SEQ ID NO: 1091514 - RNA, 14 nt, Mycobacterium bovis subsp bovis AF2122/97
cuuauccggccagu

SEQ ID NO: 1091515 - RNA, 22 nt, Mycobacterium bovis subsp bovis AF2122/97
cuuagcgcuugacccgcggacc

SEQ ID NO: 1091516 - RNA, 14 nt, Mycobacterium bovis subsp bovis AF2122/97
cuuagcgcuugccg

SEQ ID NO: 1091517 - RNA, 14 nt, Mycobacterium bovis subsp bovis AF2122/97
cuuagcugccgucg

SEQ ID NO: 1091518 - RNA, 15 nt, Mycobacterium bovis subsp bovis AF2122/97
cuuagcccggccgcg

SEQ ID NO: 1091519 - RNA, 15 nt, Mycobacterium bovis subsp bovis AF2122/97
cuuagcccgauggug

SEQ ID NO: 1091520 - RNA, 12 nt, Mycobacterium bovis subsp bovis AF2122/97
cuguugucgcgg

SEQ ID NO: 1091521 - RNA, 19 nt, Mycobacterium bovis subsp bovis AF2122/97
cuguuguggaacaccgcgg

SEQ ID NO: 1091522 - RNA, 18 nt, Mycobacterium bovis subsp bovis AF2122/97
cuuacacgccuggcuacg

SEQ ID NO: 1091523 - RNA, 17 nt, Mycobacterium bovis subsp bovis AF2122/97
cuguugcaucgccgcga

SEQ ID NO: 1091524 - RNA, 14 nt, Mycobacterium bovis subsp bovis AF2122/97
cuguugcggcggcg

SEQ ID NO: 1091525 - RNA, 18 nt, Mycobacterium bovis subsp bovis AF2122/97
cuguuggcaugccgcccg

SEQ ID NO: 1091526 - RNA, 18 nt, Mycobacterium bovis subsp bovis AF2122/97
cuguuggccagccgacaa

SEQ ID NO: 1091527 - RNA, 15 nt, Mycobacterium bovis subsp bovis AF2122/97
cuugacgcggccaca

SEQ ID NO: 1091528 - RNA, 16 nt, Mycobacterium bovis subsp bovis AF2122/97
cuugacggcgccaggc

SEQ ID NO: 1091529 - RNA, 14 nt, Mycobacterium bovis subsp bovis AF2122/97
cuugacuccgcgcg

SEQ ID NO: 1091530 - RNA, 21 nt, Mycobacterium bovis subsp bovis AF2122/97
cuugacuccgcgcgcugggcc

SEQ ID NO: 1091531 - RNA, 20 nt, Mycobacterium bovis subsp bovis AF2122/97
cuugagcaaaauggccaccg

SEQ ID NO: 1091532 - RNA, 18 nt, Mycobacterium bovis subsp bovis AF2122/97
cuugagcaaugacccgcg

SEQ ID NO: 1091533 - RNA, 23 nt, Mycobacterium bovis subsp bovis AF2122/97
cuugagcacacguccggcgauga

SEQ ID NO: 1091534 - RNA, 16 nt, Mycobacterium bovis subsp bovis AF2122/97
cuugagccgcagcacc

SEQ ID NO: 1091535 - RNA, 18 nt, Mycobacterium bovis subsp bovis AF2122/97
cuugagccgcagcaccuc

SEQ ID NO: 1091536 - RNA, 20 nt, Mycobacterium bovis subsp bovis AF2122/97
cuugagccgggcaaccagca

SEQ ID NO: 1091537 - RNA, 16 nt, Mycobacterium bovis subsp bovis AF2122/97
cuugaggcccugcggc

SEQ ID NO: 1091538 - RNA, 13 nt, Mycobacterium bovis subsp bovis AF2122/97
cuugaucggcaca

SEQ ID NO: 1091539 - RNA, 13 nt, Mycobacterium bovis subsp bovis AF2122/97
cuugaucgagcag

SEQ ID NO: 1091540 - RNA, 12 nt, Mycobacterium bovis subsp bovis AF2122/97
cuugaucagccg

SEQ ID NO: 1091541 - RNA, 19 nt, Mycobacterium bovis subsp bovis AF2122/97
cuugaucaaggugucgacg

SEQ ID NO: 1091542 - RNA, 14 nt, Mycobacterium bovis subsp bovis AF2122/97
cuugaucaccgcgu

SEQ ID NO: 1091543 - RNA, 15 nt, Mycobacterium bovis subsp bovis AF2122/97
cuugaugcucgaugc

SEQ ID NO: 1091544 - RNA, 23 nt, Mycobacterium bovis subsp bovis AF2122/97
cuugaucugggcugcggccgcga

SEQ ID NO: 1091545 - RNA, 16 nt, Mycobacterium bovis subsp bovis AF2122/97
cuugauggucuccacc

SEQ ID NO: 1091546 - RNA, 17 nt, Mycobacterium bovis subsp bovis AF2122/97
cuugauggucuccacca

SEQ ID NO: 1091547 - RNA, 14 nt, Mycobacterium bovis subsp bovis AF2122/97
cuugauuucgaucg

SEQ ID NO: 1091548 - RNA, 15 nt, Mycobacterium bovis subsp bovis AF2122/97
cuugauguucgacgg

SEQ ID NO: 1091549 - RNA, 22 nt, Mycobacterium bovis subsp bovis AF2122/97
cuugccgccauuccagccggug

SEQ ID NO: 1091550 - RNA, 17 nt, Mycobacterium bovis subsp bovis AF2122/97
cuugccgccuuggcccc

SEQ ID NO: 1091551 - RNA, 14 nt, Mycobacterium bovis subsp bovis AF2122/97
cuugccgccggccc

SEQ ID NO: 1091552 - RNA, 13 nt, Mycobacterium bovis subsp bovis AF2122/97
cuugccgccggcg

SEQ ID NO: 1091553 - RNA, 16 nt, Mycobacterium bovis subsp bovis AF2122/97
cuugccgccggcgccg

SEQ ID NO: 1091554 - RNA, 16 nt, Mycobacterium bovis subsp bovis AF2122/97
cuugccgaugacgaug

SEQ ID NO: 1091555 - RNA, 22 nt, Mycobacterium bovis subsp bovis AF2122/97
cuugccgcccgcuccgccgucg

SEQ ID NO: 1091556 - RNA, 21 nt, Mycobacterium bovis subsp bovis AF2122/97
cuugcccuucuucgaccgcga

SEQ ID NO: 1091557 - RNA, 16 nt, Mycobacterium bovis subsp bovis AF2122/97
cuugccgagcaacacc

SEQ ID NO: 1091558 - RNA, 19 nt, Mycobacterium bovis subsp bovis AF2122/97
cuugccgaccugcgcgacg

SEQ ID NO: 1091559 - RNA, 14 nt, Mycobacterium bovis subsp bovis AF2122/97
cuugccaccacgca

SEQ ID NO: 1091560 - RNA, 19 nt, Mycobacterium bovis subsp bovis AF2122/97
cuugccaccgccgccggug

SEQ ID NO: 1091561 - RNA, 16 nt, Mycobacterium bovis subsp bovis AF2122/97
cuugcccagcgacaug

SEQ ID NO: 1091562 - RNA, 17 nt, Mycobacterium bovis subsp bovis AF2122/97
cuugcccacggcgacca

SEQ ID NO: 1091563 - RNA, 19 nt, Mycobacterium bovis subsp bovis AF2122/97
cuugcccacggcgaccacg

SEQ ID NO: 1091564 - RNA, 21 nt, Mycobacterium bovis subsp bovis AF2122/97
cuugcccacggcgaccacgcc

SEQ ID NO: 1091565 - RNA, 13 nt, Mycobacterium bovis subsp bovis AF2122/97
cuugcccgacggc

SEQ ID NO: 1091566 - RNA, 14 nt, Mycobacterium bovis subsp bovis AF2122/97
cuugcagcgcguuc

SEQ ID NO: 1091567 - RNA, 21 nt, Mycobacterium bovis subsp bovis AF2122/97
cuugcaguaacuucaccggcu

SEQ ID NO: 1091568 - RNA, 17 nt, Mycobacterium bovis subsp bovis AF2122/97
cuugcaauugcgcggcc

SEQ ID NO: 1091569 - RNA, 22 nt, Mycobacterium bovis subsp bovis AF2122/97
cuugccggugggguugcgcggu

SEQ ID NO: 1091570 - RNA, 21 nt, Mycobacterium bovis subsp bovis AF2122/97
cuugccgcugagcccugcgcc

SEQ ID NO: 1091571 - RNA, 11 nt, Mycobacterium bovis subsp bovis AF2122/97
cuugccgcgca

SEQ ID NO: 1091572 - RNA, 22 nt, Mycobacterium bovis subsp bovis AF2122/97
cuugccgucuucgccgccaccg

SEQ ID NO: 1091573 - RNA, 19 nt, Mycobacterium bovis subsp bovis AF2122/97
cuugccgucuucgccgcca

SEQ ID NO: 1091574 - RNA, 16 nt, Mycobacterium bovis subsp bovis AF2122/97
cuugccgucgcugacg

SEQ ID NO: 1091575 - RNA, 20 nt, Mycobacterium bovis subsp bovis AF2122/97
cuugcgaccccggcugcgcu

SEQ ID NO: 1091576 - RNA, 22 nt, Mycobacterium bovis subsp bovis AF2122/97
cuugcgacguucuugggaccga

SEQ ID NO: 1091577 - RNA, 21 nt, Mycobacterium bovis subsp bovis AF2122/97
cuugcgaaacgaauccgccau

SEQ ID NO: 1091578 - RNA, 17 nt, Mycobacterium bovis subsp bovis AF2122/97
cuugcgcgccauuggcg

SEQ ID NO: 1091579 - RNA, 14 nt, Mycobacterium bovis subsp bovis AF2122/97
cuugcgccgacugu

SEQ ID NO: 1091580 - RNA, 21 nt, Mycobacterium bovis subsp bovis AF2122/97
cuugcgcagccgcagccgguu

SEQ ID NO: 1091581 - RNA, 16 nt, Mycobacterium bovis subsp bovis AF2122/97
cuugcgcaucgccgac

SEQ ID NO: 1091582 - RNA, 16 nt, Mycobacterium bovis subsp bovis AF2122/97
cuugcgaucgccgcua

SEQ ID NO: 1091583 - RNA, 17 nt, Mycobacterium bovis subsp bovis AF2122/97
cuuggcccgggcccgcg

SEQ ID NO: 1091584 - RNA, 15 nt, Mycobacterium bovis subsp bovis AF2122/97
cuuggccgggucgaa

SEQ ID NO: 1091585 - RNA, 21 nt, Mycobacterium bovis subsp bovis AF2122/97
cuuggccguaggcggcgaccc

SEQ ID NO: 1091586 - RNA, 20 nt, Mycobacterium bovis subsp bovis AF2122/97
cuuggccggcuugucgacca

SEQ ID NO: 1091587 - RNA, 22 nt, Mycobacterium bovis subsp bovis AF2122/97
cuuggccgccacucgcccgcug

SEQ ID NO: 1091588 - RNA, 18 nt, Mycobacterium bovis subsp bovis AF2122/97
cuuggccgcgccggucgu

SEQ ID NO: 1091589 - RNA, 19 nt, Mycobacterium bovis subsp bovis AF2122/97
cuugcgguaggcggugacc

SEQ ID NO: 1091590 - RNA, 14 nt, Mycobacterium bovis subsp bovis AF2122/97
cuugcggggccggg

SEQ ID NO: 1091591 - RNA, 15 nt, Mycobacterium bovis subsp bovis AF2122/97
cuugcgggccuggug

SEQ ID NO: 1091592 - RNA, 22 nt, Mycobacterium bovis subsp bovis AF2122/97
cuugcggcacccagucggcgcc

SEQ ID NO: 1091593 - RNA, 14 nt, Mycobacterium bovis subsp bovis AF2122/97
cuugcggagccgcc

SEQ ID NO: 1091594 - RNA, 14 nt, Mycobacterium bovis subsp bovis AF2122/97
cuugcggcagacca

SEQ ID NO: 1091595 - RNA, 18 nt, Mycobacterium bovis subsp bovis AF2122/97
cuuggccguucggcgccc

SEQ ID NO: 1091596 - RNA, 24 nt, Mycobacterium bovis subsp bovis AF2122/97
cuuggccuagccgcggcaccgccg

SEQ ID NO: 1091597 - RNA, 15 nt, Mycobacterium bovis subsp bovis AF2122/97
cuuggccucagccac

SEQ ID NO: 1091598 - RNA, 16 nt, Mycobacterium bovis subsp bovis AF2122/97
cuuggccucagccacc

SEQ ID NO: 1091599 - RNA, 18 nt, Mycobacterium bovis subsp bovis AF2122/97
cuuggcgaacgccacggc

SEQ ID NO: 1091600 - RNA, 20 nt, Mycobacterium bovis subsp bovis AF2122/97
cuuggcgaucggguugaacc

SEQ ID NO: 1091601 - RNA, 23 nt, Mycobacterium bovis subsp bovis AF2122/97
cuuggugaagaucgacacccguu

SEQ ID NO: 1091602 - RNA, 23 nt, Mycobacterium bovis subsp bovis AF2122/97
cuugaccguccaccgacguggcc

SEQ ID NO: 1091603 - RNA, 15 nt, Mycobacterium bovis subsp bovis AF2122/97
cuugaccccgccgaa

SEQ ID NO: 1091604 - RNA, 17 nt, Mycobacterium bovis subsp bovis AF2122/97
cuugaccccgccgaacg

SEQ ID NO: 1091605 - RNA, 21 nt, Mycobacterium bovis subsp bovis AF2122/97
cuugaccccuggccgccggcg

SEQ ID NO: 1091606 - RNA, 14 nt, Mycobacterium bovis subsp bovis AF2122/97
cuugaccgcgguga

SEQ ID NO: 1091607 - RNA, 12 nt, Mycobacterium bovis subsp bovis AF2122/97
cuugaccgcacc

SEQ ID NO: 1091608 - RNA, 14 nt, Mycobacterium bovis subsp bovis AF2122/97
cuugaccgcaccgg

SEQ ID NO: 1091609 - RNA, 16 nt, Mycobacterium bovis subsp bovis AF2122/97
cuugaagguucgaucg

SEQ ID NO: 1091610 - RNA, 15 nt, Mycobacterium bovis subsp bovis AF2122/97
cuugaaccagcgcgu

SEQ ID NO: 1091611 - RNA, 22 nt, Mycobacterium bovis subsp bovis AF2122/97
cuucuugacacccaccucgcca

SEQ ID NO: 1091612 - RNA, 22 nt, Mycobacterium bovis subsp bovis AF2122/97
cuucuuggcggccuuugucgcc

SEQ ID NO: 1091613 - RNA, 19 nt, Mycobacterium bovis subsp bovis AF2122/97
cuucuugcgccgagaucga

SEQ ID NO: 1091614 - RNA, 19 nt, Mycobacterium bovis subsp bovis AF2122/97
cuucuucacuggcgaacca

SEQ ID NO: 1091615 - RNA, 19 nt, Mycobacterium bovis subsp bovis AF2122/97
cuucucgucggugcgcgcg

SEQ ID NO: 1091616 - RNA, 19 nt, Mycobacterium bovis subsp bovis AF2122/97
cuucucucgggccagucga

SEQ ID NO: 1091617 - RNA, 23 nt, Mycobacterium bovis subsp bovis AF2122/97
cuucucgucggugcgcgcggcga

SEQ ID NO: 1091618 - RNA, 16 nt, Mycobacterium bovis subsp bovis AF2122/97
cuucucguucgucggu

SEQ ID NO: 1091619 - RNA, 19 nt, Mycobacterium bovis subsp bovis AF2122/97
cuucuuaccgcgggccgcc

SEQ ID NO: 1091620 - RNA, 18 nt, Mycobacterium bovis subsp bovis AF2122/97
cuucucggacacgcugua

SEQ ID NO: 1091621 - RNA, 14 nt, Mycobacterium bovis subsp bovis AF2122/97
cuucucgccgccgc

SEQ ID NO: 1091622 - RNA, 14 nt, Mycobacterium bovis subsp bovis AF2122/97
cuucggcgccgcgc

SEQ ID NO: 1091623 - RNA, 16 nt, Mycobacterium bovis subsp bovis AF2122/97
cuucggcgccgcgccg

SEQ ID NO: 1091624 - RNA, 18 nt, Mycobacterium bovis subsp bovis AF2122/97
cuucggcgccgcgccguc

SEQ ID NO: 1091625 - RNA, 22 nt, Mycobacterium bovis subsp bovis AF2122/97
cuucggcgccgucucgaucgcg

SEQ ID NO: 1091626 - RNA, 16 nt, Mycobacterium bovis subsp bovis AF2122/97
cuucggccgaccgggc

SEQ ID NO: 1091627 - RNA, 15 nt, Mycobacterium bovis subsp bovis AF2122/97
cuucggcggacaggc

SEQ ID NO: 1091628 - RNA, 16 nt, Mycobacterium bovis subsp bovis AF2122/97
cuucggcggacaggcc

SEQ ID NO: 1091629 - RNA, 21 nt, Mycobacterium bovis subsp bovis AF2122/97
cuucgcgcgcugggcgcgcuc

SEQ ID NO: 1091630 - RNA, 20 nt, Mycobacterium bovis subsp bovis AF2122/97
cuucgcgaagaacgacgcca

SEQ ID NO: 1091631 - RNA, 21 nt, Mycobacterium bovis subsp bovis AF2122/97
cuucggcgaaguugcgcgacg

SEQ ID NO: 1091632 - RNA, 19 nt, Mycobacterium bovis subsp bovis AF2122/97
cuucggcgagcgcaucggc

SEQ ID NO: 1091633 - RNA, 20 nt, Mycobacterium bovis subsp bovis AF2122/97
cuucggcgagcgcaucggcc

SEQ ID NO: 1091634 - RNA, 18 nt, Mycobacterium bovis subsp bovis AF2122/97
cuucggcgagcggugauu

SEQ ID NO: 1091635 - RNA, 16 nt, Mycobacterium bovis subsp bovis AF2122/97
cuucggcgagcguacc

SEQ ID NO: 1091636 - RNA, 22 nt, Mycobacterium bovis subsp bovis AF2122/97
cuucggccagcaguagaucgga

SEQ ID NO: 1091637 - RNA, 21 nt, Mycobacterium bovis subsp bovis AF2122/97
cuucgcggcgaucgcaugguc

SEQ ID NO: 1091638 - RNA, 22 nt, Mycobacterium bovis subsp bovis AF2122/97
cuucggcauucgcaccaccugg

SEQ ID NO: 1091639 - RNA, 18 nt, Mycobacterium bovis subsp bovis AF2122/97
cuucggccaaccaugcug

SEQ ID NO: 1091640 - RNA, 19 nt, Mycobacterium bovis subsp bovis AF2122/97
cuucgagguggcugcgccg

SEQ ID NO: 1091641 - RNA, 14 nt, Mycobacterium bovis subsp bovis AF2122/97
cuucgauaccgacc

SEQ ID NO: 1091642 - RNA, 15 nt, Mycobacterium bovis subsp bovis AF2122/97
cuucgauaccgaccg

SEQ ID NO: 1091643 - RNA, 14 nt, Mycobacterium bovis subsp bovis AF2122/97
cuucgagccgcaca

SEQ ID NO: 1091644 - RNA, 18 nt, Mycobacterium bovis subsp bovis AF2122/97
cuucgacgcggcgaccgu

SEQ ID NO: 1091645 - RNA, 19 nt, Mycobacterium bovis subsp bovis AF2122/97
cuucgagauugccgagguc

SEQ ID NO: 1091646 - RNA, 21 nt, Mycobacterium bovis subsp bovis AF2122/97
cuucgagcaccgacaccggcc

SEQ ID NO: 1091647 - RNA, 15 nt, Mycobacterium bovis subsp bovis AF2122/97
cuucgaucagcggca

SEQ ID NO: 1091648 - RNA, 20 nt, Mycobacterium bovis subsp bovis AF2122/97
cuucgaucuccaggcccggc

SEQ ID NO: 1091649 - RNA, 16 nt, Mycobacterium bovis subsp bovis AF2122/97
cuucgauaccgaccga

SEQ ID NO: 1091650 - RNA, 18 nt, Mycobacterium bovis subsp bovis AF2122/97
cuucgccgaguugaccgc

SEQ ID NO: 1091651 - RNA, 23 nt, Mycobacterium bovis subsp bovis AF2122/97
cuuccucggggcucucgagucca

SEQ ID NO: 1091652 - RNA, 13 nt, Mycobacterium bovis subsp bovis AF2122/97
cuuccucggcaag

SEQ ID NO: 1091653 - RNA, 14 nt, Mycobacterium bovis subsp bovis AF2122/97
cuuccucggccacc

SEQ ID NO: 1091654 - RNA, 17 nt, Mycobacterium bovis subsp bovis AF2122/97
cuuccuccucggcgcga

SEQ ID NO: 1091655 - RNA, 14 nt, Mycobacterium bovis subsp bovis AF2122/97
cuuccucgacgagc

SEQ ID NO: 1091656 - RNA, 15 nt, Mycobacterium bovis subsp bovis AF2122/97
cuuccuccgacgcga

SEQ ID NO: 1091657 - RNA, 16 nt, Mycobacterium bovis subsp bovis AF2122/97
cuuccuggcgggcgcc

SEQ ID NO: 1091658 - RNA, 21 nt, Mycobacterium bovis subsp bovis AF2122/97
cuuccgacaugaaccggucga

SEQ ID NO: 1091659 - RNA, 16 nt, Mycobacterium bovis subsp bovis AF2122/97
cuucccgcuugagcag

SEQ ID NO: 1091660 - RNA, 19 nt, Mycobacterium bovis subsp bovis AF2122/97
cuuccccucggccgcccgu

SEQ ID NO: 1091661 - RNA, 15 nt, Mycobacterium bovis subsp bovis AF2122/97
cuuccguggcccaac

SEQ ID NO: 1091662 - RNA, 21 nt, Mycobacterium bovis subsp bovis AF2122/97
cuucccuccagauaccaccgc

SEQ ID NO: 1091663 - RNA, 20 nt, Mycobacterium bovis subsp bovis AF2122/97
cuuccgguccagcggccgcc

SEQ ID NO: 1091664 - RNA, 15 nt, Mycobacterium bovis subsp bovis AF2122/97
cuuccccgaucgugc

SEQ ID NO: 1091665 - RNA, 13 nt, Mycobacterium bovis subsp bovis AF2122/97
cuucccacccggc

SEQ ID NO: 1091666 - RNA, 14 nt, Mycobacterium bovis subsp bovis AF2122/97
cuucccacccggcc

SEQ ID NO: 1091667 - RNA, 23 nt, Mycobacterium bovis subsp bovis AF2122/97
cuucccaguagaucgccucgacg

SEQ ID NO: 1091668 - RNA, 13 nt, Mycobacterium bovis subsp bovis AF2122/97
cuucacugcgacc

SEQ ID NO: 1091669 - RNA, 15 nt, Mycobacterium bovis subsp bovis AF2122/97
cuucacugcgaccgu

SEQ ID NO: 1091670 - RNA, 20 nt, Mycobacterium bovis subsp bovis AF2122/97
cuucacugcgaccgucccgg

SEQ ID NO: 1091671 - RNA, 15 nt, Mycobacterium bovis subsp bovis AF2122/97
cuucagcaacggcau

SEQ ID NO: 1091672 - RNA, 15 nt, Mycobacterium bovis subsp bovis AF2122/97
cugcgcggcuugucg

SEQ ID NO: 1091673 - RNA, 18 nt, Mycobacterium bovis subsp bovis AF2122/97
cugcgcggcuugucgcgg

SEQ ID NO: 1091674 - RNA, 22 nt, Mycobacterium bovis subsp bovis AF2122/97
cugcgcggcuugucgcggugcg

SEQ ID NO: 1091675 - RNA, 20 nt, Mycobacterium bovis subsp bovis AF2122/97
cugcgcgugcucgacgcgca

SEQ ID NO: 1091676 - RNA, 17 nt, Mycobacterium bovis subsp bovis AF2122/97
cugcgcgucgagcgacc

SEQ ID NO: 1091677 - RNA, 19 nt, Mycobacterium bovis subsp bovis AF2122/97
cugcgcgucgagcagcacc

SEQ ID NO: 1091678 - RNA, 15 nt, Mycobacterium bovis subsp bovis AF2122/97
cugcgcgugggcaca

SEQ ID NO: 1091679 - RNA, 14 nt, Mycobacterium bovis subsp bovis AF2122/97
cugcgcgcgaucca

SEQ ID NO: 1091680 - RNA, 13 nt, Mycobacterium bovis subsp bovis AF2122/97
cugcgcgcggccg

SEQ ID NO: 1091681 - RNA, 23 nt, Mycobacterium bovis subsp bovis AF2122/97
cugcgcgcggccgcgcugcagca

SEQ ID NO: 1091682 - RNA, 15 nt, Mycobacterium bovis subsp bovis AF2122/97
cugcgcgcggcggcc

SEQ ID NO: 1091683 - RNA, 18 nt, Mycobacterium bovis subsp bovis AF2122/97
cugcgcgcggcggccgcg

SEQ ID NO: 1091684 - RNA, 13 nt, Mycobacterium bovis subsp bovis AF2122/97
cugcgcggcugcc

SEQ ID NO: 1091685 - RNA, 14 nt, Mycobacterium bovis subsp bovis AF2122/97
cugcgcggcuucgu

SEQ ID NO: 1091686 - RNA, 18 nt, Mycobacterium bovis subsp bovis AF2122/97
cugcgcgcucggccagca

SEQ ID NO: 1091687 - RNA, 15 nt, Mycobacterium bovis subsp bovis AF2122/97
cugcgcggccaccuc

SEQ ID NO: 1091688 - RNA, 20 nt, Mycobacterium bovis subsp bovis AF2122/97
cugcgcggcgaucgcuccgc

SEQ ID NO: 1091689 - RNA, 22 nt, Mycobacterium bovis subsp bovis AF2122/97
cugcgcuuugcacagcggcauc

SEQ ID NO: 1091690 - RNA, 20 nt, Mycobacterium bovis subsp bovis AF2122/97
cugcggaacaccagcaggcg

SEQ ID NO: 1091691 - RNA, 23 nt, Mycobacterium bovis subsp bovis AF2122/97
cugcggauagugguugcggccgu

SEQ ID NO: 1091692 - RNA, 15 nt, Mycobacterium bovis subsp bovis AF2122/97
cugcggauccaccac

SEQ ID NO: 1091693 - RNA, 13 nt, Mycobacterium bovis subsp bovis AF2122/97
cugcggacuggca

SEQ ID NO: 1091694 - RNA, 17 nt, Mycobacterium bovis subsp bovis AF2122/97
cugcggaggguucgccg

SEQ ID NO: 1091695 - RNA, 17 nt, Mycobacterium bovis subsp bovis AF2122/97
cugcgcuguucggcacg

SEQ ID NO: 1091696 - RNA, 22 nt, Mycobacterium bovis subsp bovis AF2122/97
cugcgcucgggcugccgcaugc

SEQ ID NO: 1091697 - RNA, 22 nt, Mycobacterium bovis subsp bovis AF2122/97
cugcggcgcuggccagcagggu

SEQ ID NO: 1091698 - RNA, 15 nt, Mycobacterium bovis subsp bovis AF2122/97
cugcggcgcccgguc

SEQ ID NO: 1091699 - RNA, 18 nt, Mycobacterium bovis subsp bovis AF2122/97
cugcggccugcucgacca

SEQ ID NO: 1091700 - RNA, 23 nt, Mycobacterium bovis subsp bovis AF2122/97
cugcggccugcucgaccaugccg

SEQ ID NO: 1091701 - RNA, 18 nt, Mycobacterium bovis subsp bovis AF2122/97
cugcggcgucguugagga

SEQ ID NO: 1091702 - RNA, 13 nt, Mycobacterium bovis subsp bovis AF2122/97
cugcggcucgcug

SEQ ID NO: 1091703 - RNA, 22 nt, Mycobacterium bovis subsp bovis AF2122/97
cugcggcucagaacccuccgca

SEQ ID NO: 1091704 - RNA, 16 nt, Mycobacterium bovis subsp bovis AF2122/97
cugcggcuccggcggc

SEQ ID NO: 1091705 - RNA, 20 nt, Mycobacterium bovis subsp bovis AF2122/97
cugcggcuccggcggcagcg

SEQ ID NO: 1091706 - RNA, 15 nt, Mycobacterium bovis subsp bovis AF2122/97
cugcggcggucaugg

SEQ ID NO: 1091707 - RNA, 19 nt, Mycobacterium bovis subsp bovis AF2122/97
cugcggcggccauucgguc

SEQ ID NO: 1091708 - RNA, 22 nt, Mycobacterium bovis subsp bovis AF2122/97
cugcgggaaguugcccagguga

SEQ ID NO: 1091709 - RNA, 18 nt, Mycobacterium bovis subsp bovis AF2122/97
cugcgggccgagaucacg

SEQ ID NO: 1091710 - RNA, 21 nt, Mycobacterium bovis subsp bovis AF2122/97
cugcgggccgagaucacgccg

SEQ ID NO: 1091711 - RNA, 20 nt, Mycobacterium bovis subsp bovis AF2122/97
cugcgggaacgcggcggcga

SEQ ID NO: 1091712 - RNA, 19 nt, Mycobacterium bovis subsp bovis AF2122/97
cugcggcccacaccagcgc

SEQ ID NO: 1091713 - RNA, 19 nt, Mycobacterium bovis subsp bovis AF2122/97
cugcggcccaugaucucgg

SEQ ID NO: 1091714 - RNA, 17 nt, Mycobacterium bovis subsp bovis AF2122/97
cugcggcagcgcggcca

SEQ ID NO: 1091715 - RNA, 14 nt, Mycobacterium bovis subsp bovis AF2122/97
cugcggcagcggac

SEQ ID NO: 1091716 - RNA, 15 nt, Mycobacterium bovis subsp bovis AF2122/97
cugcggcagcggacc

SEQ ID NO: 1091717 - RNA, 16 nt, Mycobacterium bovis subsp bovis AF2122/97
cugcggcauggcaggc

SEQ ID NO: 1091718 - RNA, 18 nt, Mycobacterium bovis subsp bovis AF2122/97
cugcggcaggucgaugcu

SEQ ID NO: 1091719 - RNA, 12 nt, Mycobacterium bovis subsp bovis AF2122/97
cugcggccgcga

SEQ ID NO: 1091720 - RNA, 18 nt, Mycobacterium bovis subsp bovis AF2122/97
cugcggccgcgugccgcc

SEQ ID NO: 1091721 - RNA, 19 nt, Mycobacterium bovis subsp bovis AF2122/97
cugcggcccgacccggccg

SEQ ID NO: 1091722 - RNA, 23 nt, Mycobacterium bovis subsp bovis AF2122/97
cugcggcccgacccggccgaugg

SEQ ID NO: 1091723 - RNA, 17 nt, Mycobacterium bovis subsp bovis AF2122/97
cugcggcccgacccggc

SEQ ID NO: 1091724 - RNA, 15 nt, Mycobacterium bovis subsp bovis AF2122/97
cugcggccagcgcgg

SEQ ID NO: 1091725 - RNA, 20 nt, Mycobacterium bovis subsp bovis AF2122/97
cugcggcaccacccggcgaa

SEQ ID NO: 1091726 - RNA, 15 nt, Mycobacterium bovis subsp bovis AF2122/97
cugcggcagcacccg

SEQ ID NO: 1091727 - RNA, 11 nt, Mycobacterium bovis subsp bovis AF2122/97
cugcggcacca

SEQ ID NO: 1091728 - RNA, 20 nt, Mycobacterium bovis subsp bovis AF2122/97
cugcggauuaagucggcggc

SEQ ID NO: 1091729 - RNA, 21 nt, Mycobacterium bovis subsp bovis AF2122/97
cugcggauuaagucggcggcc

SEQ ID NO: 1091730 - RNA, 18 nt, Mycobacterium bovis subsp bovis AF2122/97
cugcgcgaagccaccagg

SEQ ID NO: 1091731 - RNA, 19 nt, Mycobacterium bovis subsp bovis AF2122/97
cugcgccuuggucgccggc

SEQ ID NO: 1091732 - RNA, 20 nt, Mycobacterium bovis subsp bovis AF2122/97
cugcgccuuggucgccggcg

SEQ ID NO: 1091733 - RNA, 18 nt, Mycobacterium bovis subsp bovis AF2122/97
cugcgcccacccgcgccu

SEQ ID NO: 1091734 - RNA, 14 nt, Mycobacterium bovis subsp bovis AF2122/97
cugcgccuucgcca

SEQ ID NO: 1091735 - RNA, 18 nt, Mycobacterium bovis subsp bovis AF2122/97
cugcgccuucgccagcgg

SEQ ID NO: 1091736 - RNA, 23 nt, Mycobacterium bovis subsp bovis AF2122/97
cugcgccuucgccagcggcgcga

SEQ ID NO: 1091737 - RNA, 19 nt, Mycobacterium bovis subsp bovis AF2122/97
cugcgcgaaggggacgugc

SEQ ID NO: 1091738 - RNA, 14 nt, Mycobacterium bovis subsp bovis AF2122/97
cugcgcgaccgacc

SEQ ID NO: 1091739 - RNA, 16 nt, Mycobacterium bovis subsp bovis AF2122/97
cugcgcgagguuggcg

SEQ ID NO: 1091740 - RNA, 17 nt, Mycobacterium bovis subsp bovis AF2122/97
cugcgcgaccgaccagc

SEQ ID NO: 1091741 - RNA, 16 nt, Mycobacterium bovis subsp bovis AF2122/97
cugcgcgauccgcgcg

SEQ ID NO: 1091742 - RNA, 15 nt, Mycobacterium bovis subsp bovis AF2122/97
cugcgcgauggccgu

SEQ ID NO: 1091743 - RNA, 20 nt, Mycobacterium bovis subsp bovis AF2122/97
cugcgcgccagacacaaccg

SEQ ID NO: 1091744 - RNA, 13 nt, Mycobacterium bovis subsp bovis AF2122/97
cugcgcgccguuc

SEQ ID NO: 1091745 - RNA, 14 nt, Mycobacterium bovis subsp bovis AF2122/97
cugcgccucggcgg

SEQ ID NO: 1091746 - RNA, 15 nt, Mycobacterium bovis subsp bovis AF2122/97
cugcgccucggcggc

SEQ ID NO: 1091747 - RNA, 16 nt, Mycobacterium bovis subsp bovis AF2122/97
cugcgccgucgcagcc

SEQ ID NO: 1091748 - RNA, 16 nt, Mycobacterium bovis subsp bovis AF2122/97
cugcgccgccacagca

SEQ ID NO: 1091749 - RNA, 12 nt, Mycobacterium bovis subsp bovis AF2122/97
cugcgccgcgcg

SEQ ID NO: 1091750 - RNA, 13 nt, Mycobacterium bovis subsp bovis AF2122/97
cugcgccgcgcgc

SEQ ID NO: 1091751 - RNA, 12 nt, Mycobacterium bovis subsp bovis AF2122/97
cugcgccggccg

SEQ ID NO: 1091752 - RNA, 14 nt, Mycobacterium bovis subsp bovis AF2122/97
cugcgccggccggc

SEQ ID NO: 1091753 - RNA, 17 nt, Mycobacterium bovis subsp bovis AF2122/97
cugcgccggccggcgca

SEQ ID NO: 1091754 - RNA, 19 nt, Mycobacterium bovis subsp bovis AF2122/97
cugcgccgauacccagcgg

SEQ ID NO: 1091755 - RNA, 17 nt, Mycobacterium bovis subsp bovis AF2122/97
cugcgccgacccgcgcg

SEQ ID NO: 1091756 - RNA, 21 nt, Mycobacterium bovis subsp bovis AF2122/97
cugcgccgacccgcgcgccgg

SEQ ID NO: 1091757 - RNA, 18 nt, Mycobacterium bovis subsp bovis AF2122/97
cugcgccgcacgccgacc

SEQ ID NO: 1091758 - RNA, 16 nt, Mycobacterium bovis subsp bovis AF2122/97
cugcgccgccggcggc

SEQ ID NO: 1091759 - RNA, 17 nt, Mycobacterium bovis subsp bovis AF2122/97
cugcgccgccggcggcg

SEQ ID NO: 1091760 - RNA, 13 nt, Mycobacterium bovis subsp bovis AF2122/97
cugcgccgccagc

SEQ ID NO: 1091761 - RNA, 15 nt, Mycobacterium bovis subsp bovis AF2122/97
cugcgccgccagcgc

SEQ ID NO: 1091762 - RNA, 20 nt, Mycobacterium bovis subsp bovis AF2122/97
cugcgccgccagcgccgccg

SEQ ID NO: 1091763 - RNA, 21 nt, Mycobacterium bovis subsp bovis AF2122/97
cugcgccgccagcgccgccgg

SEQ ID NO: 1091764 - RNA, 20 nt, Mycobacterium bovis subsp bovis AF2122/97
cugcgccaucacaucggccu

SEQ ID NO: 1091765 - RNA, 12 nt, Mycobacterium bovis subsp bovis AF2122/97
cugcgcccgcca

SEQ ID NO: 1091766 - RNA, 14 nt, Mycobacterium bovis subsp bovis AF2122/97
cugcgcccggacca

SEQ ID NO: 1091767 - RNA, 14 nt, Mycobacterium bovis subsp bovis AF2122/97
cugcgccgaacacc

SEQ ID NO: 1091768 - RNA, 22 nt, Mycobacterium bovis subsp bovis AF2122/97
cugcgccgaacaccacaccgag

SEQ ID NO: 1091769 - RNA, 17 nt, Mycobacterium bovis subsp bovis AF2122/97
cugcgccacgucgacgg

SEQ ID NO: 1091770 - RNA, 17 nt, Mycobacterium bovis subsp bovis AF2122/97
cugcgccaggaauugcc

SEQ ID NO: 1091771 - RNA, 12 nt, Mycobacterium bovis subsp bovis AF2122/97
cugcgccacacc

SEQ ID NO: 1091772 - RNA, 18 nt, Mycobacterium bovis subsp bovis AF2122/97
cugcgccacagcagcguu

SEQ ID NO: 1091773 - RNA, 16 nt, Mycobacterium bovis subsp bovis AF2122/97
cugcgcaucgccacca

SEQ ID NO: 1091774 - RNA, 15 nt, Mycobacterium bovis subsp bovis AF2122/97
cugcgcagcgccugc

SEQ ID NO: 1091775 - RNA, 14 nt, Mycobacterium bovis subsp bovis AF2122/97
cugcgcaucaccac

SEQ ID NO: 1091776 - RNA, 17 nt, Mycobacterium bovis subsp bovis AF2122/97
cugcgcaucaccacugg

SEQ ID NO: 1091777 - RNA, 18 nt, Mycobacterium bovis subsp bovis AF2122/97
cugcgcaucaccacuggc

SEQ ID NO: 1091778 - RNA, 12 nt, Mycobacterium bovis subsp bovis AF2122/97
cugcgcagcgca

SEQ ID NO: 1091779 - RNA, 14 nt, Mycobacterium bovis subsp bovis AF2122/97
cugcgcagcgcaac

SEQ ID NO: 1091780 - RNA, 17 nt, Mycobacterium bovis subsp bovis AF2122/97
cugcgcagccgccucaa

SEQ ID NO: 1091781 - RNA, 14 nt, Mycobacterium bovis subsp bovis AF2122/97
cugcgcaccgccgc

SEQ ID NO: 1091782 - RNA, 16 nt, Mycobacterium bovis subsp bovis AF2122/97
cugcgcaccgccgcgc

SEQ ID NO: 1091783 - RNA, 17 nt, Mycobacterium bovis subsp bovis AF2122/97
cugcgcaccgccgcgcg

SEQ ID NO: 1091784 - RNA, 18 nt, Mycobacterium bovis subsp bovis AF2122/97
cugcgcaccgccgcgcga

SEQ ID NO: 1091785 - RNA, 20 nt, Mycobacterium bovis subsp bovis AF2122/97
cugcgcaaccgagcggucga

SEQ ID NO: 1091786 - RNA, 14 nt, Mycobacterium bovis subsp bovis AF2122/97
cugcgcaccaaggc

SEQ ID NO: 1091787 - RNA, 17 nt, Mycobacterium bovis subsp bovis AF2122/97
cugcgaccaagucaugc

SEQ ID NO: 1091788 - RNA, 19 nt, Mycobacterium bovis subsp bovis AF2122/97
cugcgacgaugccgccugg

SEQ ID NO: 1091789 - RNA, 18 nt, Mycobacterium bovis subsp bovis AF2122/97
cugcgaccgucccggccu

SEQ ID NO: 1091790 - RNA, 18 nt, Mycobacterium bovis subsp bovis AF2122/97
cugcgagauguccuccca

SEQ ID NO: 1091791 - RNA, 14 nt, Mycobacterium bovis subsp bovis AF2122/97
cugcgacuggugcc

SEQ ID NO: 1091792 - RNA, 16 nt, Mycobacterium bovis subsp bovis AF2122/97
cugcgagagcaccgac

SEQ ID NO: 1091793 - RNA, 21 nt, Mycobacterium bovis subsp bovis AF2122/97
cugcgagaucggauggugugu

SEQ ID NO: 1091794 - RNA, 19 nt, Mycobacterium bovis subsp bovis AF2122/97
cugcgacguuaacugcgcc

SEQ ID NO: 1091795 - RNA, 22 nt, Mycobacterium bovis subsp bovis AF2122/97
cugcgacuaagggcacuccacc

SEQ ID NO: 1091796 - RNA, 16 nt, Mycobacterium bovis subsp bovis AF2122/97
cugcgagcgcagcgca

SEQ ID NO: 1091797 - RNA, 20 nt, Mycobacterium bovis subsp bovis AF2122/97
cugcgagggcacgcgcacag

SEQ ID NO: 1091798 - RNA, 15 nt, Mycobacterium bovis subsp bovis AF2122/97
cugcgagugcggcac

SEQ ID NO: 1091799 - RNA, 17 nt, Mycobacterium bovis subsp bovis AF2122/97
cugcgauauggucacca

SEQ ID NO: 1091800 - RNA, 22 nt, Mycobacterium bovis subsp bovis AF2122/97
cugcgaucaacccuacccgcau

SEQ ID NO: 1091801 - RNA, 16 nt, Mycobacterium bovis subsp bovis AF2122/97
cugcgaucgccgcgcu

SEQ ID NO: 1091802 - RNA, 21 nt, Mycobacterium bovis subsp bovis AF2122/97
cugcgaucgccgcgcuggucg

SEQ ID NO: 1091803 - RNA, 15 nt, Mycobacterium bovis subsp bovis AF2122/97
cugcgaucgcgaccc

SEQ ID NO: 1091804 - RNA, 20 nt, Mycobacterium bovis subsp bovis AF2122/97
cugcgaucugaaacagucga

SEQ ID NO: 1091805 - RNA, 13 nt, Mycobacterium bovis subsp bovis AF2122/97
cugcgagcaguug

SEQ ID NO: 1091806 - RNA, 14 nt, Mycobacterium bovis subsp bovis AF2122/97
cugcgcaacaccau

SEQ ID NO: 1091807 - RNA, 17 nt, Mycobacterium bovis subsp bovis AF2122/97
cugcgacagcacgugcc

SEQ ID NO: 1091808 - RNA, 18 nt, Mycobacterium bovis subsp bovis AF2122/97
cugcgacaagaccggcgg

SEQ ID NO: 1091809 - RNA, 13 nt, Mycobacterium bovis subsp bovis AF2122/97
cugcgacaccacg

SEQ ID NO: 1091810 - RNA, 16 nt, Mycobacterium bovis subsp bovis AF2122/97
cugcgacaagaccggc

SEQ ID NO: 1091811 - RNA, 13 nt, Mycobacterium bovis subsp bovis AF2122/97
cugcgaacccugc

SEQ ID NO: 1091812 - RNA, 16 nt, Mycobacterium bovis subsp bovis AF2122/97
cugcgaacccugcgca

SEQ ID NO: 1091813 - RNA, 17 nt, Mycobacterium bovis subsp bovis AF2122/97
cugcgaaaauccgugcc

SEQ ID NO: 1091814 - RNA, 18 nt, Mycobacterium bovis subsp bovis AF2122/97
cugcgaaagccacucgcg

SEQ ID NO: 1091815 - RNA, 15 nt, Mycobacterium bovis subsp bovis AF2122/97
cugcgaaacgcuggc

SEQ ID NO: 1091816 - RNA, 13 nt, Mycobacterium bovis subsp bovis AF2122/97
cugccuuggccgg

SEQ ID NO: 1091817 - RNA, 14 nt, Mycobacterium bovis subsp bovis AF2122/97
cugccuuggccggc

SEQ ID NO: 1091818 - RNA, 15 nt, Mycobacterium bovis subsp bovis AF2122/97
cugccuuggcgcggc

SEQ ID NO: 1091819 - RNA, 21 nt, Mycobacterium bovis subsp bovis AF2122/97
cugccgguguuguaggccggg

SEQ ID NO: 1091820 - RNA, 13 nt, Mycobacterium bovis subsp bovis AF2122/97
cugccgguguaca

SEQ ID NO: 1091821 - RNA, 23 nt, Mycobacterium bovis subsp bovis AF2122/97
cugccggugagugcgcgauaggu

SEQ ID NO: 1091822 - RNA, 13 nt, Mycobacterium bovis subsp bovis AF2122/97
cugccggugcuga

SEQ ID NO: 1091823 - RNA, 21 nt, Mycobacterium bovis subsp bovis AF2122/97
cugccgguggcggcggcggca

SEQ ID NO: 1091824 - RNA, 14 nt, Mycobacterium bovis subsp bovis AF2122/97
cugccggugggcgu

SEQ ID NO: 1091825 - RNA, 16 nt, Mycobacterium bovis subsp bovis AF2122/97
cugccggucgaugucg

SEQ ID NO: 1091826 - RNA, 22 nt, Mycobacterium bovis subsp bovis AF2122/97
cugccgguagcacagcagcaac

SEQ ID NO: 1091827 - RNA, 17 nt, Mycobacterium bovis subsp bovis AF2122/97
cugccggucgaugucgg

SEQ ID NO: 1091828 - RNA, 22 nt, Mycobacterium bovis subsp bovis AF2122/97
cugccgucggagaccagcucgu

SEQ ID NO: 1091829 - RNA, 19 nt, Mycobacterium bovis subsp bovis AF2122/97
cugccgucagccguucggc

SEQ ID NO: 1091830 - RNA, 16 nt, Mycobacterium bovis subsp bovis AF2122/97
cugccguggcggcagc

SEQ ID NO: 1091831 - RNA, 12 nt, Mycobacterium bovis subsp bovis AF2122/97
cugccguucggg

SEQ ID NO: 1091832 - RNA, 20 nt, Mycobacterium bovis subsp bovis AF2122/97
cugccguuagcuuagcugcc

SEQ ID NO: 1091833 - RNA, 15 nt, Mycobacterium bovis subsp bovis AF2122/97
cugccguucagcggc

SEQ ID NO: 1091834 - RNA, 19 nt, Mycobacterium bovis subsp bovis AF2122/97
cugccguuccagcaucggu

SEQ ID NO: 1091835 - RNA, 16 nt, Mycobacterium bovis subsp bovis AF2122/97
cugccguugccgccgg

SEQ ID NO: 1091836 - RNA, 20 nt, Mycobacterium bovis subsp bovis AF2122/97
cugccguugauucggccgcc

SEQ ID NO: 1091837 - RNA, 23 nt, Mycobacterium bovis subsp bovis AF2122/97
cugccguugauucggccgccgac

SEQ ID NO: 1091838 - RNA, 24 nt, Mycobacterium bovis subsp bovis AF2122/97
cugccguugauucggccgccgacg

SEQ ID NO: 1091839 - RNA, 17 nt, Mycobacterium bovis subsp bovis AF2122/97
cugccucaccgccgcua

SEQ ID NO: 1091840 - RNA, 21 nt, Mycobacterium bovis subsp bovis AF2122/97
cugccucaccgccgcuaccgc

SEQ ID NO: 1091841 - RNA, 21 nt, Mycobacterium bovis subsp bovis AF2122/97
cugccucgccugcacgcccgg

SEQ ID NO: 1091842 - RNA, 13 nt, Mycobacterium bovis subsp bovis AF2122/97
cugccugcgcacg

SEQ ID NO: 1091843 - RNA, 20 nt, Mycobacterium bovis subsp bovis AF2122/97
cugccucuugcucggcgugc

SEQ ID NO: 1091844 - RNA, 18 nt, Mycobacterium bovis subsp bovis AF2122/97
cugccucucagcacgguu

SEQ ID NO: 1091845 - RNA, 17 nt, Mycobacterium bovis subsp bovis AF2122/97
cugccucuugcucggcg

SEQ ID NO: 1091846 - RNA, 19 nt, Mycobacterium bovis subsp bovis AF2122/97
cugccggcagcgcccccgg

SEQ ID NO: 1091847 - RNA, 16 nt, Mycobacterium bovis subsp bovis AF2122/97
cugccggcagcggcga

SEQ ID NO: 1091848 - RNA, 15 nt, Mycobacterium bovis subsp bovis AF2122/97
cugccggcagcgucc

SEQ ID NO: 1091849 - RNA, 12 nt, Mycobacterium bovis subsp bovis AF2122/97
cugccggcacca

SEQ ID NO: 1091850 - RNA, 12 nt, Mycobacterium bovis subsp bovis AF2122/97
cugccggcacgc

SEQ ID NO: 1091851 - RNA, 17 nt, Mycobacterium bovis subsp bovis AF2122/97
cugccggcacgcaugcc

SEQ ID NO: 1091852 - RNA, 18 nt, Mycobacterium bovis subsp bovis AF2122/97
cugccggcaacagcucgc

SEQ ID NO: 1091853 - RNA, 14 nt, Mycobacterium bovis subsp bovis AF2122/97
cugccggcacgccg

SEQ ID NO: 1091854 - RNA, 14 nt, Mycobacterium bovis subsp bovis AF2122/97
cugccggccgcgua

SEQ ID NO: 1091855 - RNA, 14 nt, Mycobacterium bovis subsp bovis AF2122/97
cugccggcccacca

SEQ ID NO: 1091856 - RNA, 12 nt, Mycobacterium bovis subsp bovis AF2122/97
cugccggccggc

SEQ ID NO: 1091857 - RNA, 15 nt, Mycobacterium bovis subsp bovis AF2122/97
cugccgggccacggc

SEQ ID NO: 1091858 - RNA, 13 nt, Mycobacterium bovis subsp bovis AF2122/97
cugccggcugaca

SEQ ID NO: 1091859 - RNA, 17 nt, Mycobacterium bovis subsp bovis AF2122/97
cugccggcugacgacca

SEQ ID NO: 1091860 - RNA, 14 nt, Mycobacterium bovis subsp bovis AF2122/97
cugccgcgcgcugc

SEQ ID NO: 1091861 - RNA, 13 nt, Mycobacterium bovis subsp bovis AF2122/97
cugccgcggccgg

SEQ ID NO: 1091862 - RNA, 20 nt, Mycobacterium bovis subsp bovis AF2122/97
cugccgcguagaacccaggc

SEQ ID NO: 1091863 - RNA, 15 nt, Mycobacterium bovis subsp bovis AF2122/97
cugccgcucgccggu

SEQ ID NO: 1091864 - RNA, 17 nt, Mycobacterium bovis subsp bovis AF2122/97
cugccgcuggucgucga

SEQ ID NO: 1091865 - RNA, 13 nt, Mycobacterium bovis subsp bovis AF2122/97
cugccgcugcgcc

SEQ ID NO: 1091866 - RNA, 15 nt, Mycobacterium bovis subsp bovis AF2122/97
cugccggacuaccgc

SEQ ID NO: 1091867 - RNA, 20 nt, Mycobacterium bovis subsp bovis AF2122/97
cugccggacuaccgccggcg

SEQ ID NO: 1091868 - RNA, 21 nt, Mycobacterium bovis subsp bovis AF2122/97
cugccgcaaacgcggcgucga

SEQ ID NO: 1091869 - RNA, 17 nt, Mycobacterium bovis subsp bovis AF2122/97
cugccgcaccaaggccg

SEQ ID NO: 1091870 - RNA, 12 nt, Mycobacterium bovis subsp bovis AF2122/97
cugccgcacccg

SEQ ID NO: 1091871 - RNA, 13 nt, Mycobacterium bovis subsp bovis AF2122/97
cugccgcacccgg

SEQ ID NO: 1091872 - RNA, 12 nt, Mycobacterium bovis subsp bovis AF2122/97
cugccgcaccgg

SEQ ID NO: 1091873 - RNA, 17 nt, Mycobacterium bovis subsp bovis AF2122/97
cugccgcacguucggcg

SEQ ID NO: 1091874 - RNA, 16 nt, Mycobacterium bovis subsp bovis AF2122/97
cugccgcacugggcga

SEQ ID NO: 1091875 - RNA, 15 nt, Mycobacterium bovis subsp bovis AF2122/97
cugccgauagcgcgg

SEQ ID NO: 1091876 - RNA, 18 nt, Mycobacterium bovis subsp bovis AF2122/97
cugccgcaucggcaaggc

SEQ ID NO: 1091877 - RNA, 15 nt, Mycobacterium bovis subsp bovis AF2122/97
cugccgccgagcugg

SEQ ID NO: 1091878 - RNA, 19 nt, Mycobacterium bovis subsp bovis AF2122/97
cugccgccgagcuggcgcg

SEQ ID NO: 1091879 - RNA, 15 nt, Mycobacterium bovis subsp bovis AF2122/97
cugccgccgcggcca

SEQ ID NO: 1091880 - RNA, 17 nt, Mycobacterium bovis subsp bovis AF2122/97
cugccgccgcggccaca

SEQ ID NO: 1091881 - RNA, 18 nt, Mycobacterium bovis subsp bovis AF2122/97
cugccgccgucgccgccg

SEQ ID NO: 1091882 - RNA, 22 nt, Mycobacterium bovis subsp bovis AF2122/97
cugccgccgucgccgccgucac

SEQ ID NO: 1091883 - RNA, 13 nt, Mycobacterium bovis subsp bovis AF2122/97
cugccgccgccgc

SEQ ID NO: 1091884 - RNA, 16 nt, Mycobacterium bovis subsp bovis AF2122/97
cugccgccgccgccgg

SEQ ID NO: 1091885 - RNA, 17 nt, Mycobacterium bovis subsp bovis AF2122/97
cugccgacucaucggcc

SEQ ID NO: 1091886 - RNA, 20 nt, Mycobacterium bovis subsp bovis AF2122/97
cugccgacucaucggccgcg

SEQ ID NO: 1091887 - RNA, 15 nt, Mycobacterium bovis subsp bovis AF2122/97
cugaacaccgcgggc

SEQ ID NO: 1091888 - RNA, 22 nt, Mycobacterium bovis subsp bovis AF2122/97
cugaaaucgguggccaccaccg

SEQ ID NO: 1091889 - RNA, 21 nt, Mycobacterium bovis subsp bovis AF2122/97
cugaaaccuugcggcagacca

SEQ ID NO: 1091890 - RNA, 20 nt, Mycobacterium bovis subsp bovis AF2122/97
cugaaacgauugcugcggcu

SEQ ID NO: 1091891 - RNA, 21 nt, Mycobacterium bovis subsp bovis AF2122/97
cugcguugggaucccagcgca

SEQ ID NO: 1091892 - RNA, 15 nt, Mycobacterium bovis subsp bovis AF2122/97
cugcguugcggcaac

SEQ ID NO: 1091893 - RNA, 14 nt, Mycobacterium bovis subsp bovis AF2122/97
cugcuagugcgggc

SEQ ID NO: 1091894 - RNA, 18 nt, Mycobacterium bovis subsp bovis AF2122/97
cugcuaccagagccgcga

SEQ ID NO: 1091895 - RNA, 19 nt, Mycobacterium bovis subsp bovis AF2122/97
cugcuagccagucggccac

SEQ ID NO: 1091896 - RNA, 17 nt, Mycobacterium bovis subsp bovis AF2122/97
cugcgugggccugcgca

SEQ ID NO: 1091897 - RNA, 17 nt, Mycobacterium bovis subsp bovis AF2122/97
cugcgugcagaucacgg

SEQ ID NO: 1091898 - RNA, 15 nt, Mycobacterium bovis subsp bovis AF2122/97
cugcgugccgcaccg

SEQ ID NO: 1091899 - RNA, 17 nt, Mycobacterium bovis subsp bovis AF2122/97
cugcgucugcucggcgg

SEQ ID NO: 1091900 - RNA, 20 nt, Mycobacterium bovis subsp bovis AF2122/97
cugcucccgaaaagcgccuc

SEQ ID NO: 1091901 - RNA, 15 nt, Mycobacterium bovis subsp bovis AF2122/97
cugcucagcgcggcc

SEQ ID NO: 1091902 - RNA, 17 nt, Mycobacterium bovis subsp bovis AF2122/97
cugcucagcgcggcccc

SEQ ID NO: 1091903 - RNA, 17 nt, Mycobacterium bovis subsp bovis AF2122/97
cugcuccucgcgggcgg

SEQ ID NO: 1091904 - RNA, 18 nt, Mycobacterium bovis subsp bovis AF2122/97
cugcuccucgcgggcggc

SEQ ID NO: 1091905 - RNA, 14 nt, Mycobacterium bovis subsp bovis AF2122/97
cugcuccucggcca

SEQ ID NO: 1091906 - RNA, 14 nt, Mycobacterium bovis subsp bovis AF2122/97
aaccgcguccgcgc

SEQ ID NO: 1091907 - RNA, 15 nt, Mycobacterium bovis subsp bovis AF2122/97
cugcuccugcgucca

SEQ ID NO: 1091908 - RNA, 13 nt, Mycobacterium bovis subsp bovis AF2122/97
cugcuccugguag

SEQ ID NO: 1091909 - RNA, 16 nt, Mycobacterium bovis subsp bovis AF2122/97
aaccgcgugcgucagc

SEQ ID NO: 1091910 - RNA, 15 nt, Mycobacterium bovis subsp bovis AF2122/97
cugcguccgacgccu

SEQ ID NO: 1091911 - RNA, 18 nt, Mycobacterium bovis subsp bovis AF2122/97
cugcgucaucgcggguga

SEQ ID NO: 1091912 - RNA, 15 nt, Mycobacterium bovis subsp bovis AF2122/97
cugcguccaccggac

SEQ ID NO: 1091913 - RNA, 17 nt, Mycobacterium bovis subsp bovis AF2122/97
cugcgucggcccgcggu

SEQ ID NO: 1091914 - RNA, 19 nt, Mycobacterium bovis subsp bovis AF2122/97
cugcgucugcucgccagcc

SEQ ID NO: 1091915 - RNA, 20 nt, Mycobacterium bovis subsp bovis AF2122/97
cugcgucugcucgccagccg

SEQ ID NO: 1091916 - RNA, 21 nt, Mycobacterium bovis subsp bovis AF2122/97
cugcgucugcucgccguggug

SEQ ID NO: 1091917 - RNA, 16 nt, Mycobacterium bovis subsp bovis AF2122/97
cugcgucugcucgcgg

SEQ ID NO: 1091918 - RNA, 16 nt, Mycobacterium bovis subsp bovis AF2122/97
cugcgucugcucggcg

SEQ ID NO: 1091919 - RNA, 22 nt, Mycobacterium bovis subsp bovis AF2122/97
cugcggugauggacugaucgcg

SEQ ID NO: 1091920 - RNA, 23 nt, Mycobacterium bovis subsp bovis AF2122/97
cugcggugauggacugaucgcga

SEQ ID NO: 1091921 - RNA, 20 nt, Mycobacterium bovis subsp bovis AF2122/97
cugcggugcaggauucggcg

SEQ ID NO: 1091922 - RNA, 18 nt, Mycobacterium bovis subsp bovis AF2122/97
cugcggucgguccgguga

SEQ ID NO: 1091923 - RNA, 21 nt, Mycobacterium bovis subsp bovis AF2122/97
cugcggugcuaugcaacaccg

SEQ ID NO: 1091924 - RNA, 16 nt, Mycobacterium bovis subsp bovis AF2122/97
cugcgguggccugucg

SEQ ID NO: 1091925 - RNA, 17 nt, Mycobacterium bovis subsp bovis AF2122/97
cugcggugccacgguga

SEQ ID NO: 1091926 - RNA, 13 nt, Mycobacterium bovis subsp bovis AF2122/97
cugcggugccggc

SEQ ID NO: 1091927 - RNA, 14 nt, Mycobacterium bovis subsp bovis AF2122/97
cugcggugccggcc

SEQ ID NO: 1091928 - RNA, 16 nt, Mycobacterium bovis subsp bovis AF2122/97
cugcgggugcgucgau

SEQ ID NO: 1091929 - RNA, 18 nt, Mycobacterium bovis subsp bovis AF2122/97
cugcgggugcgucgauga

SEQ ID NO: 1091930 - RNA, 20 nt, Mycobacterium bovis subsp bovis AF2122/97
cugcggguucacuuccgggc

SEQ ID NO: 1091931 - RNA, 22 nt, Mycobacterium bovis subsp bovis AF2122/97
cugcgggucgcguuucgcagcc

SEQ ID NO: 1091932 - RNA, 21 nt, Mycobacterium bovis subsp bovis AF2122/97
cugcgggucgugccccggcgc

SEQ ID NO: 1091933 - RNA, 24 nt, Mycobacterium bovis subsp bovis AF2122/97
cugcgggucgugccccggcgcggu

SEQ ID NO: 1091934 - RNA, 15 nt, Mycobacterium bovis subsp bovis AF2122/97
cugcgggucucgccg

SEQ ID NO: 1091935 - RNA, 14 nt, Mycobacterium bovis subsp bovis AF2122/97
cugcgggucucgcu

SEQ ID NO: 1091936 - RNA, 16 nt, Mycobacterium bovis subsp bovis AF2122/97
cugcgguaaucgccac

SEQ ID NO: 1091937 - RNA, 17 nt, Mycobacterium bovis subsp bovis AF2122/97
cugcgguaaucgccacc

SEQ ID NO: 1091938 - RNA, 13 nt, Mycobacterium bovis subsp bovis AF2122/97
cugcggucaucgc

SEQ ID NO: 1091939 - RNA, 23 nt, Mycobacterium bovis subsp bovis AF2122/97
cugcggucaauguggcgcuucgg

SEQ ID NO: 1091940 - RNA, 21 nt, Mycobacterium bovis subsp bovis AF2122/97
cugcggucgaacaucaucggg

SEQ ID NO: 1091941 - RNA, 21 nt, Mycobacterium bovis subsp bovis AF2122/97
cugcggucgaggguaccaggc

SEQ ID NO: 1091942 - RNA, 16 nt, Mycobacterium bovis subsp bovis AF2122/97
cugcggucgcccaggc

SEQ ID NO: 1091943 - RNA, 14 nt, Mycobacterium bovis subsp bovis AF2122/97
cugcgggaucgccg

SEQ ID NO: 1091944 - RNA, 17 nt, Mycobacterium bovis subsp bovis AF2122/97
cugcggggcgaucccca

SEQ ID NO: 1091945 - RNA, 13 nt, Mycobacterium bovis subsp bovis AF2122/97
cugcgggccggca

SEQ ID NO: 1091946 - RNA, 23 nt, Mycobacterium bovis subsp bovis AF2122/97
cugcggggugagugaccacgcug

SEQ ID NO: 1091947 - RNA, 23 nt, Mycobacterium bovis subsp bovis AF2122/97
cugcggguagccgucgaucccgg

SEQ ID NO: 1091948 - RNA, 23 nt, Mycobacterium bovis subsp bovis AF2122/97
cugcggguaggugacgacgucgu

SEQ ID NO: 1091949 - RNA, 16 nt, Mycobacterium bovis subsp bovis AF2122/97
cugcgggucagcgccg

SEQ ID NO: 1091950 - RNA, 18 nt, Mycobacterium bovis subsp bovis AF2122/97
cugcugagcugcucgccg

SEQ ID NO: 1091951 - RNA, 14 nt, Mycobacterium bovis subsp bovis AF2122/97
cugcugaucgagcg

SEQ ID NO: 1091952 - RNA, 15 nt, Mycobacterium bovis subsp bovis AF2122/97
cugcucggcgcgccg

SEQ ID NO: 1091953 - RNA, 21 nt, Mycobacterium bovis subsp bovis AF2122/97
cugcucugcgaccucgccgga

SEQ ID NO: 1091954 - RNA, 18 nt, Mycobacterium bovis subsp bovis AF2122/97
cugcugaacaccggugaa

SEQ ID NO: 1091955 - RNA, 17 nt, Mycobacterium bovis subsp bovis AF2122/97
cugcucgucggccaccg

SEQ ID NO: 1091956 - RNA, 22 nt, Mycobacterium bovis subsp bovis AF2122/97
cugcucgucggccaccgcggcg

SEQ ID NO: 1091957 - RNA, 20 nt, Mycobacterium bovis subsp bovis AF2122/97
cugcucgucggcgccggcgg

SEQ ID NO: 1091958 - RNA, 23 nt, Mycobacterium bovis subsp bovis AF2122/97
cugcucgucggcgccggcggccg

SEQ ID NO: 1091959 - RNA, 18 nt, Mycobacterium bovis subsp bovis AF2122/97
cugcucgucuuggcggcg

SEQ ID NO: 1091960 - RNA, 23 nt, Mycobacterium bovis subsp bovis AF2122/97
cugcucgucuuggcggcggugca

SEQ ID NO: 1091961 - RNA, 23 nt, Mycobacterium bovis subsp bovis AF2122/97
cugcucguggguaccgagcagca

SEQ ID NO: 1091962 - RNA, 19 nt, Mycobacterium bovis subsp bovis AF2122/97
cugcucggucaggcggcug

SEQ ID NO: 1091963 - RNA, 22 nt, Mycobacterium bovis subsp bovis AF2122/97
cugcucggucaggcggcuggcc

SEQ ID NO: 1091964 - RNA, 24 nt, Mycobacterium bovis subsp bovis AF2122/97
cugcugcucgaucaucgggagccg

SEQ ID NO: 1091965 - RNA, 13 nt, Mycobacterium bovis subsp bovis AF2122/97
cugcugccgaccu

SEQ ID NO: 1091966 - RNA, 15 nt, Mycobacterium bovis subsp bovis AF2122/97
cugcugccccccaga

SEQ ID NO: 1091967 - RNA, 18 nt, Mycobacterium bovis subsp bovis AF2122/97
cugcugccauugccgaug

SEQ ID NO: 1091968 - RNA, 13 nt, Mycobacterium bovis subsp bovis AF2122/97
cugcucggagagc

SEQ ID NO: 1091969 - RNA, 23 nt, Mycobacterium bovis subsp bovis AF2122/97
cugcucggcaucgagcagcccgg

SEQ ID NO: 1091970 - RNA, 14 nt, Mycobacterium bovis subsp bovis AF2122/97
cugcucggcaucgg

SEQ ID NO: 1091971 - RNA, 15 nt, Mycobacterium bovis subsp bovis AF2122/97
cugcucggccgugca

SEQ ID NO: 1091972 - RNA, 13 nt, Mycobacterium bovis subsp bovis AF2122/97
cugcucggccugg

SEQ ID NO: 1091973 - RNA, 14 nt, Mycobacterium bovis subsp bovis AF2122/97
cugcucggccaacg

SEQ ID NO: 1091974 - RNA, 14 nt, Mycobacterium bovis subsp bovis AF2122/97
cugcucggcggccu

SEQ ID NO: 1091975 - RNA, 15 nt, Mycobacterium bovis subsp bovis AF2122/97
cugcucggcggugcc

SEQ ID NO: 1091976 - RNA, 12 nt, Mycobacterium bovis subsp bovis AF2122/97
cugcucggcgca

SEQ ID NO: 1091977 - RNA, 17 nt, Mycobacterium bovis subsp bovis AF2122/97
cugcucggcgcuagcug

SEQ ID NO: 1091978 - RNA, 22 nt, Mycobacterium bovis subsp bovis AF2122/97
cugcucggcgcuagcugcugau

SEQ ID NO: 1091979 - RNA, 18 nt, Mycobacterium bovis subsp bovis AF2122/97
cugcucgccagccggccu

SEQ ID NO: 1091980 - RNA, 20 nt, Mycobacterium bovis subsp bovis AF2122/97
cugcucgccagccggccuca

SEQ ID NO: 1091981 - RNA, 15 nt, Mycobacterium bovis subsp bovis AF2122/97
cugcucgccaggcaa

SEQ ID NO: 1091982 - RNA, 23 nt, Mycobacterium bovis subsp bovis AF2122/97
cugcucgauguccucgauccggg

SEQ ID NO: 1091983 - RNA, 23 nt, Mycobacterium bovis subsp bovis AF2122/97
cugcucgccccaugucaagcgau

SEQ ID NO: 1091984 - RNA, 15 nt, Mycobacterium bovis subsp bovis AF2122/97
cugcucgccgagcuc

SEQ ID NO: 1091985 - RNA, 14 nt, Mycobacterium bovis subsp bovis AF2122/97
cugcucgcgcccgc

SEQ ID NO: 1091986 - RNA, 13 nt, Mycobacterium bovis subsp bovis AF2122/97
cugcucgcgccgc

SEQ ID NO: 1091987 - RNA, 13 nt, Mycobacterium bovis subsp bovis AF2122/97
cugcucgccgggc

SEQ ID NO: 1091988 - RNA, 21 nt, Mycobacterium bovis subsp bovis AF2122/97
cugcucgcgcaaggcgccgca

SEQ ID NO: 1091989 - RNA, 23 nt, Mycobacterium bovis subsp bovis AF2122/97
cugcucgaucaucgggagccgca

SEQ ID NO: 1091990 - RNA, 23 nt, Mycobacterium bovis subsp bovis AF2122/97
cugcucgagagcaugguccagca

SEQ ID NO: 1091991 - RNA, 15 nt, Mycobacterium bovis subsp bovis AF2122/97
cugcucgaacgcuga

SEQ ID NO: 1091992 - RNA, 15 nt, Mycobacterium bovis subsp bovis AF2122/97
aaccggaucaucgcc

SEQ ID NO: 1091993 - RNA, 21 nt, Mycobacterium bovis subsp bovis AF2122/97
aaccgcucggcgaugauguug

SEQ ID NO: 1091994 - RNA, 17 nt, Mycobacterium bovis subsp bovis AF2122/97
aaccgcugauagcgguc

SEQ ID NO: 1091995 - RNA, 16 nt, Mycobacterium bovis subsp bovis AF2122/97
aaccgcucagcgcagc

SEQ ID NO: 1091996 - RNA, 22 nt, Mycobacterium bovis subsp bovis AF2122/97
aaccgcucagcgcagcaucguc

SEQ ID NO: 1091997 - RNA, 23 nt, Mycobacterium bovis subsp bovis AF2122/97
aaccgcucagcgcagcaucgucg

SEQ ID NO: 1091998 - RNA, 19 nt, Mycobacterium bovis subsp bovis AF2122/97
aaccgcugcuccucgcggu

SEQ ID NO: 1091999 - RNA, 18 nt, Mycobacterium bovis subsp bovis AF2122/97
aaccgcugauagcggucg

SEQ ID NO: 1092000 - RNA, 18 nt, Mycobacterium bovis subsp bovis AF2122/97
aaccgcugggggcggucg

SEQ ID NO: 1092001 - RNA, 13 nt, Mycobacterium bovis subsp bovis AF2122/97
cugcuggucacca

SEQ ID NO: 1092002 - RNA, 17 nt, Mycobacterium bovis subsp bovis AF2122/97
cugcuggugucggcucg

SEQ ID NO: 1092003 - RNA, 19 nt, Mycobacterium bovis subsp bovis AF2122/97
cugcuggugucggcucgag

SEQ ID NO: 1092004 - RNA, 18 nt, Mycobacterium bovis subsp bovis AF2122/97
cugcugucaccgcaaccg

SEQ ID NO: 1092005 - RNA, 19 nt, Mycobacterium bovis subsp bovis AF2122/97
cugcugucaccgcaaccga

SEQ ID NO: 1092006 - RNA, 14 nt, Mycobacterium bovis subsp bovis AF2122/97
cugcuguggaucga

SEQ ID NO: 1092007 - RNA, 20 nt, Mycobacterium bovis subsp bovis AF2122/97
cugcuguggaucgacaccga

SEQ ID NO: 1092008 - RNA, 16 nt, Mycobacterium bovis subsp bovis AF2122/97
cugcugugggauucgg

SEQ ID NO: 1092009 - RNA, 18 nt, Mycobacterium bovis subsp bovis AF2122/97
cugcuggcgcacgaaccc

SEQ ID NO: 1092010 - RNA, 12 nt, Mycobacterium bovis subsp bovis AF2122/97
cugcuggccggg

SEQ ID NO: 1092011 - RNA, 21 nt, Mycobacterium bovis subsp bovis AF2122/97
cugcuggccggguuccagcgg

SEQ ID NO: 1092012 - RNA, 13 nt, Mycobacterium bovis subsp bovis AF2122/97
cugcuggcuggga

SEQ ID NO: 1092013 - RNA, 20 nt, Mycobacterium bovis subsp bovis AF2122/97
cugcugcuugacuccgcgcg

SEQ ID NO: 1092014 - RNA, 20 nt, Mycobacterium bovis subsp bovis AF2122/97
cugcuggaucgucucgcgca

SEQ ID NO: 1092015 - RNA, 20 nt, Mycobacterium bovis subsp bovis AF2122/97
cugcuggccgaugugggcgg

SEQ ID NO: 1092016 - RNA, 14 nt, Mycobacterium bovis subsp bovis AF2122/97
cugcuggccgcggc

SEQ ID NO: 1092017 - RNA, 15 nt, Mycobacterium bovis subsp bovis AF2122/97
cugcuggccgcggcc

SEQ ID NO: 1092018 - RNA, 20 nt, Mycobacterium bovis subsp bovis AF2122/97
cugcuggaugucgucgacga

SEQ ID NO: 1092019 - RNA, 15 nt, Mycobacterium bovis subsp bovis AF2122/97
cuggaaugccgccac

SEQ ID NO: 1092020 - RNA, 20 nt, Mycobacterium bovis subsp bovis AF2122/97
cuggaaguacacggcggccc

SEQ ID NO: 1092021 - RNA, 21 nt, Mycobacterium bovis subsp bovis AF2122/97
cuggaagaucacgcgucgugc

SEQ ID NO: 1092022 - RNA, 20 nt, Mycobacterium bovis subsp bovis AF2122/97
cuggacaaccucgucgaucu

SEQ ID NO: 1092023 - RNA, 16 nt, Mycobacterium bovis subsp bovis AF2122/97
cuggacaucggccggc

SEQ ID NO: 1092024 - RNA, 17 nt, Mycobacterium bovis subsp bovis AF2122/97
cuggacaucggccggcg

SEQ ID NO: 1092025 - RNA, 21 nt, Mycobacterium bovis subsp bovis AF2122/97
cuggaagaagagguuggcggc

SEQ ID NO: 1092026 - RNA, 16 nt, Mycobacterium bovis subsp bovis AF2122/97
cuggaaccccgagcug

SEQ ID NO: 1092027 - RNA, 17 nt, Mycobacterium bovis subsp bovis AF2122/97
cuggaaagggccgccgc

SEQ ID NO: 1092028 - RNA, 16 nt, Mycobacterium bovis subsp bovis AF2122/97
cuggaaaccucuucgg

SEQ ID NO: 1092029 - RNA, 21 nt, Mycobacterium bovis subsp bovis AF2122/97
cuggaaagcagcagcggcggc

SEQ ID NO: 1092030 - RNA, 18 nt, Mycobacterium bovis subsp bovis AF2122/97
cuggaaaggacggccggc

SEQ ID NO: 1092031 - RNA, 21 nt, Mycobacterium bovis subsp bovis AF2122/97
cugcuugguggucuuggccgg

SEQ ID NO: 1092032 - RNA, 23 nt, Mycobacterium bovis subsp bovis AF2122/97
cugcuuggucgcccagccacuga

SEQ ID NO: 1092033 - RNA, 20 nt, Mycobacterium bovis subsp bovis AF2122/97
cugcuugcgcaucgccgaca

SEQ ID NO: 1092034 - RNA, 17 nt, Mycobacterium bovis subsp bovis AF2122/97
cugcuugcgcccggccu

SEQ ID NO: 1092035 - RNA, 16 nt, Mycobacterium bovis subsp bovis AF2122/97
cugcuugacuccgcgc

SEQ ID NO: 1092036 - RNA, 20 nt, Mycobacterium bovis subsp bovis AF2122/97
cuggcccaauugcgccgagc

SEQ ID NO: 1092037 - RNA, 15 nt, Mycobacterium bovis subsp bovis AF2122/97
cuggcccagcgacca

SEQ ID NO: 1092038 - RNA, 16 nt, Mycobacterium bovis subsp bovis AF2122/97
cuggccgccaccgcac

SEQ ID NO: 1092039 - RNA, 19 nt, Mycobacterium bovis subsp bovis AF2122/97
cuggccgcccagaccgccg

SEQ ID NO: 1092040 - RNA, 22 nt, Mycobacterium bovis subsp bovis AF2122/97
cuggccgcccagaccgccgacg

SEQ ID NO: 1092041 - RNA, 20 nt, Mycobacterium bovis subsp bovis AF2122/97
cuggccgcccuggccgccca

SEQ ID NO: 1092042 - RNA, 12 nt, Mycobacterium bovis subsp bovis AF2122/97
cuggccgccgcg

SEQ ID NO: 1092043 - RNA, 14 nt, Mycobacterium bovis subsp bovis AF2122/97
cuggccgccgcgca

SEQ ID NO: 1092044 - RNA, 16 nt, Mycobacterium bovis subsp bovis AF2122/97
cuggccgccgcgcacc

SEQ ID NO: 1092045 - RNA, 13 nt, Mycobacterium bovis subsp bovis AF2122/97
cuggccgccggcg

SEQ ID NO: 1092046 - RNA, 16 nt, Mycobacterium bovis subsp bovis AF2122/97
cuggccgccggcgccg

SEQ ID NO: 1092047 - RNA, 22 nt, Mycobacterium bovis subsp bovis AF2122/97
cuggccgcccggcgagcagggc

SEQ ID NO: 1092048 - RNA, 12 nt, Mycobacterium bovis subsp bovis AF2122/97
cuggccgccggc

SEQ ID NO: 1092049 - RNA, 20 nt, Mycobacterium bovis subsp bovis AF2122/97
cuggccgccggccccgccgu

SEQ ID NO: 1092050 - RNA, 13 nt, Mycobacterium bovis subsp bovis AF2122/97
cuggccgggugcg

SEQ ID NO: 1092051 - RNA, 20 nt, Mycobacterium bovis subsp bovis AF2122/97
cuggccggguuccagcggca

SEQ ID NO: 1092052 - RNA, 12 nt, Mycobacterium bovis subsp bovis AF2122/97
cuggccagcgaa

SEQ ID NO: 1092053 - RNA, 13 nt, Mycobacterium bovis subsp bovis AF2122/97
cuggcaugccggc

SEQ ID NO: 1092054 - RNA, 14 nt, Mycobacterium bovis subsp bovis AF2122/97
cuggcaugccggcg

SEQ ID NO: 1092055 - RNA, 19 nt, Mycobacterium bovis subsp bovis AF2122/97
cuggcauaggaucgcgccc

SEQ ID NO: 1092056 - RNA, 17 nt, Mycobacterium bovis subsp bovis AF2122/97
cuggcauaucccuugcc

SEQ ID NO: 1092057 - RNA, 20 nt, Mycobacterium bovis subsp bovis AF2122/97
cuggcauccgccccgcccgc

SEQ ID NO: 1092058 - RNA, 21 nt, Mycobacterium bovis subsp bovis AF2122/97
cuggcauccgccccgcccgca

SEQ ID NO: 1092059 - RNA, 21 nt, Mycobacterium bovis subsp bovis AF2122/97
cuggcauaucccuugccgucc

SEQ ID NO: 1092060 - RNA, 13 nt, Mycobacterium bovis subsp bovis AF2122/97
cuggccagcgcgc

SEQ ID NO: 1092061 - RNA, 17 nt, Mycobacterium bovis subsp bovis AF2122/97
cuggccagguggccgca

SEQ ID NO: 1092062 - RNA, 14 nt, Mycobacterium bovis subsp bovis AF2122/97
cuggccagguugcc

SEQ ID NO: 1092063 - RNA, 14 nt, Mycobacterium bovis subsp bovis AF2122/97
cuggccaggccggc

SEQ ID NO: 1092064 - RNA, 15 nt, Mycobacterium bovis subsp bovis AF2122/97
cuggccaggccggca

SEQ ID NO: 1092065 - RNA, 19 nt, Mycobacterium bovis subsp bovis AF2122/97
cuggaccacagccgcgccg

SEQ ID NO: 1092066 - RNA, 20 nt, Mycobacterium bovis subsp bovis AF2122/97
cuggaccgcggugacccgga

SEQ ID NO: 1092067 - RNA, 14 nt, Mycobacterium bovis subsp bovis AF2122/97
cuggacgccgccgg

SEQ ID NO: 1092068 - RNA, 13 nt, Mycobacterium bovis subsp bovis AF2122/97
cuggaccuccgac

SEQ ID NO: 1092069 - RNA, 23 nt, Mycobacterium bovis subsp bovis AF2122/97
cuggaccucguugcugccggcgu

SEQ ID NO: 1092070 - RNA, 19 nt, Mycobacterium bovis subsp bovis AF2122/97
cuggacuuccgguucaucg

SEQ ID NO: 1092071 - RNA, 21 nt, Mycobacterium bovis subsp bovis AF2122/97
cuggaucgugccgaacacggu

SEQ ID NO: 1092072 - RNA, 19 nt, Mycobacterium bovis subsp bovis AF2122/97
cuggacggcgggccgcgcg

SEQ ID NO: 1092073 - RNA, 20 nt, Mycobacterium bovis subsp bovis AF2122/97
cuggacggcgggccgcgcgg

SEQ ID NO: 1092074 - RNA, 20 nt, Mycobacterium bovis subsp bovis AF2122/97
cuggacuccggucagcgcgg

SEQ ID NO: 1092075 - RNA, 15 nt, Mycobacterium bovis subsp bovis AF2122/97
cuggacgcuccggga

SEQ ID NO: 1092076 - RNA, 16 nt, Mycobacterium bovis subsp bovis AF2122/97
cuggauggcucgccga

SEQ ID NO: 1092077 - RNA, 20 nt, Mycobacterium bovis subsp bovis AF2122/97
cuggauggcgcccugcgcca

SEQ ID NO: 1092078 - RNA, 17 nt, Mycobacterium bovis subsp bovis AF2122/97
cuggcaggccgggcacc

SEQ ID NO: 1092079 - RNA, 23 nt, Mycobacterium bovis subsp bovis AF2122/97
cuggcagcuccucgcgcucgccg

SEQ ID NO: 1092080 - RNA, 16 nt, Mycobacterium bovis subsp bovis AF2122/97
cuggcagcucggaucg

SEQ ID NO: 1092081 - RNA, 22 nt, Mycobacterium bovis subsp bovis AF2122/97
cuggauucuucagcgcggcacg

SEQ ID NO: 1092082 - RNA, 23 nt, Mycobacterium bovis subsp bovis AF2122/97
cuggauucuucagcgcggcacgg

SEQ ID NO: 1092083 - RNA, 15 nt, Mycobacterium bovis subsp bovis AF2122/97
gaacagcaccgccgg

SEQ ID NO: 1092084 - RNA, 22 nt, Mycobacterium bovis subsp bovis AF2122/97
gaacaccggugaaacgaucgug

SEQ ID NO: 1092085 - RNA, 22 nt, Mycobacterium bovis subsp bovis AF2122/97
gaacagacggcucagcgugcgc

SEQ ID NO: 1092086 - RNA, 19 nt, Mycobacterium bovis subsp bovis AF2122/97
gaacaccccgggcgccgau

SEQ ID NO: 1092087 - RNA, 16 nt, Mycobacterium bovis subsp bovis AF2122/97
gaacaccgccgcgucg

SEQ ID NO: 1092088 - RNA, 21 nt, Mycobacterium bovis subsp bovis AF2122/97
gaacaccgccgcgucgagcac

SEQ ID NO: 1092089 - RNA, 17 nt, Mycobacterium bovis subsp bovis AF2122/97
gaaaucgcacagcgcga

SEQ ID NO: 1092090 - RNA, 16 nt, Mycobacterium bovis subsp bovis AF2122/97
gaaauccuccuccgca

SEQ ID NO: 1092091 - RNA, 16 nt, Mycobacterium bovis subsp bovis AF2122/97
gaacaccaccgccaga

SEQ ID NO: 1092092 - RNA, 12 nt, Mycobacterium bovis subsp bovis AF2122/97
gaaaugacgguc

SEQ ID NO: 1092093 - RNA, 14 nt, Mycobacterium bovis subsp bovis AF2122/97
gaacaccaccaggc

SEQ ID NO: 1092094 - RNA, 13 nt, Mycobacterium bovis subsp bovis AF2122/97
gaacaccacaccg

SEQ ID NO: 1092095 - RNA, 23 nt, Mycobacterium bovis subsp bovis AF2122/97
gaaaucgucggguaccagcaccg

SEQ ID NO: 1092096 - RNA, 19 nt, Mycobacterium bovis subsp bovis AF2122/97
gaaaucggccagcuucccg

SEQ ID NO: 1092097 - RNA, 14 nt, Mycobacterium bovis subsp bovis AF2122/97
gaaaucggcggcgu

SEQ ID NO: 1092098 - RNA, 17 nt, Mycobacterium bovis subsp bovis AF2122/97
gaaaucggugcacaacg

SEQ ID NO: 1092099 - RNA, 15 nt, Mycobacterium bovis subsp bovis AF2122/97
gaacagggacuccca

SEQ ID NO: 1092100 - RNA, 20 nt, Mycobacterium bovis subsp bovis AF2122/97
gaacagggaggucgccgcau

SEQ ID NO: 1092101 - RNA, 22 nt, Mycobacterium bovis subsp bovis AF2122/97
gaacagggaggucgccgcaucg

SEQ ID NO: 1092102 - RNA, 14 nt, Mycobacterium bovis subsp bovis AF2122/97
gaacaggcgaccgg

SEQ ID NO: 1092103 - RNA, 14 nt, Mycobacterium bovis subsp bovis AF2122/97
gaacaggaucagcg

SEQ ID NO: 1092104 - RNA, 15 nt, Mycobacterium bovis subsp bovis AF2122/97
gaacaggccgaggcg

SEQ ID NO: 1092105 - RNA, 23 nt, Mycobacterium bovis subsp bovis AF2122/97
gaacaggccggccgcgauccagc

SEQ ID NO: 1092106 - RNA, 22 nt, Mycobacterium bovis subsp bovis AF2122/97
gaacagcagcgcacugcccggg

SEQ ID NO: 1092107 - RNA, 15 nt, Mycobacterium bovis subsp bovis AF2122/97
gaacagcagguuggc

SEQ ID NO: 1092108 - RNA, 16 nt, Mycobacterium bovis subsp bovis AF2122/97
gaacagcagguuggcg

SEQ ID NO: 1092109 - RNA, 18 nt, Mycobacterium bovis subsp bovis AF2122/97
gaacagcuucgcgcagcc

SEQ ID NO: 1092110 - RNA, 21 nt, Mycobacterium bovis subsp bovis AF2122/97
gaacagguuggccccggcccg

SEQ ID NO: 1092111 - RNA, 15 nt, Mycobacterium bovis subsp bovis AF2122/97
gaacagugccucgcg

SEQ ID NO: 1092112 - RNA, 16 nt, Mycobacterium bovis subsp bovis AF2122/97
gaacagugccucgcgu

SEQ ID NO: 1092113 - RNA, 23 nt, Mycobacterium bovis subsp bovis AF2122/97
gaacagggcugcgaugcgguucc

SEQ ID NO: 1092114 - RNA, 18 nt, Mycobacterium bovis subsp bovis AF2122/97
gaacaucagaucgccgac

SEQ ID NO: 1092115 - RNA, 23 nt, Mycobacterium bovis subsp bovis AF2122/97
gaacaguggggguccggcggccg

SEQ ID NO: 1092116 - RNA, 22 nt, Mycobacterium bovis subsp bovis AF2122/97
gaacaguugcacaccggcacug

SEQ ID NO: 1092117 - RNA, 15 nt, Mycobacterium bovis subsp bovis AF2122/97
gaaagucgcgcgcga

SEQ ID NO: 1092118 - RNA, 18 nt, Mycobacterium bovis subsp bovis AF2122/97
gaaagucgcgcgcgaaca

SEQ ID NO: 1092119 - RNA, 14 nt, Mycobacterium bovis subsp bovis AF2122/97
gaaagggccgccgc

SEQ ID NO: 1092120 - RNA, 17 nt, Mycobacterium bovis subsp bovis AF2122/97
gaaagccuugccgucga

SEQ ID NO: 1092121 - RNA, 13 nt, Mycobacterium bovis subsp bovis AF2122/97
gaaagcgccgaaa

SEQ ID NO: 1092122 - RNA, 18 nt, Mycobacterium bovis subsp bovis AF2122/97
gaaagacaguggcgcgua

SEQ ID NO: 1092123 - RNA, 15 nt, Mycobacterium bovis subsp bovis AF2122/97
gaaagaucucgguca

SEQ ID NO: 1092124 - RNA, 14 nt, Mycobacterium bovis subsp bovis AF2122/97
gaaagagccagcgg

SEQ ID NO: 1092125 - RNA, 19 nt, Mycobacterium bovis subsp bovis AF2122/97
gaaaccggccagccgacgc

SEQ ID NO: 1092126 - RNA, 14 nt, Mycobacterium bovis subsp bovis AF2122/97
cuuguugccgccgg

SEQ ID NO: 1092127 - RNA, 14 nt, Mycobacterium bovis subsp bovis AF2122/97
cuuguugcgcgacg

SEQ ID NO: 1092128 - RNA, 18 nt, Mycobacterium bovis subsp bovis AF2122/97
cuuguugcgcgacgccgc

SEQ ID NO: 1092129 - RNA, 16 nt, Mycobacterium bovis subsp bovis AF2122/97
cuuguuggcgcccggg

SEQ ID NO: 1092130 - RNA, 19 nt, Mycobacterium bovis subsp bovis AF2122/97
cuuguucccgaaacccgau

SEQ ID NO: 1092131 - RNA, 14 nt, Mycobacterium bovis subsp bovis AF2122/97
cuuguggucugcca

SEQ ID NO: 1092132 - RNA, 18 nt, Mycobacterium bovis subsp bovis AF2122/97
cuuguggacccgccaggg

SEQ ID NO: 1092133 - RNA, 20 nt, Mycobacterium bovis subsp bovis AF2122/97
cuuguggcacacccgcaccg

SEQ ID NO: 1092134 - RNA, 20 nt, Mycobacterium bovis subsp bovis AF2122/97
cuugugggcgacggcgauga

SEQ ID NO: 1092135 - RNA, 21 nt, Mycobacterium bovis subsp bovis AF2122/97
gaaaccguggccaucgauccc

SEQ ID NO: 1092136 - RNA, 20 nt, Mycobacterium bovis subsp bovis AF2122/97
gaaaccguggguucacguuc

SEQ ID NO: 1092137 - RNA, 15 nt, Mycobacterium bovis subsp bovis AF2122/97
gaaaccuguaccgcc

SEQ ID NO: 1092138 - RNA, 20 nt, Mycobacterium bovis subsp bovis AF2122/97
gaaacucaccagcaccccga

SEQ ID NO: 1092139 - RNA, 14 nt, Mycobacterium bovis subsp bovis AF2122/97
gaaacuccgcggcg

SEQ ID NO: 1092140 - RNA, 14 nt, Mycobacterium bovis subsp bovis AF2122/97
gaaacgccgaccgc

SEQ ID NO: 1092141 - RNA, 14 nt, Mycobacterium bovis subsp bovis AF2122/97
gaaacgccauacgu

SEQ ID NO: 1092142 - RNA, 16 nt, Mycobacterium bovis subsp bovis AF2122/97
gaaacgccgaccgcgc

SEQ ID NO: 1092143 - RNA, 22 nt, Mycobacterium bovis subsp bovis AF2122/97
gaaacgccgcaauggaccgaac

SEQ ID NO: 1092144 - RNA, 23 nt, Mycobacterium bovis subsp bovis AF2122/97
gaaacgauugcugcggcuuucag

SEQ ID NO: 1092145 - RNA, 18 nt, Mycobacterium bovis subsp bovis AF2122/97
gaaacgccggguucgccg

SEQ ID NO: 1092146 - RNA, 23 nt, Mycobacterium bovis subsp bovis AF2122/97
gaagaaguacaucugccggucga

SEQ ID NO: 1092147 - RNA, 12 nt, Mycobacterium bovis subsp bovis AF2122/97
gaagaauccggc

SEQ ID NO: 1092148 - RNA, 17 nt, Mycobacterium bovis subsp bovis AF2122/97
gaagaacucggugcccc

SEQ ID NO: 1092149 - RNA, 13 nt, Mycobacterium bovis subsp bovis AF2122/97
gaagaaggcgaga

SEQ ID NO: 1092150 - RNA, 15 nt, Mycobacterium bovis subsp bovis AF2122/97
gaagacaaguggugg

SEQ ID NO: 1092151 - RNA, 16 nt, Mycobacterium bovis subsp bovis AF2122/97
gaagacaagugguggu

SEQ ID NO: 1092152 - RNA, 14 nt, Mycobacterium bovis subsp bovis AF2122/97
gaagaccaccgccc

SEQ ID NO: 1092153 - RNA, 15 nt, Mycobacterium bovis subsp bovis AF2122/97
gaagaccaccgccca

SEQ ID NO: 1092154 - RNA, 12 nt, Mycobacterium bovis subsp bovis AF2122/97
gaagacccguga

SEQ ID NO: 1092155 - RNA, 21 nt, Mycobacterium bovis subsp bovis AF2122/97
gaagaccgccuccaccgccgc

SEQ ID NO: 1092156 - RNA, 18 nt, Mycobacterium bovis subsp bovis AF2122/97
gaagacggcaagucuggc

SEQ ID NO: 1092157 - RNA, 20 nt, Mycobacterium bovis subsp bovis AF2122/97
gaagaagaacucggcgucgu

SEQ ID NO: 1092158 - RNA, 17 nt, Mycobacterium bovis subsp bovis AF2122/97
gaagaacucggcgucgu

SEQ ID NO: 1092159 - RNA, 18 nt, Mycobacterium bovis subsp bovis AF2122/97
gaagaacgacgccaccgc

SEQ ID NO: 1092160 - RNA, 19 nt, Mycobacterium bovis subsp bovis AF2122/97
gaagaaaccgcagucgcgg

SEQ ID NO: 1092161 - RNA, 19 nt, Mycobacterium bovis subsp bovis AF2122/97
gaacuugacgaacucgccg

SEQ ID NO: 1092162 - RNA, 17 nt, Mycobacterium bovis subsp bovis AF2122/97
gaacuucuccaccagcg

SEQ ID NO: 1092163 - RNA, 20 nt, Mycobacterium bovis subsp bovis AF2122/97
gaacuggugcuuccacacgg

SEQ ID NO: 1092164 - RNA, 14 nt, Mycobacterium bovis subsp bovis AF2122/97
gaacucgucgcugc

SEQ ID NO: 1092165 - RNA, 19 nt, Mycobacterium bovis subsp bovis AF2122/97
gaacucgcgcgucgucgcg

SEQ ID NO: 1092166 - RNA, 19 nt, Mycobacterium bovis subsp bovis AF2122/97
gaacucgcgggcgaccacc

SEQ ID NO: 1092167 - RNA, 22 nt, Mycobacterium bovis subsp bovis AF2122/97
gaacucgcgggcgaccaccgcg

SEQ ID NO: 1092168 - RNA, 15 nt, Mycobacterium bovis subsp bovis AF2122/97
gaacugggcgaucga

SEQ ID NO: 1092169 - RNA, 16 nt, Mycobacterium bovis subsp bovis AF2122/97
gaacucgugauagcgc

SEQ ID NO: 1092170 - RNA, 15 nt, Mycobacterium bovis subsp bovis AF2122/97
gaacucggcgucgug

SEQ ID NO: 1092171 - RNA, 14 nt, Mycobacterium bovis subsp bovis AF2122/97
gaacgggaucgacc

SEQ ID NO: 1092172 - RNA, 17 nt, Mycobacterium bovis subsp bovis AF2122/97
gaacgggaucgacccgc

SEQ ID NO: 1092173 - RNA, 11 nt, Mycobacterium bovis subsp bovis AF2122/97
gaacggcgucg

SEQ ID NO: 1092174 - RNA, 19 nt, Mycobacterium bovis subsp bovis AF2122/97
gaacggcguugcggaauca

SEQ ID NO: 1092175 - RNA, 21 nt, Mycobacterium bovis subsp bovis AF2122/97
gaacggcgggcgauuucggcg

SEQ ID NO: 1092176 - RNA, 22 nt, Mycobacterium bovis subsp bovis AF2122/97
gaacggcucgggaacuucgccg

SEQ ID NO: 1092177 - RNA, 22 nt, Mycobacterium bovis subsp bovis AF2122/97
gaacggcucgggcagcgucacc

SEQ ID NO: 1092178 - RNA, 16 nt, Mycobacterium bovis subsp bovis AF2122/97
gaacgcguagucgcgg

SEQ ID NO: 1092179 - RNA, 21 nt, Mycobacterium bovis subsp bovis AF2122/97
gaacgcgucguugucgucgcc

SEQ ID NO: 1092180 - RNA, 13 nt, Mycobacterium bovis subsp bovis AF2122/97
gaacggcgggcga

SEQ ID NO: 1092181 - RNA, 16 nt, Mycobacterium bovis subsp bovis AF2122/97
gaacggcggcagcggc

SEQ ID NO: 1092182 - RNA, 20 nt, Mycobacterium bovis subsp bovis AF2122/97
gaaccgccgcugccgcgcgg

SEQ ID NO: 1092183 - RNA, 15 nt, Mycobacterium bovis subsp bovis AF2122/97
gaaccgccggcaccg

SEQ ID NO: 1092184 - RNA, 21 nt, Mycobacterium bovis subsp bovis AF2122/97
gaaccgccggcaccgccgccc

SEQ ID NO: 1092185 - RNA, 13 nt, Mycobacterium bovis subsp bovis AF2122/97
gaaccgccggcug

SEQ ID NO: 1092186 - RNA, 20 nt, Mycobacterium bovis subsp bovis AF2122/97
gaaccgccaacauuggugag

SEQ ID NO: 1092187 - RNA, 13 nt, Mycobacterium bovis subsp bovis AF2122/97
gaaccgcgcggcg

SEQ ID NO: 1092188 - RNA, 14 nt, Mycobacterium bovis subsp bovis AF2122/97
gaaccgcggaucga

SEQ ID NO: 1092189 - RNA, 13 nt, Mycobacterium bovis subsp bovis AF2122/97
gaaccgcucguca

SEQ ID NO: 1092190 - RNA, 18 nt, Mycobacterium bovis subsp bovis AF2122/97
gaaccgcuccgagcaccg

SEQ ID NO: 1092191 - RNA, 14 nt, Mycobacterium bovis subsp bovis AF2122/97
gaaccaaucgcacg

SEQ ID NO: 1092192 - RNA, 24 nt, Mycobacterium bovis subsp bovis AF2122/97
gaaccaaucgcacgccagcuuggc

SEQ ID NO: 1092193 - RNA, 13 nt, Mycobacterium bovis subsp bovis AF2122/97
gaacaugcucacg

SEQ ID NO: 1092194 - RNA, 18 nt, Mycobacterium bovis subsp bovis AF2122/97
gaacauucccaugcgggu

SEQ ID NO: 1092195 - RNA, 20 nt, Mycobacterium bovis subsp bovis AF2122/97
gaacaugggaugcucaccgg

SEQ ID NO: 1092196 - RNA, 13 nt, Mycobacterium bovis subsp bovis AF2122/97
gaaccgcugggac

SEQ ID NO: 1092197 - RNA, 22 nt, Mycobacterium bovis subsp bovis AF2122/97
gaaccgcugcuccucgcgguag

SEQ ID NO: 1092198 - RNA, 21 nt, Mycobacterium bovis subsp bovis AF2122/97
gaaccguccaagccggcugca

SEQ ID NO: 1092199 - RNA, 15 nt, Mycobacterium bovis subsp bovis AF2122/97
gaaccgucagcggca

SEQ ID NO: 1092200 - RNA, 18 nt, Mycobacterium bovis subsp bovis AF2122/97
gaaccggaucaucgccgc

SEQ ID NO: 1092201 - RNA, 16 nt, Mycobacterium bovis subsp bovis AF2122/97
gaaccguacgccagau

SEQ ID NO: 1092202 - RNA, 17 nt, Mycobacterium bovis subsp bovis AF2122/97
gaaccgucucggcgacc

SEQ ID NO: 1092203 - RNA, 15 nt, Mycobacterium bovis subsp bovis AF2122/97
gaaccguucgaccca

SEQ ID NO: 1092204 - RNA, 13 nt, Mycobacterium bovis subsp bovis AF2122/97
gaaccguucggcg

SEQ ID NO: 1092205 - RNA, 23 nt, Mycobacterium bovis subsp bovis AF2122/97
gaaccguucggcgacagcgcggc

SEQ ID NO: 1092206 - RNA, 19 nt, Mycobacterium bovis subsp bovis AF2122/97
gaaccguuugguggcaccg

SEQ ID NO: 1092207 - RNA, 23 nt, Mycobacterium bovis subsp bovis AF2122/97
gaaccuccucggguucgucaguc

SEQ ID NO: 1092208 - RNA, 12 nt, Mycobacterium bovis subsp bovis AF2122/97
gaaccucgcgua

SEQ ID NO: 1092209 - RNA, 12 nt, Mycobacterium bovis subsp bovis AF2122/97
gaaccucggcgg

SEQ ID NO: 1092210 - RNA, 16 nt, Mycobacterium bovis subsp bovis AF2122/97
gaacgcggaagccgcc

SEQ ID NO: 1092211 - RNA, 14 nt, Mycobacterium bovis subsp bovis AF2122/97
gaacgcggacaccg

SEQ ID NO: 1092212 - RNA, 15 nt, Mycobacterium bovis subsp bovis AF2122/97
gaacgcggccaccga

SEQ ID NO: 1092213 - RNA, 21 nt, Mycobacterium bovis subsp bovis AF2122/97
gaacgcggccaccgaccgcau

SEQ ID NO: 1092214 - RNA, 13 nt, Mycobacterium bovis subsp bovis AF2122/97
gaacgcggccucg

SEQ ID NO: 1092215 - RNA, 12 nt, Mycobacterium bovis subsp bovis AF2122/97
gaacgcggcgaa

SEQ ID NO: 1092216 - RNA, 14 nt, Mycobacterium bovis subsp bovis AF2122/97
gaacgcgucgccga

SEQ ID NO: 1092217 - RNA, 14 nt, Mycobacterium bovis subsp bovis AF2122/97
gaacgccggcaccg

SEQ ID NO: 1092218 - RNA, 15 nt, Mycobacterium bovis subsp bovis AF2122/97
gaacgccggcaucgc

SEQ ID NO: 1092219 - RNA, 16 nt, Mycobacterium bovis subsp bovis AF2122/97
gaacgccggcaucgcg

SEQ ID NO: 1092220 - RNA, 19 nt, Mycobacterium bovis subsp bovis AF2122/97
gaacgccggugcgcuggau

SEQ ID NO: 1092221 - RNA, 20 nt, Mycobacterium bovis subsp bovis AF2122/97
gaacgccgucagaacaccgg

SEQ ID NO: 1092222 - RNA, 23 nt, Mycobacterium bovis subsp bovis AF2122/97
gaacgccgucagaacaccggcca

SEQ ID NO: 1092223 - RNA, 19 nt, Mycobacterium bovis subsp bovis AF2122/97
gaacgccucaggggcgccu

SEQ ID NO: 1092224 - RNA, 13 nt, Mycobacterium bovis subsp bovis AF2122/97
gaacgccgucgac

SEQ ID NO: 1092225 - RNA, 16 nt, Mycobacterium bovis subsp bovis AF2122/97
gaacgccgucgagcau

SEQ ID NO: 1092226 - RNA, 22 nt, Mycobacterium bovis subsp bovis AF2122/97
gaacgcccgcaggacgcugccg

SEQ ID NO: 1092227 - RNA, 11 nt, Mycobacterium bovis subsp bovis AF2122/97
gaacgcccgcu

SEQ ID NO: 1092228 - RNA, 18 nt, Mycobacterium bovis subsp bovis AF2122/97
gaacgcccgcaggacgcu

SEQ ID NO: 1092229 - RNA, 22 nt, Mycobacterium bovis subsp bovis AF2122/97
gaacgccgaacaccgccgcguc

SEQ ID NO: 1092230 - RNA, 15 nt, Mycobacterium bovis subsp bovis AF2122/97
gaacgcaacagccga

SEQ ID NO: 1092231 - RNA, 17 nt, Mycobacterium bovis subsp bovis AF2122/97
gaacgcagccagcgcca

SEQ ID NO: 1092232 - RNA, 15 nt, Mycobacterium bovis subsp bovis AF2122/97
gaacgcaacgccgau

SEQ ID NO: 1092233 - RNA, 17 nt, Mycobacterium bovis subsp bovis AF2122/97
gaacgcaagcagcgcga

SEQ ID NO: 1092234 - RNA, 19 nt, Mycobacterium bovis subsp bovis AF2122/97
gaacgcaagcagcgcgauc

SEQ ID NO: 1092235 - RNA, 14 nt, Mycobacterium bovis subsp bovis AF2122/97
gaacgccacggcau

SEQ ID NO: 1092236 - RNA, 16 nt, Mycobacterium bovis subsp bovis AF2122/97
gaacgccacggcaucg

SEQ ID NO: 1092237 - RNA, 22 nt, Mycobacterium bovis subsp bovis AF2122/97
gaacgccacggcaucggccacc

SEQ ID NO: 1092238 - RNA, 14 nt, Mycobacterium bovis subsp bovis AF2122/97
gaacgccacgacgu

SEQ ID NO: 1092239 - RNA, 14 nt, Mycobacterium bovis subsp bovis AF2122/97
gaacgcaucggucc

SEQ ID NO: 1092240 - RNA, 21 nt, Mycobacterium bovis subsp bovis AF2122/97
gaacgccaccaccuccgcguc

SEQ ID NO: 1092241 - RNA, 15 nt, Mycobacterium bovis subsp bovis AF2122/97
gaagccagcgcaagg

SEQ ID NO: 1092242 - RNA, 17 nt, Mycobacterium bovis subsp bovis AF2122/97
gaagccccucaccucgg

SEQ ID NO: 1092243 - RNA, 14 nt, Mycobacterium bovis subsp bovis AF2122/97
gaagcccgacuggu

SEQ ID NO: 1092244 - RNA, 13 nt, Mycobacterium bovis subsp bovis AF2122/97
gaagcccgacugu

SEQ ID NO: 1092245 - RNA, 18 nt, Mycobacterium bovis subsp bovis AF2122/97
gaagcccccaaaccggcg

SEQ ID NO: 1092246 - RNA, 13 nt, Mycobacterium bovis subsp bovis AF2122/97
gaagcccgagacg

SEQ ID NO: 1092247 - RNA, 14 nt, Mycobacterium bovis subsp bovis AF2122/97
gaagcccgagcucg

SEQ ID NO: 1092248 - RNA, 19 nt, Mycobacterium bovis subsp bovis AF2122/97
gaagcccggggcgcucgug

SEQ ID NO: 1092249 - RNA, 13 nt, Mycobacterium bovis subsp bovis AF2122/97
gaagcccgucgcg

SEQ ID NO: 1092250 - RNA, 15 nt, Mycobacterium bovis subsp bovis AF2122/97
gaagcccgucgcggc

SEQ ID NO: 1092251 - RNA, 13 nt, Mycobacterium bovis subsp bovis AF2122/97
gaagcccucgucg

SEQ ID NO: 1092252 - RNA, 15 nt, Mycobacterium bovis subsp bovis AF2122/97
gaagcccucgucggg

SEQ ID NO: 1092253 - RNA, 14 nt, Mycobacterium bovis subsp bovis AF2122/97
gaagcccaggagca

SEQ ID NO: 1092254 - RNA, 15 nt, Mycobacterium bovis subsp bovis AF2122/97
gaagcccaccgucug

SEQ ID NO: 1092255 - RNA, 21 nt, Mycobacterium bovis subsp bovis AF2122/97
gaagcccaccgucugcuggcc

SEQ ID NO: 1092256 - RNA, 20 nt, Mycobacterium bovis subsp bovis AF2122/97
gaagcccacgaucgcgucgg

SEQ ID NO: 1092257 - RNA, 20 nt, Mycobacterium bovis subsp bovis AF2122/97
gaagccaagcgacucgccgg

SEQ ID NO: 1092258 - RNA, 18 nt, Mycobacterium bovis subsp bovis AF2122/97
gaagccagaucagccgcc

SEQ ID NO: 1092259 - RNA, 20 nt, Mycobacterium bovis subsp bovis AF2122/97
gaagccagaucagccgccgc

SEQ ID NO: 1092260 - RNA, 21 nt, Mycobacterium bovis subsp bovis AF2122/97
gaagccagaucagccgccgcc

SEQ ID NO: 1092261 - RNA, 14 nt, Mycobacterium bovis subsp bovis AF2122/97
gaagccgaccaccg

SEQ ID NO: 1092262 - RNA, 19 nt, Mycobacterium bovis subsp bovis AF2122/97
gaagccgaccucacggcau

SEQ ID NO: 1092263 - RNA, 19 nt, Mycobacterium bovis subsp bovis AF2122/97
gaagccgaccaccgccggg

SEQ ID NO: 1092264 - RNA, 19 nt, Mycobacterium bovis subsp bovis AF2122/97
gaagcccuuguagcacacc

SEQ ID NO: 1092265 - RNA, 24 nt, Mycobacterium bovis subsp bovis AF2122/97
gaagcccuuguagcacaccgacau

SEQ ID NO: 1092266 - RNA, 13 nt, Mycobacterium bovis subsp bovis AF2122/97
gaagcccggcggc

SEQ ID NO: 1092267 - RNA, 15 nt, Mycobacterium bovis subsp bovis AF2122/97
gaagccggccacuac

SEQ ID NO: 1092268 - RNA, 23 nt, Mycobacterium bovis subsp bovis AF2122/97
gaagccggccacuacggccuggc

SEQ ID NO: 1092269 - RNA, 20 nt, Mycobacterium bovis subsp bovis AF2122/97
gaagccgggucucggugcgg

SEQ ID NO: 1092270 - RNA, 12 nt, Mycobacterium bovis subsp bovis AF2122/97
gaagccgccggg

SEQ ID NO: 1092271 - RNA, 13 nt, Mycobacterium bovis subsp bovis AF2122/97
gaagccgcgcauc

SEQ ID NO: 1092272 - RNA, 12 nt, Mycobacterium bovis subsp bovis AF2122/97
gaagcacgucgu

SEQ ID NO: 1092273 - RNA, 16 nt, Mycobacterium bovis subsp bovis AF2122/97
gaagcacgucgucgcg

SEQ ID NO: 1092274 - RNA, 17 nt, Mycobacterium bovis subsp bovis AF2122/97
gaagcacaugcucggcc

SEQ ID NO: 1092275 - RNA, 16 nt, Mycobacterium bovis subsp bovis AF2122/97
gaagccaagcgacucg

SEQ ID NO: 1092276 - RNA, 20 nt, Mycobacterium bovis subsp bovis AF2122/97
gaagaugcccuucgucggca

SEQ ID NO: 1092277 - RNA, 15 nt, Mycobacterium bovis subsp bovis AF2122/97
gaagauggcaccgcc

SEQ ID NO: 1092278 - RNA, 20 nt, Mycobacterium bovis subsp bovis AF2122/97
gaagauggcaccgcccccgu

SEQ ID NO: 1092279 - RNA, 20 nt, Mycobacterium bovis subsp bovis AF2122/97
gaagaucucguagccgccgu

SEQ ID NO: 1092280 - RNA, 17 nt, Mycobacterium bovis subsp bovis AF2122/97
gaagaucuucaccggcc

SEQ ID NO: 1092281 - RNA, 17 nt, Mycobacterium bovis subsp bovis AF2122/97
gaagauguugccgccgg

SEQ ID NO: 1092282 - RNA, 19 nt, Mycobacterium bovis subsp bovis AF2122/97
gaagauuuugggcgccgac

SEQ ID NO: 1092283 - RNA, 18 nt, Mycobacterium bovis subsp bovis AF2122/97
gaagauuuucucggugcu

SEQ ID NO: 1092284 - RNA, 18 nt, Mycobacterium bovis subsp bovis AF2122/97
gaagcaagggcgaugguc

SEQ ID NO: 1092285 - RNA, 21 nt, Mycobacterium bovis subsp bovis AF2122/97
gaagauccagcgcaccggcgu

SEQ ID NO: 1092286 - RNA, 13 nt, Mycobacterium bovis subsp bovis AF2122/97
gaagagcuccguc

SEQ ID NO: 1092287 - RNA, 14 nt, Mycobacterium bovis subsp bovis AF2122/97
gaagacggccaccg

SEQ ID NO: 1092288 - RNA, 20 nt, Mycobacterium bovis subsp bovis AF2122/97
gaagacgucgggaucgccau

SEQ ID NO: 1092289 - RNA, 16 nt, Mycobacterium bovis subsp bovis AF2122/97
gaagacucgucaacgg

SEQ ID NO: 1092290 - RNA, 16 nt, Mycobacterium bovis subsp bovis AF2122/97
gaagcguugucgccca

SEQ ID NO: 1092291 - RNA, 17 nt, Mycobacterium bovis subsp bovis AF2122/97
gaagcguugucgcccac

SEQ ID NO: 1092292 - RNA, 17 nt, Mycobacterium bovis subsp bovis AF2122/97
gaagcgggcgugcucgg

SEQ ID NO: 1092293 - RNA, 17 nt, Mycobacterium bovis subsp bovis AF2122/97
gaagcgggugccaucgg

SEQ ID NO: 1092294 - RNA, 19 nt, Mycobacterium bovis subsp bovis AF2122/97
gaagcgucguugcucgguc

SEQ ID NO: 1092295 - RNA, 16 nt, Mycobacterium bovis subsp bovis AF2122/97
gaagcgugcgccgacu

SEQ ID NO: 1092296 - RNA, 18 nt, Mycobacterium bovis subsp bovis AF2122/97
gaagcggugacccacucg

SEQ ID NO: 1092297 - RNA, 17 nt, Mycobacterium bovis subsp bovis AF2122/97
gaagcucgaccgcccgg

SEQ ID NO: 1092298 - RNA, 16 nt, Mycobacterium bovis subsp bovis AF2122/97
gaagcucgcgcugugc

SEQ ID NO: 1092299 - RNA, 23 nt, Mycobacterium bovis subsp bovis AF2122/97
gaagcugcgggucucgcugggaa

SEQ ID NO: 1092300 - RNA, 14 nt, Mycobacterium bovis subsp bovis AF2122/97
gaagcuagcgcccg

SEQ ID NO: 1092301 - RNA, 22 nt, Mycobacterium bovis subsp bovis AF2122/97
gaaggccacccgcgaagccgcc

SEQ ID NO: 1092302 - RNA, 23 nt, Mycobacterium bovis subsp bovis AF2122/97
gaaggccagccaacgcgucccgc

SEQ ID NO: 1092303 - RNA, 13 nt, Mycobacterium bovis subsp bovis AF2122/97
gaaggauugcgcg

SEQ ID NO: 1092304 - RNA, 22 nt, Mycobacterium bovis subsp bovis AF2122/97
gaaggagaucccccaggcgaac

SEQ ID NO: 1092305 - RNA, 17 nt, Mycobacterium bovis subsp bovis AF2122/97
gaaggcaaacaccagcc

SEQ ID NO: 1092306 - RNA, 21 nt, Mycobacterium bovis subsp bovis AF2122/97
gaagcuguaggcgaccagaua

SEQ ID NO: 1092307 - RNA, 19 nt, Mycobacterium bovis subsp bovis AF2122/97
gaagcugugcccggcgccc

SEQ ID NO: 1092308 - RNA, 14 nt, Mycobacterium bovis subsp bovis AF2122/97
gaagcggaccagcg

SEQ ID NO: 1092309 - RNA, 20 nt, Mycobacterium bovis subsp bovis AF2122/97
gaagcgggaaggcucaccac

SEQ ID NO: 1092310 - RNA, 13 nt, Mycobacterium bovis subsp bovis AF2122/97
gaagcggcugcug

SEQ ID NO: 1092311 - RNA, 14 nt, Mycobacterium bovis subsp bovis AF2122/97
gaagcggccaccgc

SEQ ID NO: 1092312 - RNA, 15 nt, Mycobacterium bovis subsp bovis AF2122/97
gaagcggccaccgcc

SEQ ID NO: 1092313 - RNA, 13 nt, Mycobacterium bovis subsp bovis AF2122/97
gaagcgcucggca

SEQ ID NO: 1092314 - RNA, 17 nt, Mycobacterium bovis subsp bovis AF2122/97
gaagcgccaaacccggc

SEQ ID NO: 1092315 - RNA, 17 nt, Mycobacterium bovis subsp bovis AF2122/97
gaagcgaccgucgucac

SEQ ID NO: 1092316 - RNA, 13 nt, Mycobacterium bovis subsp bovis AF2122/97
gaagcgauccggc

SEQ ID NO: 1092317 - RNA, 15 nt, Mycobacterium bovis subsp bovis AF2122/97
gaagcgaugccgugc

SEQ ID NO: 1092318 - RNA, 18 nt, Mycobacterium bovis subsp bovis AF2122/97
gaagccgggucuguuggu

SEQ ID NO: 1092319 - RNA, 21 nt, Mycobacterium bovis subsp bovis AF2122/97
gaagccugcgggccggcaucg

SEQ ID NO: 1092320 - RNA, 18 nt, Mycobacterium bovis subsp bovis AF2122/97
gaagguugaacgccgcca

SEQ ID NO: 1092321 - RNA, 16 nt, Mycobacterium bovis subsp bovis AF2122/97
gaaguacgacgacccg

SEQ ID NO: 1092322 - RNA, 18 nt, Mycobacterium bovis subsp bovis AF2122/97
gaaguacgcgacgggccg

SEQ ID NO: 1092323 - RNA, 21 nt, Mycobacterium bovis subsp bovis AF2122/97
gaaguacuccacccaggccga

SEQ ID NO: 1092324 - RNA, 18 nt, Mycobacterium bovis subsp bovis AF2122/97
gaaguacuggccgccgcg

SEQ ID NO: 1092325 - RNA, 23 nt, Mycobacterium bovis subsp bovis AF2122/97
gaaguacuggccgccgcgcaccg

SEQ ID NO: 1092326 - RNA, 16 nt, Mycobacterium bovis subsp bovis AF2122/97
gaagguaacgacgguu

SEQ ID NO: 1092327 - RNA, 14 nt, Mycobacterium bovis subsp bovis AF2122/97
gaaggugccggcgu

SEQ ID NO: 1092328 - RNA, 14 nt, Mycobacterium bovis subsp bovis AF2122/97
gaaggugacgacga

SEQ ID NO: 1092329 - RNA, 13 nt, Mycobacterium bovis subsp bovis AF2122/97
gaaggugacgauc

SEQ ID NO: 1092330 - RNA, 19 nt, Mycobacterium bovis subsp bovis AF2122/97
gaagguggcauucgucgag

SEQ ID NO: 1092331 - RNA, 19 nt, Mycobacterium bovis subsp bovis AF2122/97
gaaguccuccacgcuggcg

SEQ ID NO: 1092332 - RNA, 14 nt, Mycobacterium bovis subsp bovis AF2122/97
gaaguccucggcgg

SEQ ID NO: 1092333 - RNA, 21 nt, Mycobacterium bovis subsp bovis AF2122/97
gaagucccgccguugccgccg

SEQ ID NO: 1092334 - RNA, 23 nt, Mycobacterium bovis subsp bovis AF2122/97
gaagucccgggcaccgucggaac

SEQ ID NO: 1092335 - RNA, 15 nt, Mycobacterium bovis subsp bovis AF2122/97
gaagucgaucgccga

SEQ ID NO: 1092336 - RNA, 12 nt, Mycobacterium bovis subsp bovis AF2122/97
gaagucgcccag

SEQ ID NO: 1092337 - RNA, 18 nt, Mycobacterium bovis subsp bovis AF2122/97
gaagucgcugaagccguc

SEQ ID NO: 1092338 - RNA, 15 nt, Mycobacterium bovis subsp bovis AF2122/97
gaaguagugcucgca

SEQ ID NO: 1092339 - RNA, 14 nt, Mycobacterium bovis subsp bovis AF2122/97
gaaguaggcggcga

SEQ ID NO: 1092340 - RNA, 17 nt, Mycobacterium bovis subsp bovis AF2122/97
gaaguaggcggcgacgc

SEQ ID NO: 1092341 - RNA, 20 nt, Mycobacterium bovis subsp bovis AF2122/97
gaaguagguuuucggcggcu

SEQ ID NO: 1092342 - RNA, 14 nt, Mycobacterium bovis subsp bovis AF2122/97
gaaguagccgagcc

SEQ ID NO: 1092343 - RNA, 15 nt, Mycobacterium bovis subsp bovis AF2122/97
gaaguacuccauggc

SEQ ID NO: 1092344 - RNA, 16 nt, Mycobacterium bovis subsp bovis AF2122/97
gaaguacuccauggca

SEQ ID NO: 1092345 - RNA, 23 nt, Mycobacterium bovis subsp bovis AF2122/97
gaaguccaccacgacgucgguga

SEQ ID NO: 1092346 - RNA, 16 nt, Mycobacterium bovis subsp bovis AF2122/97
gaagucacgcacccgg

SEQ ID NO: 1092347 - RNA, 15 nt, Mycobacterium bovis subsp bovis AF2122/97
gaaggcggcuccacc

SEQ ID NO: 1092348 - RNA, 22 nt, Mycobacterium bovis subsp bovis AF2122/97
gaaggcgcugccuucuaccgaa

SEQ ID NO: 1092349 - RNA, 18 nt, Mycobacterium bovis subsp bovis AF2122/97
gaaggcgacccgcugggu

SEQ ID NO: 1092350 - RNA, 18 nt, Mycobacterium bovis subsp bovis AF2122/97
gaaggccgcaccgccacc

SEQ ID NO: 1092351 - RNA, 19 nt, Mycobacterium bovis subsp bovis AF2122/97
gaaggccgcaccgccaccc

SEQ ID NO: 1092352 - RNA, 14 nt, Mycobacterium bovis subsp bovis AF2122/97
gaaggccgcaccgc

SEQ ID NO: 1092353 - RNA, 15 nt, Mycobacterium bovis subsp bovis AF2122/97
gaaggccgcaccgcc

SEQ ID NO: 1092354 - RNA, 17 nt, Mycobacterium bovis subsp bovis AF2122/97
gaaggccgcaccgccac

SEQ ID NO: 1092355 - RNA, 14 nt, Mycobacterium bovis subsp bovis AF2122/97
gaaggcccgcuguu

SEQ ID NO: 1092356 - RNA, 15 nt, Mycobacterium bovis subsp bovis AF2122/97
gaaggccggcgaccg

SEQ ID NO: 1092357 - RNA, 21 nt, Mycobacterium bovis subsp bovis AF2122/97
gaagggcuaucguggcggcgu

SEQ ID NO: 1092358 - RNA, 13 nt, Mycobacterium bovis subsp bovis AF2122/97
gaaggcuugucgg

SEQ ID NO: 1092359 - RNA, 18 nt, Mycobacterium bovis subsp bovis AF2122/97
gaagggcuugucgccggc

SEQ ID NO: 1092360 - RNA, 21 nt, Mycobacterium bovis subsp bovis AF2122/97
gaaggggcucagcgguggcgu

SEQ ID NO: 1092361 - RNA, 19 nt, Mycobacterium bovis subsp bovis AF2122/97
gaaggggugcccggcggcc

SEQ ID NO: 1092362 - RNA, 17 nt, Mycobacterium bovis subsp bovis AF2122/97
gaaucuccggcuggccc

SEQ ID NO: 1092363 - RNA, 21 nt, Mycobacterium bovis subsp bovis AF2122/97
gaaucucaccgucaacgccug

SEQ ID NO: 1092364 - RNA, 15 nt, Mycobacterium bovis subsp bovis AF2122/97
gaaucuccaaguagc

SEQ ID NO: 1092365 - RNA, 17 nt, Mycobacterium bovis subsp bovis AF2122/97
gaaucugccggccggcg

SEQ ID NO: 1092366 - RNA, 23 nt, Mycobacterium bovis subsp bovis AF2122/97
gaaucuuguuguucgccaccgca

SEQ ID NO: 1092367 - RNA, 14 nt, Mycobacterium bovis subsp bovis AF2122/97
gaauggcagcacga

SEQ ID NO: 1092368 - RNA, 23 nt, Mycobacterium bovis subsp bovis AF2122/97
gaaugccgcggggaucagcgucg

SEQ ID NO: 1092369 - RNA, 16 nt, Mycobacterium bovis subsp bovis AF2122/97
gaauggcccuugcucg

SEQ ID NO: 1092370 - RNA, 23 nt, Mycobacterium bovis subsp bovis AF2122/97
gaauggcccuugcucguccaggu

SEQ ID NO: 1092371 - RNA, 20 nt, Mycobacterium bovis subsp bovis AF2122/97
gaauggccgaaccguucggc

SEQ ID NO: 1092372 - RNA, 22 nt, Mycobacterium bovis subsp bovis AF2122/97
gaauggccgaaccguucggcga

SEQ ID NO: 1092373 - RNA, 13 nt, Mycobacterium bovis subsp bovis AF2122/97
gaauggccgccgc

SEQ ID NO: 1092374 - RNA, 15 nt, Mycobacterium bovis subsp bovis AF2122/97
gaauggccgccgcag

SEQ ID NO: 1092375 - RNA, 18 nt, Mycobacterium bovis subsp bovis AF2122/97
gaaugcccgggcccgucg

SEQ ID NO: 1092376 - RNA, 17 nt, Mycobacterium bovis subsp bovis AF2122/97
gaaugccaccucgacgc

SEQ ID NO: 1092377 - RNA, 19 nt, Mycobacterium bovis subsp bovis AF2122/97
gaauccccccugucgccga

SEQ ID NO: 1092378 - RNA, 15 nt, Mycobacterium bovis subsp bovis AF2122/97
gaauccccgcggcgg

SEQ ID NO: 1092379 - RNA, 15 nt, Mycobacterium bovis subsp bovis AF2122/97
gaaucccgcgcccgg

SEQ ID NO: 1092380 - RNA, 23 nt, Mycobacterium bovis subsp bovis AF2122/97
gaaucccguauugauacugcccg

SEQ ID NO: 1092381 - RNA, 23 nt, Mycobacterium bovis subsp bovis AF2122/97
gaauccgaucaccucggcgacgu

SEQ ID NO: 1092382 - RNA, 17 nt, Mycobacterium bovis subsp bovis AF2122/97
gaauccgacgucgacga

SEQ ID NO: 1092383 - RNA, 18 nt, Mycobacterium bovis subsp bovis AF2122/97
gaaucgccugcgacagca

SEQ ID NO: 1092384 - RNA, 20 nt, Mycobacterium bovis subsp bovis AF2122/97
gaaucgguucggccagaacg

SEQ ID NO: 1092385 - RNA, 20 nt, Mycobacterium bovis subsp bovis AF2122/97
gaaucgguuucgaccugcgg

SEQ ID NO: 1092386 - RNA, 16 nt, Mycobacterium bovis subsp bovis AF2122/97
gaaucgugcggcgacc

SEQ ID NO: 1092387 - RNA, 16 nt, Mycobacterium bovis subsp bovis AF2122/97
gaaucggagccgucga

SEQ ID NO: 1092388 - RNA, 21 nt, Mycobacterium bovis subsp bovis AF2122/97
gaaucgggcaaagucgguguc

SEQ ID NO: 1092389 - RNA, 15 nt, Mycobacterium bovis subsp bovis AF2122/97
gaaucgggccgaaua

SEQ ID NO: 1092390 - RNA, 16 nt, Mycobacterium bovis subsp bovis AF2122/97
gaaucgcugccgccga

SEQ ID NO: 1092391 - RNA, 14 nt, Mycobacterium bovis subsp bovis AF2122/97
gaaucggaccgacc

SEQ ID NO: 1092392 - RNA, 12 nt, Mycobacterium bovis subsp bovis AF2122/97
gaagucgggccg

SEQ ID NO: 1092393 - RNA, 17 nt, Mycobacterium bovis subsp bovis AF2122/97
gaaguccgagacgucgg

SEQ ID NO: 1092394 - RNA, 14 nt, Mycobacterium bovis subsp bovis AF2122/97
gaagucgucggcca

SEQ ID NO: 1092395 - RNA, 21 nt, Mycobacterium bovis subsp bovis AF2122/97
gaagucucgcggcccgagaag

SEQ ID NO: 1092396 - RNA, 23 nt, Mycobacterium bovis subsp bovis AF2122/97
gaagucuuucucccccaucgcau

SEQ ID NO: 1092397 - RNA, 17 nt, Mycobacterium bovis subsp bovis AF2122/97
gaagugacccgaaccgc

SEQ ID NO: 1092398 - RNA, 15 nt, Mycobacterium bovis subsp bovis AF2122/97
gaagugagcucggcu

SEQ ID NO: 1092399 - RNA, 21 nt, Mycobacterium bovis subsp bovis AF2122/97
gaagugagcucggcugcucga

SEQ ID NO: 1092400 - RNA, 17 nt, Mycobacterium bovis subsp bovis AF2122/97
gaagugccuuccucggc

SEQ ID NO: 1092401 - RNA, 21 nt, Mycobacterium bovis subsp bovis AF2122/97
gaagugccuuccucggcaagu

SEQ ID NO: 1092402 - RNA, 19 nt, Mycobacterium bovis subsp bovis AF2122/97
gaauaccgguggcagccug

SEQ ID NO: 1092403 - RNA, 20 nt, Mycobacterium bovis subsp bovis AF2122/97
gaaucacguggaccacggcg

SEQ ID NO: 1092404 - RNA, 15 nt, Mycobacterium bovis subsp bovis AF2122/97
gaaucagcaccccau

SEQ ID NO: 1092405 - RNA, 12 nt, Mycobacterium bovis subsp bovis AF2122/97
gaaucagcacgg

SEQ ID NO: 1092406 - RNA, 18 nt, Mycobacterium bovis subsp bovis AF2122/97
gaaucagcagcagcguga

SEQ ID NO: 1092407 - RNA, 16 nt, Mycobacterium bovis subsp bovis AF2122/97
gaaucaggcucgccga

SEQ ID NO: 1092408 - RNA, 22 nt, Mycobacterium bovis subsp bovis AF2122/97
gaaucagggucugcgccgccgg

SEQ ID NO: 1092409 - RNA, 21 nt, Mycobacterium bovis subsp bovis AF2122/97
gaccgccgcugccgccgagcu

SEQ ID NO: 1092410 - RNA, 14 nt, Mycobacterium bovis subsp bovis AF2122/97
gaccgccgcugggu

SEQ ID NO: 1092411 - RNA, 13 nt, Mycobacterium bovis subsp bovis AF2122/97
gaccgccggaccg

SEQ ID NO: 1092412 - RNA, 18 nt, Mycobacterium bovis subsp bovis AF2122/97
gaccgccggaccgccgca

SEQ ID NO: 1092413 - RNA, 21 nt, Mycobacterium bovis subsp bovis AF2122/97
gaccgccgggauaucgucgac

SEQ ID NO: 1092414 - RNA, 20 nt, Mycobacterium bovis subsp bovis AF2122/97
gaccgccuccaccgccgcgc

SEQ ID NO: 1092415 - RNA, 21 nt, Mycobacterium bovis subsp bovis AF2122/97
gaccgccuccaccgccgcgcg

SEQ ID NO: 1092416 - RNA, 22 nt, Mycobacterium bovis subsp bovis AF2122/97
gaccgccuccaccgccgcgcgg

SEQ ID NO: 1092417 - RNA, 13 nt, Mycobacterium bovis subsp bovis AF2122/97
gaccgccucgucg

SEQ ID NO: 1092418 - RNA, 14 nt, Mycobacterium bovis subsp bovis AF2122/97
gaccgccucgucga

SEQ ID NO: 1092419 - RNA, 23 nt, Mycobacterium bovis subsp bovis AF2122/97
gaccgccgggauaucgucgacgc

SEQ ID NO: 1092420 - RNA, 15 nt, Mycobacterium bovis subsp bovis AF2122/97
gaccgcucgaugucc

SEQ ID NO: 1092421 - RNA, 15 nt, Mycobacterium bovis subsp bovis AF2122/97
gaccgcucggaguug

SEQ ID NO: 1092422 - RNA, 16 nt, Mycobacterium bovis subsp bovis AF2122/97
gaccgcucgucgccgg

SEQ ID NO: 1092423 - RNA, 20 nt, Mycobacterium bovis subsp bovis AF2122/97
gaccgcucgucgccgguggc

SEQ ID NO: 1092424 - RNA, 17 nt, Mycobacterium bovis subsp bovis AF2122/97
gaccgcucugcggccac

SEQ ID NO: 1092425 - RNA, 22 nt, Mycobacterium bovis subsp bovis AF2122/97
gaccgcucugcggccacgccga

SEQ ID NO: 1092426 - RNA, 15 nt, Mycobacterium bovis subsp bovis AF2122/97
gaccgcugccgacgc

SEQ ID NO: 1092427 - RNA, 12 nt, Mycobacterium bovis subsp bovis AF2122/97
gaccgcugccug

SEQ ID NO: 1092428 - RNA, 23 nt, Mycobacterium bovis subsp bovis AF2122/97
gaccgcugccugccgcguagaac

SEQ ID NO: 1092429 - RNA, 13 nt, Mycobacterium bovis subsp bovis AF2122/97
gaccggccacgac

SEQ ID NO: 1092430 - RNA, 14 nt, Mycobacterium bovis subsp bovis AF2122/97
gaccggccacgacc

SEQ ID NO: 1092431 - RNA, 14 nt, Mycobacterium bovis subsp bovis AF2122/97
gaccggcaucgauc

SEQ ID NO: 1092432 - RNA, 21 nt, Mycobacterium bovis subsp bovis AF2122/97
gaccggcaucgaucaacacca

SEQ ID NO: 1092433 - RNA, 12 nt, Mycobacterium bovis subsp bovis AF2122/97
gaccggcaucga

SEQ ID NO: 1092434 - RNA, 13 nt, Mycobacterium bovis subsp bovis AF2122/97
gaccggccgacgu

SEQ ID NO: 1092435 - RNA, 15 nt, Mycobacterium bovis subsp bovis AF2122/97
gaccggccaguccgg

SEQ ID NO: 1092436 - RNA, 22 nt, Mycobacterium bovis subsp bovis AF2122/97
gaccggcccccggucgagcucg

SEQ ID NO: 1092437 - RNA, 20 nt, Mycobacterium bovis subsp bovis AF2122/97
gaccggcacccgcggcgaac

SEQ ID NO: 1092438 - RNA, 22 nt, Mycobacterium bovis subsp bovis AF2122/97
gaccggcaauuuucugcugcug

SEQ ID NO: 1092439 - RNA, 20 nt, Mycobacterium bovis subsp bovis AF2122/97
gaccggcaauuccguuaggc

SEQ ID NO: 1092440 - RNA, 19 nt, Mycobacterium bovis subsp bovis AF2122/97
gaccggaguucagugcgcg

SEQ ID NO: 1092441 - RNA, 20 nt, Mycobacterium bovis subsp bovis AF2122/97
gaccggaguucagugcgcgu

SEQ ID NO: 1092442 - RNA, 18 nt, Mycobacterium bovis subsp bovis AF2122/97
gaccggaucugacggcgc

SEQ ID NO: 1092443 - RNA, 20 nt, Mycobacterium bovis subsp bovis AF2122/97
gaccggaucugacggcgccg

SEQ ID NO: 1092444 - RNA, 13 nt, Mycobacterium bovis subsp bovis AF2122/97
gaccggaaaccac

SEQ ID NO: 1092445 - RNA, 18 nt, Mycobacterium bovis subsp bovis AF2122/97
gaccggaaaccacagcgc

SEQ ID NO: 1092446 - RNA, 22 nt, Mycobacterium bovis subsp bovis AF2122/97
gaccggacacuccugcacacag

SEQ ID NO: 1092447 - RNA, 15 nt, Mycobacterium bovis subsp bovis AF2122/97
gaccggcuaccggcg

SEQ ID NO: 1092448 - RNA, 21 nt, Mycobacterium bovis subsp bovis AF2122/97
gaccggcucacguaaccagug

SEQ ID NO: 1092449 - RNA, 14 nt, Mycobacterium bovis subsp bovis AF2122/97
gaccggcgggaccg

SEQ ID NO: 1092450 - RNA, 17 nt, Mycobacterium bovis subsp bovis AF2122/97
gaccggcguaaccggca

SEQ ID NO: 1092451 - RNA, 19 nt, Mycobacterium bovis subsp bovis AF2122/97
gaccggcguaaccggcagc

SEQ ID NO: 1092452 - RNA, 20 nt, Mycobacterium bovis subsp bovis AF2122/97
gaccggcguaaccggcagcg

SEQ ID NO: 1092453 - RNA, 22 nt, Mycobacterium bovis subsp bovis AF2122/97
gaccggcguaaccggcagcggu

SEQ ID NO: 1092454 - RNA, 16 nt, Mycobacterium bovis subsp bovis AF2122/97
gaccggcucgaucucg

SEQ ID NO: 1092455 - RNA, 19 nt, Mycobacterium bovis subsp bovis AF2122/97
gaccggcucgucgggcaga

SEQ ID NO: 1092456 - RNA, 15 nt, Mycobacterium bovis subsp bovis AF2122/97
gaccggcucgccggc

SEQ ID NO: 1092457 - RNA, 19 nt, Mycobacterium bovis subsp bovis AF2122/97
gaccggcuccgguaggcga

SEQ ID NO: 1092458 - RNA, 14 nt, Mycobacterium bovis subsp bovis AF2122/97
aacggcgcgccgac

SEQ ID NO: 1092459 - RNA, 13 nt, Mycobacterium bovis subsp bovis AF2122/97
aacggcgaucacc

SEQ ID NO: 1092460 - RNA, 16 nt, Mycobacterium bovis subsp bovis AF2122/97
aacggcggcaggccgg

SEQ ID NO: 1092461 - RNA, 21 nt, Mycobacterium bovis subsp bovis AF2122/97
aacggcggcaucggcggcaac

SEQ ID NO: 1092462 - RNA, 17 nt, Mycobacterium bovis subsp bovis AF2122/97
aacggcggccauggcgg

SEQ ID NO: 1092463 - RNA, 10 nt, Mycobacterium bovis subsp bovis AF2122/97
aacggcggcg

SEQ ID NO: 1092464 - RNA, 23 nt, Mycobacterium bovis subsp bovis AF2122/97
aacggcggaucggcggccggcac

SEQ ID NO: 1092465 - RNA, 18 nt, Mycobacterium bovis subsp bovis AF2122/97
aacggcggcaacggcggc

SEQ ID NO: 1092466 - RNA, 19 nt, Mycobacterium bovis subsp bovis AF2122/97
aacggcggcaacggcggca

SEQ ID NO: 1092467 - RNA, 18 nt, Mycobacterium bovis subsp bovis AF2122/97
gaccggccacgaccucgg

SEQ ID NO: 1092468 - RNA, 18 nt, Mycobacterium bovis subsp bovis AF2122/97
aacggcgaaacucgucga

SEQ ID NO: 1092469 - RNA, 22 nt, Mycobacterium bovis subsp bovis AF2122/97
aacggcgaccgccaucacgacc

SEQ ID NO: 1092470 - RNA, 18 nt, Mycobacterium bovis subsp bovis AF2122/97
gaccggccugcgacgagc

SEQ ID NO: 1092471 - RNA, 13 nt, Mycobacterium bovis subsp bovis AF2122/97
gaccggccugcga

SEQ ID NO: 1092472 - RNA, 16 nt, Mycobacterium bovis subsp bovis AF2122/97
gaccggccugcgacga

SEQ ID NO: 1092473 - RNA, 17 nt, Mycobacterium bovis subsp bovis AF2122/97
gaccggcuuccccagca

SEQ ID NO: 1092474 - RNA, 20 nt, Mycobacterium bovis subsp bovis AF2122/97
gaccgggaucggcuccgccg

SEQ ID NO: 1092475 - RNA, 15 nt, Mycobacterium bovis subsp bovis AF2122/97
gaccgggcccggcga

SEQ ID NO: 1092476 - RNA, 18 nt, Mycobacterium bovis subsp bovis AF2122/97
gaccgggcccggcgaaca

SEQ ID NO: 1092477 - RNA, 14 nt, Mycobacterium bovis subsp bovis AF2122/97
gaccggggcgcccg

SEQ ID NO: 1092478 - RNA, 15 nt, Mycobacterium bovis subsp bovis AF2122/97
gaccggggcgcccgg

SEQ ID NO: 1092479 - RNA, 17 nt, Mycobacterium bovis subsp bovis AF2122/97
gaccggggaucggggca

SEQ ID NO: 1092480 - RNA, 18 nt, Mycobacterium bovis subsp bovis AF2122/97
gaccggggucggccugcg

SEQ ID NO: 1092481 - RNA, 16 nt, Mycobacterium bovis subsp bovis AF2122/97
gaccgggucgccgaug

SEQ ID NO: 1092482 - RNA, 16 nt, Mycobacterium bovis subsp bovis AF2122/97
gaccgggucgaucacc

SEQ ID NO: 1092483 - RNA, 20 nt, Mycobacterium bovis subsp bovis AF2122/97
gaccgggucgaucaccgaca

SEQ ID NO: 1092484 - RNA, 18 nt, Mycobacterium bovis subsp bovis AF2122/97
gaccgggucgcaaccgcc

SEQ ID NO: 1092485 - RNA, 16 nt, Mycobacterium bovis subsp bovis AF2122/97
gaccggucacccgugc

SEQ ID NO: 1092486 - RNA, 16 nt, Mycobacterium bovis subsp bovis AF2122/97
gaccggugcugucgac

SEQ ID NO: 1092487 - RNA, 15 nt, Mycobacterium bovis subsp bovis AF2122/97
gaccccuggccgccg

SEQ ID NO: 1092488 - RNA, 16 nt, Mycobacterium bovis subsp bovis AF2122/97
gaccccuggccgccgg

SEQ ID NO: 1092489 - RNA, 17 nt, Mycobacterium bovis subsp bovis AF2122/97
gaccccuggccgccggc

SEQ ID NO: 1092490 - RNA, 15 nt, Mycobacterium bovis subsp bovis AF2122/97
gacccgaagccgacc

SEQ ID NO: 1092491 - RNA, 18 nt, Mycobacterium bovis subsp bovis AF2122/97
gaccccguaggcgccgaa

SEQ ID NO: 1092492 - RNA, 19 nt, Mycobacterium bovis subsp bovis AF2122/97
gaccccgucagcgggcagc

SEQ ID NO: 1092493 - RNA, 19 nt, Mycobacterium bovis subsp bovis AF2122/97
gacccgaagccgaccgggu

SEQ ID NO: 1092494 - RNA, 14 nt, Mycobacterium bovis subsp bovis AF2122/97
gacccgacguagcc

SEQ ID NO: 1092495 - RNA, 22 nt, Mycobacterium bovis subsp bovis AF2122/97
gacccgacaugguccgaccagc

SEQ ID NO: 1092496 - RNA, 14 nt, Mycobacterium bovis subsp bovis AF2122/97
gacccgaccgucgu

SEQ ID NO: 1092497 - RNA, 17 nt, Mycobacterium bovis subsp bovis AF2122/97
gacccgaauccaccagc

SEQ ID NO: 1092498 - RNA, 22 nt, Mycobacterium bovis subsp bovis AF2122/97
gacccgaauccaccagcuggug

SEQ ID NO: 1092499 - RNA, 18 nt, Mycobacterium bovis subsp bovis AF2122/97
gacccgacaugguccgac

SEQ ID NO: 1092500 - RNA, 19 nt, Mycobacterium bovis subsp bovis AF2122/97
gacccgacaugguccgacc

SEQ ID NO: 1092501 - RNA, 12 nt, Mycobacterium bovis subsp bovis AF2122/97
gacccgaugcgu

SEQ ID NO: 1092502 - RNA, 15 nt, Mycobacterium bovis subsp bovis AF2122/97
gacccgacgcugguc

SEQ ID NO: 1092503 - RNA, 18 nt, Mycobacterium bovis subsp bovis AF2122/97
gacccgaucacgcugggu

SEQ ID NO: 1092504 - RNA, 14 nt, Mycobacterium bovis subsp bovis AF2122/97
aacgcucgucgaca

SEQ ID NO: 1092505 - RNA, 19 nt, Mycobacterium bovis subsp bovis AF2122/97
gacccgucccacgugugcg

SEQ ID NO: 1092506 - RNA, 15 nt, Mycobacterium bovis subsp bovis AF2122/97
gacccgucccccgca

SEQ ID NO: 1092507 - RNA, 16 nt, Mycobacterium bovis subsp bovis AF2122/97
gacccguaccagcccg

SEQ ID NO: 1092508 - RNA, 20 nt, Mycobacterium bovis subsp bovis AF2122/97
gacccguacccacgacgggc

SEQ ID NO: 1092509 - RNA, 21 nt, Mycobacterium bovis subsp bovis AF2122/97
gacccguccaacuacgccagc

SEQ ID NO: 1092510 - RNA, 22 nt, Mycobacterium bovis subsp bovis AF2122/97
gacccguccaacuacgccagcc

SEQ ID NO: 1092511 - RNA, 21 nt, Mycobacterium bovis subsp bovis AF2122/97
gacccgguggcguggucucgg

SEQ ID NO: 1092512 - RNA, 15 nt, Mycobacterium bovis subsp bovis AF2122/97
gaccgaacagcaccg

SEQ ID NO: 1092513 - RNA, 17 nt, Mycobacterium bovis subsp bovis AF2122/97
gaccgaacagcaccgaa

SEQ ID NO: 1092514 - RNA, 13 nt, Mycobacterium bovis subsp bovis AF2122/97
gaccgaacagcgg

SEQ ID NO: 1092515 - RNA, 17 nt, Mycobacterium bovis subsp bovis AF2122/97
gaccgaaagccgcacca

SEQ ID NO: 1092516 - RNA, 22 nt, Mycobacterium bovis subsp bovis AF2122/97
gaccgaaauggucguucccgcc

SEQ ID NO: 1092517 - RNA, 22 nt, Mycobacterium bovis subsp bovis AF2122/97
gaccgaaacggggcgacguccg

SEQ ID NO: 1092518 - RNA, 15 nt, Mycobacterium bovis subsp bovis AF2122/97
gaccgaaagccgcac

SEQ ID NO: 1092519 - RNA, 16 nt, Mycobacterium bovis subsp bovis AF2122/97
gaccgaaagccgcacc

SEQ ID NO: 1092520 - RNA, 17 nt, Mycobacterium bovis subsp bovis AF2122/97
gacccgugcacgaucgc

SEQ ID NO: 1092521 - RNA, 18 nt, Mycobacterium bovis subsp bovis AF2122/97
gacccgugcacgaucgcg

SEQ ID NO: 1092522 - RNA, 13 nt, Mycobacterium bovis subsp bovis AF2122/97
gaccgaaccguca

SEQ ID NO: 1092523 - RNA, 22 nt, Mycobacterium bovis subsp bovis AF2122/97
gaccgaaaacacaugccgcagg

SEQ ID NO: 1092524 - RNA, 17 nt, Mycobacterium bovis subsp bovis AF2122/97
gaccgaacagcggcagc

SEQ ID NO: 1092525 - RNA, 17 nt, Mycobacterium bovis subsp bovis AF2122/97
gaccgaagaagcccgac

SEQ ID NO: 1092526 - RNA, 18 nt, Mycobacterium bovis subsp bovis AF2122/97
gaccgaagaagcccgacu

SEQ ID NO: 1092527 - RNA, 17 nt, Mycobacterium bovis subsp bovis AF2122/97
gaccgaagaccuccucg

SEQ ID NO: 1092528 - RNA, 20 nt, Mycobacterium bovis subsp bovis AF2122/97
gaccgaagucugcagacggu

SEQ ID NO: 1092529 - RNA, 16 nt, Mycobacterium bovis subsp bovis AF2122/97
gaccgaaucagcacgg

SEQ ID NO: 1092530 - RNA, 14 nt, Mycobacterium bovis subsp bovis AF2122/97
gaccgaauggccgc

SEQ ID NO: 1092531 - RNA, 16 nt, Mycobacterium bovis subsp bovis AF2122/97
gaccgaauggccgccg

SEQ ID NO: 1092532 - RNA, 12 nt, Mycobacterium bovis subsp bovis AF2122/97
gaccgacaccac

SEQ ID NO: 1092533 - RNA, 13 nt, Mycobacterium bovis subsp bovis AF2122/97
gaccgacaccacc

SEQ ID NO: 1092534 - RNA, 16 nt, Mycobacterium bovis subsp bovis AF2122/97
aacgcuucaccucguc

SEQ ID NO: 1092535 - RNA, 21 nt, Mycobacterium bovis subsp bovis AF2122/97
gaccgaaccuggucuugacuc

SEQ ID NO: 1092536 - RNA, 20 nt, Mycobacterium bovis subsp bovis AF2122/97
aacgcuucaccucgucgaca

SEQ ID NO: 1092537 - RNA, 17 nt, Mycobacterium bovis subsp bovis AF2122/97
gaccgccagcagcaggc

SEQ ID NO: 1092538 - RNA, 19 nt, Mycobacterium bovis subsp bovis AF2122/97
gaccgccaccuuggcguug

SEQ ID NO: 1092539 - RNA, 14 nt, Mycobacterium bovis subsp bovis AF2122/97
gaccgccagcccgg

SEQ ID NO: 1092540 - RNA, 14 nt, Mycobacterium bovis subsp bovis AF2122/97
gaccgccagccgcg

SEQ ID NO: 1092541 - RNA, 16 nt, Mycobacterium bovis subsp bovis AF2122/97
gaccgccagccgcgag

SEQ ID NO: 1092542 - RNA, 17 nt, Mycobacterium bovis subsp bovis AF2122/97
gaccgccagccgcgagc

SEQ ID NO: 1092543 - RNA, 18 nt, Mycobacterium bovis subsp bovis AF2122/97
gaccgccaucgccaacac

SEQ ID NO: 1092544 - RNA, 20 nt, Mycobacterium bovis subsp bovis AF2122/97
gaccgccaucgccaacacca

SEQ ID NO: 1092545 - RNA, 22 nt, Mycobacterium bovis subsp bovis AF2122/97
gaccgccaucgccaacaccaac

SEQ ID NO: 1092546 - RNA, 23 nt, Mycobacterium bovis subsp bovis AF2122/97
gaccgccaucgccaacaccaacc

SEQ ID NO: 1092547 - RNA, 14 nt, Mycobacterium bovis subsp bovis AF2122/97
gaccgccaucgcca

SEQ ID NO: 1092548 - RNA, 14 nt, Mycobacterium bovis subsp bovis AF2122/97
gaccgcccgccagc

SEQ ID NO: 1092549 - RNA, 16 nt, Mycobacterium bovis subsp bovis AF2122/97
gaccgcagucgcuggg

SEQ ID NO: 1092550 - RNA, 22 nt, Mycobacterium bovis subsp bovis AF2122/97
gaccgcaucgguggggcgccgg

SEQ ID NO: 1092551 - RNA, 16 nt, Mycobacterium bovis subsp bovis AF2122/97
gaccgcaucgucgagc

SEQ ID NO: 1092552 - RNA, 16 nt, Mycobacterium bovis subsp bovis AF2122/97
gaccgcagggaccggu

SEQ ID NO: 1092553 - RNA, 16 nt, Mycobacterium bovis subsp bovis AF2122/97
gaccgauugucggcaa

SEQ ID NO: 1092554 - RNA, 15 nt, Mycobacterium bovis subsp bovis AF2122/97
gaccgcacgaccagc

SEQ ID NO: 1092555 - RNA, 16 nt, Mycobacterium bovis subsp bovis AF2122/97
gaccgcacgaccagcu

SEQ ID NO: 1092556 - RNA, 23 nt, Mycobacterium bovis subsp bovis AF2122/97
gaccgccacacggggccgccagc

SEQ ID NO: 1092557 - RNA, 13 nt, Mycobacterium bovis subsp bovis AF2122/97
gaccgccacccca

SEQ ID NO: 1092558 - RNA, 13 nt, Mycobacterium bovis subsp bovis AF2122/97
gaccgccaccccg

SEQ ID NO: 1092559 - RNA, 13 nt, Mycobacterium bovis subsp bovis AF2122/97
gaccgccaccccu

SEQ ID NO: 1092560 - RNA, 13 nt, Mycobacterium bovis subsp bovis AF2122/97
gaccgccaccgcc

SEQ ID NO: 1092561 - RNA, 16 nt, Mycobacterium bovis subsp bovis AF2122/97
gaccgccaccgccagc

SEQ ID NO: 1092562 - RNA, 16 nt, Mycobacterium bovis subsp bovis AF2122/97
gaccgcaugaucgcac

SEQ ID NO: 1092563 - RNA, 22 nt, Mycobacterium bovis subsp bovis AF2122/97
gaccgcaugaucgcaccgaggu

SEQ ID NO: 1092564 - RNA, 16 nt, Mycobacterium bovis subsp bovis AF2122/97
gaccgacgccgguguc

SEQ ID NO: 1092565 - RNA, 18 nt, Mycobacterium bovis subsp bovis AF2122/97
gaccgacgccggugucgg

SEQ ID NO: 1092566 - RNA, 18 nt, Mycobacterium bovis subsp bovis AF2122/97
gaccgacgccgucgagca

SEQ ID NO: 1092567 - RNA, 17 nt, Mycobacterium bovis subsp bovis AF2122/97
gaccgaccaccgcgaaa

SEQ ID NO: 1092568 - RNA, 14 nt, Mycobacterium bovis subsp bovis AF2122/97
gaccgaccuggucg

SEQ ID NO: 1092569 - RNA, 14 nt, Mycobacterium bovis subsp bovis AF2122/97
gaccgaccacgcga

SEQ ID NO: 1092570 - RNA, 13 nt, Mycobacterium bovis subsp bovis AF2122/97
gaccgaccucggc

SEQ ID NO: 1092571 - RNA, 18 nt, Mycobacterium bovis subsp bovis AF2122/97
gaccgaccucggcgaccg

SEQ ID NO: 1092572 - RNA, 12 nt, Mycobacterium bovis subsp bovis AF2122/97
gaccgaccuggu

SEQ ID NO: 1092573 - RNA, 20 nt, Mycobacterium bovis subsp bovis AF2122/97
gaccgagaagcccaccgucu

SEQ ID NO: 1092574 - RNA, 23 nt, Mycobacterium bovis subsp bovis AF2122/97
gaccgacgggucguaggacacca

SEQ ID NO: 1092575 - RNA, 14 nt, Mycobacterium bovis subsp bovis AF2122/97
gaccgacgucgccc

SEQ ID NO: 1092576 - RNA, 19 nt, Mycobacterium bovis subsp bovis AF2122/97
gaccgauugucggcaacga

SEQ ID NO: 1092577 - RNA, 17 nt, Mycobacterium bovis subsp bovis AF2122/97
gaccgagacggcgucgg

SEQ ID NO: 1092578 - RNA, 21 nt, Mycobacterium bovis subsp bovis AF2122/97
gaccgagcaacaccccugggu

SEQ ID NO: 1092579 - RNA, 18 nt, Mycobacterium bovis subsp bovis AF2122/97
gaccgcaccgaccugagu

SEQ ID NO: 1092580 - RNA, 18 nt, Mycobacterium bovis subsp bovis AF2122/97
gaccgcagcgacgggaaa

SEQ ID NO: 1092581 - RNA, 13 nt, Mycobacterium bovis subsp bovis AF2122/97
gaccguccggguc

SEQ ID NO: 1092582 - RNA, 14 nt, Mycobacterium bovis subsp bovis AF2122/97
gaccgucgggguca

SEQ ID NO: 1092583 - RNA, 17 nt, Mycobacterium bovis subsp bovis AF2122/97
gaccgucgcgcugccgg

SEQ ID NO: 1092584 - RNA, 21 nt, Mycobacterium bovis subsp bovis AF2122/97
gaccgucgcgcugccggccgc

SEQ ID NO: 1092585 - RNA, 14 nt, Mycobacterium bovis subsp bovis AF2122/97
gaccgucgccggug

SEQ ID NO: 1092586 - RNA, 22 nt, Mycobacterium bovis subsp bovis AF2122/97
gaccgucgccggugacgacguc

SEQ ID NO: 1092587 - RNA, 12 nt, Mycobacterium bovis subsp bovis AF2122/97
gaccgucgcacc

SEQ ID NO: 1092588 - RNA, 17 nt, Mycobacterium bovis subsp bovis AF2122/97
gaccguccgacggcgga

SEQ ID NO: 1092589 - RNA, 23 nt, Mycobacterium bovis subsp bovis AF2122/97
gaccgucgauccgucggcggaga

SEQ ID NO: 1092590 - RNA, 20 nt, Mycobacterium bovis subsp bovis AF2122/97
gaccgucgauuucgacgacc

SEQ ID NO: 1092591 - RNA, 23 nt, Mycobacterium bovis subsp bovis AF2122/97
gaccguccaccgacguggccagc

SEQ ID NO: 1092592 - RNA, 18 nt, Mycobacterium bovis subsp bovis AF2122/97
gaccgucccagcgccgca

SEQ ID NO: 1092593 - RNA, 13 nt, Mycobacterium bovis subsp bovis AF2122/97
gaccgucaccgga

SEQ ID NO: 1092594 - RNA, 23 nt, Mycobacterium bovis subsp bovis AF2122/97
gaccgucccggccucgaugucgc

SEQ ID NO: 1092595 - RNA, 14 nt, Mycobacterium bovis subsp bovis AF2122/97
gaccguccgacggc

SEQ ID NO: 1092596 - RNA, 14 nt, Mycobacterium bovis subsp bovis AF2122/97
gaccguccagcaac

SEQ ID NO: 1092597 - RNA, 17 nt, Mycobacterium bovis subsp bovis AF2122/97
gaccguccagcaacagc

SEQ ID NO: 1092598 - RNA, 16 nt, Mycobacterium bovis subsp bovis AF2122/97
gaccggugccagcagu

SEQ ID NO: 1092599 - RNA, 17 nt, Mycobacterium bovis subsp bovis AF2122/97
gaccguauugaccagcg

SEQ ID NO: 1092600 - RNA, 16 nt, Mycobacterium bovis subsp bovis AF2122/97
gaccguauuucgucca

SEQ ID NO: 1092601 - RNA, 20 nt, Mycobacterium bovis subsp bovis AF2122/97
gaccgucacaagucgacacg

SEQ ID NO: 1092602 - RNA, 15 nt, Mycobacterium bovis subsp bovis AF2122/97
gaccguagcggccgg

SEQ ID NO: 1092603 - RNA, 19 nt, Mycobacterium bovis subsp bovis AF2122/97
gaccggugcugucgacguc

SEQ ID NO: 1092604 - RNA, 17 nt, Mycobacterium bovis subsp bovis AF2122/97
gaccgguggcaccggcg

SEQ ID NO: 1092605 - RNA, 20 nt, Mycobacterium bovis subsp bovis AF2122/97
gaccgguggcaccggcggcg

SEQ ID NO: 1092606 - RNA, 12 nt, Mycobacterium bovis subsp bovis AF2122/97
gaccgguguggc

SEQ ID NO: 1092607 - RNA, 14 nt, Mycobacterium bovis subsp bovis AF2122/97
aacggcgucguggu

SEQ ID NO: 1092608 - RNA, 21 nt, Mycobacterium bovis subsp bovis AF2122/97
aacggcucgggaacuucgccg

SEQ ID NO: 1092609 - RNA, 18 nt, Mycobacterium bovis subsp bovis AF2122/97
gaccgugcgucgauggcg

SEQ ID NO: 1092610 - RNA, 16 nt, Mycobacterium bovis subsp bovis AF2122/97
gaccgugaucagcgcg

SEQ ID NO: 1092611 - RNA, 21 nt, Mycobacterium bovis subsp bovis AF2122/97
gaccgugaucagcgcguagcc

SEQ ID NO: 1092612 - RNA, 18 nt, Mycobacterium bovis subsp bovis AF2122/97
gaccguggauaacgacug

SEQ ID NO: 1092613 - RNA, 17 nt, Mycobacterium bovis subsp bovis AF2122/97
gaccgugccgucggcgu

SEQ ID NO: 1092614 - RNA, 19 nt, Mycobacterium bovis subsp bovis AF2122/97
gaccgugccgucggcgugc

SEQ ID NO: 1092615 - RNA, 17 nt, Mycobacterium bovis subsp bovis AF2122/97
gaccgucgucaccgcga

SEQ ID NO: 1092616 - RNA, 21 nt, Mycobacterium bovis subsp bovis AF2122/97
gaccgucuggaguucgucacc

SEQ ID NO: 1092617 - RNA, 15 nt, Mycobacterium bovis subsp bovis AF2122/97
gaccgucguggcggu

SEQ ID NO: 1092618 - RNA, 18 nt, Mycobacterium bovis subsp bovis AF2122/97
gaccgucguggcgguggc

SEQ ID NO: 1092619 - RNA, 16 nt, Mycobacterium bovis subsp bovis AF2122/97
gaccgucucgguggug

SEQ ID NO: 1092620 - RNA, 13 nt, Mycobacterium bovis subsp bovis AF2122/97
gaccgugaucagc

SEQ ID NO: 1092621 - RNA, 17 nt, Mycobacterium bovis subsp bovis AF2122/97
gaccgugaacggcucgg

SEQ ID NO: 1092622 - RNA, 22 nt, Mycobacterium bovis subsp bovis AF2122/97
gaccgucuuuggugccgagcag

SEQ ID NO: 1092623 - RNA, 16 nt, Mycobacterium bovis subsp bovis AF2122/97
gaccuaccuccucggc

SEQ ID NO: 1092624 - RNA, 15 nt, Mycobacterium bovis subsp bovis AF2122/97
gaccuagcagcgcug

SEQ ID NO: 1092625 - RNA, 18 nt, Mycobacterium bovis subsp bovis AF2122/97
gaccucaauuggcucggc

SEQ ID NO: 1092626 - RNA, 19 nt, Mycobacterium bovis subsp bovis AF2122/97
gaccucaauuggcucggcg

SEQ ID NO: 1092627 - RNA, 13 nt, Mycobacterium bovis subsp bovis AF2122/97
gaccguuucgucg

SEQ ID NO: 1092628 - RNA, 13 nt, Mycobacterium bovis subsp bovis AF2122/97
gaccguuucuccg

SEQ ID NO: 1092629 - RNA, 21 nt, Mycobacterium bovis subsp bovis AF2122/97
gaccguuugaauuuggacguc

SEQ ID NO: 1092630 - RNA, 15 nt, Mycobacterium bovis subsp bovis AF2122/97
gaccuccgacgugcc

SEQ ID NO: 1092631 - RNA, 15 nt, Mycobacterium bovis subsp bovis AF2122/97
gaccuccacgcgcca

SEQ ID NO: 1092632 - RNA, 16 nt, Mycobacterium bovis subsp bovis AF2122/97
gaccucacgggcgccg

SEQ ID NO: 1092633 - RNA, 19 nt, Mycobacterium bovis subsp bovis AF2122/97
gaccuccagugcggccuug

SEQ ID NO: 1092634 - RNA, 13 nt, Mycobacterium bovis subsp bovis AF2122/97
gaccguguaacca

SEQ ID NO: 1092635 - RNA, 17 nt, Mycobacterium bovis subsp bovis AF2122/97
gaccgugucaccgccgg

SEQ ID NO: 1092636 - RNA, 15 nt, Mycobacterium bovis subsp bovis AF2122/97
gaccguucggcgguc

SEQ ID NO: 1092637 - RNA, 17 nt, Mycobacterium bovis subsp bovis AF2122/97
gaccguugccgauggug

SEQ ID NO: 1092638 - RNA, 21 nt, Mycobacterium bovis subsp bovis AF2122/97
gaccguuucgaucucgagcag

SEQ ID NO: 1092639 - RNA, 14 nt, Mycobacterium bovis subsp bovis AF2122/97
gaccguggcggccu

SEQ ID NO: 1092640 - RNA, 16 nt, Mycobacterium bovis subsp bovis AF2122/97
gaccguggcggccucc

SEQ ID NO: 1092641 - RNA, 18 nt, Mycobacterium bovis subsp bovis AF2122/97
aacggugaucagccaccg

SEQ ID NO: 1092642 - RNA, 14 nt, Mycobacterium bovis subsp bovis AF2122/97
aacgggauccgcgc

SEQ ID NO: 1092643 - RNA, 13 nt, Mycobacterium bovis subsp bovis AF2122/97
aacgggaugccgg

SEQ ID NO: 1092644 - RNA, 13 nt, Mycobacterium bovis subsp bovis AF2122/97
aacgggaugcggu

SEQ ID NO: 1092645 - RNA, 16 nt, Mycobacterium bovis subsp bovis AF2122/97
aacgggaugcggucga

SEQ ID NO: 1092646 - RNA, 15 nt, Mycobacterium bovis subsp bovis AF2122/97
aacgggccuucgcca

SEQ ID NO: 1092647 - RNA, 15 nt, Mycobacterium bovis subsp bovis AF2122/97
aacggguccgacggu

SEQ ID NO: 1092648 - RNA, 17 nt, Mycobacterium bovis subsp bovis AF2122/97
aacgggggcgccuucac

SEQ ID NO: 1092649 - RNA, 23 nt, Mycobacterium bovis subsp bovis AF2122/97
aacgguagcacugucgagguggu

SEQ ID NO: 1092650 - RNA, 18 nt, Mycobacterium bovis subsp bovis AF2122/97
aacggguggauugacgcg

SEQ ID NO: 1092651 - RNA, 19 nt, Mycobacterium bovis subsp bovis AF2122/97
aacgggucgaugucggcaa

SEQ ID NO: 1092652 - RNA, 20 nt, Mycobacterium bovis subsp bovis AF2122/97
aacgggucguugccggacaa

SEQ ID NO: 1092653 - RNA, 23 nt, Mycobacterium bovis subsp bovis AF2122/97
aacgggucguugccggacaaccu

SEQ ID NO: 1092654 - RNA, 19 nt, Mycobacterium bovis subsp bovis AF2122/97
aacggguacacccgcucgc

SEQ ID NO: 1092655 - RNA, 23 nt, Mycobacterium bovis subsp bovis AF2122/97
gaccucgaccuggaugggcucga

SEQ ID NO: 1092656 - RNA, 19 nt, Mycobacterium bovis subsp bovis AF2122/97
gaccuccggaaucgcccgg

SEQ ID NO: 1092657 - RNA, 20 nt, Mycobacterium bovis subsp bovis AF2122/97
gaccuccggaaucgcccggg

SEQ ID NO: 1092658 - RNA, 22 nt, Mycobacterium bovis subsp bovis AF2122/97
gaccuccggauaacccagcggc

SEQ ID NO: 1092659 - RNA, 20 nt, Mycobacterium bovis subsp bovis AF2122/97
gaccucgaagcccagcacca

SEQ ID NO: 1092660 - RNA, 17 nt, Mycobacterium bovis subsp bovis AF2122/97
gaccucgacguugggcg

SEQ ID NO: 1092661 - RNA, 15 nt, Mycobacterium bovis subsp bovis AF2122/97
gaccucgcgcaccgg

SEQ ID NO: 1092662 - RNA, 14 nt, Mycobacterium bovis subsp bovis AF2122/97
gaccucgccgguga

SEQ ID NO: 1092663 - RNA, 14 nt, Mycobacterium bovis subsp bovis AF2122/97
gaccucgccgcggc

SEQ ID NO: 1092664 - RNA, 20 nt, Mycobacterium bovis subsp bovis AF2122/97
gaccucgccgcgcgugacag

SEQ ID NO: 1092665 - RNA, 18 nt, Mycobacterium bovis subsp bovis AF2122/97
gaccucgcggcgcugguu

SEQ ID NO: 1092666 - RNA, 19 nt, Mycobacterium bovis subsp bovis AF2122/97
gaccucgcgggcgaucggc

SEQ ID NO: 1092667 - RNA, 20 nt, Mycobacterium bovis subsp bovis AF2122/97
gaccucggcaaccaccucgu

SEQ ID NO: 1092668 - RNA, 16 nt, Mycobacterium bovis subsp bovis AF2122/97
gaccucguucgucacc

SEQ ID NO: 1092669 - RNA, 22 nt, Mycobacterium bovis subsp bovis AF2122/97
gaccucgucaccggucagcgac

SEQ ID NO: 1092670 - RNA, 18 nt, Mycobacterium bovis subsp bovis AF2122/97
gaccucggcgaugucgcg

SEQ ID NO: 1092671 - RNA, 14 nt, Mycobacterium bovis subsp bovis AF2122/97
gaccucggcgacga

SEQ ID NO: 1092672 - RNA, 13 nt, Mycobacterium bovis subsp bovis AF2122/97
gaccucggcgaug

SEQ ID NO: 1092673 - RNA, 13 nt, Mycobacterium bovis subsp bovis AF2122/97
gaccucggcggcg

SEQ ID NO: 1092674 - RNA, 14 nt, Mycobacterium bovis subsp bovis AF2122/97
gaccucggcggcgg

SEQ ID NO: 1092675 - RNA, 14 nt, Mycobacterium bovis subsp bovis AF2122/97
gaccucggcgguca

SEQ ID NO: 1092676 - RNA, 20 nt, Mycobacterium bovis subsp bovis AF2122/97
gaccucuucgggcagcgcgu

SEQ ID NO: 1092677 - RNA, 17 nt, Mycobacterium bovis subsp bovis AF2122/97
gaccucgucgcgucgcc

SEQ ID NO: 1092678 - RNA, 14 nt, Mycobacterium bovis subsp bovis AF2122/97
gaccucgucgcguc

SEQ ID NO: 1092679 - RNA, 16 nt, Mycobacterium bovis subsp bovis AF2122/97
gaccucgucgcgucgc

SEQ ID NO: 1092680 - RNA, 20 nt, Mycobacterium bovis subsp bovis AF2122/97
gaccugaccgguggccaucg

SEQ ID NO: 1092681 - RNA, 21 nt, Mycobacterium bovis subsp bovis AF2122/97
gaccucggcaacgacugcaug

SEQ ID NO: 1092682 - RNA, 20 nt, Mycobacterium bovis subsp bovis AF2122/97
gaccugaugagcucaccggg

SEQ ID NO: 1092683 - RNA, 13 nt, Mycobacterium bovis subsp bovis AF2122/97
gaccugcuggcgc

SEQ ID NO: 1092684 - RNA, 18 nt, Mycobacterium bovis subsp bovis AF2122/97
gaccugaggcaccucggc

SEQ ID NO: 1092685 - RNA, 16 nt, Mycobacterium bovis subsp bovis AF2122/97
gacgacaaccggccag

SEQ ID NO: 1092686 - RNA, 17 nt, Mycobacterium bovis subsp bovis AF2122/97
gacgacaaccggccaga

SEQ ID NO: 1092687 - RNA, 15 nt, Mycobacterium bovis subsp bovis AF2122/97
gacgacaaucgggac

SEQ ID NO: 1092688 - RNA, 13 nt, Mycobacterium bovis subsp bovis AF2122/97
gacgaacgacggg

SEQ ID NO: 1092689 - RNA, 13 nt, Mycobacterium bovis subsp bovis AF2122/97
gacgaacgccguc

SEQ ID NO: 1092690 - RNA, 15 nt, Mycobacterium bovis subsp bovis AF2122/97
gacgaacgccgucga

SEQ ID NO: 1092691 - RNA, 20 nt, Mycobacterium bovis subsp bovis AF2122/97
gacgaacgaaccgccgccgc

SEQ ID NO: 1092692 - RNA, 17 nt, Mycobacterium bovis subsp bovis AF2122/97
gacgaacaccagcgcgc

SEQ ID NO: 1092693 - RNA, 13 nt, Mycobacterium bovis subsp bovis AF2122/97
gacgaacccgaca

SEQ ID NO: 1092694 - RNA, 22 nt, Mycobacterium bovis subsp bovis AF2122/97
gacgaacccgacaauggcgcca

SEQ ID NO: 1092695 - RNA, 14 nt, Mycobacterium bovis subsp bovis AF2122/97
gacgaacacaccgg

SEQ ID NO: 1092696 - RNA, 15 nt, Mycobacterium bovis subsp bovis AF2122/97
gacgaacacaccggu

SEQ ID NO: 1092697 - RNA, 22 nt, Mycobacterium bovis subsp bovis AF2122/97
gacgaaaucggcggcguccagc

SEQ ID NO: 1092698 - RNA, 18 nt, Mycobacterium bovis subsp bovis AF2122/97
gacgaaacucucccgguu

SEQ ID NO: 1092699 - RNA, 18 nt, Mycobacterium bovis subsp bovis AF2122/97
gacgaaagguugccgauc

SEQ ID NO: 1092700 - RNA, 14 nt, Mycobacterium bovis subsp bovis AF2122/97
gacgaaauccgccg

SEQ ID NO: 1092701 - RNA, 19 nt, Mycobacterium bovis subsp bovis AF2122/97
gacgaaauccgccgggcgc

SEQ ID NO: 1092702 - RNA, 15 nt, Mycobacterium bovis subsp bovis AF2122/97
gacgaaaucggcggc

SEQ ID NO: 1092703 - RNA, 15 nt, Mycobacterium bovis subsp bovis AF2122/97
gaccuggccgucgcu

SEQ ID NO: 1092704 - RNA, 13 nt, Mycobacterium bovis subsp bovis AF2122/97
gaccuggcggcgg

SEQ ID NO: 1092705 - RNA, 15 nt, Mycobacterium bovis subsp bovis AF2122/97
gaccuggcggcggua

SEQ ID NO: 1092706 - RNA, 13 nt, Mycobacterium bovis subsp bovis AF2122/97
gaccuggccgccc

SEQ ID NO: 1092707 - RNA, 14 nt, Mycobacterium bovis subsp bovis AF2122/97
gaccuggccgcccg

SEQ ID NO: 1092708 - RNA, 15 nt, Mycobacterium bovis subsp bovis AF2122/97
gaccuggccgcccgc

SEQ ID NO: 1092709 - RNA, 20 nt, Mycobacterium bovis subsp bovis AF2122/97
gaccuggccgcccgcugcgg

SEQ ID NO: 1092710 - RNA, 22 nt, Mycobacterium bovis subsp bovis AF2122/97
gaccuggccgcccgcugcggcg

SEQ ID NO: 1092711 - RNA, 12 nt, Mycobacterium bovis subsp bovis AF2122/97
gaccuggccacg

SEQ ID NO: 1092712 - RNA, 17 nt, Mycobacterium bovis subsp bovis AF2122/97
gaccuggacgcggccaa

SEQ ID NO: 1092713 - RNA, 13 nt, Mycobacterium bovis subsp bovis AF2122/97
gaccugggcgccc

SEQ ID NO: 1092714 - RNA, 17 nt, Mycobacterium bovis subsp bovis AF2122/97
gaccuggguggcgucgc

SEQ ID NO: 1092715 - RNA, 17 nt, Mycobacterium bovis subsp bovis AF2122/97
gacgaaaaaaucgugcg

SEQ ID NO: 1092716 - RNA, 18 nt, Mycobacterium bovis subsp bovis AF2122/97
gacgaaaaaaucgugcgg

SEQ ID NO: 1092717 - RNA, 15 nt, Mycobacterium bovis subsp bovis AF2122/97
gaccuuuucccgcag

SEQ ID NO: 1092718 - RNA, 22 nt, Mycobacterium bovis subsp bovis AF2122/97
gaccuuuucccgcaggcucacc

SEQ ID NO: 1092719 - RNA, 18 nt, Mycobacterium bovis subsp bovis AF2122/97
gaccccggaacgacccca

SEQ ID NO: 1092720 - RNA, 19 nt, Mycobacterium bovis subsp bovis AF2122/97
gaccccggcguugccgccg

SEQ ID NO: 1092721 - RNA, 17 nt, Mycobacterium bovis subsp bovis AF2122/97
gaccccgcugcgacguu

SEQ ID NO: 1092722 - RNA, 15 nt, Mycobacterium bovis subsp bovis AF2122/97
gaccccgccgaacgg

SEQ ID NO: 1092723 - RNA, 13 nt, Mycobacterium bovis subsp bovis AF2122/97
gaccccgccagcc

SEQ ID NO: 1092724 - RNA, 21 nt, Mycobacterium bovis subsp bovis AF2122/97
gacccccgaucaggccgacgu

SEQ ID NO: 1092725 - RNA, 17 nt, Mycobacterium bovis subsp bovis AF2122/97
gacccccgcaucggcgc

SEQ ID NO: 1092726 - RNA, 17 nt, Mycobacterium bovis subsp bovis AF2122/97
gacccauucucggccgg

SEQ ID NO: 1092727 - RNA, 18 nt, Mycobacterium bovis subsp bovis AF2122/97
gacccauucucggccggc

SEQ ID NO: 1092728 - RNA, 19 nt, Mycobacterium bovis subsp bovis AF2122/97
gacccauuggaccgagacu

SEQ ID NO: 1092729 - RNA, 14 nt, Mycobacterium bovis subsp bovis AF2122/97
gaccccaaucgacc

SEQ ID NO: 1092730 - RNA, 20 nt, Mycobacterium bovis subsp bovis AF2122/97
gaccaucgcgacggcaagca

SEQ ID NO: 1092731 - RNA, 13 nt, Mycobacterium bovis subsp bovis AF2122/97
gaccaucccgccg

SEQ ID NO: 1092732 - RNA, 16 nt, Mycobacterium bovis subsp bovis AF2122/97
gaccaucccgccgauc

SEQ ID NO: 1092733 - RNA, 21 nt, Mycobacterium bovis subsp bovis AF2122/97
gaccauccgaguugucgccgg

SEQ ID NO: 1092734 - RNA, 18 nt, Mycobacterium bovis subsp bovis AF2122/97
gaccaucgccaggcccug

SEQ ID NO: 1092735 - RNA, 19 nt, Mycobacterium bovis subsp bovis AF2122/97
gaccaucagcgucgacguc

SEQ ID NO: 1092736 - RNA, 21 nt, Mycobacterium bovis subsp bovis AF2122/97
gaccaucaccacggccgccga

SEQ ID NO: 1092737 - RNA, 22 nt, Mycobacterium bovis subsp bovis AF2122/97
gaccauacuaauggcgccaccg

SEQ ID NO: 1092738 - RNA, 16 nt, Mycobacterium bovis subsp bovis AF2122/97
gaccauagccugcgcc

SEQ ID NO: 1092739 - RNA, 18 nt, Mycobacterium bovis subsp bovis AF2122/97
gaccauagccugcgccga

SEQ ID NO: 1092740 - RNA, 20 nt, Mycobacterium bovis subsp bovis AF2122/97
gaccauagucgccgucgugc

SEQ ID NO: 1092741 - RNA, 19 nt, Mycobacterium bovis subsp bovis AF2122/97
gaccauauuggcgcggccg

SEQ ID NO: 1092742 - RNA, 21 nt, Mycobacterium bovis subsp bovis AF2122/97
gaccauauuggcgcggccgaa

SEQ ID NO: 1092743 - RNA, 13 nt, Mycobacterium bovis subsp bovis AF2122/97
gaccagugcggug

SEQ ID NO: 1092744 - RNA, 17 nt, Mycobacterium bovis subsp bovis AF2122/97
gaccagguucucggucg

SEQ ID NO: 1092745 - RNA, 14 nt, Mycobacterium bovis subsp bovis AF2122/97
gaccagucgacguc

SEQ ID NO: 1092746 - RNA, 21 nt, Mycobacterium bovis subsp bovis AF2122/97
gaccagucgacgucucuggug

SEQ ID NO: 1092747 - RNA, 22 nt, Mycobacterium bovis subsp bovis AF2122/97
gaccauaaaacucgggggcugc

SEQ ID NO: 1092748 - RNA, 17 nt, Mycobacterium bovis subsp bovis AF2122/97
aacgcgaacccgcgagg

SEQ ID NO: 1092749 - RNA, 17 nt, Mycobacterium bovis subsp bovis AF2122/97
aacgcgaaugucgcgcu

SEQ ID NO: 1092750 - RNA, 22 nt, Mycobacterium bovis subsp bovis AF2122/97
aacgccuuguuggcgcccgggc

SEQ ID NO: 1092751 - RNA, 12 nt, Mycobacterium bovis subsp bovis AF2122/97
gaccagccccgc

SEQ ID NO: 1092752 - RNA, 21 nt, Mycobacterium bovis subsp bovis AF2122/97
gaccagcuucggcuggcgugc

SEQ ID NO: 1092753 - RNA, 15 nt, Mycobacterium bovis subsp bovis AF2122/97
gaccaggaccaccgc

SEQ ID NO: 1092754 - RNA, 22 nt, Mycobacterium bovis subsp bovis AF2122/97
gaccaggacgguugguccgccg

SEQ ID NO: 1092755 - RNA, 14 nt, Mycobacterium bovis subsp bovis AF2122/97
gaccaggccaacgg

SEQ ID NO: 1092756 - RNA, 20 nt, Mycobacterium bovis subsp bovis AF2122/97
gaccaggccacugccgacca

SEQ ID NO: 1092757 - RNA, 17 nt, Mycobacterium bovis subsp bovis AF2122/97
gaccaggucggcuucga

SEQ ID NO: 1092758 - RNA, 14 nt, Mycobacterium bovis subsp bovis AF2122/97
gaccagcggcggcg

SEQ ID NO: 1092759 - RNA, 20 nt, Mycobacterium bovis subsp bovis AF2122/97
gaccagcuugaccgaccacg

SEQ ID NO: 1092760 - RNA, 18 nt, Mycobacterium bovis subsp bovis AF2122/97
gaccagcugccggcgacc

SEQ ID NO: 1092761 - RNA, 21 nt, Mycobacterium bovis subsp bovis AF2122/97
gaccagcuggccguacucguc

SEQ ID NO: 1092762 - RNA, 17 nt, Mycobacterium bovis subsp bovis AF2122/97
aacgccgagcgccaguu

SEQ ID NO: 1092763 - RNA, 20 nt, Mycobacterium bovis subsp bovis AF2122/97
aacgccgcaauggaccgaac

SEQ ID NO: 1092764 - RNA, 16 nt, Mycobacterium bovis subsp bovis AF2122/97
aacgcccgggcggcgu

SEQ ID NO: 1092765 - RNA, 18 nt, Mycobacterium bovis subsp bovis AF2122/97
gaccacggucugccacga

SEQ ID NO: 1092766 - RNA, 17 nt, Mycobacterium bovis subsp bovis AF2122/97
gaccacggugaguuggc

SEQ ID NO: 1092767 - RNA, 20 nt, Mycobacterium bovis subsp bovis AF2122/97
aacgccggauuauucgcggu

SEQ ID NO: 1092768 - RNA, 12 nt, Mycobacterium bovis subsp bovis AF2122/97
aacgccggcacc

SEQ ID NO: 1092769 - RNA, 20 nt, Mycobacterium bovis subsp bovis AF2122/97
aacgccggcgacggcgucac

SEQ ID NO: 1092770 - RNA, 15 nt, Mycobacterium bovis subsp bovis AF2122/97
gaccacgucgagguc

SEQ ID NO: 1092771 - RNA, 22 nt, Mycobacterium bovis subsp bovis AF2122/97
gaccacgugaucgacgaccguc

SEQ ID NO: 1092772 - RNA, 23 nt, Mycobacterium bovis subsp bovis AF2122/97
gaccacucaagauaacggcgacc

SEQ ID NO: 1092773 - RNA, 16 nt, Mycobacterium bovis subsp bovis AF2122/97
gaccacuccacgcagc

SEQ ID NO: 1092774 - RNA, 15 nt, Mycobacterium bovis subsp bovis AF2122/97
gaccagcaccagaac

SEQ ID NO: 1092775 - RNA, 22 nt, Mycobacterium bovis subsp bovis AF2122/97
aacgccugaaacgauugcugcg

SEQ ID NO: 1092776 - RNA, 23 nt, Mycobacterium bovis subsp bovis AF2122/97
aacgccugaaacgauugcugcgg

SEQ ID NO: 1092777 - RNA, 14 nt, Mycobacterium bovis subsp bovis AF2122/97
aacgccggcaucgc

SEQ ID NO: 1092778 - RNA, 14 nt, Mycobacterium bovis subsp bovis AF2122/97
gaccagcaaccacc

SEQ ID NO: 1092779 - RNA, 12 nt, Mycobacterium bovis subsp bovis AF2122/97
gaccagcaacga

SEQ ID NO: 1092780 - RNA, 14 nt, Mycobacterium bovis subsp bovis AF2122/97
gaccagcacaccgc

SEQ ID NO: 1092781 - RNA, 18 nt, Mycobacterium bovis subsp bovis AF2122/97
gaccagagcuucgccgcg

SEQ ID NO: 1092782 - RNA, 19 nt, Mycobacterium bovis subsp bovis AF2122/97
gaccagagcuucgccgcgc

SEQ ID NO: 1092783 - RNA, 17 nt, Mycobacterium bovis subsp bovis AF2122/97
gaccagaggaugucgau

SEQ ID NO: 1092784 - RNA, 20 nt, Mycobacterium bovis subsp bovis AF2122/97
gaccagaggaugucgauggg

SEQ ID NO: 1092785 - RNA, 22 nt, Mycobacterium bovis subsp bovis AF2122/97
gaccacgaacgcgcgcagccgg

SEQ ID NO: 1092786 - RNA, 20 nt, Mycobacterium bovis subsp bovis AF2122/97
gaccaccuucugacgcggcc

SEQ ID NO: 1092787 - RNA, 21 nt, Mycobacterium bovis subsp bovis AF2122/97
gaccaccuucugacgcggccg

SEQ ID NO: 1092788 - RNA, 20 nt, Mycobacterium bovis subsp bovis AF2122/97
gaccacgaauggggccaaca

SEQ ID NO: 1092789 - RNA, 12 nt, Mycobacterium bovis subsp bovis AF2122/97
gaccacgacgug

SEQ ID NO: 1092790 - RNA, 17 nt, Mycobacterium bovis subsp bovis AF2122/97
gaccacgacguucgacg

SEQ ID NO: 1092791 - RNA, 23 nt, Mycobacterium bovis subsp bovis AF2122/97
gaccacgacguucgacgacagca

SEQ ID NO: 1092792 - RNA, 14 nt, Mycobacterium bovis subsp bovis AF2122/97
gaccaccuggucgc

SEQ ID NO: 1092793 - RNA, 22 nt, Mycobacterium bovis subsp bovis AF2122/97
gaccaccacuaggucgccggcc

SEQ ID NO: 1092794 - RNA, 16 nt, Mycobacterium bovis subsp bovis AF2122/97
gaccaccaccgccgcc

SEQ ID NO: 1092795 - RNA, 18 nt, Mycobacterium bovis subsp bovis AF2122/97
gaccaccaccgccgccga

SEQ ID NO: 1092796 - RNA, 23 nt, Mycobacterium bovis subsp bovis AF2122/97
gaccaccaccgccgccgaagcga

SEQ ID NO: 1092797 - RNA, 11 nt, Mycobacterium bovis subsp bovis AF2122/97
gaccaccacca

SEQ ID NO: 1092798 - RNA, 14 nt, Mycobacterium bovis subsp bovis AF2122/97
gaccaccaccaacg

SEQ ID NO: 1092799 - RNA, 19 nt, Mycobacterium bovis subsp bovis AF2122/97
gaccacaccacgauggcgg

SEQ ID NO: 1092800 - RNA, 22 nt, Mycobacterium bovis subsp bovis AF2122/97
gaccacauuccgcagucccgaa

SEQ ID NO: 1092801 - RNA, 13 nt, Mycobacterium bovis subsp bovis AF2122/97
gaccaccaccgag

SEQ ID NO: 1092802 - RNA, 12 nt, Mycobacterium bovis subsp bovis AF2122/97
gaccacgccgac

SEQ ID NO: 1092803 - RNA, 13 nt, Mycobacterium bovis subsp bovis AF2122/97
gaccacgcaccgc

SEQ ID NO: 1092804 - RNA, 15 nt, Mycobacterium bovis subsp bovis AF2122/97
gaccacgcaccgccc

SEQ ID NO: 1092805 - RNA, 22 nt, Mycobacterium bovis subsp bovis AF2122/97
gaccacgcaccgccccgccguu

SEQ ID NO: 1092806 - RNA, 22 nt, Mycobacterium bovis subsp bovis AF2122/97
aacgccaagcucggcccagcgc

SEQ ID NO: 1092807 - RNA, 13 nt, Mycobacterium bovis subsp bovis AF2122/97
gacagguguugga

SEQ ID NO: 1092808 - RNA, 22 nt, Mycobacterium bovis subsp bovis AF2122/97
gacaggucggggcgucguucgc

SEQ ID NO: 1092809 - RNA, 15 nt, Mycobacterium bovis subsp bovis AF2122/97
gacaggucgggcagc

SEQ ID NO: 1092810 - RNA, 18 nt, Mycobacterium bovis subsp bovis AF2122/97
gacaggucgggcagcacu

SEQ ID NO: 1092811 - RNA, 23 nt, Mycobacterium bovis subsp bovis AF2122/97
gacagggugcgcuugcggccgcg

SEQ ID NO: 1092812 - RNA, 14 nt, Mycobacterium bovis subsp bovis AF2122/97
gacagggugggggc

SEQ ID NO: 1092813 - RNA, 13 nt, Mycobacterium bovis subsp bovis AF2122/97
gacaggucggcau

SEQ ID NO: 1092814 - RNA, 16 nt, Mycobacterium bovis subsp bovis AF2122/97
gacagucaacagggcc

SEQ ID NO: 1092815 - RNA, 14 nt, Mycobacterium bovis subsp bovis AF2122/97
gacaguggcgacgg

SEQ ID NO: 1092816 - RNA, 20 nt, Mycobacterium bovis subsp bovis AF2122/97
gacaguucgcgccguggcgu

SEQ ID NO: 1092817 - RNA, 20 nt, Mycobacterium bovis subsp bovis AF2122/97
gacaugucaggccgucaccg

SEQ ID NO: 1092818 - RNA, 19 nt, Mycobacterium bovis subsp bovis AF2122/97
gacaguuggcagcgcuggc

SEQ ID NO: 1092819 - RNA, 18 nt, Mycobacterium bovis subsp bovis AF2122/97
gacaugguccgaccagcg

SEQ ID NO: 1092820 - RNA, 23 nt, Mycobacterium bovis subsp bovis AF2122/97
gacaugguccgaccagcggccga

SEQ ID NO: 1092821 - RNA, 12 nt, Mycobacterium bovis subsp bovis AF2122/97
gacaugcgccga

SEQ ID NO: 1092822 - RNA, 13 nt, Mycobacterium bovis subsp bovis AF2122/97
gacaugcgcacca

SEQ ID NO: 1092823 - RNA, 18 nt, Mycobacterium bovis subsp bovis AF2122/97
gacaugcgcaccaugggu

SEQ ID NO: 1092824 - RNA, 17 nt, Mycobacterium bovis subsp bovis AF2122/97
gacauuggagacgacga

SEQ ID NO: 1092825 - RNA, 14 nt, Mycobacterium bovis subsp bovis AF2122/97
gacauuggugcuga

SEQ ID NO: 1092826 - RNA, 13 nt, Mycobacterium bovis subsp bovis AF2122/97
gaccaacaccccc

SEQ ID NO: 1092827 - RNA, 24 nt, Mycobacterium bovis subsp bovis AF2122/97
gaccaaaccgcuguaaccgguaac

SEQ ID NO: 1092828 - RNA, 17 nt, Mycobacterium bovis subsp bovis AF2122/97
gaccaacacgucgagca

SEQ ID NO: 1092829 - RNA, 16 nt, Mycobacterium bovis subsp bovis AF2122/97
gaccaacucguggaac

SEQ ID NO: 1092830 - RNA, 22 nt, Mycobacterium bovis subsp bovis AF2122/97
aacgacgucgucgccgccgaaa

SEQ ID NO: 1092831 - RNA, 16 nt, Mycobacterium bovis subsp bovis AF2122/97
aacgacucgcgguggc

SEQ ID NO: 1092832 - RNA, 21 nt, Mycobacterium bovis subsp bovis AF2122/97
aacgacuggguggugcucacc

SEQ ID NO: 1092833 - RNA, 21 nt, Mycobacterium bovis subsp bovis AF2122/97
aacgacguugauccccagcuc

SEQ ID NO: 1092834 - RNA, 15 nt, Mycobacterium bovis subsp bovis AF2122/97
aacgacgucgccgac

SEQ ID NO: 1092835 - RNA, 18 nt, Mycobacterium bovis subsp bovis AF2122/97
aacgagcuuccacgccgg

SEQ ID NO: 1092836 - RNA, 22 nt, Mycobacterium bovis subsp bovis AF2122/97
aacgaggcgcccagcgacaaca

SEQ ID NO: 1092837 - RNA, 17 nt, Mycobacterium bovis subsp bovis AF2122/97
aacgaguagccggucgg

SEQ ID NO: 1092838 - RNA, 15 nt, Mycobacterium bovis subsp bovis AF2122/97
aacgagauucgucca

SEQ ID NO: 1092839 - RNA, 18 nt, Mycobacterium bovis subsp bovis AF2122/97
gaccacaccgucaccgag

SEQ ID NO: 1092840 - RNA, 21 nt, Mycobacterium bovis subsp bovis AF2122/97
gaccacaccgucaccgagccc

SEQ ID NO: 1092841 - RNA, 22 nt, Mycobacterium bovis subsp bovis AF2122/97
gaccacagcggagacgaucgcc

SEQ ID NO: 1092842 - RNA, 13 nt, Mycobacterium bovis subsp bovis AF2122/97
gaccacaggcauc

SEQ ID NO: 1092843 - RNA, 15 nt, Mycobacterium bovis subsp bovis AF2122/97
gaccacagccgcgcc

SEQ ID NO: 1092844 - RNA, 22 nt, Mycobacterium bovis subsp bovis AF2122/97
gaccacagccgcgccgaccuca

SEQ ID NO: 1092845 - RNA, 17 nt, Mycobacterium bovis subsp bovis AF2122/97
gaccaauuggucgaguc

SEQ ID NO: 1092846 - RNA, 21 nt, Mycobacterium bovis subsp bovis AF2122/97
gaccaauucgcaaucggcguu

SEQ ID NO: 1092847 - RNA, 21 nt, Mycobacterium bovis subsp bovis AF2122/97
gaccaauucgaccgcgcggau

SEQ ID NO: 1092848 - RNA, 22 nt, Mycobacterium bovis subsp bovis AF2122/97
gaccaaugcgucgaugcgcugc

SEQ ID NO: 1092849 - RNA, 23 nt, Mycobacterium bovis subsp bovis AF2122/97
gaccaaugucagugccccgcccg

SEQ ID NO: 1092850 - RNA, 17 nt, Mycobacterium bovis subsp bovis AF2122/97
gaccaagguguccagca

SEQ ID NO: 1092851 - RNA, 21 nt, Mycobacterium bovis subsp bovis AF2122/97
gaccaagugucgccgcucggu

SEQ ID NO: 1092852 - RNA, 21 nt, Mycobacterium bovis subsp bovis AF2122/97
aacgaguuugauuucgcacgg

SEQ ID NO: 1092853 - RNA, 21 nt, Mycobacterium bovis subsp bovis AF2122/97
gaaugaucgucccgcggcgcg

SEQ ID NO: 1092854 - RNA, 13 nt, Mycobacterium bovis subsp bovis AF2122/97
gaauggcgccggc

SEQ ID NO: 1092855 - RNA, 19 nt, Mycobacterium bovis subsp bovis AF2122/97
gaauggcggacagggcggc

SEQ ID NO: 1092856 - RNA, 18 nt, Mycobacterium bovis subsp bovis AF2122/97
gaauggcucacgcuccgc

SEQ ID NO: 1092857 - RNA, 20 nt, Mycobacterium bovis subsp bovis AF2122/97
gaaugggggcuggucgccgu

SEQ ID NO: 1092858 - RNA, 22 nt, Mycobacterium bovis subsp bovis AF2122/97
gaaugucuccaguagccggugc

SEQ ID NO: 1092859 - RNA, 19 nt, Mycobacterium bovis subsp bovis AF2122/97
gaaugucuuuggucgccgg

SEQ ID NO: 1092860 - RNA, 18 nt, Mycobacterium bovis subsp bovis AF2122/97
gaauguaguccagcucgc

SEQ ID NO: 1092861 - RNA, 15 nt, Mycobacterium bovis subsp bovis AF2122/97
gaauguugccgccgc

SEQ ID NO: 1092862 - RNA, 20 nt, Mycobacterium bovis subsp bovis AF2122/97
gaauguugguuugccggcgg

SEQ ID NO: 1092863 - RNA, 21 nt, Mycobacterium bovis subsp bovis AF2122/97
gaauucaccacuccggcguug

SEQ ID NO: 1092864 - RNA, 14 nt, Mycobacterium bovis subsp bovis AF2122/97
gaauguuucggcga

SEQ ID NO: 1092865 - RNA, 16 nt, Mycobacterium bovis subsp bovis AF2122/97
gacagccccgcggcca

SEQ ID NO: 1092866 - RNA, 17 nt, Mycobacterium bovis subsp bovis AF2122/97
gacagccccgcggccag

SEQ ID NO: 1092867 - RNA, 19 nt, Mycobacterium bovis subsp bovis AF2122/97
gacagccccaucaccaccg

SEQ ID NO: 1092868 - RNA, 23 nt, Mycobacterium bovis subsp bovis AF2122/97
gacagccccaucaccaccggcac

SEQ ID NO: 1092869 - RNA, 16 nt, Mycobacterium bovis subsp bovis AF2122/97
gacagcccgaacgagg

SEQ ID NO: 1092870 - RNA, 14 nt, Mycobacterium bovis subsp bovis AF2122/97
gacagcccgccggc

SEQ ID NO: 1092871 - RNA, 16 nt, Mycobacterium bovis subsp bovis AF2122/97
gaauucggccggcgcg

SEQ ID NO: 1092872 - RNA, 19 nt, Mycobacterium bovis subsp bovis AF2122/97
gacagcaucacgcccacga

SEQ ID NO: 1092873 - RNA, 21 nt, Mycobacterium bovis subsp bovis AF2122/97
gacagcaucacgcccacgaua

SEQ ID NO: 1092874 - RNA, 18 nt, Mycobacterium bovis subsp bovis AF2122/97
gaauucccaugcugcgca

SEQ ID NO: 1092875 - RNA, 17 nt, Mycobacterium bovis subsp bovis AF2122/97
gaauuccccagccgcau

SEQ ID NO: 1092876 - RNA, 16 nt, Mycobacterium bovis subsp bovis AF2122/97
gaauuccgcuaccgca

SEQ ID NO: 1092877 - RNA, 18 nt, Mycobacterium bovis subsp bovis AF2122/97
gacagccugcgccacaau

SEQ ID NO: 1092878 - RNA, 13 nt, Mycobacterium bovis subsp bovis AF2122/97
gacagcgcaucca

SEQ ID NO: 1092879 - RNA, 22 nt, Mycobacterium bovis subsp bovis AF2122/97
gacagcgccaugcccucggcgc

SEQ ID NO: 1092880 - RNA, 14 nt, Mycobacterium bovis subsp bovis AF2122/97
gacagcgcggcggu

SEQ ID NO: 1092881 - RNA, 17 nt, Mycobacterium bovis subsp bovis AF2122/97
gacagggccgcucgccu

SEQ ID NO: 1092882 - RNA, 21 nt, Mycobacterium bovis subsp bovis AF2122/97
gacaggcuugacugcacacca

SEQ ID NO: 1092883 - RNA, 22 nt, Mycobacterium bovis subsp bovis AF2122/97
gacaggcuugacugcacaccac

SEQ ID NO: 1092884 - RNA, 23 nt, Mycobacterium bovis subsp bovis AF2122/97
gacaggcuugacugcacaccacc

SEQ ID NO: 1092885 - RNA, 15 nt, Mycobacterium bovis subsp bovis AF2122/97
gacagggcggcaacg

SEQ ID NO: 1092886 - RNA, 17 nt, Mycobacterium bovis subsp bovis AF2122/97
gacagggcggcaacggc

SEQ ID NO: 1092887 - RNA, 17 nt, Mycobacterium bovis subsp bovis AF2122/97
aacgaaccgcucagcgc

SEQ ID NO: 1092888 - RNA, 12 nt, Mycobacterium bovis subsp bovis AF2122/97
gacaggccaccg

SEQ ID NO: 1092889 - RNA, 18 nt, Mycobacterium bovis subsp bovis AF2122/97
cucuucgggugcagccag

SEQ ID NO: 1092890 - RNA, 14 nt, Mycobacterium bovis subsp bovis AF2122/97
cucuucggagccga

SEQ ID NO: 1092891 - RNA, 13 nt, Mycobacterium bovis subsp bovis AF2122/97
cucuucggcacca

SEQ ID NO: 1092892 - RNA, 21 nt, Mycobacterium bovis subsp bovis AF2122/97
cucucguguaucgagcggcac

SEQ ID NO: 1092893 - RNA, 13 nt, Mycobacterium bovis subsp bovis AF2122/97
cucugagcgggcg

SEQ ID NO: 1092894 - RNA, 17 nt, Mycobacterium bovis subsp bovis AF2122/97
cucugaccagccggucu

SEQ ID NO: 1092895 - RNA, 20 nt, Mycobacterium bovis subsp bovis AF2122/97
cucucugcgccaggcggcaa

SEQ ID NO: 1092896 - RNA, 14 nt, Mycobacterium bovis subsp bovis AF2122/97
cucucggcgucgag

SEQ ID NO: 1092897 - RNA, 18 nt, Mycobacterium bovis subsp bovis AF2122/97
cucucgggggccgagccg

SEQ ID NO: 1092898 - RNA, 21 nt, Mycobacterium bovis subsp bovis AF2122/97
cucucggugaacgccgccccg

SEQ ID NO: 1092899 - RNA, 19 nt, Mycobacterium bovis subsp bovis AF2122/97
cucuccuggaaaggacggc

SEQ ID NO: 1092900 - RNA, 19 nt, Mycobacterium bovis subsp bovis AF2122/97
cucguuccacugugcgagc

SEQ ID NO: 1092901 - RNA, 15 nt, Mycobacterium bovis subsp bovis AF2122/97
cucguucgugcagcc

SEQ ID NO: 1092902 - RNA, 18 nt, Mycobacterium bovis subsp bovis AF2122/97
cucguuaucgaccgccgc

SEQ ID NO: 1092903 - RNA, 23 nt, Mycobacterium bovis subsp bovis AF2122/97
cucguugaccgggucgccgauga

SEQ ID NO: 1092904 - RNA, 16 nt, Mycobacterium bovis subsp bovis AF2122/97
cucguugagcagcugg

SEQ ID NO: 1092905 - RNA, 17 nt, Mycobacterium bovis subsp bovis AF2122/97
cucguugaugcggcuau

SEQ ID NO: 1092906 - RNA, 23 nt, Mycobacterium bovis subsp bovis AF2122/97
cucgucggcgaagguguccucca

SEQ ID NO: 1092907 - RNA, 16 nt, Mycobacterium bovis subsp bovis AF2122/97
cucgucggccaccgcg

SEQ ID NO: 1092908 - RNA, 19 nt, Mycobacterium bovis subsp bovis AF2122/97
cucgucggccaccgcggcg

SEQ ID NO: 1092909 - RNA, 13 nt, Mycobacterium bovis subsp bovis AF2122/97
cucgucggccacc

SEQ ID NO: 1092910 - RNA, 13 nt, Mycobacterium bovis subsp bovis AF2122/97
cucgucgcgucgc

SEQ ID NO: 1092911 - RNA, 19 nt, Mycobacterium bovis subsp bovis AF2122/97
cucgucgcaucaccagggu

SEQ ID NO: 1092912 - RNA, 12 nt, Mycobacterium bovis subsp bovis AF2122/97
cucgucgcggcc

SEQ ID NO: 1092913 - RNA, 16 nt, Mycobacterium bovis subsp bovis AF2122/97
cucgucgccgcgguag

SEQ ID NO: 1092914 - RNA, 20 nt, Mycobacterium bovis subsp bovis AF2122/97
cucgucgccuagccgcuccg

SEQ ID NO: 1092915 - RNA, 19 nt, Mycobacterium bovis subsp bovis AF2122/97
cucgucggcgccggcggcc

SEQ ID NO: 1092916 - RNA, 16 nt, Mycobacterium bovis subsp bovis AF2122/97
cucgucggccgacacc

SEQ ID NO: 1092917 - RNA, 20 nt, Mycobacterium bovis subsp bovis AF2122/97
cucgucggccgacaccgcca

SEQ ID NO: 1092918 - RNA, 17 nt, Mycobacterium bovis subsp bovis AF2122/97
cucgucgggguugaugu

SEQ ID NO: 1092919 - RNA, 22 nt, Mycobacterium bovis subsp bovis AF2122/97
cucgucggugucgguucggucg

SEQ ID NO: 1092920 - RNA, 18 nt, Mycobacterium bovis subsp bovis AF2122/97
cucgucggcuuuggacag

SEQ ID NO: 1092921 - RNA, 16 nt, Mycobacterium bovis subsp bovis AF2122/97
cucguguaccggagcg

SEQ ID NO: 1092922 - RNA, 13 nt, Mycobacterium bovis subsp bovis AF2122/97
cucguuacgccga

SEQ ID NO: 1092923 - RNA, 14 nt, Mycobacterium bovis subsp bovis AF2122/97
cucgugggcgacga

SEQ ID NO: 1092924 - RNA, 20 nt, Mycobacterium bovis subsp bovis AF2122/97
cucguggaacuccguccgcc

SEQ ID NO: 1092925 - RNA, 13 nt, Mycobacterium bovis subsp bovis AF2122/97
cucguggcgacgg

SEQ ID NO: 1092926 - RNA, 19 nt, Mycobacterium bovis subsp bovis AF2122/97
cucgugcgugggcgcggcg

SEQ ID NO: 1092927 - RNA, 14 nt, Mycobacterium bovis subsp bovis AF2122/97
cucgugcucggcca

SEQ ID NO: 1092928 - RNA, 16 nt, Mycobacterium bovis subsp bovis AF2122/97
cucgugcucggccaga

SEQ ID NO: 1092929 - RNA, 14 nt, Mycobacterium bovis subsp bovis AF2122/97
cucgugauagcgcg

SEQ ID NO: 1092930 - RNA, 21 nt, Mycobacterium bovis subsp bovis AF2122/97
cucgucuugggccgggaugaa

SEQ ID NO: 1092931 - RNA, 16 nt, Mycobacterium bovis subsp bovis AF2122/97
cucgugcaggaccagc

SEQ ID NO: 1092932 - RNA, 17 nt, Mycobacterium bovis subsp bovis AF2122/97
cucgugcaccgucggga

SEQ ID NO: 1092933 - RNA, 13 nt, Mycobacterium bovis subsp bovis AF2122/97
cucgugcacgcac

SEQ ID NO: 1092934 - RNA, 14 nt, Mycobacterium bovis subsp bovis AF2122/97
cucgucgucgaggu

SEQ ID NO: 1092935 - RNA, 16 nt, Mycobacterium bovis subsp bovis AF2122/97
cucguaacgcggcacc

SEQ ID NO: 1092936 - RNA, 14 nt, Mycobacterium bovis subsp bovis AF2122/97
cucgguguccucga

SEQ ID NO: 1092937 - RNA, 18 nt, Mycobacterium bovis subsp bovis AF2122/97
cucgguguccucgaccgu

SEQ ID NO: 1092938 - RNA, 23 nt, Mycobacterium bovis subsp bovis AF2122/97
cucggugcgccagaucaccgucg

SEQ ID NO: 1092939 - RNA, 20 nt, Mycobacterium bovis subsp bovis AF2122/97
cucggugugcucgccgacca

SEQ ID NO: 1092940 - RNA, 22 nt, Mycobacterium bovis subsp bovis AF2122/97
cucgguucggagucacgcagcc

SEQ ID NO: 1092941 - RNA, 17 nt, Mycobacterium bovis subsp bovis AF2122/97
cucguauacccgggcgg

SEQ ID NO: 1092942 - RNA, 19 nt, Mycobacterium bovis subsp bovis AF2122/97
cucguagccgccgucgccg

SEQ ID NO: 1092943 - RNA, 14 nt, Mycobacterium bovis subsp bovis AF2122/97
cucguacggaccgu

SEQ ID NO: 1092944 - RNA, 19 nt, Mycobacterium bovis subsp bovis AF2122/97
cucguacggaccgucgccg

SEQ ID NO: 1092945 - RNA, 23 nt, Mycobacterium bovis subsp bovis AF2122/97
cucguacggaccgucgccgguga

SEQ ID NO: 1092946 - RNA, 20 nt, Mycobacterium bovis subsp bovis AF2122/97
cucgucaccaaacccgaugg

SEQ ID NO: 1092947 - RNA, 18 nt, Mycobacterium bovis subsp bovis AF2122/97
cucgucaccgcgaccagc

SEQ ID NO: 1092948 - RNA, 17 nt, Mycobacterium bovis subsp bovis AF2122/97
cucguccaagccggcca

SEQ ID NO: 1092949 - RNA, 19 nt, Mycobacterium bovis subsp bovis AF2122/97
cucgucgaugucguuggcc

SEQ ID NO: 1092950 - RNA, 14 nt, Mycobacterium bovis subsp bovis AF2122/97
cucgucgaucgccg

SEQ ID NO: 1092951 - RNA, 20 nt, Mycobacterium bovis subsp bovis AF2122/97
cucgucgaucgccgcgaugg

SEQ ID NO: 1092952 - RNA, 12 nt, Mycobacterium bovis subsp bovis AF2122/97
cucgucgaugcc

SEQ ID NO: 1092953 - RNA, 21 nt, Mycobacterium bovis subsp bovis AF2122/97
cucgucgaggaagaucaccuc

SEQ ID NO: 1092954 - RNA, 21 nt, Mycobacterium bovis subsp bovis AF2122/97
cucgucgaggcugaccguggc

SEQ ID NO: 1092955 - RNA, 13 nt, Mycobacterium bovis subsp bovis AF2122/97
cucgucgaggucc

SEQ ID NO: 1092956 - RNA, 18 nt, Mycobacterium bovis subsp bovis AF2122/97
cucgucgagccgaccgcg

SEQ ID NO: 1092957 - RNA, 16 nt, Mycobacterium bovis subsp bovis AF2122/97
cucgucgagccgaccg

SEQ ID NO: 1092958 - RNA, 18 nt, Mycobacterium bovis subsp bovis AF2122/97
cucguccaggucggccgc

SEQ ID NO: 1092959 - RNA, 21 nt, Mycobacterium bovis subsp bovis AF2122/97
cucguccaggucggccgccuc

SEQ ID NO: 1092960 - RNA, 22 nt, Mycobacterium bovis subsp bovis AF2122/97
cucggugagcagcucggugaca

SEQ ID NO: 1092961 - RNA, 16 nt, Mycobacterium bovis subsp bovis AF2122/97
cucggugacaagcggc

SEQ ID NO: 1092962 - RNA, 19 nt, Mycobacterium bovis subsp bovis AF2122/97
cucggugaacgccgccccg

SEQ ID NO: 1092963 - RNA, 15 nt, Mycobacterium bovis subsp bovis AF2122/97
cucggucgccuccuc

SEQ ID NO: 1092964 - RNA, 18 nt, Mycobacterium bovis subsp bovis AF2122/97
cucggugaucgcgguggc

SEQ ID NO: 1092965 - RNA, 14 nt, Mycobacterium bovis subsp bovis AF2122/97
cucggugaccaggc

SEQ ID NO: 1092966 - RNA, 17 nt, Mycobacterium bovis subsp bovis AF2122/97
cucggugccgcccagga

SEQ ID NO: 1092967 - RNA, 18 nt, Mycobacterium bovis subsp bovis AF2122/97
cucggugaugcccagcgc

SEQ ID NO: 1092968 - RNA, 21 nt, Mycobacterium bovis subsp bovis AF2122/97
cucggugcggaacaccgcccg

SEQ ID NO: 1092969 - RNA, 22 nt, Mycobacterium bovis subsp bovis AF2122/97
cucggugcggaacaccgcccgg

SEQ ID NO: 1092970 - RNA, 16 nt, Mycobacterium bovis subsp bovis AF2122/97
cucggugccggccgca

SEQ ID NO: 1092971 - RNA, 17 nt, Mycobacterium bovis subsp bovis AF2122/97
cucggugcugcgccgau

SEQ ID NO: 1092972 - RNA, 14 nt, Mycobacterium bovis subsp bovis AF2122/97
cucggugcuggcga

SEQ ID NO: 1092973 - RNA, 22 nt, Mycobacterium bovis subsp bovis AF2122/97
cucgguggucuuggcccggcgg

SEQ ID NO: 1092974 - RNA, 15 nt, Mycobacterium bovis subsp bovis AF2122/97
cucgguggcugcgcc

SEQ ID NO: 1092975 - RNA, 16 nt, Mycobacterium bovis subsp bovis AF2122/97
cucgguggcgccgggg

SEQ ID NO: 1092976 - RNA, 14 nt, Mycobacterium bovis subsp bovis AF2122/97
cucgguggcggacg

SEQ ID NO: 1092977 - RNA, 13 nt, Mycobacterium bovis subsp bovis AF2122/97
cucggucgccacc

SEQ ID NO: 1092978 - RNA, 16 nt, Mycobacterium bovis subsp bovis AF2122/97
cucggucgccaccgcc

SEQ ID NO: 1092979 - RNA, 17 nt, Mycobacterium bovis subsp bovis AF2122/97
cucggucgccaccgccg

SEQ ID NO: 1092980 - RNA, 23 nt, Mycobacterium bovis subsp bovis AF2122/97
cucggucgccaccgccggcagca

SEQ ID NO: 1092981 - RNA, 20 nt, Mycobacterium bovis subsp bovis AF2122/97
cucggucaggcggcuggccc

SEQ ID NO: 1092982 - RNA, 18 nt, Mycobacterium bovis subsp bovis AF2122/97
cucggucccguugccgcc

SEQ ID NO: 1092983 - RNA, 24 nt, Mycobacterium bovis subsp bovis AF2122/97
cucggucgaguagccguagccgcc

SEQ ID NO: 1092984 - RNA, 15 nt, Mycobacterium bovis subsp bovis AF2122/97
cucggucagcucguc

SEQ ID NO: 1092985 - RNA, 16 nt, Mycobacterium bovis subsp bovis AF2122/97
cucggucagcucgucg

SEQ ID NO: 1092986 - RNA, 20 nt, Mycobacterium bovis subsp bovis AF2122/97
cucggucagaugcgcgggga

SEQ ID NO: 1092987 - RNA, 18 nt, Mycobacterium bovis subsp bovis AF2122/97
cucgguauauccggguga

SEQ ID NO: 1092988 - RNA, 15 nt, Mycobacterium bovis subsp bovis AF2122/97
cucggucaccacggc

SEQ ID NO: 1092989 - RNA, 19 nt, Mycobacterium bovis subsp bovis AF2122/97
cucggucaacgcuucggca

SEQ ID NO: 1092990 - RNA, 21 nt, Mycobacterium bovis subsp bovis AF2122/97
cucggucaacgcuucggcacg

SEQ ID NO: 1092991 - RNA, 14 nt, Mycobacterium bovis subsp bovis AF2122/97
cucgguaggcggug

SEQ ID NO: 1092992 - RNA, 16 nt, Mycobacterium bovis subsp bovis AF2122/97
cucgguaggcgguguc

SEQ ID NO: 1092993 - RNA, 18 nt, Mycobacterium bovis subsp bovis AF2122/97
cucgguagcauccagcgc

SEQ ID NO: 1092994 - RNA, 15 nt, Mycobacterium bovis subsp bovis AF2122/97
cucgguaggccggca

SEQ ID NO: 1092995 - RNA, 15 nt, Mycobacterium bovis subsp bovis AF2122/97
cucgguaccaccggc

SEQ ID NO: 1092996 - RNA, 16 nt, Mycobacterium bovis subsp bovis AF2122/97
cucgguaccaccggca

SEQ ID NO: 1092997 - RNA, 22 nt, Mycobacterium bovis subsp bovis AF2122/97
cucgguaccaccggcacgguga

SEQ ID NO: 1092998 - RNA, 21 nt, Mycobacterium bovis subsp bovis AF2122/97
cucggcgaugacaucaccgac

SEQ ID NO: 1092999 - RNA, 13 nt, Mycobacterium bovis subsp bovis AF2122/97
cucggcgaguucg

SEQ ID NO: 1093000 - RNA, 17 nt, Mycobacterium bovis subsp bovis AF2122/97
cucggcgaguucggcag

SEQ ID NO: 1093001 - RNA, 22 nt, Mycobacterium bovis subsp bovis AF2122/97
cucggcgacgaugucgagcgcg

SEQ ID NO: 1093002 - RNA, 16 nt, Mycobacterium bovis subsp bovis AF2122/97
cucggcgagcaacacg

SEQ ID NO: 1093003 - RNA, 22 nt, Mycobacterium bovis subsp bovis AF2122/97
cucggcgagcaacacgagcgca

SEQ ID NO: 1093004 - RNA, 20 nt, Mycobacterium bovis subsp bovis AF2122/97
cucggcgagcacgucacgcg

SEQ ID NO: 1093005 - RNA, 17 nt, Mycobacterium bovis subsp bovis AF2122/97
cucggcgaccgacgccg

SEQ ID NO: 1093006 - RNA, 19 nt, Mycobacterium bovis subsp bovis AF2122/97
cucggcgaccgacgccggu

SEQ ID NO: 1093007 - RNA, 13 nt, Mycobacterium bovis subsp bovis AF2122/97
cucggcgagcuca

SEQ ID NO: 1093008 - RNA, 13 nt, Mycobacterium bovis subsp bovis AF2122/97
cucggcgccgccc

SEQ ID NO: 1093009 - RNA, 15 nt, Mycobacterium bovis subsp bovis AF2122/97
cucggcgccgcccag

SEQ ID NO: 1093010 - RNA, 20 nt, Mycobacterium bovis subsp bovis AF2122/97
cucggcgaugggccgguccg

SEQ ID NO: 1093011 - RNA, 19 nt, Mycobacterium bovis subsp bovis AF2122/97
cucggcgcccuccuuggcg

SEQ ID NO: 1093012 - RNA, 14 nt, Mycobacterium bovis subsp bovis AF2122/97
cucggcgccgaacu

SEQ ID NO: 1093013 - RNA, 13 nt, Mycobacterium bovis subsp bovis AF2122/97
cucggcgcagcac

SEQ ID NO: 1093014 - RNA, 17 nt, Mycobacterium bovis subsp bovis AF2122/97
cucggcgcagcacaucc

SEQ ID NO: 1093015 - RNA, 12 nt, Mycobacterium bovis subsp bovis AF2122/97
cucggcgcagcc

SEQ ID NO: 1093016 - RNA, 14 nt, Mycobacterium bovis subsp bovis AF2122/97
cucggcgcagccgg

SEQ ID NO: 1093017 - RNA, 17 nt, Mycobacterium bovis subsp bovis AF2122/97
cucggcgcagccgguga

SEQ ID NO: 1093018 - RNA, 21 nt, Mycobacterium bovis subsp bovis AF2122/97
cucggcgccacggugucgcga

SEQ ID NO: 1093019 - RNA, 18 nt, Mycobacterium bovis subsp bovis AF2122/97
cucggccagcacgccgcc

SEQ ID NO: 1093020 - RNA, 19 nt, Mycobacterium bovis subsp bovis AF2122/97
cucggccagcacgccgccg

SEQ ID NO: 1093021 - RNA, 18 nt, Mycobacterium bovis subsp bovis AF2122/97
cucggccagccagcgggc

SEQ ID NO: 1093022 - RNA, 16 nt, Mycobacterium bovis subsp bovis AF2122/97
cucggcgaccgcgucg

SEQ ID NO: 1093023 - RNA, 20 nt, Mycobacterium bovis subsp bovis AF2122/97
cucggcgaccugccggaccg

SEQ ID NO: 1093024 - RNA, 17 nt, Mycobacterium bovis subsp bovis AF2122/97
cucggcgaccuggcuca

SEQ ID NO: 1093025 - RNA, 13 nt, Mycobacterium bovis subsp bovis AF2122/97
cucggcgaccgac

SEQ ID NO: 1093026 - RNA, 14 nt, Mycobacterium bovis subsp bovis AF2122/97
cucggccaccagcg

SEQ ID NO: 1093027 - RNA, 16 nt, Mycobacterium bovis subsp bovis AF2122/97
cucggccaccagcgcc

SEQ ID NO: 1093028 - RNA, 13 nt, Mycobacterium bovis subsp bovis AF2122/97
cucggccacggcg

SEQ ID NO: 1093029 - RNA, 20 nt, Mycobacterium bovis subsp bovis AF2122/97
cucggccaacgacggccgac

SEQ ID NO: 1093030 - RNA, 16 nt, Mycobacterium bovis subsp bovis AF2122/97
cucggcauucaccgcg

SEQ ID NO: 1093031 - RNA, 13 nt, Mycobacterium bovis subsp bovis AF2122/97
cucgcuggccgca

SEQ ID NO: 1093032 - RNA, 17 nt, Mycobacterium bovis subsp bovis AF2122/97
cucgggacucccgcgcg

SEQ ID NO: 1093033 - RNA, 15 nt, Mycobacterium bovis subsp bovis AF2122/97
cucgggaggcagcgc

SEQ ID NO: 1093034 - RNA, 22 nt, Mycobacterium bovis subsp bovis AF2122/97
cucggcuucggagccgacaacg

SEQ ID NO: 1093035 - RNA, 18 nt, Mycobacterium bovis subsp bovis AF2122/97
cucgggcaacucggugac

SEQ ID NO: 1093036 - RNA, 20 nt, Mycobacterium bovis subsp bovis AF2122/97
cucgggaucggcggggucga

SEQ ID NO: 1093037 - RNA, 16 nt, Mycobacterium bovis subsp bovis AF2122/97
cucgggcaaggccacc

SEQ ID NO: 1093038 - RNA, 20 nt, Mycobacterium bovis subsp bovis AF2122/97
cucgggcaaugucgacaccg

SEQ ID NO: 1093039 - RNA, 23 nt, Mycobacterium bovis subsp bovis AF2122/97
cucgggcaaugucgacaccggcg

SEQ ID NO: 1093040 - RNA, 18 nt, Mycobacterium bovis subsp bovis AF2122/97
cucgggcaggcggccagc

SEQ ID NO: 1093041 - RNA, 19 nt, Mycobacterium bovis subsp bovis AF2122/97
cucgggcaggcggccagcg

SEQ ID NO: 1093042 - RNA, 16 nt, Mycobacterium bovis subsp bovis AF2122/97
cucgggcagcgcggcc

SEQ ID NO: 1093043 - RNA, 20 nt, Mycobacterium bovis subsp bovis AF2122/97
cucgggcagcuucaacaccg

SEQ ID NO: 1093044 - RNA, 22 nt, Mycobacterium bovis subsp bovis AF2122/97
cucgggcagcuucaacaccggc

SEQ ID NO: 1093045 - RNA, 21 nt, Mycobacterium bovis subsp bovis AF2122/97
cucgggcgcgggugaccaggc

SEQ ID NO: 1093046 - RNA, 22 nt, Mycobacterium bovis subsp bovis AF2122/97
cucgggcgcugaugcgcugggc

SEQ ID NO: 1093047 - RNA, 18 nt, Mycobacterium bovis subsp bovis AF2122/97
cucggggaacaccgcggu

SEQ ID NO: 1093048 - RNA, 14 nt, Mycobacterium bovis subsp bovis AF2122/97
cucgggcgugaucc

SEQ ID NO: 1093049 - RNA, 16 nt, Mycobacterium bovis subsp bovis AF2122/97
cucgggcgugaucccg

SEQ ID NO: 1093050 - RNA, 22 nt, Mycobacterium bovis subsp bovis AF2122/97
cucggcggcgcgugcgguggcg

SEQ ID NO: 1093051 - RNA, 14 nt, Mycobacterium bovis subsp bovis AF2122/97
cucggcggcggcac

SEQ ID NO: 1093052 - RNA, 15 nt, Mycobacterium bovis subsp bovis AF2122/97
cucggcggcggcacg

SEQ ID NO: 1093053 - RNA, 12 nt, Mycobacterium bovis subsp bovis AF2122/97
cucggcggcgcg

SEQ ID NO: 1093054 - RNA, 20 nt, Mycobacterium bovis subsp bovis AF2122/97
cucggcggccuuaggugacc

SEQ ID NO: 1093055 - RNA, 21 nt, Mycobacterium bovis subsp bovis AF2122/97
cucggcgcuagcugcugaugc

SEQ ID NO: 1093056 - RNA, 17 nt, Mycobacterium bovis subsp bovis AF2122/97
cucggcgcucaugggcg

SEQ ID NO: 1093057 - RNA, 22 nt, Mycobacterium bovis subsp bovis AF2122/97
cucggcgcucaugggcgccauc

SEQ ID NO: 1093058 - RNA, 22 nt, Mycobacterium bovis subsp bovis AF2122/97
cucggcgcgguggggcgcgccg

SEQ ID NO: 1093059 - RNA, 20 nt, Mycobacterium bovis subsp bovis AF2122/97
cucggcgcgccggucgccga

SEQ ID NO: 1093060 - RNA, 20 nt, Mycobacterium bovis subsp bovis AF2122/97
cucggcggcgcggucgaagc

SEQ ID NO: 1093061 - RNA, 13 nt, Mycobacterium bovis subsp bovis AF2122/97
cucggcggcguug

SEQ ID NO: 1093062 - RNA, 16 nt, Mycobacterium bovis subsp bovis AF2122/97
cucggcgggauccucg

SEQ ID NO: 1093063 - RNA, 21 nt, Mycobacterium bovis subsp bovis AF2122/97
cucggcgggauccucgaaggc

SEQ ID NO: 1093064 - RNA, 17 nt, Mycobacterium bovis subsp bovis AF2122/97
cucggcggggaccgcgg

SEQ ID NO: 1093065 - RNA, 15 nt, Mycobacterium bovis subsp bovis AF2122/97
cucggcgugucugcc

SEQ ID NO: 1093066 - RNA, 15 nt, Mycobacterium bovis subsp bovis AF2122/97
cucggcggugccgcg

SEQ ID NO: 1093067 - RNA, 19 nt, Mycobacterium bovis subsp bovis AF2122/97
cucggcguguccgccgaac

SEQ ID NO: 1093068 - RNA, 16 nt, Mycobacterium bovis subsp bovis AF2122/97
cucgcuaauugcggcc

SEQ ID NO: 1093069 - RNA, 17 nt, Mycobacterium bovis subsp bovis AF2122/97
cucgcguucgcuggucc

SEQ ID NO: 1093070 - RNA, 16 nt, Mycobacterium bovis subsp bovis AF2122/97
cucgcguggcaccgac

SEQ ID NO: 1093071 - RNA, 20 nt, Mycobacterium bovis subsp bovis AF2122/97
cucgcguggcaccgacagca

SEQ ID NO: 1093072 - RNA, 16 nt, Mycobacterium bovis subsp bovis AF2122/97
cucgcuauugggugca

SEQ ID NO: 1093073 - RNA, 14 nt, Mycobacterium bovis subsp bovis AF2122/97
cucgcucaccggcg

SEQ ID NO: 1093074 - RNA, 20 nt, Mycobacterium bovis subsp bovis AF2122/97
cucgcucaccggcuggugcc

SEQ ID NO: 1093075 - RNA, 15 nt, Mycobacterium bovis subsp bovis AF2122/97
cucgcucacgccguc

SEQ ID NO: 1093076 - RNA, 20 nt, Mycobacterium bovis subsp bovis AF2122/97
cucgcugcagcagggcuucg

SEQ ID NO: 1093077 - RNA, 14 nt, Mycobacterium bovis subsp bovis AF2122/97
cucgcuccgaccgg

SEQ ID NO: 1093078 - RNA, 12 nt, Mycobacterium bovis subsp bovis AF2122/97
cucgcucgacgu

SEQ ID NO: 1093079 - RNA, 21 nt, Mycobacterium bovis subsp bovis AF2122/97
cucgcugaucagcaugcggcc

SEQ ID NO: 1093080 - RNA, 20 nt, Mycobacterium bovis subsp bovis AF2122/97
cucgcugaucaggucuucga

SEQ ID NO: 1093081 - RNA, 19 nt, Mycobacterium bovis subsp bovis AF2122/97
cucgcucugcgcggcuucg

SEQ ID NO: 1093082 - RNA, 19 nt, Mycobacterium bovis subsp bovis AF2122/97
cucgcgcucgcucacgccg

SEQ ID NO: 1093083 - RNA, 16 nt, Mycobacterium bovis subsp bovis AF2122/97
cucgcggaccucggcg

SEQ ID NO: 1093084 - RNA, 20 nt, Mycobacterium bovis subsp bovis AF2122/97
cucgcggaccucggcgaccu

SEQ ID NO: 1093085 - RNA, 14 nt, Mycobacterium bovis subsp bovis AF2122/97
cucgcgcucgccgg

SEQ ID NO: 1093086 - RNA, 19 nt, Mycobacterium bovis subsp bovis AF2122/97
cucgcgcuugcgccgccca

SEQ ID NO: 1093087 - RNA, 17 nt, Mycobacterium bovis subsp bovis AF2122/97
cucgcggucgacagcgc

SEQ ID NO: 1093088 - RNA, 16 nt, Mycobacterium bovis subsp bovis AF2122/97
cucgcggccggcgucg

SEQ ID NO: 1093089 - RNA, 16 nt, Mycobacterium bovis subsp bovis AF2122/97
cucgcggaugagcucg

SEQ ID NO: 1093090 - RNA, 15 nt, Mycobacterium bovis subsp bovis AF2122/97
cucgcggugcggcaa

SEQ ID NO: 1093091 - RNA, 12 nt, Mycobacterium bovis subsp bovis AF2122/97
cucgcgguggcc

SEQ ID NO: 1093092 - RNA, 19 nt, Mycobacterium bovis subsp bovis AF2122/97
cucgcguagggccagcgcc

SEQ ID NO: 1093093 - RNA, 19 nt, Mycobacterium bovis subsp bovis AF2122/97
cucgcgaggugacucggca

SEQ ID NO: 1093094 - RNA, 22 nt, Mycobacterium bovis subsp bovis AF2122/97
cucgcgaagccgguucgcccag

SEQ ID NO: 1093095 - RNA, 15 nt, Mycobacterium bovis subsp bovis AF2122/97
cucgcgaaaccgccg

SEQ ID NO: 1093096 - RNA, 16 nt, Mycobacterium bovis subsp bovis AF2122/97
cucgcgaagaucagcg

SEQ ID NO: 1093097 - RNA, 18 nt, Mycobacterium bovis subsp bovis AF2122/97
cucgcgcacccugcgugc

SEQ ID NO: 1093098 - RNA, 16 nt, Mycobacterium bovis subsp bovis AF2122/97
cucgcgcacauaggcg

SEQ ID NO: 1093099 - RNA, 16 nt, Mycobacterium bovis subsp bovis AF2122/97
cucgcgcaagcggacc

SEQ ID NO: 1093100 - RNA, 23 nt, Mycobacterium bovis subsp bovis AF2122/97
cucgcgcaagcggacccgaccgu

SEQ ID NO: 1093101 - RNA, 15 nt, Mycobacterium bovis subsp bovis AF2122/97
cucgcgacgaguugc

SEQ ID NO: 1093102 - RNA, 23 nt, Mycobacterium bovis subsp bovis AF2122/97
cucgcgaucgcagugagcagccg

SEQ ID NO: 1093103 - RNA, 14 nt, Mycobacterium bovis subsp bovis AF2122/97
cucgcgcgcggcga

SEQ ID NO: 1093104 - RNA, 17 nt, Mycobacterium bovis subsp bovis AF2122/97
cucgcgcgcggcgacga

SEQ ID NO: 1093105 - RNA, 19 nt, Mycobacterium bovis subsp bovis AF2122/97
cucgccacggucgccgacc

SEQ ID NO: 1093106 - RNA, 21 nt, Mycobacterium bovis subsp bovis AF2122/97
cucgccacggucgccgaccac

SEQ ID NO: 1093107 - RNA, 22 nt, Mycobacterium bovis subsp bovis AF2122/97
cucgccacucagcccgacaccg

SEQ ID NO: 1093108 - RNA, 16 nt, Mycobacterium bovis subsp bovis AF2122/97
cucgccaccgcggcga

SEQ ID NO: 1093109 - RNA, 14 nt, Mycobacterium bovis subsp bovis AF2122/97
cucgcccagcgagc

SEQ ID NO: 1093110 - RNA, 21 nt, Mycobacterium bovis subsp bovis AF2122/97
cucgcccaccuccugguugac

SEQ ID NO: 1093111 - RNA, 21 nt, Mycobacterium bovis subsp bovis AF2122/97
cucgauuaucgcgcgcaaccg

SEQ ID NO: 1093112 - RNA, 19 nt, Mycobacterium bovis subsp bovis AF2122/97
cucgauucccggcgcggug

SEQ ID NO: 1093113 - RNA, 22 nt, Mycobacterium bovis subsp bovis AF2122/97
cucgauucccggcgcgguggcc

SEQ ID NO: 1093114 - RNA, 17 nt, Mycobacterium bovis subsp bovis AF2122/97
cucgauuguggccagcg

SEQ ID NO: 1093115 - RNA, 22 nt, Mycobacterium bovis subsp bovis AF2122/97
cucgccaaccagucgcacgacg

SEQ ID NO: 1093116 - RNA, 18 nt, Mycobacterium bovis subsp bovis AF2122/97
cucgccacauuucaccac

SEQ ID NO: 1093117 - RNA, 16 nt, Mycobacterium bovis subsp bovis AF2122/97
cucgcaaucguuggcc

SEQ ID NO: 1093118 - RNA, 15 nt, Mycobacterium bovis subsp bovis AF2122/97
cucgcaaacaagauc

SEQ ID NO: 1093119 - RNA, 15 nt, Mycobacterium bovis subsp bovis AF2122/97
cucgauguacagcgg

SEQ ID NO: 1093120 - RNA, 16 nt, Mycobacterium bovis subsp bovis AF2122/97
cuccucgcgcucgccg

SEQ ID NO: 1093121 - RNA, 17 nt, Mycobacterium bovis subsp bovis AF2122/97
cuccgugagccggaccg

SEQ ID NO: 1093122 - RNA, 16 nt, Mycobacterium bovis subsp bovis AF2122/97
cuccucggcaggccga

SEQ ID NO: 1093123 - RNA, 13 nt, Mycobacterium bovis subsp bovis AF2122/97
cuccugaguugcg

SEQ ID NO: 1093124 - RNA, 17 nt, Mycobacterium bovis subsp bovis AF2122/97
cuccucgugcaggacca

SEQ ID NO: 1093125 - RNA, 14 nt, Mycobacterium bovis subsp bovis AF2122/97
cuccucgucgacgu

SEQ ID NO: 1093126 - RNA, 17 nt, Mycobacterium bovis subsp bovis AF2122/97
cuccucgucgacgucgg

SEQ ID NO: 1093127 - RNA, 18 nt, Mycobacterium bovis subsp bovis AF2122/97
cuccgugggcagcgcgcc

SEQ ID NO: 1093128 - RNA, 21 nt, Mycobacterium bovis subsp bovis AF2122/97
cuccguggugcuagcgccgcc

SEQ ID NO: 1093129 - RNA, 20 nt, Mycobacterium bovis subsp bovis AF2122/97
cuccguaaacgaggucgccg

SEQ ID NO: 1093130 - RNA, 13 nt, Mycobacterium bovis subsp bovis AF2122/97
cuccgucgcggcc

SEQ ID NO: 1093131 - RNA, 14 nt, Mycobacterium bovis subsp bovis AF2122/97
cuccgucgcggccg

SEQ ID NO: 1093132 - RNA, 18 nt, Mycobacterium bovis subsp bovis AF2122/97
cuccguccccgcagcgcc

SEQ ID NO: 1093133 - RNA, 14 nt, Mycobacterium bovis subsp bovis AF2122/97
cuccgucggccagg

SEQ ID NO: 1093134 - RNA, 20 nt, Mycobacterium bovis subsp bovis AF2122/97
cucgaaauccugguggcaga

SEQ ID NO: 1093135 - RNA, 18 nt, Mycobacterium bovis subsp bovis AF2122/97
cuccuugggcgacgcggc

SEQ ID NO: 1093136 - RNA, 19 nt, Mycobacterium bovis subsp bovis AF2122/97
cuccuugggcgacgcggcg

SEQ ID NO: 1093137 - RNA, 22 nt, Mycobacterium bovis subsp bovis AF2122/97
cuccuuggcuaacaccgcaggc

SEQ ID NO: 1093138 - RNA, 17 nt, Mycobacterium bovis subsp bovis AF2122/97
cucgaacagcucgauca

SEQ ID NO: 1093139 - RNA, 17 nt, Mycobacterium bovis subsp bovis AF2122/97
cucgaaagcgucgauca

SEQ ID NO: 1093140 - RNA, 21 nt, Mycobacterium bovis subsp bovis AF2122/97
cucgaacagguuggccccggc

SEQ ID NO: 1093141 - RNA, 21 nt, Mycobacterium bovis subsp bovis AF2122/97
cucgaacaucggaacgugacc

SEQ ID NO: 1093142 - RNA, 21 nt, Mycobacterium bovis subsp bovis AF2122/97
cucgacacccagccgcagccc

SEQ ID NO: 1093143 - RNA, 18 nt, Mycobacterium bovis subsp bovis AF2122/97
cucgaaccgacgcguccg

SEQ ID NO: 1093144 - RNA, 13 nt, Mycobacterium bovis subsp bovis AF2122/97
cucgacagcggca

SEQ ID NO: 1093145 - RNA, 15 nt, Mycobacterium bovis subsp bovis AF2122/97
cuccggugaucaccg

SEQ ID NO: 1093146 - RNA, 17 nt, Mycobacterium bovis subsp bovis AF2122/97
cuccggugaucaccgac

SEQ ID NO: 1093147 - RNA, 21 nt, Mycobacterium bovis subsp bovis AF2122/97
cuccggcguugacgaucaguc

SEQ ID NO: 1093148 - RNA, 18 nt, Mycobacterium bovis subsp bovis AF2122/97
cuccggcucgacaacauc

SEQ ID NO: 1093149 - RNA, 19 nt, Mycobacterium bovis subsp bovis AF2122/97
cuccggcucgacaacaucg

SEQ ID NO: 1093150 - RNA, 17 nt, Mycobacterium bovis subsp bovis AF2122/97
cuccggcggugccgucg

SEQ ID NO: 1093151 - RNA, 22 nt, Mycobacterium bovis subsp bovis AF2122/97
cuccggcggugccgucgccgcc

SEQ ID NO: 1093152 - RNA, 14 nt, Mycobacterium bovis subsp bovis AF2122/97
cuccggcaggcccg

SEQ ID NO: 1093153 - RNA, 17 nt, Mycobacterium bovis subsp bovis AF2122/97
cuccggcgucggcggcc

SEQ ID NO: 1093154 - RNA, 23 nt, Mycobacterium bovis subsp bovis AF2122/97
cuccggugcauauuggaucgucg

SEQ ID NO: 1093155 - RNA, 16 nt, Mycobacterium bovis subsp bovis AF2122/97
cuccggugccggcaac

SEQ ID NO: 1093156 - RNA, 15 nt, Mycobacterium bovis subsp bovis AF2122/97
cuccgguggccaaca

SEQ ID NO: 1093157 - RNA, 20 nt, Mycobacterium bovis subsp bovis AF2122/97
cuccgguggccaacaccgcc

SEQ ID NO: 1093158 - RNA, 17 nt, Mycobacterium bovis subsp bovis AF2122/97
cuccggugugaucggcg

SEQ ID NO: 1093159 - RNA, 22 nt, Mycobacterium bovis subsp bovis AF2122/97
cuccgguguguuuggcaugguc

SEQ ID NO: 1093160 - RNA, 18 nt, Mycobacterium bovis subsp bovis AF2122/97
cuccggccgcguuggggu

SEQ ID NO: 1093161 - RNA, 13 nt, Mycobacterium bovis subsp bovis AF2122/97
cuccggccggcca

SEQ ID NO: 1093162 - RNA, 17 nt, Mycobacterium bovis subsp bovis AF2122/97
cuccgcguccgccaaug

SEQ ID NO: 1093163 - RNA, 18 nt, Mycobacterium bovis subsp bovis AF2122/97
cuccggcccugccgccgg

SEQ ID NO: 1093164 - RNA, 20 nt, Mycobacterium bovis subsp bovis AF2122/97
cuccggccgcacgccgacca

SEQ ID NO: 1093165 - RNA, 22 nt, Mycobacterium bovis subsp bovis AF2122/97
cuccggcgacgaucucgccgcc

SEQ ID NO: 1093166 - RNA, 14 nt, Mycobacterium bovis subsp bovis AF2122/97
cuccggcgccaccg

SEQ ID NO: 1093167 - RNA, 15 nt, Mycobacterium bovis subsp bovis AF2122/97
cuccggcgccaccgc

SEQ ID NO: 1093168 - RNA, 15 nt, Mycobacterium bovis subsp bovis AF2122/97
cuccggcgcgacgcc

SEQ ID NO: 1093169 - RNA, 22 nt, Mycobacterium bovis subsp bovis AF2122/97
cuccggcggcagcggcgccgcc

SEQ ID NO: 1093170 - RNA, 22 nt, Mycobacterium bovis subsp bovis AF2122/97
cuccggcggcgaagaagccggc

SEQ ID NO: 1093171 - RNA, 21 nt, Mycobacterium bovis subsp bovis AF2122/97
cuccgccggucccgcgugcca

SEQ ID NO: 1093172 - RNA, 15 nt, Mycobacterium bovis subsp bovis AF2122/97
cuccgccgucgccgc

SEQ ID NO: 1093173 - RNA, 14 nt, Mycobacterium bovis subsp bovis AF2122/97
cuccgccguugacg

SEQ ID NO: 1093174 - RNA, 14 nt, Mycobacterium bovis subsp bovis AF2122/97
cuccgccguugccg

SEQ ID NO: 1093175 - RNA, 17 nt, Mycobacterium bovis subsp bovis AF2122/97
cuccgccguugccgccg

SEQ ID NO: 1093176 - RNA, 23 nt, Mycobacterium bovis subsp bovis AF2122/97
cuccgccugccgcuggucgucga

SEQ ID NO: 1093177 - RNA, 16 nt, Mycobacterium bovis subsp bovis AF2122/97
cuccgcccgcgggccc

SEQ ID NO: 1093178 - RNA, 22 nt, Mycobacterium bovis subsp bovis AF2122/97
cuccgcccggcgugucgccgcc

SEQ ID NO: 1093179 - RNA, 23 nt, Mycobacterium bovis subsp bovis AF2122/97
cuccgcccucaguucacguucgg

SEQ ID NO: 1093180 - RNA, 13 nt, Mycobacterium bovis subsp bovis AF2122/97
cuccgccgcccag

SEQ ID NO: 1093181 - RNA, 13 nt, Mycobacterium bovis subsp bovis AF2122/97
cuccgccgccgac

SEQ ID NO: 1093182 - RNA, 22 nt, Mycobacterium bovis subsp bovis AF2122/97
cuccgccgcgggcuccccggca

SEQ ID NO: 1093183 - RNA, 15 nt, Mycobacterium bovis subsp bovis AF2122/97
cuccgcgccgccccg

SEQ ID NO: 1093184 - RNA, 15 nt, Mycobacterium bovis subsp bovis AF2122/97
cuccgcggcgcgcaa

SEQ ID NO: 1093185 - RNA, 22 nt, Mycobacterium bovis subsp bovis AF2122/97
cuccgcgguuguuucggcguga

SEQ ID NO: 1093186 - RNA, 19 nt, Mycobacterium bovis subsp bovis AF2122/97
cuccgcggcgcagcacggc

SEQ ID NO: 1093187 - RNA, 23 nt, Mycobacterium bovis subsp bovis AF2122/97
cuccgcggcgcagcacggcggcc

SEQ ID NO: 1093188 - RNA, 12 nt, Mycobacterium bovis subsp bovis AF2122/97
cucgaugcgauc

SEQ ID NO: 1093189 - RNA, 13 nt, Mycobacterium bovis subsp bovis AF2122/97
cucgaugcgggcg

SEQ ID NO: 1093190 - RNA, 20 nt, Mycobacterium bovis subsp bovis AF2122/97
cucgaugcggguggcgccgg

SEQ ID NO: 1093191 - RNA, 17 nt, Mycobacterium bovis subsp bovis AF2122/97
cucgauggaaaacgcca

SEQ ID NO: 1093192 - RNA, 19 nt, Mycobacterium bovis subsp bovis AF2122/97
cucgauguccucgauccgg

SEQ ID NO: 1093193 - RNA, 14 nt, Mycobacterium bovis subsp bovis AF2122/97
cucgaugucagcgg

SEQ ID NO: 1093194 - RNA, 16 nt, Mycobacterium bovis subsp bovis AF2122/97
cucgaugucccgagcc

SEQ ID NO: 1093195 - RNA, 19 nt, Mycobacterium bovis subsp bovis AF2122/97
cucgauguccgauaccgcg

SEQ ID NO: 1093196 - RNA, 21 nt, Mycobacterium bovis subsp bovis AF2122/97
cucgaugguuuucucgaaguc

SEQ ID NO: 1093197 - RNA, 17 nt, Mycobacterium bovis subsp bovis AF2122/97
cucgauggcggccacca

SEQ ID NO: 1093198 - RNA, 12 nt, Mycobacterium bovis subsp bovis AF2122/97
cucgauggcggu

SEQ ID NO: 1093199 - RNA, 18 nt, Mycobacterium bovis subsp bovis AF2122/97
cucgauggcgguggcgag

SEQ ID NO: 1093200 - RNA, 16 nt, Mycobacterium bovis subsp bovis AF2122/97
cucgauggcggccacc

SEQ ID NO: 1093201 - RNA, 20 nt, Mycobacterium bovis subsp bovis AF2122/97
cucgauggucucccggcuga

SEQ ID NO: 1093202 - RNA, 16 nt, Mycobacterium bovis subsp bovis AF2122/97
cucgauauaacccggc

SEQ ID NO: 1093203 - RNA, 20 nt, Mycobacterium bovis subsp bovis AF2122/97
cucgauauaacccggcucca

SEQ ID NO: 1093204 - RNA, 23 nt, Mycobacterium bovis subsp bovis AF2122/97
cucgauaucguuggcgaccaccg

SEQ ID NO: 1093205 - RNA, 23 nt, Mycobacterium bovis subsp bovis AF2122/97
cucgaguuuggccaguucgguga

SEQ ID NO: 1093206 - RNA, 22 nt, Mycobacterium bovis subsp bovis AF2122/97
cucgaguccaggcagcuugcca

SEQ ID NO: 1093207 - RNA, 13 nt, Mycobacterium bovis subsp bovis AF2122/97
cucgagugccgcc

SEQ ID NO: 1093208 - RNA, 21 nt, Mycobacterium bovis subsp bovis AF2122/97
cucgaguucgggcugcggcag

SEQ ID NO: 1093209 - RNA, 22 nt, Mycobacterium bovis subsp bovis AF2122/97
cucgaguugcgcggcaguggcc

SEQ ID NO: 1093210 - RNA, 16 nt, Mycobacterium bovis subsp bovis AF2122/97
cucgaguugcucgaca

SEQ ID NO: 1093211 - RNA, 23 nt, Mycobacterium bovis subsp bovis AF2122/97
cucgaguggaucauguucggcca

SEQ ID NO: 1093212 - RNA, 14 nt, Mycobacterium bovis subsp bovis AF2122/97
cucgaguggcgaac

SEQ ID NO: 1093213 - RNA, 20 nt, Mycobacterium bovis subsp bovis AF2122/97
cucgagagcaugguccagca

SEQ ID NO: 1093214 - RNA, 13 nt, Mycobacterium bovis subsp bovis AF2122/97
cucgaguagucgc

SEQ ID NO: 1093215 - RNA, 18 nt, Mycobacterium bovis subsp bovis AF2122/97
cucgagcccucguuaucg

SEQ ID NO: 1093216 - RNA, 12 nt, Mycobacterium bovis subsp bovis AF2122/97
cucgagccgccc

SEQ ID NO: 1093217 - RNA, 13 nt, Mycobacterium bovis subsp bovis AF2122/97
cucgagccgcccg

SEQ ID NO: 1093218 - RNA, 14 nt, Mycobacterium bovis subsp bovis AF2122/97
cucgagccgcccgu

SEQ ID NO: 1093219 - RNA, 15 nt, Mycobacterium bovis subsp bovis AF2122/97
cucgaucacggcggc

SEQ ID NO: 1093220 - RNA, 17 nt, Mycobacterium bovis subsp bovis AF2122/97
cucgaucacggcggccc

SEQ ID NO: 1093221 - RNA, 19 nt, Mycobacterium bovis subsp bovis AF2122/97
cucgaucagaucgucacuc

SEQ ID NO: 1093222 - RNA, 12 nt, Mycobacterium bovis subsp bovis AF2122/97
cucgaacgccgc

SEQ ID NO: 1093223 - RNA, 16 nt, Mycobacterium bovis subsp bovis AF2122/97
cucgacaguggcgacg

SEQ ID NO: 1093224 - RNA, 17 nt, Mycobacterium bovis subsp bovis AF2122/97
cucgacaguggcgacgg

SEQ ID NO: 1093225 - RNA, 13 nt, Mycobacterium bovis subsp bovis AF2122/97
cucgaccaccgcc

SEQ ID NO: 1093226 - RNA, 21 nt, Mycobacterium bovis subsp bovis AF2122/97
cucgaccagacgcugcccaaa

SEQ ID NO: 1093227 - RNA, 16 nt, Mycobacterium bovis subsp bovis AF2122/97
cucgaccagagccgcg

SEQ ID NO: 1093228 - RNA, 12 nt, Mycobacterium bovis subsp bovis AF2122/97
cucgaccagcgc

SEQ ID NO: 1093229 - RNA, 16 nt, Mycobacterium bovis subsp bovis AF2122/97
cucgaccaggaacggc

SEQ ID NO: 1093230 - RNA, 12 nt, Mycobacterium bovis subsp bovis AF2122/97
cucgaccaggac

SEQ ID NO: 1093231 - RNA, 18 nt, Mycobacterium bovis subsp bovis AF2122/97
cucgaccaggaccggcug

SEQ ID NO: 1093232 - RNA, 13 nt, Mycobacterium bovis subsp bovis AF2122/97
cucgaccagcgcc

SEQ ID NO: 1093233 - RNA, 23 nt, Mycobacterium bovis subsp bovis AF2122/97
cucgacgagucggcgggcgacau

SEQ ID NO: 1093234 - RNA, 14 nt, Mycobacterium bovis subsp bovis AF2122/97
cucgacgacgggcg

SEQ ID NO: 1093235 - RNA, 16 nt, Mycobacterium bovis subsp bovis AF2122/97
cucgacgacgggcgcc

SEQ ID NO: 1093236 - RNA, 16 nt, Mycobacterium bovis subsp bovis AF2122/97
cucgacgagcacgccg

SEQ ID NO: 1093237 - RNA, 19 nt, Mycobacterium bovis subsp bovis AF2122/97
cucgagcaugcccagcgaa

SEQ ID NO: 1093238 - RNA, 21 nt, Mycobacterium bovis subsp bovis AF2122/97
cucgagcaccucggccucguc

SEQ ID NO: 1093239 - RNA, 19 nt, Mycobacterium bovis subsp bovis AF2122/97
cucgagcaggaugcgaucg

SEQ ID NO: 1093240 - RNA, 20 nt, Mycobacterium bovis subsp bovis AF2122/97
cucgagcaggcgcaccaggc

SEQ ID NO: 1093241 - RNA, 18 nt, Mycobacterium bovis subsp bovis AF2122/97
cucgacgcaccuaugguc

SEQ ID NO: 1093242 - RNA, 15 nt, Mycobacterium bovis subsp bovis AF2122/97
cucgacgaucagcac

SEQ ID NO: 1093243 - RNA, 15 nt, Mycobacterium bovis subsp bovis AF2122/97
cucgacgaggccacg

SEQ ID NO: 1093244 - RNA, 13 nt, Mycobacterium bovis subsp bovis AF2122/97
cucgacgccccag

SEQ ID NO: 1093245 - RNA, 14 nt, Mycobacterium bovis subsp bovis AF2122/97
cucgacgccgcgca

SEQ ID NO: 1093246 - RNA, 15 nt, Mycobacterium bovis subsp bovis AF2122/97
cucgacgccgcgcag

SEQ ID NO: 1093247 - RNA, 13 nt, Mycobacterium bovis subsp bovis AF2122/97
cucgacgcccgcc

SEQ ID NO: 1093248 - RNA, 14 nt, Mycobacterium bovis subsp bovis AF2122/97
cucgacgcccgcca

SEQ ID NO: 1093249 - RNA, 16 nt, Mycobacterium bovis subsp bovis AF2122/97
cucgacgcccgcccug

SEQ ID NO: 1093250 - RNA, 22 nt, Mycobacterium bovis subsp bovis AF2122/97
cucgacgcccgcccuggcaacg

SEQ ID NO: 1093251 - RNA, 14 nt, Mycobacterium bovis subsp bovis AF2122/97
cuccagcaccagca

SEQ ID NO: 1093252 - RNA, 17 nt, Mycobacterium bovis subsp bovis AF2122/97
cuccagauaccaccgcc

SEQ ID NO: 1093253 - RNA, 15 nt, Mycobacterium bovis subsp bovis AF2122/97
cuccagauccacgcc

SEQ ID NO: 1093254 - RNA, 15 nt, Mycobacterium bovis subsp bovis AF2122/97
cuccaccgucgccgc

SEQ ID NO: 1093255 - RNA, 14 nt, Mycobacterium bovis subsp bovis AF2122/97
cuccagcaccaccg

SEQ ID NO: 1093256 - RNA, 17 nt, Mycobacterium bovis subsp bovis AF2122/97
cuccagcacccggucga

SEQ ID NO: 1093257 - RNA, 13 nt, Mycobacterium bovis subsp bovis AF2122/97
cuccagcaccgug

SEQ ID NO: 1093258 - RNA, 20 nt, Mycobacterium bovis subsp bovis AF2122/97
cuccagcagcucgccggcac

SEQ ID NO: 1093259 - RNA, 22 nt, Mycobacterium bovis subsp bovis AF2122/97
cuccagcagguccgcggccgcg

SEQ ID NO: 1093260 - RNA, 19 nt, Mycobacterium bovis subsp bovis AF2122/97
cuccccgaucagcaccgac

SEQ ID NO: 1093261 - RNA, 18 nt, Mycobacterium bovis subsp bovis AF2122/97
cuccccagcgaaucaccc

SEQ ID NO: 1093262 - RNA, 20 nt, Mycobacterium bovis subsp bovis AF2122/97
cuccccgaucugcuccucgg

SEQ ID NO: 1093263 - RNA, 16 nt, Mycobacterium bovis subsp bovis AF2122/97
cuccccgcgcgcugau

SEQ ID NO: 1093264 - RNA, 19 nt, Mycobacterium bovis subsp bovis AF2122/97
cuccccggcccgcucaacg

SEQ ID NO: 1093265 - RNA, 14 nt, Mycobacterium bovis subsp bovis AF2122/97
cucccgaccgccga

SEQ ID NO: 1093266 - RNA, 15 nt, Mycobacterium bovis subsp bovis AF2122/97
cucccgaccgccgag

SEQ ID NO: 1093267 - RNA, 20 nt, Mycobacterium bovis subsp bovis AF2122/97
cuccagcgaaccgacccggc

SEQ ID NO: 1093268 - RNA, 18 nt, Mycobacterium bovis subsp bovis AF2122/97
cuccgaaucugccggccg

SEQ ID NO: 1093269 - RNA, 15 nt, Mycobacterium bovis subsp bovis AF2122/97
cuccgaaggccgcca

SEQ ID NO: 1093270 - RNA, 18 nt, Mycobacterium bovis subsp bovis AF2122/97
cuccgaacauggccagca

SEQ ID NO: 1093271 - RNA, 23 nt, Mycobacterium bovis subsp bovis AF2122/97
cuccgacgcgaucuguccgcgaa

SEQ ID NO: 1093272 - RNA, 22 nt, Mycobacterium bovis subsp bovis AF2122/97
cuccgaaaucgucaguaccgca

SEQ ID NO: 1093273 - RNA, 21 nt, Mycobacterium bovis subsp bovis AF2122/97
cuccgagcacaggaucaccca

SEQ ID NO: 1093274 - RNA, 14 nt, Mycobacterium bovis subsp bovis AF2122/97
cuccgacggccgcg

SEQ ID NO: 1093275 - RNA, 14 nt, Mycobacterium bovis subsp bovis AF2122/97
cuccgacgggcgaa

SEQ ID NO: 1093276 - RNA, 22 nt, Mycobacterium bovis subsp bovis AF2122/97
cuccgacucgauauaacccggc

SEQ ID NO: 1093277 - RNA, 23 nt, Mycobacterium bovis subsp bovis AF2122/97
cuccgccaacaacuucucgucga

SEQ ID NO: 1093278 - RNA, 17 nt, Mycobacterium bovis subsp bovis AF2122/97
cuccgccaacucgucca

SEQ ID NO: 1093279 - RNA, 21 nt, Mycobacterium bovis subsp bovis AF2122/97
cuccgcagcuauuucgcgacg

SEQ ID NO: 1093280 - RNA, 22 nt, Mycobacterium bovis subsp bovis AF2122/97
cuccgaggccgccaucgccgcc

SEQ ID NO: 1093281 - RNA, 15 nt, Mycobacterium bovis subsp bovis AF2122/97
cuccgaucgggccca

SEQ ID NO: 1093282 - RNA, 17 nt, Mycobacterium bovis subsp bovis AF2122/97
cuccgaugccgacggcg

SEQ ID NO: 1093283 - RNA, 24 nt, Mycobacterium bovis subsp bovis AF2122/97
cuccgaugugccgauuggccugcc

SEQ ID NO: 1093284 - RNA, 12 nt, Mycobacterium bovis subsp bovis AF2122/97
cucccggccgcc

SEQ ID NO: 1093285 - RNA, 19 nt, Mycobacterium bovis subsp bovis AF2122/97
cucccggauauugccaucc

SEQ ID NO: 1093286 - RNA, 15 nt, Mycobacterium bovis subsp bovis AF2122/97
cucccgcgaucgcga

SEQ ID NO: 1093287 - RNA, 20 nt, Mycobacterium bovis subsp bovis AF2122/97
cucccgcacggccgggucga

SEQ ID NO: 1093288 - RNA, 13 nt, Mycobacterium bovis subsp bovis AF2122/97
cucccgcggcacc

SEQ ID NO: 1093289 - RNA, 13 nt, Mycobacterium bovis subsp bovis AF2122/97
cuccacagcggcc

SEQ ID NO: 1093290 - RNA, 16 nt, Mycobacterium bovis subsp bovis AF2122/97
cuccaccccguuggcg

SEQ ID NO: 1093291 - RNA, 22 nt, Mycobacterium bovis subsp bovis AF2122/97
cuccaccaggucgugcccggga

SEQ ID NO: 1093292 - RNA, 19 nt, Mycobacterium bovis subsp bovis AF2122/97
cuccaccgcgccggcggca

SEQ ID NO: 1093293 - RNA, 15 nt, Mycobacterium bovis subsp bovis AF2122/97
cuccaccgccgcgcg

SEQ ID NO: 1093294 - RNA, 16 nt, Mycobacterium bovis subsp bovis AF2122/97
cuccaccgccgcgcgg

SEQ ID NO: 1093295 - RNA, 12 nt, Mycobacterium bovis subsp bovis AF2122/97
cuccaccgcgcc

SEQ ID NO: 1093296 - RNA, 21 nt, Mycobacterium bovis subsp bovis AF2122/97
cuccaccgaaaaguccgccgc

SEQ ID NO: 1093297 - RNA, 20 nt, Mycobacterium bovis subsp bovis AF2122/97
cuccagacguuccaucacgg

SEQ ID NO: 1093298 - RNA, 22 nt, Mycobacterium bovis subsp bovis AF2122/97
cuccagacguuccaucacggac

SEQ ID NO: 1093299 - RNA, 14 nt, Mycobacterium bovis subsp bovis AF2122/97
cuccaccgcgucca

SEQ ID NO: 1093300 - RNA, 17 nt, Mycobacterium bovis subsp bovis AF2122/97
cuccaccgggcccgccg

SEQ ID NO: 1093301 - RNA, 20 nt, Mycobacterium bovis subsp bovis AF2122/97
cuccaccgggcccgccggcc

SEQ ID NO: 1093302 - RNA, 18 nt, Mycobacterium bovis subsp bovis AF2122/97
cucaugcuaggccaccgg

SEQ ID NO: 1093303 - RNA, 18 nt, Mycobacterium bovis subsp bovis AF2122/97
cucaugcccgacgagucg

SEQ ID NO: 1093304 - RNA, 14 nt, Mycobacterium bovis subsp bovis AF2122/97
cucaugcgagucgu

SEQ ID NO: 1093305 - RNA, 21 nt, Mycobacterium bovis subsp bovis AF2122/97
cucaucuuugacaccggucgg

SEQ ID NO: 1093306 - RNA, 15 nt, Mycobacterium bovis subsp bovis AF2122/97
cucaugaccgcucgg

SEQ ID NO: 1093307 - RNA, 14 nt, Mycobacterium bovis subsp bovis AF2122/97
cucaucuucgguca

SEQ ID NO: 1093308 - RNA, 15 nt, Mycobacterium bovis subsp bovis AF2122/97
cucaugcacccggua

SEQ ID NO: 1093309 - RNA, 22 nt, Mycobacterium bovis subsp bovis AF2122/97
cucaucugaggcuuccagcucg

SEQ ID NO: 1093310 - RNA, 14 nt, Mycobacterium bovis subsp bovis AF2122/97
cucaucuguaaccu

SEQ ID NO: 1093311 - RNA, 15 nt, Mycobacterium bovis subsp bovis AF2122/97
cucaucgugguaacc

SEQ ID NO: 1093312 - RNA, 19 nt, Mycobacterium bovis subsp bovis AF2122/97
cucaucguuccacgagucg

SEQ ID NO: 1093313 - RNA, 15 nt, Mycobacterium bovis subsp bovis AF2122/97
cucaucgaccgcggc

SEQ ID NO: 1093314 - RNA, 21 nt, Mycobacterium bovis subsp bovis AF2122/97
cucaucgauccucgcccgcac

SEQ ID NO: 1093315 - RNA, 14 nt, Mycobacterium bovis subsp bovis AF2122/97
cucauccgccgggc

SEQ ID NO: 1093316 - RNA, 16 nt, Mycobacterium bovis subsp bovis AF2122/97
cucagggugcgccgca

SEQ ID NO: 1093317 - RNA, 18 nt, Mycobacterium bovis subsp bovis AF2122/97
cucaggucaccggccgcc

SEQ ID NO: 1093318 - RNA, 16 nt, Mycobacterium bovis subsp bovis AF2122/97
cucaggucggugcggu

SEQ ID NO: 1093319 - RNA, 14 nt, Mycobacterium bovis subsp bovis AF2122/97
cucagugcucgccc

SEQ ID NO: 1093320 - RNA, 14 nt, Mycobacterium bovis subsp bovis AF2122/97
cucauaggccggcg

SEQ ID NO: 1093321 - RNA, 20 nt, Mycobacterium bovis subsp bovis AF2122/97
cucauaggccugcagccgau

SEQ ID NO: 1093322 - RNA, 17 nt, Mycobacterium bovis subsp bovis AF2122/97
cucauagagcggcacca

SEQ ID NO: 1093323 - RNA, 15 nt, Mycobacterium bovis subsp bovis AF2122/97
cucauagcgacggcg

SEQ ID NO: 1093324 - RNA, 12 nt, Mycobacterium bovis subsp bovis AF2122/97
cucagcggcgac

SEQ ID NO: 1093325 - RNA, 17 nt, Mycobacterium bovis subsp bovis AF2122/97
cucagcgcggccacgcc

SEQ ID NO: 1093326 - RNA, 17 nt, Mycobacterium bovis subsp bovis AF2122/97
cucagccgugcccaggc

SEQ ID NO: 1093327 - RNA, 14 nt, Mycobacterium bovis subsp bovis AF2122/97
cucagcgaugcuca

SEQ ID NO: 1093328 - RNA, 14 nt, Mycobacterium bovis subsp bovis AF2122/97
cucagccgcggcca

SEQ ID NO: 1093329 - RNA, 15 nt, Mycobacterium bovis subsp bovis AF2122/97
cucagccgcggccac

SEQ ID NO: 1093330 - RNA, 13 nt, Mycobacterium bovis subsp bovis AF2122/97
cucagccgcucgg

SEQ ID NO: 1093331 - RNA, 23 nt, Mycobacterium bovis subsp bovis AF2122/97
cuagugccaggaucgcggcgccg

SEQ ID NO: 1093332 - RNA, 19 nt, Mycobacterium bovis subsp bovis AF2122/97
cuaguccggcacugcggcc

SEQ ID NO: 1093333 - RNA, 13 nt, Mycobacterium bovis subsp bovis AF2122/97
cuagucgcggccg

SEQ ID NO: 1093334 - RNA, 14 nt, Mycobacterium bovis subsp bovis AF2122/97
cguguuaaccgggc

SEQ ID NO: 1093335 - RNA, 17 nt, Mycobacterium bovis subsp bovis AF2122/97
cguguguuaggcccgca

SEQ ID NO: 1093336 - RNA, 13 nt, Mycobacterium bovis subsp bovis AF2122/97
cguguuaaccggg

SEQ ID NO: 1093337 - RNA, 14 nt, Mycobacterium bovis subsp bovis AF2122/97
cguuaccccaccgg

SEQ ID NO: 1093338 - RNA, 15 nt, Mycobacterium bovis subsp bovis AF2122/97
cguuaccgccgcugc

SEQ ID NO: 1093339 - RNA, 15 nt, Mycobacterium bovis subsp bovis AF2122/97
cguuaccgccguugc

SEQ ID NO: 1093340 - RNA, 17 nt, Mycobacterium bovis subsp bovis AF2122/97
cguuaccgacgccggug

SEQ ID NO: 1093341 - RNA, 12 nt, Mycobacterium bovis subsp bovis AF2122/97
cguuaccgccaa

SEQ ID NO: 1093342 - RNA, 15 nt, Mycobacterium bovis subsp bovis AF2122/97
cguuacgcucggcga

SEQ ID NO: 1093343 - RNA, 13 nt, Mycobacterium bovis subsp bovis AF2122/97
cguuacgccgcga

SEQ ID NO: 1093344 - RNA, 21 nt, Mycobacterium bovis subsp bovis AF2122/97
cguuagcuuagcugccgucgg

SEQ ID NO: 1093345 - RNA, 14 nt, Mycobacterium bovis subsp bovis AF2122/97
cguuagggccgcca

SEQ ID NO: 1093346 - RNA, 17 nt, Mycobacterium bovis subsp bovis AF2122/97
cguuaggucgccggcug

SEQ ID NO: 1093347 - RNA, 17 nt, Mycobacterium bovis subsp bovis AF2122/97
cguguggucccggcacg

SEQ ID NO: 1093348 - RNA, 22 nt, Mycobacterium bovis subsp bovis AF2122/97
cgugugugcgauccagggccga

SEQ ID NO: 1093349 - RNA, 14 nt, Mycobacterium bovis subsp bovis AF2122/97
cguguggccguugg

SEQ ID NO: 1093350 - RNA, 23 nt, Mycobacterium bovis subsp bovis AF2122/97
cgugugcggaagcaucggcugcg

SEQ ID NO: 1093351 - RNA, 18 nt, Mycobacterium bovis subsp bovis AF2122/97
cgugugcaucggcgaccg

SEQ ID NO: 1093352 - RNA, 15 nt, Mycobacterium bovis subsp bovis AF2122/97
cgugugcaccaucau

SEQ ID NO: 1093353 - RNA, 21 nt, Mycobacterium bovis subsp bovis AF2122/97
cgugugcucuugcgccacggc

SEQ ID NO: 1093354 - RNA, 20 nt, Mycobacterium bovis subsp bovis AF2122/97
cgugucgccgccguugccgc

SEQ ID NO: 1093355 - RNA, 13 nt, Mycobacterium bovis subsp bovis AF2122/97
cgugucgccggcg

SEQ ID NO: 1093356 - RNA, 14 nt, Mycobacterium bovis subsp bovis AF2122/97
cgugucgccggcga

SEQ ID NO: 1093357 - RNA, 15 nt, Mycobacterium bovis subsp bovis AF2122/97
cgugucgccggcgaa

SEQ ID NO: 1093358 - RNA, 19 nt, Mycobacterium bovis subsp bovis AF2122/97
cgugucggcggugccgacg

SEQ ID NO: 1093359 - RNA, 14 nt, Mycobacterium bovis subsp bovis AF2122/97
cgugucgcugcggc

SEQ ID NO: 1093360 - RNA, 15 nt, Mycobacterium bovis subsp bovis AF2122/97
cgugucgcugcggcg

SEQ ID NO: 1093361 - RNA, 15 nt, Mycobacterium bovis subsp bovis AF2122/97
cgugucguugccagg

SEQ ID NO: 1093362 - RNA, 21 nt, Mycobacterium bovis subsp bovis AF2122/97
cgugucguugccagggcgggc

SEQ ID NO: 1093363 - RNA, 17 nt, Mycobacterium bovis subsp bovis AF2122/97
cgugucugggaccccgc

SEQ ID NO: 1093364 - RNA, 22 nt, Mycobacterium bovis subsp bovis AF2122/97
cgugugaggccuucgccgacua

SEQ ID NO: 1093365 - RNA, 21 nt, Mycobacterium bovis subsp bovis AF2122/97
cgugugaggccuucgccgacu

SEQ ID NO: 1093366 - RNA, 22 nt, Mycobacterium bovis subsp bovis AF2122/97
cgugucgggaacgaguacgggc

SEQ ID NO: 1093367 - RNA, 15 nt, Mycobacterium bovis subsp bovis AF2122/97
cgugucggugcgcgc

SEQ ID NO: 1093368 - RNA, 19 nt, Mycobacterium bovis subsp bovis AF2122/97
cgugucuugucgcgcagca

SEQ ID NO: 1093369 - RNA, 16 nt, Mycobacterium bovis subsp bovis AF2122/97
cguucaugcggcggcg

SEQ ID NO: 1093370 - RNA, 17 nt, Mycobacterium bovis subsp bovis AF2122/97
cguucaugcggcggcgc

SEQ ID NO: 1093371 - RNA, 19 nt, Mycobacterium bovis subsp bovis AF2122/97
cguucaucuucaccacgcc

SEQ ID NO: 1093372 - RNA, 17 nt, Mycobacterium bovis subsp bovis AF2122/97
cguuccacgccggcauc

SEQ ID NO: 1093373 - RNA, 14 nt, Mycobacterium bovis subsp bovis AF2122/97
cguuccacacagau

SEQ ID NO: 1093374 - RNA, 23 nt, Mycobacterium bovis subsp bovis AF2122/97
cguuccacaucaaaacggcggug

SEQ ID NO: 1093375 - RNA, 17 nt, Mycobacterium bovis subsp bovis AF2122/97
cguuccaucgccgacgc

SEQ ID NO: 1093376 - RNA, 22 nt, Mycobacterium bovis subsp bovis AF2122/97
cguuccaucacggaccaggccu

SEQ ID NO: 1093377 - RNA, 18 nt, Mycobacterium bovis subsp bovis AF2122/97
cguuccgggccgaucacc

SEQ ID NO: 1093378 - RNA, 19 nt, Mycobacterium bovis subsp bovis AF2122/97
cguuccagggucacggucg

SEQ ID NO: 1093379 - RNA, 14 nt, Mycobacterium bovis subsp bovis AF2122/97
cguuccaucacgga

SEQ ID NO: 1093380 - RNA, 14 nt, Mycobacterium bovis subsp bovis AF2122/97
cguucgccgcccgg

SEQ ID NO: 1093381 - RNA, 15 nt, Mycobacterium bovis subsp bovis AF2122/97
cguucgccgcccggc

SEQ ID NO: 1093382 - RNA, 21 nt, Mycobacterium bovis subsp bovis AF2122/97
cguucgccggaauacaccagc

SEQ ID NO: 1093383 - RNA, 14 nt, Mycobacterium bovis subsp bovis AF2122/97
cguucgcgccguug

SEQ ID NO: 1093384 - RNA, 16 nt, Mycobacterium bovis subsp bovis AF2122/97
cguucgcgucacacca

SEQ ID NO: 1093385 - RNA, 19 nt, Mycobacterium bovis subsp bovis AF2122/97
cguucgcgucacaccagcg

SEQ ID NO: 1093386 - RNA, 14 nt, Mycobacterium bovis subsp bovis AF2122/97
cguucgacccagcg

SEQ ID NO: 1093387 - RNA, 15 nt, Mycobacterium bovis subsp bovis AF2122/97
cguucgagugcgguc

SEQ ID NO: 1093388 - RNA, 22 nt, Mycobacterium bovis subsp bovis AF2122/97
cguucgacucgaccgcgacggc

SEQ ID NO: 1093389 - RNA, 16 nt, Mycobacterium bovis subsp bovis AF2122/97
cguucgaaggccaccc

SEQ ID NO: 1093390 - RNA, 15 nt, Mycobacterium bovis subsp bovis AF2122/97
cguuggacggcaccg

SEQ ID NO: 1093391 - RNA, 18 nt, Mycobacterium bovis subsp bovis AF2122/97
cguuggauccacacccac

SEQ ID NO: 1093392 - RNA, 18 nt, Mycobacterium bovis subsp bovis AF2122/97
cguuggaugaagucgucg

SEQ ID NO: 1093393 - RNA, 23 nt, Mycobacterium bovis subsp bovis AF2122/97
cguuggauguuuuccgguccggc

SEQ ID NO: 1093394 - RNA, 18 nt, Mycobacterium bovis subsp bovis AF2122/97
cguuggcaaugaccccgg

SEQ ID NO: 1093395 - RNA, 23 nt, Mycobacterium bovis subsp bovis AF2122/97
cguuggcaaugaccccggcguug

SEQ ID NO: 1093396 - RNA, 17 nt, Mycobacterium bovis subsp bovis AF2122/97
cguugcugccggcguag

SEQ ID NO: 1093397 - RNA, 16 nt, Mycobacterium bovis subsp bovis AF2122/97
cguugcuggcggccag

SEQ ID NO: 1093398 - RNA, 14 nt, Mycobacterium bovis subsp bovis AF2122/97
cguugcuggcuggg

SEQ ID NO: 1093399 - RNA, 16 nt, Mycobacterium bovis subsp bovis AF2122/97
cguugcuggucgccgu

SEQ ID NO: 1093400 - RNA, 19 nt, Mycobacterium bovis subsp bovis AF2122/97
cguugcucccacggcaccc

SEQ ID NO: 1093401 - RNA, 19 nt, Mycobacterium bovis subsp bovis AF2122/97
cguugcucggucucgucgc

SEQ ID NO: 1093402 - RNA, 17 nt, Mycobacterium bovis subsp bovis AF2122/97
cguugcugaugucgccg

SEQ ID NO: 1093403 - RNA, 15 nt, Mycobacterium bovis subsp bovis AF2122/97
cguugcccaacccgg

SEQ ID NO: 1093404 - RNA, 12 nt, Mycobacterium bovis subsp bovis AF2122/97
cguugccaccgg

SEQ ID NO: 1093405 - RNA, 15 nt, Mycobacterium bovis subsp bovis AF2122/97
cguugccaccggugc

SEQ ID NO: 1093406 - RNA, 20 nt, Mycobacterium bovis subsp bovis AF2122/97
cguugccaccggugccggcg

SEQ ID NO: 1093407 - RNA, 21 nt, Mycobacterium bovis subsp bovis AF2122/97
cguugccaccggugccggcga

SEQ ID NO: 1093408 - RNA, 18 nt, Mycobacterium bovis subsp bovis AF2122/97
cguugccaccguugccgc

SEQ ID NO: 1093409 - RNA, 20 nt, Mycobacterium bovis subsp bovis AF2122/97
cguugccaccguugccgccg

SEQ ID NO: 1093410 - RNA, 18 nt, Mycobacterium bovis subsp bovis AF2122/97
cguugcgucugcucggcg

SEQ ID NO: 1093411 - RNA, 13 nt, Mycobacterium bovis subsp bovis AF2122/97
cguugagcagcac

SEQ ID NO: 1093412 - RNA, 16 nt, Mycobacterium bovis subsp bovis AF2122/97
cguugagcagcaccca

SEQ ID NO: 1093413 - RNA, 22 nt, Mycobacterium bovis subsp bovis AF2122/97
cguugagcaggugcccgaggug

SEQ ID NO: 1093414 - RNA, 15 nt, Mycobacterium bovis subsp bovis AF2122/97
cguucugcccaggca

SEQ ID NO: 1093415 - RNA, 13 nt, Mycobacterium bovis subsp bovis AF2122/97
cguucuccggcac

SEQ ID NO: 1093416 - RNA, 24 nt, Mycobacterium bovis subsp bovis AF2122/97
cguucucggugaaguggcgcacca

SEQ ID NO: 1093417 - RNA, 21 nt, Mycobacterium bovis subsp bovis AF2122/97
cguucucgauugucgccgcgc

SEQ ID NO: 1093418 - RNA, 22 nt, Mycobacterium bovis subsp bovis AF2122/97
cguucucgcccacccgcugcga

SEQ ID NO: 1093419 - RNA, 23 nt, Mycobacterium bovis subsp bovis AF2122/97
cguucggaugucccuugacggug

SEQ ID NO: 1093420 - RNA, 15 nt, Mycobacterium bovis subsp bovis AF2122/97
cguucgugcagccca

SEQ ID NO: 1093421 - RNA, 22 nt, Mycobacterium bovis subsp bovis AF2122/97
cguucgugggcauugcggcgcg

SEQ ID NO: 1093422 - RNA, 16 nt, Mycobacterium bovis subsp bovis AF2122/97
cguucgugagcggcca

SEQ ID NO: 1093423 - RNA, 17 nt, Mycobacterium bovis subsp bovis AF2122/97
cguucgugagcggccag

SEQ ID NO: 1093424 - RNA, 18 nt, Mycobacterium bovis subsp bovis AF2122/97
cguucgugagcggccagg

SEQ ID NO: 1093425 - RNA, 21 nt, Mycobacterium bovis subsp bovis AF2122/97
cguucguucccgcucgggcaa

SEQ ID NO: 1093426 - RNA, 14 nt, Mycobacterium bovis subsp bovis AF2122/97
cguugaucggcacg

SEQ ID NO: 1093427 - RNA, 16 nt, Mycobacterium bovis subsp bovis AF2122/97
cguugcacugcugguu

SEQ ID NO: 1093428 - RNA, 15 nt, Mycobacterium bovis subsp bovis AF2122/97
cguugcagaccacca

SEQ ID NO: 1093429 - RNA, 16 nt, Mycobacterium bovis subsp bovis AF2122/97
cguugcagcucgaucc

SEQ ID NO: 1093430 - RNA, 20 nt, Mycobacterium bovis subsp bovis AF2122/97
cguugagguaggugagcgcg

SEQ ID NO: 1093431 - RNA, 16 nt, Mycobacterium bovis subsp bovis AF2122/97
cguugagguauucgaa

SEQ ID NO: 1093432 - RNA, 15 nt, Mycobacterium bovis subsp bovis AF2122/97
cguugaggucgauca

SEQ ID NO: 1093433 - RNA, 12 nt, Mycobacterium bovis subsp bovis AF2122/97
cguugagcuggc

SEQ ID NO: 1093434 - RNA, 13 nt, Mycobacterium bovis subsp bovis AF2122/97
cguucugcgcccg

SEQ ID NO: 1093435 - RNA, 21 nt, Mycobacterium bovis subsp bovis AF2122/97
cguugaucaagaaggccagcg

SEQ ID NO: 1093436 - RNA, 16 nt, Mycobacterium bovis subsp bovis AF2122/97
cguugauccccagcuc

SEQ ID NO: 1093437 - RNA, 17 nt, Mycobacterium bovis subsp bovis AF2122/97
cguugaucccgaaccgu

SEQ ID NO: 1093438 - RNA, 20 nt, Mycobacterium bovis subsp bovis AF2122/97
cguugaguggaugcgccgca

SEQ ID NO: 1093439 - RNA, 16 nt, Mycobacterium bovis subsp bovis AF2122/97
cguugauacgcgucga

SEQ ID NO: 1093440 - RNA, 20 nt, Mycobacterium bovis subsp bovis AF2122/97
cguggccgcacugcugguca

SEQ ID NO: 1093441 - RNA, 15 nt, Mycobacterium bovis subsp bovis AF2122/97
cguggcccuccucgg

SEQ ID NO: 1093442 - RNA, 21 nt, Mycobacterium bovis subsp bovis AF2122/97
cguggcccuccucggugaggu

SEQ ID NO: 1093443 - RNA, 12 nt, Mycobacterium bovis subsp bovis AF2122/97
cguggccgccgg

SEQ ID NO: 1093444 - RNA, 13 nt, Mycobacterium bovis subsp bovis AF2122/97
cguggccgccggc

SEQ ID NO: 1093445 - RNA, 17 nt, Mycobacterium bovis subsp bovis AF2122/97
cguggccgcgaucccgg

SEQ ID NO: 1093446 - RNA, 15 nt, Mycobacterium bovis subsp bovis AF2122/97
cguggcgaaccaggg

SEQ ID NO: 1093447 - RNA, 13 nt, Mycobacterium bovis subsp bovis AF2122/97
cguggcgggggcu

SEQ ID NO: 1093448 - RNA, 22 nt, Mycobacterium bovis subsp bovis AF2122/97
cguggcgggcugcagccgacag

SEQ ID NO: 1093449 - RNA, 22 nt, Mycobacterium bovis subsp bovis AF2122/97
cguggccucgauguccugcgga

SEQ ID NO: 1093450 - RNA, 20 nt, Mycobacterium bovis subsp bovis AF2122/97
cguggcggggaaaccggcca

SEQ ID NO: 1093451 - RNA, 17 nt, Mycobacterium bovis subsp bovis AF2122/97
cguggcgucgugcgcgg

SEQ ID NO: 1093452 - RNA, 22 nt, Mycobacterium bovis subsp bovis AF2122/97
cguggcgucgugcgcggccggc

SEQ ID NO: 1093453 - RNA, 16 nt, Mycobacterium bovis subsp bovis AF2122/97
cguggcuaccgcaggu

SEQ ID NO: 1093454 - RNA, 12 nt, Mycobacterium bovis subsp bovis AF2122/97
cguggcucggcg

SEQ ID NO: 1093455 - RNA, 18 nt, Mycobacterium bovis subsp bovis AF2122/97
cguggcugccuucggcga

SEQ ID NO: 1093456 - RNA, 21 nt, Mycobacterium bovis subsp bovis AF2122/97
cguggcugccuucggcgagcg

SEQ ID NO: 1093457 - RNA, 22 nt, Mycobacterium bovis subsp bovis AF2122/97
cguggcugcgauuuucggcacg

SEQ ID NO: 1093458 - RNA, 15 nt, Mycobacterium bovis subsp bovis AF2122/97
cguggcugcgcucgc

SEQ ID NO: 1093459 - RNA, 13 nt, Mycobacterium bovis subsp bovis AF2122/97
cguggcuggcacc

SEQ ID NO: 1093460 - RNA, 17 nt, Mycobacterium bovis subsp bovis AF2122/97
cgugggcgacggcggcg

SEQ ID NO: 1093461 - RNA, 15 nt, Mycobacterium bovis subsp bovis AF2122/97
cguggcucggcgggu

SEQ ID NO: 1093462 - RNA, 23 nt, Mycobacterium bovis subsp bovis AF2122/97
cguggcuggcaugccggcgugcg

SEQ ID NO: 1093463 - RNA, 13 nt, Mycobacterium bovis subsp bovis AF2122/97
cguggcuggcggc

SEQ ID NO: 1093464 - RNA, 19 nt, Mycobacterium bovis subsp bovis AF2122/97
cgugggccuguugcugccc

SEQ ID NO: 1093465 - RNA, 22 nt, Mycobacterium bovis subsp bovis AF2122/97
cgugggccuguugcugcccgac

SEQ ID NO: 1093466 - RNA, 14 nt, Mycobacterium bovis subsp bovis AF2122/97
cgugggugccggcu

SEQ ID NO: 1093467 - RNA, 21 nt, Mycobacterium bovis subsp bovis AF2122/97
cgugggugucggcuagcaacg

SEQ ID NO: 1093468 - RNA, 14 nt, Mycobacterium bovis subsp bovis AF2122/97
cgugggugucggcu

SEQ ID NO: 1093469 - RNA, 18 nt, Mycobacterium bovis subsp bovis AF2122/97
cgugggugucggcuagca

SEQ ID NO: 1093470 - RNA, 18 nt, Mycobacterium bovis subsp bovis AF2122/97
cgugggugagcgaccugg

SEQ ID NO: 1093471 - RNA, 22 nt, Mycobacterium bovis subsp bovis AF2122/97
cguggguccguuuuaccucggc

SEQ ID NO: 1093472 - RNA, 15 nt, Mycobacterium bovis subsp bovis AF2122/97
cgugggcgcggcgcc

SEQ ID NO: 1093473 - RNA, 20 nt, Mycobacterium bovis subsp bovis AF2122/97
cgugggcggaacgaugccgg

SEQ ID NO: 1093474 - RNA, 22 nt, Mycobacterium bovis subsp bovis AF2122/97
cguggguacgcaucucgagcau

SEQ ID NO: 1093475 - RNA, 18 nt, Mycobacterium bovis subsp bovis AF2122/97
cgugggguaucgccagcc

SEQ ID NO: 1093476 - RNA, 14 nt, Mycobacterium bovis subsp bovis AF2122/97
cguguacugcuccu

SEQ ID NO: 1093477 - RNA, 17 nt, Mycobacterium bovis subsp bovis AF2122/97
cguguacauugccgacc

SEQ ID NO: 1093478 - RNA, 21 nt, Mycobacterium bovis subsp bovis AF2122/97
cguguaccuccucgaguaccc

SEQ ID NO: 1093479 - RNA, 15 nt, Mycobacterium bovis subsp bovis AF2122/97
cguguacgucgauca

SEQ ID NO: 1093480 - RNA, 16 nt, Mycobacterium bovis subsp bovis AF2122/97
cgugucaccgggugca

SEQ ID NO: 1093481 - RNA, 15 nt, Mycobacterium bovis subsp bovis AF2122/97
cgugucacgcgacca

SEQ ID NO: 1093482 - RNA, 22 nt, Mycobacterium bovis subsp bovis AF2122/97
cgugucacgcgaccaccgccga

SEQ ID NO: 1093483 - RNA, 20 nt, Mycobacterium bovis subsp bovis AF2122/97
cguguaguggcccgcgggca

SEQ ID NO: 1093484 - RNA, 16 nt, Mycobacterium bovis subsp bovis AF2122/97
cgugucaaccggucgg

SEQ ID NO: 1093485 - RNA, 13 nt, Mycobacterium bovis subsp bovis AF2122/97
cguguccgccgga

SEQ ID NO: 1093486 - RNA, 12 nt, Mycobacterium bovis subsp bovis AF2122/97
cguguccgccgu

SEQ ID NO: 1093487 - RNA, 22 nt, Mycobacterium bovis subsp bovis AF2122/97
cgugucaugcucaccgaggaac

SEQ ID NO: 1093488 - RNA, 16 nt, Mycobacterium bovis subsp bovis AF2122/97
cgugucgacggucauc

SEQ ID NO: 1093489 - RNA, 19 nt, Mycobacterium bovis subsp bovis AF2122/97
cgugucccaacgccacugc

SEQ ID NO: 1093490 - RNA, 16 nt, Mycobacterium bovis subsp bovis AF2122/97
cgugucgccgccacca

SEQ ID NO: 1093491 - RNA, 17 nt, Mycobacterium bovis subsp bovis AF2122/97
cgugucgccgccaccag

SEQ ID NO: 1093492 - RNA, 16 nt, Mycobacterium bovis subsp bovis AF2122/97
cgugucgccgccguug

SEQ ID NO: 1093493 - RNA, 20 nt, Mycobacterium bovis subsp bovis AF2122/97
cguggucgacggggcggucg

SEQ ID NO: 1093494 - RNA, 15 nt, Mycobacterium bovis subsp bovis AF2122/97
cgugguccaaccggg

SEQ ID NO: 1093495 - RNA, 17 nt, Mycobacterium bovis subsp bovis AF2122/97
cgugguccaaccgggcc

SEQ ID NO: 1093496 - RNA, 12 nt, Mycobacterium bovis subsp bovis AF2122/97
cguggucgcccc

SEQ ID NO: 1093497 - RNA, 22 nt, Mycobacterium bovis subsp bovis AF2122/97
cguggucgccccgaugaccgcc

SEQ ID NO: 1093498 - RNA, 20 nt, Mycobacterium bovis subsp bovis AF2122/97
cguggucgagggcggcgucg

SEQ ID NO: 1093499 - RNA, 21 nt, Mycobacterium bovis subsp bovis AF2122/97
cgugguccuuguuguggugga

SEQ ID NO: 1093500 - RNA, 19 nt, Mycobacterium bovis subsp bovis AF2122/97
cguggucgauccacucggc

SEQ ID NO: 1093501 - RNA, 21 nt, Mycobacterium bovis subsp bovis AF2122/97
cguggucaccccuucgccagc

SEQ ID NO: 1093502 - RNA, 19 nt, Mycobacterium bovis subsp bovis AF2122/97
cgugguagacggccugcga

SEQ ID NO: 1093503 - RNA, 16 nt, Mycobacterium bovis subsp bovis AF2122/97
cgugguagccggcgac

SEQ ID NO: 1093504 - RNA, 21 nt, Mycobacterium bovis subsp bovis AF2122/97
cguggguguugaugggcagcc

SEQ ID NO: 1093505 - RNA, 20 nt, Mycobacterium bovis subsp bovis AF2122/97
cguggguucacguucggugg

SEQ ID NO: 1093506 - RNA, 15 nt, Mycobacterium bovis subsp bovis AF2122/97
cgugguaaccagggc

SEQ ID NO: 1093507 - RNA, 16 nt, Mycobacterium bovis subsp bovis AF2122/97
cgugggugucgguggc

SEQ ID NO: 1093508 - RNA, 23 nt, Mycobacterium bovis subsp bovis AF2122/97
cgugggugucgguggccgcggcg

SEQ ID NO: 1093509 - RNA, 17 nt, Mycobacterium bovis subsp bovis AF2122/97
cgucucggaggcgacca

SEQ ID NO: 1093510 - RNA, 21 nt, Mycobacterium bovis subsp bovis AF2122/97
cgucucgcgcaccugaucggu

SEQ ID NO: 1093511 - RNA, 19 nt, Mycobacterium bovis subsp bovis AF2122/97
cgucucgcggugcggcaac

SEQ ID NO: 1093512 - RNA, 22 nt, Mycobacterium bovis subsp bovis AF2122/97
cgucucgacacugcagugaucg

SEQ ID NO: 1093513 - RNA, 17 nt, Mycobacterium bovis subsp bovis AF2122/97
cgucucgacaguggcga

SEQ ID NO: 1093514 - RNA, 23 nt, Mycobacterium bovis subsp bovis AF2122/97
cgucuccuguggggauuccgcac

SEQ ID NO: 1093515 - RNA, 21 nt, Mycobacterium bovis subsp bovis AF2122/97
cgucuccuugaucgacaacgc

SEQ ID NO: 1093516 - RNA, 11 nt, Mycobacterium bovis subsp bovis AF2122/97
cgucucgauga

SEQ ID NO: 1093517 - RNA, 14 nt, Mycobacterium bovis subsp bovis AF2122/97
cgucucgcaccgcg

SEQ ID NO: 1093518 - RNA, 13 nt, Mycobacterium bovis subsp bovis AF2122/97
cgucucgcggugc

SEQ ID NO: 1093519 - RNA, 13 nt, Mycobacterium bovis subsp bovis AF2122/97
cgucucgccgcgc

SEQ ID NO: 1093520 - RNA, 22 nt, Mycobacterium bovis subsp bovis AF2122/97
cgucucgcggugcggcaacagc

SEQ ID NO: 1093521 - RNA, 19 nt, Mycobacterium bovis subsp bovis AF2122/97
cgucucggguggggaucac

SEQ ID NO: 1093522 - RNA, 15 nt, Mycobacterium bovis subsp bovis AF2122/97
cgugcgcgcgcagcu

SEQ ID NO: 1093523 - RNA, 16 nt, Mycobacterium bovis subsp bovis AF2122/97
cgugcgcgcgcagcug

SEQ ID NO: 1093524 - RNA, 14 nt, Mycobacterium bovis subsp bovis AF2122/97
cgugcgcggccggc

SEQ ID NO: 1093525 - RNA, 15 nt, Mycobacterium bovis subsp bovis AF2122/97
cgugcgcggccggca

SEQ ID NO: 1093526 - RNA, 20 nt, Mycobacterium bovis subsp bovis AF2122/97
cgugcgcguuggucaucacc

SEQ ID NO: 1093527 - RNA, 21 nt, Mycobacterium bovis subsp bovis AF2122/97
cgugcggacugacgucgaagg

SEQ ID NO: 1093528 - RNA, 19 nt, Mycobacterium bovis subsp bovis AF2122/97
cgugcgcuggcugacaccg

SEQ ID NO: 1093529 - RNA, 19 nt, Mycobacterium bovis subsp bovis AF2122/97
cgugcgguauuugaacgcc

SEQ ID NO: 1093530 - RNA, 23 nt, Mycobacterium bovis subsp bovis AF2122/97
cgugcgguauuugaacgcccgcu

SEQ ID NO: 1093531 - RNA, 11 nt, Mycobacterium bovis subsp bovis AF2122/97
cgugcggucau

SEQ ID NO: 1093532 - RNA, 14 nt, Mycobacterium bovis subsp bovis AF2122/97
cgugcggucgcgcc

SEQ ID NO: 1093533 - RNA, 22 nt, Mycobacterium bovis subsp bovis AF2122/97
cgugcgguggcgcgcagcgcga

SEQ ID NO: 1093534 - RNA, 12 nt, Mycobacterium bovis subsp bovis AF2122/97
cgugcgguggcu

SEQ ID NO: 1093535 - RNA, 17 nt, Mycobacterium bovis subsp bovis AF2122/97
cgugcgugggcgcggcg

SEQ ID NO: 1093536 - RNA, 18 nt, Mycobacterium bovis subsp bovis AF2122/97
cgugcgugggcgcggcgc

SEQ ID NO: 1093537 - RNA, 18 nt, Mycobacterium bovis subsp bovis AF2122/97
cgugcuacccauucggcg

SEQ ID NO: 1093538 - RNA, 12 nt, Mycobacterium bovis subsp bovis AF2122/97
cgugcucaccgg

SEQ ID NO: 1093539 - RNA, 15 nt, Mycobacterium bovis subsp bovis AF2122/97
cgugcucaccggcgc

SEQ ID NO: 1093540 - RNA, 16 nt, Mycobacterium bovis subsp bovis AF2122/97
cgugcucaccggcgcc

SEQ ID NO: 1093541 - RNA, 17 nt, Mycobacterium bovis subsp bovis AF2122/97
cguggcaccaccaaggu

SEQ ID NO: 1093542 - RNA, 20 nt, Mycobacterium bovis subsp bovis AF2122/97
cguggauguguagguggggc

SEQ ID NO: 1093543 - RNA, 19 nt, Mycobacterium bovis subsp bovis AF2122/97
cguggaugguggugccguc

SEQ ID NO: 1093544 - RNA, 12 nt, Mycobacterium bovis subsp bovis AF2122/97
cguggaugucgc

SEQ ID NO: 1093545 - RNA, 14 nt, Mycobacterium bovis subsp bovis AF2122/97
cguggaugucgcgg

SEQ ID NO: 1093546 - RNA, 22 nt, Mycobacterium bovis subsp bovis AF2122/97
cguggcacccgcaguggucggc

SEQ ID NO: 1093547 - RNA, 22 nt, Mycobacterium bovis subsp bovis AF2122/97
cguggcacugacgcgcccgacg

SEQ ID NO: 1093548 - RNA, 23 nt, Mycobacterium bovis subsp bovis AF2122/97
cguggcagugcaggcggccgcca

SEQ ID NO: 1093549 - RNA, 18 nt, Mycobacterium bovis subsp bovis AF2122/97
cguggcaguacaccggcg

SEQ ID NO: 1093550 - RNA, 20 nt, Mycobacterium bovis subsp bovis AF2122/97
cguggcaguacaccggcgug

SEQ ID NO: 1093551 - RNA, 22 nt, Mycobacterium bovis subsp bovis AF2122/97
cguggcagucgcacggugccgc

SEQ ID NO: 1093552 - RNA, 15 nt, Mycobacterium bovis subsp bovis AF2122/97
cguggcagugcaggc

SEQ ID NO: 1093553 - RNA, 18 nt, Mycobacterium bovis subsp bovis AF2122/97
cguggcagugcaggcggc

SEQ ID NO: 1093554 - RNA, 13 nt, Mycobacterium bovis subsp bovis AF2122/97
cgugcuggcgacg

SEQ ID NO: 1093555 - RNA, 16 nt, Mycobacterium bovis subsp bovis AF2122/97
cgugcugggccgacgg

SEQ ID NO: 1093556 - RNA, 18 nt, Mycobacterium bovis subsp bovis AF2122/97
cgugcugggccgacggga

SEQ ID NO: 1093557 - RNA, 17 nt, Mycobacterium bovis subsp bovis AF2122/97
cgugcugggcgccgcgc

SEQ ID NO: 1093558 - RNA, 22 nt, Mycobacterium bovis subsp bovis AF2122/97
cgugcugggcaucaccgacgcg

SEQ ID NO: 1093559 - RNA, 15 nt, Mycobacterium bovis subsp bovis AF2122/97
cgugcugggccgacg

SEQ ID NO: 1093560 - RNA, 15 nt, Mycobacterium bovis subsp bovis AF2122/97
cgugcuggcgccgaa

SEQ ID NO: 1093561 - RNA, 20 nt, Mycobacterium bovis subsp bovis AF2122/97
cgugcugggugacaccggug

SEQ ID NO: 1093562 - RNA, 21 nt, Mycobacterium bovis subsp bovis AF2122/97
cgugcuguggaugccgacggc

SEQ ID NO: 1093563 - RNA, 22 nt, Mycobacterium bovis subsp bovis AF2122/97
cgugcuguggaugccgacggcg

SEQ ID NO: 1093564 - RNA, 17 nt, Mycobacterium bovis subsp bovis AF2122/97
cgugcuuccauucgcgg

SEQ ID NO: 1093565 - RNA, 21 nt, Mycobacterium bovis subsp bovis AF2122/97
cguggaucucuuucggaugca

SEQ ID NO: 1093566 - RNA, 22 nt, Mycobacterium bovis subsp bovis AF2122/97
cguggaucugaagagcggagcc

SEQ ID NO: 1093567 - RNA, 14 nt, Mycobacterium bovis subsp bovis AF2122/97
cguggauggccgcc

SEQ ID NO: 1093568 - RNA, 22 nt, Mycobacterium bovis subsp bovis AF2122/97
cguggaguggacugagucguag

SEQ ID NO: 1093569 - RNA, 14 nt, Mycobacterium bovis subsp bovis AF2122/97
cgugcuugcccggu

SEQ ID NO: 1093570 - RNA, 15 nt, Mycobacterium bovis subsp bovis AF2122/97
cgugcuugcccgguu

SEQ ID NO: 1093571 - RNA, 20 nt, Mycobacterium bovis subsp bovis AF2122/97
cgugcucgacgcgcaucgca

SEQ ID NO: 1093572 - RNA, 21 nt, Mycobacterium bovis subsp bovis AF2122/97
cguggagcucacgugcugccg

SEQ ID NO: 1093573 - RNA, 22 nt, Mycobacterium bovis subsp bovis AF2122/97
cguggagcucacgugcugccga

SEQ ID NO: 1093574 - RNA, 15 nt, Mycobacterium bovis subsp bovis AF2122/97
cuaggcccagcacgg

SEQ ID NO: 1093575 - RNA, 16 nt, Mycobacterium bovis subsp bovis AF2122/97
cuaggccccuggccgc

SEQ ID NO: 1093576 - RNA, 19 nt, Mycobacterium bovis subsp bovis AF2122/97
cuaggccaagccgcggcua

SEQ ID NO: 1093577 - RNA, 15 nt, Mycobacterium bovis subsp bovis AF2122/97
cuaggccaccggcga

SEQ ID NO: 1093578 - RNA, 14 nt, Mycobacterium bovis subsp bovis AF2122/97
cuagggucaccgac

SEQ ID NO: 1093579 - RNA, 13 nt, Mycobacterium bovis subsp bovis AF2122/97
cuaggucagcggg

SEQ ID NO: 1093580 - RNA, 14 nt, Mycobacterium bovis subsp bovis AF2122/97
cuaggucagcgggc

SEQ ID NO: 1093581 - RNA, 18 nt, Mycobacterium bovis subsp bovis AF2122/97
cuaggucgcgcugaaggu

SEQ ID NO: 1093582 - RNA, 19 nt, Mycobacterium bovis subsp bovis AF2122/97
cuaggugacgccgccagca

SEQ ID NO: 1093583 - RNA, 21 nt, Mycobacterium bovis subsp bovis AF2122/97
cuagguggacgugcagccgca

SEQ ID NO: 1093584 - RNA, 18 nt, Mycobacterium bovis subsp bovis AF2122/97
cuaggugugcgacgacgg

SEQ ID NO: 1093585 - RNA, 11 nt, Mycobacterium bovis subsp bovis AF2122/97
cuagguucagu

SEQ ID NO: 1093586 - RNA, 18 nt, Mycobacterium bovis subsp bovis AF2122/97
cuaggacggcgcgagccg

SEQ ID NO: 1093587 - RNA, 19 nt, Mycobacterium bovis subsp bovis AF2122/97
cuaggacggcgcgagccgc

SEQ ID NO: 1093588 - RNA, 20 nt, Mycobacterium bovis subsp bovis AF2122/97
cuaggccaaaccccugcacg

SEQ ID NO: 1093589 - RNA, 15 nt, Mycobacterium bovis subsp bovis AF2122/97
cuagcuuggcggcca

SEQ ID NO: 1093590 - RNA, 18 nt, Mycobacterium bovis subsp bovis AF2122/97
cuagcuggugcgcccgac

SEQ ID NO: 1093591 - RNA, 21 nt, Mycobacterium bovis subsp bovis AF2122/97
cuagcggcucaccgcgcauca

SEQ ID NO: 1093592 - RNA, 18 nt, Mycobacterium bovis subsp bovis AF2122/97
cuagcggucgcuugcugu

SEQ ID NO: 1093593 - RNA, 19 nt, Mycobacterium bovis subsp bovis AF2122/97
cuagcgguggaaaaagccc

SEQ ID NO: 1093594 - RNA, 15 nt, Mycobacterium bovis subsp bovis AF2122/97
cuagcgcggcgacga

SEQ ID NO: 1093595 - RNA, 19 nt, Mycobacterium bovis subsp bovis AF2122/97
cuagcgcuauaggccgcau

SEQ ID NO: 1093596 - RNA, 15 nt, Mycobacterium bovis subsp bovis AF2122/97
cuagcggcucaccgc

SEQ ID NO: 1093597 - RNA, 13 nt, Mycobacterium bovis subsp bovis AF2122/97
cuacugcgaucgc

SEQ ID NO: 1093598 - RNA, 20 nt, Mycobacterium bovis subsp bovis AF2122/97
cuagcgccaaauccggcuug

SEQ ID NO: 1093599 - RNA, 15 nt, Mycobacterium bovis subsp bovis AF2122/97
cuagcgccucgccgg

SEQ ID NO: 1093600 - RNA, 21 nt, Mycobacterium bovis subsp bovis AF2122/97
cuagcgccucgccggccaccc

SEQ ID NO: 1093601 - RNA, 23 nt, Mycobacterium bovis subsp bovis AF2122/97
cuagcgagccggcgccgggucga

SEQ ID NO: 1093602 - RNA, 16 nt, Mycobacterium bovis subsp bovis AF2122/97
cuagacgccgccgcug

SEQ ID NO: 1093603 - RNA, 17 nt, Mycobacterium bovis subsp bovis AF2122/97
cuacccggucgccgguc

SEQ ID NO: 1093604 - RNA, 16 nt, Mycobacterium bovis subsp bovis AF2122/97
cuacccgcggcgcgaa

SEQ ID NO: 1093605 - RNA, 19 nt, Mycobacterium bovis subsp bovis AF2122/97
cuaccgagaucaccgccac

SEQ ID NO: 1093606 - RNA, 20 nt, Mycobacterium bovis subsp bovis AF2122/97
cuaccgagauugggcuggga

SEQ ID NO: 1093607 - RNA, 18 nt, Mycobacterium bovis subsp bovis AF2122/97
cuaccgccuugucggcga

SEQ ID NO: 1093608 - RNA, 14 nt, Mycobacterium bovis subsp bovis AF2122/97
cuaccgcccgcgcc

SEQ ID NO: 1093609 - RNA, 15 nt, Mycobacterium bovis subsp bovis AF2122/97
cuaccgcccgcgcca

SEQ ID NO: 1093610 - RNA, 20 nt, Mycobacterium bovis subsp bovis AF2122/97
cuaccgccggcggcggccgc

SEQ ID NO: 1093611 - RNA, 21 nt, Mycobacterium bovis subsp bovis AF2122/97
cuaccgccggcggcggccgca

SEQ ID NO: 1093612 - RNA, 20 nt, Mycobacterium bovis subsp bovis AF2122/97
cuaccgcccgcgccaccggc

SEQ ID NO: 1093613 - RNA, 14 nt, Mycobacterium bovis subsp bovis AF2122/97
cuaccgccgaccgg

SEQ ID NO: 1093614 - RNA, 20 nt, Mycobacterium bovis subsp bovis AF2122/97
cuaccgguccgucaccaccg

SEQ ID NO: 1093615 - RNA, 21 nt, Mycobacterium bovis subsp bovis AF2122/97
cuaccuaacccgcgccggccg

SEQ ID NO: 1093616 - RNA, 22 nt, Mycobacterium bovis subsp bovis AF2122/97
cuaccuaacccgcgccggccgc

SEQ ID NO: 1093617 - RNA, 14 nt, Mycobacterium bovis subsp bovis AF2122/97
cuaccuccgccacc

SEQ ID NO: 1093618 - RNA, 15 nt, Mycobacterium bovis subsp bovis AF2122/97
cuaccuccgccacca

SEQ ID NO: 1093619 - RNA, 16 nt, Mycobacterium bovis subsp bovis AF2122/97
cuaccgcuucccccgg

SEQ ID NO: 1093620 - RNA, 18 nt, Mycobacterium bovis subsp bovis AF2122/97
cuaccggcgugucacguc

SEQ ID NO: 1093621 - RNA, 18 nt, Mycobacterium bovis subsp bovis AF2122/97
cuaccggcuacggcgaca

SEQ ID NO: 1093622 - RNA, 20 nt, Mycobacterium bovis subsp bovis AF2122/97
cuaccgccuugucggcgaug

SEQ ID NO: 1093623 - RNA, 17 nt, Mycobacterium bovis subsp bovis AF2122/97
cuaccgccuuugcccgc

SEQ ID NO: 1093624 - RNA, 14 nt, Mycobacterium bovis subsp bovis AF2122/97
cuacgccccacugc

SEQ ID NO: 1093625 - RNA, 13 nt, Mycobacterium bovis subsp bovis AF2122/97
cuacgacggcgcc

SEQ ID NO: 1093626 - RNA, 19 nt, Mycobacterium bovis subsp bovis AF2122/97
cuacgacgguccguucgcg

SEQ ID NO: 1093627 - RNA, 15 nt, Mycobacterium bovis subsp bovis AF2122/97
cuaccuuggacucgg

SEQ ID NO: 1093628 - RNA, 15 nt, Mycobacterium bovis subsp bovis AF2122/97
cuacgcgcgcucgcu

SEQ ID NO: 1093629 - RNA, 17 nt, Mycobacterium bovis subsp bovis AF2122/97
cuacgcgcgcucgcuca

SEQ ID NO: 1093630 - RNA, 21 nt, Mycobacterium bovis subsp bovis AF2122/97
cuacgcgcgcucgcucaccgg

SEQ ID NO: 1093631 - RNA, 22 nt, Mycobacterium bovis subsp bovis AF2122/97
cuacgcgcgcucgcucaccggc

SEQ ID NO: 1093632 - RNA, 20 nt, Mycobacterium bovis subsp bovis AF2122/97
cuacgcggccgaggucaccc

SEQ ID NO: 1093633 - RNA, 18 nt, Mycobacterium bovis subsp bovis AF2122/97
cuaccaacaccgcccgca

SEQ ID NO: 1093634 - RNA, 15 nt, Mycobacterium bovis subsp bovis AF2122/97
cuaccagcugggcga

SEQ ID NO: 1093635 - RNA, 15 nt, Mycobacterium bovis subsp bovis AF2122/97
cuacccaccggccgg

SEQ ID NO: 1093636 - RNA, 17 nt, Mycobacterium bovis subsp bovis AF2122/97
cuacccauggcccguug

SEQ ID NO: 1093637 - RNA, 21 nt, Mycobacterium bovis subsp bovis AF2122/97
cuaccccagggagugccgcac

SEQ ID NO: 1093638 - RNA, 14 nt, Mycobacterium bovis subsp bovis AF2122/97
cuacaucggcggcg

SEQ ID NO: 1093639 - RNA, 19 nt, Mycobacterium bovis subsp bovis AF2122/97
cuacaucgucgagcgcggu

SEQ ID NO: 1093640 - RNA, 11 nt, Mycobacterium bovis subsp bovis AF2122/97
cuaccaccgcg

SEQ ID NO: 1093641 - RNA, 18 nt, Mycobacterium bovis subsp bovis AF2122/97
cuaccacggaggguugcc

SEQ ID NO: 1093642 - RNA, 22 nt, Mycobacterium bovis subsp bovis AF2122/97
cuaccacggaggguugccgccg

SEQ ID NO: 1093643 - RNA, 18 nt, Mycobacterium bovis subsp bovis AF2122/97
cuacaucgaucagaugcg

SEQ ID NO: 1093644 - RNA, 19 nt, Mycobacterium bovis subsp bovis AF2122/97
cuacaugggggcguuggcg

SEQ ID NO: 1093645 - RNA, 22 nt, Mycobacterium bovis subsp bovis AF2122/97
cuacaugggggcguuggcgggc

SEQ ID NO: 1093646 - RNA, 20 nt, Mycobacterium bovis subsp bovis AF2122/97
cuacacaggaagcguugucg

SEQ ID NO: 1093647 - RNA, 21 nt, Mycobacterium bovis subsp bovis AF2122/97
cuacaccggcaagccacgccg

SEQ ID NO: 1093648 - RNA, 18 nt, Mycobacterium bovis subsp bovis AF2122/97
cuacagcguugccaggug

SEQ ID NO: 1093649 - RNA, 15 nt, Mycobacterium bovis subsp bovis AF2122/97
cuaauucgccucgcc

SEQ ID NO: 1093650 - RNA, 21 nt, Mycobacterium bovis subsp bovis AF2122/97
cuaacuggacuggggcgccac

SEQ ID NO: 1093651 - RNA, 13 nt, Mycobacterium bovis subsp bovis AF2122/97
cuaaggcucacca

SEQ ID NO: 1093652 - RNA, 16 nt, Mycobacterium bovis subsp bovis AF2122/97
cuaaggcucaccaggc

SEQ ID NO: 1093653 - RNA, 18 nt, Mycobacterium bovis subsp bovis AF2122/97
cuaaggcucaccaggcga

SEQ ID NO: 1093654 - RNA, 19 nt, Mycobacterium bovis subsp bovis AF2122/97
cuaaguccccgcuuggcga

SEQ ID NO: 1093655 - RNA, 21 nt, Mycobacterium bovis subsp bovis AF2122/97
cuaaguucgccacgcccgacg

SEQ ID NO: 1093656 - RNA, 22 nt, Mycobacterium bovis subsp bovis AF2122/97
cuaaugugaccaacccggcucg

SEQ ID NO: 1093657 - RNA, 21 nt, Mycobacterium bovis subsp bovis AF2122/97
cuaaugucgauuucgaugacg

SEQ ID NO: 1093658 - RNA, 17 nt, Mycobacterium bovis subsp bovis AF2122/97
cguuggccgggcacgcg

SEQ ID NO: 1093659 - RNA, 15 nt, Mycobacterium bovis subsp bovis AF2122/97
cguuggcgaucucga

SEQ ID NO: 1093660 - RNA, 17 nt, Mycobacterium bovis subsp bovis AF2122/97
cguuggcgaccaccgcg

SEQ ID NO: 1093661 - RNA, 19 nt, Mycobacterium bovis subsp bovis AF2122/97
cguuggcgaucucgacggc

SEQ ID NO: 1093662 - RNA, 17 nt, Mycobacterium bovis subsp bovis AF2122/97
cguuggcaggcagguug

SEQ ID NO: 1093663 - RNA, 14 nt, Mycobacterium bovis subsp bovis AF2122/97
cguuggcgccacca

SEQ ID NO: 1093664 - RNA, 12 nt, Mycobacterium bovis subsp bovis AF2122/97
cguuggcucgag

SEQ ID NO: 1093665 - RNA, 14 nt, Mycobacterium bovis subsp bovis AF2122/97
cguuggcucgagcc

SEQ ID NO: 1093666 - RNA, 17 nt, Mycobacterium bovis subsp bovis AF2122/97
cguuggcgugcaccgca

SEQ ID NO: 1093667 - RNA, 16 nt, Mycobacterium bovis subsp bovis AF2122/97
cguuggcgugcucacc

SEQ ID NO: 1093668 - RNA, 14 nt, Mycobacterium bovis subsp bovis AF2122/97
cguuggcggcucgc

SEQ ID NO: 1093669 - RNA, 15 nt, Mycobacterium bovis subsp bovis AF2122/97
cguuggcggcucgcg

SEQ ID NO: 1093670 - RNA, 20 nt, Mycobacterium bovis subsp bovis AF2122/97
cguuggcgguaaaccacucg

SEQ ID NO: 1093671 - RNA, 16 nt, Mycobacterium bovis subsp bovis AF2122/97
cguuggcggcgguggc

SEQ ID NO: 1093672 - RNA, 15 nt, Mycobacterium bovis subsp bovis AF2122/97
cguuggcgcgguugc

SEQ ID NO: 1093673 - RNA, 15 nt, Mycobacterium bovis subsp bovis AF2122/97
cguuggcggccagcg

SEQ ID NO: 1093674 - RNA, 17 nt, Mycobacterium bovis subsp bovis AF2122/97
cguuggcggaugcccgc

SEQ ID NO: 1093675 - RNA, 13 nt, Mycobacterium bovis subsp bovis AF2122/97
cguugggccgacu

SEQ ID NO: 1093676 - RNA, 21 nt, Mycobacterium bovis subsp bovis AF2122/97
cguugggcgggauggccgccg

SEQ ID NO: 1093677 - RNA, 23 nt, Mycobacterium bovis subsp bovis AF2122/97
cguugggcgggauggccgccgac

SEQ ID NO: 1093678 - RNA, 21 nt, Mycobacterium bovis subsp bovis AF2122/97
cguuggggccguucaaccgga

SEQ ID NO: 1093679 - RNA, 18 nt, Mycobacterium bovis subsp bovis AF2122/97
cguugggaccagugcggu

SEQ ID NO: 1093680 - RNA, 22 nt, Mycobacterium bovis subsp bovis AF2122/97
cguugggaucccagcgcagcgg

SEQ ID NO: 1093681 - RNA, 22 nt, Mycobacterium bovis subsp bovis AF2122/97
cguuggcuggugcaggugacga

SEQ ID NO: 1093682 - RNA, 18 nt, Mycobacterium bovis subsp bovis AF2122/97
cguugggaucgcgcagcg

SEQ ID NO: 1093683 - RNA, 14 nt, Mycobacterium bovis subsp bovis AF2122/97
cguugggaugacac

SEQ ID NO: 1093684 - RNA, 23 nt, Mycobacterium bovis subsp bovis AF2122/97
cguugguccgcugcagcaccgca

SEQ ID NO: 1093685 - RNA, 18 nt, Mycobacterium bovis subsp bovis AF2122/97
cguuggugaggccccccg

SEQ ID NO: 1093686 - RNA, 21 nt, Mycobacterium bovis subsp bovis AF2122/97
cguugguagccggugaccgcg

SEQ ID NO: 1093687 - RNA, 22 nt, Mycobacterium bovis subsp bovis AF2122/97
cguugguagccggugaccgcga

SEQ ID NO: 1093688 - RNA, 17 nt, Mycobacterium bovis subsp bovis AF2122/97
cguuguaugcguuacgc

SEQ ID NO: 1093689 - RNA, 16 nt, Mycobacterium bovis subsp bovis AF2122/97
cguuguacucgugcgg

SEQ ID NO: 1093690 - RNA, 21 nt, Mycobacterium bovis subsp bovis AF2122/97
cguuguaugcguuacgccgcg

SEQ ID NO: 1093691 - RNA, 20 nt, Mycobacterium bovis subsp bovis AF2122/97
cguugucagcgaacggccag

SEQ ID NO: 1093692 - RNA, 14 nt, Mycobacterium bovis subsp bovis AF2122/97
cguugguggucggc

SEQ ID NO: 1093693 - RNA, 21 nt, Mycobacterium bovis subsp bovis AF2122/97
cguugggcaugucgccgaacg

SEQ ID NO: 1093694 - RNA, 21 nt, Mycobacterium bovis subsp bovis AF2122/97
cguugucggcggggcgccgga

SEQ ID NO: 1093695 - RNA, 16 nt, Mycobacterium bovis subsp bovis AF2122/97
cguuguccagaacggc

SEQ ID NO: 1093696 - RNA, 18 nt, Mycobacterium bovis subsp bovis AF2122/97
cguugugcccgccggccc

SEQ ID NO: 1093697 - RNA, 15 nt, Mycobacterium bovis subsp bovis AF2122/97
cguugugcagcgcgu

SEQ ID NO: 1093698 - RNA, 12 nt, Mycobacterium bovis subsp bovis AF2122/97
cguuguugucgc

SEQ ID NO: 1093699 - RNA, 15 nt, Mycobacterium bovis subsp bovis AF2122/97
cguuguugggcgagg

SEQ ID NO: 1093700 - RNA, 18 nt, Mycobacterium bovis subsp bovis AF2122/97
cguuguugggcgagggug

SEQ ID NO: 1093701 - RNA, 18 nt, Mycobacterium bovis subsp bovis AF2122/97
cguuguucaccgacgcga

SEQ ID NO: 1093702 - RNA, 20 nt, Mycobacterium bovis subsp bovis AF2122/97
cguugugucaccggcgucgc

SEQ ID NO: 1093703 - RNA, 17 nt, Mycobacterium bovis subsp bovis AF2122/97
cguuuacauagaccacc

SEQ ID NO: 1093704 - RNA, 22 nt, Mycobacterium bovis subsp bovis AF2122/97
cguuucacccgggcugcuugcg

SEQ ID NO: 1093705 - RNA, 22 nt, Mycobacterium bovis subsp bovis AF2122/97
cguuucccggguccuggaucag

SEQ ID NO: 1093706 - RNA, 16 nt, Mycobacterium bovis subsp bovis AF2122/97
cguuucccuggccgcc

SEQ ID NO: 1093707 - RNA, 18 nt, Mycobacterium bovis subsp bovis AF2122/97
cguuucccuggccgccgc

SEQ ID NO: 1093708 - RNA, 13 nt, Mycobacterium bovis subsp bovis AF2122/97
cguuuccgccgcc

SEQ ID NO: 1093709 - RNA, 15 nt, Mycobacterium bovis subsp bovis AF2122/97
cguuuccgccgccgc

SEQ ID NO: 1093710 - RNA, 19 nt, Mycobacterium bovis subsp bovis AF2122/97
cguuuccucagcugcucgu

SEQ ID NO: 1093711 - RNA, 16 nt, Mycobacterium bovis subsp bovis AF2122/97
cguuucgccagccggc

SEQ ID NO: 1093712 - RNA, 21 nt, Mycobacterium bovis subsp bovis AF2122/97
cguuucgccagccggccgcga

SEQ ID NO: 1093713 - RNA, 17 nt, Mycobacterium bovis subsp bovis AF2122/97
cguuucuccgccgccca

SEQ ID NO: 1093714 - RNA, 12 nt, Mycobacterium bovis subsp bovis AF2122/97
cguuugacgcgc

SEQ ID NO: 1093715 - RNA, 18 nt, Mycobacterium bovis subsp bovis AF2122/97
cguuugagcggccaccgu

SEQ ID NO: 1093716 - RNA, 17 nt, Mycobacterium bovis subsp bovis AF2122/97
cguuugaacuucgccgu

SEQ ID NO: 1093717 - RNA, 16 nt, Mycobacterium bovis subsp bovis AF2122/97
cguuucgcgacgucug

SEQ ID NO: 1093718 - RNA, 14 nt, Mycobacterium bovis subsp bovis AF2122/97
cguuuggcugccga

SEQ ID NO: 1093719 - RNA, 20 nt, Mycobacterium bovis subsp bovis AF2122/97
cguuugcgccguugcccccg

SEQ ID NO: 1093720 - RNA, 22 nt, Mycobacterium bovis subsp bovis AF2122/97
cguuuguguugaacgcguagag

SEQ ID NO: 1093721 - RNA, 20 nt, Mycobacterium bovis subsp bovis AF2122/97
cguuuuccgggcuguucgcg

SEQ ID NO: 1093722 - RNA, 16 nt, Mycobacterium bovis subsp bovis AF2122/97
cguuuuccugaucgcg

SEQ ID NO: 1093723 - RNA, 20 nt, Mycobacterium bovis subsp bovis AF2122/97
cguuuugggugaucgcacag

SEQ ID NO: 1093724 - RNA, 14 nt, Mycobacterium bovis subsp bovis AF2122/97
cuaacccgcaccgg

SEQ ID NO: 1093725 - RNA, 20 nt, Mycobacterium bovis subsp bovis AF2122/97
cuaacccgcaccuacccugc

SEQ ID NO: 1093726 - RNA, 15 nt, Mycobacterium bovis subsp bovis AF2122/97
cuaacccgcgccggc

SEQ ID NO: 1093727 - RNA, 19 nt, Mycobacterium bovis subsp bovis AF2122/97
cuaacgcaccugcgcgcgg

SEQ ID NO: 1093728 - RNA, 17 nt, Mycobacterium bovis subsp bovis AF2122/97
cuaacggcagccaccgu

SEQ ID NO: 1093729 - RNA, 14 nt, Mycobacterium bovis subsp bovis AF2122/97
cuaacggucagcuu

SEQ ID NO: 1093730 - RNA, 20 nt, Mycobacterium bovis subsp bovis AF2122/97
cuaacgucgaucucggcgca

SEQ ID NO: 1093731 - RNA, 18 nt, Mycobacterium bovis subsp bovis AF2122/97
cuaaccccggcucgacgc

SEQ ID NO: 1093732 - RNA, 14 nt, Mycobacterium bovis subsp bovis AF2122/97
cuaacaacaccacc

SEQ ID NO: 1093733 - RNA, 12 nt, Mycobacterium bovis subsp bovis AF2122/97
cuaaaccagcca

SEQ ID NO: 1093734 - RNA, 19 nt, Mycobacterium bovis subsp bovis AF2122/97
cuaaacaggccgccaccgu

SEQ ID NO: 1093735 - RNA, 12 nt, Mycobacterium bovis subsp bovis AF2122/97
cggucugcucca

SEQ ID NO: 1093736 - RNA, 20 nt, Mycobacterium bovis subsp bovis AF2122/97
cggucuggcccgcgacaucg

SEQ ID NO: 1093737 - RNA, 21 nt, Mycobacterium bovis subsp bovis AF2122/97
cggucuggacaucggccggcg

SEQ ID NO: 1093738 - RNA, 20 nt, Mycobacterium bovis subsp bovis AF2122/97
cggucuggaucagaucccgc

SEQ ID NO: 1093739 - RNA, 23 nt, Mycobacterium bovis subsp bovis AF2122/97
cggucugcgccuucgccagcggc

SEQ ID NO: 1093740 - RNA, 17 nt, Mycobacterium bovis subsp bovis AF2122/97
cggucuugcaucgccaa

SEQ ID NO: 1093741 - RNA, 15 nt, Mycobacterium bovis subsp bovis AF2122/97
cggucuugcaucgcc

SEQ ID NO: 1093742 - RNA, 13 nt, Mycobacterium bovis subsp bovis AF2122/97
cggucuggugguc

SEQ ID NO: 1093743 - RNA, 14 nt, Mycobacterium bovis subsp bovis AF2122/97
cggucuggcgauga

SEQ ID NO: 1093744 - RNA, 20 nt, Mycobacterium bovis subsp bovis AF2122/97
cggucugguugucgaucucg

SEQ ID NO: 1093745 - RNA, 15 nt, Mycobacterium bovis subsp bovis AF2122/97
cggucugugcugcgc

SEQ ID NO: 1093746 - RNA, 16 nt, Mycobacterium bovis subsp bovis AF2122/97
cggucucgaccgcgcc

SEQ ID NO: 1093747 - RNA, 15 nt, Mycobacterium bovis subsp bovis AF2122/97
cggucucgacggcgg

SEQ ID NO: 1093748 - RNA, 17 nt, Mycobacterium bovis subsp bovis AF2122/97
cggucucgacggcggcc

SEQ ID NO: 1093749 - RNA, 16 nt, Mycobacterium bovis subsp bovis AF2122/97
cggucucgagucgguu

SEQ ID NO: 1093750 - RNA, 14 nt, Mycobacterium bovis subsp bovis AF2122/97
cggucucguaacca

SEQ ID NO: 1093751 - RNA, 18 nt, Mycobacterium bovis subsp bovis AF2122/97
cggucucggcgucgacca

SEQ ID NO: 1093752 - RNA, 22 nt, Mycobacterium bovis subsp bovis AF2122/97
cggucuccaccaccgacgagga

SEQ ID NO: 1093753 - RNA, 19 nt, Mycobacterium bovis subsp bovis AF2122/97
cggucuccccagagcuggu

SEQ ID NO: 1093754 - RNA, 18 nt, Mycobacterium bovis subsp bovis AF2122/97
cggucuauuugccugccg

SEQ ID NO: 1093755 - RNA, 15 nt, Mycobacterium bovis subsp bovis AF2122/97
cggucucacggcgcg

SEQ ID NO: 1093756 - RNA, 17 nt, Mycobacterium bovis subsp bovis AF2122/97
cggucucacggcgcgag

SEQ ID NO: 1093757 - RNA, 16 nt, Mycobacterium bovis subsp bovis AF2122/97
cggucucaugcacccg

SEQ ID NO: 1093758 - RNA, 12 nt, Mycobacterium bovis subsp bovis AF2122/97
cggucguggucc

SEQ ID NO: 1093759 - RNA, 15 nt, Mycobacterium bovis subsp bovis AF2122/97
cggucguuggucggg

SEQ ID NO: 1093760 - RNA, 22 nt, Mycobacterium bovis subsp bovis AF2122/97
cggucguugccgcggucggcga

SEQ ID NO: 1093761 - RNA, 18 nt, Mycobacterium bovis subsp bovis AF2122/97
cggugaaggccccgccgg

SEQ ID NO: 1093762 - RNA, 15 nt, Mycobacterium bovis subsp bovis AF2122/97
cggugaacugcuggc

SEQ ID NO: 1093763 - RNA, 22 nt, Mycobacterium bovis subsp bovis AF2122/97
cggugaacuucuccaccagcgu

SEQ ID NO: 1093764 - RNA, 18 nt, Mycobacterium bovis subsp bovis AF2122/97
cggugaagaaguucgggu

SEQ ID NO: 1093765 - RNA, 20 nt, Mycobacterium bovis subsp bovis AF2122/97
cggugaagaaguucggguag

SEQ ID NO: 1093766 - RNA, 21 nt, Mycobacterium bovis subsp bovis AF2122/97
cggugaacggcaaggucgcgg

SEQ ID NO: 1093767 - RNA, 20 nt, Mycobacterium bovis subsp bovis AF2122/97
cggugaacggcagcacgguc

SEQ ID NO: 1093768 - RNA, 18 nt, Mycobacterium bovis subsp bovis AF2122/97
cggugaacgccgccccga

SEQ ID NO: 1093769 - RNA, 18 nt, Mycobacterium bovis subsp bovis AF2122/97
cggugaacaaaugccggu

SEQ ID NO: 1093770 - RNA, 17 nt, Mycobacterium bovis subsp bovis AF2122/97
cggugaaaaaggcgacu

SEQ ID NO: 1093771 - RNA, 21 nt, Mycobacterium bovis subsp bovis AF2122/97
cggugaaaccggccuucucgc

SEQ ID NO: 1093772 - RNA, 23 nt, Mycobacterium bovis subsp bovis AF2122/97
cggucuuuggcauugccgccagc

SEQ ID NO: 1093773 - RNA, 17 nt, Mycobacterium bovis subsp bovis AF2122/97
cggucuuggcgcgccca

SEQ ID NO: 1093774 - RNA, 21 nt, Mycobacterium bovis subsp bovis AF2122/97
cggucuuuaauccagcgccga

SEQ ID NO: 1093775 - RNA, 15 nt, Mycobacterium bovis subsp bovis AF2122/97
cggugaaacgaucgu

SEQ ID NO: 1093776 - RNA, 19 nt, Mycobacterium bovis subsp bovis AF2122/97
cggugaaacgaucgugcga

SEQ ID NO: 1093777 - RNA, 22 nt, Mycobacterium bovis subsp bovis AF2122/97
cggugaaacgaucgugcgaucg

SEQ ID NO: 1093778 - RNA, 16 nt, Mycobacterium bovis subsp bovis AF2122/97
cggugaaaucgcacag

SEQ ID NO: 1093779 - RNA, 23 nt, Mycobacterium bovis subsp bovis AF2122/97
cggugaccagcaaccaccccagg

SEQ ID NO: 1093780 - RNA, 20 nt, Mycobacterium bovis subsp bovis AF2122/97
cggugacaagcggcccgcug

SEQ ID NO: 1093781 - RNA, 14 nt, Mycobacterium bovis subsp bovis AF2122/97
cggugaccaccccg

SEQ ID NO: 1093782 - RNA, 15 nt, Mycobacterium bovis subsp bovis AF2122/97
cggugaccgcgaugu

SEQ ID NO: 1093783 - RNA, 12 nt, Mycobacterium bovis subsp bovis AF2122/97
cggugacccgcu

SEQ ID NO: 1093784 - RNA, 12 nt, Mycobacterium bovis subsp bovis AF2122/97
cggugaccgcga

SEQ ID NO: 1093785 - RNA, 18 nt, Mycobacterium bovis subsp bovis AF2122/97
cggugaauucacgaugcu

SEQ ID NO: 1093786 - RNA, 22 nt, Mycobacterium bovis subsp bovis AF2122/97
cggugaaguccuccacgcuggc

SEQ ID NO: 1093787 - RNA, 21 nt, Mycobacterium bovis subsp bovis AF2122/97
cggugaaguggcgcaccaccu

SEQ ID NO: 1093788 - RNA, 16 nt, Mycobacterium bovis subsp bovis AF2122/97
cggugaagccgagcgc

SEQ ID NO: 1093789 - RNA, 19 nt, Mycobacterium bovis subsp bovis AF2122/97
cggugaaguagugcucgca

SEQ ID NO: 1093790 - RNA, 15 nt, Mycobacterium bovis subsp bovis AF2122/97
cggugaauucggcga

SEQ ID NO: 1093791 - RNA, 17 nt, Mycobacterium bovis subsp bovis AF2122/97
cggugacaccaacaccg

SEQ ID NO: 1093792 - RNA, 18 nt, Mycobacterium bovis subsp bovis AF2122/97
cggugacaccaacaccgg

SEQ ID NO: 1093793 - RNA, 19 nt, Mycobacterium bovis subsp bovis AF2122/97
cggugacaccaacaccggu

SEQ ID NO: 1093794 - RNA, 20 nt, Mycobacterium bovis subsp bovis AF2122/97
cggugacaccaacaccggug

SEQ ID NO: 1093795 - RNA, 16 nt, Mycobacterium bovis subsp bovis AF2122/97
cggucggccaggccgu

SEQ ID NO: 1093796 - RNA, 16 nt, Mycobacterium bovis subsp bovis AF2122/97
cggucggccauccacc

SEQ ID NO: 1093797 - RNA, 18 nt, Mycobacterium bovis subsp bovis AF2122/97
cggucggccauccaccgc

SEQ ID NO: 1093798 - RNA, 20 nt, Mycobacterium bovis subsp bovis AF2122/97
cggucggccauugcccgggc

SEQ ID NO: 1093799 - RNA, 21 nt, Mycobacterium bovis subsp bovis AF2122/97
cggucggccauugcccgggcg

SEQ ID NO: 1093800 - RNA, 12 nt, Mycobacterium bovis subsp bovis AF2122/97
cggucggcggca

SEQ ID NO: 1093801 - RNA, 13 nt, Mycobacterium bovis subsp bovis AF2122/97
cggucggcggccg

SEQ ID NO: 1093802 - RNA, 14 nt, Mycobacterium bovis subsp bovis AF2122/97
cggucggcggccgc

SEQ ID NO: 1093803 - RNA, 15 nt, Mycobacterium bovis subsp bovis AF2122/97
cggucggcggccgcc

SEQ ID NO: 1093804 - RNA, 16 nt, Mycobacterium bovis subsp bovis AF2122/97
cggucggcggccgcca

SEQ ID NO: 1093805 - RNA, 19 nt, Mycobacterium bovis subsp bovis AF2122/97
cggucggcgaccaccagcg

SEQ ID NO: 1093806 - RNA, 13 nt, Mycobacterium bovis subsp bovis AF2122/97
cggucggcgacgu

SEQ ID NO: 1093807 - RNA, 15 nt, Mycobacterium bovis subsp bovis AF2122/97
cggucggcgacguag

SEQ ID NO: 1093808 - RNA, 21 nt, Mycobacterium bovis subsp bovis AF2122/97
cggucggaucgauuccgccgc

SEQ ID NO: 1093809 - RNA, 16 nt, Mycobacterium bovis subsp bovis AF2122/97
cggucggaucggcgcc

SEQ ID NO: 1093810 - RNA, 14 nt, Mycobacterium bovis subsp bovis AF2122/97
cggucggaucggug

SEQ ID NO: 1093811 - RNA, 21 nt, Mycobacterium bovis subsp bovis AF2122/97
cggucggagucgagcacaccg

SEQ ID NO: 1093812 - RNA, 23 nt, Mycobacterium bovis subsp bovis AF2122/97
cggucggagucgagcacaccgag

SEQ ID NO: 1093813 - RNA, 19 nt, Mycobacterium bovis subsp bovis AF2122/97
cggucggacggccaucgcc

SEQ ID NO: 1093814 - RNA, 22 nt, Mycobacterium bovis subsp bovis AF2122/97
cggucggacggccaucgccagc

SEQ ID NO: 1093815 - RNA, 22 nt, Mycobacterium bovis subsp bovis AF2122/97
cggucggaaugccgucgccggu

SEQ ID NO: 1093816 - RNA, 17 nt, Mycobacterium bovis subsp bovis AF2122/97
cggucggaccacccggc

SEQ ID NO: 1093817 - RNA, 12 nt, Mycobacterium bovis subsp bovis AF2122/97
cggucggcacca

SEQ ID NO: 1093818 - RNA, 13 nt, Mycobacterium bovis subsp bovis AF2122/97
cggucggcaccac

SEQ ID NO: 1093819 - RNA, 20 nt, Mycobacterium bovis subsp bovis AF2122/97
cggucggcaccaccacgccg

SEQ ID NO: 1093820 - RNA, 12 nt, Mycobacterium bovis subsp bovis AF2122/97
cggucggcagcg

SEQ ID NO: 1093821 - RNA, 15 nt, Mycobacterium bovis subsp bovis AF2122/97
cggucggcagcgacg

SEQ ID NO: 1093822 - RNA, 12 nt, Mycobacterium bovis subsp bovis AF2122/97
cggucggcagcu

SEQ ID NO: 1093823 - RNA, 18 nt, Mycobacterium bovis subsp bovis AF2122/97
cggucggcagcuccagca

SEQ ID NO: 1093824 - RNA, 22 nt, Mycobacterium bovis subsp bovis AF2122/97
cggucggcagcuucucgccgac

SEQ ID NO: 1093825 - RNA, 21 nt, Mycobacterium bovis subsp bovis AF2122/97
cggucggccacauccagcgcu

SEQ ID NO: 1093826 - RNA, 19 nt, Mycobacterium bovis subsp bovis AF2122/97
cggucgcgguagcagccgc

SEQ ID NO: 1093827 - RNA, 18 nt, Mycobacterium bovis subsp bovis AF2122/97
cggucggucaccauggcg

SEQ ID NO: 1093828 - RNA, 18 nt, Mycobacterium bovis subsp bovis AF2122/97
cggucgguaacggcggug

SEQ ID NO: 1093829 - RNA, 23 nt, Mycobacterium bovis subsp bovis AF2122/97
cggucgguaacggcggugcgggu

SEQ ID NO: 1093830 - RNA, 22 nt, Mycobacterium bovis subsp bovis AF2122/97
cggucggcgguagccgaccagc

SEQ ID NO: 1093831 - RNA, 16 nt, Mycobacterium bovis subsp bovis AF2122/97
cggucggcuccacgcu

SEQ ID NO: 1093832 - RNA, 23 nt, Mycobacterium bovis subsp bovis AF2122/97
cggucggggagcugcggcggcca

SEQ ID NO: 1093833 - RNA, 20 nt, Mycobacterium bovis subsp bovis AF2122/97
cggucggggauccgaccugc

SEQ ID NO: 1093834 - RNA, 14 nt, Mycobacterium bovis subsp bovis AF2122/97
cggucgggcccggc

SEQ ID NO: 1093835 - RNA, 20 nt, Mycobacterium bovis subsp bovis AF2122/97
cggucgggcccggcgagcua

SEQ ID NO: 1093836 - RNA, 20 nt, Mycobacterium bovis subsp bovis AF2122/97
cggucguagacagucugcga

SEQ ID NO: 1093837 - RNA, 13 nt, Mycobacterium bovis subsp bovis AF2122/97
cggucggugcgga

SEQ ID NO: 1093838 - RNA, 20 nt, Mycobacterium bovis subsp bovis AF2122/97
cggucgucacggaccgccac

SEQ ID NO: 1093839 - RNA, 21 nt, Mycobacterium bovis subsp bovis AF2122/97
cggucgucacggaccgccacc

SEQ ID NO: 1093840 - RNA, 12 nt, Mycobacterium bovis subsp bovis AF2122/97
cggucgucgcga

SEQ ID NO: 1093841 - RNA, 13 nt, Mycobacterium bovis subsp bovis AF2122/97
cggucgugccccg

SEQ ID NO: 1093842 - RNA, 20 nt, Mycobacterium bovis subsp bovis AF2122/97
cggucgugccggggcugccg

SEQ ID NO: 1093843 - RNA, 16 nt, Mycobacterium bovis subsp bovis AF2122/97
cggucgucugucucgg

SEQ ID NO: 1093844 - RNA, 20 nt, Mycobacterium bovis subsp bovis AF2122/97
cggucgucugucucggugcc

SEQ ID NO: 1093845 - RNA, 16 nt, Mycobacterium bovis subsp bovis AF2122/97
cggucgugaucggcgu

SEQ ID NO: 1093846 - RNA, 17 nt, Mycobacterium bovis subsp bovis AF2122/97
cggucgcgcgacggccg

SEQ ID NO: 1093847 - RNA, 14 nt, Mycobacterium bovis subsp bovis AF2122/97
cggucgcgcgaugg

SEQ ID NO: 1093848 - RNA, 23 nt, Mycobacterium bovis subsp bovis AF2122/97
cggucgcgcccucagccgcggcc

SEQ ID NO: 1093849 - RNA, 20 nt, Mycobacterium bovis subsp bovis AF2122/97
cggucgcuguccacugccac

SEQ ID NO: 1093850 - RNA, 16 nt, Mycobacterium bovis subsp bovis AF2122/97
cggucgcugauccggg

SEQ ID NO: 1093851 - RNA, 18 nt, Mycobacterium bovis subsp bovis AF2122/97
cggucgcugauccgggcg

SEQ ID NO: 1093852 - RNA, 20 nt, Mycobacterium bovis subsp bovis AF2122/97
cggucgcugauccgggcgcc

SEQ ID NO: 1093853 - RNA, 22 nt, Mycobacterium bovis subsp bovis AF2122/97
cggucgcggacagguagucgcc

SEQ ID NO: 1093854 - RNA, 12 nt, Mycobacterium bovis subsp bovis AF2122/97
cggucgcggaac

SEQ ID NO: 1093855 - RNA, 21 nt, Mycobacterium bovis subsp bovis AF2122/97
cggucgcguugcagaccacca

SEQ ID NO: 1093856 - RNA, 21 nt, Mycobacterium bovis subsp bovis AF2122/97
cggucgcuauccggcggccag

SEQ ID NO: 1093857 - RNA, 22 nt, Mycobacterium bovis subsp bovis AF2122/97
cggucgcuccggguagcggaua

SEQ ID NO: 1093858 - RNA, 16 nt, Mycobacterium bovis subsp bovis AF2122/97
cggucgcggcugacaa

SEQ ID NO: 1093859 - RNA, 16 nt, Mycobacterium bovis subsp bovis AF2122/97
cggucgccucaccggc

SEQ ID NO: 1093860 - RNA, 15 nt, Mycobacterium bovis subsp bovis AF2122/97
cggucgccgcgucua

SEQ ID NO: 1093861 - RNA, 21 nt, Mycobacterium bovis subsp bovis AF2122/97
cggguagacccacaucagguc

SEQ ID NO: 1093862 - RNA, 20 nt, Mycobacterium bovis subsp bovis AF2122/97
cggucgcgacuaccaucgcc

SEQ ID NO: 1093863 - RNA, 18 nt, Mycobacterium bovis subsp bovis AF2122/97
cggucgccucaccggcgc

SEQ ID NO: 1093864 - RNA, 19 nt, Mycobacterium bovis subsp bovis AF2122/97
cggucgccucaccggcgcg

SEQ ID NO: 1093865 - RNA, 23 nt, Mycobacterium bovis subsp bovis AF2122/97
cggucgccuggaagaucacgcgu

SEQ ID NO: 1093866 - RNA, 15 nt, Mycobacterium bovis subsp bovis AF2122/97
cggguacacccgcuc

SEQ ID NO: 1093867 - RNA, 23 nt, Mycobacterium bovis subsp bovis AF2122/97
cggguacacccgcucgcccgccg

SEQ ID NO: 1093868 - RNA, 20 nt, Mycobacterium bovis subsp bovis AF2122/97
cggguacaucgaggccacgc

SEQ ID NO: 1093869 - RNA, 19 nt, Mycobacterium bovis subsp bovis AF2122/97
cggguaccacgcuggcgcg

SEQ ID NO: 1093870 - RNA, 15 nt, Mycobacterium bovis subsp bovis AF2122/97
cggguaccagcaccg

SEQ ID NO: 1093871 - RNA, 16 nt, Mycobacterium bovis subsp bovis AF2122/97
cggguaccagcaccga

SEQ ID NO: 1093872 - RNA, 21 nt, Mycobacterium bovis subsp bovis AF2122/97
cggguagaaccagcccggccg

SEQ ID NO: 1093873 - RNA, 17 nt, Mycobacterium bovis subsp bovis AF2122/97
cggguagacaccgcgau

SEQ ID NO: 1093874 - RNA, 20 nt, Mycobacterium bovis subsp bovis AF2122/97
cggguacggcguacgccgga

SEQ ID NO: 1093875 - RNA, 13 nt, Mycobacterium bovis subsp bovis AF2122/97
cggguaccacgcu

SEQ ID NO: 1093876 - RNA, 14 nt, Mycobacterium bovis subsp bovis AF2122/97
cggucgccgcgcgu

SEQ ID NO: 1093877 - RNA, 16 nt, Mycobacterium bovis subsp bovis AF2122/97
cggguacuuacggguc

SEQ ID NO: 1093878 - RNA, 17 nt, Mycobacterium bovis subsp bovis AF2122/97
cggguagacccacauca

SEQ ID NO: 1093879 - RNA, 19 nt, Mycobacterium bovis subsp bovis AF2122/97
cggugaucuuguccgggcc

SEQ ID NO: 1093880 - RNA, 22 nt, Mycobacterium bovis subsp bovis AF2122/97
cggugaugaacgacauccggcc

SEQ ID NO: 1093881 - RNA, 21 nt, Mycobacterium bovis subsp bovis AF2122/97
cggugaugcccagcgccgaau

SEQ ID NO: 1093882 - RNA, 15 nt, Mycobacterium bovis subsp bovis AF2122/97
cggugauggagccgg

SEQ ID NO: 1093883 - RNA, 19 nt, Mycobacterium bovis subsp bovis AF2122/97
cggugauggagccggugac

SEQ ID NO: 1093884 - RNA, 21 nt, Mycobacterium bovis subsp bovis AF2122/97
cggugauggccgaccagccga

SEQ ID NO: 1093885 - RNA, 24 nt, Mycobacterium bovis subsp bovis AF2122/97
cggugauggccgaccagccgauca

SEQ ID NO: 1093886 - RNA, 22 nt, Mycobacterium bovis subsp bovis AF2122/97
cggugaugggggagccggugac

SEQ ID NO: 1093887 - RNA, 16 nt, Mycobacterium bovis subsp bovis AF2122/97
cggugauggucaccgu

SEQ ID NO: 1093888 - RNA, 23 nt, Mycobacterium bovis subsp bovis AF2122/97
cggugaugguggcaacggguccg

SEQ ID NO: 1093889 - RNA, 23 nt, Mycobacterium bovis subsp bovis AF2122/97
cggugaucgccggcuucgcccag

SEQ ID NO: 1093890 - RNA, 15 nt, Mycobacterium bovis subsp bovis AF2122/97
cggugaucggcggca

SEQ ID NO: 1093891 - RNA, 20 nt, Mycobacterium bovis subsp bovis AF2122/97
cggugaucggcggcaaccgc

SEQ ID NO: 1093892 - RNA, 19 nt, Mycobacterium bovis subsp bovis AF2122/97
cggugaucgggcagcacgc

SEQ ID NO: 1093893 - RNA, 19 nt, Mycobacterium bovis subsp bovis AF2122/97
cggugaucgccggcuucgc

SEQ ID NO: 1093894 - RNA, 18 nt, Mycobacterium bovis subsp bovis AF2122/97
cggugaucaaaccggcgg

SEQ ID NO: 1093895 - RNA, 16 nt, Mycobacterium bovis subsp bovis AF2122/97
cggugaucccacgagc

SEQ ID NO: 1093896 - RNA, 13 nt, Mycobacterium bovis subsp bovis AF2122/97
cggugaucgaggu

SEQ ID NO: 1093897 - RNA, 17 nt, Mycobacterium bovis subsp bovis AF2122/97
cggugaucagccaccgg

SEQ ID NO: 1093898 - RNA, 19 nt, Mycobacterium bovis subsp bovis AF2122/97
cggugauccacgcucgggc

SEQ ID NO: 1093899 - RNA, 19 nt, Mycobacterium bovis subsp bovis AF2122/97
cggugaucaccgacaccgu

SEQ ID NO: 1093900 - RNA, 21 nt, Mycobacterium bovis subsp bovis AF2122/97
cggugaucacggucggcgggu

SEQ ID NO: 1093901 - RNA, 13 nt, Mycobacterium bovis subsp bovis AF2122/97
cggugaguccgcu

SEQ ID NO: 1093902 - RNA, 21 nt, Mycobacterium bovis subsp bovis AF2122/97
cggugacucggccuccgccga

SEQ ID NO: 1093903 - RNA, 24 nt, Mycobacterium bovis subsp bovis AF2122/97
cggugacucggccuccgccgagga

SEQ ID NO: 1093904 - RNA, 12 nt, Mycobacterium bovis subsp bovis AF2122/97
cggugagaucgg

SEQ ID NO: 1093905 - RNA, 16 nt, Mycobacterium bovis subsp bovis AF2122/97
cggugacguggugggc

SEQ ID NO: 1093906 - RNA, 20 nt, Mycobacterium bovis subsp bovis AF2122/97
cggugacggggcugaccgcc

SEQ ID NO: 1093907 - RNA, 21 nt, Mycobacterium bovis subsp bovis AF2122/97
cggugacggggcugaccgcca

SEQ ID NO: 1093908 - RNA, 21 nt, Mycobacterium bovis subsp bovis AF2122/97
cggugacgggguugaccgcca

SEQ ID NO: 1093909 - RNA, 15 nt, Mycobacterium bovis subsp bovis AF2122/97
cggugagccgggcgg

SEQ ID NO: 1093910 - RNA, 21 nt, Mycobacterium bovis subsp bovis AF2122/97
cggugagcagcucggugacaa

SEQ ID NO: 1093911 - RNA, 12 nt, Mycobacterium bovis subsp bovis AF2122/97
cggugagcaccg

SEQ ID NO: 1093912 - RNA, 14 nt, Mycobacterium bovis subsp bovis AF2122/97
cggugacggcggcu

SEQ ID NO: 1093913 - RNA, 16 nt, Mycobacterium bovis subsp bovis AF2122/97
cggugagcgagcgcgc

SEQ ID NO: 1093914 - RNA, 18 nt, Mycobacterium bovis subsp bovis AF2122/97
cggugagcgagcgcgcgu

SEQ ID NO: 1093915 - RNA, 15 nt, Mycobacterium bovis subsp bovis AF2122/97
cggugagcagggcgg

SEQ ID NO: 1093916 - RNA, 20 nt, Mycobacterium bovis subsp bovis AF2122/97
cggugagcgagcgcgcguag

SEQ ID NO: 1093917 - RNA, 17 nt, Mycobacterium bovis subsp bovis AF2122/97
cggugagggcgucgucg

SEQ ID NO: 1093918 - RNA, 14 nt, Mycobacterium bovis subsp bovis AF2122/97
cggugagguauucg

SEQ ID NO: 1093919 - RNA, 21 nt, Mycobacterium bovis subsp bovis AF2122/97
cggugagguauucguggucgg

SEQ ID NO: 1093920 - RNA, 15 nt, Mycobacterium bovis subsp bovis AF2122/97
cggugaggucgaugc

SEQ ID NO: 1093921 - RNA, 18 nt, Mycobacterium bovis subsp bovis AF2122/97
cggugaggucgaugccgg

SEQ ID NO: 1093922 - RNA, 14 nt, Mycobacterium bovis subsp bovis AF2122/97
cggugaggucggug

SEQ ID NO: 1093923 - RNA, 14 nt, Mycobacterium bovis subsp bovis AF2122/97
cggugaggugacca

SEQ ID NO: 1093924 - RNA, 15 nt, Mycobacterium bovis subsp bovis AF2122/97
cggugacgccgucga

SEQ ID NO: 1093925 - RNA, 13 nt, Mycobacterium bovis subsp bovis AF2122/97
cggugacgccguc

SEQ ID NO: 1093926 - RNA, 19 nt, Mycobacterium bovis subsp bovis AF2122/97
cggugacgaugaccgcgcg

SEQ ID NO: 1093927 - RNA, 19 nt, Mycobacterium bovis subsp bovis AF2122/97
cggugacgcaacaucggau

SEQ ID NO: 1093928 - RNA, 21 nt, Mycobacterium bovis subsp bovis AF2122/97
cggugacgcacagcagcaccg

SEQ ID NO: 1093929 - RNA, 16 nt, Mycobacterium bovis subsp bovis AF2122/97
cggugacgcaacaucg

SEQ ID NO: 1093930 - RNA, 16 nt, Mycobacterium bovis subsp bovis AF2122/97
cggugacgaugaccgc

SEQ ID NO: 1093931 - RNA, 18 nt, Mycobacterium bovis subsp bovis AF2122/97
cggugacgacgucgccgc

SEQ ID NO: 1093932 - RNA, 19 nt, Mycobacterium bovis subsp bovis AF2122/97
cggugacgacgucgccgcc

SEQ ID NO: 1093933 - RNA, 20 nt, Mycobacterium bovis subsp bovis AF2122/97
cggugacgacgucgccgccg

SEQ ID NO: 1093934 - RNA, 22 nt, Mycobacterium bovis subsp bovis AF2122/97
cggugacgacgucgccgccgcg

SEQ ID NO: 1093935 - RNA, 18 nt, Mycobacterium bovis subsp bovis AF2122/97
cggugacgagccaccacc

SEQ ID NO: 1093936 - RNA, 19 nt, Mycobacterium bovis subsp bovis AF2122/97
cggugacgagccaccaccg

SEQ ID NO: 1093937 - RNA, 20 nt, Mycobacterium bovis subsp bovis AF2122/97
cggugacgagccaccaccgc

SEQ ID NO: 1093938 - RNA, 16 nt, Mycobacterium bovis subsp bovis AF2122/97
cggugaccucggcgac

SEQ ID NO: 1093939 - RNA, 14 nt, Mycobacterium bovis subsp bovis AF2122/97
cggugaccguucgg

SEQ ID NO: 1093940 - RNA, 18 nt, Mycobacterium bovis subsp bovis AF2122/97
cggugaccggcucggcgg

SEQ ID NO: 1093941 - RNA, 12 nt, Mycobacterium bovis subsp bovis AF2122/97
cggugaccgggu

SEQ ID NO: 1093942 - RNA, 20 nt, Mycobacterium bovis subsp bovis AF2122/97
cggugacgaagagcaccgcg

SEQ ID NO: 1093943 - RNA, 21 nt, Mycobacterium bovis subsp bovis AF2122/97
cggugacgaagagcaccgcgc

SEQ ID NO: 1093944 - RNA, 18 nt, Mycobacterium bovis subsp bovis AF2122/97
cggugacgaccacgucga

SEQ ID NO: 1093945 - RNA, 18 nt, Mycobacterium bovis subsp bovis AF2122/97
cggugaccucggcgacca

SEQ ID NO: 1093946 - RNA, 21 nt, Mycobacterium bovis subsp bovis AF2122/97
cggugacccugguggugcgga

SEQ ID NO: 1093947 - RNA, 23 nt, Mycobacterium bovis subsp bovis AF2122/97
cggugccgccauugacgccguug

SEQ ID NO: 1093948 - RNA, 18 nt, Mycobacterium bovis subsp bovis AF2122/97
cggugccgccggugccgc

SEQ ID NO: 1093949 - RNA, 20 nt, Mycobacterium bovis subsp bovis AF2122/97
cggugccgccggugccgcca

SEQ ID NO: 1093950 - RNA, 20 nt, Mycobacterium bovis subsp bovis AF2122/97
cggugccgccggugccgccu

SEQ ID NO: 1093951 - RNA, 21 nt, Mycobacterium bovis subsp bovis AF2122/97
cggugccgccggugccgccug

SEQ ID NO: 1093952 - RNA, 22 nt, Mycobacterium bovis subsp bovis AF2122/97
cggugccgccggugccgccugc

SEQ ID NO: 1093953 - RNA, 22 nt, Mycobacterium bovis subsp bovis AF2122/97
cggugccgccgauaccgccggc

SEQ ID NO: 1093954 - RNA, 13 nt, Mycobacterium bovis subsp bovis AF2122/97
cggugccgccgcc

SEQ ID NO: 1093955 - RNA, 15 nt, Mycobacterium bovis subsp bovis AF2122/97
cggugccgccgccgg

SEQ ID NO: 1093956 - RNA, 19 nt, Mycobacterium bovis subsp bovis AF2122/97
cggugccgccgccggcgcc

SEQ ID NO: 1093957 - RNA, 18 nt, Mycobacterium bovis subsp bovis AF2122/97
cggugccgccgccugcuc

SEQ ID NO: 1093958 - RNA, 17 nt, Mycobacterium bovis subsp bovis AF2122/97
cggugccgccgcggcca

SEQ ID NO: 1093959 - RNA, 20 nt, Mycobacterium bovis subsp bovis AF2122/97
cggugccgccgcggccacca

SEQ ID NO: 1093960 - RNA, 20 nt, Mycobacterium bovis subsp bovis AF2122/97
cggugccgccaucgccgccg

SEQ ID NO: 1093961 - RNA, 21 nt, Mycobacterium bovis subsp bovis AF2122/97
cggugccgccaucgccgccgg

SEQ ID NO: 1093962 - RNA, 12 nt, Mycobacterium bovis subsp bovis AF2122/97
cggugccgccga

SEQ ID NO: 1093963 - RNA, 17 nt, Mycobacterium bovis subsp bovis AF2122/97
cggugccgccgauaccg

SEQ ID NO: 1093964 - RNA, 22 nt, Mycobacterium bovis subsp bovis AF2122/97
cggugccgccgcggccaccacc

SEQ ID NO: 1093965 - RNA, 24 nt, Mycobacterium bovis subsp bovis AF2122/97
cggugccgccgcggccaccaccgc

SEQ ID NO: 1093966 - RNA, 13 nt, Mycobacterium bovis subsp bovis AF2122/97
cggugccgccacc

SEQ ID NO: 1093967 - RNA, 15 nt, Mycobacterium bovis subsp bovis AF2122/97
cggugccgccaccgg

SEQ ID NO: 1093968 - RNA, 21 nt, Mycobacterium bovis subsp bovis AF2122/97
cggugccgacggugggcgagg

SEQ ID NO: 1093969 - RNA, 14 nt, Mycobacterium bovis subsp bovis AF2122/97
cggugccgaccggu

SEQ ID NO: 1093970 - RNA, 12 nt, Mycobacterium bovis subsp bovis AF2122/97
cggugccgacgg

SEQ ID NO: 1093971 - RNA, 15 nt, Mycobacterium bovis subsp bovis AF2122/97
cggugccgacggcgc

SEQ ID NO: 1093972 - RNA, 18 nt, Mycobacterium bovis subsp bovis AF2122/97
cggugccgacggugaugg

SEQ ID NO: 1093973 - RNA, 12 nt, Mycobacterium bovis subsp bovis AF2122/97
cggugccgagcg

SEQ ID NO: 1093974 - RNA, 16 nt, Mycobacterium bovis subsp bovis AF2122/97
cggugccgccaccggc

SEQ ID NO: 1093975 - RNA, 13 nt, Mycobacterium bovis subsp bovis AF2122/97
cggugccgccauc

SEQ ID NO: 1093976 - RNA, 16 nt, Mycobacterium bovis subsp bovis AF2122/97
cggugccgccaucgcc

SEQ ID NO: 1093977 - RNA, 18 nt, Mycobacterium bovis subsp bovis AF2122/97
cggugccgccaucgccgc

SEQ ID NO: 1093978 - RNA, 20 nt, Mycobacterium bovis subsp bovis AF2122/97
cggugccgcccgagccggug

SEQ ID NO: 1093979 - RNA, 19 nt, Mycobacterium bovis subsp bovis AF2122/97
cggugccgcccgcgccgcc

SEQ ID NO: 1093980 - RNA, 15 nt, Mycobacterium bovis subsp bovis AF2122/97
cggugccgucgccgc

SEQ ID NO: 1093981 - RNA, 16 nt, Mycobacterium bovis subsp bovis AF2122/97
cggugccgucggugcc

SEQ ID NO: 1093982 - RNA, 15 nt, Mycobacterium bovis subsp bovis AF2122/97
cggugccugcaacgc

SEQ ID NO: 1093983 - RNA, 19 nt, Mycobacterium bovis subsp bovis AF2122/97
cggugccguuggagccgcc

SEQ ID NO: 1093984 - RNA, 16 nt, Mycobacterium bovis subsp bovis AF2122/97
cggugccucgcagcca

SEQ ID NO: 1093985 - RNA, 20 nt, Mycobacterium bovis subsp bovis AF2122/97
cggugccucgcagccaacgc

SEQ ID NO: 1093986 - RNA, 16 nt, Mycobacterium bovis subsp bovis AF2122/97
cggugccgucagcggc

SEQ ID NO: 1093987 - RNA, 21 nt, Mycobacterium bovis subsp bovis AF2122/97
cggugccggucgagugccucg

SEQ ID NO: 1093988 - RNA, 16 nt, Mycobacterium bovis subsp bovis AF2122/97
cggugccggcggcgca

SEQ ID NO: 1093989 - RNA, 19 nt, Mycobacterium bovis subsp bovis AF2122/97
cggugccggggcugccgcc

SEQ ID NO: 1093990 - RNA, 23 nt, Mycobacterium bovis subsp bovis AF2122/97
cggugccggggcugccgccguug

SEQ ID NO: 1093991 - RNA, 15 nt, Mycobacterium bovis subsp bovis AF2122/97
cggugccggcggauc

SEQ ID NO: 1093992 - RNA, 14 nt, Mycobacterium bovis subsp bovis AF2122/97
cggugccgggaucg

SEQ ID NO: 1093993 - RNA, 18 nt, Mycobacterium bovis subsp bovis AF2122/97
cggugccgggaucgccgu

SEQ ID NO: 1093994 - RNA, 19 nt, Mycobacterium bovis subsp bovis AF2122/97
cggugccgggaugccgccg

SEQ ID NO: 1093995 - RNA, 16 nt, Mycobacterium bovis subsp bovis AF2122/97
cggugccggggcugcc

SEQ ID NO: 1093996 - RNA, 18 nt, Mycobacterium bovis subsp bovis AF2122/97
cggugccggggcugccgc

SEQ ID NO: 1093997 - RNA, 21 nt, Mycobacterium bovis subsp bovis AF2122/97
cggugccggcgacgcuaccgc

SEQ ID NO: 1093998 - RNA, 12 nt, Mycobacterium bovis subsp bovis AF2122/97
cggugccggccg

SEQ ID NO: 1093999 - RNA, 14 nt, Mycobacterium bovis subsp bovis AF2122/97
cggugccggccgca

SEQ ID NO: 1094000 - RNA, 13 nt, Mycobacterium bovis subsp bovis AF2122/97
cggugccggcgca

SEQ ID NO: 1094001 - RNA, 20 nt, Mycobacterium bovis subsp bovis AF2122/97
cggugccggcccugcucggc

SEQ ID NO: 1094002 - RNA, 15 nt, Mycobacterium bovis subsp bovis AF2122/97
cggugccggaaacgc

SEQ ID NO: 1094003 - RNA, 23 nt, Mycobacterium bovis subsp bovis AF2122/97
cggugccggagacaccgcaacgc

SEQ ID NO: 1094004 - RNA, 14 nt, Mycobacterium bovis subsp bovis AF2122/97
cggugccgccguug

SEQ ID NO: 1094005 - RNA, 17 nt, Mycobacterium bovis subsp bovis AF2122/97
cggugccgccuccgccu

SEQ ID NO: 1094006 - RNA, 18 nt, Mycobacterium bovis subsp bovis AF2122/97
cggugccgccuccgccug

SEQ ID NO: 1094007 - RNA, 19 nt, Mycobacterium bovis subsp bovis AF2122/97
cggugccgccuccgccugc

SEQ ID NO: 1094008 - RNA, 18 nt, Mycobacterium bovis subsp bovis AF2122/97
cggugccgccugcgccgc

SEQ ID NO: 1094009 - RNA, 15 nt, Mycobacterium bovis subsp bovis AF2122/97
cggugccgccgucgc

SEQ ID NO: 1094010 - RNA, 17 nt, Mycobacterium bovis subsp bovis AF2122/97
cggugccgaagcugccc

SEQ ID NO: 1094011 - RNA, 15 nt, Mycobacterium bovis subsp bovis AF2122/97
cggugccgaccgcgu

SEQ ID NO: 1094012 - RNA, 15 nt, Mycobacterium bovis subsp bovis AF2122/97
cggugcccugccggc

SEQ ID NO: 1094013 - RNA, 13 nt, Mycobacterium bovis subsp bovis AF2122/97
cggugccgaccgg

SEQ ID NO: 1094014 - RNA, 18 nt, Mycobacterium bovis subsp bovis AF2122/97
cggugcccagcagcgcga

SEQ ID NO: 1094015 - RNA, 22 nt, Mycobacterium bovis subsp bovis AF2122/97
cggugcccagcagcgcgacggu

SEQ ID NO: 1094016 - RNA, 15 nt, Mycobacterium bovis subsp bovis AF2122/97
cggugcccagcagcg

SEQ ID NO: 1094017 - RNA, 16 nt, Mycobacterium bovis subsp bovis AF2122/97
cggugccacggcaccg

SEQ ID NO: 1094018 - RNA, 17 nt, Mycobacterium bovis subsp bovis AF2122/97
cggugccacggcaccga

SEQ ID NO: 1094019 - RNA, 14 nt, Mycobacterium bovis subsp bovis AF2122/97
cggugccacgguga

SEQ ID NO: 1094020 - RNA, 23 nt, Mycobacterium bovis subsp bovis AF2122/97
cggugccagcaccacgucgacga

SEQ ID NO: 1094021 - RNA, 15 nt, Mycobacterium bovis subsp bovis AF2122/97
cggugccaccacgcu

SEQ ID NO: 1094022 - RNA, 18 nt, Mycobacterium bovis subsp bovis AF2122/97
cggugccaccgcgacggc

SEQ ID NO: 1094023 - RNA, 16 nt, Mycobacterium bovis subsp bovis AF2122/97
cggugccacgaucggc

SEQ ID NO: 1094024 - RNA, 18 nt, Mycobacterium bovis subsp bovis AF2122/97
cggugccaaaggacgaca

SEQ ID NO: 1094025 - RNA, 20 nt, Mycobacterium bovis subsp bovis AF2122/97
cggugccagcacuccaccgc

SEQ ID NO: 1094026 - RNA, 16 nt, Mycobacterium bovis subsp bovis AF2122/97
cggugccagcaggccg

SEQ ID NO: 1094027 - RNA, 15 nt, Mycobacterium bovis subsp bovis AF2122/97
cggugcaucgccacc

SEQ ID NO: 1094028 - RNA, 19 nt, Mycobacterium bovis subsp bovis AF2122/97
cggugcaucgccaccaccg

SEQ ID NO: 1094029 - RNA, 20 nt, Mycobacterium bovis subsp bovis AF2122/97
cggugcaggucguccaucgc

SEQ ID NO: 1094030 - RNA, 15 nt, Mycobacterium bovis subsp bovis AF2122/97
cggugcagcccgccg

SEQ ID NO: 1094031 - RNA, 16 nt, Mycobacterium bovis subsp bovis AF2122/97
cggugcagcccgccgg

SEQ ID NO: 1094032 - RNA, 16 nt, Mycobacterium bovis subsp bovis AF2122/97
cggugcagcuccccgc

SEQ ID NO: 1094033 - RNA, 21 nt, Mycobacterium bovis subsp bovis AF2122/97
cggugcaggaccagaacucgu

SEQ ID NO: 1094034 - RNA, 12 nt, Mycobacterium bovis subsp bovis AF2122/97
cggugcaggauu

SEQ ID NO: 1094035 - RNA, 19 nt, Mycobacterium bovis subsp bovis AF2122/97
cggugcaggauucggcggu

SEQ ID NO: 1094036 - RNA, 17 nt, Mycobacterium bovis subsp bovis AF2122/97
cggugcagaucggcuca

SEQ ID NO: 1094037 - RNA, 19 nt, Mycobacterium bovis subsp bovis AF2122/97
cggugcacaacgcccacca

SEQ ID NO: 1094038 - RNA, 20 nt, Mycobacterium bovis subsp bovis AF2122/97
cggugcacaacgcccaccac

SEQ ID NO: 1094039 - RNA, 22 nt, Mycobacterium bovis subsp bovis AF2122/97
cggugcacaacgcccaccacgc

SEQ ID NO: 1094040 - RNA, 20 nt, Mycobacterium bovis subsp bovis AF2122/97
cgguggcggcggugccacga

SEQ ID NO: 1094041 - RNA, 16 nt, Mycobacterium bovis subsp bovis AF2122/97
cgguggcggccuccga

SEQ ID NO: 1094042 - RNA, 13 nt, Mycobacterium bovis subsp bovis AF2122/97
cgguggcggcacg

SEQ ID NO: 1094043 - RNA, 15 nt, Mycobacterium bovis subsp bovis AF2122/97
cgguggcggcacgca

SEQ ID NO: 1094044 - RNA, 17 nt, Mycobacterium bovis subsp bovis AF2122/97
cgguggcggcagcagcg

SEQ ID NO: 1094045 - RNA, 16 nt, Mycobacterium bovis subsp bovis AF2122/97
cgguggcgcggugccg

SEQ ID NO: 1094046 - RNA, 18 nt, Mycobacterium bovis subsp bovis AF2122/97
cgguggcgcggugccggc

SEQ ID NO: 1094047 - RNA, 20 nt, Mycobacterium bovis subsp bovis AF2122/97
cgguggcgcggugccggcgg

SEQ ID NO: 1094048 - RNA, 16 nt, Mycobacterium bovis subsp bovis AF2122/97
cgguggcgccggggcc

SEQ ID NO: 1094049 - RNA, 17 nt, Mycobacterium bovis subsp bovis AF2122/97
cgguggcgccggggccg

SEQ ID NO: 1094050 - RNA, 20 nt, Mycobacterium bovis subsp bovis AF2122/97
cgguggcgccggggccgccg

SEQ ID NO: 1094051 - RNA, 15 nt, Mycobacterium bovis subsp bovis AF2122/97
cgguggcgccgucgg

SEQ ID NO: 1094052 - RNA, 20 nt, Mycobacterium bovis subsp bovis AF2122/97
cgguggccgucgggugcagc

SEQ ID NO: 1094053 - RNA, 19 nt, Mycobacterium bovis subsp bovis AF2122/97
cgguggccgcaucgacgcu

SEQ ID NO: 1094054 - RNA, 13 nt, Mycobacterium bovis subsp bovis AF2122/97
cgguggccggcga

SEQ ID NO: 1094055 - RNA, 19 nt, Mycobacterium bovis subsp bovis AF2122/97
cgguggccucccacggcgc

SEQ ID NO: 1094056 - RNA, 20 nt, Mycobacterium bovis subsp bovis AF2122/97
cgguggccucccacggcgcg

SEQ ID NO: 1094057 - RNA, 17 nt, Mycobacterium bovis subsp bovis AF2122/97
cgguggccagcacgugc

SEQ ID NO: 1094058 - RNA, 14 nt, Mycobacterium bovis subsp bovis AF2122/97
cgguggccgcacga

SEQ ID NO: 1094059 - RNA, 12 nt, Mycobacterium bovis subsp bovis AF2122/97
cgguggccgaca

SEQ ID NO: 1094060 - RNA, 14 nt, Mycobacterium bovis subsp bovis AF2122/97
cgguggccgcaucg

SEQ ID NO: 1094061 - RNA, 15 nt, Mycobacterium bovis subsp bovis AF2122/97
cgguggccgcaucga

SEQ ID NO: 1094062 - RNA, 15 nt, Mycobacterium bovis subsp bovis AF2122/97
cgguggccgucgggu

SEQ ID NO: 1094063 - RNA, 17 nt, Mycobacterium bovis subsp bovis AF2122/97
cgguggccggcaacggc

SEQ ID NO: 1094064 - RNA, 12 nt, Mycobacterium bovis subsp bovis AF2122/97
cgguggccgcgg

SEQ ID NO: 1094065 - RNA, 15 nt, Mycobacterium bovis subsp bovis AF2122/97
cgguggccgcggcgg

SEQ ID NO: 1094066 - RNA, 16 nt, Mycobacterium bovis subsp bovis AF2122/97
cgguggccgcggcggu

SEQ ID NO: 1094067 - RNA, 17 nt, Mycobacterium bovis subsp bovis AF2122/97
cgguggccgcgcugguc

SEQ ID NO: 1094068 - RNA, 16 nt, Mycobacterium bovis subsp bovis AF2122/97
cgguggcccggugcaa

SEQ ID NO: 1094069 - RNA, 19 nt, Mycobacterium bovis subsp bovis AF2122/97
cgguggccccgauggcgau

SEQ ID NO: 1094070 - RNA, 20 nt, Mycobacterium bovis subsp bovis AF2122/97
cgguggcauucguugaugau

SEQ ID NO: 1094071 - RNA, 14 nt, Mycobacterium bovis subsp bovis AF2122/97
cgguggccaacacc

SEQ ID NO: 1094072 - RNA, 15 nt, Mycobacterium bovis subsp bovis AF2122/97
cgguggccacccggc

SEQ ID NO: 1094073 - RNA, 22 nt, Mycobacterium bovis subsp bovis AF2122/97
cgguggccacccggccgcgcgg

SEQ ID NO: 1094074 - RNA, 14 nt, Mycobacterium bovis subsp bovis AF2122/97
cgguggccaccacc

SEQ ID NO: 1094075 - RNA, 14 nt, Mycobacterium bovis subsp bovis AF2122/97
cgguggccacccgg

SEQ ID NO: 1094076 - RNA, 19 nt, Mycobacterium bovis subsp bovis AF2122/97
cgguggcagcacagcgucg

SEQ ID NO: 1094077 - RNA, 13 nt, Mycobacterium bovis subsp bovis AF2122/97
cggugggucgucg

SEQ ID NO: 1094078 - RNA, 13 nt, Mycobacterium bovis subsp bovis AF2122/97
cggugggucucgg

SEQ ID NO: 1094079 - RNA, 15 nt, Mycobacterium bovis subsp bovis AF2122/97
cggugggugccagcc

SEQ ID NO: 1094080 - RNA, 16 nt, Mycobacterium bovis subsp bovis AF2122/97
cgguggggucgccguc

SEQ ID NO: 1094081 - RNA, 18 nt, Mycobacterium bovis subsp bovis AF2122/97
cgguggggucgccgucga

SEQ ID NO: 1094082 - RNA, 16 nt, Mycobacterium bovis subsp bovis AF2122/97
cgguggggucgcugcc

SEQ ID NO: 1094083 - RNA, 17 nt, Mycobacterium bovis subsp bovis AF2122/97
cgguggggucgcugccg

SEQ ID NO: 1094084 - RNA, 21 nt, Mycobacterium bovis subsp bovis AF2122/97
cgguggggucgcugccgccgu

SEQ ID NO: 1094085 - RNA, 20 nt, Mycobacterium bovis subsp bovis AF2122/97
cgguggggucggucuggcug

SEQ ID NO: 1094086 - RNA, 21 nt, Mycobacterium bovis subsp bovis AF2122/97
cggugggcgggugcgcgaggu

SEQ ID NO: 1094087 - RNA, 19 nt, Mycobacterium bovis subsp bovis AF2122/97
cggugggcguucccccggc

SEQ ID NO: 1094088 - RNA, 18 nt, Mycobacterium bovis subsp bovis AF2122/97
cgguggggccggcgucga

SEQ ID NO: 1094089 - RNA, 18 nt, Mycobacterium bovis subsp bovis AF2122/97
cggugggcuugccgcgca

SEQ ID NO: 1094090 - RNA, 20 nt, Mycobacterium bovis subsp bovis AF2122/97
cgguggucagcaccggcgcg

SEQ ID NO: 1094091 - RNA, 15 nt, Mycobacterium bovis subsp bovis AF2122/97
cgguggggcgcgccg

SEQ ID NO: 1094092 - RNA, 13 nt, Mycobacterium bovis subsp bovis AF2122/97
cggugguagcggc

SEQ ID NO: 1094093 - RNA, 16 nt, Mycobacterium bovis subsp bovis AF2122/97
cggugguaacaccggc

SEQ ID NO: 1094094 - RNA, 19 nt, Mycobacterium bovis subsp bovis AF2122/97
cggugguaacaccggcgag

SEQ ID NO: 1094095 - RNA, 19 nt, Mycobacterium bovis subsp bovis AF2122/97
cggugguaagacgccgaac

SEQ ID NO: 1094096 - RNA, 21 nt, Mycobacterium bovis subsp bovis AF2122/97
cggugggugccagccggucga

SEQ ID NO: 1094097 - RNA, 12 nt, Mycobacterium bovis subsp bovis AF2122/97
cggugggugggc

SEQ ID NO: 1094098 - RNA, 14 nt, Mycobacterium bovis subsp bovis AF2122/97
cggugguagcgacg

SEQ ID NO: 1094099 - RNA, 15 nt, Mycobacterium bovis subsp bovis AF2122/97
cgguggucggcgcgc

SEQ ID NO: 1094100 - RNA, 18 nt, Mycobacterium bovis subsp bovis AF2122/97
cgguggucggcgcgccgu

SEQ ID NO: 1094101 - RNA, 14 nt, Mycobacterium bovis subsp bovis AF2122/97
cggugguccagcgc

SEQ ID NO: 1094102 - RNA, 15 nt, Mycobacterium bovis subsp bovis AF2122/97
cggugguccagcgcu

SEQ ID NO: 1094103 - RNA, 19 nt, Mycobacterium bovis subsp bovis AF2122/97
cgguggucccccgcagcca

SEQ ID NO: 1094104 - RNA, 12 nt, Mycobacterium bovis subsp bovis AF2122/97
cggugggcagca

SEQ ID NO: 1094105 - RNA, 18 nt, Mycobacterium bovis subsp bovis AF2122/97
cgguggcuucgacggcgg

SEQ ID NO: 1094106 - RNA, 19 nt, Mycobacterium bovis subsp bovis AF2122/97
cgguggcguuugaugcggg

SEQ ID NO: 1094107 - RNA, 18 nt, Mycobacterium bovis subsp bovis AF2122/97
cgguggcuugccccgccg

SEQ ID NO: 1094108 - RNA, 13 nt, Mycobacterium bovis subsp bovis AF2122/97
cggugggcgccga

SEQ ID NO: 1094109 - RNA, 21 nt, Mycobacterium bovis subsp bovis AF2122/97
cggugggcgccgacaccggcu

SEQ ID NO: 1094110 - RNA, 16 nt, Mycobacterium bovis subsp bovis AF2122/97
cgguggcugaucaccg

SEQ ID NO: 1094111 - RNA, 13 nt, Mycobacterium bovis subsp bovis AF2122/97
cgguggcugccac

SEQ ID NO: 1094112 - RNA, 13 nt, Mycobacterium bovis subsp bovis AF2122/97
cgguggcuggccg

SEQ ID NO: 1094113 - RNA, 20 nt, Mycobacterium bovis subsp bovis AF2122/97
cgguggcuggccgccaccgc

SEQ ID NO: 1094114 - RNA, 15 nt, Mycobacterium bovis subsp bovis AF2122/97
cgguggcguggucuc

SEQ ID NO: 1094115 - RNA, 19 nt, Mycobacterium bovis subsp bovis AF2122/97
cgguggcguauucggugca

SEQ ID NO: 1094116 - RNA, 20 nt, Mycobacterium bovis subsp bovis AF2122/97
cgguggcggcucacgaccgg

SEQ ID NO: 1094117 - RNA, 12 nt, Mycobacterium bovis subsp bovis AF2122/97
cgguggcgggcu

SEQ ID NO: 1094118 - RNA, 20 nt, Mycobacterium bovis subsp bovis AF2122/97
cgguggcggucgccacaccc

SEQ ID NO: 1094119 - RNA, 22 nt, Mycobacterium bovis subsp bovis AF2122/97
cgguggcggucgccacacccgc

SEQ ID NO: 1094120 - RNA, 22 nt, Mycobacterium bovis subsp bovis AF2122/97
cgguggaugcgaugcgcgccga

SEQ ID NO: 1094121 - RNA, 13 nt, Mycobacterium bovis subsp bovis AF2122/97
cgguggcacccgc

SEQ ID NO: 1094122 - RNA, 15 nt, Mycobacterium bovis subsp bovis AF2122/97
cgguggcaccggcgg

SEQ ID NO: 1094123 - RNA, 20 nt, Mycobacterium bovis subsp bovis AF2122/97
cgguggcacggccccugcca

SEQ ID NO: 1094124 - RNA, 21 nt, Mycobacterium bovis subsp bovis AF2122/97
cgguggcacggccccugccac

SEQ ID NO: 1094125 - RNA, 16 nt, Mycobacterium bovis subsp bovis AF2122/97
cgguggcagagccgcc

SEQ ID NO: 1094126 - RNA, 18 nt, Mycobacterium bovis subsp bovis AF2122/97
cgguggcagagccgccgu

SEQ ID NO: 1094127 - RNA, 23 nt, Mycobacterium bovis subsp bovis AF2122/97
cgguggagcgcgccucgcccagc

SEQ ID NO: 1094128 - RNA, 20 nt, Mycobacterium bovis subsp bovis AF2122/97
cgguggcaacggaggugccg

SEQ ID NO: 1094129 - RNA, 14 nt, Mycobacterium bovis subsp bovis AF2122/97
cgguggcaacgggu

SEQ ID NO: 1094130 - RNA, 22 nt, Mycobacterium bovis subsp bovis AF2122/97
cggugcugguggcggcacuggc

SEQ ID NO: 1094131 - RNA, 21 nt, Mycobacterium bovis subsp bovis AF2122/97
cggugcugucgacgucggcaa

SEQ ID NO: 1094132 - RNA, 17 nt, Mycobacterium bovis subsp bovis AF2122/97
cgguggaauccaccagc

SEQ ID NO: 1094133 - RNA, 18 nt, Mycobacterium bovis subsp bovis AF2122/97
cgguggaauccaccagcc

SEQ ID NO: 1094134 - RNA, 22 nt, Mycobacterium bovis subsp bovis AF2122/97
cgguggaauccaccagccggua

SEQ ID NO: 1094135 - RNA, 23 nt, Mycobacterium bovis subsp bovis AF2122/97
cgguggacgcagagucaacagau

SEQ ID NO: 1094136 - RNA, 21 nt, Mycobacterium bovis subsp bovis AF2122/97
cgguggacggcaggcggccgc

SEQ ID NO: 1094137 - RNA, 14 nt, Mycobacterium bovis subsp bovis AF2122/97
cgguggaccgggca

SEQ ID NO: 1094138 - RNA, 16 nt, Mycobacterium bovis subsp bovis AF2122/97
cgguggacgauacgcg

SEQ ID NO: 1094139 - RNA, 20 nt, Mycobacterium bovis subsp bovis AF2122/97
cggugcguccggugcugguc

SEQ ID NO: 1094140 - RNA, 19 nt, Mycobacterium bovis subsp bovis AF2122/97
cggugcgguucgcugcggc

SEQ ID NO: 1094141 - RNA, 18 nt, Mycobacterium bovis subsp bovis AF2122/97
cggugcgguggugcgcaa

SEQ ID NO: 1094142 - RNA, 23 nt, Mycobacterium bovis subsp bovis AF2122/97
cggugcggucagauucggcgaug

SEQ ID NO: 1094143 - RNA, 14 nt, Mycobacterium bovis subsp bovis AF2122/97
cggugcuaaccgac

SEQ ID NO: 1094144 - RNA, 17 nt, Mycobacterium bovis subsp bovis AF2122/97
cggugcuaaccgacgcu

SEQ ID NO: 1094145 - RNA, 17 nt, Mycobacterium bovis subsp bovis AF2122/97
cggugcugaccccgccg

SEQ ID NO: 1094146 - RNA, 18 nt, Mycobacterium bovis subsp bovis AF2122/97
cggugcugaccccgccgg

SEQ ID NO: 1094147 - RNA, 21 nt, Mycobacterium bovis subsp bovis AF2122/97
cggugcugaccccgccggcug

SEQ ID NO: 1094148 - RNA, 16 nt, Mycobacterium bovis subsp bovis AF2122/97
cggugcugguccagcc

SEQ ID NO: 1094149 - RNA, 22 nt, Mycobacterium bovis subsp bovis AF2122/97
cggugcgccagaucaccgucga

SEQ ID NO: 1094150 - RNA, 18 nt, Mycobacterium bovis subsp bovis AF2122/97
cggugcgcgaucacuucc

SEQ ID NO: 1094151 - RNA, 15 nt, Mycobacterium bovis subsp bovis AF2122/97
cggugcggacuucga

SEQ ID NO: 1094152 - RNA, 18 nt, Mycobacterium bovis subsp bovis AF2122/97
cggugcgcuggcggcgca

SEQ ID NO: 1094153 - RNA, 13 nt, Mycobacterium bovis subsp bovis AF2122/97
cggugcgcugguu

SEQ ID NO: 1094154 - RNA, 17 nt, Mycobacterium bovis subsp bovis AF2122/97
cggugcggaacaccgcc

SEQ ID NO: 1094155 - RNA, 21 nt, Mycobacterium bovis subsp bovis AF2122/97
cggugcggaacaccgcccggc

SEQ ID NO: 1094156 - RNA, 16 nt, Mycobacterium bovis subsp bovis AF2122/97
cggugcggaacacgau

SEQ ID NO: 1094157 - RNA, 23 nt, Mycobacterium bovis subsp bovis AF2122/97
cggugcgcuggaggcuccugguc

SEQ ID NO: 1094158 - RNA, 19 nt, Mycobacterium bovis subsp bovis AF2122/97
cggugcgcuggaucuucga

SEQ ID NO: 1094159 - RNA, 14 nt, Mycobacterium bovis subsp bovis AF2122/97
cggugcgcggcaau

SEQ ID NO: 1094160 - RNA, 14 nt, Mycobacterium bovis subsp bovis AF2122/97
cggugcgcgguugu

SEQ ID NO: 1094161 - RNA, 22 nt, Mycobacterium bovis subsp bovis AF2122/97
cggugcgcgguugugacgguga

SEQ ID NO: 1094162 - RNA, 20 nt, Mycobacterium bovis subsp bovis AF2122/97
cggugcgcgugacgaccagc

SEQ ID NO: 1094163 - RNA, 14 nt, Mycobacterium bovis subsp bovis AF2122/97
cggugcggcuguug

SEQ ID NO: 1094164 - RNA, 13 nt, Mycobacterium bovis subsp bovis AF2122/97
cggugcggcgagg

SEQ ID NO: 1094165 - RNA, 17 nt, Mycobacterium bovis subsp bovis AF2122/97
cggugcggguggugccg

SEQ ID NO: 1094166 - RNA, 14 nt, Mycobacterium bovis subsp bovis AF2122/97
cggugcgggcuagg

SEQ ID NO: 1094167 - RNA, 22 nt, Mycobacterium bovis subsp bovis AF2122/97
cggugcgggcuaggcggcguuu

SEQ ID NO: 1094168 - RNA, 12 nt, Mycobacterium bovis subsp bovis AF2122/97
cggugcgcacca

SEQ ID NO: 1094169 - RNA, 18 nt, Mycobacterium bovis subsp bovis AF2122/97
cggugcgcaccaccgagc

SEQ ID NO: 1094170 - RNA, 14 nt, Mycobacterium bovis subsp bovis AF2122/97
cggugcgcaccaga

SEQ ID NO: 1094171 - RNA, 22 nt, Mycobacterium bovis subsp bovis AF2122/97
cggugcgcaccagagugguguu

SEQ ID NO: 1094172 - RNA, 13 nt, Mycobacterium bovis subsp bovis AF2122/97
cggugcgcacggc

SEQ ID NO: 1094173 - RNA, 16 nt, Mycobacterium bovis subsp bovis AF2122/97
cggugcgcacggcggc

SEQ ID NO: 1094174 - RNA, 19 nt, Mycobacterium bovis subsp bovis AF2122/97
cggugcgcacggcggccca

SEQ ID NO: 1094175 - RNA, 17 nt, Mycobacterium bovis subsp bovis AF2122/97
cggugcgauccugacca

SEQ ID NO: 1094176 - RNA, 18 nt, Mycobacterium bovis subsp bovis AF2122/97
cggugcgaccaacacggu

SEQ ID NO: 1094177 - RNA, 21 nt, Mycobacterium bovis subsp bovis AF2122/97
cggugccgugaucggcgcccg

SEQ ID NO: 1094178 - RNA, 22 nt, Mycobacterium bovis subsp bovis AF2122/97
cggugccgugaucggcgcccgg

SEQ ID NO: 1094179 - RNA, 14 nt, Mycobacterium bovis subsp bovis AF2122/97
cggugccugcagcu

SEQ ID NO: 1094180 - RNA, 16 nt, Mycobacterium bovis subsp bovis AF2122/97
cggugccugcagcuug

SEQ ID NO: 1094181 - RNA, 17 nt, Mycobacterium bovis subsp bovis AF2122/97
cggugcgcaacuucgac

SEQ ID NO: 1094182 - RNA, 22 nt, Mycobacterium bovis subsp bovis AF2122/97
cggugcgcagggccuggaagac

SEQ ID NO: 1094183 - RNA, 19 nt, Mycobacterium bovis subsp bovis AF2122/97
cggugcgccagaucaccgu

SEQ ID NO: 1094184 - RNA, 21 nt, Mycobacterium bovis subsp bovis AF2122/97
cgguggugccgcggccaccgc

SEQ ID NO: 1094185 - RNA, 15 nt, Mycobacterium bovis subsp bovis AF2122/97
cggugguggcgaccc

SEQ ID NO: 1094186 - RNA, 18 nt, Mycobacterium bovis subsp bovis AF2122/97
cggugguggcgucgaugg

SEQ ID NO: 1094187 - RNA, 14 nt, Mycobacterium bovis subsp bovis AF2122/97
cgguggugggccgu

SEQ ID NO: 1094188 - RNA, 24 nt, Mycobacterium bovis subsp bovis AF2122/97
cgguggugguguaggaguacaaca

SEQ ID NO: 1094189 - RNA, 14 nt, Mycobacterium bovis subsp bovis AF2122/97
cgguggugcugccg

SEQ ID NO: 1094190 - RNA, 15 nt, Mycobacterium bovis subsp bovis AF2122/97
cgguggugggcuagg

SEQ ID NO: 1094191 - RNA, 15 nt, Mycobacterium bovis subsp bovis AF2122/97
cgguggugucagcca

SEQ ID NO: 1094192 - RNA, 19 nt, Mycobacterium bovis subsp bovis AF2122/97
cggugguuagguggcuggc

SEQ ID NO: 1094193 - RNA, 14 nt, Mycobacterium bovis subsp bovis AF2122/97
cgguggugucgguu

SEQ ID NO: 1094194 - RNA, 22 nt, Mycobacterium bovis subsp bovis AF2122/97
cgguggugucgguucgucgggc

SEQ ID NO: 1094195 - RNA, 22 nt, Mycobacterium bovis subsp bovis AF2122/97
cgguggucucgacggcgccgcc

SEQ ID NO: 1094196 - RNA, 10 nt, Mycobacterium bovis subsp bovis AF2122/97
cgguggucgu

SEQ ID NO: 1094197 - RNA, 13 nt, Mycobacterium bovis subsp bovis AF2122/97
cgguggucguagg

SEQ ID NO: 1094198 - RNA, 19 nt, Mycobacterium bovis subsp bovis AF2122/97
cgguggucguaggugacga

SEQ ID NO: 1094199 - RNA, 15 nt, Mycobacterium bovis subsp bovis AF2122/97
cgguggugacgucga

SEQ ID NO: 1094200 - RNA, 18 nt, Mycobacterium bovis subsp bovis AF2122/97
cgguggucugcgcggugc

SEQ ID NO: 1094201 - RNA, 18 nt, Mycobacterium bovis subsp bovis AF2122/97
cgguggucuuggcccggc

SEQ ID NO: 1094202 - RNA, 19 nt, Mycobacterium bovis subsp bovis AF2122/97
cgguggucuuggcccggcg

SEQ ID NO: 1094203 - RNA, 20 nt, Mycobacterium bovis subsp bovis AF2122/97
cgguggucuuggcccggcgg

SEQ ID NO: 1094204 - RNA, 22 nt, Mycobacterium bovis subsp bovis AF2122/97
cgguggugaucacgucggaucc

SEQ ID NO: 1094205 - RNA, 18 nt, Mycobacterium bovis subsp bovis AF2122/97
cgguggugacgucgaggu

SEQ ID NO: 1094206 - RNA, 13 nt, Mycobacterium bovis subsp bovis AF2122/97
cgguggugccgcg

SEQ ID NO: 1094207 - RNA, 14 nt, Mycobacterium bovis subsp bovis AF2122/97
cgguggugccgcgg

SEQ ID NO: 1094208 - RNA, 15 nt, Mycobacterium bovis subsp bovis AF2122/97
cgguggugccgcggc

SEQ ID NO: 1094209 - RNA, 20 nt, Mycobacterium bovis subsp bovis AF2122/97
cgguggugccgcggccaccg

SEQ ID NO: 1094210 - RNA, 19 nt, Mycobacterium bovis subsp bovis AF2122/97
cgguggugccggcgccgcc

SEQ ID NO: 1094211 - RNA, 21 nt, Mycobacterium bovis subsp bovis AF2122/97
cgguggugcgcucgcgguagc

SEQ ID NO: 1094212 - RNA, 14 nt, Mycobacterium bovis subsp bovis AF2122/97
cgguggugcggccc

SEQ ID NO: 1094213 - RNA, 12 nt, Mycobacterium bovis subsp bovis AF2122/97
cgguggugcggu

SEQ ID NO: 1094214 - RNA, 13 nt, Mycobacterium bovis subsp bovis AF2122/97
cgguggugcgguc

SEQ ID NO: 1094215 - RNA, 23 nt, Mycobacterium bovis subsp bovis AF2122/97
cgguguccagugcauucccgccu

SEQ ID NO: 1094216 - RNA, 20 nt, Mycobacterium bovis subsp bovis AF2122/97
cggugucaugaacgaccgga

SEQ ID NO: 1094217 - RNA, 18 nt, Mycobacterium bovis subsp bovis AF2122/97
cgguguauccgacgucgg

SEQ ID NO: 1094218 - RNA, 17 nt, Mycobacterium bovis subsp bovis AF2122/97
cgguguauccgacuggc

SEQ ID NO: 1094219 - RNA, 14 nt, Mycobacterium bovis subsp bovis AF2122/97
cgguguagggcggc

SEQ ID NO: 1094220 - RNA, 17 nt, Mycobacterium bovis subsp bovis AF2122/97
cgguguagggcggcguu

SEQ ID NO: 1094221 - RNA, 20 nt, Mycobacterium bovis subsp bovis AF2122/97
cgguguaggccucggcagca

SEQ ID NO: 1094222 - RNA, 19 nt, Mycobacterium bovis subsp bovis AF2122/97
cgguguaggccugcccccg

SEQ ID NO: 1094223 - RNA, 14 nt, Mycobacterium bovis subsp bovis AF2122/97
cgguguagccgccg

SEQ ID NO: 1094224 - RNA, 20 nt, Mycobacterium bovis subsp bovis AF2122/97
cgguguagccgccggcagug

SEQ ID NO: 1094225 - RNA, 18 nt, Mycobacterium bovis subsp bovis AF2122/97
cgguguagccggcgccgc

SEQ ID NO: 1094226 - RNA, 21 nt, Mycobacterium bovis subsp bovis AF2122/97
cgguguagcaacgguagcggc

SEQ ID NO: 1094227 - RNA, 18 nt, Mycobacterium bovis subsp bovis AF2122/97
cgguguacucgaagcggg

SEQ ID NO: 1094228 - RNA, 17 nt, Mycobacterium bovis subsp bovis AF2122/97
cgguguagaagcgggcg

SEQ ID NO: 1094229 - RNA, 19 nt, Mycobacterium bovis subsp bovis AF2122/97
cgguguagagcgcaccgcg

SEQ ID NO: 1094230 - RNA, 20 nt, Mycobacterium bovis subsp bovis AF2122/97
cgguguagagcgcaccgcga

SEQ ID NO: 1094231 - RNA, 18 nt, Mycobacterium bovis subsp bovis AF2122/97
cgguguacaggucgccgg

SEQ ID NO: 1094232 - RNA, 23 nt, Mycobacterium bovis subsp bovis AF2122/97
cgguguacaggucgccggggccg

SEQ ID NO: 1094233 - RNA, 18 nt, Mycobacterium bovis subsp bovis AF2122/97
cgguguacagucgcgcgc

SEQ ID NO: 1094234 - RNA, 15 nt, Mycobacterium bovis subsp bovis AF2122/97
cgguguaacccucga

SEQ ID NO: 1094235 - RNA, 21 nt, Mycobacterium bovis subsp bovis AF2122/97
cggugguuuucccgucgccgc

SEQ ID NO: 1094236 - RNA, 21 nt, Mycobacterium bovis subsp bovis AF2122/97
cggugguugugcuguggucgg

SEQ ID NO: 1094237 - RNA, 23 nt, Mycobacterium bovis subsp bovis AF2122/97
cggugguuguggcgggucagcgc

SEQ ID NO: 1094238 - RNA, 18 nt, Mycobacterium bovis subsp bovis AF2122/97
cgguguggcccaacaccg

SEQ ID NO: 1094239 - RNA, 23 nt, Mycobacterium bovis subsp bovis AF2122/97
cgguguggcccaacaccgccaga

SEQ ID NO: 1094240 - RNA, 22 nt, Mycobacterium bovis subsp bovis AF2122/97
cgguguggacuucagcaggccc

SEQ ID NO: 1094241 - RNA, 20 nt, Mycobacterium bovis subsp bovis AF2122/97
cgguguggacuucagcaggc

SEQ ID NO: 1094242 - RNA, 17 nt, Mycobacterium bovis subsp bovis AF2122/97
cggugugcggcgcaugc

SEQ ID NO: 1094243 - RNA, 16 nt, Mycobacterium bovis subsp bovis AF2122/97
cggugugcucgccgac

SEQ ID NO: 1094244 - RNA, 18 nt, Mycobacterium bovis subsp bovis AF2122/97
cggugugcucgccgacca

SEQ ID NO: 1094245 - RNA, 14 nt, Mycobacterium bovis subsp bovis AF2122/97
cggugugcgugcgg

SEQ ID NO: 1094246 - RNA, 16 nt, Mycobacterium bovis subsp bovis AF2122/97
cggugugcgugcgguc

SEQ ID NO: 1094247 - RNA, 16 nt, Mycobacterium bovis subsp bovis AF2122/97
cggugugcgcaccccg

SEQ ID NO: 1094248 - RNA, 15 nt, Mycobacterium bovis subsp bovis AF2122/97
cggugugcgcgccag

SEQ ID NO: 1094249 - RNA, 16 nt, Mycobacterium bovis subsp bovis AF2122/97
cgguguugcgcacccg

SEQ ID NO: 1094250 - RNA, 19 nt, Mycobacterium bovis subsp bovis AF2122/97
cgguguugagcgaacccgc

SEQ ID NO: 1094251 - RNA, 21 nt, Mycobacterium bovis subsp bovis AF2122/97
cgguguucguggccgacagcg

SEQ ID NO: 1094252 - RNA, 22 nt, Mycobacterium bovis subsp bovis AF2122/97
cgguguggcgcugaucggcagg

SEQ ID NO: 1094253 - RNA, 14 nt, Mycobacterium bovis subsp bovis AF2122/97
cgguguggcuugcg

SEQ ID NO: 1094254 - RNA, 15 nt, Mycobacterium bovis subsp bovis AF2122/97
cgguguuccgcccag

SEQ ID NO: 1094255 - RNA, 14 nt, Mycobacterium bovis subsp bovis AF2122/97
cgguguuccgccgc

SEQ ID NO: 1094256 - RNA, 15 nt, Mycobacterium bovis subsp bovis AF2122/97
cgguguuccgccgcg

SEQ ID NO: 1094257 - RNA, 17 nt, Mycobacterium bovis subsp bovis AF2122/97
cgguguuccgccgcgcu

SEQ ID NO: 1094258 - RNA, 14 nt, Mycobacterium bovis subsp bovis AF2122/97
cggugugguggggc

SEQ ID NO: 1094259 - RNA, 17 nt, Mycobacterium bovis subsp bovis AF2122/97
cggugucuucugccauc

SEQ ID NO: 1094260 - RNA, 20 nt, Mycobacterium bovis subsp bovis AF2122/97
cggugucuucugccaucaac

SEQ ID NO: 1094261 - RNA, 22 nt, Mycobacterium bovis subsp bovis AF2122/97
cggugucuuccaacccaaccga

SEQ ID NO: 1094262 - RNA, 14 nt, Mycobacterium bovis subsp bovis AF2122/97
cggugucggugaca

SEQ ID NO: 1094263 - RNA, 15 nt, Mycobacterium bovis subsp bovis AF2122/97
cggugugcaggauca

SEQ ID NO: 1094264 - RNA, 17 nt, Mycobacterium bovis subsp bovis AF2122/97
cggugugcaucgccggc

SEQ ID NO: 1094265 - RNA, 21 nt, Mycobacterium bovis subsp bovis AF2122/97
cggugugccagugcugcaccg

SEQ ID NO: 1094266 - RNA, 16 nt, Mycobacterium bovis subsp bovis AF2122/97
cggugucgacggggaa

SEQ ID NO: 1094267 - RNA, 14 nt, Mycobacterium bovis subsp bovis AF2122/97
cggugugcccgccu

SEQ ID NO: 1094268 - RNA, 15 nt, Mycobacterium bovis subsp bovis AF2122/97
cggugugaucggcgg

SEQ ID NO: 1094269 - RNA, 15 nt, Mycobacterium bovis subsp bovis AF2122/97
cggugugcacggcga

SEQ ID NO: 1094270 - RNA, 17 nt, Mycobacterium bovis subsp bovis AF2122/97
cggugucggggcccccg

SEQ ID NO: 1094271 - RNA, 15 nt, Mycobacterium bovis subsp bovis AF2122/97
cggugucggccagca

SEQ ID NO: 1094272 - RNA, 13 nt, Mycobacterium bovis subsp bovis AF2122/97
cggugucggccgc

SEQ ID NO: 1094273 - RNA, 12 nt, Mycobacterium bovis subsp bovis AF2122/97
cggugucgacgg

SEQ ID NO: 1094274 - RNA, 13 nt, Mycobacterium bovis subsp bovis AF2122/97
cggugucgaugcu

SEQ ID NO: 1094275 - RNA, 14 nt, Mycobacterium bovis subsp bovis AF2122/97
cggugucgaugcug

SEQ ID NO: 1094276 - RNA, 19 nt, Mycobacterium bovis subsp bovis AF2122/97
cgguguccagccacgcugu

SEQ ID NO: 1094277 - RNA, 14 nt, Mycobacterium bovis subsp bovis AF2122/97
cgguuccggccggc

SEQ ID NO: 1094278 - RNA, 18 nt, Mycobacterium bovis subsp bovis AF2122/97
cgguucccgggcagccgc

SEQ ID NO: 1094279 - RNA, 19 nt, Mycobacterium bovis subsp bovis AF2122/97
cgguuccgauagccgacca

SEQ ID NO: 1094280 - RNA, 23 nt, Mycobacterium bovis subsp bovis AF2122/97
cgguuccgccaggccgaccgcgc

SEQ ID NO: 1094281 - RNA, 15 nt, Mycobacterium bovis subsp bovis AF2122/97
cgguuccgccggccc

SEQ ID NO: 1094282 - RNA, 15 nt, Mycobacterium bovis subsp bovis AF2122/97
cgguucugcgcccac

SEQ ID NO: 1094283 - RNA, 14 nt, Mycobacterium bovis subsp bovis AF2122/97
cgguucugcggccg

SEQ ID NO: 1094284 - RNA, 16 nt, Mycobacterium bovis subsp bovis AF2122/97
cgguucugcggccgcg

SEQ ID NO: 1094285 - RNA, 14 nt, Mycobacterium bovis subsp bovis AF2122/97
cgguugacacccgg

SEQ ID NO: 1094286 - RNA, 14 nt, Mycobacterium bovis subsp bovis AF2122/97
cgguugaacgaccu

SEQ ID NO: 1094287 - RNA, 15 nt, Mycobacterium bovis subsp bovis AF2122/97
cgguucugggccugc

SEQ ID NO: 1094288 - RNA, 24 nt, Mycobacterium bovis subsp bovis AF2122/97
cgguugacgggcucggcaggcccg

SEQ ID NO: 1094289 - RNA, 15 nt, Mycobacterium bovis subsp bovis AF2122/97
cgguugacgggcucg

SEQ ID NO: 1094290 - RNA, 16 nt, Mycobacterium bovis subsp bovis AF2122/97
cgguugacgggcucgg

SEQ ID NO: 1094291 - RNA, 18 nt, Mycobacterium bovis subsp bovis AF2122/97
cgguugacgggcucggca

SEQ ID NO: 1094292 - RNA, 17 nt, Mycobacterium bovis subsp bovis AF2122/97
cgguugaccggucgacc

SEQ ID NO: 1094293 - RNA, 20 nt, Mycobacterium bovis subsp bovis AF2122/97
cgguugacacccgggccacc

SEQ ID NO: 1094294 - RNA, 16 nt, Mycobacterium bovis subsp bovis AF2122/97
cgguuccauacagccg

SEQ ID NO: 1094295 - RNA, 19 nt, Mycobacterium bovis subsp bovis AF2122/97
cgguuccauacagccgccg

SEQ ID NO: 1094296 - RNA, 19 nt, Mycobacterium bovis subsp bovis AF2122/97
cgguuccauugcgaacucg

SEQ ID NO: 1094297 - RNA, 16 nt, Mycobacterium bovis subsp bovis AF2122/97
cgguuccacgcugccc

SEQ ID NO: 1094298 - RNA, 21 nt, Mycobacterium bovis subsp bovis AF2122/97
cgguucagggguggcgcgggc

SEQ ID NO: 1094299 - RNA, 21 nt, Mycobacterium bovis subsp bovis AF2122/97
cgguucagcgcuggcaggccg

SEQ ID NO: 1094300 - RNA, 15 nt, Mycobacterium bovis subsp bovis AF2122/97
cgguguuggugaccg

SEQ ID NO: 1094301 - RNA, 17 nt, Mycobacterium bovis subsp bovis AF2122/97
cgguguuggugaccggg

SEQ ID NO: 1094302 - RNA, 15 nt, Mycobacterium bovis subsp bovis AF2122/97
cgguguugguggccg

SEQ ID NO: 1094303 - RNA, 15 nt, Mycobacterium bovis subsp bovis AF2122/97
cgguguugguguucg

SEQ ID NO: 1094304 - RNA, 20 nt, Mycobacterium bovis subsp bovis AF2122/97
cgguguuguaggccgggccg

SEQ ID NO: 1094305 - RNA, 23 nt, Mycobacterium bovis subsp bovis AF2122/97
cgguguuguaggccgggccggcc

SEQ ID NO: 1094306 - RNA, 21 nt, Mycobacterium bovis subsp bovis AF2122/97
cgguguuuaugguugugcggc

SEQ ID NO: 1094307 - RNA, 17 nt, Mycobacterium bovis subsp bovis AF2122/97
cgguuaaggugcgaucc

SEQ ID NO: 1094308 - RNA, 16 nt, Mycobacterium bovis subsp bovis AF2122/97
cgguguuuccgaaacc

SEQ ID NO: 1094309 - RNA, 19 nt, Mycobacterium bovis subsp bovis AF2122/97
cgguguuuccgaaacccgc

SEQ ID NO: 1094310 - RNA, 23 nt, Mycobacterium bovis subsp bovis AF2122/97
cgguguuuccgaaacccgccgcg

SEQ ID NO: 1094311 - RNA, 22 nt, Mycobacterium bovis subsp bovis AF2122/97
cgguugcggucaucggcgccaa

SEQ ID NO: 1094312 - RNA, 17 nt, Mycobacterium bovis subsp bovis AF2122/97
cgguugcugugucgugg

SEQ ID NO: 1094313 - RNA, 18 nt, Mycobacterium bovis subsp bovis AF2122/97
cgguuggaucggcggccg

SEQ ID NO: 1094314 - RNA, 13 nt, Mycobacterium bovis subsp bovis AF2122/97
cgguuggccacca

SEQ ID NO: 1094315 - RNA, 21 nt, Mycobacterium bovis subsp bovis AF2122/97
cgguuggccagccacagccga

SEQ ID NO: 1094316 - RNA, 18 nt, Mycobacterium bovis subsp bovis AF2122/97
cgguuggguagcaccgau

SEQ ID NO: 1094317 - RNA, 13 nt, Mycobacterium bovis subsp bovis AF2122/97
cgguugggcgaaa

SEQ ID NO: 1094318 - RNA, 17 nt, Mycobacterium bovis subsp bovis AF2122/97
cgguugguccgccgucg

SEQ ID NO: 1094319 - RNA, 21 nt, Mycobacterium bovis subsp bovis AF2122/97
cgguugguccgccgucgacca

SEQ ID NO: 1094320 - RNA, 22 nt, Mycobacterium bovis subsp bovis AF2122/97
cgguuguguugggagccaccgg

SEQ ID NO: 1094321 - RNA, 15 nt, Mycobacterium bovis subsp bovis AF2122/97
cgguuguccggucgc

SEQ ID NO: 1094322 - RNA, 19 nt, Mycobacterium bovis subsp bovis AF2122/97
cgguuguccuccgacgggg

SEQ ID NO: 1094323 - RNA, 18 nt, Mycobacterium bovis subsp bovis AF2122/97
cgguuguggaaccacggc

SEQ ID NO: 1094324 - RNA, 16 nt, Mycobacterium bovis subsp bovis AF2122/97
cgguuuccagacgacc

SEQ ID NO: 1094325 - RNA, 17 nt, Mycobacterium bovis subsp bovis AF2122/97
cgguuuccagacgacca

SEQ ID NO: 1094326 - RNA, 20 nt, Mycobacterium bovis subsp bovis AF2122/97
cguaaacagcgcgccggcgu

SEQ ID NO: 1094327 - RNA, 15 nt, Mycobacterium bovis subsp bovis AF2122/97
cguaaaagccgauga

SEQ ID NO: 1094328 - RNA, 17 nt, Mycobacterium bovis subsp bovis AF2122/97
cguaaaagccgaugacg

SEQ ID NO: 1094329 - RNA, 17 nt, Mycobacterium bovis subsp bovis AF2122/97
cguaaagggcgucguag

SEQ ID NO: 1094330 - RNA, 15 nt, Mycobacterium bovis subsp bovis AF2122/97
cguaaagccaacugg

SEQ ID NO: 1094331 - RNA, 15 nt, Mycobacterium bovis subsp bovis AF2122/97
cguaaauagcgcccu

SEQ ID NO: 1094332 - RNA, 23 nt, Mycobacterium bovis subsp bovis AF2122/97
cgucgaucagaacgugacggucc

SEQ ID NO: 1094333 - RNA, 18 nt, Mycobacterium bovis subsp bovis AF2122/97
cgucgaugaugccggaca

SEQ ID NO: 1094334 - RNA, 15 nt, Mycobacterium bovis subsp bovis AF2122/97
cgucgaugcgguggu

SEQ ID NO: 1094335 - RNA, 15 nt, Mycobacterium bovis subsp bovis AF2122/97
cgucgaugcgggcca

SEQ ID NO: 1094336 - RNA, 13 nt, Mycobacterium bovis subsp bovis AF2122/97
cgucgauggccac

SEQ ID NO: 1094337 - RNA, 23 nt, Mycobacterium bovis subsp bovis AF2122/97
cgucgaucacgugguccaaccgg

SEQ ID NO: 1094338 - RNA, 14 nt, Mycobacterium bovis subsp bovis AF2122/97
cgucgaugagucgg

SEQ ID NO: 1094339 - RNA, 17 nt, Mycobacterium bovis subsp bovis AF2122/97
cgucgaugagcgguacc

SEQ ID NO: 1094340 - RNA, 14 nt, Mycobacterium bovis subsp bovis AF2122/97
cgucgaucacgucg

SEQ ID NO: 1094341 - RNA, 18 nt, Mycobacterium bovis subsp bovis AF2122/97
cgucgaucacgucgucag

SEQ ID NO: 1094342 - RNA, 13 nt, Mycobacterium bovis subsp bovis AF2122/97
cgucgaucaccug

SEQ ID NO: 1094343 - RNA, 19 nt, Mycobacterium bovis subsp bovis AF2122/97
cgucgaucaacaacagccg

SEQ ID NO: 1094344 - RNA, 20 nt, Mycobacterium bovis subsp bovis AF2122/97
cgucgaucaagugcgguccg

SEQ ID NO: 1094345 - RNA, 21 nt, Mycobacterium bovis subsp bovis AF2122/97
cgucgaucaagugcgguccgg

SEQ ID NO: 1094346 - RNA, 14 nt, Mycobacterium bovis subsp bovis AF2122/97
cgucgauaucgcga

SEQ ID NO: 1094347 - RNA, 15 nt, Mycobacterium bovis subsp bovis AF2122/97
cgucgacggcggccg

SEQ ID NO: 1094348 - RNA, 15 nt, Mycobacterium bovis subsp bovis AF2122/97
cgucgacgcgucgug

SEQ ID NO: 1094349 - RNA, 19 nt, Mycobacterium bovis subsp bovis AF2122/97
cgucgaaauacccggucca

SEQ ID NO: 1094350 - RNA, 14 nt, Mycobacterium bovis subsp bovis AF2122/97
cgucgacggccugg

SEQ ID NO: 1094351 - RNA, 22 nt, Mycobacterium bovis subsp bovis AF2122/97
cgucgacggccuggggcagccg

SEQ ID NO: 1094352 - RNA, 20 nt, Mycobacterium bovis subsp bovis AF2122/97
cgucgacgcccauggcgucg

SEQ ID NO: 1094353 - RNA, 14 nt, Mycobacterium bovis subsp bovis AF2122/97
cgucgacgcggccg

SEQ ID NO: 1094354 - RNA, 16 nt, Mycobacterium bovis subsp bovis AF2122/97
cgucgacgcggccggc

SEQ ID NO: 1094355 - RNA, 17 nt, Mycobacterium bovis subsp bovis AF2122/97
cgucgacgcggccggcc

SEQ ID NO: 1094356 - RNA, 17 nt, Mycobacterium bovis subsp bovis AF2122/97
cgucgacgauucccgcg

SEQ ID NO: 1094357 - RNA, 18 nt, Mycobacterium bovis subsp bovis AF2122/97
cgucgacgauucccgcgg

SEQ ID NO: 1094358 - RNA, 14 nt, Mycobacterium bovis subsp bovis AF2122/97
cgucgacgccgauc

SEQ ID NO: 1094359 - RNA, 15 nt, Mycobacterium bovis subsp bovis AF2122/97
cgucgacgccgaucg

SEQ ID NO: 1094360 - RNA, 14 nt, Mycobacterium bovis subsp bovis AF2122/97
cgucgagugccgcc

SEQ ID NO: 1094361 - RNA, 18 nt, Mycobacterium bovis subsp bovis AF2122/97
cgucgagugccgccaccg

SEQ ID NO: 1094362 - RNA, 19 nt, Mycobacterium bovis subsp bovis AF2122/97
cgucgagugccgccaccgc

SEQ ID NO: 1094363 - RNA, 19 nt, Mycobacterium bovis subsp bovis AF2122/97
cgucgacggcgauggcgcg

SEQ ID NO: 1094364 - RNA, 21 nt, Mycobacterium bovis subsp bovis AF2122/97
cgucgacggcgauggcgcgca

SEQ ID NO: 1094365 - RNA, 19 nt, Mycobacterium bovis subsp bovis AF2122/97
cgucgaguccaggccggca

SEQ ID NO: 1094366 - RNA, 22 nt, Mycobacterium bovis subsp bovis AF2122/97
cgucgaguccaggccggcagcu

SEQ ID NO: 1094367 - RNA, 15 nt, Mycobacterium bovis subsp bovis AF2122/97
cgucgaguuggccau

SEQ ID NO: 1094368 - RNA, 17 nt, Mycobacterium bovis subsp bovis AF2122/97
cgucgaguuccggccgg

SEQ ID NO: 1094369 - RNA, 18 nt, Mycobacterium bovis subsp bovis AF2122/97
cgucgccgaacagcgacg

SEQ ID NO: 1094370 - RNA, 19 nt, Mycobacterium bovis subsp bovis AF2122/97
cgucgccgaacagcgacgc

SEQ ID NO: 1094371 - RNA, 22 nt, Mycobacterium bovis subsp bovis AF2122/97
cgucgccgaacagugcgguccc

SEQ ID NO: 1094372 - RNA, 22 nt, Mycobacterium bovis subsp bovis AF2122/97
cgucgcccuuagggucgccgca

SEQ ID NO: 1094373 - RNA, 14 nt, Mycobacterium bovis subsp bovis AF2122/97
cgucgccgacgccg

SEQ ID NO: 1094374 - RNA, 15 nt, Mycobacterium bovis subsp bovis AF2122/97
cgucgccgacgccgg

SEQ ID NO: 1094375 - RNA, 23 nt, Mycobacterium bovis subsp bovis AF2122/97
cgucgcccggguggcgucgaucu

SEQ ID NO: 1094376 - RNA, 14 nt, Mycobacterium bovis subsp bovis AF2122/97
cgucgcccccggcc

SEQ ID NO: 1094377 - RNA, 22 nt, Mycobacterium bovis subsp bovis AF2122/97
cgucgcccugacacaacaccgg

SEQ ID NO: 1094378 - RNA, 19 nt, Mycobacterium bovis subsp bovis AF2122/97
cgucgccgaucagcugcgc

SEQ ID NO: 1094379 - RNA, 14 nt, Mycobacterium bovis subsp bovis AF2122/97
cgucgccgagcggg

SEQ ID NO: 1094380 - RNA, 17 nt, Mycobacterium bovis subsp bovis AF2122/97
cgucgccgcccuggccg

SEQ ID NO: 1094381 - RNA, 21 nt, Mycobacterium bovis subsp bovis AF2122/97
cgucgccgcccuggccgccgg

SEQ ID NO: 1094382 - RNA, 13 nt, Mycobacterium bovis subsp bovis AF2122/97
cgucgccgccauu

SEQ ID NO: 1094383 - RNA, 13 nt, Mycobacterium bovis subsp bovis AF2122/97
cgucgccgcccgu

SEQ ID NO: 1094384 - RNA, 16 nt, Mycobacterium bovis subsp bovis AF2122/97
cgucgccgcccgugcc

SEQ ID NO: 1094385 - RNA, 19 nt, Mycobacterium bovis subsp bovis AF2122/97
cgucgccgcccgugccgcc

SEQ ID NO: 1094386 - RNA, 12 nt, Mycobacterium bovis subsp bovis AF2122/97
cgucgccgccgc

SEQ ID NO: 1094387 - RNA, 18 nt, Mycobacterium bovis subsp bovis AF2122/97
cgucgccgccgcgggcgc

SEQ ID NO: 1094388 - RNA, 17 nt, Mycobacterium bovis subsp bovis AF2122/97
cgucgccgccgcuaccg

SEQ ID NO: 1094389 - RNA, 18 nt, Mycobacterium bovis subsp bovis AF2122/97
cgucgccgccgcuaccgc

SEQ ID NO: 1094390 - RNA, 21 nt, Mycobacterium bovis subsp bovis AF2122/97
cgucgccgccgcuaccgccgg

SEQ ID NO: 1094391 - RNA, 22 nt, Mycobacterium bovis subsp bovis AF2122/97
cgucgcacgagccaacaagucg

SEQ ID NO: 1094392 - RNA, 14 nt, Mycobacterium bovis subsp bovis AF2122/97
cgucgcacgcgcgc

SEQ ID NO: 1094393 - RNA, 22 nt, Mycobacterium bovis subsp bovis AF2122/97
cgucgcacgcgcgcaggccgcc

SEQ ID NO: 1094394 - RNA, 18 nt, Mycobacterium bovis subsp bovis AF2122/97
cgucgauggccacccggu

SEQ ID NO: 1094395 - RNA, 14 nt, Mycobacterium bovis subsp bovis AF2122/97
cgucgauggcgucg

SEQ ID NO: 1094396 - RNA, 16 nt, Mycobacterium bovis subsp bovis AF2122/97
cgucgauggcgucggu

SEQ ID NO: 1094397 - RNA, 15 nt, Mycobacterium bovis subsp bovis AF2122/97
cgucgcaucaccagg

SEQ ID NO: 1094398 - RNA, 23 nt, Mycobacterium bovis subsp bovis AF2122/97
cgucgcaaggcccgcaccgcuga

SEQ ID NO: 1094399 - RNA, 20 nt, Mycobacterium bovis subsp bovis AF2122/97
cgucgcaguauucacagucg

SEQ ID NO: 1094400 - RNA, 20 nt, Mycobacterium bovis subsp bovis AF2122/97
cgucgcaggauucccagucg

SEQ ID NO: 1094401 - RNA, 15 nt, Mycobacterium bovis subsp bovis AF2122/97
cgucgcagaaaccau

SEQ ID NO: 1094402 - RNA, 23 nt, Mycobacterium bovis subsp bovis AF2122/97
cgucgcccauuuugaacgcugcc

SEQ ID NO: 1094403 - RNA, 22 nt, Mycobacterium bovis subsp bovis AF2122/97
cgucgccaagcccaggcgaucg

SEQ ID NO: 1094404 - RNA, 14 nt, Mycobacterium bovis subsp bovis AF2122/97
cgucgcccaggcgu

SEQ ID NO: 1094405 - RNA, 15 nt, Mycobacterium bovis subsp bovis AF2122/97
cgucgcccagugcgc

SEQ ID NO: 1094406 - RNA, 19 nt, Mycobacterium bovis subsp bovis AF2122/97
cgucgccaaucugcgcgag

SEQ ID NO: 1094407 - RNA, 19 nt, Mycobacterium bovis subsp bovis AF2122/97
cgucgcccagugcgcaacc

SEQ ID NO: 1094408 - RNA, 16 nt, Mycobacterium bovis subsp bovis AF2122/97
cgucgcaucaccaggg

SEQ ID NO: 1094409 - RNA, 18 nt, Mycobacterium bovis subsp bovis AF2122/97
cgucgcaucaccagggug

SEQ ID NO: 1094410 - RNA, 17 nt, Mycobacterium bovis subsp bovis AF2122/97
cgucggagccggccacc

SEQ ID NO: 1094411 - RNA, 16 nt, Mycobacterium bovis subsp bovis AF2122/97
cgucggccaccgccug

SEQ ID NO: 1094412 - RNA, 18 nt, Mycobacterium bovis subsp bovis AF2122/97
cgucggagaccagcucgu

SEQ ID NO: 1094413 - RNA, 24 nt, Mycobacterium bovis subsp bovis AF2122/97
cgucggacggcugagacagaccgg

SEQ ID NO: 1094414 - RNA, 17 nt, Mycobacterium bovis subsp bovis AF2122/97
cgucggccagcagauca

SEQ ID NO: 1094415 - RNA, 14 nt, Mycobacterium bovis subsp bovis AF2122/97
cgucggccaccgcg

SEQ ID NO: 1094416 - RNA, 20 nt, Mycobacterium bovis subsp bovis AF2122/97
cgucggccaggaucaaccgg

SEQ ID NO: 1094417 - RNA, 14 nt, Mycobacterium bovis subsp bovis AF2122/97
cgucggccagcagc

SEQ ID NO: 1094418 - RNA, 12 nt, Mycobacterium bovis subsp bovis AF2122/97
cgucggccagug

SEQ ID NO: 1094419 - RNA, 17 nt, Mycobacterium bovis subsp bovis AF2122/97
cgucggcccgcggucgc

SEQ ID NO: 1094420 - RNA, 12 nt, Mycobacterium bovis subsp bovis AF2122/97
cgucggccgaca

SEQ ID NO: 1094421 - RNA, 13 nt, Mycobacterium bovis subsp bovis AF2122/97
cgucggccgacac

SEQ ID NO: 1094422 - RNA, 15 nt, Mycobacterium bovis subsp bovis AF2122/97
cgucggccgacaccg

SEQ ID NO: 1094423 - RNA, 18 nt, Mycobacterium bovis subsp bovis AF2122/97
cgucggccgacaccgcca

SEQ ID NO: 1094424 - RNA, 22 nt, Mycobacterium bovis subsp bovis AF2122/97
cgucggccgacaccgccaccac

SEQ ID NO: 1094425 - RNA, 12 nt, Mycobacterium bovis subsp bovis AF2122/97
cgucggccgcau

SEQ ID NO: 1094426 - RNA, 12 nt, Mycobacterium bovis subsp bovis AF2122/97
cgucggccggca

SEQ ID NO: 1094427 - RNA, 14 nt, Mycobacterium bovis subsp bovis AF2122/97
cgucggccggcacc

SEQ ID NO: 1094428 - RNA, 22 nt, Mycobacterium bovis subsp bovis AF2122/97
cgucggccggcaccccacggcc

SEQ ID NO: 1094429 - RNA, 14 nt, Mycobacterium bovis subsp bovis AF2122/97
cgucggccucggcg

SEQ ID NO: 1094430 - RNA, 17 nt, Mycobacterium bovis subsp bovis AF2122/97
cgucggccagugcgcgc

SEQ ID NO: 1094431 - RNA, 17 nt, Mycobacterium bovis subsp bovis AF2122/97
cgucggccugcgccggc

SEQ ID NO: 1094432 - RNA, 18 nt, Mycobacterium bovis subsp bovis AF2122/97
cgucggccugcgccggcg

SEQ ID NO: 1094433 - RNA, 23 nt, Mycobacterium bovis subsp bovis AF2122/97
cgucggccugcgccggcgcugcc

SEQ ID NO: 1094434 - RNA, 18 nt, Mycobacterium bovis subsp bovis AF2122/97
cgucggcgacggccagcg

SEQ ID NO: 1094435 - RNA, 16 nt, Mycobacterium bovis subsp bovis AF2122/97
cgucggcgacguccag

SEQ ID NO: 1094436 - RNA, 13 nt, Mycobacterium bovis subsp bovis AF2122/97
cgucggcgaaggg

SEQ ID NO: 1094437 - RNA, 14 nt, Mycobacterium bovis subsp bovis AF2122/97
cgucggcgaaggug

SEQ ID NO: 1094438 - RNA, 12 nt, Mycobacterium bovis subsp bovis AF2122/97
cgucggcgacca

SEQ ID NO: 1094439 - RNA, 17 nt, Mycobacterium bovis subsp bovis AF2122/97
cgucggcgagcucggcc

SEQ ID NO: 1094440 - RNA, 20 nt, Mycobacterium bovis subsp bovis AF2122/97
cgucggaacugaccacgucg

SEQ ID NO: 1094441 - RNA, 17 nt, Mycobacterium bovis subsp bovis AF2122/97
cgucggaauacaacagc

SEQ ID NO: 1094442 - RNA, 17 nt, Mycobacterium bovis subsp bovis AF2122/97
cgucggacauaccgcga

SEQ ID NO: 1094443 - RNA, 20 nt, Mycobacterium bovis subsp bovis AF2122/97
cgucgcggguccaggcguug

SEQ ID NO: 1094444 - RNA, 15 nt, Mycobacterium bovis subsp bovis AF2122/97
cgucgcggucgauca

SEQ ID NO: 1094445 - RNA, 15 nt, Mycobacterium bovis subsp bovis AF2122/97
cgucgcguccgcgau

SEQ ID NO: 1094446 - RNA, 18 nt, Mycobacterium bovis subsp bovis AF2122/97
cgucgcguccgcgaucug

SEQ ID NO: 1094447 - RNA, 12 nt, Mycobacterium bovis subsp bovis AF2122/97
cgucgcgucgac

SEQ ID NO: 1094448 - RNA, 16 nt, Mycobacterium bovis subsp bovis AF2122/97
cgucgcgucgccaggc

SEQ ID NO: 1094449 - RNA, 18 nt, Mycobacterium bovis subsp bovis AF2122/97
cgucgcgugggaugucga

SEQ ID NO: 1094450 - RNA, 22 nt, Mycobacterium bovis subsp bovis AF2122/97
cgucgcugggaggcgcggucga

SEQ ID NO: 1094451 - RNA, 16 nt, Mycobacterium bovis subsp bovis AF2122/97
cgucgcgggcgauggc

SEQ ID NO: 1094452 - RNA, 13 nt, Mycobacterium bovis subsp bovis AF2122/97
cgucgcgacgucg

SEQ ID NO: 1094453 - RNA, 23 nt, Mycobacterium bovis subsp bovis AF2122/97
cgucgcgggagaaaacggcggcg

SEQ ID NO: 1094454 - RNA, 19 nt, Mycobacterium bovis subsp bovis AF2122/97
cgucgcgaguagcugaccc

SEQ ID NO: 1094455 - RNA, 19 nt, Mycobacterium bovis subsp bovis AF2122/97
cgucgccggucaggccgcc

SEQ ID NO: 1094456 - RNA, 21 nt, Mycobacterium bovis subsp bovis AF2122/97
cgucgccggucaggccgccgc

SEQ ID NO: 1094457 - RNA, 16 nt, Mycobacterium bovis subsp bovis AF2122/97
cgucgccggugacgac

SEQ ID NO: 1094458 - RNA, 12 nt, Mycobacterium bovis subsp bovis AF2122/97
cgucgccgccgu

SEQ ID NO: 1094459 - RNA, 15 nt, Mycobacterium bovis subsp bovis AF2122/97
cgucgccgccgggca

SEQ ID NO: 1094460 - RNA, 14 nt, Mycobacterium bovis subsp bovis AF2122/97
cgucgccgccgcgg

SEQ ID NO: 1094461 - RNA, 19 nt, Mycobacterium bovis subsp bovis AF2122/97
cgucgccgccggcgccgcc

SEQ ID NO: 1094462 - RNA, 20 nt, Mycobacterium bovis subsp bovis AF2122/97
cgucgccgccggcgccgccg

SEQ ID NO: 1094463 - RNA, 14 nt, Mycobacterium bovis subsp bovis AF2122/97
cgucgccgccggcu

SEQ ID NO: 1094464 - RNA, 23 nt, Mycobacterium bovis subsp bovis AF2122/97
cgucgccgccggcuccggcggug

SEQ ID NO: 1094465 - RNA, 15 nt, Mycobacterium bovis subsp bovis AF2122/97
cgucgccugccgacg

SEQ ID NO: 1094466 - RNA, 13 nt, Mycobacterium bovis subsp bovis AF2122/97
cgucgccugcgac

SEQ ID NO: 1094467 - RNA, 13 nt, Mycobacterium bovis subsp bovis AF2122/97
cgucgccgucggu

SEQ ID NO: 1094468 - RNA, 15 nt, Mycobacterium bovis subsp bovis AF2122/97
cgucgggcaccgcca

SEQ ID NO: 1094469 - RNA, 14 nt, Mycobacterium bovis subsp bovis AF2122/97
cgucgggccgucgg

SEQ ID NO: 1094470 - RNA, 18 nt, Mycobacterium bovis subsp bovis AF2122/97
cgucgggccgucgggugu

SEQ ID NO: 1094471 - RNA, 16 nt, Mycobacterium bovis subsp bovis AF2122/97
cgucgggcauggcggc

SEQ ID NO: 1094472 - RNA, 14 nt, Mycobacterium bovis subsp bovis AF2122/97
cgucgggcccagcc

SEQ ID NO: 1094473 - RNA, 20 nt, Mycobacterium bovis subsp bovis AF2122/97
cgucgggcuaauccagcagc

SEQ ID NO: 1094474 - RNA, 23 nt, Mycobacterium bovis subsp bovis AF2122/97
cgucgggcacaccgacgccgcca

SEQ ID NO: 1094475 - RNA, 24 nt, Mycobacterium bovis subsp bovis AF2122/97
cgucgggugcagcacggcgccgcc

SEQ ID NO: 1094476 - RNA, 15 nt, Mycobacterium bovis subsp bovis AF2122/97
cgucgggguggcggu

SEQ ID NO: 1094477 - RNA, 20 nt, Mycobacterium bovis subsp bovis AF2122/97
cgucgggguugauguagagc

SEQ ID NO: 1094478 - RNA, 20 nt, Mycobacterium bovis subsp bovis AF2122/97
cgucggggucguugaggccg

SEQ ID NO: 1094479 - RNA, 19 nt, Mycobacterium bovis subsp bovis AF2122/97
cgucggugaucaccgcggc

SEQ ID NO: 1094480 - RNA, 14 nt, Mycobacterium bovis subsp bovis AF2122/97
cgucggugagcgcg

SEQ ID NO: 1094481 - RNA, 19 nt, Mycobacterium bovis subsp bovis AF2122/97
cgucggugagcgcgucgcg

SEQ ID NO: 1094482 - RNA, 22 nt, Mycobacterium bovis subsp bovis AF2122/97
cgucggugagcgcgucgcggga

SEQ ID NO: 1094483 - RNA, 15 nt, Mycobacterium bovis subsp bovis AF2122/97
cgucggugaaugccg

SEQ ID NO: 1094484 - RNA, 12 nt, Mycobacterium bovis subsp bovis AF2122/97
cgucggucgucg

SEQ ID NO: 1094485 - RNA, 17 nt, Mycobacterium bovis subsp bovis AF2122/97
cgucggugaaugccguc

SEQ ID NO: 1094486 - RNA, 18 nt, Mycobacterium bovis subsp bovis AF2122/97
cgucggugaaauucgcgg

SEQ ID NO: 1094487 - RNA, 15 nt, Mycobacterium bovis subsp bovis AF2122/97
cgucggugaacgcgu

SEQ ID NO: 1094488 - RNA, 13 nt, Mycobacterium bovis subsp bovis AF2122/97
cgucgguccaccc

SEQ ID NO: 1094489 - RNA, 23 nt, Mycobacterium bovis subsp bovis AF2122/97
cgucgguccacccaagcucgguc

SEQ ID NO: 1094490 - RNA, 21 nt, Mycobacterium bovis subsp bovis AF2122/97
cgucggucaugucggccaccg

SEQ ID NO: 1094491 - RNA, 18 nt, Mycobacterium bovis subsp bovis AF2122/97
cgucgguaaugccgggcc

SEQ ID NO: 1094492 - RNA, 17 nt, Mycobacterium bovis subsp bovis AF2122/97
cgucgggucaaugcugg

SEQ ID NO: 1094493 - RNA, 20 nt, Mycobacterium bovis subsp bovis AF2122/97
cgucgggucacccagauacc

SEQ ID NO: 1094494 - RNA, 16 nt, Mycobacterium bovis subsp bovis AF2122/97
cgucggguugucgcgg

SEQ ID NO: 1094495 - RNA, 22 nt, Mycobacterium bovis subsp bovis AF2122/97
cgucgguaagcgccaaggcgau

SEQ ID NO: 1094496 - RNA, 16 nt, Mycobacterium bovis subsp bovis AF2122/97
cgucggucaucgguug

SEQ ID NO: 1094497 - RNA, 19 nt, Mycobacterium bovis subsp bovis AF2122/97
cgucggucaugucggccac

SEQ ID NO: 1094498 - RNA, 15 nt, Mycobacterium bovis subsp bovis AF2122/97
cgucggggugccggc

SEQ ID NO: 1094499 - RNA, 18 nt, Mycobacterium bovis subsp bovis AF2122/97
cgucggguagggcaucgu

SEQ ID NO: 1094500 - RNA, 16 nt, Mycobacterium bovis subsp bovis AF2122/97
cgucggcgccggcggc

SEQ ID NO: 1094501 - RNA, 18 nt, Mycobacterium bovis subsp bovis AF2122/97
cgucggcgccucggacca

SEQ ID NO: 1094502 - RNA, 15 nt, Mycobacterium bovis subsp bovis AF2122/97
cgucggcgcgcaccu

SEQ ID NO: 1094503 - RNA, 13 nt, Mycobacterium bovis subsp bovis AF2122/97
cgucggcgcggcc

SEQ ID NO: 1094504 - RNA, 14 nt, Mycobacterium bovis subsp bovis AF2122/97
cgucggcgcggccg

SEQ ID NO: 1094505 - RNA, 19 nt, Mycobacterium bovis subsp bovis AF2122/97
cgucggcgcucgucgcggc

SEQ ID NO: 1094506 - RNA, 14 nt, Mycobacterium bovis subsp bovis AF2122/97
cgucggcgcugacg

SEQ ID NO: 1094507 - RNA, 15 nt, Mycobacterium bovis subsp bovis AF2122/97
cgucggcggagagca

SEQ ID NO: 1094508 - RNA, 23 nt, Mycobacterium bovis subsp bovis AF2122/97
cgucggcggccgucaccggucgg

SEQ ID NO: 1094509 - RNA, 14 nt, Mycobacterium bovis subsp bovis AF2122/97
cgucggcgcugcgc

SEQ ID NO: 1094510 - RNA, 16 nt, Mycobacterium bovis subsp bovis AF2122/97
cgucggcggcgaccgc

SEQ ID NO: 1094511 - RNA, 17 nt, Mycobacterium bovis subsp bovis AF2122/97
cgucggcgggcugcagu

SEQ ID NO: 1094512 - RNA, 18 nt, Mycobacterium bovis subsp bovis AF2122/97
cgucggcgggcggcagcg

SEQ ID NO: 1094513 - RNA, 14 nt, Mycobacterium bovis subsp bovis AF2122/97
cgucggcggugagc

SEQ ID NO: 1094514 - RNA, 16 nt, Mycobacterium bovis subsp bovis AF2122/97
cgucggcggugagcaa

SEQ ID NO: 1094515 - RNA, 21 nt, Mycobacterium bovis subsp bovis AF2122/97
cgucggcggugagcaacuggc

SEQ ID NO: 1094516 - RNA, 17 nt, Mycobacterium bovis subsp bovis AF2122/97
cgucggcguagacguag

SEQ ID NO: 1094517 - RNA, 13 nt, Mycobacterium bovis subsp bovis AF2122/97
cgucggcgucgag

SEQ ID NO: 1094518 - RNA, 16 nt, Mycobacterium bovis subsp bovis AF2122/97
cgucgggaccaccgac

SEQ ID NO: 1094519 - RNA, 19 nt, Mycobacterium bovis subsp bovis AF2122/97
cgucgggaccaccgaccgc

SEQ ID NO: 1094520 - RNA, 13 nt, Mycobacterium bovis subsp bovis AF2122/97
cgucggcgucgaa

SEQ ID NO: 1094521 - RNA, 23 nt, Mycobacterium bovis subsp bovis AF2122/97
cgucggcguggucgcgcggcacc

SEQ ID NO: 1094522 - RNA, 14 nt, Mycobacterium bovis subsp bovis AF2122/97
cgucgggcaccgcc

SEQ ID NO: 1094523 - RNA, 17 nt, Mycobacterium bovis subsp bovis AF2122/97
cgucgggcacaccgacg

SEQ ID NO: 1094524 - RNA, 16 nt, Mycobacterium bovis subsp bovis AF2122/97
cgucgggacgccgccc

SEQ ID NO: 1094525 - RNA, 18 nt, Mycobacterium bovis subsp bovis AF2122/97
cgucgggacgccgccccc

SEQ ID NO: 1094526 - RNA, 17 nt, Mycobacterium bovis subsp bovis AF2122/97
cgucgggacggccaaca

SEQ ID NO: 1094527 - RNA, 22 nt, Mycobacterium bovis subsp bovis AF2122/97
cgucgggaucggcguccaucac

SEQ ID NO: 1094528 - RNA, 15 nt, Mycobacterium bovis subsp bovis AF2122/97
cgucgggaugcccgc

SEQ ID NO: 1094529 - RNA, 15 nt, Mycobacterium bovis subsp bovis AF2122/97
cgucgggaugcucga

SEQ ID NO: 1094530 - RNA, 14 nt, Mycobacterium bovis subsp bovis AF2122/97
cgucguagccacgc

SEQ ID NO: 1094531 - RNA, 18 nt, Mycobacterium bovis subsp bovis AF2122/97
cgucguaguacagcgcga

SEQ ID NO: 1094532 - RNA, 13 nt, Mycobacterium bovis subsp bovis AF2122/97
cgucguagguggc

SEQ ID NO: 1094533 - RNA, 15 nt, Mycobacterium bovis subsp bovis AF2122/97
cgucguagguggccg

SEQ ID NO: 1094534 - RNA, 21 nt, Mycobacterium bovis subsp bovis AF2122/97
cgucguauugccucaccaggu

SEQ ID NO: 1094535 - RNA, 13 nt, Mycobacterium bovis subsp bovis AF2122/97
cgucgucaacccg

SEQ ID NO: 1094536 - RNA, 17 nt, Mycobacterium bovis subsp bovis AF2122/97
cgucgucaacccggugu

SEQ ID NO: 1094537 - RNA, 16 nt, Mycobacterium bovis subsp bovis AF2122/97
cgucguaguuggugaa

SEQ ID NO: 1094538 - RNA, 22 nt, Mycobacterium bovis subsp bovis AF2122/97
cgucgucaaguccuucacugcg

SEQ ID NO: 1094539 - RNA, 14 nt, Mycobacterium bovis subsp bovis AF2122/97
cgucgucagguggc

SEQ ID NO: 1094540 - RNA, 15 nt, Mycobacterium bovis subsp bovis AF2122/97
cgucgucagcgggua

SEQ ID NO: 1094541 - RNA, 19 nt, Mycobacterium bovis subsp bovis AF2122/97
cgucgucaccgaugcgccg

SEQ ID NO: 1094542 - RNA, 17 nt, Mycobacterium bovis subsp bovis AF2122/97
cgucgucacgaucgugc

SEQ ID NO: 1094543 - RNA, 15 nt, Mycobacterium bovis subsp bovis AF2122/97
cgucgucagccaccg

SEQ ID NO: 1094544 - RNA, 17 nt, Mycobacterium bovis subsp bovis AF2122/97
cgucgucagccaccgca

SEQ ID NO: 1094545 - RNA, 17 nt, Mycobacterium bovis subsp bovis AF2122/97
cgucgucaucgagcggg

SEQ ID NO: 1094546 - RNA, 14 nt, Mycobacterium bovis subsp bovis AF2122/97
cgucguccagacgc

SEQ ID NO: 1094547 - RNA, 15 nt, Mycobacterium bovis subsp bovis AF2122/97
cgucguccagacgcc

SEQ ID NO: 1094548 - RNA, 22 nt, Mycobacterium bovis subsp bovis AF2122/97
cgucguccagacgccacugcca

SEQ ID NO: 1094549 - RNA, 14 nt, Mycobacterium bovis subsp bovis AF2122/97
cgucguccagcacc

SEQ ID NO: 1094550 - RNA, 18 nt, Mycobacterium bovis subsp bovis AF2122/97
cgucguacucgaccgcga

SEQ ID NO: 1094551 - RNA, 14 nt, Mycobacterium bovis subsp bovis AF2122/97
cgucguacucggcg

SEQ ID NO: 1094552 - RNA, 19 nt, Mycobacterium bovis subsp bovis AF2122/97
cgucguaccguucgggccg

SEQ ID NO: 1094553 - RNA, 21 nt, Mycobacterium bovis subsp bovis AF2122/97
cgucguaccguucgggccguc

SEQ ID NO: 1094554 - RNA, 15 nt, Mycobacterium bovis subsp bovis AF2122/97
cgucguagaccucca

SEQ ID NO: 1094555 - RNA, 22 nt, Mycobacterium bovis subsp bovis AF2122/97
cgucguagaccuccagugcggc

SEQ ID NO: 1094556 - RNA, 17 nt, Mycobacterium bovis subsp bovis AF2122/97
cgucguacucggcggcc

SEQ ID NO: 1094557 - RNA, 18 nt, Mycobacterium bovis subsp bovis AF2122/97
cgucguacucggcggcca

SEQ ID NO: 1094558 - RNA, 21 nt, Mycobacterium bovis subsp bovis AF2122/97
cgucguacucggcggccacca

SEQ ID NO: 1094559 - RNA, 21 nt, Mycobacterium bovis subsp bovis AF2122/97
cgucggugggucucggcguuc

SEQ ID NO: 1094560 - RNA, 22 nt, Mycobacterium bovis subsp bovis AF2122/97
cgucggugggucucggcguucc

SEQ ID NO: 1094561 - RNA, 13 nt, Mycobacterium bovis subsp bovis AF2122/97
cgucggugugguc

SEQ ID NO: 1094562 - RNA, 16 nt, Mycobacterium bovis subsp bovis AF2122/97
cgucgguuccgggcgc

SEQ ID NO: 1094563 - RNA, 16 nt, Mycobacterium bovis subsp bovis AF2122/97
cgucgguugccacgcc

SEQ ID NO: 1094564 - RNA, 20 nt, Mycobacterium bovis subsp bovis AF2122/97
cgucgguugccacgccgccg

SEQ ID NO: 1094565 - RNA, 18 nt, Mycobacterium bovis subsp bovis AF2122/97
cgucguaaacgucggucg

SEQ ID NO: 1094566 - RNA, 14 nt, Mycobacterium bovis subsp bovis AF2122/97
cgucggugggcgug

SEQ ID NO: 1094567 - RNA, 21 nt, Mycobacterium bovis subsp bovis AF2122/97
cgucggugcgcgcggcgacca

SEQ ID NO: 1094568 - RNA, 15 nt, Mycobacterium bovis subsp bovis AF2122/97
cgucggugccaccac

SEQ ID NO: 1094569 - RNA, 13 nt, Mycobacterium bovis subsp bovis AF2122/97
cgucggugcgcgc

SEQ ID NO: 1094570 - RNA, 16 nt, Mycobacterium bovis subsp bovis AF2122/97
cgucggugccgccgcc

SEQ ID NO: 1094571 - RNA, 20 nt, Mycobacterium bovis subsp bovis AF2122/97
cgucggugccggggcugccg

SEQ ID NO: 1094572 - RNA, 14 nt, Mycobacterium bovis subsp bovis AF2122/97
cgucggugccacca

SEQ ID NO: 1094573 - RNA, 14 nt, Mycobacterium bovis subsp bovis AF2122/97
cgucgucgucgggu

SEQ ID NO: 1094574 - RNA, 13 nt, Mycobacterium bovis subsp bovis AF2122/97
cgucgucgugcac

SEQ ID NO: 1094575 - RNA, 14 nt, Mycobacterium bovis subsp bovis AF2122/97
cgucgucgucgacg

SEQ ID NO: 1094576 - RNA, 13 nt, Mycobacterium bovis subsp bovis AF2122/97
cgucgucgucgag

SEQ ID NO: 1094577 - RNA, 14 nt, Mycobacterium bovis subsp bovis AF2122/97
cgucgucgugcacg

SEQ ID NO: 1094578 - RNA, 15 nt, Mycobacterium bovis subsp bovis AF2122/97
cgucgucgucccagg

SEQ ID NO: 1094579 - RNA, 13 nt, Mycobacterium bovis subsp bovis AF2122/97
cgucgucggcguc

SEQ ID NO: 1094580 - RNA, 14 nt, Mycobacterium bovis subsp bovis AF2122/97
cgucgucggguucg

SEQ ID NO: 1094581 - RNA, 14 nt, Mycobacterium bovis subsp bovis AF2122/97
cgucgucggcguag

SEQ ID NO: 1094582 - RNA, 14 nt, Mycobacterium bovis subsp bovis AF2122/97
cgucgucggcggcg

SEQ ID NO: 1094583 - RNA, 17 nt, Mycobacterium bovis subsp bovis AF2122/97
cgucgucggaaucggag

SEQ ID NO: 1094584 - RNA, 15 nt, Mycobacterium bovis subsp bovis AF2122/97
cgucguccgacgggc

SEQ ID NO: 1094585 - RNA, 16 nt, Mycobacterium bovis subsp bovis AF2122/97
cgucgucccagcgcgg

SEQ ID NO: 1094586 - RNA, 14 nt, Mycobacterium bovis subsp bovis AF2122/97
cgucguccgcgcca

SEQ ID NO: 1094587 - RNA, 23 nt, Mycobacterium bovis subsp bovis AF2122/97
cgucguccgcgccaguggccacc

SEQ ID NO: 1094588 - RNA, 13 nt, Mycobacterium bovis subsp bovis AF2122/97
cgucgucggcaac

SEQ ID NO: 1094589 - RNA, 15 nt, Mycobacterium bovis subsp bovis AF2122/97
cgucguccuguccgg

SEQ ID NO: 1094590 - RNA, 17 nt, Mycobacterium bovis subsp bovis AF2122/97
cgucuaccccgagccuu

SEQ ID NO: 1094591 - RNA, 20 nt, Mycobacterium bovis subsp bovis AF2122/97
cgucguuuggccucagcccg

SEQ ID NO: 1094592 - RNA, 16 nt, Mycobacterium bovis subsp bovis AF2122/97
cgucgugaccgaccgc

SEQ ID NO: 1094593 - RNA, 15 nt, Mycobacterium bovis subsp bovis AF2122/97
cgucguuucgccagc

SEQ ID NO: 1094594 - RNA, 19 nt, Mycobacterium bovis subsp bovis AF2122/97
cgucguuucgccagccggc

SEQ ID NO: 1094595 - RNA, 20 nt, Mycobacterium bovis subsp bovis AF2122/97
cgucgucguuucgccagccg

SEQ ID NO: 1094596 - RNA, 22 nt, Mycobacterium bovis subsp bovis AF2122/97
cgucgucguuucgccagccggc

SEQ ID NO: 1094597 - RNA, 15 nt, Mycobacterium bovis subsp bovis AF2122/97
cgucgucuagcggga

SEQ ID NO: 1094598 - RNA, 22 nt, Mycobacterium bovis subsp bovis AF2122/97
cgucgucugcagaccuguccgg

SEQ ID NO: 1094599 - RNA, 17 nt, Mycobacterium bovis subsp bovis AF2122/97
cgucgucuucuucgcgg

SEQ ID NO: 1094600 - RNA, 14 nt, Mycobacterium bovis subsp bovis AF2122/97
cgucuccggcgcca

SEQ ID NO: 1094601 - RNA, 18 nt, Mycobacterium bovis subsp bovis AF2122/97
cgucuccggcgccaccgc

SEQ ID NO: 1094602 - RNA, 15 nt, Mycobacterium bovis subsp bovis AF2122/97
cgucccgguugacgc

SEQ ID NO: 1094603 - RNA, 14 nt, Mycobacterium bovis subsp bovis AF2122/97
cgucccggcgguca

SEQ ID NO: 1094604 - RNA, 12 nt, Mycobacterium bovis subsp bovis AF2122/97
cgucccgcucga

SEQ ID NO: 1094605 - RNA, 13 nt, Mycobacterium bovis subsp bovis AF2122/97
cgucccgcucgag

SEQ ID NO: 1094606 - RNA, 18 nt, Mycobacterium bovis subsp bovis AF2122/97
cgucccgcucgagcagcg

SEQ ID NO: 1094607 - RNA, 17 nt, Mycobacterium bovis subsp bovis AF2122/97
cgucccgauacggccgg

SEQ ID NO: 1094608 - RNA, 18 nt, Mycobacterium bovis subsp bovis AF2122/97
cgucccgauacggccggc

SEQ ID NO: 1094609 - RNA, 16 nt, Mycobacterium bovis subsp bovis AF2122/97
cgucccgccgcaccgc

SEQ ID NO: 1094610 - RNA, 15 nt, Mycobacterium bovis subsp bovis AF2122/97
cguccccagaccggc

SEQ ID NO: 1094611 - RNA, 15 nt, Mycobacterium bovis subsp bovis AF2122/97
cguccccgucgcugg

SEQ ID NO: 1094612 - RNA, 15 nt, Mycobacterium bovis subsp bovis AF2122/97
cgucccccgcacgcg

SEQ ID NO: 1094613 - RNA, 11 nt, Mycobacterium bovis subsp bovis AF2122/97
cguccccgacg

SEQ ID NO: 1094614 - RNA, 12 nt, Mycobacterium bovis subsp bovis AF2122/97
cguccccgcagc

SEQ ID NO: 1094615 - RNA, 13 nt, Mycobacterium bovis subsp bovis AF2122/97
cguccccgccgac

SEQ ID NO: 1094616 - RNA, 15 nt, Mycobacterium bovis subsp bovis AF2122/97
cguccccgccgacgc

SEQ ID NO: 1094617 - RNA, 15 nt, Mycobacterium bovis subsp bovis AF2122/97
cguccaggucggccg

SEQ ID NO: 1094618 - RNA, 23 nt, Mycobacterium bovis subsp bovis AF2122/97
cguccagguccaaguccuccacg

SEQ ID NO: 1094619 - RNA, 15 nt, Mycobacterium bovis subsp bovis AF2122/97
cguccagggcgccga

SEQ ID NO: 1094620 - RNA, 15 nt, Mycobacterium bovis subsp bovis AF2122/97
cguccaggugcgccg

SEQ ID NO: 1094621 - RNA, 20 nt, Mycobacterium bovis subsp bovis AF2122/97
cguccagcaaaugcggcgcg

SEQ ID NO: 1094622 - RNA, 22 nt, Mycobacterium bovis subsp bovis AF2122/97
cguccagcaaaugcggcgcguu

SEQ ID NO: 1094623 - RNA, 12 nt, Mycobacterium bovis subsp bovis AF2122/97
cguccagcaaca

SEQ ID NO: 1094624 - RNA, 14 nt, Mycobacterium bovis subsp bovis AF2122/97
cguccaucaccggc

SEQ ID NO: 1094625 - RNA, 21 nt, Mycobacterium bovis subsp bovis AF2122/97
cguccaguggcagccagcggc

SEQ ID NO: 1094626 - RNA, 15 nt, Mycobacterium bovis subsp bovis AF2122/97
cguccaguggcagcc

SEQ ID NO: 1094627 - RNA, 15 nt, Mycobacterium bovis subsp bovis AF2122/97
cguccaucgccaccg

SEQ ID NO: 1094628 - RNA, 20 nt, Mycobacterium bovis subsp bovis AF2122/97
cguccaucccggcgccgcgg

SEQ ID NO: 1094629 - RNA, 17 nt, Mycobacterium bovis subsp bovis AF2122/97
cguccaccgucacgguc

SEQ ID NO: 1094630 - RNA, 18 nt, Mycobacterium bovis subsp bovis AF2122/97
cguccaccgucacggucg

SEQ ID NO: 1094631 - RNA, 20 nt, Mycobacterium bovis subsp bovis AF2122/97
cguccaccacaccugcggcu

SEQ ID NO: 1094632 - RNA, 22 nt, Mycobacterium bovis subsp bovis AF2122/97
cguccaccacaccugcggcugc

SEQ ID NO: 1094633 - RNA, 21 nt, Mycobacterium bovis subsp bovis AF2122/97
cguccaccccgauccgccacg

SEQ ID NO: 1094634 - RNA, 22 nt, Mycobacterium bovis subsp bovis AF2122/97
cguccaccccgauccgccacga

SEQ ID NO: 1094635 - RNA, 15 nt, Mycobacterium bovis subsp bovis AF2122/97
cguccacgacagcag

SEQ ID NO: 1094636 - RNA, 20 nt, Mycobacterium bovis subsp bovis AF2122/97
cguccagaccguagcggccg

SEQ ID NO: 1094637 - RNA, 21 nt, Mycobacterium bovis subsp bovis AF2122/97
cguccagaccguagcggccgg

SEQ ID NO: 1094638 - RNA, 17 nt, Mycobacterium bovis subsp bovis AF2122/97
cguccagauaguagucg

SEQ ID NO: 1094639 - RNA, 20 nt, Mycobacterium bovis subsp bovis AF2122/97
cguccagauagugcuccacg

SEQ ID NO: 1094640 - RNA, 16 nt, Mycobacterium bovis subsp bovis AF2122/97
cguccacgggaucugc

SEQ ID NO: 1094641 - RNA, 23 nt, Mycobacterium bovis subsp bovis AF2122/97
cguccacgggaucugcggaggcg

SEQ ID NO: 1094642 - RNA, 15 nt, Mycobacterium bovis subsp bovis AF2122/97
cgucaucccgagcuc

SEQ ID NO: 1094643 - RNA, 14 nt, Mycobacterium bovis subsp bovis AF2122/97
cgucauccauccgg

SEQ ID NO: 1094644 - RNA, 15 nt, Mycobacterium bovis subsp bovis AF2122/97
cgucauccaccgcaa

SEQ ID NO: 1094645 - RNA, 16 nt, Mycobacterium bovis subsp bovis AF2122/97
cgucaucaggucgucg

SEQ ID NO: 1094646 - RNA, 17 nt, Mycobacterium bovis subsp bovis AF2122/97
cgucaucgacgagcgau

SEQ ID NO: 1094647 - RNA, 23 nt, Mycobacterium bovis subsp bovis AF2122/97
cgucauccauccgggccgcggcc

SEQ ID NO: 1094648 - RNA, 17 nt, Mycobacterium bovis subsp bovis AF2122/97
cguccaagccggccacg

SEQ ID NO: 1094649 - RNA, 16 nt, Mycobacterium bovis subsp bovis AF2122/97
cguccaagccggcugc

SEQ ID NO: 1094650 - RNA, 23 nt, Mycobacterium bovis subsp bovis AF2122/97
cguccaagccguagaccaggccc

SEQ ID NO: 1094651 - RNA, 17 nt, Mycobacterium bovis subsp bovis AF2122/97
cguccaacucggcccgg

SEQ ID NO: 1094652 - RNA, 17 nt, Mycobacterium bovis subsp bovis AF2122/97
cguccaagccagcguug

SEQ ID NO: 1094653 - RNA, 18 nt, Mycobacterium bovis subsp bovis AF2122/97
cguccaagccagcguugg

SEQ ID NO: 1094654 - RNA, 13 nt, Mycobacterium bovis subsp bovis AF2122/97
cgucauacagcgc

SEQ ID NO: 1094655 - RNA, 16 nt, Mycobacterium bovis subsp bovis AF2122/97
cgucaguucggugugc

SEQ ID NO: 1094656 - RNA, 19 nt, Mycobacterium bovis subsp bovis AF2122/97
cgucaguucggugugcggc

SEQ ID NO: 1094657 - RNA, 15 nt, Mycobacterium bovis subsp bovis AF2122/97
cguccgccgcagacg

SEQ ID NO: 1094658 - RNA, 19 nt, Mycobacterium bovis subsp bovis AF2122/97
cguccgccggcgagugguc

SEQ ID NO: 1094659 - RNA, 15 nt, Mycobacterium bovis subsp bovis AF2122/97
cguccgcccagcacc

SEQ ID NO: 1094660 - RNA, 17 nt, Mycobacterium bovis subsp bovis AF2122/97
cguccgcccagccgcag

SEQ ID NO: 1094661 - RNA, 16 nt, Mycobacterium bovis subsp bovis AF2122/97
cguccgccgcagacgc

SEQ ID NO: 1094662 - RNA, 12 nt, Mycobacterium bovis subsp bovis AF2122/97
cguccgaucggu

SEQ ID NO: 1094663 - RNA, 17 nt, Mycobacterium bovis subsp bovis AF2122/97
cgucccgcccaucccgg

SEQ ID NO: 1094664 - RNA, 20 nt, Mycobacterium bovis subsp bovis AF2122/97
cgucccugugucgccgucgc

SEQ ID NO: 1094665 - RNA, 21 nt, Mycobacterium bovis subsp bovis AF2122/97
cgucccugugucgccgucgcg

SEQ ID NO: 1094666 - RNA, 19 nt, Mycobacterium bovis subsp bovis AF2122/97
cguccgacgaguacacgau

SEQ ID NO: 1094667 - RNA, 21 nt, Mycobacterium bovis subsp bovis AF2122/97
cguccgaccgauaacacccgg

SEQ ID NO: 1094668 - RNA, 15 nt, Mycobacterium bovis subsp bovis AF2122/97
cguccgacaacgacu

SEQ ID NO: 1094669 - RNA, 20 nt, Mycobacterium bovis subsp bovis AF2122/97
cguccgacaacgacugcguu

SEQ ID NO: 1094670 - RNA, 22 nt, Mycobacterium bovis subsp bovis AF2122/97
cguccgaaccaccuguccggug

SEQ ID NO: 1094671 - RNA, 16 nt, Mycobacterium bovis subsp bovis AF2122/97
cguccgggucaccagc

SEQ ID NO: 1094672 - RNA, 16 nt, Mycobacterium bovis subsp bovis AF2122/97
cguccgccugcaccgc

SEQ ID NO: 1094673 - RNA, 17 nt, Mycobacterium bovis subsp bovis AF2122/97
cguccggguagacaugg

SEQ ID NO: 1094674 - RNA, 14 nt, Mycobacterium bovis subsp bovis AF2122/97
cguccgggucacca

SEQ ID NO: 1094675 - RNA, 24 nt, Mycobacterium bovis subsp bovis AF2122/97
cguccgccguaugccgccaaccgc

SEQ ID NO: 1094676 - RNA, 16 nt, Mycobacterium bovis subsp bovis AF2122/97
cguccggugcuggucc

SEQ ID NO: 1094677 - RNA, 23 nt, Mycobacterium bovis subsp bovis AF2122/97
cguccggguuuugcgcggccacc

SEQ ID NO: 1094678 - RNA, 17 nt, Mycobacterium bovis subsp bovis AF2122/97
cguccggucgccucacc

SEQ ID NO: 1094679 - RNA, 23 nt, Mycobacterium bovis subsp bovis AF2122/97
cguccugaaucgguucggccaga

SEQ ID NO: 1094680 - RNA, 15 nt, Mycobacterium bovis subsp bovis AF2122/97
cguccugaaucgguu

SEQ ID NO: 1094681 - RNA, 19 nt, Mycobacterium bovis subsp bovis AF2122/97
cguccugaaucgguucggc

SEQ ID NO: 1094682 - RNA, 16 nt, Mycobacterium bovis subsp bovis AF2122/97
cguccgucgucggcgu

SEQ ID NO: 1094683 - RNA, 18 nt, Mycobacterium bovis subsp bovis AF2122/97
cguccgucucgcaggcgc

SEQ ID NO: 1094684 - RNA, 17 nt, Mycobacterium bovis subsp bovis AF2122/97
cguccuguccgggcugc

SEQ ID NO: 1094685 - RNA, 22 nt, Mycobacterium bovis subsp bovis AF2122/97
cguccugguggcgggaucacca

SEQ ID NO: 1094686 - RNA, 18 nt, Mycobacterium bovis subsp bovis AF2122/97
cguccuuuggguucuucg

SEQ ID NO: 1094687 - RNA, 15 nt, Mycobacterium bovis subsp bovis AF2122/97
cguccugccaguccg

SEQ ID NO: 1094688 - RNA, 17 nt, Mycobacterium bovis subsp bovis AF2122/97
cguccugccaguccgca

SEQ ID NO: 1094689 - RNA, 21 nt, Mycobacterium bovis subsp bovis AF2122/97
cguccugcaggaaguacgcga

SEQ ID NO: 1094690 - RNA, 23 nt, Mycobacterium bovis subsp bovis AF2122/97
cguccuggauaugcuccggccgc

SEQ ID NO: 1094691 - RNA, 16 nt, Mycobacterium bovis subsp bovis AF2122/97
cguccugcucgcgagg

SEQ ID NO: 1094692 - RNA, 22 nt, Mycobacterium bovis subsp bovis AF2122/97
cguccugcggguaggugacgac

SEQ ID NO: 1094693 - RNA, 17 nt, Mycobacterium bovis subsp bovis AF2122/97
cgucgaccaugcgaccg

SEQ ID NO: 1094694 - RNA, 20 nt, Mycobacterium bovis subsp bovis AF2122/97
cgucgaccaugcgaccggca

SEQ ID NO: 1094695 - RNA, 20 nt, Mycobacterium bovis subsp bovis AF2122/97
cgucgacccccugccacagc

SEQ ID NO: 1094696 - RNA, 21 nt, Mycobacterium bovis subsp bovis AF2122/97
cgucgacccccugccacagcg

SEQ ID NO: 1094697 - RNA, 22 nt, Mycobacterium bovis subsp bovis AF2122/97
cgucgacccccugccacagcga

SEQ ID NO: 1094698 - RNA, 15 nt, Mycobacterium bovis subsp bovis AF2122/97
cgucgaccacgacgu

SEQ ID NO: 1094699 - RNA, 21 nt, Mycobacterium bovis subsp bovis AF2122/97
cgucgaccacgacguucgacg

SEQ ID NO: 1094700 - RNA, 13 nt, Mycobacterium bovis subsp bovis AF2122/97
cgucgaccaggcc

SEQ ID NO: 1094701 - RNA, 16 nt, Mycobacterium bovis subsp bovis AF2122/97
cgucgacaguucaacg

SEQ ID NO: 1094702 - RNA, 21 nt, Mycobacterium bovis subsp bovis AF2122/97
cgucgacaucaaagucgaggu

SEQ ID NO: 1094703 - RNA, 15 nt, Mycobacterium bovis subsp bovis AF2122/97
cgucgacaucgccau

SEQ ID NO: 1094704 - RNA, 22 nt, Mycobacterium bovis subsp bovis AF2122/97
cgucgaaauggauugcggcacg

SEQ ID NO: 1094705 - RNA, 20 nt, Mycobacterium bovis subsp bovis AF2122/97
cgucgaaagagaaggcggcg

SEQ ID NO: 1094706 - RNA, 23 nt, Mycobacterium bovis subsp bovis AF2122/97
cgucgaaagagaaggcggcgucg

SEQ ID NO: 1094707 - RNA, 21 nt, Mycobacterium bovis subsp bovis AF2122/97
cgucaggccuccaaaaucgcg

SEQ ID NO: 1094708 - RNA, 19 nt, Mycobacterium bovis subsp bovis AF2122/97
cgucaggccagagucgccc

SEQ ID NO: 1094709 - RNA, 20 nt, Mycobacterium bovis subsp bovis AF2122/97
cgucaggguauccacgccgg

SEQ ID NO: 1094710 - RNA, 23 nt, Mycobacterium bovis subsp bovis AF2122/97
cgucaggguauccacgccgggca

SEQ ID NO: 1094711 - RNA, 16 nt, Mycobacterium bovis subsp bovis AF2122/97
cgucaggugcgcgacc

SEQ ID NO: 1094712 - RNA, 15 nt, Mycobacterium bovis subsp bovis AF2122/97
cgucaguccucaucg

SEQ ID NO: 1094713 - RNA, 15 nt, Mycobacterium bovis subsp bovis AF2122/97
cgucagugccccgca

SEQ ID NO: 1094714 - RNA, 19 nt, Mycobacterium bovis subsp bovis AF2122/97
cgucagugccccgcagcac

SEQ ID NO: 1094715 - RNA, 22 nt, Mycobacterium bovis subsp bovis AF2122/97
cgucaguuacgcaucgucagcg

SEQ ID NO: 1094716 - RNA, 23 nt, Mycobacterium bovis subsp bovis AF2122/97
cgucaguuacgcaucgucagcga

SEQ ID NO: 1094717 - RNA, 18 nt, Mycobacterium bovis subsp bovis AF2122/97
cgucagguuccgcgacaa

SEQ ID NO: 1094718 - RNA, 19 nt, Mycobacterium bovis subsp bovis AF2122/97
cgucagguuccgcgacaac

SEQ ID NO: 1094719 - RNA, 20 nt, Mycobacterium bovis subsp bovis AF2122/97
cgucagguucuaccaaaucg

SEQ ID NO: 1094720 - RNA, 23 nt, Mycobacterium bovis subsp bovis AF2122/97
cgucagguucuaccaaaucgaca

SEQ ID NO: 1094721 - RNA, 20 nt, Mycobacterium bovis subsp bovis AF2122/97
cgucagcuccccgucgggga

SEQ ID NO: 1094722 - RNA, 22 nt, Mycobacterium bovis subsp bovis AF2122/97
cgucagcuguuugccggcuuug

SEQ ID NO: 1094723 - RNA, 16 nt, Mycobacterium bovis subsp bovis AF2122/97
cgucaggaaccaccca

SEQ ID NO: 1094724 - RNA, 21 nt, Mycobacterium bovis subsp bovis AF2122/97
cgucaggaaccacccaccggc

SEQ ID NO: 1094725 - RNA, 22 nt, Mycobacterium bovis subsp bovis AF2122/97
cgucagcuuggacccugcgccg

SEQ ID NO: 1094726 - RNA, 23 nt, Mycobacterium bovis subsp bovis AF2122/97
cgucagcuuggacccugcgccgc

SEQ ID NO: 1094727 - RNA, 22 nt, Mycobacterium bovis subsp bovis AF2122/97
cgucagcgucggcgcaucacca

SEQ ID NO: 1094728 - RNA, 21 nt, Mycobacterium bovis subsp bovis AF2122/97
cgucagcgucucucgcagcuc

SEQ ID NO: 1094729 - RNA, 18 nt, Mycobacterium bovis subsp bovis AF2122/97
cgucagcgucugagcgcc

SEQ ID NO: 1094730 - RNA, 19 nt, Mycobacterium bovis subsp bovis AF2122/97
cgucagcgucugagcgccg

SEQ ID NO: 1094731 - RNA, 14 nt, Mycobacterium bovis subsp bovis AF2122/97
cgucagcggcggcc

SEQ ID NO: 1094732 - RNA, 15 nt, Mycobacterium bovis subsp bovis AF2122/97
cgucagcggcggcca

SEQ ID NO: 1094733 - RNA, 13 nt, Mycobacterium bovis subsp bovis AF2122/97
cgucagcggccag

SEQ ID NO: 1094734 - RNA, 14 nt, Mycobacterium bovis subsp bovis AF2122/97
cgucagcgccgccg

SEQ ID NO: 1094735 - RNA, 18 nt, Mycobacterium bovis subsp bovis AF2122/97
cgucagcgcgaccgucag

SEQ ID NO: 1094736 - RNA, 14 nt, Mycobacterium bovis subsp bovis AF2122/97
cgucagcgcgccgu

SEQ ID NO: 1094737 - RNA, 16 nt, Mycobacterium bovis subsp bovis AF2122/97
cgucagcgccgcgcgc

SEQ ID NO: 1094738 - RNA, 15 nt, Mycobacterium bovis subsp bovis AF2122/97
cgucagcgccgcuga

SEQ ID NO: 1094739 - RNA, 17 nt, Mycobacterium bovis subsp bovis AF2122/97
cgucagcccgacguugc

SEQ ID NO: 1094740 - RNA, 13 nt, Mycobacterium bovis subsp bovis AF2122/97
cgucagccgcacc

SEQ ID NO: 1094741 - RNA, 17 nt, Mycobacterium bovis subsp bovis AF2122/97
cgucagccaggugccca

SEQ ID NO: 1094742 - RNA, 14 nt, Mycobacterium bovis subsp bovis AF2122/97
cgucagcagcaacg

SEQ ID NO: 1094743 - RNA, 13 nt, Mycobacterium bovis subsp bovis AF2122/97
cgucagauccggc

SEQ ID NO: 1094744 - RNA, 15 nt, Mycobacterium bovis subsp bovis AF2122/97
cgucagcaccauccc

SEQ ID NO: 1094745 - RNA, 21 nt, Mycobacterium bovis subsp bovis AF2122/97
cgucagaacaccggccaggcc

SEQ ID NO: 1094746 - RNA, 15 nt, Mycobacterium bovis subsp bovis AF2122/97
cgucagaccgcgaac

SEQ ID NO: 1094747 - RNA, 16 nt, Mycobacterium bovis subsp bovis AF2122/97
cgucacguucggcgca

SEQ ID NO: 1094748 - RNA, 17 nt, Mycobacterium bovis subsp bovis AF2122/97
cgucacucccuggccgc

SEQ ID NO: 1094749 - RNA, 17 nt, Mycobacterium bovis subsp bovis AF2122/97
cgucacguggucggcca

SEQ ID NO: 1094750 - RNA, 19 nt, Mycobacterium bovis subsp bovis AF2122/97
cgucacguggucggccacc

SEQ ID NO: 1094751 - RNA, 20 nt, Mycobacterium bovis subsp bovis AF2122/97
cgucacguggucggccaccc

SEQ ID NO: 1094752 - RNA, 15 nt, Mycobacterium bovis subsp bovis AF2122/97
cgucacugccaccuc

SEQ ID NO: 1094753 - RNA, 14 nt, Mycobacterium bovis subsp bovis AF2122/97
cgucacucccgaca

SEQ ID NO: 1094754 - RNA, 17 nt, Mycobacterium bovis subsp bovis AF2122/97
cgucacgucgacggcgg

SEQ ID NO: 1094755 - RNA, 15 nt, Mycobacterium bovis subsp bovis AF2122/97
cgucacgucgacggc

SEQ ID NO: 1094756 - RNA, 14 nt, Mycobacterium bovis subsp bovis AF2122/97
cgucacgggcguug

SEQ ID NO: 1094757 - RNA, 20 nt, Mycobacterium bovis subsp bovis AF2122/97
cgucacggacccuuccgccg

SEQ ID NO: 1094758 - RNA, 19 nt, Mycobacterium bovis subsp bovis AF2122/97
cgucacauccgacagcagc

SEQ ID NO: 1094759 - RNA, 22 nt, Mycobacterium bovis subsp bovis AF2122/97
cgucacaaugcccaggcucgca

SEQ ID NO: 1094760 - RNA, 21 nt, Mycobacterium bovis subsp bovis AF2122/97
cgucacaagucgacacgccga

SEQ ID NO: 1094761 - RNA, 17 nt, Mycobacterium bovis subsp bovis AF2122/97
cgucaaguccgagucgg

SEQ ID NO: 1094762 - RNA, 18 nt, Mycobacterium bovis subsp bovis AF2122/97
cgucaaucaccaccgcca

SEQ ID NO: 1094763 - RNA, 15 nt, Mycobacterium bovis subsp bovis AF2122/97
cguaggcggcggccc

SEQ ID NO: 1094764 - RNA, 19 nt, Mycobacterium bovis subsp bovis AF2122/97
cguaggcggcggcccgcag

SEQ ID NO: 1094765 - RNA, 19 nt, Mycobacterium bovis subsp bovis AF2122/97
cguaaugcgcugccgccgu

SEQ ID NO: 1094766 - RNA, 14 nt, Mycobacterium bovis subsp bovis AF2122/97
cguagggacgccga

SEQ ID NO: 1094767 - RNA, 16 nt, Mycobacterium bovis subsp bovis AF2122/97
cguagggacgccgagc

SEQ ID NO: 1094768 - RNA, 15 nt, Mycobacterium bovis subsp bovis AF2122/97
cguagggccagcgcc

SEQ ID NO: 1094769 - RNA, 21 nt, Mycobacterium bovis subsp bovis AF2122/97
cguagggccagcgccucggca

SEQ ID NO: 1094770 - RNA, 23 nt, Mycobacterium bovis subsp bovis AF2122/97
cguagggcuguccgaccucgccg

SEQ ID NO: 1094771 - RNA, 19 nt, Mycobacterium bovis subsp bovis AF2122/97
cguagggauagcagugcag

SEQ ID NO: 1094772 - RNA, 22 nt, Mycobacterium bovis subsp bovis AF2122/97
cguagggauagcagugcagcaa

SEQ ID NO: 1094773 - RNA, 18 nt, Mycobacterium bovis subsp bovis AF2122/97
cguagguccuugucggcc

SEQ ID NO: 1094774 - RNA, 23 nt, Mycobacterium bovis subsp bovis AF2122/97
cguaggggugguagcugacgcug

SEQ ID NO: 1094775 - RNA, 15 nt, Mycobacterium bovis subsp bovis AF2122/97
cguaggguggccgac

SEQ ID NO: 1094776 - RNA, 15 nt, Mycobacterium bovis subsp bovis AF2122/97
cguaggguggccggu

SEQ ID NO: 1094777 - RNA, 13 nt, Mycobacterium bovis subsp bovis AF2122/97
cguagugcgcgcc

SEQ ID NO: 1094778 - RNA, 17 nt, Mycobacterium bovis subsp bovis AF2122/97
cguagugcucgccggca

SEQ ID NO: 1094779 - RNA, 19 nt, Mycobacterium bovis subsp bovis AF2122/97
cguagugcucgccggcacc

SEQ ID NO: 1094780 - RNA, 20 nt, Mycobacterium bovis subsp bovis AF2122/97
cguagugcucgccggcaccg

SEQ ID NO: 1094781 - RNA, 17 nt, Mycobacterium bovis subsp bovis AF2122/97
cguaggugccgaagaug

SEQ ID NO: 1094782 - RNA, 20 nt, Mycobacterium bovis subsp bovis AF2122/97
cguaggugccgaagaugacc

SEQ ID NO: 1094783 - RNA, 16 nt, Mycobacterium bovis subsp bovis AF2122/97
cguaguuccgcaccga

SEQ ID NO: 1094784 - RNA, 15 nt, Mycobacterium bovis subsp bovis AF2122/97
cguaguggccggcuu

SEQ ID NO: 1094785 - RNA, 14 nt, Mycobacterium bovis subsp bovis AF2122/97
cguagugucggcgu

SEQ ID NO: 1094786 - RNA, 16 nt, Mycobacterium bovis subsp bovis AF2122/97
cguaguggaagccgac

SEQ ID NO: 1094787 - RNA, 14 nt, Mycobacterium bovis subsp bovis AF2122/97
cguaggcgccguug

SEQ ID NO: 1094788 - RNA, 19 nt, Mycobacterium bovis subsp bovis AF2122/97
cguaaggcugugccggcca

SEQ ID NO: 1094789 - RNA, 14 nt, Mycobacterium bovis subsp bovis AF2122/97
cguaagcaccagcc

SEQ ID NO: 1094790 - RNA, 20 nt, Mycobacterium bovis subsp bovis AF2122/97
cguauggcggcuccaacgau

SEQ ID NO: 1094791 - RNA, 17 nt, Mycobacterium bovis subsp bovis AF2122/97
cguaugccgccaaccgc

SEQ ID NO: 1094792 - RNA, 17 nt, Mycobacterium bovis subsp bovis AF2122/97
cguaugccguggccgcc

SEQ ID NO: 1094793 - RNA, 20 nt, Mycobacterium bovis subsp bovis AF2122/97
cguaguugccggcuucggcg

SEQ ID NO: 1094794 - RNA, 17 nt, Mycobacterium bovis subsp bovis AF2122/97
cguauaggcccgggcgg

SEQ ID NO: 1094795 - RNA, 16 nt, Mycobacterium bovis subsp bovis AF2122/97
cguauaccgcacccug

SEQ ID NO: 1094796 - RNA, 20 nt, Mycobacterium bovis subsp bovis AF2122/97
cguauucguuggggcugccg

SEQ ID NO: 1094797 - RNA, 19 nt, Mycobacterium bovis subsp bovis AF2122/97
cguauugauacugcccgcg

SEQ ID NO: 1094798 - RNA, 21 nt, Mycobacterium bovis subsp bovis AF2122/97
cguauggcucaccccggucga

SEQ ID NO: 1094799 - RNA, 14 nt, Mycobacterium bovis subsp bovis AF2122/97
cguauggcggucgg

SEQ ID NO: 1094800 - RNA, 15 nt, Mycobacterium bovis subsp bovis AF2122/97
cguauugcggccugu

SEQ ID NO: 1094801 - RNA, 22 nt, Mycobacterium bovis subsp bovis AF2122/97
aacccggcccugaacgguucgg

SEQ ID NO: 1094802 - RNA, 14 nt, Mycobacterium bovis subsp bovis AF2122/97
aacccggccgccga

SEQ ID NO: 1094803 - RNA, 12 nt, Mycobacterium bovis subsp bovis AF2122/97
aacccggcgacc

SEQ ID NO: 1094804 - RNA, 21 nt, Mycobacterium bovis subsp bovis AF2122/97
aacccggcgggcccgccggcc

SEQ ID NO: 1094805 - RNA, 16 nt, Mycobacterium bovis subsp bovis AF2122/97
aacccggcgucgacga

SEQ ID NO: 1094806 - RNA, 21 nt, Mycobacterium bovis subsp bovis AF2122/97
aacccguaggguggccgacga

SEQ ID NO: 1094807 - RNA, 19 nt, Mycobacterium bovis subsp bovis AF2122/97
aacccgucuuaucggcguc

SEQ ID NO: 1094808 - RNA, 21 nt, Mycobacterium bovis subsp bovis AF2122/97
aacccggugaccagcaaccac

SEQ ID NO: 1094809 - RNA, 14 nt, Mycobacterium bovis subsp bovis AF2122/97
cgucaaccgggcgg

SEQ ID NO: 1094810 - RNA, 18 nt, Mycobacterium bovis subsp bovis AF2122/97
cgucaaccacggccgccg

SEQ ID NO: 1094811 - RNA, 19 nt, Mycobacterium bovis subsp bovis AF2122/97
cgucaaccagggugccggc

SEQ ID NO: 1094812 - RNA, 21 nt, Mycobacterium bovis subsp bovis AF2122/97
cgucaaccagggugccggcgg

SEQ ID NO: 1094813 - RNA, 14 nt, Mycobacterium bovis subsp bovis AF2122/97
cgucaacgauggug

SEQ ID NO: 1094814 - RNA, 22 nt, Mycobacterium bovis subsp bovis AF2122/97
cgucaacggaagaagcaguagc

SEQ ID NO: 1094815 - RNA, 19 nt, Mycobacterium bovis subsp bovis AF2122/97
cgucaagccgugcugccca

SEQ ID NO: 1094816 - RNA, 22 nt, Mycobacterium bovis subsp bovis AF2122/97
cgucaagcacacuggccacaau

SEQ ID NO: 1094817 - RNA, 24 nt, Mycobacterium bovis subsp bovis AF2122/97
cgucaagcacacuggccacaaucg

SEQ ID NO: 1094818 - RNA, 20 nt, Mycobacterium bovis subsp bovis AF2122/97
cgucaagagugcucagcgcg

SEQ ID NO: 1094819 - RNA, 23 nt, Mycobacterium bovis subsp bovis AF2122/97
cgucaagagugcucagcgcgcgc

SEQ ID NO: 1094820 - RNA, 15 nt, Mycobacterium bovis subsp bovis AF2122/97
cgucaagauugaacg

SEQ ID NO: 1094821 - RNA, 17 nt, Mycobacterium bovis subsp bovis AF2122/97
uuuggcgacgucgacaa

SEQ ID NO: 1094822 - RNA, 20 nt, Mycobacterium bovis subsp bovis AF2122/97
uuuucccgucgccgcccgug

SEQ ID NO: 1094823 - RNA, 19 nt, Mycobacterium bovis subsp bovis AF2122/97
uuuugcgucugcucgccag

SEQ ID NO: 1094824 - RNA, 20 nt, Mycobacterium bovis subsp bovis AF2122/97
uuuugcgucugcucgccggg

SEQ ID NO: 1094825 - RNA, 19 nt, Mycobacterium bovis subsp bovis AF2122/97
uuugaggaccuugccggug

SEQ ID NO: 1094826 - RNA, 21 nt, Mycobacterium bovis subsp bovis AF2122/97
uuugcgaugcccacggugccg

SEQ ID NO: 1094827 - RNA, 17 nt, Mycobacterium bovis subsp bovis AF2122/97
uugucguagcgacgcca

SEQ ID NO: 1094828 - RNA, 13 nt, Mycobacterium bovis subsp bovis AF2122/97
uuguucaccgacg

SEQ ID NO: 1094829 - RNA, 17 nt, Mycobacterium bovis subsp bovis AF2122/97
uuguuccagcgcaucga

SEQ ID NO: 1094830 - RNA, 14 nt, Mycobacterium bovis subsp bovis AF2122/97
uuguugaagccgau

SEQ ID NO: 1094831 - RNA, 21 nt, Mycobacterium bovis subsp bovis AF2122/97
uuguugccccggucggcgacg

SEQ ID NO: 1094832 - RNA, 13 nt, Mycobacterium bovis subsp bovis AF2122/97
uuguugcgcgacg

SEQ ID NO: 1094833 - RNA, 20 nt, Mycobacterium bovis subsp bovis AF2122/97
uuguuggccagaccgcgcgc

SEQ ID NO: 1094834 - RNA, 16 nt, Mycobacterium bovis subsp bovis AF2122/97
uuguugggccgccagc

SEQ ID NO: 1094835 - RNA, 24 nt, Mycobacterium bovis subsp bovis AF2122/97
uuguccugaaaacaccgcacggug

SEQ ID NO: 1094836 - RNA, 16 nt, Mycobacterium bovis subsp bovis AF2122/97
uugucgcggagucugc

SEQ ID NO: 1094837 - RNA, 15 nt, Mycobacterium bovis subsp bovis AF2122/97
uugucggcuggacgg

SEQ ID NO: 1094838 - RNA, 14 nt, Mycobacterium bovis subsp bovis AF2122/97
uugucgggauuggc

SEQ ID NO: 1094839 - RNA, 20 nt, Mycobacterium bovis subsp bovis AF2122/97
uuguagcgguccagcgucgc

SEQ ID NO: 1094840 - RNA, 19 nt, Mycobacterium bovis subsp bovis AF2122/97
uuggcugagcagcgcggcc

SEQ ID NO: 1094841 - RNA, 16 nt, Mycobacterium bovis subsp bovis AF2122/97
uuggcugggcccgccg

SEQ ID NO: 1094842 - RNA, 18 nt, Mycobacterium bovis subsp bovis AF2122/97
uugggcgauuuugcgucu

SEQ ID NO: 1094843 - RNA, 19 nt, Mycobacterium bovis subsp bovis AF2122/97
uugggcgauuuugcgucug

SEQ ID NO: 1094844 - RNA, 13 nt, Mycobacterium bovis subsp bovis AF2122/97
uuggcgggugcga

SEQ ID NO: 1094845 - RNA, 18 nt, Mycobacterium bovis subsp bovis AF2122/97
uuggcggucugcgccaaa

SEQ ID NO: 1094846 - RNA, 23 nt, Mycobacterium bovis subsp bovis AF2122/97
uuggcgggcgccuuggucgccgc

SEQ ID NO: 1094847 - RNA, 12 nt, Mycobacterium bovis subsp bovis AF2122/97
uuggcggcggca

SEQ ID NO: 1094848 - RNA, 15 nt, Mycobacterium bovis subsp bovis AF2122/97
uuggcggccagcgca

SEQ ID NO: 1094849 - RNA, 15 nt, Mycobacterium bovis subsp bovis AF2122/97
uuggcgucagcagca

SEQ ID NO: 1094850 - RNA, 21 nt, Mycobacterium bovis subsp bovis AF2122/97
uuggcgucgacaacacgccgu

SEQ ID NO: 1094851 - RNA, 17 nt, Mycobacterium bovis subsp bovis AF2122/97
uuggcgucgucggcggc

SEQ ID NO: 1094852 - RNA, 21 nt, Mycobacterium bovis subsp bovis AF2122/97
uuggcggaugcccgcaacgcc

SEQ ID NO: 1094853 - RNA, 13 nt, Mycobacterium bovis subsp bovis AF2122/97
uuggcgcgcccau

SEQ ID NO: 1094854 - RNA, 22 nt, Mycobacterium bovis subsp bovis AF2122/97
uuggcgcggcacccggucggcc

SEQ ID NO: 1094855 - RNA, 11 nt, Mycobacterium bovis subsp bovis AF2122/97
uuggcgccgau

SEQ ID NO: 1094856 - RNA, 20 nt, Mycobacterium bovis subsp bovis AF2122/97
uuggcgaucccgccggggcc

SEQ ID NO: 1094857 - RNA, 16 nt, Mycobacterium bovis subsp bovis AF2122/97
uuggcgccgaugaccg

SEQ ID NO: 1094858 - RNA, 18 nt, Mycobacterium bovis subsp bovis AF2122/97
uuggcgccgccgaucccg

SEQ ID NO: 1094859 - RNA, 17 nt, Mycobacterium bovis subsp bovis AF2122/97
uggcucgcggaugcucg

SEQ ID NO: 1094860 - RNA, 13 nt, Mycobacterium bovis subsp bovis AF2122/97
uggcucgcuggga

SEQ ID NO: 1094861 - RNA, 22 nt, Mycobacterium bovis subsp bovis AF2122/97
uggcucgacgaugcggucaacg

SEQ ID NO: 1094862 - RNA, 18 nt, Mycobacterium bovis subsp bovis AF2122/97
uggcucacgcuccgccgg

SEQ ID NO: 1094863 - RNA, 22 nt, Mycobacterium bovis subsp bovis AF2122/97
uggcggugggcuuggcgccgau

SEQ ID NO: 1094864 - RNA, 14 nt, Mycobacterium bovis subsp bovis AF2122/97
uggcgguggugccg

SEQ ID NO: 1094865 - RNA, 17 nt, Mycobacterium bovis subsp bovis AF2122/97
uggcguuggcgaucucg

SEQ ID NO: 1094866 - RNA, 18 nt, Mycobacterium bovis subsp bovis AF2122/97
uggcguuggcgguaaacc

SEQ ID NO: 1094867 - RNA, 16 nt, Mycobacterium bovis subsp bovis AF2122/97
uggcggugccggcggc

SEQ ID NO: 1094868 - RNA, 19 nt, Mycobacterium bovis subsp bovis AF2122/97
uggcggugccggcggcgca

SEQ ID NO: 1094869 - RNA, 20 nt, Mycobacterium bovis subsp bovis AF2122/97
uggcggucgguuccggugua

SEQ ID NO: 1094870 - RNA, 16 nt, Mycobacterium bovis subsp bovis AF2122/97
uggcgguggccgucgg

SEQ ID NO: 1094871 - RNA, 22 nt, Mycobacterium bovis subsp bovis AF2122/97
uggcggggaaaccggccagccg

SEQ ID NO: 1094872 - RNA, 16 nt, Mycobacterium bovis subsp bovis AF2122/97
uggcgguccaccggcc

SEQ ID NO: 1094873 - RNA, 21 nt, Mycobacterium bovis subsp bovis AF2122/97
uggcggucaccacgcggcggu

SEQ ID NO: 1094874 - RNA, 14 nt, Mycobacterium bovis subsp bovis AF2122/97
uggcgggugcgaca

SEQ ID NO: 1094875 - RNA, 21 nt, Mycobacterium bovis subsp bovis AF2122/97
uggcgggcuugccgucuucgc

SEQ ID NO: 1094876 - RNA, 19 nt, Mycobacterium bovis subsp bovis AF2122/97
uggcggggaaaccggccag

SEQ ID NO: 1094877 - RNA, 22 nt, Mycobacterium bovis subsp bovis AF2122/97
uggcgggcgccuuggucgccgc

SEQ ID NO: 1094878 - RNA, 17 nt, Mycobacterium bovis subsp bovis AF2122/97
uggcgggcagcuguucg

SEQ ID NO: 1094879 - RNA, 20 nt, Mycobacterium bovis subsp bovis AF2122/97
uggcggcucguugcgggcgg

SEQ ID NO: 1094880 - RNA, 20 nt, Mycobacterium bovis subsp bovis AF2122/97
uggcgggagaucgucgccau

SEQ ID NO: 1094881 - RNA, 23 nt, Mycobacterium bovis subsp bovis AF2122/97
uggcgggaccgugacguaucgcc

SEQ ID NO: 1094882 - RNA, 17 nt, Mycobacterium bovis subsp bovis AF2122/97
uggcgggagaucgucgc

SEQ ID NO: 1094883 - RNA, 22 nt, Mycobacterium bovis subsp bovis AF2122/97
uggcugguuucggggaccacgc

SEQ ID NO: 1094884 - RNA, 17 nt, Mycobacterium bovis subsp bovis AF2122/97
uggcuggcggcgaccgu

SEQ ID NO: 1094885 - RNA, 14 nt, Mycobacterium bovis subsp bovis AF2122/97
uggcugggucguca

SEQ ID NO: 1094886 - RNA, 15 nt, Mycobacterium bovis subsp bovis AF2122/97
uggcugugcccacgc

SEQ ID NO: 1094887 - RNA, 23 nt, Mycobacterium bovis subsp bovis AF2122/97
ugggaucgggaauuucgucggcc

SEQ ID NO: 1094888 - RNA, 19 nt, Mycobacterium bovis subsp bovis AF2122/97
ugggaugaguucgucgugg

SEQ ID NO: 1094889 - RNA, 22 nt, Mycobacterium bovis subsp bovis AF2122/97
ugggaucgcagcgccauuccaa

SEQ ID NO: 1094890 - RNA, 16 nt, Mycobacterium bovis subsp bovis AF2122/97
uggcuugaguuucggc

SEQ ID NO: 1094891 - RNA, 16 nt, Mycobacterium bovis subsp bovis AF2122/97
uggcuugccccgccgu

SEQ ID NO: 1094892 - RNA, 20 nt, Mycobacterium bovis subsp bovis AF2122/97
ugggcacuugcccgucggcg

SEQ ID NO: 1094893 - RNA, 14 nt, Mycobacterium bovis subsp bovis AF2122/97
ugggcccgcuggug

SEQ ID NO: 1094894 - RNA, 19 nt, Mycobacterium bovis subsp bovis AF2122/97
ugggcccagcggccgcgau

SEQ ID NO: 1094895 - RNA, 16 nt, Mycobacterium bovis subsp bovis AF2122/97
ugggccccgaucccga

SEQ ID NO: 1094896 - RNA, 14 nt, Mycobacterium bovis subsp bovis AF2122/97
ugggcagcagcgcg

SEQ ID NO: 1094897 - RNA, 18 nt, Mycobacterium bovis subsp bovis AF2122/97
ugggcccuucacuguugc

SEQ ID NO: 1094898 - RNA, 13 nt, Mycobacterium bovis subsp bovis AF2122/97
ugggccgaccgcc

SEQ ID NO: 1094899 - RNA, 21 nt, Mycobacterium bovis subsp bovis AF2122/97
ugggcccuuugcuguccccgc

SEQ ID NO: 1094900 - RNA, 15 nt, Mycobacterium bovis subsp bovis AF2122/97
ugggccgccgcccug

SEQ ID NO: 1094901 - RNA, 13 nt, Mycobacterium bovis subsp bovis AF2122/97
ugggcaccggcgg

SEQ ID NO: 1094902 - RNA, 21 nt, Mycobacterium bovis subsp bovis AF2122/97
ugggcaccacccgauuggcca

SEQ ID NO: 1094903 - RNA, 17 nt, Mycobacterium bovis subsp bovis AF2122/97
ugggcacguugugaucg

SEQ ID NO: 1094904 - RNA, 16 nt, Mycobacterium bovis subsp bovis AF2122/97
ugggcaauuccgccga

SEQ ID NO: 1094905 - RNA, 22 nt, Mycobacterium bovis subsp bovis AF2122/97
ugggauugaagcuggccaccgc

SEQ ID NO: 1094906 - RNA, 21 nt, Mycobacterium bovis subsp bovis AF2122/97
ugggcaauccggucagcgcgg

SEQ ID NO: 1094907 - RNA, 17 nt, Mycobacterium bovis subsp bovis AF2122/97
ugggcaagcugaccgcc

SEQ ID NO: 1094908 - RNA, 14 nt, Mycobacterium bovis subsp bovis AF2122/97
ugggccuccaccgc

SEQ ID NO: 1094909 - RNA, 21 nt, Mycobacterium bovis subsp bovis AF2122/97
ugggcgcgaaacgccgcaaug

SEQ ID NO: 1094910 - RNA, 15 nt, Mycobacterium bovis subsp bovis AF2122/97
ugggcgcgcucaucg

SEQ ID NO: 1094911 - RNA, 19 nt, Mycobacterium bovis subsp bovis AF2122/97
ugggcgcgcucaucgaccg

SEQ ID NO: 1094912 - RNA, 20 nt, Mycobacterium bovis subsp bovis AF2122/97
ugggcgcgcucaucgaccgc

SEQ ID NO: 1094913 - RNA, 22 nt, Mycobacterium bovis subsp bovis AF2122/97
ugggcgcgcucaucgaccgggg

SEQ ID NO: 1094914 - RNA, 16 nt, Mycobacterium bovis subsp bovis AF2122/97
ugggcgcucgcaucau

SEQ ID NO: 1094915 - RNA, 15 nt, Mycobacterium bovis subsp bovis AF2122/97
ugggcgcgcuggcgg

SEQ ID NO: 1094916 - RNA, 17 nt, Mycobacterium bovis subsp bovis AF2122/97
ugggcggaacgaugccg

SEQ ID NO: 1094917 - RNA, 23 nt, Mycobacterium bovis subsp bovis AF2122/97
ugggccucaaguugguucaccgc

SEQ ID NO: 1094918 - RNA, 13 nt, Mycobacterium bovis subsp bovis AF2122/97
ugggcgccaccau

SEQ ID NO: 1094919 - RNA, 17 nt, Mycobacterium bovis subsp bovis AF2122/97
ugggcgccgcaaccgcc

SEQ ID NO: 1094920 - RNA, 16 nt, Mycobacterium bovis subsp bovis AF2122/97
ugggcgccgucucugc

SEQ ID NO: 1094921 - RNA, 15 nt, Mycobacterium bovis subsp bovis AF2122/97
uggggacccgcucca

SEQ ID NO: 1094922 - RNA, 13 nt, Mycobacterium bovis subsp bovis AF2122/97
ugggcuugcccca

SEQ ID NO: 1094923 - RNA, 15 nt, Mycobacterium bovis subsp bovis AF2122/97
ugggcuugcgccgga

SEQ ID NO: 1094924 - RNA, 19 nt, Mycobacterium bovis subsp bovis AF2122/97
ugggcuuucugcacccgcc

SEQ ID NO: 1094925 - RNA, 23 nt, Mycobacterium bovis subsp bovis AF2122/97
ugggcuucgagugcgacggcgac

SEQ ID NO: 1094926 - RNA, 22 nt, Mycobacterium bovis subsp bovis AF2122/97
ugggcuucgaguuuggcgacga

SEQ ID NO: 1094927 - RNA, 17 nt, Mycobacterium bovis subsp bovis AF2122/97
ugggcggccuggucggc

SEQ ID NO: 1094928 - RNA, 15 nt, Mycobacterium bovis subsp bovis AF2122/97
ugggcggccagcacg

SEQ ID NO: 1094929 - RNA, 19 nt, Mycobacterium bovis subsp bovis AF2122/97
ugggcggccagcacgucgu

SEQ ID NO: 1094930 - RNA, 18 nt, Mycobacterium bovis subsp bovis AF2122/97
ugggcggcccaccggcca

SEQ ID NO: 1094931 - RNA, 16 nt, Mycobacterium bovis subsp bovis AF2122/97
ugggcuggccagcacg

SEQ ID NO: 1094932 - RNA, 20 nt, Mycobacterium bovis subsp bovis AF2122/97
ugggcuggccagcacgcccg

SEQ ID NO: 1094933 - RNA, 21 nt, Mycobacterium bovis subsp bovis AF2122/97
ugggcugggauagcgcgguug

SEQ ID NO: 1094934 - RNA, 16 nt, Mycobacterium bovis subsp bovis AF2122/97
ugggcugccggccaga

SEQ ID NO: 1094935 - RNA, 20 nt, Mycobacterium bovis subsp bovis AF2122/97
uggggccgcggcgcgacggc

SEQ ID NO: 1094936 - RNA, 21 nt, Mycobacterium bovis subsp bovis AF2122/97
uggggccgcuggggcgcccga

SEQ ID NO: 1094937 - RNA, 14 nt, Mycobacterium bovis subsp bovis AF2122/97
uggggcacgacgcc

SEQ ID NO: 1094938 - RNA, 20 nt, Mycobacterium bovis subsp bovis AF2122/97
uggggcacgacgccggccug

SEQ ID NO: 1094939 - RNA, 23 nt, Mycobacterium bovis subsp bovis AF2122/97
uggggauaaacugccgcggcacc

SEQ ID NO: 1094940 - RNA, 18 nt, Mycobacterium bovis subsp bovis AF2122/97
uggggauagccgcgucgc

SEQ ID NO: 1094941 - RNA, 19 nt, Mycobacterium bovis subsp bovis AF2122/97
uggggaucgcaccgugggc

SEQ ID NO: 1094942 - RNA, 16 nt, Mycobacterium bovis subsp bovis AF2122/97
uggggaugcgauggcc

SEQ ID NO: 1094943 - RNA, 19 nt, Mycobacterium bovis subsp bovis AF2122/97
uggggccggcgucgaugac

SEQ ID NO: 1094944 - RNA, 16 nt, Mycobacterium bovis subsp bovis AF2122/97
uggggccgggcuccuc

SEQ ID NO: 1094945 - RNA, 16 nt, Mycobacterium bovis subsp bovis AF2122/97
uggggccggggucggc

SEQ ID NO: 1094946 - RNA, 14 nt, Mycobacterium bovis subsp bovis AF2122/97
ugggguguggcggc

SEQ ID NO: 1094947 - RNA, 13 nt, Mycobacterium bovis subsp bovis AF2122/97
uggguauccaccg

SEQ ID NO: 1094948 - RNA, 24 nt, Mycobacterium bovis subsp bovis AF2122/97
uggguagcggaucaagcgcacaaa

SEQ ID NO: 1094949 - RNA, 20 nt, Mycobacterium bovis subsp bovis AF2122/97
uggguaccucucugucgcgu

SEQ ID NO: 1094950 - RNA, 14 nt, Mycobacterium bovis subsp bovis AF2122/97
uggguccgggcggc

SEQ ID NO: 1094951 - RNA, 22 nt, Mycobacterium bovis subsp bovis AF2122/97
ugggucgaccguagccgugaca

SEQ ID NO: 1094952 - RNA, 16 nt, Mycobacterium bovis subsp bovis AF2122/97
ugggucaccucggaga

SEQ ID NO: 1094953 - RNA, 17 nt, Mycobacterium bovis subsp bovis AF2122/97
ugguacggcucggcgcu

SEQ ID NO: 1094954 - RNA, 16 nt, Mycobacterium bovis subsp bovis AF2122/97
ugguacgugcgagccc

SEQ ID NO: 1094955 - RNA, 20 nt, Mycobacterium bovis subsp bovis AF2122/97
ugggucgugcaggcgacggc

SEQ ID NO: 1094956 - RNA, 21 nt, Mycobacterium bovis subsp bovis AF2122/97
ugggucgugcaggcgacggcu

SEQ ID NO: 1094957 - RNA, 21 nt, Mycobacterium bovis subsp bovis AF2122/97
ugggucuccggaucgccgaau

SEQ ID NO: 1094958 - RNA, 20 nt, Mycobacterium bovis subsp bovis AF2122/97
ugggugaagagaagucucgc

SEQ ID NO: 1094959 - RNA, 19 nt, Mycobacterium bovis subsp bovis AF2122/97
ugggugacaccggugcgac

SEQ ID NO: 1094960 - RNA, 19 nt, Mycobacterium bovis subsp bovis AF2122/97
ugguaggagaucaccucgg

SEQ ID NO: 1094961 - RNA, 16 nt, Mycobacterium bovis subsp bovis AF2122/97
ugguacuuucacgcuc

SEQ ID NO: 1094962 - RNA, 13 nt, Mycobacterium bovis subsp bovis AF2122/97
ugguaggucaccg

SEQ ID NO: 1094963 - RNA, 16 nt, Mycobacterium bovis subsp bovis AF2122/97
ugguaggucaccgguc

SEQ ID NO: 1094964 - RNA, 12 nt, Mycobacterium bovis subsp bovis AF2122/97
ugguaggcggcc

SEQ ID NO: 1094965 - RNA, 17 nt, Mycobacterium bovis subsp bovis AF2122/97
uggcgaucaugagcagc

SEQ ID NO: 1094966 - RNA, 14 nt, Mycobacterium bovis subsp bovis AF2122/97
uggcgauccgcggc

SEQ ID NO: 1094967 - RNA, 12 nt, Mycobacterium bovis subsp bovis AF2122/97
uggcgaucucga

SEQ ID NO: 1094968 - RNA, 17 nt, Mycobacterium bovis subsp bovis AF2122/97
uggcgaucccgccgggg

SEQ ID NO: 1094969 - RNA, 20 nt, Mycobacterium bovis subsp bovis AF2122/97
uggcgaugaggaacguuucg

SEQ ID NO: 1094970 - RNA, 18 nt, Mycobacterium bovis subsp bovis AF2122/97
uggcgaugagguggccgc

SEQ ID NO: 1094971 - RNA, 17 nt, Mycobacterium bovis subsp bovis AF2122/97
uggcgaugaccuugggg

SEQ ID NO: 1094972 - RNA, 17 nt, Mycobacterium bovis subsp bovis AF2122/97
uggcgaugacgaucgcg

SEQ ID NO: 1094973 - RNA, 15 nt, Mycobacterium bovis subsp bovis AF2122/97
uggcgauaucggccc

SEQ ID NO: 1094974 - RNA, 14 nt, Mycobacterium bovis subsp bovis AF2122/97
uggcgaggcagcac

SEQ ID NO: 1094975 - RNA, 17 nt, Mycobacterium bovis subsp bovis AF2122/97
uggcgaggucggugagg

SEQ ID NO: 1094976 - RNA, 17 nt, Mycobacterium bovis subsp bovis AF2122/97
uggcgccggccagccag

SEQ ID NO: 1094977 - RNA, 18 nt, Mycobacterium bovis subsp bovis AF2122/97
uggcgccggggaccacgg

SEQ ID NO: 1094978 - RNA, 11 nt, Mycobacterium bovis subsp bovis AF2122/97
uggcgccggug

SEQ ID NO: 1094979 - RNA, 14 nt, Mycobacterium bovis subsp bovis AF2122/97
uggcgccggugccg

SEQ ID NO: 1094980 - RNA, 14 nt, Mycobacterium bovis subsp bovis AF2122/97
uggcgccgccggug

SEQ ID NO: 1094981 - RNA, 18 nt, Mycobacterium bovis subsp bovis AF2122/97
uggcgccggugccgccgg

SEQ ID NO: 1094982 - RNA, 18 nt, Mycobacterium bovis subsp bovis AF2122/97
uggcgccgaugccggcca

SEQ ID NO: 1094983 - RNA, 13 nt, Mycobacterium bovis subsp bovis AF2122/97
uggcgccgcgccg

SEQ ID NO: 1094984 - RNA, 15 nt, Mycobacterium bovis subsp bovis AF2122/97
uggcgccgcgccgau

SEQ ID NO: 1094985 - RNA, 23 nt, Mycobacterium bovis subsp bovis AF2122/97
uggcgccgcgccgauuccaccgc

SEQ ID NO: 1094986 - RNA, 14 nt, Mycobacterium bovis subsp bovis AF2122/97
uggcggcgcagcgu

SEQ ID NO: 1094987 - RNA, 13 nt, Mycobacterium bovis subsp bovis AF2122/97
uggcggcgccggu

SEQ ID NO: 1094988 - RNA, 14 nt, Mycobacterium bovis subsp bovis AF2122/97
uggcggcgccggug

SEQ ID NO: 1094989 - RNA, 16 nt, Mycobacterium bovis subsp bovis AF2122/97
uggcggcgccgguggu

SEQ ID NO: 1094990 - RNA, 21 nt, Mycobacterium bovis subsp bovis AF2122/97
uggcggcgaugguaucgccgc

SEQ ID NO: 1094991 - RNA, 21 nt, Mycobacterium bovis subsp bovis AF2122/97
uggcggcgaucaacucgggca

SEQ ID NO: 1094992 - RNA, 12 nt, Mycobacterium bovis subsp bovis AF2122/97
uggcggcgacgg

SEQ ID NO: 1094993 - RNA, 14 nt, Mycobacterium bovis subsp bovis AF2122/97
uggcggcgacggcc

SEQ ID NO: 1094994 - RNA, 23 nt, Mycobacterium bovis subsp bovis AF2122/97
uggcggcgacccgucccccgcac

SEQ ID NO: 1094995 - RNA, 19 nt, Mycobacterium bovis subsp bovis AF2122/97
uggcggcgaucaacucggg

SEQ ID NO: 1094996 - RNA, 16 nt, Mycobacterium bovis subsp bovis AF2122/97
uggcggcggugcagca

SEQ ID NO: 1094997 - RNA, 18 nt, Mycobacterium bovis subsp bovis AF2122/97
uggcggcggugccacgau

SEQ ID NO: 1094998 - RNA, 22 nt, Mycobacterium bovis subsp bovis AF2122/97
uggcggcggugccacgaucggc

SEQ ID NO: 1094999 - RNA, 20 nt, Mycobacterium bovis subsp bovis AF2122/97
uggcggcgggccucggcgac

SEQ ID NO: 1095000 - RNA, 16 nt, Mycobacterium bovis subsp bovis AF2122/97
uggcggcgggggcggc

SEQ ID NO: 1095001 - RNA, 19 nt, Mycobacterium bovis subsp bovis AF2122/97
uggcggcguagucguuguc

SEQ ID NO: 1095002 - RNA, 23 nt, Mycobacterium bovis subsp bovis AF2122/97
uggcggcggcauagugcgacugc

SEQ ID NO: 1095003 - RNA, 19 nt, Mycobacterium bovis subsp bovis AF2122/97
uggcggcgcguucgucguc

SEQ ID NO: 1095004 - RNA, 16 nt, Mycobacterium bovis subsp bovis AF2122/97
uggcgcugaagccgac

SEQ ID NO: 1095005 - RNA, 21 nt, Mycobacterium bovis subsp bovis AF2122/97
uggcgcugcccgccgccccgu

SEQ ID NO: 1095006 - RNA, 18 nt, Mycobacterium bovis subsp bovis AF2122/97
uggcgcugaagccgacga

SEQ ID NO: 1095007 - RNA, 19 nt, Mycobacterium bovis subsp bovis AF2122/97
uggcgcugaagccgacgau

SEQ ID NO: 1095008 - RNA, 23 nt, Mycobacterium bovis subsp bovis AF2122/97
uggcgcugaagccgacgauccac

SEQ ID NO: 1095009 - RNA, 12 nt, Mycobacterium bovis subsp bovis AF2122/97
uggcgcugaucg

SEQ ID NO: 1095010 - RNA, 17 nt, Mycobacterium bovis subsp bovis AF2122/97
uggcgcugaugcuggcc

SEQ ID NO: 1095011 - RNA, 18 nt, Mycobacterium bovis subsp bovis AF2122/97
uggcgcgggccggcgacu

SEQ ID NO: 1095012 - RNA, 14 nt, Mycobacterium bovis subsp bovis AF2122/97
uggcgcgggcgaga

SEQ ID NO: 1095013 - RNA, 20 nt, Mycobacterium bovis subsp bovis AF2122/97
uggcgcgggcgagaacccac

SEQ ID NO: 1095014 - RNA, 23 nt, Mycobacterium bovis subsp bovis AF2122/97
uggcgcguaggcccaacgacggc

SEQ ID NO: 1095015 - RNA, 13 nt, Mycobacterium bovis subsp bovis AF2122/97
uggcgcguaucgc

SEQ ID NO: 1095016 - RNA, 17 nt, Mycobacterium bovis subsp bovis AF2122/97
uggccgucagcgucggc

SEQ ID NO: 1095017 - RNA, 13 nt, Mycobacterium bovis subsp bovis AF2122/97
uggccgucagcca

SEQ ID NO: 1095018 - RNA, 16 nt, Mycobacterium bovis subsp bovis AF2122/97
uggccgucagccaggu

SEQ ID NO: 1095019 - RNA, 15 nt, Mycobacterium bovis subsp bovis AF2122/97
uggccgucgccgaag

SEQ ID NO: 1095020 - RNA, 19 nt, Mycobacterium bovis subsp bovis AF2122/97
uggccgucgccgaaguucc

SEQ ID NO: 1095021 - RNA, 18 nt, Mycobacterium bovis subsp bovis AF2122/97
uggccgucgcugguggcg

SEQ ID NO: 1095022 - RNA, 22 nt, Mycobacterium bovis subsp bovis AF2122/97
uggccguggcgaaugacggcca

SEQ ID NO: 1095023 - RNA, 18 nt, Mycobacterium bovis subsp bovis AF2122/97
uggccguugccaacaaca

SEQ ID NO: 1095024 - RNA, 17 nt, Mycobacterium bovis subsp bovis AF2122/97
uggccguuggcggcggu

SEQ ID NO: 1095025 - RNA, 22 nt, Mycobacterium bovis subsp bovis AF2122/97
uggccuccuggaaggaggccgg

SEQ ID NO: 1095026 - RNA, 13 nt, Mycobacterium bovis subsp bovis AF2122/97
uggccgugggugu

SEQ ID NO: 1095027 - RNA, 23 nt, Mycobacterium bovis subsp bovis AF2122/97
uggccguuucggcgccgucgccc

SEQ ID NO: 1095028 - RNA, 18 nt, Mycobacterium bovis subsp bovis AF2122/97
uggccuagccgcggcacc

SEQ ID NO: 1095029 - RNA, 16 nt, Mycobacterium bovis subsp bovis AF2122/97
uggccucauccaccga

SEQ ID NO: 1095030 - RNA, 18 nt, Mycobacterium bovis subsp bovis AF2122/97
uggccugaugcagggccc

SEQ ID NO: 1095031 - RNA, 17 nt, Mycobacterium bovis subsp bovis AF2122/97
uggccugcaacgccgcg

SEQ ID NO: 1095032 - RNA, 21 nt, Mycobacterium bovis subsp bovis AF2122/97
uggccugcaacgccgcggacc

SEQ ID NO: 1095033 - RNA, 17 nt, Mycobacterium bovis subsp bovis AF2122/97
uggcgaaugacggccag

SEQ ID NO: 1095034 - RNA, 12 nt, Mycobacterium bovis subsp bovis AF2122/97
uggcgaccacga

SEQ ID NO: 1095035 - RNA, 12 nt, Mycobacterium bovis subsp bovis AF2122/97
uggcgaccccgc

SEQ ID NO: 1095036 - RNA, 13 nt, Mycobacterium bovis subsp bovis AF2122/97
uggcgaccugcgc

SEQ ID NO: 1095037 - RNA, 18 nt, Mycobacterium bovis subsp bovis AF2122/97
uggcgacugucuggucgg

SEQ ID NO: 1095038 - RNA, 17 nt, Mycobacterium bovis subsp bovis AF2122/97
uggcgagcagacgcgaa

SEQ ID NO: 1095039 - RNA, 21 nt, Mycobacterium bovis subsp bovis AF2122/97
uggcgagccagcuucccgcug

SEQ ID NO: 1095040 - RNA, 15 nt, Mycobacterium bovis subsp bovis AF2122/97
uggcgacggacuccc

SEQ ID NO: 1095041 - RNA, 12 nt, Mycobacterium bovis subsp bovis AF2122/97
uggcgacgucga

SEQ ID NO: 1095042 - RNA, 22 nt, Mycobacterium bovis subsp bovis AF2122/97
uggccgcuuugcgcggucagcc

SEQ ID NO: 1095043 - RNA, 19 nt, Mycobacterium bovis subsp bovis AF2122/97
uggccggaucccagugcca

SEQ ID NO: 1095044 - RNA, 23 nt, Mycobacterium bovis subsp bovis AF2122/97
uggccggaucgaagaccagcaac

SEQ ID NO: 1095045 - RNA, 18 nt, Mycobacterium bovis subsp bovis AF2122/97
uggccgcgggcgcggccc

SEQ ID NO: 1095046 - RNA, 18 nt, Mycobacterium bovis subsp bovis AF2122/97
uggccggguccagcccgg

SEQ ID NO: 1095047 - RNA, 19 nt, Mycobacterium bovis subsp bovis AF2122/97
uggccgguccgaucguuuc

SEQ ID NO: 1095048 - RNA, 14 nt, Mycobacterium bovis subsp bovis AF2122/97
uggccguaccggug

SEQ ID NO: 1095049 - RNA, 14 nt, Mycobacterium bovis subsp bovis AF2122/97
uggccgcggcaccc

SEQ ID NO: 1095050 - RNA, 17 nt, Mycobacterium bovis subsp bovis AF2122/97
uggccgcuuugcgcggu

SEQ ID NO: 1095051 - RNA, 21 nt, Mycobacterium bovis subsp bovis AF2122/97
uggccgcgcaggggcggcgug

SEQ ID NO: 1095052 - RNA, 23 nt, Mycobacterium bovis subsp bovis AF2122/97
uggaaagcgcuuuagcggugugg

SEQ ID NO: 1095053 - RNA, 20 nt, Mycobacterium bovis subsp bovis AF2122/97
uggaaagcagcagcggcggc

SEQ ID NO: 1095054 - RNA, 23 nt, Mycobacterium bovis subsp bovis AF2122/97
ugcuuuugggcaauuccgccgag

SEQ ID NO: 1095055 - RNA, 14 nt, Mycobacterium bovis subsp bovis AF2122/97
uggucugcaggcgg

SEQ ID NO: 1095056 - RNA, 15 nt, Mycobacterium bovis subsp bovis AF2122/97
uggugaaccgcgcgg

SEQ ID NO: 1095057 - RNA, 20 nt, Mycobacterium bovis subsp bovis AF2122/97
uggugaacgagaugccgcga

SEQ ID NO: 1095058 - RNA, 19 nt, Mycobacterium bovis subsp bovis AF2122/97
uggucgucccgauggcggu

SEQ ID NO: 1095059 - RNA, 14 nt, Mycobacterium bovis subsp bovis AF2122/97
uggucuacccgcgg

SEQ ID NO: 1095060 - RNA, 17 nt, Mycobacterium bovis subsp bovis AF2122/97
uggucgggaacccggug

SEQ ID NO: 1095061 - RNA, 13 nt, Mycobacterium bovis subsp bovis AF2122/97
uggucgggucgca

SEQ ID NO: 1095062 - RNA, 20 nt, Mycobacterium bovis subsp bovis AF2122/97
uggucggucgcgcgacggcc

SEQ ID NO: 1095063 - RNA, 21 nt, Mycobacterium bovis subsp bovis AF2122/97
uggucggugcugaccccgccg

SEQ ID NO: 1095064 - RNA, 23 nt, Mycobacterium bovis subsp bovis AF2122/97
uggucggugcugaccccgccggc

SEQ ID NO: 1095065 - RNA, 16 nt, Mycobacterium bovis subsp bovis AF2122/97
uggugauugcggaaca

SEQ ID NO: 1095066 - RNA, 15 nt, Mycobacterium bovis subsp bovis AF2122/97
uggugauugcggccg

SEQ ID NO: 1095067 - RNA, 13 nt, Mycobacterium bovis subsp bovis AF2122/97
uggugauggccga

SEQ ID NO: 1095068 - RNA, 20 nt, Mycobacterium bovis subsp bovis AF2122/97
uggugaugggggagccggug

SEQ ID NO: 1095069 - RNA, 17 nt, Mycobacterium bovis subsp bovis AF2122/97
uggugaugccaucaacg

SEQ ID NO: 1095070 - RNA, 15 nt, Mycobacterium bovis subsp bovis AF2122/97
uggugaucugcuggg

SEQ ID NO: 1095071 - RNA, 23 nt, Mycobacterium bovis subsp bovis AF2122/97
uggugauccagccgucggcgcug

SEQ ID NO: 1095072 - RNA, 17 nt, Mycobacterium bovis subsp bovis AF2122/97
uggugauccggucuccg

SEQ ID NO: 1095073 - RNA, 21 nt, Mycobacterium bovis subsp bovis AF2122/97
uggugaaguagucggcgccga

SEQ ID NO: 1095074 - RNA, 22 nt, Mycobacterium bovis subsp bovis AF2122/97
uggugaaguagucggcgccgag

SEQ ID NO: 1095075 - RNA, 17 nt, Mycobacterium bovis subsp bovis AF2122/97
uggugaagucggugccg

SEQ ID NO: 1095076 - RNA, 16 nt, Mycobacterium bovis subsp bovis AF2122/97
uggugaagugaaccag

SEQ ID NO: 1095077 - RNA, 18 nt, Mycobacterium bovis subsp bovis AF2122/97
uggugacauagaccucgc

SEQ ID NO: 1095078 - RNA, 23 nt, Mycobacterium bovis subsp bovis AF2122/97
uggugacauagaccucgccggug

SEQ ID NO: 1095079 - RNA, 15 nt, Mycobacterium bovis subsp bovis AF2122/97
uggugaccgacgcgg

SEQ ID NO: 1095080 - RNA, 13 nt, Mycobacterium bovis subsp bovis AF2122/97
uggugacggcggu

SEQ ID NO: 1095081 - RNA, 20 nt, Mycobacterium bovis subsp bovis AF2122/97
uggugaggccccccgcgccu

SEQ ID NO: 1095082 - RNA, 21 nt, Mycobacterium bovis subsp bovis AF2122/97
uggugagguggucagccggug

SEQ ID NO: 1095083 - RNA, 13 nt, Mycobacterium bovis subsp bovis AF2122/97
uggugccaaccug

SEQ ID NO: 1095084 - RNA, 19 nt, Mycobacterium bovis subsp bovis AF2122/97
uggugcaggugagugcggc

SEQ ID NO: 1095085 - RNA, 15 nt, Mycobacterium bovis subsp bovis AF2122/97
uggugccaaccuggg

SEQ ID NO: 1095086 - RNA, 22 nt, Mycobacterium bovis subsp bovis AF2122/97
uggugccaaccugggccaucac

SEQ ID NO: 1095087 - RNA, 17 nt, Mycobacterium bovis subsp bovis AF2122/97
uggugcagccgcggucg

SEQ ID NO: 1095088 - RNA, 17 nt, Mycobacterium bovis subsp bovis AF2122/97
uggugccaacugcgccg

SEQ ID NO: 1095089 - RNA, 16 nt, Mycobacterium bovis subsp bovis AF2122/97
uggugccgacccgccg

SEQ ID NO: 1095090 - RNA, 17 nt, Mycobacterium bovis subsp bovis AF2122/97
uggugcccgacccgccg

SEQ ID NO: 1095091 - RNA, 20 nt, Mycobacterium bovis subsp bovis AF2122/97
uggugcccgacccgccgaug

SEQ ID NO: 1095092 - RNA, 14 nt, Mycobacterium bovis subsp bovis AF2122/97
uggugccgcggcca

SEQ ID NO: 1095093 - RNA, 15 nt, Mycobacterium bovis subsp bovis AF2122/97
uggugccgcggccac

SEQ ID NO: 1095094 - RNA, 14 nt, Mycobacterium bovis subsp bovis AF2122/97
uggugccgccugug

SEQ ID NO: 1095095 - RNA, 23 nt, Mycobacterium bovis subsp bovis AF2122/97
uggugccgccaccaccggcgccu

SEQ ID NO: 1095096 - RNA, 14 nt, Mycobacterium bovis subsp bovis AF2122/97
uggugccgacccgc

SEQ ID NO: 1095097 - RNA, 19 nt, Mycobacterium bovis subsp bovis AF2122/97
uggugcgccgggcguccgc

SEQ ID NO: 1095098 - RNA, 19 nt, Mycobacterium bovis subsp bovis AF2122/97
uggugcgccacgccaccgc

SEQ ID NO: 1095099 - RNA, 18 nt, Mycobacterium bovis subsp bovis AF2122/97
uggugcgccgggcguccg

SEQ ID NO: 1095100 - RNA, 18 nt, Mycobacterium bovis subsp bovis AF2122/97
uggugccgcggccaccgc

SEQ ID NO: 1095101 - RNA, 18 nt, Mycobacterium bovis subsp bovis AF2122/97
ugguguccucgucgaggu

SEQ ID NO: 1095102 - RNA, 13 nt, Mycobacterium bovis subsp bovis AF2122/97
uggugucgcggcc

SEQ ID NO: 1095103 - RNA, 13 nt, Mycobacterium bovis subsp bovis AF2122/97
uggugucgcucag

SEQ ID NO: 1095104 - RNA, 22 nt, Mycobacterium bovis subsp bovis AF2122/97
uggugucggaaugggcgccaca

SEQ ID NO: 1095105 - RNA, 17 nt, Mycobacterium bovis subsp bovis AF2122/97
uggugugucaccggauu

SEQ ID NO: 1095106 - RNA, 12 nt, Mycobacterium bovis subsp bovis AF2122/97
ugguucaacacc

SEQ ID NO: 1095107 - RNA, 16 nt, Mycobacterium bovis subsp bovis AF2122/97
ugguucaacaccggua

SEQ ID NO: 1095108 - RNA, 20 nt, Mycobacterium bovis subsp bovis AF2122/97
uggucgcugcugccgcaccg

SEQ ID NO: 1095109 - RNA, 23 nt, Mycobacterium bovis subsp bovis AF2122/97
uggucgcugcugccgcaccggug

SEQ ID NO: 1095110 - RNA, 15 nt, Mycobacterium bovis subsp bovis AF2122/97
uggucgcggcugcca

SEQ ID NO: 1095111 - RNA, 14 nt, Mycobacterium bovis subsp bovis AF2122/97
uggucgcgcagcuc

SEQ ID NO: 1095112 - RNA, 13 nt, Mycobacterium bovis subsp bovis AF2122/97
uggucggcgacgu

SEQ ID NO: 1095113 - RNA, 14 nt, Mycobacterium bovis subsp bovis AF2122/97
uggucggcgcgccg

SEQ ID NO: 1095114 - RNA, 20 nt, Mycobacterium bovis subsp bovis AF2122/97
uggucggcuaccgccgaccg

SEQ ID NO: 1095115 - RNA, 17 nt, Mycobacterium bovis subsp bovis AF2122/97
uggucggcuccgcgacg

SEQ ID NO: 1095116 - RNA, 14 nt, Mycobacterium bovis subsp bovis AF2122/97
uggucggcucguca

SEQ ID NO: 1095117 - RNA, 20 nt, Mycobacterium bovis subsp bovis AF2122/97
uggucgccgccuuccuggcg

SEQ ID NO: 1095118 - RNA, 18 nt, Mycobacterium bovis subsp bovis AF2122/97
uggucgccgcggcagcgu

SEQ ID NO: 1095119 - RNA, 17 nt, Mycobacterium bovis subsp bovis AF2122/97
uggucgccgcuuucuug

SEQ ID NO: 1095120 - RNA, 19 nt, Mycobacterium bovis subsp bovis AF2122/97
uggucgccaacgccagcac

SEQ ID NO: 1095121 - RNA, 23 nt, Mycobacterium bovis subsp bovis AF2122/97
uggucgccacccgacaugcgccg

SEQ ID NO: 1095122 - RNA, 23 nt, Mycobacterium bovis subsp bovis AF2122/97
uggucgagcagugccucggcgau

SEQ ID NO: 1095123 - RNA, 19 nt, Mycobacterium bovis subsp bovis AF2122/97
uggucgagcacgcugcugc

SEQ ID NO: 1095124 - RNA, 14 nt, Mycobacterium bovis subsp bovis AF2122/97
uggucgagggcggc

SEQ ID NO: 1095125 - RNA, 20 nt, Mycobacterium bovis subsp bovis AF2122/97
uggucgauccacucggcgau

SEQ ID NO: 1095126 - RNA, 14 nt, Mycobacterium bovis subsp bovis AF2122/97
uggucgaggucggc

SEQ ID NO: 1095127 - RNA, 20 nt, Mycobacterium bovis subsp bovis AF2122/97
uggucgaucaugacgagccg

SEQ ID NO: 1095128 - RNA, 18 nt, Mycobacterium bovis subsp bovis AF2122/97
uggucgauuucggcgcgu

SEQ ID NO: 1095129 - RNA, 14 nt, Mycobacterium bovis subsp bovis AF2122/97
uggucgcaccgccg

SEQ ID NO: 1095130 - RNA, 23 nt, Mycobacterium bovis subsp bovis AF2122/97
ugguccuccaaggcggucaccac

SEQ ID NO: 1095131 - RNA, 19 nt, Mycobacterium bovis subsp bovis AF2122/97
ugguccuccuucgguggug

SEQ ID NO: 1095132 - RNA, 21 nt, Mycobacterium bovis subsp bovis AF2122/97
ugguccucgaucagacgcucg

SEQ ID NO: 1095133 - RNA, 15 nt, Mycobacterium bovis subsp bovis AF2122/97
ugguccgaccagcgg

SEQ ID NO: 1095134 - RNA, 22 nt, Mycobacterium bovis subsp bovis AF2122/97
ugguccgccagaucucgcgcgc

SEQ ID NO: 1095135 - RNA, 20 nt, Mycobacterium bovis subsp bovis AF2122/97
ugguccgccgucgaccacga

SEQ ID NO: 1095136 - RNA, 20 nt, Mycobacterium bovis subsp bovis AF2122/97
ugguccgggugccggugcgc

SEQ ID NO: 1095137 - RNA, 22 nt, Mycobacterium bovis subsp bovis AF2122/97
uggucgacggggcggucggccg

SEQ ID NO: 1095138 - RNA, 20 nt, Mycobacterium bovis subsp bovis AF2122/97
uggucgaacucgccccgcgu

SEQ ID NO: 1095139 - RNA, 21 nt, Mycobacterium bovis subsp bovis AF2122/97
uggucgaacagcgaaccggcu

SEQ ID NO: 1095140 - RNA, 22 nt, Mycobacterium bovis subsp bovis AF2122/97
uggucgaaacgguacgccgccg

SEQ ID NO: 1095141 - RNA, 21 nt, Mycobacterium bovis subsp bovis AF2122/97
uggucaguccgacaccggcgg

SEQ ID NO: 1095142 - RNA, 19 nt, Mycobacterium bovis subsp bovis AF2122/97
uggucagcguggacgcccg

SEQ ID NO: 1095143 - RNA, 23 nt, Mycobacterium bovis subsp bovis AF2122/97
uggucagcuggccgcggcgagua

SEQ ID NO: 1095144 - RNA, 16 nt, Mycobacterium bovis subsp bovis AF2122/97
uggucaggaacacucg

SEQ ID NO: 1095145 - RNA, 18 nt, Mycobacterium bovis subsp bovis AF2122/97
uggucccggcacgaccac

SEQ ID NO: 1095146 - RNA, 12 nt, Mycobacterium bovis subsp bovis AF2122/97
ugguccagccgg

SEQ ID NO: 1095147 - RNA, 15 nt, Mycobacterium bovis subsp bovis AF2122/97
ugguccagcaccggg

SEQ ID NO: 1095148 - RNA, 16 nt, Mycobacterium bovis subsp bovis AF2122/97
ugguccaagacagccu

SEQ ID NO: 1095149 - RNA, 18 nt, Mycobacterium bovis subsp bovis AF2122/97
uggucagcaccggcgcgg

SEQ ID NO: 1095150 - RNA, 17 nt, Mycobacterium bovis subsp bovis AF2122/97
uggucacggcgucgacu

SEQ ID NO: 1095151 - RNA, 20 nt, Mycobacterium bovis subsp bovis AF2122/97
uggucaccaagacaccggcc

SEQ ID NO: 1095152 - RNA, 13 nt, Mycobacterium bovis subsp bovis AF2122/97
uggucaacggccg

SEQ ID NO: 1095153 - RNA, 22 nt, Mycobacterium bovis subsp bovis AF2122/97
uggucaaugccggccgcggggc

SEQ ID NO: 1095154 - RNA, 11 nt, Mycobacterium bovis subsp bovis AF2122/97
uggucaacacg

SEQ ID NO: 1095155 - RNA, 13 nt, Mycobacterium bovis subsp bovis AF2122/97
uggucaacagcgg

SEQ ID NO: 1095156 - RNA, 15 nt, Mycobacterium bovis subsp bovis AF2122/97
uggucaacggcagau

SEQ ID NO: 1095157 - RNA, 19 nt, Mycobacterium bovis subsp bovis AF2122/97
ugguauccaugucgcgcca

SEQ ID NO: 1095158 - RNA, 16 nt, Mycobacterium bovis subsp bovis AF2122/97
ugguauucaugcccgu

SEQ ID NO: 1095159 - RNA, 13 nt, Mycobacterium bovis subsp bovis AF2122/97
uguauccgcgccg

SEQ ID NO: 1095160 - RNA, 19 nt, Mycobacterium bovis subsp bovis AF2122/97
ugucaaguucgccagcaac

SEQ ID NO: 1095161 - RNA, 16 nt, Mycobacterium bovis subsp bovis AF2122/97
ugucaacgccgcgguc

SEQ ID NO: 1095162 - RNA, 21 nt, Mycobacterium bovis subsp bovis AF2122/97
uguaggccugcccccggcgcg

SEQ ID NO: 1095163 - RNA, 18 nt, Mycobacterium bovis subsp bovis AF2122/97
uguccucggcgaucacgc

SEQ ID NO: 1095164 - RNA, 23 nt, Mycobacterium bovis subsp bovis AF2122/97
uguccugccguauggcaucggcc

SEQ ID NO: 1095165 - RNA, 20 nt, Mycobacterium bovis subsp bovis AF2122/97
uguccuaauucggggccgcg

SEQ ID NO: 1095166 - RNA, 20 nt, Mycobacterium bovis subsp bovis AF2122/97
ugucgaagacguuggcgcgg

SEQ ID NO: 1095167 - RNA, 17 nt, Mycobacterium bovis subsp bovis AF2122/97
ugucgaagauccagcgc

SEQ ID NO: 1095168 - RNA, 21 nt, Mycobacterium bovis subsp bovis AF2122/97
uguccuucagccaguccagcg

SEQ ID NO: 1095169 - RNA, 17 nt, Mycobacterium bovis subsp bovis AF2122/97
uguccguccgcgacacc

SEQ ID NO: 1095170 - RNA, 12 nt, Mycobacterium bovis subsp bovis AF2122/97
ugucgaugccgc

SEQ ID NO: 1095171 - RNA, 16 nt, Mycobacterium bovis subsp bovis AF2122/97
ugucgaugccgcgcag

SEQ ID NO: 1095172 - RNA, 19 nt, Mycobacterium bovis subsp bovis AF2122/97
ugucgaugccgcgcagcgc

SEQ ID NO: 1095173 - RNA, 18 nt, Mycobacterium bovis subsp bovis AF2122/97
ugucgacaaccgcugccg

SEQ ID NO: 1095174 - RNA, 12 nt, Mycobacterium bovis subsp bovis AF2122/97
ugucgacaucga

SEQ ID NO: 1095175 - RNA, 17 nt, Mycobacterium bovis subsp bovis AF2122/97
ugucgaagaaccggccg

SEQ ID NO: 1095176 - RNA, 21 nt, Mycobacterium bovis subsp bovis AF2122/97
ugucgaagccccucaccucgg

SEQ ID NO: 1095177 - RNA, 13 nt, Mycobacterium bovis subsp bovis AF2122/97
ugucgccacaccg

SEQ ID NO: 1095178 - RNA, 22 nt, Mycobacterium bovis subsp bovis AF2122/97
ugucgauggggacggcggcgag

SEQ ID NO: 1095179 - RNA, 16 nt, Mycobacterium bovis subsp bovis AF2122/97
ugucgauuucgaugac

SEQ ID NO: 1095180 - RNA, 16 nt, Mycobacterium bovis subsp bovis AF2122/97
ugucgauuugaucgac

SEQ ID NO: 1095181 - RNA, 18 nt, Mycobacterium bovis subsp bovis AF2122/97
ugucccgcgggccagcac

SEQ ID NO: 1095182 - RNA, 23 nt, Mycobacterium bovis subsp bovis AF2122/97
ugucccggaccaucgccugcaag

SEQ ID NO: 1095183 - RNA, 18 nt, Mycobacterium bovis subsp bovis AF2122/97
ugucccgcaugcacguca

SEQ ID NO: 1095184 - RNA, 17 nt, Mycobacterium bovis subsp bovis AF2122/97
ugucccgaugguggccg

SEQ ID NO: 1095185 - RNA, 14 nt, Mycobacterium bovis subsp bovis AF2122/97
uguccccccgcgca

SEQ ID NO: 1095186 - RNA, 15 nt, Mycobacterium bovis subsp bovis AF2122/97
uguccagguggcgcg

SEQ ID NO: 1095187 - RNA, 16 nt, Mycobacterium bovis subsp bovis AF2122/97
uguccagguggcgcgg

SEQ ID NO: 1095188 - RNA, 18 nt, Mycobacterium bovis subsp bovis AF2122/97
uguccaggcgcgcaccac

SEQ ID NO: 1095189 - RNA, 13 nt, Mycobacterium bovis subsp bovis AF2122/97
ugucacaggcgac

SEQ ID NO: 1095190 - RNA, 15 nt, Mycobacterium bovis subsp bovis AF2122/97
ugucaaugacaccgg

SEQ ID NO: 1095191 - RNA, 14 nt, Mycobacterium bovis subsp bovis AF2122/97
ugucggccagcaac

SEQ ID NO: 1095192 - RNA, 12 nt, Mycobacterium bovis subsp bovis AF2122/97
ugucgggcgcga

SEQ ID NO: 1095193 - RNA, 20 nt, Mycobacterium bovis subsp bovis AF2122/97
ugucgggcuggguggccaac

SEQ ID NO: 1095194 - RNA, 19 nt, Mycobacterium bovis subsp bovis AF2122/97
ugucggcggggcgccggau

SEQ ID NO: 1095195 - RNA, 20 nt, Mycobacterium bovis subsp bovis AF2122/97
ugucggcggugaaaucgcac

SEQ ID NO: 1095196 - RNA, 17 nt, Mycobacterium bovis subsp bovis AF2122/97
ugucggcuggacggcgc

SEQ ID NO: 1095197 - RNA, 16 nt, Mycobacterium bovis subsp bovis AF2122/97
ugucgggaaggugacg

SEQ ID NO: 1095198 - RNA, 17 nt, Mycobacterium bovis subsp bovis AF2122/97
ugucggggugcacaccg

SEQ ID NO: 1095199 - RNA, 19 nt, Mycobacterium bovis subsp bovis AF2122/97
ugucgggguuucaggcggc

SEQ ID NO: 1095200 - RNA, 20 nt, Mycobacterium bovis subsp bovis AF2122/97
ugucgggggcuuuugcgucu

SEQ ID NO: 1095201 - RNA, 17 nt, Mycobacterium bovis subsp bovis AF2122/97
ugucgucgccggcggcg

SEQ ID NO: 1095202 - RNA, 23 nt, Mycobacterium bovis subsp bovis AF2122/97
ugucgucgccggcggcggugcgc

SEQ ID NO: 1095203 - RNA, 20 nt, Mycobacterium bovis subsp bovis AF2122/97
ugucguaacugcccgcggcg

SEQ ID NO: 1095204 - RNA, 13 nt, Mycobacterium bovis subsp bovis AF2122/97
ugucgucaccgug

SEQ ID NO: 1095205 - RNA, 19 nt, Mycobacterium bovis subsp bovis AF2122/97
ugucggugguaccggcggc

SEQ ID NO: 1095206 - RNA, 21 nt, Mycobacterium bovis subsp bovis AF2122/97
ugucgguguacagucgcgcgc

SEQ ID NO: 1095207 - RNA, 16 nt, Mycobacterium bovis subsp bovis AF2122/97
ugucggugucggugac

SEQ ID NO: 1095208 - RNA, 19 nt, Mycobacterium bovis subsp bovis AF2122/97
ugucggugcguccggugcu

SEQ ID NO: 1095209 - RNA, 20 nt, Mycobacterium bovis subsp bovis AF2122/97
ugucgguggccgcggcgguc

SEQ ID NO: 1095210 - RNA, 14 nt, Mycobacterium bovis subsp bovis AF2122/97
ugucguaggccgca

SEQ ID NO: 1095211 - RNA, 16 nt, Mycobacterium bovis subsp bovis AF2122/97
ugucguaccgcggauc

SEQ ID NO: 1095212 - RNA, 14 nt, Mycobacterium bovis subsp bovis AF2122/97
ugucgccgcguccu

SEQ ID NO: 1095213 - RNA, 14 nt, Mycobacterium bovis subsp bovis AF2122/97
ugucgccgcucggu

SEQ ID NO: 1095214 - RNA, 21 nt, Mycobacterium bovis subsp bovis AF2122/97
ugucgccgauaucggugaccg

SEQ ID NO: 1095215 - RNA, 20 nt, Mycobacterium bovis subsp bovis AF2122/97
ugucgcccucgaucgccacg

SEQ ID NO: 1095216 - RNA, 17 nt, Mycobacterium bovis subsp bovis AF2122/97
ugucgccgaucaccgca

SEQ ID NO: 1095217 - RNA, 13 nt, Mycobacterium bovis subsp bovis AF2122/97
ugucggcgcaggc

SEQ ID NO: 1095218 - RNA, 13 nt, Mycobacterium bovis subsp bovis AF2122/97
ugucggcgcgccg

SEQ ID NO: 1095219 - RNA, 21 nt, Mycobacterium bovis subsp bovis AF2122/97
ugucggcgaaccacggcagcc

SEQ ID NO: 1095220 - RNA, 20 nt, Mycobacterium bovis subsp bovis AF2122/97
ugucggcgaucaacgcgcac

SEQ ID NO: 1095221 - RNA, 22 nt, Mycobacterium bovis subsp bovis AF2122/97
ugucggcgaucaacgcgcacgc

SEQ ID NO: 1095222 - RNA, 10 nt, Mycobacterium bovis subsp bovis AF2122/97
ugucggcgau

SEQ ID NO: 1095223 - RNA, 18 nt, Mycobacterium bovis subsp bovis AF2122/97
ugucggccggggccaccc

SEQ ID NO: 1095224 - RNA, 21 nt, Mycobacterium bovis subsp bovis AF2122/97
ugucggccggggccacccgca

SEQ ID NO: 1095225 - RNA, 21 nt, Mycobacterium bovis subsp bovis AF2122/97
ugucggccgccuucuccggcg

SEQ ID NO: 1095226 - RNA, 11 nt, Mycobacterium bovis subsp bovis AF2122/97
ugucggccgcg

SEQ ID NO: 1095227 - RNA, 13 nt, Mycobacterium bovis subsp bovis AF2122/97
ugucggccccggc

SEQ ID NO: 1095228 - RNA, 17 nt, Mycobacterium bovis subsp bovis AF2122/97
ugucggccccggccgcg

SEQ ID NO: 1095229 - RNA, 23 nt, Mycobacterium bovis subsp bovis AF2122/97
ugucggauagccucggcggcgcc

SEQ ID NO: 1095230 - RNA, 21 nt, Mycobacterium bovis subsp bovis AF2122/97
ugucggcagguaccaccgcgg

SEQ ID NO: 1095231 - RNA, 17 nt, Mycobacterium bovis subsp bovis AF2122/97
ugucguugccgucggcg

SEQ ID NO: 1095232 - RNA, 18 nt, Mycobacterium bovis subsp bovis AF2122/97
ugucguuguacggggccg

SEQ ID NO: 1095233 - RNA, 19 nt, Mycobacterium bovis subsp bovis AF2122/97
ugucgugauacagcucggu

SEQ ID NO: 1095234 - RNA, 17 nt, Mycobacterium bovis subsp bovis AF2122/97
ugucgugcgggcgcacc

SEQ ID NO: 1095235 - RNA, 17 nt, Mycobacterium bovis subsp bovis AF2122/97
ugucgucuuggcgaucg

SEQ ID NO: 1095236 - RNA, 17 nt, Mycobacterium bovis subsp bovis AF2122/97
ugucucgggcgcgggug

SEQ ID NO: 1095237 - RNA, 21 nt, Mycobacterium bovis subsp bovis AF2122/97
ugucucgggcgcgggugacca

SEQ ID NO: 1095238 - RNA, 23 nt, Mycobacterium bovis subsp bovis AF2122/97
ugucugccaugugucccggacca

SEQ ID NO: 1095239 - RNA, 15 nt, Mycobacterium bovis subsp bovis AF2122/97
ugucugcucgccgag

SEQ ID NO: 1095240 - RNA, 23 nt, Mycobacterium bovis subsp bovis AF2122/97
ugucugcucggcgagcgucgggc

SEQ ID NO: 1095241 - RNA, 17 nt, Mycobacterium bovis subsp bovis AF2122/97
ugucuggucauggccga

SEQ ID NO: 1095242 - RNA, 19 nt, Mycobacterium bovis subsp bovis AF2122/97
ugucuguacaacgacacgc

SEQ ID NO: 1095243 - RNA, 14 nt, Mycobacterium bovis subsp bovis AF2122/97
ugugcccgccggcc

SEQ ID NO: 1095244 - RNA, 24 nt, Mycobacterium bovis subsp bovis AF2122/97
ugugcccggcgcgaagucguuguu

SEQ ID NO: 1095245 - RNA, 20 nt, Mycobacterium bovis subsp bovis AF2122/97
ugugcccggcuccuccccgg

SEQ ID NO: 1095246 - RNA, 11 nt, Mycobacterium bovis subsp bovis AF2122/97
ugugccgccgg

SEQ ID NO: 1095247 - RNA, 15 nt, Mycobacterium bovis subsp bovis AF2122/97
ugugaacaggccgag

SEQ ID NO: 1095248 - RNA, 19 nt, Mycobacterium bovis subsp bovis AF2122/97
ugugccgggcgaugcuggg

SEQ ID NO: 1095249 - RNA, 16 nt, Mycobacterium bovis subsp bovis AF2122/97
ugugccggucgaugac

SEQ ID NO: 1095250 - RNA, 19 nt, Mycobacterium bovis subsp bovis AF2122/97
ugugcgagcugcgggucgc

SEQ ID NO: 1095251 - RNA, 14 nt, Mycobacterium bovis subsp bovis AF2122/97
ugugcggcguacuc

SEQ ID NO: 1095252 - RNA, 21 nt, Mycobacterium bovis subsp bovis AF2122/97
ugugcggacaguucccggcca

SEQ ID NO: 1095253 - RNA, 16 nt, Mycobacterium bovis subsp bovis AF2122/97
ugucuugccaccacgc

SEQ ID NO: 1095254 - RNA, 14 nt, Mycobacterium bovis subsp bovis AF2122/97
ugugaacagcgcgu

SEQ ID NO: 1095255 - RNA, 18 nt, Mycobacterium bovis subsp bovis AF2122/97
ugugaacagcgcgucgga

SEQ ID NO: 1095256 - RNA, 19 nt, Mycobacterium bovis subsp bovis AF2122/97
ugugccagcagcagcgccg

SEQ ID NO: 1095257 - RNA, 18 nt, Mycobacterium bovis subsp bovis AF2122/97
ugugcccaugaugcucga

SEQ ID NO: 1095258 - RNA, 21 nt, Mycobacterium bovis subsp bovis AF2122/97
uucagccaguccagcgcgcca

SEQ ID NO: 1095259 - RNA, 14 nt, Mycobacterium bovis subsp bovis AF2122/97
uucagcgcggcacg

SEQ ID NO: 1095260 - RNA, 19 nt, Mycobacterium bovis subsp bovis AF2122/97
uucaucgcuauggaugggg

SEQ ID NO: 1095261 - RNA, 21 nt, Mycobacterium bovis subsp bovis AF2122/97
uucaucucgccuucggggugc

SEQ ID NO: 1095262 - RNA, 21 nt, Mycobacterium bovis subsp bovis AF2122/97
uucccaggaacgggacgccgu

SEQ ID NO: 1095263 - RNA, 15 nt, Mycobacterium bovis subsp bovis AF2122/97
uucccaggcccgaca

SEQ ID NO: 1095264 - RNA, 17 nt, Mycobacterium bovis subsp bovis AF2122/97
uucccacccacgccgac

SEQ ID NO: 1095265 - RNA, 15 nt, Mycobacterium bovis subsp bovis AF2122/97
uucccaaccgcccgu

SEQ ID NO: 1095266 - RNA, 16 nt, Mycobacterium bovis subsp bovis AF2122/97
uuccaacucggcggcc

SEQ ID NO: 1095267 - RNA, 13 nt, Mycobacterium bovis subsp bovis AF2122/97
uucauguggcgcg

SEQ ID NO: 1095268 - RNA, 20 nt, Mycobacterium bovis subsp bovis AF2122/97
uucaagguguucuggcaacc

SEQ ID NO: 1095269 - RNA, 21 nt, Mycobacterium bovis subsp bovis AF2122/97
uucaccgacgcgaacgcggcc

SEQ ID NO: 1095270 - RNA, 19 nt, Mycobacterium bovis subsp bovis AF2122/97
uucagcacgugggccaacg

SEQ ID NO: 1095271 - RNA, 22 nt, Mycobacterium bovis subsp bovis AF2122/97
uucacgccgccccugcgcggcc

SEQ ID NO: 1095272 - RNA, 14 nt, Mycobacterium bovis subsp bovis AF2122/97
uucacgacgccgag

SEQ ID NO: 1095273 - RNA, 14 nt, Mycobacterium bovis subsp bovis AF2122/97
uucaccucggcgac

SEQ ID NO: 1095274 - RNA, 23 nt, Mycobacterium bovis subsp bovis AF2122/97
uucaaagaggauccgcugcggcc

SEQ ID NO: 1095275 - RNA, 19 nt, Mycobacterium bovis subsp bovis AF2122/97
ugugcucggugacguagac

SEQ ID NO: 1095276 - RNA, 16 nt, Mycobacterium bovis subsp bovis AF2122/97
ugugcucgccgauuug

SEQ ID NO: 1095277 - RNA, 14 nt, Mycobacterium bovis subsp bovis AF2122/97
ugugcugcacggcc

SEQ ID NO: 1095278 - RNA, 12 nt, Mycobacterium bovis subsp bovis AF2122/97
ugugcugccgca

SEQ ID NO: 1095279 - RNA, 14 nt, Mycobacterium bovis subsp bovis AF2122/97
ugugcucgauaucg

SEQ ID NO: 1095280 - RNA, 13 nt, Mycobacterium bovis subsp bovis AF2122/97
ugugcucgccgac

SEQ ID NO: 1095281 - RNA, 16 nt, Mycobacterium bovis subsp bovis AF2122/97
ugugcucacggcggcg

SEQ ID NO: 1095282 - RNA, 16 nt, Mycobacterium bovis subsp bovis AF2122/97
ugugcgucugcggcgg

SEQ ID NO: 1095283 - RNA, 13 nt, Mycobacterium bovis subsp bovis AF2122/97
ugugcggugaccg

SEQ ID NO: 1095284 - RNA, 20 nt, Mycobacterium bovis subsp bovis AF2122/97
uguggccccaagcgugcugc

SEQ ID NO: 1095285 - RNA, 19 nt, Mycobacterium bovis subsp bovis AF2122/97
uguggcccaacaccgccag

SEQ ID NO: 1095286 - RNA, 12 nt, Mycobacterium bovis subsp bovis AF2122/97
uguuggugaccg

SEQ ID NO: 1095287 - RNA, 21 nt, Mycobacterium bovis subsp bovis AF2122/97
uguuggugaccgggucgauca

SEQ ID NO: 1095288 - RNA, 20 nt, Mycobacterium bovis subsp bovis AF2122/97
uguggccguugacggugucu

SEQ ID NO: 1095289 - RNA, 11 nt, Mycobacterium bovis subsp bovis AF2122/97
uguggcgauga

SEQ ID NO: 1095290 - RNA, 19 nt, Mycobacterium bovis subsp bovis AF2122/97
uguggagcucgcggcgcag

SEQ ID NO: 1095291 - RNA, 18 nt, Mycobacterium bovis subsp bovis AF2122/97
uguggaaccacggcgcag

SEQ ID NO: 1095292 - RNA, 14 nt, Mycobacterium bovis subsp bovis AF2122/97
uguggaaccauccc

SEQ ID NO: 1095293 - RNA, 18 nt, Mycobacterium bovis subsp bovis AF2122/97
uguggaauggaccagcgc

SEQ ID NO: 1095294 - RNA, 14 nt, Mycobacterium bovis subsp bovis AF2122/97
uguggacacggcgc

SEQ ID NO: 1095295 - RNA, 15 nt, Mycobacterium bovis subsp bovis AF2122/97
uguuguugccccggu

SEQ ID NO: 1095296 - RNA, 20 nt, Mycobacterium bovis subsp bovis AF2122/97
uguugucgcauuucgacgag

SEQ ID NO: 1095297 - RNA, 21 nt, Mycobacterium bovis subsp bovis AF2122/97
uguugguggccgggucgauca

SEQ ID NO: 1095298 - RNA, 22 nt, Mycobacterium bovis subsp bovis AF2122/97
uguuuuugcgggugguccagcc

SEQ ID NO: 1095299 - RNA, 18 nt, Mycobacterium bovis subsp bovis AF2122/97
uguuuuuguauguucggc

SEQ ID NO: 1095300 - RNA, 22 nt, Mycobacterium bovis subsp bovis AF2122/97
uuacgccgcgagagccggcggc

SEQ ID NO: 1095301 - RNA, 13 nt, Mycobacterium bovis subsp bovis AF2122/97
uuacgcgacgccg

SEQ ID NO: 1095302 - RNA, 15 nt, Mycobacterium bovis subsp bovis AF2122/97
uuacguacagggugg

SEQ ID NO: 1095303 - RNA, 20 nt, Mycobacterium bovis subsp bovis AF2122/97
uuaccggcacgccggcggcg

SEQ ID NO: 1095304 - RNA, 15 nt, Mycobacterium bovis subsp bovis AF2122/97
uuagcccgauggugc

SEQ ID NO: 1095305 - RNA, 14 nt, Mycobacterium bovis subsp bovis AF2122/97
uuagccggguuggc

SEQ ID NO: 1095306 - RNA, 18 nt, Mycobacterium bovis subsp bovis AF2122/97
uuagccacaaucgcagau

SEQ ID NO: 1095307 - RNA, 20 nt, Mycobacterium bovis subsp bovis AF2122/97
uuagugggcuuuugcgucug

SEQ ID NO: 1095308 - RNA, 17 nt, Mycobacterium bovis subsp bovis AF2122/97
uucugcgcccacccgcg

SEQ ID NO: 1095309 - RNA, 24 nt, Mycobacterium bovis subsp bovis AF2122/97
uucuguuccagaaggccgcaccgc

SEQ ID NO: 1095310 - RNA, 19 nt, Mycobacterium bovis subsp bovis AF2122/97
uucugugucugcucggcga

SEQ ID NO: 1095311 - RNA, 20 nt, Mycobacterium bovis subsp bovis AF2122/97
uucuccccgcuagcccacca

SEQ ID NO: 1095312 - RNA, 21 nt, Mycobacterium bovis subsp bovis AF2122/97
uucuccucgucgcgggcgaug

SEQ ID NO: 1095313 - RNA, 14 nt, Mycobacterium bovis subsp bovis AF2122/97
uucuccugaguugc

SEQ ID NO: 1095314 - RNA, 15 nt, Mycobacterium bovis subsp bovis AF2122/97
uucuccaccagcgug

SEQ ID NO: 1095315 - RNA, 13 nt, Mycobacterium bovis subsp bovis AF2122/97
uucucgccgccgc

SEQ ID NO: 1095316 - RNA, 20 nt, Mycobacterium bovis subsp bovis AF2122/97
uucugccuuaccaaccggga

SEQ ID NO: 1095317 - RNA, 15 nt, Mycobacterium bovis subsp bovis AF2122/97
uucucggccggcggc

SEQ ID NO: 1095318 - RNA, 19 nt, Mycobacterium bovis subsp bovis AF2122/97
uucggcgagccgcgcccaa

SEQ ID NO: 1095319 - RNA, 12 nt, Mycobacterium bovis subsp bovis AF2122/97
uucggcgagcgc

SEQ ID NO: 1095320 - RNA, 13 nt, Mycobacterium bovis subsp bovis AF2122/97
uucggcgaccggc

SEQ ID NO: 1095321 - RNA, 17 nt, Mycobacterium bovis subsp bovis AF2122/97
uucggcgcugaucgcgc

SEQ ID NO: 1095322 - RNA, 15 nt, Mycobacterium bovis subsp bovis AF2122/97
uucggcggccgccgc

SEQ ID NO: 1095323 - RNA, 19 nt, Mycobacterium bovis subsp bovis AF2122/97
uucggcgccggcgucggcg

SEQ ID NO: 1095324 - RNA, 18 nt, Mycobacterium bovis subsp bovis AF2122/97
uucggcgccucguugccg

SEQ ID NO: 1095325 - RNA, 20 nt, Mycobacterium bovis subsp bovis AF2122/97
uucggcggcauguucaucgc

SEQ ID NO: 1095326 - RNA, 14 nt, Mycobacterium bovis subsp bovis AF2122/97
uucggccagcgugu

SEQ ID NO: 1095327 - RNA, 12 nt, Mycobacterium bovis subsp bovis AF2122/97
uucggccagcgc

SEQ ID NO: 1095328 - RNA, 16 nt, Mycobacterium bovis subsp bovis AF2122/97
uucggccagcgcccgc

SEQ ID NO: 1095329 - RNA, 22 nt, Mycobacterium bovis subsp bovis AF2122/97
uucggcccgaggugccggggcc

SEQ ID NO: 1095330 - RNA, 18 nt, Mycobacterium bovis subsp bovis AF2122/97
uucggcgaaguugcgcga

SEQ ID NO: 1095331 - RNA, 14 nt, Mycobacterium bovis subsp bovis AF2122/97
uucggcccgguggu

SEQ ID NO: 1095332 - RNA, 19 nt, Mycobacterium bovis subsp bovis AF2122/97
uucggccggagccgccggc

SEQ ID NO: 1095333 - RNA, 17 nt, Mycobacterium bovis subsp bovis AF2122/97
uucggcccgaggugccg

SEQ ID NO: 1095334 - RNA, 19 nt, Mycobacterium bovis subsp bovis AF2122/97
uucggugagcaacgcgacc

SEQ ID NO: 1095335 - RNA, 19 nt, Mycobacterium bovis subsp bovis AF2122/97
uucgguggggucgcugccg

SEQ ID NO: 1095336 - RNA, 20 nt, Mycobacterium bovis subsp bovis AF2122/97
uucggugccgugaucggcgc

SEQ ID NO: 1095337 - RNA, 14 nt, Mycobacterium bovis subsp bovis AF2122/97
uucggggaccacgc

SEQ ID NO: 1095338 - RNA, 13 nt, Mycobacterium bovis subsp bovis AF2122/97
uucggcggucgcu

SEQ ID NO: 1095339 - RNA, 14 nt, Mycobacterium bovis subsp bovis AF2122/97
uucggcgucaccgu

SEQ ID NO: 1095340 - RNA, 18 nt, Mycobacterium bovis subsp bovis AF2122/97
uucggcggccgugucggg

SEQ ID NO: 1095341 - RNA, 22 nt, Mycobacterium bovis subsp bovis AF2122/97
uucggcggccgugucgggcgcg

SEQ ID NO: 1095342 - RNA, 16 nt, Mycobacterium bovis subsp bovis AF2122/97
uucggcgucguugccg

SEQ ID NO: 1095343 - RNA, 17 nt, Mycobacterium bovis subsp bovis AF2122/97
uucggcuggcgugcugc

SEQ ID NO: 1095344 - RNA, 17 nt, Mycobacterium bovis subsp bovis AF2122/97
uucgggcagcacccgcg

SEQ ID NO: 1095345 - RNA, 18 nt, Mycobacterium bovis subsp bovis AF2122/97
uucguggcuggcaugccg

SEQ ID NO: 1095346 - RNA, 20 nt, Mycobacterium bovis subsp bovis AF2122/97
uucgucgacacccgcacgaa

SEQ ID NO: 1095347 - RNA, 18 nt, Mycobacterium bovis subsp bovis AF2122/97
uucgucgaccgcgccaua

SEQ ID NO: 1095348 - RNA, 19 nt, Mycobacterium bovis subsp bovis AF2122/97
uucgucgggacgccgcccc

SEQ ID NO: 1095349 - RNA, 20 nt, Mycobacterium bovis subsp bovis AF2122/97
uucgucggagaacgcccgca

SEQ ID NO: 1095350 - RNA, 15 nt, Mycobacterium bovis subsp bovis AF2122/97
uucgucgucgcagug

SEQ ID NO: 1095351 - RNA, 22 nt, Mycobacterium bovis subsp bovis AF2122/97
uucgugcagcccaaggcgacga

SEQ ID NO: 1095352 - RNA, 23 nt, Mycobacterium bovis subsp bovis AF2122/97
uucgugcaccacauuggcgauca

SEQ ID NO: 1095353 - RNA, 16 nt, Mycobacterium bovis subsp bovis AF2122/97
uucgguuagcgcggcc

SEQ ID NO: 1095354 - RNA, 19 nt, Mycobacterium bovis subsp bovis AF2122/97
uucguccaccgcgaugccc

SEQ ID NO: 1095355 - RNA, 21 nt, Mycobacterium bovis subsp bovis AF2122/97
uucgucaccacgaucgcagug

SEQ ID NO: 1095356 - RNA, 22 nt, Mycobacterium bovis subsp bovis AF2122/97
uucggacucacucgguguuucg

SEQ ID NO: 1095357 - RNA, 14 nt, Mycobacterium bovis subsp bovis AF2122/97
uucggacucgccga

SEQ ID NO: 1095358 - RNA, 12 nt, Mycobacterium bovis subsp bovis AF2122/97
uucggaugccgc

SEQ ID NO: 1095359 - RNA, 14 nt, Mycobacterium bovis subsp bovis AF2122/97
uucggaggugaccu

SEQ ID NO: 1095360 - RNA, 17 nt, Mycobacterium bovis subsp bovis AF2122/97
uucggcagcgcggcacc

SEQ ID NO: 1095361 - RNA, 16 nt, Mycobacterium bovis subsp bovis AF2122/97
uucggcaccaccgcga

SEQ ID NO: 1095362 - RNA, 22 nt, Mycobacterium bovis subsp bovis AF2122/97
uucgcgcgccgcgacgaugccu

SEQ ID NO: 1095363 - RNA, 20 nt, Mycobacterium bovis subsp bovis AF2122/97
uucgcgccacgcacccggca

SEQ ID NO: 1095364 - RNA, 15 nt, Mycobacterium bovis subsp bovis AF2122/97
uucgcgggugcgcug

SEQ ID NO: 1095365 - RNA, 15 nt, Mycobacterium bovis subsp bovis AF2122/97
uucgcucgcaccgcc

SEQ ID NO: 1095366 - RNA, 14 nt, Mycobacterium bovis subsp bovis AF2122/97
uucgcucagggugu

SEQ ID NO: 1095367 - RNA, 21 nt, Mycobacterium bovis subsp bovis AF2122/97
uucgcgauguccucgagcacc

SEQ ID NO: 1095368 - RNA, 19 nt, Mycobacterium bovis subsp bovis AF2122/97
uucgcgacgucugccaggc

SEQ ID NO: 1095369 - RNA, 14 nt, Mycobacterium bovis subsp bovis AF2122/97
uucgcgcacgucgg

SEQ ID NO: 1095370 - RNA, 16 nt, Mycobacterium bovis subsp bovis AF2122/97
uucgccgucggcgacu

SEQ ID NO: 1095371 - RNA, 18 nt, Mycobacterium bovis subsp bovis AF2122/97
uucgcgacaacucgcgaa

SEQ ID NO: 1095372 - RNA, 18 nt, Mycobacterium bovis subsp bovis AF2122/97
uucgccgggcaacgcgaa

SEQ ID NO: 1095373 - RNA, 16 nt, Mycobacterium bovis subsp bovis AF2122/97
uucgccgcgcagcgug

SEQ ID NO: 1095374 - RNA, 18 nt, Mycobacterium bovis subsp bovis AF2122/97
uucgccgauaucgcagau

SEQ ID NO: 1095375 - RNA, 22 nt, Mycobacterium bovis subsp bovis AF2122/97
uucgccccugcacagcaggcuc

SEQ ID NO: 1095376 - RNA, 13 nt, Mycobacterium bovis subsp bovis AF2122/97
uucgccgaagccg

SEQ ID NO: 1095377 - RNA, 15 nt, Mycobacterium bovis subsp bovis AF2122/97
uucgcccacaugccg

SEQ ID NO: 1095378 - RNA, 13 nt, Mycobacterium bovis subsp bovis AF2122/97
uucgcccgcccgu

SEQ ID NO: 1095379 - RNA, 22 nt, Mycobacterium bovis subsp bovis AF2122/97
uucgcacaccuccucgaccgug

SEQ ID NO: 1095380 - RNA, 14 nt, Mycobacterium bovis subsp bovis AF2122/97
uucgcagccgcacc

SEQ ID NO: 1095381 - RNA, 15 nt, Mycobacterium bovis subsp bovis AF2122/97
uucgccagguggccg

SEQ ID NO: 1095382 - RNA, 19 nt, Mycobacterium bovis subsp bovis AF2122/97
uucgcaguugaggguguga

SEQ ID NO: 1095383 - RNA, 20 nt, Mycobacterium bovis subsp bovis AF2122/97
uucgcauuggggacgcccga

SEQ ID NO: 1095384 - RNA, 15 nt, Mycobacterium bovis subsp bovis AF2122/97
uuccucgucaccgcg

SEQ ID NO: 1095385 - RNA, 13 nt, Mycobacterium bovis subsp bovis AF2122/97
uucccuggccgcc

SEQ ID NO: 1095386 - RNA, 23 nt, Mycobacterium bovis subsp bovis AF2122/97
uuccgaagagugugacggcggcc

SEQ ID NO: 1095387 - RNA, 23 nt, Mycobacterium bovis subsp bovis AF2122/97
uuccgaaacccgccgcgaugacg

SEQ ID NO: 1095388 - RNA, 15 nt, Mycobacterium bovis subsp bovis AF2122/97
uucccuacgccgcca

SEQ ID NO: 1095389 - RNA, 12 nt, Mycobacterium bovis subsp bovis AF2122/97
uucccgucggcg

SEQ ID NO: 1095390 - RNA, 22 nt, Mycobacterium bovis subsp bovis AF2122/97
uucccguugcugagcguaggcc

SEQ ID NO: 1095391 - RNA, 16 nt, Mycobacterium bovis subsp bovis AF2122/97
uuccgacgaacccgac

SEQ ID NO: 1095392 - RNA, 16 nt, Mycobacterium bovis subsp bovis AF2122/97
uuccgauagccgacca

SEQ ID NO: 1095393 - RNA, 17 nt, Mycobacterium bovis subsp bovis AF2122/97
uuccgcaucggccccca

SEQ ID NO: 1095394 - RNA, 20 nt, Mycobacterium bovis subsp bovis AF2122/97
uucgaccuugcaccggccga

SEQ ID NO: 1095395 - RNA, 11 nt, Mycobacterium bovis subsp bovis AF2122/97
uucgacgacac

SEQ ID NO: 1095396 - RNA, 21 nt, Mycobacterium bovis subsp bovis AF2122/97
uucgacgacacguugaccgug

SEQ ID NO: 1095397 - RNA, 17 nt, Mycobacterium bovis subsp bovis AF2122/97
uucgaccaccacccgga

SEQ ID NO: 1095398 - RNA, 14 nt, Mycobacterium bovis subsp bovis AF2122/97
uucgaccagcccgc

SEQ ID NO: 1095399 - RNA, 13 nt, Mycobacterium bovis subsp bovis AF2122/97
uucgacagcgcgc

SEQ ID NO: 1095400 - RNA, 17 nt, Mycobacterium bovis subsp bovis AF2122/97
uucgacaggccaccgca

SEQ ID NO: 1095401 - RNA, 19 nt, Mycobacterium bovis subsp bovis AF2122/97
uucgacaucacucgcgcca

SEQ ID NO: 1095402 - RNA, 21 nt, Mycobacterium bovis subsp bovis AF2122/97
uucgaagcgaucgccggccgc

SEQ ID NO: 1095403 - RNA, 17 nt, Mycobacterium bovis subsp bovis AF2122/97
uucgaacuggcuggugg

SEQ ID NO: 1095404 - RNA, 19 nt, Mycobacterium bovis subsp bovis AF2122/97
uucgaaagcaccgaugcug

SEQ ID NO: 1095405 - RNA, 20 nt, Mycobacterium bovis subsp bovis AF2122/97
uucgaucccguccgcgccca

SEQ ID NO: 1095406 - RNA, 17 nt, Mycobacterium bovis subsp bovis AF2122/97
uucgaucgcggcaauga

SEQ ID NO: 1095407 - RNA, 20 nt, Mycobacterium bovis subsp bovis AF2122/97
uucgaugucguaccgggcga

SEQ ID NO: 1095408 - RNA, 22 nt, Mycobacterium bovis subsp bovis AF2122/97
uucgauauagccgccggugccg

SEQ ID NO: 1095409 - RNA, 15 nt, Mycobacterium bovis subsp bovis AF2122/97
uucgagcgcgccuuc

SEQ ID NO: 1095410 - RNA, 15 nt, Mycobacterium bovis subsp bovis AF2122/97
uucgagcugccaggc

SEQ ID NO: 1095411 - RNA, 19 nt, Mycobacterium bovis subsp bovis AF2122/97
uucgaggaacacgaugccc

SEQ ID NO: 1095412 - RNA, 16 nt, Mycobacterium bovis subsp bovis AF2122/97
uucgacgucguugccg

SEQ ID NO: 1095413 - RNA, 14 nt, Mycobacterium bovis subsp bovis AF2122/97
uucgagggugaccc

SEQ ID NO: 1095414 - RNA, 20 nt, Mycobacterium bovis subsp bovis AF2122/97
uucgacguaaugcgcugccg

SEQ ID NO: 1095415 - RNA, 23 nt, Mycobacterium bovis subsp bovis AF2122/97
uucgagcaacugcucgacgaggc

SEQ ID NO: 1095416 - RNA, 13 nt, Mycobacterium bovis subsp bovis AF2122/97
uucgagcaccgac

SEQ ID NO: 1095417 - RNA, 16 nt, Mycobacterium bovis subsp bovis AF2122/97
guugacuaccaccgcg

SEQ ID NO: 1095418 - RNA, 19 nt, Mycobacterium bovis subsp bovis AF2122/97
guugacgucgagcagcgcc

SEQ ID NO: 1095419 - RNA, 13 nt, Mycobacterium bovis subsp bovis AF2122/97
guugacgucgaug

SEQ ID NO: 1095420 - RNA, 20 nt, Mycobacterium bovis subsp bovis AF2122/97
guugacgguugccccggcga

SEQ ID NO: 1095421 - RNA, 21 nt, Mycobacterium bovis subsp bovis AF2122/97
guugacgguugccccggcgac

SEQ ID NO: 1095422 - RNA, 14 nt, Mycobacterium bovis subsp bovis AF2122/97
guugacguccaaca

SEQ ID NO: 1095423 - RNA, 17 nt, Mycobacterium bovis subsp bovis AF2122/97
guugacucugcguccac

SEQ ID NO: 1095424 - RNA, 21 nt, Mycobacterium bovis subsp bovis AF2122/97
guugacucugcguccaccacg

SEQ ID NO: 1095425 - RNA, 23 nt, Mycobacterium bovis subsp bovis AF2122/97
guugacucugcguccaccggacg

SEQ ID NO: 1095426 - RNA, 16 nt, Mycobacterium bovis subsp bovis AF2122/97
guugacuggccgcccg

SEQ ID NO: 1095427 - RNA, 20 nt, Mycobacterium bovis subsp bovis AF2122/97
guugacuggccgcccggcga

SEQ ID NO: 1095428 - RNA, 20 nt, Mycobacterium bovis subsp bovis AF2122/97
guugagcaucgauucgaugu

SEQ ID NO: 1095429 - RNA, 16 nt, Mycobacterium bovis subsp bovis AF2122/97
guugagcaugucgucg

SEQ ID NO: 1095430 - RNA, 13 nt, Mycobacterium bovis subsp bovis AF2122/97
guugagcagcacc

SEQ ID NO: 1095431 - RNA, 17 nt, Mycobacterium bovis subsp bovis AF2122/97
guugagcugucgcaacg

SEQ ID NO: 1095432 - RNA, 13 nt, Mycobacterium bovis subsp bovis AF2122/97
guugagccgccgc

SEQ ID NO: 1095433 - RNA, 18 nt, Mycobacterium bovis subsp bovis AF2122/97
guugacgccgguccccgc

SEQ ID NO: 1095434 - RNA, 14 nt, Mycobacterium bovis subsp bovis AF2122/97
guugaccaccagcg

SEQ ID NO: 1095435 - RNA, 14 nt, Mycobacterium bovis subsp bovis AF2122/97
guugaagucgccgg

SEQ ID NO: 1095436 - RNA, 14 nt, Mycobacterium bovis subsp bovis AF2122/97
guugaacgccgcca

SEQ ID NO: 1095437 - RNA, 17 nt, Mycobacterium bovis subsp bovis AF2122/97
guugacacaacgacgaa

SEQ ID NO: 1095438 - RNA, 16 nt, Mycobacterium bovis subsp bovis AF2122/97
guucugcaccagcucg

SEQ ID NO: 1095439 - RNA, 20 nt, Mycobacterium bovis subsp bovis AF2122/97
guugaaaacgcccggcacac

SEQ ID NO: 1095440 - RNA, 22 nt, Mycobacterium bovis subsp bovis AF2122/97
guugaacucgaguugcucgaca

SEQ ID NO: 1095441 - RNA, 17 nt, Mycobacterium bovis subsp bovis AF2122/97
guugaacggcaccagcg

SEQ ID NO: 1095442 - RNA, 21 nt, Mycobacterium bovis subsp bovis AF2122/97
guugaacccuuccccgucggg

SEQ ID NO: 1095443 - RNA, 12 nt, Mycobacterium bovis subsp bovis AF2122/97
guugaaccggua

SEQ ID NO: 1095444 - RNA, 22 nt, Mycobacterium bovis subsp bovis AF2122/97
guggugauccagccgucggcgc

SEQ ID NO: 1095445 - RNA, 14 nt, Mycobacterium bovis subsp bovis AF2122/97
guucgucgacaccc

SEQ ID NO: 1095446 - RNA, 19 nt, Mycobacterium bovis subsp bovis AF2122/97
guucgucgacgucggcgag

SEQ ID NO: 1095447 - RNA, 18 nt, Mycobacterium bovis subsp bovis AF2122/97
guucgucgggacgccgcc

SEQ ID NO: 1095448 - RNA, 14 nt, Mycobacterium bovis subsp bovis AF2122/97
guucgucgggcaug

SEQ ID NO: 1095449 - RNA, 16 nt, Mycobacterium bovis subsp bovis AF2122/97
guggugaccgacgcgg

SEQ ID NO: 1095450 - RNA, 19 nt, Mycobacterium bovis subsp bovis AF2122/97
guggugagugcgucucggu

SEQ ID NO: 1095451 - RNA, 15 nt, Mycobacterium bovis subsp bovis AF2122/97
guggucuuggccggu

SEQ ID NO: 1095452 - RNA, 17 nt, Mycobacterium bovis subsp bovis AF2122/97
guggucuuggcgguggc

SEQ ID NO: 1095453 - RNA, 21 nt, Mycobacterium bovis subsp bovis AF2122/97
guggugaaaccccagccccga

SEQ ID NO: 1095454 - RNA, 19 nt, Mycobacterium bovis subsp bovis AF2122/97
guggugaaguagucggcgc

SEQ ID NO: 1095455 - RNA, 13 nt, Mycobacterium bovis subsp bovis AF2122/97
guggugaagucgg

SEQ ID NO: 1095456 - RNA, 15 nt, Mycobacterium bovis subsp bovis AF2122/97
guggucucggucagc

SEQ ID NO: 1095457 - RNA, 16 nt, Mycobacterium bovis subsp bovis AF2122/97
guggucucggucagcc

SEQ ID NO: 1095458 - RNA, 21 nt, Mycobacterium bovis subsp bovis AF2122/97
guggucucgacggcgccgccc

SEQ ID NO: 1095459 - RNA, 17 nt, Mycobacterium bovis subsp bovis AF2122/97
guggucuccggcaccga

SEQ ID NO: 1095460 - RNA, 22 nt, Mycobacterium bovis subsp bovis AF2122/97
guggucugccaaaagggcggca

SEQ ID NO: 1095461 - RNA, 14 nt, Mycobacterium bovis subsp bovis AF2122/97
guggucugcgcggu

SEQ ID NO: 1095462 - RNA, 19 nt, Mycobacterium bovis subsp bovis AF2122/97
guucuccugcucguccacc

SEQ ID NO: 1095463 - RNA, 14 nt, Mycobacterium bovis subsp bovis AF2122/97
guucucgagcucgg

SEQ ID NO: 1095464 - RNA, 20 nt, Mycobacterium bovis subsp bovis AF2122/97
guucucgagcucggcgaacg

SEQ ID NO: 1095465 - RNA, 17 nt, Mycobacterium bovis subsp bovis AF2122/97
guucgugagcggccagg

SEQ ID NO: 1095466 - RNA, 14 nt, Mycobacterium bovis subsp bovis AF2122/97
guucgugccggcgu

SEQ ID NO: 1095467 - RNA, 23 nt, Mycobacterium bovis subsp bovis AF2122/97
guucgugccggcguugccgaaac

SEQ ID NO: 1095468 - RNA, 17 nt, Mycobacterium bovis subsp bovis AF2122/97
guucguucccgcucggg

SEQ ID NO: 1095469 - RNA, 20 nt, Mycobacterium bovis subsp bovis AF2122/97
guugcgcgguagcucgucga

SEQ ID NO: 1095470 - RNA, 13 nt, Mycobacterium bovis subsp bovis AF2122/97
guugcgcgguagc

SEQ ID NO: 1095471 - RNA, 23 nt, Mycobacterium bovis subsp bovis AF2122/97
guugccguuaccgccaaacgcug

SEQ ID NO: 1095472 - RNA, 22 nt, Mycobacterium bovis subsp bovis AF2122/97
guugcggaguuuuucggggugg

SEQ ID NO: 1095473 - RNA, 16 nt, Mycobacterium bovis subsp bovis AF2122/97
guugcgcugcgcgacg

SEQ ID NO: 1095474 - RNA, 21 nt, Mycobacterium bovis subsp bovis AF2122/97
guugccgggguuggucgucgc

SEQ ID NO: 1095475 - RNA, 23 nt, Mycobacterium bovis subsp bovis AF2122/97
guugccggucaggcaguccaccg

SEQ ID NO: 1095476 - RNA, 13 nt, Mycobacterium bovis subsp bovis AF2122/97
guugccggcggcg

SEQ ID NO: 1095477 - RNA, 22 nt, Mycobacterium bovis subsp bovis AF2122/97
guugccggcguugccgccgucc

SEQ ID NO: 1095478 - RNA, 20 nt, Mycobacterium bovis subsp bovis AF2122/97
guugccggugccgccgcggc

SEQ ID NO: 1095479 - RNA, 23 nt, Mycobacterium bovis subsp bovis AF2122/97
guugccggugccgccgcggccac

SEQ ID NO: 1095480 - RNA, 20 nt, Mycobacterium bovis subsp bovis AF2122/97
guugccgucgucgccgucgg

SEQ ID NO: 1095481 - RNA, 13 nt, Mycobacterium bovis subsp bovis AF2122/97
guugcugccggcg

SEQ ID NO: 1095482 - RNA, 19 nt, Mycobacterium bovis subsp bovis AF2122/97
guugcugaucagagcguuc

SEQ ID NO: 1095483 - RNA, 15 nt, Mycobacterium bovis subsp bovis AF2122/97
guugcugauggugcc

SEQ ID NO: 1095484 - RNA, 21 nt, Mycobacterium bovis subsp bovis AF2122/97
guugcugcccgacacccgcau

SEQ ID NO: 1095485 - RNA, 14 nt, Mycobacterium bovis subsp bovis AF2122/97
guugcggccgucga

SEQ ID NO: 1095486 - RNA, 15 nt, Mycobacterium bovis subsp bovis AF2122/97
guugcggccgucgau

SEQ ID NO: 1095487 - RNA, 20 nt, Mycobacterium bovis subsp bovis AF2122/97
guuggagcccgagcucgccg

SEQ ID NO: 1095488 - RNA, 22 nt, Mycobacterium bovis subsp bovis AF2122/97
guuggcaaagacgcuggccacg

SEQ ID NO: 1095489 - RNA, 23 nt, Mycobacterium bovis subsp bovis AF2122/97
guuggcaaugaccccggcguugc

SEQ ID NO: 1095490 - RNA, 13 nt, Mycobacterium bovis subsp bovis AF2122/97
guuggcaccagcc

SEQ ID NO: 1095491 - RNA, 16 nt, Mycobacterium bovis subsp bovis AF2122/97
guugcuuugcuggcgc

SEQ ID NO: 1095492 - RNA, 15 nt, Mycobacterium bovis subsp bovis AF2122/97
guugcuggcgccccc

SEQ ID NO: 1095493 - RNA, 19 nt, Mycobacterium bovis subsp bovis AF2122/97
guugcugagcaaguccugc

SEQ ID NO: 1095494 - RNA, 15 nt, Mycobacterium bovis subsp bovis AF2122/97
guugcacguucggcg

SEQ ID NO: 1095495 - RNA, 15 nt, Mycobacterium bovis subsp bovis AF2122/97
guugcauaccgccgg

SEQ ID NO: 1095496 - RNA, 14 nt, Mycobacterium bovis subsp bovis AF2122/97
guugcagucgcgag

SEQ ID NO: 1095497 - RNA, 18 nt, Mycobacterium bovis subsp bovis AF2122/97
guugcaggagccggcaac

SEQ ID NO: 1095498 - RNA, 18 nt, Mycobacterium bovis subsp bovis AF2122/97
guugcaucagcacgucgc

SEQ ID NO: 1095499 - RNA, 18 nt, Mycobacterium bovis subsp bovis AF2122/97
guugccagggcgggcguc

SEQ ID NO: 1095500 - RNA, 16 nt, Mycobacterium bovis subsp bovis AF2122/97
guugccggacaaccug

SEQ ID NO: 1095501 - RNA, 18 nt, Mycobacterium bovis subsp bovis AF2122/97
guugccgcggucggcgac

SEQ ID NO: 1095502 - RNA, 19 nt, Mycobacterium bovis subsp bovis AF2122/97
guugccgcggucggcgacg

SEQ ID NO: 1095503 - RNA, 19 nt, Mycobacterium bovis subsp bovis AF2122/97
guugccggagacgucgccg

SEQ ID NO: 1095504 - RNA, 21 nt, Mycobacterium bovis subsp bovis AF2122/97
guugccggagacgucgccgca

SEQ ID NO: 1095505 - RNA, 17 nt, Mycobacterium bovis subsp bovis AF2122/97
guugccaacaccggcga

SEQ ID NO: 1095506 - RNA, 15 nt, Mycobacterium bovis subsp bovis AF2122/97
guugccaacgaaccg

SEQ ID NO: 1095507 - RNA, 13 nt, Mycobacterium bovis subsp bovis AF2122/97
guugccaccggug

SEQ ID NO: 1095508 - RNA, 14 nt, Mycobacterium bovis subsp bovis AF2122/97
guugcacgcgggug

SEQ ID NO: 1095509 - RNA, 17 nt, Mycobacterium bovis subsp bovis AF2122/97
guugcacggccgggacg

SEQ ID NO: 1095510 - RNA, 18 nt, Mycobacterium bovis subsp bovis AF2122/97
guugauuucggcggcgau

SEQ ID NO: 1095511 - RNA, 14 nt, Mycobacterium bovis subsp bovis AF2122/97
guugcacagcagcg

SEQ ID NO: 1095512 - RNA, 20 nt, Mycobacterium bovis subsp bovis AF2122/97
guugcaacggguacacccgc

SEQ ID NO: 1095513 - RNA, 18 nt, Mycobacterium bovis subsp bovis AF2122/97
guugcacaccgaucggca

SEQ ID NO: 1095514 - RNA, 22 nt, Mycobacterium bovis subsp bovis AF2122/97
guugagguucuucugcgccacg

SEQ ID NO: 1095515 - RNA, 14 nt, Mycobacterium bovis subsp bovis AF2122/97
guugaggccgguga

SEQ ID NO: 1095516 - RNA, 17 nt, Mycobacterium bovis subsp bovis AF2122/97
guugauuucggcggcga

SEQ ID NO: 1095517 - RNA, 15 nt, Mycobacterium bovis subsp bovis AF2122/97
guugauucgugcgau

SEQ ID NO: 1095518 - RNA, 14 nt, Mycobacterium bovis subsp bovis AF2122/97
guuggugucguacu

SEQ ID NO: 1095519 - RNA, 20 nt, Mycobacterium bovis subsp bovis AF2122/97
guugguguucgggucgauca

SEQ ID NO: 1095520 - RNA, 16 nt, Mycobacterium bovis subsp bovis AF2122/97
guugguguugcggacg

SEQ ID NO: 1095521 - RNA, 16 nt, Mycobacterium bovis subsp bovis AF2122/97
guuguagacggcaccc

SEQ ID NO: 1095522 - RNA, 14 nt, Mycobacterium bovis subsp bovis AF2122/97
guuguagacggcgg

SEQ ID NO: 1095523 - RNA, 15 nt, Mycobacterium bovis subsp bovis AF2122/97
guuguaucgcagcau

SEQ ID NO: 1095524 - RNA, 20 nt, Mycobacterium bovis subsp bovis AF2122/97
guuguaguccgcgccgacgg

SEQ ID NO: 1095525 - RNA, 16 nt, Mycobacterium bovis subsp bovis AF2122/97
guuguccgcggccaac

SEQ ID NO: 1095526 - RNA, 13 nt, Mycobacterium bovis subsp bovis AF2122/97
guuguccagaacg

SEQ ID NO: 1095527 - RNA, 22 nt, Mycobacterium bovis subsp bovis AF2122/97
guuguccagaacggcgaucacc

SEQ ID NO: 1095528 - RNA, 16 nt, Mycobacterium bovis subsp bovis AF2122/97
guuguccagcgcgacg

SEQ ID NO: 1095529 - RNA, 22 nt, Mycobacterium bovis subsp bovis AF2122/97
guuguccagcgcgacguccacc

SEQ ID NO: 1095530 - RNA, 20 nt, Mycobacterium bovis subsp bovis AF2122/97
guugucagcgaacggccagg

SEQ ID NO: 1095531 - RNA, 19 nt, Mycobacterium bovis subsp bovis AF2122/97
guuguccaccgccaccacg

SEQ ID NO: 1095532 - RNA, 15 nt, Mycobacterium bovis subsp bovis AF2122/97
guuguccucggcgau

SEQ ID NO: 1095533 - RNA, 23 nt, Mycobacterium bovis subsp bovis AF2122/97
guuguccuucagccaguccagcg

SEQ ID NO: 1095534 - RNA, 19 nt, Mycobacterium bovis subsp bovis AF2122/97
guugucgacgaagguggcg

SEQ ID NO: 1095535 - RNA, 16 nt, Mycobacterium bovis subsp bovis AF2122/97
guugucgacggucggc

SEQ ID NO: 1095536 - RNA, 22 nt, Mycobacterium bovis subsp bovis AF2122/97
guuggccgagcagggccggcac

SEQ ID NO: 1095537 - RNA, 20 nt, Mycobacterium bovis subsp bovis AF2122/97
guuggccgaacagcugcccg

SEQ ID NO: 1095538 - RNA, 23 nt, Mycobacterium bovis subsp bovis AF2122/97
guuggccgaacagcugcccgcca

SEQ ID NO: 1095539 - RNA, 18 nt, Mycobacterium bovis subsp bovis AF2122/97
guuggccaguaugcggug

SEQ ID NO: 1095540 - RNA, 21 nt, Mycobacterium bovis subsp bovis AF2122/97
guuggccaugcaccgaugccg

SEQ ID NO: 1095541 - RNA, 16 nt, Mycobacterium bovis subsp bovis AF2122/97
guuggccauggccagu

SEQ ID NO: 1095542 - RNA, 22 nt, Mycobacterium bovis subsp bovis AF2122/97
guuggugaacaugugaccggcg

SEQ ID NO: 1095543 - RNA, 21 nt, Mycobacterium bovis subsp bovis AF2122/97
guuggugacauagaccucgcc

SEQ ID NO: 1095544 - RNA, 18 nt, Mycobacterium bovis subsp bovis AF2122/97
guuggccaccgcccagug

SEQ ID NO: 1095545 - RNA, 20 nt, Mycobacterium bovis subsp bovis AF2122/97
guuggugcccgugugcagcc

SEQ ID NO: 1095546 - RNA, 21 nt, Mycobacterium bovis subsp bovis AF2122/97
guuggugauugcggccgccga

SEQ ID NO: 1095547 - RNA, 12 nt, Mycobacterium bovis subsp bovis AF2122/97
guuggugcuggc

SEQ ID NO: 1095548 - RNA, 14 nt, Mycobacterium bovis subsp bovis AF2122/97
guuggccaccagcu

SEQ ID NO: 1095549 - RNA, 17 nt, Mycobacterium bovis subsp bovis AF2122/97
guuggcacgcaacaccg

SEQ ID NO: 1095550 - RNA, 23 nt, Mycobacterium bovis subsp bovis AF2122/97
guuggcagcacaggcuggcgaug

SEQ ID NO: 1095551 - RNA, 22 nt, Mycobacterium bovis subsp bovis AF2122/97
guuggcagcccucugguggcgc

SEQ ID NO: 1095552 - RNA, 19 nt, Mycobacterium bovis subsp bovis AF2122/97
guuggcagcgcuggcuacg

SEQ ID NO: 1095553 - RNA, 22 nt, Mycobacterium bovis subsp bovis AF2122/97
guuggcagcgggacugcggaag

SEQ ID NO: 1095554 - RNA, 18 nt, Mycobacterium bovis subsp bovis AF2122/97
guuggcaagcacggcguc

SEQ ID NO: 1095555 - RNA, 18 nt, Mycobacterium bovis subsp bovis AF2122/97
guuggcaccagccgguga

SEQ ID NO: 1095556 - RNA, 18 nt, Mycobacterium bovis subsp bovis AF2122/97
guuucggcgccgucgccc

SEQ ID NO: 1095557 - RNA, 21 nt, Mycobacterium bovis subsp bovis AF2122/97
guuucgggccgauugcucggg

SEQ ID NO: 1095558 - RNA, 19 nt, Mycobacterium bovis subsp bovis AF2122/97
guuucgaccugcgggaucg

SEQ ID NO: 1095559 - RNA, 17 nt, Mycobacterium bovis subsp bovis AF2122/97
guuucccuggccgccgc

SEQ ID NO: 1095560 - RNA, 19 nt, Mycobacterium bovis subsp bovis AF2122/97
guuucccuggccgccgccg

SEQ ID NO: 1095561 - RNA, 20 nt, Mycobacterium bovis subsp bovis AF2122/97
guuuccgaaacccgccgcga

SEQ ID NO: 1095562 - RNA, 14 nt, Mycobacterium bovis subsp bovis AF2122/97
guuuccgccgccgc

SEQ ID NO: 1095563 - RNA, 18 nt, Mycobacterium bovis subsp bovis AF2122/97
guuuacggcccggcaccc

SEQ ID NO: 1095564 - RNA, 20 nt, Mycobacterium bovis subsp bovis AF2122/97
guuucguccccagaccggcg

SEQ ID NO: 1095565 - RNA, 15 nt, Mycobacterium bovis subsp bovis AF2122/97
guuugaccaccuggu

SEQ ID NO: 1095566 - RNA, 14 nt, Mycobacterium bovis subsp bovis AF2122/97
guuugacgccgaug

SEQ ID NO: 1095567 - RNA, 14 nt, Mycobacterium bovis subsp bovis AF2122/97
guuugacgcgcucg

SEQ ID NO: 1095568 - RNA, 16 nt, Mycobacterium bovis subsp bovis AF2122/97
guuugacgcgcucgcg

SEQ ID NO: 1095569 - RNA, 13 nt, Mycobacterium bovis subsp bovis AF2122/97
guuugaacgcaug

SEQ ID NO: 1095570 - RNA, 18 nt, Mycobacterium bovis subsp bovis AF2122/97
guuugaacuucgccgucc

SEQ ID NO: 1095571 - RNA, 20 nt, Mycobacterium bovis subsp bovis AF2122/97
guuuggcauggucaggcggc

SEQ ID NO: 1095572 - RNA, 12 nt, Mycobacterium bovis subsp bovis AF2122/97
guuuggccgccg

SEQ ID NO: 1095573 - RNA, 21 nt, Mycobacterium bovis subsp bovis AF2122/97
guuuggacgggcgugcugccg

SEQ ID NO: 1095574 - RNA, 14 nt, Mycobacterium bovis subsp bovis AF2122/97
guuugcguccuggu

SEQ ID NO: 1095575 - RNA, 20 nt, Mycobacterium bovis subsp bovis AF2122/97
guuugcguccugguggcggg

SEQ ID NO: 1095576 - RNA, 12 nt, Mycobacterium bovis subsp bovis AF2122/97
guuuggcggcag

SEQ ID NO: 1095577 - RNA, 20 nt, Mycobacterium bovis subsp bovis AF2122/97
guuugggcaucaucgcugug

SEQ ID NO: 1095578 - RNA, 17 nt, Mycobacterium bovis subsp bovis AF2122/97
guuuggcgugccgucgc

SEQ ID NO: 1095579 - RNA, 12 nt, Mycobacterium bovis subsp bovis AF2122/97
guuuggcugccg

SEQ ID NO: 1095580 - RNA, 18 nt, Mycobacterium bovis subsp bovis AF2122/97
guuuggugcagccgcggu

SEQ ID NO: 1095581 - RNA, 23 nt, Mycobacterium bovis subsp bovis AF2122/97
guuugccaucgggaccggggacg

SEQ ID NO: 1095582 - RNA, 16 nt, Mycobacterium bovis subsp bovis AF2122/97
guuugccgggcgcugg

SEQ ID NO: 1095583 - RNA, 15 nt, Mycobacterium bovis subsp bovis AF2122/97
guuugccggugcggu

SEQ ID NO: 1095584 - RNA, 18 nt, Mycobacterium bovis subsp bovis AF2122/97
guuugccggugcgguggu

SEQ ID NO: 1095585 - RNA, 16 nt, Mycobacterium bovis subsp bovis AF2122/97
guuugccgguucggcg

SEQ ID NO: 1095586 - RNA, 14 nt, Mycobacterium bovis subsp bovis AF2122/97
guuugaucgcaacg

SEQ ID NO: 1095587 - RNA, 18 nt, Mycobacterium bovis subsp bovis AF2122/97
guuugaugcgggcggcaa

SEQ ID NO: 1095588 - RNA, 20 nt, Mycobacterium bovis subsp bovis AF2122/97
guuugcacuguucgcgguga

SEQ ID NO: 1095589 - RNA, 13 nt, Mycobacterium bovis subsp bovis AF2122/97
guuugucgcggug

SEQ ID NO: 1095590 - RNA, 15 nt, Mycobacterium bovis subsp bovis AF2122/97
guuugucgcgguggu

SEQ ID NO: 1095591 - RNA, 15 nt, Mycobacterium bovis subsp bovis AF2122/97
guuuguagucacggu

SEQ ID NO: 1095592 - RNA, 22 nt, Mycobacterium bovis subsp bovis AF2122/97
guuuguagucacggucguggug

SEQ ID NO: 1095593 - RNA, 18 nt, Mycobacterium bovis subsp bovis AF2122/97
guuuuaccucggccgcca

SEQ ID NO: 1095594 - RNA, 17 nt, Mycobacterium bovis subsp bovis AF2122/97
guuuugauagacgaccc

SEQ ID NO: 1095595 - RNA, 18 nt, Mycobacterium bovis subsp bovis AF2122/97
guuuucccgucgccgccc

SEQ ID NO: 1095596 - RNA, 21 nt, Mycobacterium bovis subsp bovis AF2122/97
guuuugucgacguucgguggc

SEQ ID NO: 1095597 - RNA, 19 nt, Mycobacterium bovis subsp bovis AF2122/97
guuuuggugcggaccugcg

SEQ ID NO: 1095598 - RNA, 16 nt, Mycobacterium bovis subsp bovis AF2122/97
uacaggcccggcaccg

SEQ ID NO: 1095599 - RNA, 20 nt, Mycobacterium bovis subsp bovis AF2122/97
uacaucggcggcgucgacgu

SEQ ID NO: 1095600 - RNA, 23 nt, Mycobacterium bovis subsp bovis AF2122/97
uacagcgcggcguguacgucgau

SEQ ID NO: 1095601 - RNA, 18 nt, Mycobacterium bovis subsp bovis AF2122/97
uacagcggcggcgucgac

SEQ ID NO: 1095602 - RNA, 14 nt, Mycobacterium bovis subsp bovis AF2122/97
uacacguugccgau

SEQ ID NO: 1095603 - RNA, 19 nt, Mycobacterium bovis subsp bovis AF2122/97
uaauggcgccaccggccgc

SEQ ID NO: 1095604 - RNA, 18 nt, Mycobacterium bovis subsp bovis AF2122/97
uacaaccacccacccgca

SEQ ID NO: 1095605 - RNA, 21 nt, Mycobacterium bovis subsp bovis AF2122/97
uacaaccacccacccgcacca

SEQ ID NO: 1095606 - RNA, 23 nt, Mycobacterium bovis subsp bovis AF2122/97
uacaacagcugggucaugccgua

SEQ ID NO: 1095607 - RNA, 15 nt, Mycobacterium bovis subsp bovis AF2122/97
uaaggcccuggccgc

SEQ ID NO: 1095608 - RNA, 13 nt, Mycobacterium bovis subsp bovis AF2122/97
uaaggccggccgg

SEQ ID NO: 1095609 - RNA, 15 nt, Mycobacterium bovis subsp bovis AF2122/97
uaaguacuagccggu

SEQ ID NO: 1095610 - RNA, 15 nt, Mycobacterium bovis subsp bovis AF2122/97
uaagacggcgacgac

SEQ ID NO: 1095611 - RNA, 14 nt, Mycobacterium bovis subsp bovis AF2122/97
uaagacgucggacg

SEQ ID NO: 1095612 - RNA, 21 nt, Mycobacterium bovis subsp bovis AF2122/97
uaaggugcgauccggcgcacg

SEQ ID NO: 1095613 - RNA, 17 nt, Mycobacterium bovis subsp bovis AF2122/97
uaaccguuggagucagg

SEQ ID NO: 1095614 - RNA, 14 nt, Mycobacterium bovis subsp bovis AF2122/97
uaaccggcgcgccc

SEQ ID NO: 1095615 - RNA, 21 nt, Mycobacterium bovis subsp bovis AF2122/97
uaaccggcggauucggcgcug

SEQ ID NO: 1095616 - RNA, 15 nt, Mycobacterium bovis subsp bovis AF2122/97
uaaccgcgucgaccg

SEQ ID NO: 1095617 - RNA, 21 nt, Mycobacterium bovis subsp bovis AF2122/97
uaaccgagccgaccggcggca

SEQ ID NO: 1095618 - RNA, 13 nt, Mycobacterium bovis subsp bovis AF2122/97
uaacccgcaccgg

SEQ ID NO: 1095619 - RNA, 19 nt, Mycobacterium bovis subsp bovis AF2122/97
uaacgcggcaccacgucga

SEQ ID NO: 1095620 - RNA, 16 nt, Mycobacterium bovis subsp bovis AF2122/97
uaacgcggaucgggca

SEQ ID NO: 1095621 - RNA, 17 nt, Mycobacterium bovis subsp bovis AF2122/97
uaacgguaaccggcccg

SEQ ID NO: 1095622 - RNA, 23 nt, Mycobacterium bovis subsp bovis AF2122/97
uaacgcugcucguaggugccgaa

SEQ ID NO: 1095623 - RNA, 16 nt, Mycobacterium bovis subsp bovis AF2122/97
uaacggcgaccgccau

SEQ ID NO: 1095624 - RNA, 14 nt, Mycobacterium bovis subsp bovis AF2122/97
uaacagccggccgg

SEQ ID NO: 1095625 - RNA, 18 nt, Mycobacterium bovis subsp bovis AF2122/97
uaacagccggccggaucc

SEQ ID NO: 1095626 - RNA, 23 nt, Mycobacterium bovis subsp bovis AF2122/97
uaaagguggucgucccgauggcg

SEQ ID NO: 1095627 - RNA, 15 nt, Mycobacterium bovis subsp bovis AF2122/97
uaaagcccggcggca

SEQ ID NO: 1095628 - RNA, 12 nt, Mycobacterium bovis subsp bovis AF2122/97
uaaacaccgcga

SEQ ID NO: 1095629 - RNA, 19 nt, Mycobacterium bovis subsp bovis AF2122/97
uaaaaaccacccccaccga

SEQ ID NO: 1095630 - RNA, 18 nt, Mycobacterium bovis subsp bovis AF2122/97
guuuuugcagacucggcg

SEQ ID NO: 1095631 - RNA, 12 nt, Mycobacterium bovis subsp bovis AF2122/97
uacgcggccgag

SEQ ID NO: 1095632 - RNA, 14 nt, Mycobacterium bovis subsp bovis AF2122/97
uacgcgggugacca

SEQ ID NO: 1095633 - RNA, 18 nt, Mycobacterium bovis subsp bovis AF2122/97
uacgcguugugcccgccg

SEQ ID NO: 1095634 - RNA, 15 nt, Mycobacterium bovis subsp bovis AF2122/97
uacgcggcugcgucg

SEQ ID NO: 1095635 - RNA, 14 nt, Mycobacterium bovis subsp bovis AF2122/97
uacgcgcgcccgau

SEQ ID NO: 1095636 - RNA, 16 nt, Mycobacterium bovis subsp bovis AF2122/97
uacgcgcgcccgaucc

SEQ ID NO: 1095637 - RNA, 20 nt, Mycobacterium bovis subsp bovis AF2122/97
uacgcgccgccggcucgccg

SEQ ID NO: 1095638 - RNA, 14 nt, Mycobacterium bovis subsp bovis AF2122/97
uacgccuccuucgu

SEQ ID NO: 1095639 - RNA, 13 nt, Mycobacterium bovis subsp bovis AF2122/97
uacgcucggcgaa

SEQ ID NO: 1095640 - RNA, 22 nt, Mycobacterium bovis subsp bovis AF2122/97
uacgcuggcacacuguuacucc

SEQ ID NO: 1095641 - RNA, 13 nt, Mycobacterium bovis subsp bovis AF2122/97
uacggcgacaccc

SEQ ID NO: 1095642 - RNA, 16 nt, Mycobacterium bovis subsp bovis AF2122/97
uacggcgacacgccag

SEQ ID NO: 1095643 - RNA, 15 nt, Mycobacterium bovis subsp bovis AF2122/97
uacggccaccaggug

SEQ ID NO: 1095644 - RNA, 13 nt, Mycobacterium bovis subsp bovis AF2122/97
uacgaagccgccg

SEQ ID NO: 1095645 - RNA, 20 nt, Mycobacterium bovis subsp bovis AF2122/97
uaccugguugcugacgacug

SEQ ID NO: 1095646 - RNA, 12 nt, Mycobacterium bovis subsp bovis AF2122/97
uaccuccucgag

SEQ ID NO: 1095647 - RNA, 14 nt, Mycobacterium bovis subsp bovis AF2122/97
uaccaacaccgccc

SEQ ID NO: 1095648 - RNA, 19 nt, Mycobacterium bovis subsp bovis AF2122/97
uaccgugccgcccggucgg

SEQ ID NO: 1095649 - RNA, 17 nt, Mycobacterium bovis subsp bovis AF2122/97
uaccuaacccgcgccgg

SEQ ID NO: 1095650 - RNA, 23 nt, Mycobacterium bovis subsp bovis AF2122/97
uaccuaggagugguacggcucgg

SEQ ID NO: 1095651 - RNA, 22 nt, Mycobacterium bovis subsp bovis AF2122/97
uacggcgaugcggucggccaca

SEQ ID NO: 1095652 - RNA, 14 nt, Mycobacterium bovis subsp bovis AF2122/97
uacggcgggcggcc

SEQ ID NO: 1095653 - RNA, 18 nt, Mycobacterium bovis subsp bovis AF2122/97
uacgggcugacgaucucc

SEQ ID NO: 1095654 - RNA, 18 nt, Mycobacterium bovis subsp bovis AF2122/97
uacggggccgucucgccg

SEQ ID NO: 1095655 - RNA, 16 nt, Mycobacterium bovis subsp bovis AF2122/97
uacggcucggcgcuga

SEQ ID NO: 1095656 - RNA, 24 nt, Mycobacterium bovis subsp bovis AF2122/97
uacgggaacguccagccguggcgg

SEQ ID NO: 1095657 - RNA, 13 nt, Mycobacterium bovis subsp bovis AF2122/97
uacgggugucggg

SEQ ID NO: 1095658 - RNA, 22 nt, Mycobacterium bovis subsp bovis AF2122/97
uacgggcugacgaucuccaccc

SEQ ID NO: 1095659 - RNA, 18 nt, Mycobacterium bovis subsp bovis AF2122/97
uacgguccggcguacucg

SEQ ID NO: 1095660 - RNA, 17 nt, Mycobacterium bovis subsp bovis AF2122/97
uacguuguacucgugcg

SEQ ID NO: 1095661 - RNA, 14 nt, Mycobacterium bovis subsp bovis AF2122/97
uacucccccgcgaa

SEQ ID NO: 1095662 - RNA, 15 nt, Mycobacterium bovis subsp bovis AF2122/97
uacuccaccgcgccg

SEQ ID NO: 1095663 - RNA, 20 nt, Mycobacterium bovis subsp bovis AF2122/97
uacuccaccgcgccgucguc

SEQ ID NO: 1095664 - RNA, 18 nt, Mycobacterium bovis subsp bovis AF2122/97
uacgucaagccgugcugc

SEQ ID NO: 1095665 - RNA, 21 nt, Mycobacterium bovis subsp bovis AF2122/97
uacgucgagggugaccaacgu

SEQ ID NO: 1095666 - RNA, 16 nt, Mycobacterium bovis subsp bovis AF2122/97
uacgucggggccgcac

SEQ ID NO: 1095667 - RNA, 17 nt, Mycobacterium bovis subsp bovis AF2122/97
uacgugcgagcccaccu

SEQ ID NO: 1095668 - RNA, 14 nt, Mycobacterium bovis subsp bovis AF2122/97
uacuucgcggcggu

SEQ ID NO: 1095669 - RNA, 22 nt, Mycobacterium bovis subsp bovis AF2122/97
uacuuccauccacaucgauguc

SEQ ID NO: 1095670 - RNA, 15 nt, Mycobacterium bovis subsp bovis AF2122/97
uagaacguagcgccc

SEQ ID NO: 1095671 - RNA, 15 nt, Mycobacterium bovis subsp bovis AF2122/97
uagaagucgaucgcc

SEQ ID NO: 1095672 - RNA, 13 nt, Mycobacterium bovis subsp bovis AF2122/97
uacucggcgcgca

SEQ ID NO: 1095673 - RNA, 12 nt, Mycobacterium bovis subsp bovis AF2122/97
uacucggcggcu

SEQ ID NO: 1095674 - RNA, 13 nt, Mycobacterium bovis subsp bovis AF2122/97
uagggcuccucgu

SEQ ID NO: 1095675 - RNA, 16 nt, Mycobacterium bovis subsp bovis AF2122/97
uagggcggcggcgcga

SEQ ID NO: 1095676 - RNA, 20 nt, Mycobacterium bovis subsp bovis AF2122/97
uaggggcuuuugcgucugcu

SEQ ID NO: 1095677 - RNA, 13 nt, Mycobacterium bovis subsp bovis AF2122/97
uagggccggugac

SEQ ID NO: 1095678 - RNA, 16 nt, Mycobacterium bovis subsp bovis AF2122/97
uagggcaucgucgccg

SEQ ID NO: 1095679 - RNA, 22 nt, Mycobacterium bovis subsp bovis AF2122/97
uagggauaacgacgucggcgcg

SEQ ID NO: 1095680 - RNA, 17 nt, Mycobacterium bovis subsp bovis AF2122/97
uaggcggcggcccgcag

SEQ ID NO: 1095681 - RNA, 16 nt, Mycobacterium bovis subsp bovis AF2122/97
uaggcgcggucaccgc

SEQ ID NO: 1095682 - RNA, 20 nt, Mycobacterium bovis subsp bovis AF2122/97
uaggcgauucugcgucugcu

SEQ ID NO: 1095683 - RNA, 23 nt, Mycobacterium bovis subsp bovis AF2122/97
uaggcgaccagauagaacaacgu

SEQ ID NO: 1095684 - RNA, 15 nt, Mycobacterium bovis subsp bovis AF2122/97
uaggcgauaucgccc

SEQ ID NO: 1095685 - RNA, 18 nt, Mycobacterium bovis subsp bovis AF2122/97
uaggcgauugcgccgcac

SEQ ID NO: 1095686 - RNA, 21 nt, Mycobacterium bovis subsp bovis AF2122/97
uaggccugagcgugucuggcg

SEQ ID NO: 1095687 - RNA, 14 nt, Mycobacterium bovis subsp bovis AF2122/97
uaggcgaccagaua

SEQ ID NO: 1095688 - RNA, 18 nt, Mycobacterium bovis subsp bovis AF2122/97
uaggccccgccagcgccg

SEQ ID NO: 1095689 - RNA, 14 nt, Mycobacterium bovis subsp bovis AF2122/97
uaggcccgcacguu

SEQ ID NO: 1095690 - RNA, 22 nt, Mycobacterium bovis subsp bovis AF2122/97
uaggccgccggacccgucgagc

SEQ ID NO: 1095691 - RNA, 15 nt, Mycobacterium bovis subsp bovis AF2122/97
uaggccgcgucgauc

SEQ ID NO: 1095692 - RNA, 21 nt, Mycobacterium bovis subsp bovis AF2122/97
uagcuggccagguugccgucg

SEQ ID NO: 1095693 - RNA, 17 nt, Mycobacterium bovis subsp bovis AF2122/97
uagcuggcggggguccg

SEQ ID NO: 1095694 - RNA, 22 nt, Mycobacterium bovis subsp bovis AF2122/97
uagcuguugaccguguggccgu

SEQ ID NO: 1095695 - RNA, 16 nt, Mycobacterium bovis subsp bovis AF2122/97
uagcugcucaucgcgc

SEQ ID NO: 1095696 - RNA, 19 nt, Mycobacterium bovis subsp bovis AF2122/97
uagcuggaguaggugugcg

SEQ ID NO: 1095697 - RNA, 17 nt, Mycobacterium bovis subsp bovis AF2122/97
uagcugacccgcgguag

SEQ ID NO: 1095698 - RNA, 19 nt, Mycobacterium bovis subsp bovis AF2122/97
uagcugaccgagcugaucc

SEQ ID NO: 1095699 - RNA, 14 nt, Mycobacterium bovis subsp bovis AF2122/97
uaggcacucccgga

SEQ ID NO: 1095700 - RNA, 20 nt, Mycobacterium bovis subsp bovis AF2122/97
uaggcaaggucaacccgcac

SEQ ID NO: 1095701 - RNA, 16 nt, Mycobacterium bovis subsp bovis AF2122/97
uaggcaggaucgccug

SEQ ID NO: 1095702 - RNA, 14 nt, Mycobacterium bovis subsp bovis AF2122/97
uaggcaggccggcu

SEQ ID NO: 1095703 - RNA, 18 nt, Mycobacterium bovis subsp bovis AF2122/97
uaggacggcgcgagccgc

SEQ ID NO: 1095704 - RNA, 21 nt, Mycobacterium bovis subsp bovis AF2122/97
uaggacucuucggucagggug

SEQ ID NO: 1095705 - RNA, 17 nt, Mycobacterium bovis subsp bovis AF2122/97
uaggacaccaccguggc

SEQ ID NO: 1095706 - RNA, 14 nt, Mycobacterium bovis subsp bovis AF2122/97
uagcgcggccagca

SEQ ID NO: 1095707 - RNA, 17 nt, Mycobacterium bovis subsp bovis AF2122/97
uagcgcuauaggccgca

SEQ ID NO: 1095708 - RNA, 16 nt, Mycobacterium bovis subsp bovis AF2122/97
uagcgcggcaccagca

SEQ ID NO: 1095709 - RNA, 12 nt, Mycobacterium bovis subsp bovis AF2122/97
uagcgcggccag

SEQ ID NO: 1095710 - RNA, 15 nt, Mycobacterium bovis subsp bovis AF2122/97
uagccuuaacggcau

SEQ ID NO: 1095711 - RNA, 12 nt, Mycobacterium bovis subsp bovis AF2122/97
uagccugcggcg

SEQ ID NO: 1095712 - RNA, 15 nt, Mycobacterium bovis subsp bovis AF2122/97
uagccugcggcggcg

SEQ ID NO: 1095713 - RNA, 20 nt, Mycobacterium bovis subsp bovis AF2122/97
uagcgacggcgcucggcgag

SEQ ID NO: 1095714 - RNA, 21 nt, Mycobacterium bovis subsp bovis AF2122/97
uagcgacgguuuagcgccggu

SEQ ID NO: 1095715 - RNA, 15 nt, Mycobacterium bovis subsp bovis AF2122/97
uagcgccgaucuucg

SEQ ID NO: 1095716 - RNA, 16 nt, Mycobacterium bovis subsp bovis AF2122/97
uagcgccgccagucgu

SEQ ID NO: 1095717 - RNA, 17 nt, Mycobacterium bovis subsp bovis AF2122/97
uagcgacgccaucugcu

SEQ ID NO: 1095718 - RNA, 19 nt, Mycobacterium bovis subsp bovis AF2122/97
uagcgugaccgugccgucg

SEQ ID NO: 1095719 - RNA, 23 nt, Mycobacterium bovis subsp bovis AF2122/97
uagcggaaaacccagaucggcga

SEQ ID NO: 1095720 - RNA, 22 nt, Mycobacterium bovis subsp bovis AF2122/97
uagcgugguacuuucacgcucg

SEQ ID NO: 1095721 - RNA, 13 nt, Mycobacterium bovis subsp bovis AF2122/97
uagcguucggcga

SEQ ID NO: 1095722 - RNA, 14 nt, Mycobacterium bovis subsp bovis AF2122/97
uagccguucggcug

SEQ ID NO: 1095723 - RNA, 19 nt, Mycobacterium bovis subsp bovis AF2122/97
uagccguagcggucgauga

SEQ ID NO: 1095724 - RNA, 22 nt, Mycobacterium bovis subsp bovis AF2122/97
uagccguagcggucgaugaucu

SEQ ID NO: 1095725 - RNA, 19 nt, Mycobacterium bovis subsp bovis AF2122/97
uagccgguugucgcagcgc

SEQ ID NO: 1095726 - RNA, 18 nt, Mycobacterium bovis subsp bovis AF2122/97
uagccgggaacgcugacg

SEQ ID NO: 1095727 - RNA, 21 nt, Mycobacterium bovis subsp bovis AF2122/97
uagccggucaguauggcgacg

SEQ ID NO: 1095728 - RNA, 15 nt, Mycobacterium bovis subsp bovis AF2122/97
uagccggcgugcacu

SEQ ID NO: 1095729 - RNA, 14 nt, Mycobacterium bovis subsp bovis AF2122/97
uagccggcgccgcc

SEQ ID NO: 1095730 - RNA, 17 nt, Mycobacterium bovis subsp bovis AF2122/97
uagccggcgccgccguc

SEQ ID NO: 1095731 - RNA, 17 nt, Mycobacterium bovis subsp bovis AF2122/97
uagccggcgacaccgca

SEQ ID NO: 1095732 - RNA, 20 nt, Mycobacterium bovis subsp bovis AF2122/97
uagccggcgacaccgcaggu

SEQ ID NO: 1095733 - RNA, 16 nt, Mycobacterium bovis subsp bovis AF2122/97
uagaucagcaacggca

SEQ ID NO: 1095734 - RNA, 20 nt, Mycobacterium bovis subsp bovis AF2122/97
uagaucagcaugccuucggc

SEQ ID NO: 1095735 - RNA, 11 nt, Mycobacterium bovis subsp bovis AF2122/97
uagaucgccuc

SEQ ID NO: 1095736 - RNA, 16 nt, Mycobacterium bovis subsp bovis AF2122/97
uagaucgccucgacgc

SEQ ID NO: 1095737 - RNA, 23 nt, Mycobacterium bovis subsp bovis AF2122/97
uagaucauuucgguaauggccgc

SEQ ID NO: 1095738 - RNA, 12 nt, Mycobacterium bovis subsp bovis AF2122/97
uagccgcgcucg

SEQ ID NO: 1095739 - RNA, 18 nt, Mycobacterium bovis subsp bovis AF2122/97
uagccgcgcucgaacucc

SEQ ID NO: 1095740 - RNA, 21 nt, Mycobacterium bovis subsp bovis AF2122/97
uagccgcggcccgcgugcgca

SEQ ID NO: 1095741 - RNA, 14 nt, Mycobacterium bovis subsp bovis AF2122/97
uagccgcuccgccc

SEQ ID NO: 1095742 - RNA, 17 nt, Mycobacterium bovis subsp bovis AF2122/97
uauccgcaggcccgcca

SEQ ID NO: 1095743 - RNA, 13 nt, Mycobacterium bovis subsp bovis AF2122/97
uauccgacgucgg

SEQ ID NO: 1095744 - RNA, 17 nt, Mycobacterium bovis subsp bovis AF2122/97
uauccggacuugaccag

SEQ ID NO: 1095745 - RNA, 18 nt, Mycobacterium bovis subsp bovis AF2122/97
uauccguacaguccacgc

SEQ ID NO: 1095746 - RNA, 17 nt, Mycobacterium bovis subsp bovis AF2122/97
uaucgucccggcgaccg

SEQ ID NO: 1095747 - RNA, 13 nt, Mycobacterium bovis subsp bovis AF2122/97
uaucgggaagccg

SEQ ID NO: 1095748 - RNA, 21 nt, Mycobacterium bovis subsp bovis AF2122/97
uaucgggcucagcggcgaccg

SEQ ID NO: 1095749 - RNA, 22 nt, Mycobacterium bovis subsp bovis AF2122/97
uaucggugccggagacaccgca

SEQ ID NO: 1095750 - RNA, 19 nt, Mycobacterium bovis subsp bovis AF2122/97
uaucggugcuggucgccgc

SEQ ID NO: 1095751 - RNA, 18 nt, Mycobacterium bovis subsp bovis AF2122/97
uaucggccgaaucuccgc

SEQ ID NO: 1095752 - RNA, 23 nt, Mycobacterium bovis subsp bovis AF2122/97
uaucggccgugaauucgccgaac

SEQ ID NO: 1095753 - RNA, 19 nt, Mycobacterium bovis subsp bovis AF2122/97
uaucggcauacccaucaac

SEQ ID NO: 1095754 - RNA, 17 nt, Mycobacterium bovis subsp bovis AF2122/97
uauccaugucgcgccag

SEQ ID NO: 1095755 - RNA, 23 nt, Mycobacterium bovis subsp bovis AF2122/97
uaucagccgcgcgccaucgccuc

SEQ ID NO: 1095756 - RNA, 14 nt, Mycobacterium bovis subsp bovis AF2122/97
uauucguuggcgaa

SEQ ID NO: 1095757 - RNA, 16 nt, Mycobacterium bovis subsp bovis AF2122/97
uaugacgcccaccgac

SEQ ID NO: 1095758 - RNA, 21 nt, Mycobacterium bovis subsp bovis AF2122/97
uaugacuugcgcgcggcaaca

SEQ ID NO: 1095759 - RNA, 14 nt, Mycobacterium bovis subsp bovis AF2122/97
uaugggaccggcaa

SEQ ID NO: 1095760 - RNA, 15 nt, Mycobacterium bovis subsp bovis AF2122/97
uauggcccgggccga

SEQ ID NO: 1095761 - RNA, 15 nt, Mycobacterium bovis subsp bovis AF2122/97
uauggccggagcgca

SEQ ID NO: 1095762 - RNA, 20 nt, Mycobacterium bovis subsp bovis AF2122/97
uauggcauucgauaccgcac

SEQ ID NO: 1095763 - RNA, 21 nt, Mycobacterium bovis subsp bovis AF2122/97
uaguaguucagccaggccgca

SEQ ID NO: 1095764 - RNA, 17 nt, Mycobacterium bovis subsp bovis AF2122/97
uaggggucgaggucuuu

SEQ ID NO: 1095765 - RNA, 14 nt, Mycobacterium bovis subsp bovis AF2122/97
uaggguggccgacg

SEQ ID NO: 1095766 - RNA, 19 nt, Mycobacterium bovis subsp bovis AF2122/97
uagguccuugucggccccg

SEQ ID NO: 1095767 - RNA, 13 nt, Mycobacterium bovis subsp bovis AF2122/97
uaggucgacgccg

SEQ ID NO: 1095768 - RNA, 22 nt, Mycobacterium bovis subsp bovis AF2122/97
uaggugugcgacgacggcgccg

SEQ ID NO: 1095769 - RNA, 17 nt, Mycobacterium bovis subsp bovis AF2122/97
uagguggccagcgcggc

SEQ ID NO: 1095770 - RNA, 16 nt, Mycobacterium bovis subsp bovis AF2122/97
uagguuuucggcggcu

SEQ ID NO: 1095771 - RNA, 23 nt, Mycobacterium bovis subsp bovis AF2122/97
uagucgggcaaggcggcggccag

SEQ ID NO: 1095772 - RNA, 13 nt, Mycobacterium bovis subsp bovis AF2122/97
uagucgacgucga

SEQ ID NO: 1095773 - RNA, 22 nt, Mycobacterium bovis subsp bovis AF2122/97
uagucgaucacguacgccgccg

SEQ ID NO: 1095774 - RNA, 21 nt, Mycobacterium bovis subsp bovis AF2122/97
uaguccgagggcgucgccgcc

SEQ ID NO: 1095775 - RNA, 18 nt, Mycobacterium bovis subsp bovis AF2122/97
uaguccgcauccgcgacg

SEQ ID NO: 1095776 - RNA, 20 nt, Mycobacterium bovis subsp bovis AF2122/97
uaguccgagggcgucgccgc

SEQ ID NO: 1095777 - RNA, 15 nt, Mycobacterium bovis subsp bovis AF2122/97
uagucgucggcgcug

SEQ ID NO: 1095778 - RNA, 18 nt, Mycobacterium bovis subsp bovis AF2122/97
uagucgucggcgcugacg

SEQ ID NO: 1095779 - RNA, 16 nt, Mycobacterium bovis subsp bovis AF2122/97
uagucggccggcgguc

SEQ ID NO: 1095780 - RNA, 11 nt, Mycobacterium bovis subsp bovis AF2122/97
uagucggccug

SEQ ID NO: 1095781 - RNA, 17 nt, Mycobacterium bovis subsp bovis AF2122/97
uagugaucgaucgcggc

SEQ ID NO: 1095782 - RNA, 21 nt, Mycobacterium bovis subsp bovis AF2122/97
uagugaacggcucgggcagcg

SEQ ID NO: 1095783 - RNA, 21 nt, Mycobacterium bovis subsp bovis AF2122/97
uagugaugguucaugaacauc

SEQ ID NO: 1095784 - RNA, 22 nt, Mycobacterium bovis subsp bovis AF2122/97
uagugccucgauuguggccagc

SEQ ID NO: 1095785 - RNA, 22 nt, Mycobacterium bovis subsp bovis AF2122/97
uagugcgacugcgaaugcuggg

SEQ ID NO: 1095786 - RNA, 18 nt, Mycobacterium bovis subsp bovis AF2122/97
uaguggaacagucgaggu

SEQ ID NO: 1095787 - RNA, 19 nt, Mycobacterium bovis subsp bovis AF2122/97
uaguugcgcggcaucccgc

SEQ ID NO: 1095788 - RNA, 16 nt, Mycobacterium bovis subsp bovis AF2122/97
uauaggacgccgcgcc

SEQ ID NO: 1095789 - RNA, 12 nt, Mycobacterium bovis subsp bovis AF2122/97
uauaccgcuggg

SEQ ID NO: 1095790 - RNA, 17 nt, Mycobacterium bovis subsp bovis AF2122/97
uauagccgacgccggug

SEQ ID NO: 1095791 - RNA, 14 nt, Mycobacterium bovis subsp bovis AF2122/97
uauagccgccggug

SEQ ID NO: 1095792 - RNA, 20 nt, Mycobacterium bovis subsp bovis AF2122/97
uaguugauggccccgggcgg

SEQ ID NO: 1095793 - RNA, 22 nt, Mycobacterium bovis subsp bovis AF2122/97
ucagcggcgccaguauggccgc

SEQ ID NO: 1095794 - RNA, 22 nt, Mycobacterium bovis subsp bovis AF2122/97
ucagcggccgguacacguccag

SEQ ID NO: 1095795 - RNA, 15 nt, Mycobacterium bovis subsp bovis AF2122/97
ucagcggccugcucg

SEQ ID NO: 1095796 - RNA, 14 nt, Mycobacterium bovis subsp bovis AF2122/97
ucagcggccaaccc

SEQ ID NO: 1095797 - RNA, 15 nt, Mycobacterium bovis subsp bovis AF2122/97
ucagcggccaaccca

SEQ ID NO: 1095798 - RNA, 18 nt, Mycobacterium bovis subsp bovis AF2122/97
ucagcggcagcaccgcac

SEQ ID NO: 1095799 - RNA, 15 nt, Mycobacterium bovis subsp bovis AF2122/97
ucagcgcgguccauc

SEQ ID NO: 1095800 - RNA, 21 nt, Mycobacterium bovis subsp bovis AF2122/97
ucagcgcggcgcccuggccgc

SEQ ID NO: 1095801 - RNA, 18 nt, Mycobacterium bovis subsp bovis AF2122/97
ucagcggcaacgaucgac

SEQ ID NO: 1095802 - RNA, 14 nt, Mycobacterium bovis subsp bovis AF2122/97
ucagcgcgaccgaa

SEQ ID NO: 1095803 - RNA, 17 nt, Mycobacterium bovis subsp bovis AF2122/97
ucagcgcggccacgccg

SEQ ID NO: 1095804 - RNA, 17 nt, Mycobacterium bovis subsp bovis AF2122/97
ucagcgccagcgagcau

SEQ ID NO: 1095805 - RNA, 21 nt, Mycobacterium bovis subsp bovis AF2122/97
ucagcgcgcgguuuucggcug

SEQ ID NO: 1095806 - RNA, 22 nt, Mycobacterium bovis subsp bovis AF2122/97
ucagcgccgagagcaccgcucg

SEQ ID NO: 1095807 - RNA, 19 nt, Mycobacterium bovis subsp bovis AF2122/97
ucagcgccacguccaucac

SEQ ID NO: 1095808 - RNA, 21 nt, Mycobacterium bovis subsp bovis AF2122/97
ucagccagcccaggguguccg

SEQ ID NO: 1095809 - RNA, 19 nt, Mycobacterium bovis subsp bovis AF2122/97
ucagccagggucccgccgc

SEQ ID NO: 1095810 - RNA, 20 nt, Mycobacterium bovis subsp bovis AF2122/97
ucagccagggucccgccgcc

SEQ ID NO: 1095811 - RNA, 22 nt, Mycobacterium bovis subsp bovis AF2122/97
ucagccagggucccgccgccug

SEQ ID NO: 1095812 - RNA, 16 nt, Mycobacterium bovis subsp bovis AF2122/97
ucagccacucgccacu

SEQ ID NO: 1095813 - RNA, 17 nt, Mycobacterium bovis subsp bovis AF2122/97
ucagcacccaacccggc

SEQ ID NO: 1095814 - RNA, 21 nt, Mycobacterium bovis subsp bovis AF2122/97
ucagcacccaacccggcggca

SEQ ID NO: 1095815 - RNA, 19 nt, Mycobacterium bovis subsp bovis AF2122/97
ucagcaccccauggccacc

SEQ ID NO: 1095816 - RNA, 15 nt, Mycobacterium bovis subsp bovis AF2122/97
ucagcaccaccagca

SEQ ID NO: 1095817 - RNA, 18 nt, Mycobacterium bovis subsp bovis AF2122/97
ucagcgaguuucugcucg

SEQ ID NO: 1095818 - RNA, 15 nt, Mycobacterium bovis subsp bovis AF2122/97
ucagccgguggucug

SEQ ID NO: 1095819 - RNA, 17 nt, Mycobacterium bovis subsp bovis AF2122/97
ucagccggccauacgcg

SEQ ID NO: 1095820 - RNA, 20 nt, Mycobacterium bovis subsp bovis AF2122/97
ucagccggccauacgcgcgc

SEQ ID NO: 1095821 - RNA, 19 nt, Mycobacterium bovis subsp bovis AF2122/97
ucagcgcacuggccgcuau

SEQ ID NO: 1095822 - RNA, 19 nt, Mycobacterium bovis subsp bovis AF2122/97
ucagccgcaccccgcccga

SEQ ID NO: 1095823 - RNA, 14 nt, Mycobacterium bovis subsp bovis AF2122/97
ucagccgcgccggg

SEQ ID NO: 1095824 - RNA, 20 nt, Mycobacterium bovis subsp bovis AF2122/97
ucagccgcgcgggucacgac

SEQ ID NO: 1095825 - RNA, 12 nt, Mycobacterium bovis subsp bovis AF2122/97
ucagccgcggcc

SEQ ID NO: 1095826 - RNA, 15 nt, Mycobacterium bovis subsp bovis AF2122/97
ucagccgcggccaca

SEQ ID NO: 1095827 - RNA, 21 nt, Mycobacterium bovis subsp bovis AF2122/97
ucagcaccccauggccaccga

SEQ ID NO: 1095828 - RNA, 17 nt, Mycobacterium bovis subsp bovis AF2122/97
ucagcugugcgacccgc

SEQ ID NO: 1095829 - RNA, 20 nt, Mycobacterium bovis subsp bovis AF2122/97
ucaggaacaaguagccgucg

SEQ ID NO: 1095830 - RNA, 16 nt, Mycobacterium bovis subsp bovis AF2122/97
ucaggaagcgugcggu

SEQ ID NO: 1095831 - RNA, 17 nt, Mycobacterium bovis subsp bovis AF2122/97
ucaggaaccacccaccg

SEQ ID NO: 1095832 - RNA, 14 nt, Mycobacterium bovis subsp bovis AF2122/97
ucaggaucgcaccg

SEQ ID NO: 1095833 - RNA, 17 nt, Mycobacterium bovis subsp bovis AF2122/97
ucaggaucccgguggca

SEQ ID NO: 1095834 - RNA, 19 nt, Mycobacterium bovis subsp bovis AF2122/97
ucaggaucccgguggcagc

SEQ ID NO: 1095835 - RNA, 20 nt, Mycobacterium bovis subsp bovis AF2122/97
ucaggacgcgaucggcguca

SEQ ID NO: 1095836 - RNA, 22 nt, Mycobacterium bovis subsp bovis AF2122/97
ucaggccagggugaccaggccg

SEQ ID NO: 1095837 - RNA, 19 nt, Mycobacterium bovis subsp bovis AF2122/97
ucaggccgacgucgaccac

SEQ ID NO: 1095838 - RNA, 20 nt, Mycobacterium bovis subsp bovis AF2122/97
ucaggccgacuaaccacugu

SEQ ID NO: 1095839 - RNA, 14 nt, Mycobacterium bovis subsp bovis AF2122/97
ucaggcccgggcgg

SEQ ID NO: 1095840 - RNA, 17 nt, Mycobacterium bovis subsp bovis AF2122/97
ucaggccgccgcggcga

SEQ ID NO: 1095841 - RNA, 20 nt, Mycobacterium bovis subsp bovis AF2122/97
ucaggcacaacgcgacgccg

SEQ ID NO: 1095842 - RNA, 21 nt, Mycobacterium bovis subsp bovis AF2122/97
ucaggccagagucgcccgcac

SEQ ID NO: 1095843 - RNA, 17 nt, Mycobacterium bovis subsp bovis AF2122/97
ucaggcagcuccgccgc

SEQ ID NO: 1095844 - RNA, 17 nt, Mycobacterium bovis subsp bovis AF2122/97
ucaggcaguccaccgcg

SEQ ID NO: 1095845 - RNA, 11 nt, Mycobacterium bovis subsp bovis AF2122/97
ucagcgucuga

SEQ ID NO: 1095846 - RNA, 21 nt, Mycobacterium bovis subsp bovis AF2122/97
ucagcgucugagcgccggcau

SEQ ID NO: 1095847 - RNA, 14 nt, Mycobacterium bovis subsp bovis AF2122/97
ucagcgugucgccg

SEQ ID NO: 1095848 - RNA, 13 nt, Mycobacterium bovis subsp bovis AF2122/97
ucagcgucgacgu

SEQ ID NO: 1095849 - RNA, 14 nt, Mycobacterium bovis subsp bovis AF2122/97
ucagcgucgacguc

SEQ ID NO: 1095850 - RNA, 21 nt, Mycobacterium bovis subsp bovis AF2122/97
ucagcgucgacgucagcacca

SEQ ID NO: 1095851 - RNA, 14 nt, Mycobacterium bovis subsp bovis AF2122/97
ucagcgucaggugc

SEQ ID NO: 1095852 - RNA, 17 nt, Mycobacterium bovis subsp bovis AF2122/97
ucagcgucggcgcauca

SEQ ID NO: 1095853 - RNA, 15 nt, Mycobacterium bovis subsp bovis AF2122/97
ucagcggcugggcgg

SEQ ID NO: 1095854 - RNA, 19 nt, Mycobacterium bovis subsp bovis AF2122/97
ucagcgggcacgccgccga

SEQ ID NO: 1095855 - RNA, 21 nt, Mycobacterium bovis subsp bovis AF2122/97
ucagcgggcacgccgccgacg

SEQ ID NO: 1095856 - RNA, 20 nt, Mycobacterium bovis subsp bovis AF2122/97
ucagcgggcagcaggcgaug

SEQ ID NO: 1095857 - RNA, 16 nt, Mycobacterium bovis subsp bovis AF2122/97
ucagcgggucgacccc

SEQ ID NO: 1095858 - RNA, 22 nt, Mycobacterium bovis subsp bovis AF2122/97
ucagcucggugaugucggugcg

SEQ ID NO: 1095859 - RNA, 22 nt, Mycobacterium bovis subsp bovis AF2122/97
ucagcucgucggcgauggccag

SEQ ID NO: 1095860 - RNA, 19 nt, Mycobacterium bovis subsp bovis AF2122/97
ucagcucggguugcgcgau

SEQ ID NO: 1095861 - RNA, 12 nt, Mycobacterium bovis subsp bovis AF2122/97
ucagcugcggau

SEQ ID NO: 1095862 - RNA, 20 nt, Mycobacterium bovis subsp bovis AF2122/97
ucagcugcucgucuuggcgg

SEQ ID NO: 1095863 - RNA, 13 nt, Mycobacterium bovis subsp bovis AF2122/97
ucagcuggccgcg

SEQ ID NO: 1095864 - RNA, 17 nt, Mycobacterium bovis subsp bovis AF2122/97
ucagcuggccgcggcga

SEQ ID NO: 1095865 - RNA, 22 nt, Mycobacterium bovis subsp bovis AF2122/97
ucagcugcggauuaagucggcg

SEQ ID NO: 1095866 - RNA, 21 nt, Mycobacterium bovis subsp bovis AF2122/97
ucagcuggccgcggcgaguac

SEQ ID NO: 1095867 - RNA, 17 nt, Mycobacterium bovis subsp bovis AF2122/97
ucagcugggacccgagc

SEQ ID NO: 1095868 - RNA, 16 nt, Mycobacterium bovis subsp bovis AF2122/97
ucagcguugaccgcau

SEQ ID NO: 1095869 - RNA, 21 nt, Mycobacterium bovis subsp bovis AF2122/97
ucagcgugaucugcagggcca

SEQ ID NO: 1095870 - RNA, 17 nt, Mycobacterium bovis subsp bovis AF2122/97
ucacgcugccccgccgc

SEQ ID NO: 1095871 - RNA, 20 nt, Mycobacterium bovis subsp bovis AF2122/97
ucacgcugccccgccgccau

SEQ ID NO: 1095872 - RNA, 14 nt, Mycobacterium bovis subsp bovis AF2122/97
ucacgcucgacgac

SEQ ID NO: 1095873 - RNA, 22 nt, Mycobacterium bovis subsp bovis AF2122/97
ucacgcguuccauggcccgcuc

SEQ ID NO: 1095874 - RNA, 13 nt, Mycobacterium bovis subsp bovis AF2122/97
ucacgccaccgca

SEQ ID NO: 1095875 - RNA, 21 nt, Mycobacterium bovis subsp bovis AF2122/97
ucacgccaccgcaacucgccg

SEQ ID NO: 1095876 - RNA, 23 nt, Mycobacterium bovis subsp bovis AF2122/97
ucacgccaccgcaacucgccgaa

SEQ ID NO: 1095877 - RNA, 21 nt, Mycobacterium bovis subsp bovis AF2122/97
ucacgccagucccacugggcc

SEQ ID NO: 1095878 - RNA, 23 nt, Mycobacterium bovis subsp bovis AF2122/97
ucacgcacugaugucacccgccc

SEQ ID NO: 1095879 - RNA, 16 nt, Mycobacterium bovis subsp bovis AF2122/97
ucacgcagccgcgcgg

SEQ ID NO: 1095880 - RNA, 13 nt, Mycobacterium bovis subsp bovis AF2122/97
ucacgcagucggg

SEQ ID NO: 1095881 - RNA, 15 nt, Mycobacterium bovis subsp bovis AF2122/97
ucacgcagucgggca

SEQ ID NO: 1095882 - RNA, 17 nt, Mycobacterium bovis subsp bovis AF2122/97
ucacguacgccgccgau

SEQ ID NO: 1095883 - RNA, 17 nt, Mycobacterium bovis subsp bovis AF2122/97
ucacguagcgaccgcgg

SEQ ID NO: 1095884 - RNA, 16 nt, Mycobacterium bovis subsp bovis AF2122/97
ucacgucgacggcggc

SEQ ID NO: 1095885 - RNA, 17 nt, Mycobacterium bovis subsp bovis AF2122/97
ucacgucgacggcggcc

SEQ ID NO: 1095886 - RNA, 21 nt, Mycobacterium bovis subsp bovis AF2122/97
ucacguccgcgggggaccgcc

SEQ ID NO: 1095887 - RNA, 20 nt, Mycobacterium bovis subsp bovis AF2122/97
ucacgucagcguugaccgca

SEQ ID NO: 1095888 - RNA, 13 nt, Mycobacterium bovis subsp bovis AF2122/97
ucacggaccaggc

SEQ ID NO: 1095889 - RNA, 13 nt, Mycobacterium bovis subsp bovis AF2122/97
ucacgcugugcgg

SEQ ID NO: 1095890 - RNA, 21 nt, Mycobacterium bovis subsp bovis AF2122/97
ucacggccgcauaaaacucgc

SEQ ID NO: 1095891 - RNA, 22 nt, Mycobacterium bovis subsp bovis AF2122/97
ucacgguucgcccgucgccaau

SEQ ID NO: 1095892 - RNA, 19 nt, Mycobacterium bovis subsp bovis AF2122/97
ucagaccaaugaccgccag

SEQ ID NO: 1095893 - RNA, 15 nt, Mycobacterium bovis subsp bovis AF2122/97
ucagacgacgaucgc

SEQ ID NO: 1095894 - RNA, 23 nt, Mycobacterium bovis subsp bovis AF2122/97
ucagacgacgaucgcgucgggcu

SEQ ID NO: 1095895 - RNA, 21 nt, Mycobacterium bovis subsp bovis AF2122/97
ucagacgacgaugaugccguc

SEQ ID NO: 1095896 - RNA, 22 nt, Mycobacterium bovis subsp bovis AF2122/97
ucagacgacgaugaugccgucg

SEQ ID NO: 1095897 - RNA, 18 nt, Mycobacterium bovis subsp bovis AF2122/97
ucagacggugaagccgag

SEQ ID NO: 1095898 - RNA, 21 nt, Mycobacterium bovis subsp bovis AF2122/97
ucagacggugaagccgagcgc

SEQ ID NO: 1095899 - RNA, 22 nt, Mycobacterium bovis subsp bovis AF2122/97
ucagacggugaagccgagcgcc

SEQ ID NO: 1095900 - RNA, 13 nt, Mycobacterium bovis subsp bovis AF2122/97
ucagacgauucgg

SEQ ID NO: 1095901 - RNA, 16 nt, Mycobacterium bovis subsp bovis AF2122/97
ucagacgauucggcgg

SEQ ID NO: 1095902 - RNA, 17 nt, Mycobacterium bovis subsp bovis AF2122/97
ucagacgauucggcggc

SEQ ID NO: 1095903 - RNA, 18 nt, Mycobacterium bovis subsp bovis AF2122/97
ucagcaacgucacgucga

SEQ ID NO: 1095904 - RNA, 18 nt, Mycobacterium bovis subsp bovis AF2122/97
ucagcaacaacgucugca

SEQ ID NO: 1095905 - RNA, 16 nt, Mycobacterium bovis subsp bovis AF2122/97
ucacugugccgcugca

SEQ ID NO: 1095906 - RNA, 17 nt, Mycobacterium bovis subsp bovis AF2122/97
ucacgucuaacacgcgg

SEQ ID NO: 1095907 - RNA, 19 nt, Mycobacterium bovis subsp bovis AF2122/97
ucacgugguccaaccgggc

SEQ ID NO: 1095908 - RNA, 14 nt, Mycobacterium bovis subsp bovis AF2122/97
ucacgugcccgcgc

SEQ ID NO: 1095909 - RNA, 22 nt, Mycobacterium bovis subsp bovis AF2122/97
ucacuucccggauagacggcga

SEQ ID NO: 1095910 - RNA, 15 nt, Mycobacterium bovis subsp bovis AF2122/97
ucaccgcagccaacg

SEQ ID NO: 1095911 - RNA, 13 nt, Mycobacterium bovis subsp bovis AF2122/97
ucaccgaccaacg

SEQ ID NO: 1095912 - RNA, 19 nt, Mycobacterium bovis subsp bovis AF2122/97
ucaccgccaccaccagggc

SEQ ID NO: 1095913 - RNA, 13 nt, Mycobacterium bovis subsp bovis AF2122/97
ucaccgccagccc

SEQ ID NO: 1095914 - RNA, 15 nt, Mycobacterium bovis subsp bovis AF2122/97
ucaccgagauggcga

SEQ ID NO: 1095915 - RNA, 17 nt, Mycobacterium bovis subsp bovis AF2122/97
ucaccgaucccgcggcc

SEQ ID NO: 1095916 - RNA, 17 nt, Mycobacterium bovis subsp bovis AF2122/97
ucaccgaucucgaccag

SEQ ID NO: 1095917 - RNA, 15 nt, Mycobacterium bovis subsp bovis AF2122/97
ucaccgaugcgccgg

SEQ ID NO: 1095918 - RNA, 16 nt, Mycobacterium bovis subsp bovis AF2122/97
ucaccgauucggccag

SEQ ID NO: 1095919 - RNA, 18 nt, Mycobacterium bovis subsp bovis AF2122/97
ucaccgauucggccagcg

SEQ ID NO: 1095920 - RNA, 20 nt, Mycobacterium bovis subsp bovis AF2122/97
ucaccgacgcacaggcgacg

SEQ ID NO: 1095921 - RNA, 18 nt, Mycobacterium bovis subsp bovis AF2122/97
ucaccuucuuggcgggug

SEQ ID NO: 1095922 - RNA, 18 nt, Mycobacterium bovis subsp bovis AF2122/97
ucaccgggcccgacgacg

SEQ ID NO: 1095923 - RNA, 20 nt, Mycobacterium bovis subsp bovis AF2122/97
ucaccuggcgugucgccgcc

SEQ ID NO: 1095924 - RNA, 15 nt, Mycobacterium bovis subsp bovis AF2122/97
ucaccugcugcaacc

SEQ ID NO: 1095925 - RNA, 20 nt, Mycobacterium bovis subsp bovis AF2122/97
ucaccggcuucggccagcag

SEQ ID NO: 1095926 - RNA, 14 nt, Mycobacterium bovis subsp bovis AF2122/97
ucaccggcgcgguu

SEQ ID NO: 1095927 - RNA, 22 nt, Mycobacterium bovis subsp bovis AF2122/97
ucaccggcaugcgugccggcag

SEQ ID NO: 1095928 - RNA, 11 nt, Mycobacterium bovis subsp bovis AF2122/97
ucaccggcaau

SEQ ID NO: 1095929 - RNA, 16 nt, Mycobacterium bovis subsp bovis AF2122/97
ucaccggagcgccgag

SEQ ID NO: 1095930 - RNA, 20 nt, Mycobacterium bovis subsp bovis AF2122/97
ucacgacccaagucgccgag

SEQ ID NO: 1095931 - RNA, 21 nt, Mycobacterium bovis subsp bovis AF2122/97
ucacgacccaagucgccgagg

SEQ ID NO: 1095932 - RNA, 22 nt, Mycobacterium bovis subsp bovis AF2122/97
ucacgaccgcgcaacaccucgu

SEQ ID NO: 1095933 - RNA, 23 nt, Mycobacterium bovis subsp bovis AF2122/97
ucacgagccaaggcuuccuccga

SEQ ID NO: 1095934 - RNA, 16 nt, Mycobacterium bovis subsp bovis AF2122/97
ucacgcacccggcgca

SEQ ID NO: 1095935 - RNA, 11 nt, Mycobacterium bovis subsp bovis AF2122/97
ucacgcaccgc

SEQ ID NO: 1095936 - RNA, 15 nt, Mycobacterium bovis subsp bovis AF2122/97
ucacgcacgccgcgu

SEQ ID NO: 1095937 - RNA, 13 nt, Mycobacterium bovis subsp bovis AF2122/97
ucacgcaccgcgg

SEQ ID NO: 1095938 - RNA, 13 nt, Mycobacterium bovis subsp bovis AF2122/97
ucacgacgccgag

SEQ ID NO: 1095939 - RNA, 17 nt, Mycobacterium bovis subsp bovis AF2122/97
ucacgaucgugccggga

SEQ ID NO: 1095940 - RNA, 15 nt, Mycobacterium bovis subsp bovis AF2122/97
ucacgaugcucgccg

SEQ ID NO: 1095941 - RNA, 14 nt, Mycobacterium bovis subsp bovis AF2122/97
uccaaaacaccgcc

SEQ ID NO: 1095942 - RNA, 12 nt, Mycobacterium bovis subsp bovis AF2122/97
ucauugcccuug

SEQ ID NO: 1095943 - RNA, 20 nt, Mycobacterium bovis subsp bovis AF2122/97
uccaaacccgguguuccggu

SEQ ID NO: 1095944 - RNA, 22 nt, Mycobacterium bovis subsp bovis AF2122/97
uccaacgcacacaccguaccga

SEQ ID NO: 1095945 - RNA, 14 nt, Mycobacterium bovis subsp bovis AF2122/97
uccaacacuggggc

SEQ ID NO: 1095946 - RNA, 17 nt, Mycobacterium bovis subsp bovis AF2122/97
uccaacaggccggugug

SEQ ID NO: 1095947 - RNA, 20 nt, Mycobacterium bovis subsp bovis AF2122/97
ucaugggcgccaucccgccg

SEQ ID NO: 1095948 - RNA, 22 nt, Mycobacterium bovis subsp bovis AF2122/97
ucaugggaucaggcugggcaga

SEQ ID NO: 1095949 - RNA, 12 nt, Mycobacterium bovis subsp bovis AF2122/97
ucaugggcgcgu

SEQ ID NO: 1095950 - RNA, 20 nt, Mycobacterium bovis subsp bovis AF2122/97
ucauggggcuauggcgcagc

SEQ ID NO: 1095951 - RNA, 22 nt, Mycobacterium bovis subsp bovis AF2122/97
ucauggugaaggcaaacaccag

SEQ ID NO: 1095952 - RNA, 13 nt, Mycobacterium bovis subsp bovis AF2122/97
ucaugucggccac

SEQ ID NO: 1095953 - RNA, 21 nt, Mycobacterium bovis subsp bovis AF2122/97
ucaugucgaucagcgcgacgg

SEQ ID NO: 1095954 - RNA, 19 nt, Mycobacterium bovis subsp bovis AF2122/97
ucauguccauagccggcau

SEQ ID NO: 1095955 - RNA, 14 nt, Mycobacterium bovis subsp bovis AF2122/97
ucauguccgccgug

SEQ ID NO: 1095956 - RNA, 15 nt, Mycobacterium bovis subsp bovis AF2122/97
ucauccacaccggau

SEQ ID NO: 1095957 - RNA, 13 nt, Mycobacterium bovis subsp bovis AF2122/97
ucaucauggccgg

SEQ ID NO: 1095958 - RNA, 23 nt, Mycobacterium bovis subsp bovis AF2122/97
ucaucggccgcggucggccacca

SEQ ID NO: 1095959 - RNA, 15 nt, Mycobacterium bovis subsp bovis AF2122/97
ucaucggcuggccgc

SEQ ID NO: 1095960 - RNA, 16 nt, Mycobacterium bovis subsp bovis AF2122/97
ucaucgggagccgcac

SEQ ID NO: 1095961 - RNA, 13 nt, Mycobacterium bovis subsp bovis AF2122/97
ucaucgggccaca

SEQ ID NO: 1095962 - RNA, 14 nt, Mycobacterium bovis subsp bovis AF2122/97
ucaugaacgaucgg

SEQ ID NO: 1095963 - RNA, 14 nt, Mycobacterium bovis subsp bovis AF2122/97
ucaugaccaucgag

SEQ ID NO: 1095964 - RNA, 21 nt, Mycobacterium bovis subsp bovis AF2122/97
ucaugccagccgucaccgcga

SEQ ID NO: 1095965 - RNA, 19 nt, Mycobacterium bovis subsp bovis AF2122/97
ucaugccauagaugcccgc

SEQ ID NO: 1095966 - RNA, 23 nt, Mycobacterium bovis subsp bovis AF2122/97
ucaugcccgacgagucgccgcgg

SEQ ID NO: 1095967 - RNA, 16 nt, Mycobacterium bovis subsp bovis AF2122/97
ucaucaggucgucguc

SEQ ID NO: 1095968 - RNA, 15 nt, Mycobacterium bovis subsp bovis AF2122/97
ucaucacgccgccgg

SEQ ID NO: 1095969 - RNA, 17 nt, Mycobacterium bovis subsp bovis AF2122/97
ucaguuugacgccgaug

SEQ ID NO: 1095970 - RNA, 14 nt, Mycobacterium bovis subsp bovis AF2122/97
ucaguuccaccgcg

SEQ ID NO: 1095971 - RNA, 15 nt, Mycobacterium bovis subsp bovis AF2122/97
ucaguucccgaaccc

SEQ ID NO: 1095972 - RNA, 14 nt, Mycobacterium bovis subsp bovis AF2122/97
ucaguucacgcucg

SEQ ID NO: 1095973 - RNA, 12 nt, Mycobacterium bovis subsp bovis AF2122/97
ucaggccgcgcg

SEQ ID NO: 1095974 - RNA, 13 nt, Mycobacterium bovis subsp bovis AF2122/97
ucaggccgcgcgg

SEQ ID NO: 1095975 - RNA, 18 nt, Mycobacterium bovis subsp bovis AF2122/97
ucagguacggcgggcggc

SEQ ID NO: 1095976 - RNA, 17 nt, Mycobacterium bovis subsp bovis AF2122/97
ucagguagcggcccuuc

SEQ ID NO: 1095977 - RNA, 23 nt, Mycobacterium bovis subsp bovis AF2122/97
ucagguagcggcccuucgacgag

SEQ ID NO: 1095978 - RNA, 15 nt, Mycobacterium bovis subsp bovis AF2122/97
ucaggucuggcgcgg

SEQ ID NO: 1095979 - RNA, 20 nt, Mycobacterium bovis subsp bovis AF2122/97
ucaggugauucgcgcagcgc

SEQ ID NO: 1095980 - RNA, 23 nt, Mycobacterium bovis subsp bovis AF2122/97
ucagguccuaggugugcgacgac

SEQ ID NO: 1095981 - RNA, 17 nt, Mycobacterium bovis subsp bovis AF2122/97
ucaggucaccggccgcc

SEQ ID NO: 1095982 - RNA, 23 nt, Mycobacterium bovis subsp bovis AF2122/97
ucaguccggcccccgacuccggc

SEQ ID NO: 1095983 - RNA, 13 nt, Mycobacterium bovis subsp bovis AF2122/97
ucaggucgccgag

SEQ ID NO: 1095984 - RNA, 22 nt, Mycobacterium bovis subsp bovis AF2122/97
ucagugaccuguugaacggccg

SEQ ID NO: 1095985 - RNA, 20 nt, Mycobacterium bovis subsp bovis AF2122/97
ucagugcaagaccgcaucgg

SEQ ID NO: 1095986 - RNA, 16 nt, Mycobacterium bovis subsp bovis AF2122/97
ucagugaucaccaacc

SEQ ID NO: 1095987 - RNA, 18 nt, Mycobacterium bovis subsp bovis AF2122/97
ucagugaucaccaacccg

SEQ ID NO: 1095988 - RNA, 18 nt, Mycobacterium bovis subsp bovis AF2122/97
uccacgccgugcuugcga

SEQ ID NO: 1095989 - RNA, 14 nt, Mycobacterium bovis subsp bovis AF2122/97
uccacgcguugacg

SEQ ID NO: 1095990 - RNA, 14 nt, Mycobacterium bovis subsp bovis AF2122/97
uccacggagucaac

SEQ ID NO: 1095991 - RNA, 18 nt, Mycobacterium bovis subsp bovis AF2122/97
uccacgguugccggcggc

SEQ ID NO: 1095992 - RNA, 20 nt, Mycobacterium bovis subsp bovis AF2122/97
uccacgguugccggcggcga

SEQ ID NO: 1095993 - RNA, 14 nt, Mycobacterium bovis subsp bovis AF2122/97
uccacggucgacca

SEQ ID NO: 1095994 - RNA, 15 nt, Mycobacterium bovis subsp bovis AF2122/97
uccacggcggugccg

SEQ ID NO: 1095995 - RNA, 17 nt, Mycobacterium bovis subsp bovis AF2122/97
uccacgucaucuggcgc

SEQ ID NO: 1095996 - RNA, 13 nt, Mycobacterium bovis subsp bovis AF2122/97
uccacggucggga

SEQ ID NO: 1095997 - RNA, 22 nt, Mycobacterium bovis subsp bovis AF2122/97
uccacgguugccggcggcgacg

SEQ ID NO: 1095998 - RNA, 17 nt, Mycobacterium bovis subsp bovis AF2122/97
uccacguucggcugcga

SEQ ID NO: 1095999 - RNA, 18 nt, Mycobacterium bovis subsp bovis AF2122/97
uccacuccagcgaaccga

SEQ ID NO: 1096000 - RNA, 15 nt, Mycobacterium bovis subsp bovis AF2122/97
uccacuccgccaaca

SEQ ID NO: 1096001 - RNA, 16 nt, Mycobacterium bovis subsp bovis AF2122/97
uccagauggggcucga

SEQ ID NO: 1096002 - RNA, 13 nt, Mycobacterium bovis subsp bovis AF2122/97
uccagauguccga

SEQ ID NO: 1096003 - RNA, 23 nt, Mycobacterium bovis subsp bovis AF2122/97
uccagcaccagcacggcaaccag

SEQ ID NO: 1096004 - RNA, 15 nt, Mycobacterium bovis subsp bovis AF2122/97
uccacugccaccgcg

SEQ ID NO: 1096005 - RNA, 19 nt, Mycobacterium bovis subsp bovis AF2122/97
uccacuucagaucggcgaa

SEQ ID NO: 1096006 - RNA, 18 nt, Mycobacterium bovis subsp bovis AF2122/97
uccaccgcgccggcggca

SEQ ID NO: 1096007 - RNA, 23 nt, Mycobacterium bovis subsp bovis AF2122/97
uccaccgccgagaugcuggucgg

SEQ ID NO: 1096008 - RNA, 24 nt, Mycobacterium bovis subsp bovis AF2122/97
uccaccgccgagaugcuggucggc

SEQ ID NO: 1096009 - RNA, 18 nt, Mycobacterium bovis subsp bovis AF2122/97
uccaccgauucggcgacg

SEQ ID NO: 1096010 - RNA, 18 nt, Mycobacterium bovis subsp bovis AF2122/97
uccaccgcagauccccgc

SEQ ID NO: 1096011 - RNA, 22 nt, Mycobacterium bovis subsp bovis AF2122/97
uccaccgacguggccagcccgc

SEQ ID NO: 1096012 - RNA, 20 nt, Mycobacterium bovis subsp bovis AF2122/97
uccaccgggcccgccggccc

SEQ ID NO: 1096013 - RNA, 19 nt, Mycobacterium bovis subsp bovis AF2122/97
uccacgccggcaucgucga

SEQ ID NO: 1096014 - RNA, 21 nt, Mycobacterium bovis subsp bovis AF2122/97
uccacgccgaccaucucaccg

SEQ ID NO: 1096015 - RNA, 16 nt, Mycobacterium bovis subsp bovis AF2122/97
uccaccgucacggucg

SEQ ID NO: 1096016 - RNA, 18 nt, Mycobacterium bovis subsp bovis AF2122/97
uccaacuacgccagccgc

SEQ ID NO: 1096017 - RNA, 22 nt, Mycobacterium bovis subsp bovis AF2122/97
uccaacugaucccguagccgug

SEQ ID NO: 1096018 - RNA, 20 nt, Mycobacterium bovis subsp bovis AF2122/97
uccacaccaggccgagccgc

SEQ ID NO: 1096019 - RNA, 17 nt, Mycobacterium bovis subsp bovis AF2122/97
uccacaccgcggcggcg

SEQ ID NO: 1096020 - RNA, 19 nt, Mycobacterium bovis subsp bovis AF2122/97
uccacaauccgcucggucg

SEQ ID NO: 1096021 - RNA, 19 nt, Mycobacterium bovis subsp bovis AF2122/97
uccaagauguccgguccgc

SEQ ID NO: 1096022 - RNA, 15 nt, Mycobacterium bovis subsp bovis AF2122/97
uccaccaccgucgag

SEQ ID NO: 1096023 - RNA, 14 nt, Mycobacterium bovis subsp bovis AF2122/97
uccaccaccggcac

SEQ ID NO: 1096024 - RNA, 16 nt, Mycobacterium bovis subsp bovis AF2122/97
uccacagccggcggcu

SEQ ID NO: 1096025 - RNA, 12 nt, Mycobacterium bovis subsp bovis AF2122/97
uccacagcggcc

SEQ ID NO: 1096026 - RNA, 20 nt, Mycobacterium bovis subsp bovis AF2122/97
uccaccaagcucgcaaccga

SEQ ID NO: 1096027 - RNA, 22 nt, Mycobacterium bovis subsp bovis AF2122/97
uccagggugccggucacgucga

SEQ ID NO: 1096028 - RNA, 21 nt, Mycobacterium bovis subsp bovis AF2122/97
uccaggucgccuucccagccg

SEQ ID NO: 1096029 - RNA, 13 nt, Mycobacterium bovis subsp bovis AF2122/97
uccaggucggccg

SEQ ID NO: 1096030 - RNA, 19 nt, Mycobacterium bovis subsp bovis AF2122/97
uccaggcgcgcaccaccgc

SEQ ID NO: 1096031 - RNA, 16 nt, Mycobacterium bovis subsp bovis AF2122/97
uccaggcgcugcagca

SEQ ID NO: 1096032 - RNA, 21 nt, Mycobacterium bovis subsp bovis AF2122/97
uccaggcgcugcagcauggcu

SEQ ID NO: 1096033 - RNA, 16 nt, Mycobacterium bovis subsp bovis AF2122/97
uccaggcgagugaacu

SEQ ID NO: 1096034 - RNA, 22 nt, Mycobacterium bovis subsp bovis AF2122/97
uccaggccgucguugccggcga

SEQ ID NO: 1096035 - RNA, 17 nt, Mycobacterium bovis subsp bovis AF2122/97
uccaggcuguggccagc

SEQ ID NO: 1096036 - RNA, 15 nt, Mycobacterium bovis subsp bovis AF2122/97
uccaucgccaccgcg

SEQ ID NO: 1096037 - RNA, 21 nt, Mycobacterium bovis subsp bovis AF2122/97
uccaucccgagcuccgcggcg

SEQ ID NO: 1096038 - RNA, 13 nt, Mycobacterium bovis subsp bovis AF2122/97
uccaucagcgcga

SEQ ID NO: 1096039 - RNA, 15 nt, Mycobacterium bovis subsp bovis AF2122/97
uccagguuccagguc

SEQ ID NO: 1096040 - RNA, 17 nt, Mycobacterium bovis subsp bovis AF2122/97
uccagguggucaucgcc

SEQ ID NO: 1096041 - RNA, 14 nt, Mycobacterium bovis subsp bovis AF2122/97
uccaucgcgcaccg

SEQ ID NO: 1096042 - RNA, 18 nt, Mycobacterium bovis subsp bovis AF2122/97
uccaugacaaaccugcau

SEQ ID NO: 1096043 - RNA, 16 nt, Mycobacterium bovis subsp bovis AF2122/97
uccaucgucugguggc

SEQ ID NO: 1096044 - RNA, 13 nt, Mycobacterium bovis subsp bovis AF2122/97
uccagcggccgcc

SEQ ID NO: 1096045 - RNA, 14 nt, Mycobacterium bovis subsp bovis AF2122/97
uccagcggccgccg

SEQ ID NO: 1096046 - RNA, 15 nt, Mycobacterium bovis subsp bovis AF2122/97
uccagcccgagcaga

SEQ ID NO: 1096047 - RNA, 14 nt, Mycobacterium bovis subsp bovis AF2122/97
uccagcccagaucc

SEQ ID NO: 1096048 - RNA, 19 nt, Mycobacterium bovis subsp bovis AF2122/97
uccagccaggcgauugccc

SEQ ID NO: 1096049 - RNA, 17 nt, Mycobacterium bovis subsp bovis AF2122/97
uccagccaccgaccccg

SEQ ID NO: 1096050 - RNA, 21 nt, Mycobacterium bovis subsp bovis AF2122/97
uccagcacccgcgcgacgccg

SEQ ID NO: 1096051 - RNA, 13 nt, Mycobacterium bovis subsp bovis AF2122/97
uccagcacccgcu

SEQ ID NO: 1096052 - RNA, 22 nt, Mycobacterium bovis subsp bovis AF2122/97
uccagcaucaguuugacgccga

SEQ ID NO: 1096053 - RNA, 14 nt, Mycobacterium bovis subsp bovis AF2122/97
uccagcaugggcga

SEQ ID NO: 1096054 - RNA, 20 nt, Mycobacterium bovis subsp bovis AF2122/97
uccagcaguacaccgcccgg

SEQ ID NO: 1096055 - RNA, 13 nt, Mycobacterium bovis subsp bovis AF2122/97
uccagcgugucgu

SEQ ID NO: 1096056 - RNA, 18 nt, Mycobacterium bovis subsp bovis AF2122/97
uccaggcccuggccagcc

SEQ ID NO: 1096057 - RNA, 20 nt, Mycobacterium bovis subsp bovis AF2122/97
uccaggccagggcgguggcc

SEQ ID NO: 1096058 - RNA, 18 nt, Mycobacterium bovis subsp bovis AF2122/97
uccagcguuugcuggcgg

SEQ ID NO: 1096059 - RNA, 12 nt, Mycobacterium bovis subsp bovis AF2122/97
ucccugggcguc

SEQ ID NO: 1096060 - RNA, 17 nt, Mycobacterium bovis subsp bovis AF2122/97
ucccugggcgucgacca

SEQ ID NO: 1096061 - RNA, 15 nt, Mycobacterium bovis subsp bovis AF2122/97
ucccuggggccgucc

SEQ ID NO: 1096062 - RNA, 22 nt, Mycobacterium bovis subsp bovis AF2122/97
ucccuccgacuaacggugcggu

SEQ ID NO: 1096063 - RNA, 16 nt, Mycobacterium bovis subsp bovis AF2122/97
ucccugcacccagccg

SEQ ID NO: 1096064 - RNA, 19 nt, Mycobacterium bovis subsp bovis AF2122/97
ucccugaucaaggaccgcu

SEQ ID NO: 1096065 - RNA, 13 nt, Mycobacterium bovis subsp bovis AF2122/97
ucccuggccgccg

SEQ ID NO: 1096066 - RNA, 15 nt, Mycobacterium bovis subsp bovis AF2122/97
uccgaaagccgccga

SEQ ID NO: 1096067 - RNA, 19 nt, Mycobacterium bovis subsp bovis AF2122/97
uccgacgggccgucgccgu

SEQ ID NO: 1096068 - RNA, 19 nt, Mycobacterium bovis subsp bovis AF2122/97
uccgacgguguagccgccg

SEQ ID NO: 1096069 - RNA, 14 nt, Mycobacterium bovis subsp bovis AF2122/97
uccgacgucgacga

SEQ ID NO: 1096070 - RNA, 20 nt, Mycobacterium bovis subsp bovis AF2122/97
uccgacggcggauaaccggc

SEQ ID NO: 1096071 - RNA, 13 nt, Mycobacterium bovis subsp bovis AF2122/97
uccgacggccgcg

SEQ ID NO: 1096072 - RNA, 15 nt, Mycobacterium bovis subsp bovis AF2122/97
uccgagaccaugccg

SEQ ID NO: 1096073 - RNA, 20 nt, Mycobacterium bovis subsp bovis AF2122/97
uccgaagagccagcaacggu

SEQ ID NO: 1096074 - RNA, 16 nt, Mycobacterium bovis subsp bovis AF2122/97
uccgaacauggccagc

SEQ ID NO: 1096075 - RNA, 15 nt, Mycobacterium bovis subsp bovis AF2122/97
uccgaacucgcgggc

SEQ ID NO: 1096076 - RNA, 15 nt, Mycobacterium bovis subsp bovis AF2122/97
uccgaagagccagca

SEQ ID NO: 1096077 - RNA, 14 nt, Mycobacterium bovis subsp bovis AF2122/97
uccgacuggccccg

SEQ ID NO: 1096078 - RNA, 20 nt, Mycobacterium bovis subsp bovis AF2122/97
uccgacuggccccgccagcg

SEQ ID NO: 1096079 - RNA, 13 nt, Mycobacterium bovis subsp bovis AF2122/97
uccgagccgcgau

SEQ ID NO: 1096080 - RNA, 18 nt, Mycobacterium bovis subsp bovis AF2122/97
uccgagcuuggccgccgc

SEQ ID NO: 1096081 - RNA, 22 nt, Mycobacterium bovis subsp bovis AF2122/97
uccgaggagggccgcgaucgac

SEQ ID NO: 1096082 - RNA, 15 nt, Mycobacterium bovis subsp bovis AF2122/97
uccgagcgcggcggc

SEQ ID NO: 1096083 - RNA, 19 nt, Mycobacterium bovis subsp bovis AF2122/97
uccgagggcgucgccgccg

SEQ ID NO: 1096084 - RNA, 15 nt, Mycobacterium bovis subsp bovis AF2122/97
uccgagggugcguug

SEQ ID NO: 1096085 - RNA, 20 nt, Mycobacterium bovis subsp bovis AF2122/97
uccgcccucaguucacguuc

SEQ ID NO: 1096086 - RNA, 23 nt, Mycobacterium bovis subsp bovis AF2122/97
uccgcccagcgaggugggcguca

SEQ ID NO: 1096087 - RNA, 21 nt, Mycobacterium bovis subsp bovis AF2122/97
uccgcagugagcaaugccaac

SEQ ID NO: 1096088 - RNA, 16 nt, Mycobacterium bovis subsp bovis AF2122/97
uccgcacagcgacgag

SEQ ID NO: 1096089 - RNA, 17 nt, Mycobacterium bovis subsp bovis AF2122/97
uccgcacagcgacgaga

SEQ ID NO: 1096090 - RNA, 20 nt, Mycobacterium bovis subsp bovis AF2122/97
uccgcaccccauacucggcg

SEQ ID NO: 1096091 - RNA, 22 nt, Mycobacterium bovis subsp bovis AF2122/97
uccgcacucugaugucgggaag

SEQ ID NO: 1096092 - RNA, 22 nt, Mycobacterium bovis subsp bovis AF2122/97
uccgcacugugcccucaacguc

SEQ ID NO: 1096093 - RNA, 14 nt, Mycobacterium bovis subsp bovis AF2122/97
uccgccgcccccgc

SEQ ID NO: 1096094 - RNA, 18 nt, Mycobacterium bovis subsp bovis AF2122/97
uccgccgauagcaccgga

SEQ ID NO: 1096095 - RNA, 16 nt, Mycobacterium bovis subsp bovis AF2122/97
uccgccgccgccgggu

SEQ ID NO: 1096096 - RNA, 22 nt, Mycobacterium bovis subsp bovis AF2122/97
uccgcgaagugcuugggccgcu

SEQ ID NO: 1096097 - RNA, 20 nt, Mycobacterium bovis subsp bovis AF2122/97
uccgcgaaucaacaggaccg

SEQ ID NO: 1096098 - RNA, 16 nt, Mycobacterium bovis subsp bovis AF2122/97
uccgcgaucugcagcg

SEQ ID NO: 1096099 - RNA, 13 nt, Mycobacterium bovis subsp bovis AF2122/97
uccgcgacggcgg

SEQ ID NO: 1096100 - RNA, 22 nt, Mycobacterium bovis subsp bovis AF2122/97
uccgcgacggcggcucccgggg

SEQ ID NO: 1096101 - RNA, 21 nt, Mycobacterium bovis subsp bovis AF2122/97
uccgcgacgcucgcugcagca

SEQ ID NO: 1096102 - RNA, 13 nt, Mycobacterium bovis subsp bovis AF2122/97
ucccggcgaccgg

SEQ ID NO: 1096103 - RNA, 21 nt, Mycobacterium bovis subsp bovis AF2122/97
ucccggccauagcccgagcgc

SEQ ID NO: 1096104 - RNA, 21 nt, Mycobacterium bovis subsp bovis AF2122/97
ucccggccgggucuuccggug

SEQ ID NO: 1096105 - RNA, 18 nt, Mycobacterium bovis subsp bovis AF2122/97
ucccggcgagcacccgcu

SEQ ID NO: 1096106 - RNA, 23 nt, Mycobacterium bovis subsp bovis AF2122/97
ucccggcucgagcucggcgaugc

SEQ ID NO: 1096107 - RNA, 14 nt, Mycobacterium bovis subsp bovis AF2122/97
ucccggcucggcca

SEQ ID NO: 1096108 - RNA, 15 nt, Mycobacterium bovis subsp bovis AF2122/97
ucccggcucggccag

SEQ ID NO: 1096109 - RNA, 18 nt, Mycobacterium bovis subsp bovis AF2122/97
ucccggcucggccagcca

SEQ ID NO: 1096110 - RNA, 13 nt, Mycobacterium bovis subsp bovis AF2122/97
ucccgcgccggcg

SEQ ID NO: 1096111 - RNA, 14 nt, Mycobacterium bovis subsp bovis AF2122/97
ucccgcgccggcgu

SEQ ID NO: 1096112 - RNA, 15 nt, Mycobacterium bovis subsp bovis AF2122/97
ucccgccuucucccg

SEQ ID NO: 1096113 - RNA, 13 nt, Mycobacterium bovis subsp bovis AF2122/97
ucccgcgaucgcg

SEQ ID NO: 1096114 - RNA, 14 nt, Mycobacterium bovis subsp bovis AF2122/97
ucccgcgcgagccg

SEQ ID NO: 1096115 - RNA, 23 nt, Mycobacterium bovis subsp bovis AF2122/97
ucccggcagcuggucggugggcu

SEQ ID NO: 1096116 - RNA, 14 nt, Mycobacterium bovis subsp bovis AF2122/97
ucccggccaggccg

SEQ ID NO: 1096117 - RNA, 20 nt, Mycobacterium bovis subsp bovis AF2122/97
ucccgucccagcugaccagc

SEQ ID NO: 1096118 - RNA, 17 nt, Mycobacterium bovis subsp bovis AF2122/97
ucccguauucgaugccg

SEQ ID NO: 1096119 - RNA, 22 nt, Mycobacterium bovis subsp bovis AF2122/97
ucccgucgggcacaccgacgcc

SEQ ID NO: 1096120 - RNA, 11 nt, Mycobacterium bovis subsp bovis AF2122/97
ucccgucgccg

SEQ ID NO: 1096121 - RNA, 13 nt, Mycobacterium bovis subsp bovis AF2122/97
ucccgucgccgcc

SEQ ID NO: 1096122 - RNA, 20 nt, Mycobacterium bovis subsp bovis AF2122/97
ucccgucucgacaguggcga

SEQ ID NO: 1096123 - RNA, 21 nt, Mycobacterium bovis subsp bovis AF2122/97
ucccgucucgacaguggcgac

SEQ ID NO: 1096124 - RNA, 15 nt, Mycobacterium bovis subsp bovis AF2122/97
ucccguucgcccgcc

SEQ ID NO: 1096125 - RNA, 16 nt, Mycobacterium bovis subsp bovis AF2122/97
ucccguucgcccgccc

SEQ ID NO: 1096126 - RNA, 18 nt, Mycobacterium bovis subsp bovis AF2122/97
ucccguucgcccgcccgu

SEQ ID NO: 1096127 - RNA, 16 nt, Mycobacterium bovis subsp bovis AF2122/97
ucccguugccgcccac

SEQ ID NO: 1096128 - RNA, 24 nt, Mycobacterium bovis subsp bovis AF2122/97
ucccucgccaaccagucgcacgac

SEQ ID NO: 1096129 - RNA, 17 nt, Mycobacterium bovis subsp bovis AF2122/97
ucccuauugcugcggug

SEQ ID NO: 1096130 - RNA, 17 nt, Mycobacterium bovis subsp bovis AF2122/97
ucccugaaauaccaguc

SEQ ID NO: 1096131 - RNA, 19 nt, Mycobacterium bovis subsp bovis AF2122/97
ucccgccgaucgaaccgcu

SEQ ID NO: 1096132 - RNA, 13 nt, Mycobacterium bovis subsp bovis AF2122/97
ucccgcccagcag

SEQ ID NO: 1096133 - RNA, 14 nt, Mycobacterium bovis subsp bovis AF2122/97
ucccgcccagcagc

SEQ ID NO: 1096134 - RNA, 13 nt, Mycobacterium bovis subsp bovis AF2122/97
ucccgcacggccg

SEQ ID NO: 1096135 - RNA, 20 nt, Mycobacterium bovis subsp bovis AF2122/97
ucccgccacaccaacgucga

SEQ ID NO: 1096136 - RNA, 14 nt, Mycobacterium bovis subsp bovis AF2122/97
ucccgccacgucgc

SEQ ID NO: 1096137 - RNA, 13 nt, Mycobacterium bovis subsp bovis AF2122/97
ucccgccgcaccg

SEQ ID NO: 1096138 - RNA, 15 nt, Mycobacterium bovis subsp bovis AF2122/97
ucccgccgcaccgcc

SEQ ID NO: 1096139 - RNA, 19 nt, Mycobacterium bovis subsp bovis AF2122/97
ucccgccgcaccgccgcau

SEQ ID NO: 1096140 - RNA, 15 nt, Mycobacterium bovis subsp bovis AF2122/97
ucccgccgcccgcau

SEQ ID NO: 1096141 - RNA, 20 nt, Mycobacterium bovis subsp bovis AF2122/97
ucccgccgcugccgccggug

SEQ ID NO: 1096142 - RNA, 11 nt, Mycobacterium bovis subsp bovis AF2122/97
ucccgccgggu

SEQ ID NO: 1096143 - RNA, 17 nt, Mycobacterium bovis subsp bovis AF2122/97
ucccgccggcuccgcca

SEQ ID NO: 1096144 - RNA, 15 nt, Mycobacterium bovis subsp bovis AF2122/97
ucccgccggucacga

SEQ ID NO: 1096145 - RNA, 22 nt, Mycobacterium bovis subsp bovis AF2122/97
ucccgccggucacgacguccga

SEQ ID NO: 1096146 - RNA, 19 nt, Mycobacterium bovis subsp bovis AF2122/97
ucccgccggugugcccgcc

SEQ ID NO: 1096147 - RNA, 19 nt, Mycobacterium bovis subsp bovis AF2122/97
ucccgccgugccgcggcga

SEQ ID NO: 1096148 - RNA, 21 nt, Mycobacterium bovis subsp bovis AF2122/97
ucccgccgugccgcggcgacg

SEQ ID NO: 1096149 - RNA, 23 nt, Mycobacterium bovis subsp bovis AF2122/97
ucccgccguugccgccgucaccg

SEQ ID NO: 1096150 - RNA, 23 nt, Mycobacterium bovis subsp bovis AF2122/97
uccauguuuugcugcaugccgac

SEQ ID NO: 1096151 - RNA, 12 nt, Mycobacterium bovis subsp bovis AF2122/97
uccauggcgugc

SEQ ID NO: 1096152 - RNA, 23 nt, Mycobacterium bovis subsp bovis AF2122/97
ucccgcaacauuuucgcccgcuc

SEQ ID NO: 1096153 - RNA, 19 nt, Mycobacterium bovis subsp bovis AF2122/97
ucccgcacaagcccagccc

SEQ ID NO: 1096154 - RNA, 16 nt, Mycobacterium bovis subsp bovis AF2122/97
uccgguccagcggccg

SEQ ID NO: 1096155 - RNA, 17 nt, Mycobacterium bovis subsp bovis AF2122/97
uccgguccagcggccgc

SEQ ID NO: 1096156 - RNA, 21 nt, Mycobacterium bovis subsp bovis AF2122/97
uccgguccagcggccgccgcg

SEQ ID NO: 1096157 - RNA, 22 nt, Mycobacterium bovis subsp bovis AF2122/97
uccgguccagcggccgccgcgg

SEQ ID NO: 1096158 - RNA, 13 nt, Mycobacterium bovis subsp bovis AF2122/97
uccggucccgccg

SEQ ID NO: 1096159 - RNA, 20 nt, Mycobacterium bovis subsp bovis AF2122/97
uccggucccgccgugccgcg

SEQ ID NO: 1096160 - RNA, 16 nt, Mycobacterium bovis subsp bovis AF2122/97
uccgguccgccagcgc

SEQ ID NO: 1096161 - RNA, 22 nt, Mycobacterium bovis subsp bovis AF2122/97
uccggucgccucaccggcgcga

SEQ ID NO: 1096162 - RNA, 15 nt, Mycobacterium bovis subsp bovis AF2122/97
uccgguucaucggca

SEQ ID NO: 1096163 - RNA, 16 nt, Mycobacterium bovis subsp bovis AF2122/97
uccgguucaucggcau

SEQ ID NO: 1096164 - RNA, 12 nt, Mycobacterium bovis subsp bovis AF2122/97
uccgguucgccg

SEQ ID NO: 1096165 - RNA, 15 nt, Mycobacterium bovis subsp bovis AF2122/97
uccgguucgccgccg

SEQ ID NO: 1096166 - RNA, 21 nt, Mycobacterium bovis subsp bovis AF2122/97
uccgguggcuggccgccaccg

SEQ ID NO: 1096167 - RNA, 18 nt, Mycobacterium bovis subsp bovis AF2122/97
uccgguguugagaucgcc

SEQ ID NO: 1096168 - RNA, 14 nt, Mycobacterium bovis subsp bovis AF2122/97
uccgguuacgcucg

SEQ ID NO: 1096169 - RNA, 23 nt, Mycobacterium bovis subsp bovis AF2122/97
uccgguggccaacaccgccagca

SEQ ID NO: 1096170 - RNA, 19 nt, Mycobacterium bovis subsp bovis AF2122/97
uccggugcugguccagccg

SEQ ID NO: 1096171 - RNA, 21 nt, Mycobacterium bovis subsp bovis AF2122/97
uccgguggaauccaccagccg

SEQ ID NO: 1096172 - RNA, 19 nt, Mycobacterium bovis subsp bovis AF2122/97
uccgguggacgaucuggca

SEQ ID NO: 1096173 - RNA, 18 nt, Mycobacterium bovis subsp bovis AF2122/97
uccggugccgcgaucgcg

SEQ ID NO: 1096174 - RNA, 17 nt, Mycobacterium bovis subsp bovis AF2122/97
uccggugcgccgauccc

SEQ ID NO: 1096175 - RNA, 12 nt, Mycobacterium bovis subsp bovis AF2122/97
uccgugagcagu

SEQ ID NO: 1096176 - RNA, 18 nt, Mycobacterium bovis subsp bovis AF2122/97
uccgugagccggaccggc

SEQ ID NO: 1096177 - RNA, 21 nt, Mycobacterium bovis subsp bovis AF2122/97
uccgugaaucgagcaccgcaa

SEQ ID NO: 1096178 - RNA, 17 nt, Mycobacterium bovis subsp bovis AF2122/97
uccgugccagcugccga

SEQ ID NO: 1096179 - RNA, 15 nt, Mycobacterium bovis subsp bovis AF2122/97
uccgugccgaugccg

SEQ ID NO: 1096180 - RNA, 17 nt, Mycobacterium bovis subsp bovis AF2122/97
uccgugccgaugccggc

SEQ ID NO: 1096181 - RNA, 22 nt, Mycobacterium bovis subsp bovis AF2122/97
uccgucgcggccgagacggcgu

SEQ ID NO: 1096182 - RNA, 16 nt, Mycobacterium bovis subsp bovis AF2122/97
uccguccccgcagcgc

SEQ ID NO: 1096183 - RNA, 18 nt, Mycobacterium bovis subsp bovis AF2122/97
uccgucgagucgccgagg

SEQ ID NO: 1096184 - RNA, 20 nt, Mycobacterium bovis subsp bovis AF2122/97
uccgucugacccaccgcccc

SEQ ID NO: 1096185 - RNA, 18 nt, Mycobacterium bovis subsp bovis AF2122/97
uccgucagcgccgcgcgc

SEQ ID NO: 1096186 - RNA, 12 nt, Mycobacterium bovis subsp bovis AF2122/97
uccgguuucggg

SEQ ID NO: 1096187 - RNA, 15 nt, Mycobacterium bovis subsp bovis AF2122/97
uccgguuucgggugc

SEQ ID NO: 1096188 - RNA, 18 nt, Mycobacterium bovis subsp bovis AF2122/97
uccguagaaggcgauuug

SEQ ID NO: 1096189 - RNA, 22 nt, Mycobacterium bovis subsp bovis AF2122/97
uccguagacggggugagccgac

SEQ ID NO: 1096190 - RNA, 14 nt, Mycobacterium bovis subsp bovis AF2122/97
uccguagccggcgg

SEQ ID NO: 1096191 - RNA, 13 nt, Mycobacterium bovis subsp bovis AF2122/97
uccuccccgaccg

SEQ ID NO: 1096192 - RNA, 14 nt, Mycobacterium bovis subsp bovis AF2122/97
uccuccggguuggc

SEQ ID NO: 1096193 - RNA, 19 nt, Mycobacterium bovis subsp bovis AF2122/97
uccuccgguaucggcgacc

SEQ ID NO: 1096194 - RNA, 19 nt, Mycobacterium bovis subsp bovis AF2122/97
uccuccguuuggcugccga

SEQ ID NO: 1096195 - RNA, 22 nt, Mycobacterium bovis subsp bovis AF2122/97
uccucgaaggcguucgacucga

SEQ ID NO: 1096196 - RNA, 22 nt, Mycobacterium bovis subsp bovis AF2122/97
uccucgaaguccgcuugggcgg

SEQ ID NO: 1096197 - RNA, 15 nt, Mycobacterium bovis subsp bovis AF2122/97
uccucgacgagcauc

SEQ ID NO: 1096198 - RNA, 21 nt, Mycobacterium bovis subsp bovis AF2122/97
uccucgacgaggagccucgac

SEQ ID NO: 1096199 - RNA, 23 nt, Mycobacterium bovis subsp bovis AF2122/97
uccucgacgaggagccucgaccg

SEQ ID NO: 1096200 - RNA, 13 nt, Mycobacterium bovis subsp bovis AF2122/97
uccuccgacgcga

SEQ ID NO: 1096201 - RNA, 16 nt, Mycobacterium bovis subsp bovis AF2122/97
uccuccgggcagucga

SEQ ID NO: 1096202 - RNA, 20 nt, Mycobacterium bovis subsp bovis AF2122/97
uccuccgggcagucgagugc

SEQ ID NO: 1096203 - RNA, 16 nt, Mycobacterium bovis subsp bovis AF2122/97
uccucagccgccuguc

SEQ ID NO: 1096204 - RNA, 17 nt, Mycobacterium bovis subsp bovis AF2122/97
uccucagccggugcgcu

SEQ ID NO: 1096205 - RNA, 19 nt, Mycobacterium bovis subsp bovis AF2122/97
uccuccacuuuuccgccgg

SEQ ID NO: 1096206 - RNA, 13 nt, Mycobacterium bovis subsp bovis AF2122/97
uccuccagcagcg

SEQ ID NO: 1096207 - RNA, 22 nt, Mycobacterium bovis subsp bovis AF2122/97
uccgugcuuccauucgcggucc

SEQ ID NO: 1096208 - RNA, 19 nt, Mycobacterium bovis subsp bovis AF2122/97
uccguguuucgaacaccgu

SEQ ID NO: 1096209 - RNA, 23 nt, Mycobacterium bovis subsp bovis AF2122/97
uccguugagguaggugagcgcgc

SEQ ID NO: 1096210 - RNA, 16 nt, Mycobacterium bovis subsp bovis AF2122/97
uccgugguugccgaag

SEQ ID NO: 1096211 - RNA, 16 nt, Mycobacterium bovis subsp bovis AF2122/97
uccguugaugccgccg

SEQ ID NO: 1096212 - RNA, 23 nt, Mycobacterium bovis subsp bovis AF2122/97
uccguugcccccauugccgccgu

SEQ ID NO: 1096213 - RNA, 20 nt, Mycobacterium bovis subsp bovis AF2122/97
uccggcccguagcugcgcag

SEQ ID NO: 1096214 - RNA, 14 nt, Mycobacterium bovis subsp bovis AF2122/97
uccggccgacccgg

SEQ ID NO: 1096215 - RNA, 14 nt, Mycobacterium bovis subsp bovis AF2122/97
uccggccgaugcga

SEQ ID NO: 1096216 - RNA, 18 nt, Mycobacterium bovis subsp bovis AF2122/97
uccggcccuacgcagcgc

SEQ ID NO: 1096217 - RNA, 23 nt, Mycobacterium bovis subsp bovis AF2122/97
uccggcccguagcugcgcagcgc

SEQ ID NO: 1096218 - RNA, 21 nt, Mycobacterium bovis subsp bovis AF2122/97
uccggcgccaggaucgaucgu

SEQ ID NO: 1096219 - RNA, 21 nt, Mycobacterium bovis subsp bovis AF2122/97
uccggccgccaacuucaccac

SEQ ID NO: 1096220 - RNA, 12 nt, Mycobacterium bovis subsp bovis AF2122/97
uccggcgccgag

SEQ ID NO: 1096221 - RNA, 14 nt, Mycobacterium bovis subsp bovis AF2122/97
uccggcgcgacgcc

SEQ ID NO: 1096222 - RNA, 18 nt, Mycobacterium bovis subsp bovis AF2122/97
uccggcgcggccggccgc

SEQ ID NO: 1096223 - RNA, 22 nt, Mycobacterium bovis subsp bovis AF2122/97
uccggcgcuccacugaccaggu

SEQ ID NO: 1096224 - RNA, 17 nt, Mycobacterium bovis subsp bovis AF2122/97
uccggcgcagguucucg

SEQ ID NO: 1096225 - RNA, 13 nt, Mycobacterium bovis subsp bovis AF2122/97
uccggcgccaccg

SEQ ID NO: 1096226 - RNA, 22 nt, Mycobacterium bovis subsp bovis AF2122/97
uccggcgccaccgccgcugccg

SEQ ID NO: 1096227 - RNA, 20 nt, Mycobacterium bovis subsp bovis AF2122/97
uccggcgccgaggucgaacg

SEQ ID NO: 1096228 - RNA, 18 nt, Mycobacterium bovis subsp bovis AF2122/97
uccggcuggaagcggcga

SEQ ID NO: 1096229 - RNA, 20 nt, Mycobacterium bovis subsp bovis AF2122/97
uccggcuggaagcggcgacu

SEQ ID NO: 1096230 - RNA, 16 nt, Mycobacterium bovis subsp bovis AF2122/97
uccggcuuaccggcgg

SEQ ID NO: 1096231 - RNA, 19 nt, Mycobacterium bovis subsp bovis AF2122/97
uccggcuggugggacgcgg

SEQ ID NO: 1096232 - RNA, 14 nt, Mycobacterium bovis subsp bovis AF2122/97
uccgguagcagcgc

SEQ ID NO: 1096233 - RNA, 20 nt, Mycobacterium bovis subsp bovis AF2122/97
uccgggccgaucaccccggu

SEQ ID NO: 1096234 - RNA, 22 nt, Mycobacterium bovis subsp bovis AF2122/97
uccgggaugaagcucgaccgcc

SEQ ID NO: 1096235 - RNA, 20 nt, Mycobacterium bovis subsp bovis AF2122/97
uccgggcagccgcgccgcgg

SEQ ID NO: 1096236 - RNA, 16 nt, Mycobacterium bovis subsp bovis AF2122/97
uccggcuuggcggcga

SEQ ID NO: 1096237 - RNA, 20 nt, Mycobacterium bovis subsp bovis AF2122/97
uccgggaccggaaacugggg

SEQ ID NO: 1096238 - RNA, 15 nt, Mycobacterium bovis subsp bovis AF2122/97
uccgggacuaccacc

SEQ ID NO: 1096239 - RNA, 13 nt, Mycobacterium bovis subsp bovis AF2122/97
uccggcacgcguc

SEQ ID NO: 1096240 - RNA, 15 nt, Mycobacterium bovis subsp bovis AF2122/97
uccggcaggcccgac

SEQ ID NO: 1096241 - RNA, 21 nt, Mycobacterium bovis subsp bovis AF2122/97
uccggcaauugugcugcgcgu

SEQ ID NO: 1096242 - RNA, 19 nt, Mycobacterium bovis subsp bovis AF2122/97
uccggcaccaacgccaccg

SEQ ID NO: 1096243 - RNA, 22 nt, Mycobacterium bovis subsp bovis AF2122/97
uccggcagaccggugcugucga

SEQ ID NO: 1096244 - RNA, 22 nt, Mycobacterium bovis subsp bovis AF2122/97
uccggcaccggucuuggugcuc

SEQ ID NO: 1096245 - RNA, 14 nt, Mycobacterium bovis subsp bovis AF2122/97
uccggcaccuccag

SEQ ID NO: 1096246 - RNA, 17 nt, Mycobacterium bovis subsp bovis AF2122/97
uccggcaccuccagcac

SEQ ID NO: 1096247 - RNA, 16 nt, Mycobacterium bovis subsp bovis AF2122/97
uccggcauacaucgcc

SEQ ID NO: 1096248 - RNA, 21 nt, Mycobacterium bovis subsp bovis AF2122/97
uccggcauaccgaacagcacc

SEQ ID NO: 1096249 - RNA, 14 nt, Mycobacterium bovis subsp bovis AF2122/97
uccggcagcagccg

SEQ ID NO: 1096250 - RNA, 12 nt, Mycobacterium bovis subsp bovis AF2122/97
uccggcccccga

SEQ ID NO: 1096251 - RNA, 16 nt, Mycobacterium bovis subsp bovis AF2122/97
uccggcccacucacac

SEQ ID NO: 1096252 - RNA, 17 nt, Mycobacterium bovis subsp bovis AF2122/97
uccggcccaccagcgca

SEQ ID NO: 1096253 - RNA, 15 nt, Mycobacterium bovis subsp bovis AF2122/97
uccggcccaccgguc

SEQ ID NO: 1096254 - RNA, 13 nt, Mycobacterium bovis subsp bovis AF2122/97
uccggaaccaacc

SEQ ID NO: 1096255 - RNA, 22 nt, Mycobacterium bovis subsp bovis AF2122/97
uccggaagcggcguucgaugcc

SEQ ID NO: 1096256 - RNA, 14 nt, Mycobacterium bovis subsp bovis AF2122/97
uccggaaucgcccg

SEQ ID NO: 1096257 - RNA, 15 nt, Mycobacterium bovis subsp bovis AF2122/97
uccgcugccgcccgc

SEQ ID NO: 1096258 - RNA, 17 nt, Mycobacterium bovis subsp bovis AF2122/97
uccgcugccgcccgcgc

SEQ ID NO: 1096259 - RNA, 16 nt, Mycobacterium bovis subsp bovis AF2122/97
uccgcgauucgaccgg

SEQ ID NO: 1096260 - RNA, 15 nt, Mycobacterium bovis subsp bovis AF2122/97
uccgcgauggccgcg

SEQ ID NO: 1096261 - RNA, 16 nt, Mycobacterium bovis subsp bovis AF2122/97
uccgcuggguggccgc

SEQ ID NO: 1096262 - RNA, 15 nt, Mycobacterium bovis subsp bovis AF2122/97
uccgcuguuccucga

SEQ ID NO: 1096263 - RNA, 20 nt, Mycobacterium bovis subsp bovis AF2122/97
ucgacgaacuccgcguuggg

SEQ ID NO: 1096264 - RNA, 21 nt, Mycobacterium bovis subsp bovis AF2122/97
ucgacgacgcccucacaacga

SEQ ID NO: 1096265 - RNA, 20 nt, Mycobacterium bovis subsp bovis AF2122/97
ucgacgacguccucgacgau

SEQ ID NO: 1096266 - RNA, 13 nt, Mycobacterium bovis subsp bovis AF2122/97
ucgacgacgucgc

SEQ ID NO: 1096267 - RNA, 19 nt, Mycobacterium bovis subsp bovis AF2122/97
ucgacgacgucgcgcaucg

SEQ ID NO: 1096268 - RNA, 23 nt, Mycobacterium bovis subsp bovis AF2122/97
ucgacgacguggcugcguucgcc

SEQ ID NO: 1096269 - RNA, 15 nt, Mycobacterium bovis subsp bovis AF2122/97
ucgacgagccgcggu

SEQ ID NO: 1096270 - RNA, 18 nt, Mycobacterium bovis subsp bovis AF2122/97
ucgacgagcaccgcgccg

SEQ ID NO: 1096271 - RNA, 19 nt, Mycobacterium bovis subsp bovis AF2122/97
ucgacgagcaccgcgccgc

SEQ ID NO: 1096272 - RNA, 21 nt, Mycobacterium bovis subsp bovis AF2122/97
ucgacgagcaccgcgccgcgc

SEQ ID NO: 1096273 - RNA, 21 nt, Mycobacterium bovis subsp bovis AF2122/97
ucgacgagacgaaccgccgac

SEQ ID NO: 1096274 - RNA, 22 nt, Mycobacterium bovis subsp bovis AF2122/97
ucgacgagauagcauccgcccg

SEQ ID NO: 1096275 - RNA, 17 nt, Mycobacterium bovis subsp bovis AF2122/97
ucgacgagauccagcgc

SEQ ID NO: 1096276 - RNA, 24 nt, Mycobacterium bovis subsp bovis AF2122/97
ucgacgagguugccgcaccagucg

SEQ ID NO: 1096277 - RNA, 13 nt, Mycobacterium bovis subsp bovis AF2122/97
ucgacgagucggc

SEQ ID NO: 1096278 - RNA, 17 nt, Mycobacterium bovis subsp bovis AF2122/97
ucgacgagucggcgggc

SEQ ID NO: 1096279 - RNA, 21 nt, Mycobacterium bovis subsp bovis AF2122/97
ucgacgagucggcgggcgaca

SEQ ID NO: 1096280 - RNA, 16 nt, Mycobacterium bovis subsp bovis AF2122/97
ucgaccgccagccgcg

SEQ ID NO: 1096281 - RNA, 19 nt, Mycobacterium bovis subsp bovis AF2122/97
ucgaccgccagcgccgcca

SEQ ID NO: 1096282 - RNA, 14 nt, Mycobacterium bovis subsp bovis AF2122/97
ucgaccgcggcccg

SEQ ID NO: 1096283 - RNA, 20 nt, Mycobacterium bovis subsp bovis AF2122/97
ucgaccgcggccuuggcggc

SEQ ID NO: 1096284 - RNA, 21 nt, Mycobacterium bovis subsp bovis AF2122/97
ucgaccgcggccuuggcggcc

SEQ ID NO: 1096285 - RNA, 13 nt, Mycobacterium bovis subsp bovis AF2122/97
ucgaccgccgugg

SEQ ID NO: 1096286 - RNA, 21 nt, Mycobacterium bovis subsp bovis AF2122/97
ucgaccggcgggaugcgcgcc

SEQ ID NO: 1096287 - RNA, 15 nt, Mycobacterium bovis subsp bovis AF2122/97
ucgaccggcguugcg

SEQ ID NO: 1096288 - RNA, 19 nt, Mycobacterium bovis subsp bovis AF2122/97
ucgaccgggaacagggugg

SEQ ID NO: 1096289 - RNA, 22 nt, Mycobacterium bovis subsp bovis AF2122/97
ucgaccggacaaacaucgcacc

SEQ ID NO: 1096290 - RNA, 18 nt, Mycobacterium bovis subsp bovis AF2122/97
ucgaccuggauugccacc

SEQ ID NO: 1096291 - RNA, 13 nt, Mycobacterium bovis subsp bovis AF2122/97
ucgaccucgucgg

SEQ ID NO: 1096292 - RNA, 15 nt, Mycobacterium bovis subsp bovis AF2122/97
ucgaccguggcggcc

SEQ ID NO: 1096293 - RNA, 16 nt, Mycobacterium bovis subsp bovis AF2122/97
ucgaccgugucaccgc

SEQ ID NO: 1096294 - RNA, 16 nt, Mycobacterium bovis subsp bovis AF2122/97
ucgaccgucaccggaa

SEQ ID NO: 1096295 - RNA, 21 nt, Mycobacterium bovis subsp bovis AF2122/97
ucgaccgucacgcguacgucg

SEQ ID NO: 1096296 - RNA, 19 nt, Mycobacterium bovis subsp bovis AF2122/97
ucgaccguccgggucacca

SEQ ID NO: 1096297 - RNA, 17 nt, Mycobacterium bovis subsp bovis AF2122/97
ucgacccgaucacgcug

SEQ ID NO: 1096298 - RNA, 10 nt, Mycobacterium bovis subsp bovis AF2122/97
ucgacccgcg

SEQ ID NO: 1096299 - RNA, 16 nt, Mycobacterium bovis subsp bovis AF2122/97
ucgacccggucgacgg

SEQ ID NO: 1096300 - RNA, 16 nt, Mycobacterium bovis subsp bovis AF2122/97
ucgaccgaacccgacg

SEQ ID NO: 1096301 - RNA, 15 nt, Mycobacterium bovis subsp bovis AF2122/97
ucgaccgcccgccag

SEQ ID NO: 1096302 - RNA, 12 nt, Mycobacterium bovis subsp bovis AF2122/97
ucgaccgagcuu

SEQ ID NO: 1096303 - RNA, 19 nt, Mycobacterium bovis subsp bovis AF2122/97
ucgaccgauagcuggccga

SEQ ID NO: 1096304 - RNA, 21 nt, Mycobacterium bovis subsp bovis AF2122/97
ucgacccccgcaucggcgcca

SEQ ID NO: 1096305 - RNA, 16 nt, Mycobacterium bovis subsp bovis AF2122/97
ucgacccccugccaca

SEQ ID NO: 1096306 - RNA, 16 nt, Mycobacterium bovis subsp bovis AF2122/97
ucgacccccgcaucgg

SEQ ID NO: 1096307 - RNA, 20 nt, Mycobacterium bovis subsp bovis AF2122/97
ucgacccacucaucagagcg

SEQ ID NO: 1096308 - RNA, 15 nt, Mycobacterium bovis subsp bovis AF2122/97
ucgaccaucaccacg

SEQ ID NO: 1096309 - RNA, 20 nt, Mycobacterium bovis subsp bovis AF2122/97
ucgaccaucaccacggccgc

SEQ ID NO: 1096310 - RNA, 15 nt, Mycobacterium bovis subsp bovis AF2122/97
ucgaccagcgccgau

SEQ ID NO: 1096311 - RNA, 15 nt, Mycobacterium bovis subsp bovis AF2122/97
ucgaccacggucugc

SEQ ID NO: 1096312 - RNA, 19 nt, Mycobacterium bovis subsp bovis AF2122/97
ucgaccagagccgcgagca

SEQ ID NO: 1096313 - RNA, 11 nt, Mycobacterium bovis subsp bovis AF2122/97
ucgaccacgaa

SEQ ID NO: 1096314 - RNA, 17 nt, Mycobacterium bovis subsp bovis AF2122/97
ucgacaugggucggcug

SEQ ID NO: 1096315 - RNA, 13 nt, Mycobacterium bovis subsp bovis AF2122/97
ucgacaucgccau

SEQ ID NO: 1096316 - RNA, 13 nt, Mycobacterium bovis subsp bovis AF2122/97
ucgacaucggcca

SEQ ID NO: 1096317 - RNA, 14 nt, Mycobacterium bovis subsp bovis AF2122/97
ucgacaucggccag

SEQ ID NO: 1096318 - RNA, 18 nt, Mycobacterium bovis subsp bovis AF2122/97
ucgaccaccgccggcccg

SEQ ID NO: 1096319 - RNA, 17 nt, Mycobacterium bovis subsp bovis AF2122/97
ucgaccaccacccggaa

SEQ ID NO: 1096320 - RNA, 18 nt, Mycobacterium bovis subsp bovis AF2122/97
ucgacaccgugaccgccg

SEQ ID NO: 1096321 - RNA, 16 nt, Mycobacterium bovis subsp bovis AF2122/97
ucgacacggugaucuu

SEQ ID NO: 1096322 - RNA, 23 nt, Mycobacterium bovis subsp bovis AF2122/97
ucgacacuggacgcuccgggaau

SEQ ID NO: 1096323 - RNA, 14 nt, Mycobacterium bovis subsp bovis AF2122/97
ucgacacccguuga

SEQ ID NO: 1096324 - RNA, 16 nt, Mycobacterium bovis subsp bovis AF2122/97
ucgacaccagcgugug

SEQ ID NO: 1096325 - RNA, 12 nt, Mycobacterium bovis subsp bovis AF2122/97
ucgacaccgacg

SEQ ID NO: 1096326 - RNA, 15 nt, Mycobacterium bovis subsp bovis AF2122/97
ucgacaccgagccac

SEQ ID NO: 1096327 - RNA, 14 nt, Mycobacterium bovis subsp bovis AF2122/97
ucgacaccgcccga

SEQ ID NO: 1096328 - RNA, 20 nt, Mycobacterium bovis subsp bovis AF2122/97
ucgacacccgcacgaagccg

SEQ ID NO: 1096329 - RNA, 13 nt, Mycobacterium bovis subsp bovis AF2122/97
ucgacaccggcgc

SEQ ID NO: 1096330 - RNA, 17 nt, Mycobacterium bovis subsp bovis AF2122/97
ucgacaggugccagacc

SEQ ID NO: 1096331 - RNA, 17 nt, Mycobacterium bovis subsp bovis AF2122/97
ucgacaguugcgccagc

SEQ ID NO: 1096332 - RNA, 18 nt, Mycobacterium bovis subsp bovis AF2122/97
ucgacaguugcgccagcg

SEQ ID NO: 1096333 - RNA, 15 nt, Mycobacterium bovis subsp bovis AF2122/97
ucgacaucaccaccg

SEQ ID NO: 1096334 - RNA, 17 nt, Mycobacterium bovis subsp bovis AF2122/97
ucgacaggccaccgcag

SEQ ID NO: 1096335 - RNA, 21 nt, Mycobacterium bovis subsp bovis AF2122/97
ucgacaggccaccgcagacgc

SEQ ID NO: 1096336 - RNA, 22 nt, Mycobacterium bovis subsp bovis AF2122/97
ucgacagcgaaggcgccgaaca

SEQ ID NO: 1096337 - RNA, 20 nt, Mycobacterium bovis subsp bovis AF2122/97
ucgacagcaucacgcccacg

SEQ ID NO: 1096338 - RNA, 23 nt, Mycobacterium bovis subsp bovis AF2122/97
ucgaauaguugaccaggccgaca

SEQ ID NO: 1096339 - RNA, 14 nt, Mycobacterium bovis subsp bovis AF2122/97
ucgaauccugccgc

SEQ ID NO: 1096340 - RNA, 17 nt, Mycobacterium bovis subsp bovis AF2122/97
ucgaauccugccgcacg

SEQ ID NO: 1096341 - RNA, 19 nt, Mycobacterium bovis subsp bovis AF2122/97
ucgaaguccgcuugggcgg

SEQ ID NO: 1096342 - RNA, 17 nt, Mycobacterium bovis subsp bovis AF2122/97
ucgaaguucucggugcg

SEQ ID NO: 1096343 - RNA, 19 nt, Mycobacterium bovis subsp bovis AF2122/97
ucgacacacccaccggacc

SEQ ID NO: 1096344 - RNA, 14 nt, Mycobacterium bovis subsp bovis AF2122/97
ucgacaaacagcgc

SEQ ID NO: 1096345 - RNA, 16 nt, Mycobacterium bovis subsp bovis AF2122/97
ucgacaaaccacagac

SEQ ID NO: 1096346 - RNA, 16 nt, Mycobacterium bovis subsp bovis AF2122/97
ucgacaaccgcugccg

SEQ ID NO: 1096347 - RNA, 22 nt, Mycobacterium bovis subsp bovis AF2122/97
ucgacaaccgcugccgcaucgg

SEQ ID NO: 1096348 - RNA, 17 nt, Mycobacterium bovis subsp bovis AF2122/97
ucgacaacgaucgcgcg

SEQ ID NO: 1096349 - RNA, 19 nt, Mycobacterium bovis subsp bovis AF2122/97
ucgacaacgaucgcgcgag

SEQ ID NO: 1096350 - RNA, 20 nt, Mycobacterium bovis subsp bovis AF2122/97
ucgacaacgccuuguuggcg

SEQ ID NO: 1096351 - RNA, 18 nt, Mycobacterium bovis subsp bovis AF2122/97
ucgaaggcgugggugucg

SEQ ID NO: 1096352 - RNA, 19 nt, Mycobacterium bovis subsp bovis AF2122/97
ucgaagggcuugucgccgg

SEQ ID NO: 1096353 - RNA, 15 nt, Mycobacterium bovis subsp bovis AF2122/97
ucgaaggcacugcga

SEQ ID NO: 1096354 - RNA, 16 nt, Mycobacterium bovis subsp bovis AF2122/97
ucgaaggccacccgcg

SEQ ID NO: 1096355 - RNA, 23 nt, Mycobacterium bovis subsp bovis AF2122/97
ucgaagcgggcuugagcgccgau

SEQ ID NO: 1096356 - RNA, 18 nt, Mycobacterium bovis subsp bovis AF2122/97
ucgaagcggaccagcgaa

SEQ ID NO: 1096357 - RNA, 24 nt, Mycobacterium bovis subsp bovis AF2122/97
ucgaagaaccugagcaccaagacc

SEQ ID NO: 1096358 - RNA, 14 nt, Mycobacterium bovis subsp bovis AF2122/97
ucgaagcccggcgg

SEQ ID NO: 1096359 - RNA, 13 nt, Mycobacterium bovis subsp bovis AF2122/97
ucgaagcgauccg

SEQ ID NO: 1096360 - RNA, 13 nt, Mycobacterium bovis subsp bovis AF2122/97
ucgaagcgaucgc

SEQ ID NO: 1096361 - RNA, 20 nt, Mycobacterium bovis subsp bovis AF2122/97
ucgaagcggcugcugcgcgg

SEQ ID NO: 1096362 - RNA, 22 nt, Mycobacterium bovis subsp bovis AF2122/97
ucgaagcccgaguugaaggugc

SEQ ID NO: 1096363 - RNA, 21 nt, Mycobacterium bovis subsp bovis AF2122/97
ucgaacggcagcccgggcgug

SEQ ID NO: 1096364 - RNA, 15 nt, Mycobacterium bovis subsp bovis AF2122/97
ucgaacggcuuggcg

SEQ ID NO: 1096365 - RNA, 16 nt, Mycobacterium bovis subsp bovis AF2122/97
ucgaacgcagccagcg

SEQ ID NO: 1096366 - RNA, 13 nt, Mycobacterium bovis subsp bovis AF2122/97
ucgaacugccgga

SEQ ID NO: 1096367 - RNA, 23 nt, Mycobacterium bovis subsp bovis AF2122/97
ucgaacugccggacuaccgccgg

SEQ ID NO: 1096368 - RNA, 20 nt, Mycobacterium bovis subsp bovis AF2122/97
ucgaacugguuucgcaccgu

SEQ ID NO: 1096369 - RNA, 13 nt, Mycobacterium bovis subsp bovis AF2122/97
ucgaacugggcgc

SEQ ID NO: 1096370 - RNA, 21 nt, Mycobacterium bovis subsp bovis AF2122/97
ucgaacuucgauucuggccgg

SEQ ID NO: 1096371 - RNA, 20 nt, Mycobacterium bovis subsp bovis AF2122/97
ucgaacuccccggucgccgc

SEQ ID NO: 1096372 - RNA, 21 nt, Mycobacterium bovis subsp bovis AF2122/97
ucgaagacguuggcgcgguug

SEQ ID NO: 1096373 - RNA, 17 nt, Mycobacterium bovis subsp bovis AF2122/97
ucgaagaccucgucgcg

SEQ ID NO: 1096374 - RNA, 13 nt, Mycobacterium bovis subsp bovis AF2122/97
uccugcggcaccg

SEQ ID NO: 1096375 - RNA, 22 nt, Mycobacterium bovis subsp bovis AF2122/97
uccugcgagugcggcacgaucg

SEQ ID NO: 1096376 - RNA, 22 nt, Mycobacterium bovis subsp bovis AF2122/97
uccugcgccgcacgccgaccgg

SEQ ID NO: 1096377 - RNA, 19 nt, Mycobacterium bovis subsp bovis AF2122/97
uccugccaaugcugcaggu

SEQ ID NO: 1096378 - RNA, 14 nt, Mycobacterium bovis subsp bovis AF2122/97
uccugaguuccggu

SEQ ID NO: 1096379 - RNA, 17 nt, Mycobacterium bovis subsp bovis AF2122/97
uccugaaaacaccgcac

SEQ ID NO: 1096380 - RNA, 20 nt, Mycobacterium bovis subsp bovis AF2122/97
uccugcaagaaccacugcau

SEQ ID NO: 1096381 - RNA, 15 nt, Mycobacterium bovis subsp bovis AF2122/97
uccugcagcuggcga

SEQ ID NO: 1096382 - RNA, 19 nt, Mycobacterium bovis subsp bovis AF2122/97
uccugcagcccgggcagca

SEQ ID NO: 1096383 - RNA, 13 nt, Mycobacterium bovis subsp bovis AF2122/97
uccucgacgucgg

SEQ ID NO: 1096384 - RNA, 14 nt, Mycobacterium bovis subsp bovis AF2122/97
uccucgaucgucga

SEQ ID NO: 1096385 - RNA, 15 nt, Mycobacterium bovis subsp bovis AF2122/97
uccucgaucgucgac

SEQ ID NO: 1096386 - RNA, 18 nt, Mycobacterium bovis subsp bovis AF2122/97
uccucgaucgucgacgcg

SEQ ID NO: 1096387 - RNA, 19 nt, Mycobacterium bovis subsp bovis AF2122/97
uccucgauagcggcgccug

SEQ ID NO: 1096388 - RNA, 22 nt, Mycobacterium bovis subsp bovis AF2122/97
uccucgauauggguugccagcg

SEQ ID NO: 1096389 - RNA, 21 nt, Mycobacterium bovis subsp bovis AF2122/97
uccucgaugcgggcgccccac

SEQ ID NO: 1096390 - RNA, 11 nt, Mycobacterium bovis subsp bovis AF2122/97
uccucgaucgu

SEQ ID NO: 1096391 - RNA, 14 nt, Mycobacterium bovis subsp bovis AF2122/97
uccucgccgcacgc

SEQ ID NO: 1096392 - RNA, 13 nt, Mycobacterium bovis subsp bovis AF2122/97
uccucgcugucga

SEQ ID NO: 1096393 - RNA, 19 nt, Mycobacterium bovis subsp bovis AF2122/97
uccucggcaaaccaagcgc

SEQ ID NO: 1096394 - RNA, 18 nt, Mycobacterium bovis subsp bovis AF2122/97
uccucggucaccgagggc

SEQ ID NO: 1096395 - RNA, 22 nt, Mycobacterium bovis subsp bovis AF2122/97
uccucgucgacgucggcaucgg

SEQ ID NO: 1096396 - RNA, 13 nt, Mycobacterium bovis subsp bovis AF2122/97
uccucgucgaggu

SEQ ID NO: 1096397 - RNA, 21 nt, Mycobacterium bovis subsp bovis AF2122/97
uccucggcguggcaguacacc

SEQ ID NO: 1096398 - RNA, 16 nt, Mycobacterium bovis subsp bovis AF2122/97
uccucggggaggucga

SEQ ID NO: 1096399 - RNA, 15 nt, Mycobacterium bovis subsp bovis AF2122/97
uccucggguucguca

SEQ ID NO: 1096400 - RNA, 19 nt, Mycobacterium bovis subsp bovis AF2122/97
uccucgucggcgucgagcu

SEQ ID NO: 1096401 - RNA, 13 nt, Mycobacterium bovis subsp bovis AF2122/97
uccucgucgucga

SEQ ID NO: 1096402 - RNA, 16 nt, Mycobacterium bovis subsp bovis AF2122/97
uccucugguugggagc

SEQ ID NO: 1096403 - RNA, 22 nt, Mycobacterium bovis subsp bovis AF2122/97
uccucuugcaccagggccucga

SEQ ID NO: 1096404 - RNA, 23 nt, Mycobacterium bovis subsp bovis AF2122/97
ucgaaaucgauuccgggugcgau

SEQ ID NO: 1096405 - RNA, 16 nt, Mycobacterium bovis subsp bovis AF2122/97
ucgaaaucgcacagcg

SEQ ID NO: 1096406 - RNA, 17 nt, Mycobacterium bovis subsp bovis AF2122/97
ucgaaagccaacucgac

SEQ ID NO: 1096407 - RNA, 15 nt, Mycobacterium bovis subsp bovis AF2122/97
ucgaacaggaucagc

SEQ ID NO: 1096408 - RNA, 18 nt, Mycobacterium bovis subsp bovis AF2122/97
ucgaacaggaucagcgac

SEQ ID NO: 1096409 - RNA, 16 nt, Mycobacterium bovis subsp bovis AF2122/97
ucgaacaggccggccg

SEQ ID NO: 1096410 - RNA, 14 nt, Mycobacterium bovis subsp bovis AF2122/97
ucgaaccuaccgug

SEQ ID NO: 1096411 - RNA, 13 nt, Mycobacterium bovis subsp bovis AF2122/97
uccuugucgaccc

SEQ ID NO: 1096412 - RNA, 21 nt, Mycobacterium bovis subsp bovis AF2122/97
uccuuggcuaacaccgcaggc

SEQ ID NO: 1096413 - RNA, 22 nt, Mycobacterium bovis subsp bovis AF2122/97
uccuuggcccagcgguaguccg

SEQ ID NO: 1096414 - RNA, 18 nt, Mycobacterium bovis subsp bovis AF2122/97
uccuggaucgcggugggc

SEQ ID NO: 1096415 - RNA, 18 nt, Mycobacterium bovis subsp bovis AF2122/97
uccugcuuguagcgcauc

SEQ ID NO: 1096416 - RNA, 22 nt, Mycobacterium bovis subsp bovis AF2122/97
uccuucucgcggaccucggcga

SEQ ID NO: 1096417 - RNA, 19 nt, Mycobacterium bovis subsp bovis AF2122/97
uccuucagggcgucgaacu

SEQ ID NO: 1096418 - RNA, 14 nt, Mycobacterium bovis subsp bovis AF2122/97
uccugucgcaccag

SEQ ID NO: 1096419 - RNA, 21 nt, Mycobacterium bovis subsp bovis AF2122/97
ucgcggcggcgcuggcgggca

SEQ ID NO: 1096420 - RNA, 11 nt, Mycobacterium bovis subsp bovis AF2122/97
ucgcggcggca

SEQ ID NO: 1096421 - RNA, 22 nt, Mycobacterium bovis subsp bovis AF2122/97
ucgcggcggcacuacgcagccg

SEQ ID NO: 1096422 - RNA, 11 nt, Mycobacterium bovis subsp bovis AF2122/97
ucgcggcggcg

SEQ ID NO: 1096423 - RNA, 12 nt, Mycobacterium bovis subsp bovis AF2122/97
ucgcggcggcga

SEQ ID NO: 1096424 - RNA, 21 nt, Mycobacterium bovis subsp bovis AF2122/97
ucgcggcggucguugauuucg

SEQ ID NO: 1096425 - RNA, 18 nt, Mycobacterium bovis subsp bovis AF2122/97
ucgcggcuauggcgccgc

SEQ ID NO: 1096426 - RNA, 20 nt, Mycobacterium bovis subsp bovis AF2122/97
ucgcggcuauggcgccgcgg

SEQ ID NO: 1096427 - RNA, 16 nt, Mycobacterium bovis subsp bovis AF2122/97
ucgcgggacaacagca

SEQ ID NO: 1096428 - RNA, 15 nt, Mycobacterium bovis subsp bovis AF2122/97
ucgcgggcagggccu

SEQ ID NO: 1096429 - RNA, 17 nt, Mycobacterium bovis subsp bovis AF2122/97
ucgcgggcagggccucg

SEQ ID NO: 1096430 - RNA, 23 nt, Mycobacterium bovis subsp bovis AF2122/97
ucgcgggcagggccucggucgcc

SEQ ID NO: 1096431 - RNA, 22 nt, Mycobacterium bovis subsp bovis AF2122/97
ucgcgggauccaggcccagccg

SEQ ID NO: 1096432 - RNA, 19 nt, Mycobacterium bovis subsp bovis AF2122/97
ucgcgggacgcgacucggc

SEQ ID NO: 1096433 - RNA, 23 nt, Mycobacterium bovis subsp bovis AF2122/97
ucgcgggacgcgacucggcgguc

SEQ ID NO: 1096434 - RNA, 20 nt, Mycobacterium bovis subsp bovis AF2122/97
ucgcgggagaaaacggcggc

SEQ ID NO: 1096435 - RNA, 21 nt, Mycobacterium bovis subsp bovis AF2122/97
ucgcgggagaaaacggcggcg

SEQ ID NO: 1096436 - RNA, 19 nt, Mycobacterium bovis subsp bovis AF2122/97
ucgcgggccgaggccgucg

SEQ ID NO: 1096437 - RNA, 20 nt, Mycobacterium bovis subsp bovis AF2122/97
ucgcgggcuuaugcacgacg

SEQ ID NO: 1096438 - RNA, 13 nt, Mycobacterium bovis subsp bovis AF2122/97
ucgcggggccgga

SEQ ID NO: 1096439 - RNA, 15 nt, Mycobacterium bovis subsp bovis AF2122/97
ucgcgggcgaucggc

SEQ ID NO: 1096440 - RNA, 14 nt, Mycobacterium bovis subsp bovis AF2122/97
ucgcgggcccgcgc

SEQ ID NO: 1096441 - RNA, 13 nt, Mycobacterium bovis subsp bovis AF2122/97
ucgcgggcggcgu

SEQ ID NO: 1096442 - RNA, 20 nt, Mycobacterium bovis subsp bovis AF2122/97
ucgcgguaguuaacccaggg

SEQ ID NO: 1096443 - RNA, 20 nt, Mycobacterium bovis subsp bovis AF2122/97
ucgcgguaccaucaccgcgc

SEQ ID NO: 1096444 - RNA, 22 nt, Mycobacterium bovis subsp bovis AF2122/97
ucgcgguaccaucaccgcgcca

SEQ ID NO: 1096445 - RNA, 13 nt, Mycobacterium bovis subsp bovis AF2122/97
ucgcgguagcagc

SEQ ID NO: 1096446 - RNA, 19 nt, Mycobacterium bovis subsp bovis AF2122/97
ucgcgggugcgcugcagcg

SEQ ID NO: 1096447 - RNA, 22 nt, Mycobacterium bovis subsp bovis AF2122/97
ucgcggucaugggaucaggcug

SEQ ID NO: 1096448 - RNA, 17 nt, Mycobacterium bovis subsp bovis AF2122/97
ucgcggucccacggccg

SEQ ID NO: 1096449 - RNA, 18 nt, Mycobacterium bovis subsp bovis AF2122/97
ucgcggucccacggccgg

SEQ ID NO: 1096450 - RNA, 20 nt, Mycobacterium bovis subsp bovis AF2122/97
ucgcggucccacggccggcc

SEQ ID NO: 1096451 - RNA, 16 nt, Mycobacterium bovis subsp bovis AF2122/97
ucgcggucgacagcgc

SEQ ID NO: 1096452 - RNA, 13 nt, Mycobacterium bovis subsp bovis AF2122/97
ucgcggucgaggu

SEQ ID NO: 1096453 - RNA, 12 nt, Mycobacterium bovis subsp bovis AF2122/97
ucgcggucgauc

SEQ ID NO: 1096454 - RNA, 14 nt, Mycobacterium bovis subsp bovis AF2122/97
ucgcggucgccacc

SEQ ID NO: 1096455 - RNA, 17 nt, Mycobacterium bovis subsp bovis AF2122/97
ucgcggaucucaucggg

SEQ ID NO: 1096456 - RNA, 14 nt, Mycobacterium bovis subsp bovis AF2122/97
ucgcgcgucgucgc

SEQ ID NO: 1096457 - RNA, 13 nt, Mycobacterium bovis subsp bovis AF2122/97
ucgcggagucugc

SEQ ID NO: 1096458 - RNA, 22 nt, Mycobacterium bovis subsp bovis AF2122/97
ucgcgcgucgucgcgcugaacg

SEQ ID NO: 1096459 - RNA, 18 nt, Mycobacterium bovis subsp bovis AF2122/97
ucgcggaucagcccgcgc

SEQ ID NO: 1096460 - RNA, 20 nt, Mycobacterium bovis subsp bovis AF2122/97
ucgcggaucucaucgggcca

SEQ ID NO: 1096461 - RNA, 16 nt, Mycobacterium bovis subsp bovis AF2122/97
ucgcggauugccgcgc

SEQ ID NO: 1096462 - RNA, 19 nt, Mycobacterium bovis subsp bovis AF2122/97
ucgcggauugccgcgcgca

SEQ ID NO: 1096463 - RNA, 20 nt, Mycobacterium bovis subsp bovis AF2122/97
ucgcggcaaugaggccgucu

SEQ ID NO: 1096464 - RNA, 13 nt, Mycobacterium bovis subsp bovis AF2122/97
ucgcgcgcggcga

SEQ ID NO: 1096465 - RNA, 23 nt, Mycobacterium bovis subsp bovis AF2122/97
ucgcgcggcaccgauggcgcacc

SEQ ID NO: 1096466 - RNA, 14 nt, Mycobacterium bovis subsp bovis AF2122/97
ucgcgcgcucgcgg

SEQ ID NO: 1096467 - RNA, 13 nt, Mycobacterium bovis subsp bovis AF2122/97
ucgcgcgcugggc

SEQ ID NO: 1096468 - RNA, 24 nt, Mycobacterium bovis subsp bovis AF2122/97
ucgcgcggcugugcccgaucagcc

SEQ ID NO: 1096469 - RNA, 15 nt, Mycobacterium bovis subsp bovis AF2122/97
ucgcggcgacccggu

SEQ ID NO: 1096470 - RNA, 16 nt, Mycobacterium bovis subsp bovis AF2122/97
ucgcggcccgcagcgu

SEQ ID NO: 1096471 - RNA, 20 nt, Mycobacterium bovis subsp bovis AF2122/97
ucgcggcgagcaccacccca

SEQ ID NO: 1096472 - RNA, 19 nt, Mycobacterium bovis subsp bovis AF2122/97
ucgcggcgcaggucgcgca

SEQ ID NO: 1096473 - RNA, 14 nt, Mycobacterium bovis subsp bovis AF2122/97
ucgcggccggcggc

SEQ ID NO: 1096474 - RNA, 15 nt, Mycobacterium bovis subsp bovis AF2122/97
ucgcggccggcggcc

SEQ ID NO: 1096475 - RNA, 17 nt, Mycobacterium bovis subsp bovis AF2122/97
ucgcggccggcgucggc

SEQ ID NO: 1096476 - RNA, 14 nt, Mycobacterium bovis subsp bovis AF2122/97
ucgcggccgcggcc

SEQ ID NO: 1096477 - RNA, 14 nt, Mycobacterium bovis subsp bovis AF2122/97
ucgcggccgcucac

SEQ ID NO: 1096478 - RNA, 13 nt, Mycobacterium bovis subsp bovis AF2122/97
ucgcggccacggu

SEQ ID NO: 1096479 - RNA, 17 nt, Mycobacterium bovis subsp bovis AF2122/97
ucgcggaucugggcggc

SEQ ID NO: 1096480 - RNA, 23 nt, Mycobacterium bovis subsp bovis AF2122/97
ucgcggcacgaucaaccggguca

SEQ ID NO: 1096481 - RNA, 20 nt, Mycobacterium bovis subsp bovis AF2122/97
ucgccggugacgacgucgcc

SEQ ID NO: 1096482 - RNA, 19 nt, Mycobacterium bovis subsp bovis AF2122/97
ucgccggugacgaugaccg

SEQ ID NO: 1096483 - RNA, 15 nt, Mycobacterium bovis subsp bovis AF2122/97
ucgccggcuaccgcc

SEQ ID NO: 1096484 - RNA, 14 nt, Mycobacterium bovis subsp bovis AF2122/97
ucgccggugagccg

SEQ ID NO: 1096485 - RNA, 17 nt, Mycobacterium bovis subsp bovis AF2122/97
ucgccggugacgacguc

SEQ ID NO: 1096486 - RNA, 15 nt, Mycobacterium bovis subsp bovis AF2122/97
ucgcgacccgaucgc

SEQ ID NO: 1096487 - RNA, 14 nt, Mycobacterium bovis subsp bovis AF2122/97
ucgcgacaacucgc

SEQ ID NO: 1096488 - RNA, 17 nt, Mycobacterium bovis subsp bovis AF2122/97
ucgcgacacgcggcccg

SEQ ID NO: 1096489 - RNA, 18 nt, Mycobacterium bovis subsp bovis AF2122/97
ucgcgacacggccauccg

SEQ ID NO: 1096490 - RNA, 16 nt, Mycobacterium bovis subsp bovis AF2122/97
ucgccgucacgcacgc

SEQ ID NO: 1096491 - RNA, 23 nt, Mycobacterium bovis subsp bovis AF2122/97
ucgccguaagcaccagccagccu

SEQ ID NO: 1096492 - RNA, 23 nt, Mycobacterium bovis subsp bovis AF2122/97
ucgccguacaaccacccacccgc

SEQ ID NO: 1096493 - RNA, 15 nt, Mycobacterium bovis subsp bovis AF2122/97
ucgcgauagccgccg

SEQ ID NO: 1096494 - RNA, 23 nt, Mycobacterium bovis subsp bovis AF2122/97
ucgcgaggcuguccgaaccgacg

SEQ ID NO: 1096495 - RNA, 17 nt, Mycobacterium bovis subsp bovis AF2122/97
ucgcgaggugaagccga

SEQ ID NO: 1096496 - RNA, 13 nt, Mycobacterium bovis subsp bovis AF2122/97
ucgcgauccaccc

SEQ ID NO: 1096497 - RNA, 18 nt, Mycobacterium bovis subsp bovis AF2122/97
ucgcgauccacuccggcg

SEQ ID NO: 1096498 - RNA, 14 nt, Mycobacterium bovis subsp bovis AF2122/97
ucgcgaccgaccgc

SEQ ID NO: 1096499 - RNA, 15 nt, Mycobacterium bovis subsp bovis AF2122/97
ucgcgaccgaccgca

SEQ ID NO: 1096500 - RNA, 22 nt, Mycobacterium bovis subsp bovis AF2122/97
ucgcgacccgaucgcgccaggc

SEQ ID NO: 1096501 - RNA, 18 nt, Mycobacterium bovis subsp bovis AF2122/97
ucgcgacgaugccccggu

SEQ ID NO: 1096502 - RNA, 14 nt, Mycobacterium bovis subsp bovis AF2122/97
ucgcgagccagcug

SEQ ID NO: 1096503 - RNA, 13 nt, Mycobacterium bovis subsp bovis AF2122/97
ucgcgagcgccgc

SEQ ID NO: 1096504 - RNA, 20 nt, Mycobacterium bovis subsp bovis AF2122/97
ucgcgacggggucgcgaugc

SEQ ID NO: 1096505 - RNA, 16 nt, Mycobacterium bovis subsp bovis AF2122/97
ucgcgauguccucgag

SEQ ID NO: 1096506 - RNA, 23 nt, Mycobacterium bovis subsp bovis AF2122/97
ucgcgaugcucaaugugccgccg

SEQ ID NO: 1096507 - RNA, 22 nt, Mycobacterium bovis subsp bovis AF2122/97
ucgcgaugcuucccggaugccg

SEQ ID NO: 1096508 - RNA, 19 nt, Mycobacterium bovis subsp bovis AF2122/97
ucgcgaugugcgccaccuc

SEQ ID NO: 1096509 - RNA, 19 nt, Mycobacterium bovis subsp bovis AF2122/97
ucgcgcagcaucuccgccg

SEQ ID NO: 1096510 - RNA, 17 nt, Mycobacterium bovis subsp bovis AF2122/97
ucgcgcagccgccgcgc

SEQ ID NO: 1096511 - RNA, 13 nt, Mycobacterium bovis subsp bovis AF2122/97
ucgcgcagcgccg

SEQ ID NO: 1096512 - RNA, 14 nt, Mycobacterium bovis subsp bovis AF2122/97
ucgcgcagcgccgc

SEQ ID NO: 1096513 - RNA, 22 nt, Mycobacterium bovis subsp bovis AF2122/97
ucgcgcauuucguugagaacau

SEQ ID NO: 1096514 - RNA, 19 nt, Mycobacterium bovis subsp bovis AF2122/97
ucgcgcauugccgacgcgc

SEQ ID NO: 1096515 - RNA, 16 nt, Mycobacterium bovis subsp bovis AF2122/97
ucgcgccauacuggcg

SEQ ID NO: 1096516 - RNA, 17 nt, Mycobacterium bovis subsp bovis AF2122/97
ucgcgccauacuggcgg

SEQ ID NO: 1096517 - RNA, 18 nt, Mycobacterium bovis subsp bovis AF2122/97
ucgcgccauacuggcggu

SEQ ID NO: 1096518 - RNA, 19 nt, Mycobacterium bovis subsp bovis AF2122/97
ucgcgccaucgucgcgccg

SEQ ID NO: 1096519 - RNA, 21 nt, Mycobacterium bovis subsp bovis AF2122/97
ucgcgcccucagccgcggcca

SEQ ID NO: 1096520 - RNA, 16 nt, Mycobacterium bovis subsp bovis AF2122/97
ucgcgcgcggcauggg

SEQ ID NO: 1096521 - RNA, 21 nt, Mycobacterium bovis subsp bovis AF2122/97
ucgcgccaggcgcgaucgcgc

SEQ ID NO: 1096522 - RNA, 16 nt, Mycobacterium bovis subsp bovis AF2122/97
ucgccgaaucgcugac

SEQ ID NO: 1096523 - RNA, 20 nt, Mycobacterium bovis subsp bovis AF2122/97
ucgccgaaucgcugaccgcg

SEQ ID NO: 1096524 - RNA, 21 nt, Mycobacterium bovis subsp bovis AF2122/97
ucgccgaaguuccagccgacg

SEQ ID NO: 1096525 - RNA, 16 nt, Mycobacterium bovis subsp bovis AF2122/97
ucgccgaccacucgag

SEQ ID NO: 1096526 - RNA, 17 nt, Mycobacterium bovis subsp bovis AF2122/97
ucgccgaaucucaccgu

SEQ ID NO: 1096527 - RNA, 17 nt, Mycobacterium bovis subsp bovis AF2122/97
ucgccgacacccucggg

SEQ ID NO: 1096528 - RNA, 22 nt, Mycobacterium bovis subsp bovis AF2122/97
ucgccgaccagcuugaccgacc

SEQ ID NO: 1096529 - RNA, 16 nt, Mycobacterium bovis subsp bovis AF2122/97
ucgccgaccuuggcgu

SEQ ID NO: 1096530 - RNA, 15 nt, Mycobacterium bovis subsp bovis AF2122/97
ucgccgacccgccgc

SEQ ID NO: 1096531 - RNA, 17 nt, Mycobacterium bovis subsp bovis AF2122/97
ucgccgacccgccgcgg

SEQ ID NO: 1096532 - RNA, 13 nt, Mycobacterium bovis subsp bovis AF2122/97
ucgccgacccggg

SEQ ID NO: 1096533 - RNA, 19 nt, Mycobacterium bovis subsp bovis AF2122/97
ucgccgaccuuggcgucga

SEQ ID NO: 1096534 - RNA, 15 nt, Mycobacterium bovis subsp bovis AF2122/97
ucgccgacgccagaa

SEQ ID NO: 1096535 - RNA, 12 nt, Mycobacterium bovis subsp bovis AF2122/97
ucgccgacgcga

SEQ ID NO: 1096536 - RNA, 20 nt, Mycobacterium bovis subsp bovis AF2122/97
ucgccgaucaacagcaccgu

SEQ ID NO: 1096537 - RNA, 14 nt, Mycobacterium bovis subsp bovis AF2122/97
ucgccgaucaccgc

SEQ ID NO: 1096538 - RNA, 21 nt, Mycobacterium bovis subsp bovis AF2122/97
ucgccgaucaccgcaucggug

SEQ ID NO: 1096539 - RNA, 21 nt, Mycobacterium bovis subsp bovis AF2122/97
ucgccgaguaccggccagccg

SEQ ID NO: 1096540 - RNA, 23 nt, Mycobacterium bovis subsp bovis AF2122/97
ucgccgaguaccggccagccgcg

SEQ ID NO: 1096541 - RNA, 21 nt, Mycobacterium bovis subsp bovis AF2122/97
ucgccgaucagcugcgcaucg

SEQ ID NO: 1096542 - RNA, 23 nt, Mycobacterium bovis subsp bovis AF2122/97
ucgccgccggugccgcccgagcc

SEQ ID NO: 1096543 - RNA, 21 nt, Mycobacterium bovis subsp bovis AF2122/97
ucgccgccguugccgccggcg

SEQ ID NO: 1096544 - RNA, 21 nt, Mycobacterium bovis subsp bovis AF2122/97
ucgccgccguugccgccggug

SEQ ID NO: 1096545 - RNA, 22 nt, Mycobacterium bovis subsp bovis AF2122/97
ucgccgccguuggcucgagccg

SEQ ID NO: 1096546 - RNA, 23 nt, Mycobacterium bovis subsp bovis AF2122/97
ucgccgccguuggcucgagccgc

SEQ ID NO: 1096547 - RNA, 17 nt, Mycobacterium bovis subsp bovis AF2122/97
ucgccgccuuacgcacc

SEQ ID NO: 1096548 - RNA, 15 nt, Mycobacterium bovis subsp bovis AF2122/97
ucgccgccgucaccg

SEQ ID NO: 1096549 - RNA, 18 nt, Mycobacterium bovis subsp bovis AF2122/97
ucgccgccuuccuggcgg

SEQ ID NO: 1096550 - RNA, 23 nt, Mycobacterium bovis subsp bovis AF2122/97
ucgccgccuucuucucggcgagc

SEQ ID NO: 1096551 - RNA, 18 nt, Mycobacterium bovis subsp bovis AF2122/97
ucgccgccuucuuggcgg

SEQ ID NO: 1096552 - RNA, 19 nt, Mycobacterium bovis subsp bovis AF2122/97
ucgccgccuucuuggcggc

SEQ ID NO: 1096553 - RNA, 21 nt, Mycobacterium bovis subsp bovis AF2122/97
ucgccgauguuggcagggcca

SEQ ID NO: 1096554 - RNA, 18 nt, Mycobacterium bovis subsp bovis AF2122/97
ucgccgcaacauggguga

SEQ ID NO: 1096555 - RNA, 22 nt, Mycobacterium bovis subsp bovis AF2122/97
ucgccgaugauguuuuccccgc

SEQ ID NO: 1096556 - RNA, 14 nt, Mycobacterium bovis subsp bovis AF2122/97
ucgccgcgcagcgu

SEQ ID NO: 1096557 - RNA, 19 nt, Mycobacterium bovis subsp bovis AF2122/97
ucgccgcgcagcgugcgau

SEQ ID NO: 1096558 - RNA, 21 nt, Mycobacterium bovis subsp bovis AF2122/97
ucgccgcgcagcgugcgaugc

SEQ ID NO: 1096559 - RNA, 16 nt, Mycobacterium bovis subsp bovis AF2122/97
ucgccgcgacugcacc

SEQ ID NO: 1096560 - RNA, 16 nt, Mycobacterium bovis subsp bovis AF2122/97
ucgccgcggcggcagc

SEQ ID NO: 1096561 - RNA, 17 nt, Mycobacterium bovis subsp bovis AF2122/97
ucgccgcggcggcagcg

SEQ ID NO: 1096562 - RNA, 22 nt, Mycobacterium bovis subsp bovis AF2122/97
ucgccgcgggacagauggcggc

SEQ ID NO: 1096563 - RNA, 14 nt, Mycobacterium bovis subsp bovis AF2122/97
ucgccgcgggcagc

SEQ ID NO: 1096564 - RNA, 14 nt, Mycobacterium bovis subsp bovis AF2122/97
ucgccgcggcagcg

SEQ ID NO: 1096565 - RNA, 20 nt, Mycobacterium bovis subsp bovis AF2122/97
ucgccgcggcagcguugacg

SEQ ID NO: 1096566 - RNA, 21 nt, Mycobacterium bovis subsp bovis AF2122/97
ucgccgcuaacgcaccugcgc

SEQ ID NO: 1096567 - RNA, 15 nt, Mycobacterium bovis subsp bovis AF2122/97
ucgccgcgggcagcg

SEQ ID NO: 1096568 - RNA, 18 nt, Mycobacterium bovis subsp bovis AF2122/97
ucgccgcucgguccccgc

SEQ ID NO: 1096569 - RNA, 15 nt, Mycobacterium bovis subsp bovis AF2122/97
ucgccgcuacgccgg

SEQ ID NO: 1096570 - RNA, 19 nt, Mycobacterium bovis subsp bovis AF2122/97
ucgccgcuugacgcagcuc

SEQ ID NO: 1096571 - RNA, 16 nt, Mycobacterium bovis subsp bovis AF2122/97
ucgccggcgccagcag

SEQ ID NO: 1096572 - RNA, 16 nt, Mycobacterium bovis subsp bovis AF2122/97
ucgccggcaccggaug

SEQ ID NO: 1096573 - RNA, 14 nt, Mycobacterium bovis subsp bovis AF2122/97
ucgccggcgcgccg

SEQ ID NO: 1096574 - RNA, 16 nt, Mycobacterium bovis subsp bovis AF2122/97
ucgccggcgcgccgau

SEQ ID NO: 1096575 - RNA, 19 nt, Mycobacterium bovis subsp bovis AF2122/97
ucgccggauagcgcagcuc

SEQ ID NO: 1096576 - RNA, 16 nt, Mycobacterium bovis subsp bovis AF2122/97
ucgccggauagcgcag

SEQ ID NO: 1096577 - RNA, 13 nt, Mycobacterium bovis subsp bovis AF2122/97
ucgccggagucga

SEQ ID NO: 1096578 - RNA, 18 nt, Mycobacterium bovis subsp bovis AF2122/97
ucgccggacugcggcccg

SEQ ID NO: 1096579 - RNA, 17 nt, Mycobacterium bovis subsp bovis AF2122/97
ucgccgcuuggcccggc

SEQ ID NO: 1096580 - RNA, 18 nt, Mycobacterium bovis subsp bovis AF2122/97
ucgccgcuuggcccggca

SEQ ID NO: 1096581 - RNA, 18 nt, Mycobacterium bovis subsp bovis AF2122/97
ucgccgcuuucuuggcgg

SEQ ID NO: 1096582 - RNA, 16 nt, Mycobacterium bovis subsp bovis AF2122/97
ucgcccaggaagccga

SEQ ID NO: 1096583 - RNA, 17 nt, Mycobacterium bovis subsp bovis AF2122/97
ucgcccaggaagccgag

SEQ ID NO: 1096584 - RNA, 21 nt, Mycobacterium bovis subsp bovis AF2122/97
ucgcccaggccaagguggcca

SEQ ID NO: 1096585 - RNA, 18 nt, Mycobacterium bovis subsp bovis AF2122/97
ucgcccgcacacagaccg

SEQ ID NO: 1096586 - RNA, 15 nt, Mycobacterium bovis subsp bovis AF2122/97
ucgcccgcaccagcu

SEQ ID NO: 1096587 - RNA, 21 nt, Mycobacterium bovis subsp bovis AF2122/97
ucgcccgaggcaacgaacgcc

SEQ ID NO: 1096588 - RNA, 12 nt, Mycobacterium bovis subsp bovis AF2122/97
ucgcccaggcgc

SEQ ID NO: 1096589 - RNA, 18 nt, Mycobacterium bovis subsp bovis AF2122/97
ucgcccaggcgugucguc

SEQ ID NO: 1096590 - RNA, 13 nt, Mycobacterium bovis subsp bovis AF2122/97
ucgcccagggugg

SEQ ID NO: 1096591 - RNA, 16 nt, Mycobacterium bovis subsp bovis AF2122/97
ucgcccagugcgcaac

SEQ ID NO: 1096592 - RNA, 12 nt, Mycobacterium bovis subsp bovis AF2122/97
ucgcccgauccg

SEQ ID NO: 1096593 - RNA, 18 nt, Mycobacterium bovis subsp bovis AF2122/97
ucgcccgcugccgucgga

SEQ ID NO: 1096594 - RNA, 16 nt, Mycobacterium bovis subsp bovis AF2122/97
ucgcccgcuacggcag

SEQ ID NO: 1096595 - RNA, 19 nt, Mycobacterium bovis subsp bovis AF2122/97
ucgccgaaaucggccagcu

SEQ ID NO: 1096596 - RNA, 20 nt, Mycobacterium bovis subsp bovis AF2122/97
ucgccgaagcgccgcuuggc

SEQ ID NO: 1096597 - RNA, 18 nt, Mycobacterium bovis subsp bovis AF2122/97
ucgccgaaaucggccagc

SEQ ID NO: 1096598 - RNA, 16 nt, Mycobacterium bovis subsp bovis AF2122/97
ucgcccugggcgccgg

SEQ ID NO: 1096599 - RNA, 17 nt, Mycobacterium bovis subsp bovis AF2122/97
ucgcccuguucggcccg

SEQ ID NO: 1096600 - RNA, 22 nt, Mycobacterium bovis subsp bovis AF2122/97
ucgcccugacacccaucgaccg

SEQ ID NO: 1096601 - RNA, 23 nt, Mycobacterium bovis subsp bovis AF2122/97
ucgcccugacacccaucgaccgc

SEQ ID NO: 1096602 - RNA, 18 nt, Mycobacterium bovis subsp bovis AF2122/97
ucgcccugacccggagcc

SEQ ID NO: 1096603 - RNA, 20 nt, Mycobacterium bovis subsp bovis AF2122/97
ucgcccugacgucacguucg

SEQ ID NO: 1096604 - RNA, 13 nt, Mycobacterium bovis subsp bovis AF2122/97
ucgcccggccccg

SEQ ID NO: 1096605 - RNA, 14 nt, Mycobacterium bovis subsp bovis AF2122/97
ucgcccugcagacg

SEQ ID NO: 1096606 - RNA, 19 nt, Mycobacterium bovis subsp bovis AF2122/97
ucgacgccggccagcggcc

SEQ ID NO: 1096607 - RNA, 23 nt, Mycobacterium bovis subsp bovis AF2122/97
ucgacgccgccacccggcgggcg

SEQ ID NO: 1096608 - RNA, 14 nt, Mycobacterium bovis subsp bovis AF2122/97
ucgacgcgcaucgc

SEQ ID NO: 1096609 - RNA, 21 nt, Mycobacterium bovis subsp bovis AF2122/97
ucgacgcgcauucgccgggcg

SEQ ID NO: 1096610 - RNA, 15 nt, Mycobacterium bovis subsp bovis AF2122/97
ucgacgccgagaccg

SEQ ID NO: 1096611 - RNA, 22 nt, Mycobacterium bovis subsp bovis AF2122/97
ucgacgcaccuauggucaaccg

SEQ ID NO: 1096612 - RNA, 13 nt, Mycobacterium bovis subsp bovis AF2122/97
ucgacgaucucgc

SEQ ID NO: 1096613 - RNA, 23 nt, Mycobacterium bovis subsp bovis AF2122/97
ucgccaugauggacagcugcggg

SEQ ID NO: 1096614 - RNA, 16 nt, Mycobacterium bovis subsp bovis AF2122/97
ucgcccaacaccgcgc

SEQ ID NO: 1096615 - RNA, 21 nt, Mycobacterium bovis subsp bovis AF2122/97
ucgcccagcaggcccuuggcg

SEQ ID NO: 1096616 - RNA, 18 nt, Mycobacterium bovis subsp bovis AF2122/97
ucgcccaauuucgugccg

SEQ ID NO: 1096617 - RNA, 17 nt, Mycobacterium bovis subsp bovis AF2122/97
ucgcccaauucggcacg

SEQ ID NO: 1096618 - RNA, 21 nt, Mycobacterium bovis subsp bovis AF2122/97
ucggccucgucgugcaccucg

SEQ ID NO: 1096619 - RNA, 14 nt, Mycobacterium bovis subsp bovis AF2122/97
ucggccugaccggu

SEQ ID NO: 1096620 - RNA, 16 nt, Mycobacterium bovis subsp bovis AF2122/97
ucggccugaccgguca

SEQ ID NO: 1096621 - RNA, 19 nt, Mycobacterium bovis subsp bovis AF2122/97
ucggcgaacgcggcgucga

SEQ ID NO: 1096622 - RNA, 22 nt, Mycobacterium bovis subsp bovis AF2122/97
ucggcgaacggauucccgccca

SEQ ID NO: 1096623 - RNA, 24 nt, Mycobacterium bovis subsp bovis AF2122/97
ucggcgaacggauucccgcccagc

SEQ ID NO: 1096624 - RNA, 20 nt, Mycobacterium bovis subsp bovis AF2122/97
ucggcgaacggcaccagauc

SEQ ID NO: 1096625 - RNA, 12 nt, Mycobacterium bovis subsp bovis AF2122/97
ucggcgaccagc

SEQ ID NO: 1096626 - RNA, 19 nt, Mycobacterium bovis subsp bovis AF2122/97
ucggcgaaugcgauugccg

SEQ ID NO: 1096627 - RNA, 22 nt, Mycobacterium bovis subsp bovis AF2122/97
ucggcgaaugcgauugccgucg

SEQ ID NO: 1096628 - RNA, 22 nt, Mycobacterium bovis subsp bovis AF2122/97
ucggcgacaggccgagcagaua

SEQ ID NO: 1096629 - RNA, 15 nt, Mycobacterium bovis subsp bovis AF2122/97
ucggcgaagcgggcg

SEQ ID NO: 1096630 - RNA, 16 nt, Mycobacterium bovis subsp bovis AF2122/97
ucggcgaauccgccgc

SEQ ID NO: 1096631 - RNA, 18 nt, Mycobacterium bovis subsp bovis AF2122/97
ucggcgaaugcgauugcc

SEQ ID NO: 1096632 - RNA, 16 nt, Mycobacterium bovis subsp bovis AF2122/97
ucggcgaccgacgccg

SEQ ID NO: 1096633 - RNA, 22 nt, Mycobacterium bovis subsp bovis AF2122/97
ucggcgaccgacgccggugucg

SEQ ID NO: 1096634 - RNA, 14 nt, Mycobacterium bovis subsp bovis AF2122/97
ucggcgaccgccug

SEQ ID NO: 1096635 - RNA, 20 nt, Mycobacterium bovis subsp bovis AF2122/97
ucggcgaccgccugcgcggc

SEQ ID NO: 1096636 - RNA, 23 nt, Mycobacterium bovis subsp bovis AF2122/97
ucggcgagcagcgcacgauuucg

SEQ ID NO: 1096637 - RNA, 15 nt, Mycobacterium bovis subsp bovis AF2122/97
ucggcgagcagcgca

SEQ ID NO: 1096638 - RNA, 16 nt, Mycobacterium bovis subsp bovis AF2122/97
ucggcgagcgcaucgg

SEQ ID NO: 1096639 - RNA, 16 nt, Mycobacterium bovis subsp bovis AF2122/97
ucggcgagccgcgccc

SEQ ID NO: 1096640 - RNA, 22 nt, Mycobacterium bovis subsp bovis AF2122/97
ucggcgagcgcaucggccaaca

SEQ ID NO: 1096641 - RNA, 13 nt, Mycobacterium bovis subsp bovis AF2122/97
ucggcgagcgccc

SEQ ID NO: 1096642 - RNA, 14 nt, Mycobacterium bovis subsp bovis AF2122/97
ucggcgagcgucgg

SEQ ID NO: 1096643 - RNA, 23 nt, Mycobacterium bovis subsp bovis AF2122/97
ucggcgaggaacuggaccggugc

SEQ ID NO: 1096644 - RNA, 18 nt, Mycobacterium bovis subsp bovis AF2122/97
ucggcgaggccucggcgg

SEQ ID NO: 1096645 - RNA, 23 nt, Mycobacterium bovis subsp bovis AF2122/97
ucggcgaggccucggcggccgug

SEQ ID NO: 1096646 - RNA, 21 nt, Mycobacterium bovis subsp bovis AF2122/97
ucggcgagucgguugucgggg

SEQ ID NO: 1096647 - RNA, 19 nt, Mycobacterium bovis subsp bovis AF2122/97
ucggcgaggucccggccga

SEQ ID NO: 1096648 - RNA, 18 nt, Mycobacterium bovis subsp bovis AF2122/97
ucggcgaguucggcagcg

SEQ ID NO: 1096649 - RNA, 15 nt, Mycobacterium bovis subsp bovis AF2122/97
ucggccacgcgcacu

SEQ ID NO: 1096650 - RNA, 17 nt, Mycobacterium bovis subsp bovis AF2122/97
ucggccacgucccagag

SEQ ID NO: 1096651 - RNA, 19 nt, Mycobacterium bovis subsp bovis AF2122/97
ucggccagcucgcgggccg

SEQ ID NO: 1096652 - RNA, 21 nt, Mycobacterium bovis subsp bovis AF2122/97
ucggccagcucgcgggccgcg

SEQ ID NO: 1096653 - RNA, 21 nt, Mycobacterium bovis subsp bovis AF2122/97
ucggccaggaugaagacgcgg

SEQ ID NO: 1096654 - RNA, 20 nt, Mycobacterium bovis subsp bovis AF2122/97
ucggccagcuugagguccgu

SEQ ID NO: 1096655 - RNA, 21 nt, Mycobacterium bovis subsp bovis AF2122/97
ucggccaggucgagcaccggc

SEQ ID NO: 1096656 - RNA, 18 nt, Mycobacterium bovis subsp bovis AF2122/97
ucggccguaucgucgagc

SEQ ID NO: 1096657 - RNA, 23 nt, Mycobacterium bovis subsp bovis AF2122/97
ucggccuccucgucgcucccggu

SEQ ID NO: 1096658 - RNA, 12 nt, Mycobacterium bovis subsp bovis AF2122/97
ucggccggcaac

SEQ ID NO: 1096659 - RNA, 15 nt, Mycobacterium bovis subsp bovis AF2122/97
ucggccggcacccca

SEQ ID NO: 1096660 - RNA, 21 nt, Mycobacterium bovis subsp bovis AF2122/97
ucggccggaugagcgaacgcc

SEQ ID NO: 1096661 - RNA, 16 nt, Mycobacterium bovis subsp bovis AF2122/97
ucggccggagccgccg

SEQ ID NO: 1096662 - RNA, 17 nt, Mycobacterium bovis subsp bovis AF2122/97
ucggccauagcgccgcg

SEQ ID NO: 1096663 - RNA, 15 nt, Mycobacterium bovis subsp bovis AF2122/97
ucggcggugccgacg

SEQ ID NO: 1096664 - RNA, 17 nt, Mycobacterium bovis subsp bovis AF2122/97
ucggcggugccgcggcu

SEQ ID NO: 1096665 - RNA, 20 nt, Mycobacterium bovis subsp bovis AF2122/97
ucggcggugaaaucgcacag

SEQ ID NO: 1096666 - RNA, 23 nt, Mycobacterium bovis subsp bovis AF2122/97
ucggcggugaaaucgcacagcgc

SEQ ID NO: 1096667 - RNA, 16 nt, Mycobacterium bovis subsp bovis AF2122/97
ucggcggucgccgcgc

SEQ ID NO: 1096668 - RNA, 16 nt, Mycobacterium bovis subsp bovis AF2122/97
ucggcgguucgauccc

SEQ ID NO: 1096669 - RNA, 22 nt, Mycobacterium bovis subsp bovis AF2122/97
ucggcguacccguuaugcgccg

SEQ ID NO: 1096670 - RNA, 19 nt, Mycobacterium bovis subsp bovis AF2122/97
ucggcguacucgugcaccg

SEQ ID NO: 1096671 - RNA, 17 nt, Mycobacterium bovis subsp bovis AF2122/97
ucggcgucauccaccgc

SEQ ID NO: 1096672 - RNA, 14 nt, Mycobacterium bovis subsp bovis AF2122/97
ucggcgucgaagac

SEQ ID NO: 1096673 - RNA, 17 nt, Mycobacterium bovis subsp bovis AF2122/97
ucggcgucgaccaguuc

SEQ ID NO: 1096674 - RNA, 23 nt, Mycobacterium bovis subsp bovis AF2122/97
ucggcgggggaccccgccagccg

SEQ ID NO: 1096675 - RNA, 17 nt, Mycobacterium bovis subsp bovis AF2122/97
ucggcggggaccgcggu

SEQ ID NO: 1096676 - RNA, 19 nt, Mycobacterium bovis subsp bovis AF2122/97
ucggcgggcgugugcaguc

SEQ ID NO: 1096677 - RNA, 16 nt, Mycobacterium bovis subsp bovis AF2122/97
ucggcggggcgccgga

SEQ ID NO: 1096678 - RNA, 20 nt, Mycobacterium bovis subsp bovis AF2122/97
ucggcgggggaccccgccag

SEQ ID NO: 1096679 - RNA, 21 nt, Mycobacterium bovis subsp bovis AF2122/97
ucggcgggucugggucaggcg

SEQ ID NO: 1096680 - RNA, 19 nt, Mycobacterium bovis subsp bovis AF2122/97
ucggcgguagccgaccagc

SEQ ID NO: 1096681 - RNA, 15 nt, Mycobacterium bovis subsp bovis AF2122/97
ucggcgggcggcagc

SEQ ID NO: 1096682 - RNA, 17 nt, Mycobacterium bovis subsp bovis AF2122/97
ucggcgggauccucgaa

SEQ ID NO: 1096683 - RNA, 19 nt, Mycobacterium bovis subsp bovis AF2122/97
ucggcggcuuggccgcccc

SEQ ID NO: 1096684 - RNA, 21 nt, Mycobacterium bovis subsp bovis AF2122/97
ucggcggcuucgauugcgcug

SEQ ID NO: 1096685 - RNA, 13 nt, Mycobacterium bovis subsp bovis AF2122/97
ucggcggcgucga

SEQ ID NO: 1096686 - RNA, 17 nt, Mycobacterium bovis subsp bovis AF2122/97
ucggcggcgucgacguc

SEQ ID NO: 1096687 - RNA, 22 nt, Mycobacterium bovis subsp bovis AF2122/97
ucggcggcucuagaucgccgag

SEQ ID NO: 1096688 - RNA, 19 nt, Mycobacterium bovis subsp bovis AF2122/97
ucggcgccgagcagcccgc

SEQ ID NO: 1096689 - RNA, 15 nt, Mycobacterium bovis subsp bovis AF2122/97
ucggcgccgaacuca

SEQ ID NO: 1096690 - RNA, 13 nt, Mycobacterium bovis subsp bovis AF2122/97
ucggcgcugcggc

SEQ ID NO: 1096691 - RNA, 22 nt, Mycobacterium bovis subsp bovis AF2122/97
ucggcgcugcggcgugccgggu

SEQ ID NO: 1096692 - RNA, 21 nt, Mycobacterium bovis subsp bovis AF2122/97
ucggcgcugaucgcgcgcacc

SEQ ID NO: 1096693 - RNA, 14 nt, Mycobacterium bovis subsp bovis AF2122/97
ucggcgccgcgccg

SEQ ID NO: 1096694 - RNA, 20 nt, Mycobacterium bovis subsp bovis AF2122/97
ucggcgccgccguccagcgc

SEQ ID NO: 1096695 - RNA, 22 nt, Mycobacterium bovis subsp bovis AF2122/97
ucggcggacaggcccgguggcg

SEQ ID NO: 1096696 - RNA, 16 nt, Mycobacterium bovis subsp bovis AF2122/97
ucggcggacccgguga

SEQ ID NO: 1096697 - RNA, 21 nt, Mycobacterium bovis subsp bovis AF2122/97
ucggcggaagaccggaucgcc

SEQ ID NO: 1096698 - RNA, 23 nt, Mycobacterium bovis subsp bovis AF2122/97
ucggcggcggggacucugccacc

SEQ ID NO: 1096699 - RNA, 12 nt, Mycobacterium bovis subsp bovis AF2122/97
ucggcggcggcu

SEQ ID NO: 1096700 - RNA, 18 nt, Mycobacterium bovis subsp bovis AF2122/97
ucggcggcgcgccgaucg

SEQ ID NO: 1096701 - RNA, 19 nt, Mycobacterium bovis subsp bovis AF2122/97
ucggcggcgcggucgaagc

SEQ ID NO: 1096702 - RNA, 21 nt, Mycobacterium bovis subsp bovis AF2122/97
ucggcggcgcgugcgguggcg

SEQ ID NO: 1096703 - RNA, 21 nt, Mycobacterium bovis subsp bovis AF2122/97
ucggcggagagcacugggcug

SEQ ID NO: 1096704 - RNA, 19 nt, Mycobacterium bovis subsp bovis AF2122/97
ucggcggacccggugaccc

SEQ ID NO: 1096705 - RNA, 22 nt, Mycobacterium bovis subsp bovis AF2122/97
ucggcgccgccguccagcgccg

SEQ ID NO: 1096706 - RNA, 17 nt, Mycobacterium bovis subsp bovis AF2122/97
ucggcggaccgcagcgu

SEQ ID NO: 1096707 - RNA, 17 nt, Mycobacterium bovis subsp bovis AF2122/97
ucggcggcgacguggcg

SEQ ID NO: 1096708 - RNA, 13 nt, Mycobacterium bovis subsp bovis AF2122/97
ucggcggccagcg

SEQ ID NO: 1096709 - RNA, 23 nt, Mycobacterium bovis subsp bovis AF2122/97
ucggcggcauaaacaucgguggc

SEQ ID NO: 1096710 - RNA, 16 nt, Mycobacterium bovis subsp bovis AF2122/97
ucggcggccaacagca

SEQ ID NO: 1096711 - RNA, 22 nt, Mycobacterium bovis subsp bovis AF2122/97
ucggcggcgacguggcgccgac

SEQ ID NO: 1096712 - RNA, 17 nt, Mycobacterium bovis subsp bovis AF2122/97
ucggccaacccgggccg

SEQ ID NO: 1096713 - RNA, 18 nt, Mycobacterium bovis subsp bovis AF2122/97
ucggccaacccgggccgc

SEQ ID NO: 1096714 - RNA, 17 nt, Mycobacterium bovis subsp bovis AF2122/97
ucggccacauccagcgc

SEQ ID NO: 1096715 - RNA, 15 nt, Mycobacterium bovis subsp bovis AF2122/97
ucggccaccaaccuc

SEQ ID NO: 1096716 - RNA, 17 nt, Mycobacterium bovis subsp bovis AF2122/97
ucggccaccaacucggc

SEQ ID NO: 1096717 - RNA, 18 nt, Mycobacterium bovis subsp bovis AF2122/97
ucggccaccggcgucugc

SEQ ID NO: 1096718 - RNA, 20 nt, Mycobacterium bovis subsp bovis AF2122/97
ucggccaccaacucggcgac

SEQ ID NO: 1096719 - RNA, 16 nt, Mycobacterium bovis subsp bovis AF2122/97
ucggcaggguggccag

SEQ ID NO: 1096720 - RNA, 17 nt, Mycobacterium bovis subsp bovis AF2122/97
ucggcaggguggccagc

SEQ ID NO: 1096721 - RNA, 20 nt, Mycobacterium bovis subsp bovis AF2122/97
ucggcagcucccgccacguc

SEQ ID NO: 1096722 - RNA, 21 nt, Mycobacterium bovis subsp bovis AF2122/97
ucggcagcucccgccacgucg

SEQ ID NO: 1096723 - RNA, 14 nt, Mycobacterium bovis subsp bovis AF2122/97
ucggcaggccgcuu

SEQ ID NO: 1096724 - RNA, 17 nt, Mycobacterium bovis subsp bovis AF2122/97
ucggcagcuucucgccg

SEQ ID NO: 1096725 - RNA, 16 nt, Mycobacterium bovis subsp bovis AF2122/97
ucggcagcccggugug

SEQ ID NO: 1096726 - RNA, 17 nt, Mycobacterium bovis subsp bovis AF2122/97
ucggcagcgacgccggc

SEQ ID NO: 1096727 - RNA, 13 nt, Mycobacterium bovis subsp bovis AF2122/97
ucggcaccaccgc

SEQ ID NO: 1096728 - RNA, 23 nt, Mycobacterium bovis subsp bovis AF2122/97
ucggcaaugacguacggggucgc

SEQ ID NO: 1096729 - RNA, 19 nt, Mycobacterium bovis subsp bovis AF2122/97
ucggcaccauagcuggagu

SEQ ID NO: 1096730 - RNA, 18 nt, Mycobacterium bovis subsp bovis AF2122/97
ucggcaccaccgcgaccu

SEQ ID NO: 1096731 - RNA, 15 nt, Mycobacterium bovis subsp bovis AF2122/97
ucggcaccagcgcgc

SEQ ID NO: 1096732 - RNA, 20 nt, Mycobacterium bovis subsp bovis AF2122/97
ucggcaccagcgcgcgccga

SEQ ID NO: 1096733 - RNA, 18 nt, Mycobacterium bovis subsp bovis AF2122/97
ucggcaacgacccgccgc

SEQ ID NO: 1096734 - RNA, 13 nt, Mycobacterium bovis subsp bovis AF2122/97
ucggcaaccaacc

SEQ ID NO: 1096735 - RNA, 20 nt, Mycobacterium bovis subsp bovis AF2122/97
ucggcaaccaccucgugggc

SEQ ID NO: 1096736 - RNA, 22 nt, Mycobacterium bovis subsp bovis AF2122/97
ucggcaaaccaagcgcgccagc

SEQ ID NO: 1096737 - RNA, 23 nt, Mycobacterium bovis subsp bovis AF2122/97
ucggcaaggacguggcgcuggac

SEQ ID NO: 1096738 - RNA, 15 nt, Mycobacterium bovis subsp bovis AF2122/97
ucggcaagucgacgc

SEQ ID NO: 1096739 - RNA, 24 nt, Mycobacterium bovis subsp bovis AF2122/97
ucggcaagucgacgccgcagcguc

SEQ ID NO: 1096740 - RNA, 13 nt, Mycobacterium bovis subsp bovis AF2122/97
ucggaaucggcgg

SEQ ID NO: 1096741 - RNA, 18 nt, Mycobacterium bovis subsp bovis AF2122/97
ucggaauacaacagcugg

SEQ ID NO: 1096742 - RNA, 20 nt, Mycobacterium bovis subsp bovis AF2122/97
ucggaacgugaccgacgccg

SEQ ID NO: 1096743 - RNA, 16 nt, Mycobacterium bovis subsp bovis AF2122/97
ucggaugucccuugac

SEQ ID NO: 1096744 - RNA, 13 nt, Mycobacterium bovis subsp bovis AF2122/97
ucggauggcggcc

SEQ ID NO: 1096745 - RNA, 22 nt, Mycobacterium bovis subsp bovis AF2122/97
ucggaucggcgccgcauaccag

SEQ ID NO: 1096746 - RNA, 15 nt, Mycobacterium bovis subsp bovis AF2122/97
ucggaugaccaguga

SEQ ID NO: 1096747 - RNA, 19 nt, Mycobacterium bovis subsp bovis AF2122/97
ucggaugcaacccggugau

SEQ ID NO: 1096748 - RNA, 18 nt, Mycobacterium bovis subsp bovis AF2122/97
ucggaucgauuccgccgc

SEQ ID NO: 1096749 - RNA, 17 nt, Mycobacterium bovis subsp bovis AF2122/97
ucggaucggcgccgcau

SEQ ID NO: 1096750 - RNA, 16 nt, Mycobacterium bovis subsp bovis AF2122/97
ucggauuuuccgccug

SEQ ID NO: 1096751 - RNA, 17 nt, Mycobacterium bovis subsp bovis AF2122/97
ucggauugcagcgcgau

SEQ ID NO: 1096752 - RNA, 16 nt, Mycobacterium bovis subsp bovis AF2122/97
ucgcuguaggcagccu

SEQ ID NO: 1096753 - RNA, 16 nt, Mycobacterium bovis subsp bovis AF2122/97
ucgcugucgaucagcg

SEQ ID NO: 1096754 - RNA, 13 nt, Mycobacterium bovis subsp bovis AF2122/97
ucgcuugcgcacg

SEQ ID NO: 1096755 - RNA, 16 nt, Mycobacterium bovis subsp bovis AF2122/97
ucggaaaaccgcaccg

SEQ ID NO: 1096756 - RNA, 15 nt, Mycobacterium bovis subsp bovis AF2122/97
ucgcgugccacagca

SEQ ID NO: 1096757 - RNA, 14 nt, Mycobacterium bovis subsp bovis AF2122/97
ucgcguggccgccg

SEQ ID NO: 1096758 - RNA, 18 nt, Mycobacterium bovis subsp bovis AF2122/97
ucgcguggcgcaccaccg

SEQ ID NO: 1096759 - RNA, 22 nt, Mycobacterium bovis subsp bovis AF2122/97
ucgcgucugacaucgucgacga

SEQ ID NO: 1096760 - RNA, 14 nt, Mycobacterium bovis subsp bovis AF2122/97
ucgcgucugcucgc

SEQ ID NO: 1096761 - RNA, 23 nt, Mycobacterium bovis subsp bovis AF2122/97
ucgcgucgucuucuucgcggauc

SEQ ID NO: 1096762 - RNA, 15 nt, Mycobacterium bovis subsp bovis AF2122/97
ucgcgucgccgauga

SEQ ID NO: 1096763 - RNA, 16 nt, Mycobacterium bovis subsp bovis AF2122/97
ucgcgucgccgaugaa

SEQ ID NO: 1096764 - RNA, 13 nt, Mycobacterium bovis subsp bovis AF2122/97
ucgcgucgccgau

SEQ ID NO: 1096765 - RNA, 17 nt, Mycobacterium bovis subsp bovis AF2122/97
ucgcgucgagagaacgu

SEQ ID NO: 1096766 - RNA, 16 nt, Mycobacterium bovis subsp bovis AF2122/97
ucgcgggccgcgucga

SEQ ID NO: 1096767 - RNA, 15 nt, Mycobacterium bovis subsp bovis AF2122/97
ucgcgucaucaacgu

SEQ ID NO: 1096768 - RNA, 13 nt, Mycobacterium bovis subsp bovis AF2122/97
ucgcguccucggg

SEQ ID NO: 1096769 - RNA, 23 nt, Mycobacterium bovis subsp bovis AF2122/97
ucgcggucuuugagccgguagcu

SEQ ID NO: 1096770 - RNA, 15 nt, Mycobacterium bovis subsp bovis AF2122/97
ucgcggucgccaccg

SEQ ID NO: 1096771 - RNA, 16 nt, Mycobacterium bovis subsp bovis AF2122/97
ucgcggucgccaccgu

SEQ ID NO: 1096772 - RNA, 15 nt, Mycobacterium bovis subsp bovis AF2122/97
ucgcggugaccggcu

SEQ ID NO: 1096773 - RNA, 13 nt, Mycobacterium bovis subsp bovis AF2122/97
ucgcgguggcggc

SEQ ID NO: 1096774 - RNA, 13 nt, Mycobacterium bovis subsp bovis AF2122/97
ucgcgguggccga

SEQ ID NO: 1096775 - RNA, 18 nt, Mycobacterium bovis subsp bovis AF2122/97
ucgcggugugcggcagcc

SEQ ID NO: 1096776 - RNA, 14 nt, Mycobacterium bovis subsp bovis AF2122/97
ucgcggugugcggc

SEQ ID NO: 1096777 - RNA, 21 nt, Mycobacterium bovis subsp bovis AF2122/97
ucgcggugggccccgaucccg

SEQ ID NO: 1096778 - RNA, 17 nt, Mycobacterium bovis subsp bovis AF2122/97
ucgcgucacccggggcu

SEQ ID NO: 1096779 - RNA, 21 nt, Mycobacterium bovis subsp bovis AF2122/97
ucgcgguuguccuccgacggg

SEQ ID NO: 1096780 - RNA, 22 nt, Mycobacterium bovis subsp bovis AF2122/97
ucgcguaauuuggcuugcgccg

SEQ ID NO: 1096781 - RNA, 19 nt, Mycobacterium bovis subsp bovis AF2122/97
ucgcgguuuuggucgcgau

SEQ ID NO: 1096782 - RNA, 21 nt, Mycobacterium bovis subsp bovis AF2122/97
ucgcguuucgcagccgcaccg

SEQ ID NO: 1096783 - RNA, 18 nt, Mycobacterium bovis subsp bovis AF2122/97
ucgcguuucgcgaugugc

SEQ ID NO: 1096784 - RNA, 17 nt, Mycobacterium bovis subsp bovis AF2122/97
ucgcguugcagaccacc

SEQ ID NO: 1096785 - RNA, 19 nt, Mycobacterium bovis subsp bovis AF2122/97
ucgcguugcagaccaccag

SEQ ID NO: 1096786 - RNA, 20 nt, Mycobacterium bovis subsp bovis AF2122/97
ucgcucccccgcuacgcgcg

SEQ ID NO: 1096787 - RNA, 23 nt, Mycobacterium bovis subsp bovis AF2122/97
ucgcgugcggugccgugguggac

SEQ ID NO: 1096788 - RNA, 22 nt, Mycobacterium bovis subsp bovis AF2122/97
ucgcguucugcaccagcucggu

SEQ ID NO: 1096789 - RNA, 21 nt, Mycobacterium bovis subsp bovis AF2122/97
ucgcguugacucugcguccac

SEQ ID NO: 1096790 - RNA, 17 nt, Mycobacterium bovis subsp bovis AF2122/97
ucgcguucuccggcacc

SEQ ID NO: 1096791 - RNA, 20 nt, Mycobacterium bovis subsp bovis AF2122/97
ucgcguucuccggcaccggu

SEQ ID NO: 1096792 - RNA, 14 nt, Mycobacterium bovis subsp bovis AF2122/97
ucgcguucugcacc

SEQ ID NO: 1096793 - RNA, 22 nt, Mycobacterium bovis subsp bovis AF2122/97
ucgcugaccgcguagaccagug

SEQ ID NO: 1096794 - RNA, 12 nt, Mycobacterium bovis subsp bovis AF2122/97
ucgcugaccgcg

SEQ ID NO: 1096795 - RNA, 20 nt, Mycobacterium bovis subsp bovis AF2122/97
ucgcugaagccgucguaugc

SEQ ID NO: 1096796 - RNA, 19 nt, Mycobacterium bovis subsp bovis AF2122/97
ucgcuggugaaccacucgg

SEQ ID NO: 1096797 - RNA, 19 nt, Mycobacterium bovis subsp bovis AF2122/97
ucgcuggcuugggccagcg

SEQ ID NO: 1096798 - RNA, 20 nt, Mycobacterium bovis subsp bovis AF2122/97
ucgcuggcuugggccagcgc

SEQ ID NO: 1096799 - RNA, 22 nt, Mycobacterium bovis subsp bovis AF2122/97
ucgcugguauagcucacggugg

SEQ ID NO: 1096800 - RNA, 12 nt, Mycobacterium bovis subsp bovis AF2122/97
ucgcuccgaccg

SEQ ID NO: 1096801 - RNA, 13 nt, Mycobacterium bovis subsp bovis AF2122/97
ucgcuccgaccgg

SEQ ID NO: 1096802 - RNA, 16 nt, Mycobacterium bovis subsp bovis AF2122/97
ucgcuccgaccggugg

SEQ ID NO: 1096803 - RNA, 19 nt, Mycobacterium bovis subsp bovis AF2122/97
ucgcuccggcccugccgcc

SEQ ID NO: 1096804 - RNA, 13 nt, Mycobacterium bovis subsp bovis AF2122/97
ucgcucucgguca

SEQ ID NO: 1096805 - RNA, 18 nt, Mycobacterium bovis subsp bovis AF2122/97
ucgcucugugucgccgau

SEQ ID NO: 1096806 - RNA, 16 nt, Mycobacterium bovis subsp bovis AF2122/97
ucggucagcgccgacu

SEQ ID NO: 1096807 - RNA, 20 nt, Mycobacterium bovis subsp bovis AF2122/97
ucggucaacucgaacgucac

SEQ ID NO: 1096808 - RNA, 15 nt, Mycobacterium bovis subsp bovis AF2122/97
ucggucaccgaacga

SEQ ID NO: 1096809 - RNA, 12 nt, Mycobacterium bovis subsp bovis AF2122/97
ucggucaccgac

SEQ ID NO: 1096810 - RNA, 16 nt, Mycobacterium bovis subsp bovis AF2122/97
ucggucaccucgaugc

SEQ ID NO: 1096811 - RNA, 20 nt, Mycobacterium bovis subsp bovis AF2122/97
ucggucaccauggcgccgcg

SEQ ID NO: 1096812 - RNA, 21 nt, Mycobacterium bovis subsp bovis AF2122/97
ucggucaccauggcgccgcgc

SEQ ID NO: 1096813 - RNA, 18 nt, Mycobacterium bovis subsp bovis AF2122/97
ucggucaauucggugcgc

SEQ ID NO: 1096814 - RNA, 22 nt, Mycobacterium bovis subsp bovis AF2122/97
ucggucaauucggugcgcuggc

SEQ ID NO: 1096815 - RNA, 18 nt, Mycobacterium bovis subsp bovis AF2122/97
ucggucaccacggcggcg

SEQ ID NO: 1096816 - RNA, 12 nt, Mycobacterium bovis subsp bovis AF2122/97
ucggucaccgaa

SEQ ID NO: 1096817 - RNA, 12 nt, Mycobacterium bovis subsp bovis AF2122/97
ucggucaacucg

SEQ ID NO: 1096818 - RNA, 22 nt, Mycobacterium bovis subsp bovis AF2122/97
ucggguccgaaguacuggccgc

SEQ ID NO: 1096819 - RNA, 15 nt, Mycobacterium bovis subsp bovis AF2122/97
ucggguagaucgccu

SEQ ID NO: 1096820 - RNA, 15 nt, Mycobacterium bovis subsp bovis AF2122/97
ucggguaggccgccg

SEQ ID NO: 1096821 - RNA, 17 nt, Mycobacterium bovis subsp bovis AF2122/97
ucggguaggccgccgug

SEQ ID NO: 1096822 - RNA, 18 nt, Mycobacterium bovis subsp bovis AF2122/97
ucgggucguuggcggcgg

SEQ ID NO: 1096823 - RNA, 22 nt, Mycobacterium bovis subsp bovis AF2122/97
ucgggugcgcccggccaagccg

SEQ ID NO: 1096824 - RNA, 16 nt, Mycobacterium bovis subsp bovis AF2122/97
ucgggugcgcugcgau

SEQ ID NO: 1096825 - RNA, 16 nt, Mycobacterium bovis subsp bovis AF2122/97
ucgggguggugguauc

SEQ ID NO: 1096826 - RNA, 12 nt, Mycobacterium bovis subsp bovis AF2122/97
ucggcuccacgc

SEQ ID NO: 1096827 - RNA, 18 nt, Mycobacterium bovis subsp bovis AF2122/97
ucgggguucuuccacagc

SEQ ID NO: 1096828 - RNA, 18 nt, Mycobacterium bovis subsp bovis AF2122/97
ucggcuaccgccgaccgg

SEQ ID NO: 1096829 - RNA, 23 nt, Mycobacterium bovis subsp bovis AF2122/97
ucggcuaccuaacccgcgccggc

SEQ ID NO: 1096830 - RNA, 21 nt, Mycobacterium bovis subsp bovis AF2122/97
ucggcuaccuuguccggcccg

SEQ ID NO: 1096831 - RNA, 17 nt, Mycobacterium bovis subsp bovis AF2122/97
ucggcucaccgaacgcg

SEQ ID NO: 1096832 - RNA, 14 nt, Mycobacterium bovis subsp bovis AF2122/97
ucggcucagcaacg

SEQ ID NO: 1096833 - RNA, 21 nt, Mycobacterium bovis subsp bovis AF2122/97
ucggcucagcaacgucacguc

SEQ ID NO: 1096834 - RNA, 22 nt, Mycobacterium bovis subsp bovis AF2122/97
ucggcucagcaacgucacgucg

SEQ ID NO: 1096835 - RNA, 14 nt, Mycobacterium bovis subsp bovis AF2122/97
ucggcgugucgggg

SEQ ID NO: 1096836 - RNA, 17 nt, Mycobacterium bovis subsp bovis AF2122/97
ucggcguuaucgaaggc

SEQ ID NO: 1096837 - RNA, 15 nt, Mycobacterium bovis subsp bovis AF2122/97
ucggcguugccgccg

SEQ ID NO: 1096838 - RNA, 17 nt, Mycobacterium bovis subsp bovis AF2122/97
ucggcguugccgccguu

SEQ ID NO: 1096839 - RNA, 23 nt, Mycobacterium bovis subsp bovis AF2122/97
ucggcguggcugccuucggcgag

SEQ ID NO: 1096840 - RNA, 21 nt, Mycobacterium bovis subsp bovis AF2122/97
ucggcgugguguccaccgcau

SEQ ID NO: 1096841 - RNA, 17 nt, Mycobacterium bovis subsp bovis AF2122/97
ucggcgugucgcgucgc

SEQ ID NO: 1096842 - RNA, 20 nt, Mycobacterium bovis subsp bovis AF2122/97
ucggugaccucggcgaccag

SEQ ID NO: 1096843 - RNA, 14 nt, Mycobacterium bovis subsp bovis AF2122/97
ucggugacgaaaca

SEQ ID NO: 1096844 - RNA, 17 nt, Mycobacterium bovis subsp bovis AF2122/97
ucggugacaccaacacc

SEQ ID NO: 1096845 - RNA, 15 nt, Mycobacterium bovis subsp bovis AF2122/97
ucggucagggugggc

SEQ ID NO: 1096846 - RNA, 21 nt, Mycobacterium bovis subsp bovis AF2122/97
ucggugaaaaaggcgacucgg

SEQ ID NO: 1096847 - RNA, 20 nt, Mycobacterium bovis subsp bovis AF2122/97
ucggugaaauucgcggcggu

SEQ ID NO: 1096848 - RNA, 16 nt, Mycobacterium bovis subsp bovis AF2122/97
ucggugagcagggcgg

SEQ ID NO: 1096849 - RNA, 17 nt, Mycobacterium bovis subsp bovis AF2122/97
ucggugagcagggcggc

SEQ ID NO: 1096850 - RNA, 17 nt, Mycobacterium bovis subsp bovis AF2122/97
ucggugagccgggcggc

SEQ ID NO: 1096851 - RNA, 21 nt, Mycobacterium bovis subsp bovis AF2122/97
ucggugagccgggcggccucg

SEQ ID NO: 1096852 - RNA, 16 nt, Mycobacterium bovis subsp bovis AF2122/97
ucggugagcgcgucgc

SEQ ID NO: 1096853 - RNA, 20 nt, Mycobacterium bovis subsp bovis AF2122/97
ucggugacggccggcggucg

SEQ ID NO: 1096854 - RNA, 14 nt, Mycobacterium bovis subsp bovis AF2122/97
ucggugaagaacau

SEQ ID NO: 1096855 - RNA, 22 nt, Mycobacterium bovis subsp bovis AF2122/97
ucggugaucgagguugacguca

SEQ ID NO: 1096856 - RNA, 17 nt, Mycobacterium bovis subsp bovis AF2122/97
ucggugaucgcgguggc

SEQ ID NO: 1096857 - RNA, 20 nt, Mycobacterium bovis subsp bovis AF2122/97
ucggugaugaacgacauccg

SEQ ID NO: 1096858 - RNA, 17 nt, Mycobacterium bovis subsp bovis AF2122/97
ucggugaggucgaugcc

SEQ ID NO: 1096859 - RNA, 18 nt, Mycobacterium bovis subsp bovis AF2122/97
ucggugaggucgaugccg

SEQ ID NO: 1096860 - RNA, 20 nt, Mycobacterium bovis subsp bovis AF2122/97
ucggugaucaaaccggcggc

SEQ ID NO: 1096861 - RNA, 21 nt, Mycobacterium bovis subsp bovis AF2122/97
ucggugaucaaaccggcggcg

SEQ ID NO: 1096862 - RNA, 14 nt, Mycobacterium bovis subsp bovis AF2122/97
ucggugaucaccgc

SEQ ID NO: 1096863 - RNA, 23 nt, Mycobacterium bovis subsp bovis AF2122/97
ucgguggcgccgaacgccagcag

SEQ ID NO: 1096864 - RNA, 14 nt, Mycobacterium bovis subsp bovis AF2122/97
ucgguggcgccggg

SEQ ID NO: 1096865 - RNA, 19 nt, Mycobacterium bovis subsp bovis AF2122/97
ucgguggcgccggggcgca

SEQ ID NO: 1096866 - RNA, 15 nt, Mycobacterium bovis subsp bovis AF2122/97
ucgguggcugcgccg

SEQ ID NO: 1096867 - RNA, 16 nt, Mycobacterium bovis subsp bovis AF2122/97
ucgguggcggcacgca

SEQ ID NO: 1096868 - RNA, 15 nt, Mycobacterium bovis subsp bovis AF2122/97
ucgguggcggcagca

SEQ ID NO: 1096869 - RNA, 20 nt, Mycobacterium bovis subsp bovis AF2122/97
ucgguggggucgcugccgcc

SEQ ID NO: 1096870 - RNA, 12 nt, Mycobacterium bovis subsp bovis AF2122/97
ucggugggcggc

SEQ ID NO: 1096871 - RNA, 16 nt, Mycobacterium bovis subsp bovis AF2122/97
ucggugggcggcgagc

SEQ ID NO: 1096872 - RNA, 17 nt, Mycobacterium bovis subsp bovis AF2122/97
ucggugggcgggugcgc

SEQ ID NO: 1096873 - RNA, 16 nt, Mycobacterium bovis subsp bovis AF2122/97
ucggugggucucggcg

SEQ ID NO: 1096874 - RNA, 18 nt, Mycobacterium bovis subsp bovis AF2122/97
ucggugguaccggcggcg

SEQ ID NO: 1096875 - RNA, 12 nt, Mycobacterium bovis subsp bovis AF2122/97
ucggugguacgu

SEQ ID NO: 1096876 - RNA, 19 nt, Mycobacterium bovis subsp bovis AF2122/97
ucgguggucuuggcccggc

SEQ ID NO: 1096877 - RNA, 19 nt, Mycobacterium bovis subsp bovis AF2122/97
ucggugguggcgucgaugg

SEQ ID NO: 1096878 - RNA, 19 nt, Mycobacterium bovis subsp bovis AF2122/97
ucggugccgugaucggcgc

SEQ ID NO: 1096879 - RNA, 19 nt, Mycobacterium bovis subsp bovis AF2122/97
ucggugccgccgccggcgc

SEQ ID NO: 1096880 - RNA, 21 nt, Mycobacterium bovis subsp bovis AF2122/97
ucggugccgccgccggcgccg

SEQ ID NO: 1096881 - RNA, 23 nt, Mycobacterium bovis subsp bovis AF2122/97
ucggugccgccgccggcgccgga

SEQ ID NO: 1096882 - RNA, 16 nt, Mycobacterium bovis subsp bovis AF2122/97
ucggugccgaacagcg

SEQ ID NO: 1096883 - RNA, 14 nt, Mycobacterium bovis subsp bovis AF2122/97
ucggugcccaaccc

SEQ ID NO: 1096884 - RNA, 18 nt, Mycobacterium bovis subsp bovis AF2122/97
ucggugauggagccggug

SEQ ID NO: 1096885 - RNA, 19 nt, Mycobacterium bovis subsp bovis AF2122/97
ucggugaugcccagcgccg

SEQ ID NO: 1096886 - RNA, 19 nt, Mycobacterium bovis subsp bovis AF2122/97
ucggugaugucggugcguc

SEQ ID NO: 1096887 - RNA, 15 nt, Mycobacterium bovis subsp bovis AF2122/97
ucggugcacgagcgg

SEQ ID NO: 1096888 - RNA, 21 nt, Mycobacterium bovis subsp bovis AF2122/97
ucggugcagcgcacgcagccg

SEQ ID NO: 1096889 - RNA, 21 nt, Mycobacterium bovis subsp bovis AF2122/97
ucggugccacugccggugggc

SEQ ID NO: 1096890 - RNA, 16 nt, Mycobacterium bovis subsp bovis AF2122/97
ucgucgagcugaccac

SEQ ID NO: 1096891 - RNA, 15 nt, Mycobacterium bovis subsp bovis AF2122/97
ucgucgagcugaucc

SEQ ID NO: 1096892 - RNA, 17 nt, Mycobacterium bovis subsp bovis AF2122/97
ucgucgagccacagcgu

SEQ ID NO: 1096893 - RNA, 13 nt, Mycobacterium bovis subsp bovis AF2122/97
ucgucgagccgac

SEQ ID NO: 1096894 - RNA, 17 nt, Mycobacterium bovis subsp bovis AF2122/97
ucgucgagccgaccgcg

SEQ ID NO: 1096895 - RNA, 20 nt, Mycobacterium bovis subsp bovis AF2122/97
ucgucgagccgaucgcccgc

SEQ ID NO: 1096896 - RNA, 15 nt, Mycobacterium bovis subsp bovis AF2122/97
ucgucgaguuggcca

SEQ ID NO: 1096897 - RNA, 20 nt, Mycobacterium bovis subsp bovis AF2122/97
ucgucgaggucagugggcgg

SEQ ID NO: 1096898 - RNA, 16 nt, Mycobacterium bovis subsp bovis AF2122/97
ucgucgagguccucga

SEQ ID NO: 1096899 - RNA, 18 nt, Mycobacterium bovis subsp bovis AF2122/97
ucgucgaucucgaucgac

SEQ ID NO: 1096900 - RNA, 23 nt, Mycobacterium bovis subsp bovis AF2122/97
ucgucgaucucgaucgacccggu

SEQ ID NO: 1096901 - RNA, 16 nt, Mycobacterium bovis subsp bovis AF2122/97
ucgucgaucgccgcga

SEQ ID NO: 1096902 - RNA, 18 nt, Mycobacterium bovis subsp bovis AF2122/97
ucgucgauguucgccgcg

SEQ ID NO: 1096903 - RNA, 19 nt, Mycobacterium bovis subsp bovis AF2122/97
ucgucgaugaugccggaca

SEQ ID NO: 1096904 - RNA, 17 nt, Mycobacterium bovis subsp bovis AF2122/97
ucgucgcaucaccaggg

SEQ ID NO: 1096905 - RNA, 22 nt, Mycobacterium bovis subsp bovis AF2122/97
ucgucgccccggggguccaccu

SEQ ID NO: 1096906 - RNA, 15 nt, Mycobacterium bovis subsp bovis AF2122/97
ucgucgccgucggug

SEQ ID NO: 1096907 - RNA, 22 nt, Mycobacterium bovis subsp bovis AF2122/97
ucgucgccgcgguagacgccgc

SEQ ID NO: 1096908 - RNA, 19 nt, Mycobacterium bovis subsp bovis AF2122/97
ucgucgcgggccaccgcug

SEQ ID NO: 1096909 - RNA, 15 nt, Mycobacterium bovis subsp bovis AF2122/97
ucgucgcugagcagc

SEQ ID NO: 1096910 - RNA, 13 nt, Mycobacterium bovis subsp bovis AF2122/97
ucgucgccggcgg

SEQ ID NO: 1096911 - RNA, 14 nt, Mycobacterium bovis subsp bovis AF2122/97
ucgucgccggcggc

SEQ ID NO: 1096912 - RNA, 18 nt, Mycobacterium bovis subsp bovis AF2122/97
ucgucgcggaaucgcgac

SEQ ID NO: 1096913 - RNA, 13 nt, Mycobacterium bovis subsp bovis AF2122/97
ucgucgcggccgc

SEQ ID NO: 1096914 - RNA, 14 nt, Mycobacterium bovis subsp bovis AF2122/97
ucgucgcggccgcg

SEQ ID NO: 1096915 - RNA, 19 nt, Mycobacterium bovis subsp bovis AF2122/97
ucgucggguagaucgccuu

SEQ ID NO: 1096916 - RNA, 22 nt, Mycobacterium bovis subsp bovis AF2122/97
ucgucggguagggcaucgucgc

SEQ ID NO: 1096917 - RNA, 18 nt, Mycobacterium bovis subsp bovis AF2122/97
ucgucgggucacccagau

SEQ ID NO: 1096918 - RNA, 22 nt, Mycobacterium bovis subsp bovis AF2122/97
ucgucggccagcagaucagguc

SEQ ID NO: 1096919 - RNA, 19 nt, Mycobacterium bovis subsp bovis AF2122/97
ucgucggccaugguguucg

SEQ ID NO: 1096920 - RNA, 21 nt, Mycobacterium bovis subsp bovis AF2122/97
ucgucgggcgucccggcgguc

SEQ ID NO: 1096921 - RNA, 14 nt, Mycobacterium bovis subsp bovis AF2122/97
ucgucggccaccgc

SEQ ID NO: 1096922 - RNA, 16 nt, Mycobacterium bovis subsp bovis AF2122/97
ucgucggccaccgcgg

SEQ ID NO: 1096923 - RNA, 18 nt, Mycobacterium bovis subsp bovis AF2122/97
ucgucggccaccgcggcg

SEQ ID NO: 1096924 - RNA, 20 nt, Mycobacterium bovis subsp bovis AF2122/97
ucgucgcugagcagcgccgc

SEQ ID NO: 1096925 - RNA, 18 nt, Mycobacterium bovis subsp bovis AF2122/97
ucgucggaccucgcccau

SEQ ID NO: 1096926 - RNA, 18 nt, Mycobacterium bovis subsp bovis AF2122/97
ucgucggaguaccgcgcg

SEQ ID NO: 1096927 - RNA, 15 nt, Mycobacterium bovis subsp bovis AF2122/97
ucgucgcugccgcca

SEQ ID NO: 1096928 - RNA, 15 nt, Mycobacterium bovis subsp bovis AF2122/97
ucguacuucggacaa

SEQ ID NO: 1096929 - RNA, 23 nt, Mycobacterium bovis subsp bovis AF2122/97
ucguccaucagcaacacgucggg

SEQ ID NO: 1096930 - RNA, 17 nt, Mycobacterium bovis subsp bovis AF2122/97
ucguccccagaccggcg

SEQ ID NO: 1096931 - RNA, 14 nt, Mycobacterium bovis subsp bovis AF2122/97
ucgucccagcgcgg

SEQ ID NO: 1096932 - RNA, 21 nt, Mycobacterium bovis subsp bovis AF2122/97
ucgucccacagguuugcgccg

SEQ ID NO: 1096933 - RNA, 16 nt, Mycobacterium bovis subsp bovis AF2122/97
ucgucccgcggcgcgg

SEQ ID NO: 1096934 - RNA, 18 nt, Mycobacterium bovis subsp bovis AF2122/97
ucguccgcugacccgcca

SEQ ID NO: 1096935 - RNA, 15 nt, Mycobacterium bovis subsp bovis AF2122/97
ucguccgccugcacc

SEQ ID NO: 1096936 - RNA, 22 nt, Mycobacterium bovis subsp bovis AF2122/97
ucguccgccugcaccgccgccg

SEQ ID NO: 1096937 - RNA, 19 nt, Mycobacterium bovis subsp bovis AF2122/97
ucguccgugguuugcguca

SEQ ID NO: 1096938 - RNA, 18 nt, Mycobacterium bovis subsp bovis AF2122/97
ucgucgacggcugcgccg

SEQ ID NO: 1096939 - RNA, 17 nt, Mycobacterium bovis subsp bovis AF2122/97
ucgucgacucggcggcg

SEQ ID NO: 1096940 - RNA, 20 nt, Mycobacterium bovis subsp bovis AF2122/97
ucgucgagagguucgccguc

SEQ ID NO: 1096941 - RNA, 22 nt, Mycobacterium bovis subsp bovis AF2122/97
ucgucgacgucggcaucggcgg

SEQ ID NO: 1096942 - RNA, 17 nt, Mycobacterium bovis subsp bovis AF2122/97
ucgucgacgucggcgag

SEQ ID NO: 1096943 - RNA, 20 nt, Mycobacterium bovis subsp bovis AF2122/97
ucgucgagauagccgacguc

SEQ ID NO: 1096944 - RNA, 17 nt, Mycobacterium bovis subsp bovis AF2122/97
ucggugguuagguggcu

SEQ ID NO: 1096945 - RNA, 18 nt, Mycobacterium bovis subsp bovis AF2122/97
ucggugguuuggcgcgcc

SEQ ID NO: 1096946 - RNA, 16 nt, Mycobacterium bovis subsp bovis AF2122/97
ucgguguccucgaccg

SEQ ID NO: 1096947 - RNA, 17 nt, Mycobacterium bovis subsp bovis AF2122/97
ucggugucgaugcugaa

SEQ ID NO: 1096948 - RNA, 14 nt, Mycobacterium bovis subsp bovis AF2122/97
ucggugucgccacc

SEQ ID NO: 1096949 - RNA, 19 nt, Mycobacterium bovis subsp bovis AF2122/97
ucgguuugggaauccgcau

SEQ ID NO: 1096950 - RNA, 14 nt, Mycobacterium bovis subsp bovis AF2122/97
ucggugguccagcg

SEQ ID NO: 1096951 - RNA, 20 nt, Mycobacterium bovis subsp bovis AF2122/97
ucguacccggccugcgucga

SEQ ID NO: 1096952 - RNA, 19 nt, Mycobacterium bovis subsp bovis AF2122/97
ucguccaggucggccgccu

SEQ ID NO: 1096953 - RNA, 20 nt, Mycobacterium bovis subsp bovis AF2122/97
ucguacucccaggccgccgc

SEQ ID NO: 1096954 - RNA, 17 nt, Mycobacterium bovis subsp bovis AF2122/97
ucucggcuacgccucgg

SEQ ID NO: 1096955 - RNA, 16 nt, Mycobacterium bovis subsp bovis AF2122/97
ucucggcgagcaccgu

SEQ ID NO: 1096956 - RNA, 18 nt, Mycobacterium bovis subsp bovis AF2122/97
ucucggagcgcacgaacg

SEQ ID NO: 1096957 - RNA, 14 nt, Mycobacterium bovis subsp bovis AF2122/97
ucucgcggugcggc

SEQ ID NO: 1096958 - RNA, 14 nt, Mycobacterium bovis subsp bovis AF2122/97
ucucgcugaccuuu

SEQ ID NO: 1096959 - RNA, 19 nt, Mycobacterium bovis subsp bovis AF2122/97
ucucgcccccagugcacgc

SEQ ID NO: 1096960 - RNA, 17 nt, Mycobacterium bovis subsp bovis AF2122/97
ucucgcgcgcggcgacg

SEQ ID NO: 1096961 - RNA, 23 nt, Mycobacterium bovis subsp bovis AF2122/97
ucucgcgcgcggcgacgacggcc

SEQ ID NO: 1096962 - RNA, 16 nt, Mycobacterium bovis subsp bovis AF2122/97
ucucgcggaccucggc

SEQ ID NO: 1096963 - RNA, 13 nt, Mycobacterium bovis subsp bovis AF2122/97
ucucgcggacgga

SEQ ID NO: 1096964 - RNA, 17 nt, Mycobacterium bovis subsp bovis AF2122/97
ucucggugcgcagcugc

SEQ ID NO: 1096965 - RNA, 13 nt, Mycobacterium bovis subsp bovis AF2122/97
ucucggcgcagcc

SEQ ID NO: 1096966 - RNA, 14 nt, Mycobacterium bovis subsp bovis AF2122/97
ucucggcgcagccg

SEQ ID NO: 1096967 - RNA, 17 nt, Mycobacterium bovis subsp bovis AF2122/97
ucucggcgcagccggug

SEQ ID NO: 1096968 - RNA, 16 nt, Mycobacterium bovis subsp bovis AF2122/97
ucucgggggccgagcc

SEQ ID NO: 1096969 - RNA, 14 nt, Mycobacterium bovis subsp bovis AF2122/97
ucucggucugcaug

SEQ ID NO: 1096970 - RNA, 19 nt, Mycobacterium bovis subsp bovis AF2122/97
ucucggugaacgccgcccc

SEQ ID NO: 1096971 - RNA, 23 nt, Mycobacterium bovis subsp bovis AF2122/97
ucucgucgccccguucacgcucg

SEQ ID NO: 1096972 - RNA, 21 nt, Mycobacterium bovis subsp bovis AF2122/97
ucucguuugcuuucagcagga

SEQ ID NO: 1096973 - RNA, 17 nt, Mycobacterium bovis subsp bovis AF2122/97
ucucgacggugaccgga

SEQ ID NO: 1096974 - RNA, 15 nt, Mycobacterium bovis subsp bovis AF2122/97
ucucgagccgccgga

SEQ ID NO: 1096975 - RNA, 14 nt, Mycobacterium bovis subsp bovis AF2122/97
ucucgagcgcgccg

SEQ ID NO: 1096976 - RNA, 17 nt, Mycobacterium bovis subsp bovis AF2122/97
ucucgaucaccucgcgg

SEQ ID NO: 1096977 - RNA, 17 nt, Mycobacterium bovis subsp bovis AF2122/97
ucucgauugucgccgcg

SEQ ID NO: 1096978 - RNA, 22 nt, Mycobacterium bovis subsp bovis AF2122/97
ucucgaucaucaugucggcgca

SEQ ID NO: 1096979 - RNA, 12 nt, Mycobacterium bovis subsp bovis AF2122/97
ucucgacgucgg

SEQ ID NO: 1096980 - RNA, 15 nt, Mycobacterium bovis subsp bovis AF2122/97
ucucgagcaugccca

SEQ ID NO: 1096981 - RNA, 13 nt, Mycobacterium bovis subsp bovis AF2122/97
ucucgcaccgcgu

SEQ ID NO: 1096982 - RNA, 23 nt, Mycobacterium bovis subsp bovis AF2122/97
ucucgcagcauguccgcagcggu

SEQ ID NO: 1096983 - RNA, 17 nt, Mycobacterium bovis subsp bovis AF2122/97
ucucgcccagcgagcgc

SEQ ID NO: 1096984 - RNA, 18 nt, Mycobacterium bovis subsp bovis AF2122/97
ucucgcccagcgagcgcc

SEQ ID NO: 1096985 - RNA, 21 nt, Mycobacterium bovis subsp bovis AF2122/97
ucucgaccucagacagcugca

SEQ ID NO: 1096986 - RNA, 18 nt, Mycobacterium bovis subsp bovis AF2122/97
ucuccugcucguccaccc

SEQ ID NO: 1096987 - RNA, 15 nt, Mycobacterium bovis subsp bovis AF2122/97
ucuccggcaccgguc

SEQ ID NO: 1096988 - RNA, 13 nt, Mycobacterium bovis subsp bovis AF2122/97
ucuccuccaccag

SEQ ID NO: 1096989 - RNA, 18 nt, Mycobacterium bovis subsp bovis AF2122/97
ucuccucgccugcccgaa

SEQ ID NO: 1096990 - RNA, 17 nt, Mycobacterium bovis subsp bovis AF2122/97
ucuccucggcgaugccg

SEQ ID NO: 1096991 - RNA, 16 nt, Mycobacterium bovis subsp bovis AF2122/97
ucuccgccgucgccac

SEQ ID NO: 1096992 - RNA, 15 nt, Mycobacterium bovis subsp bovis AF2122/97
ucuccgcguccgcca

SEQ ID NO: 1096993 - RNA, 15 nt, Mycobacterium bovis subsp bovis AF2122/97
ucuccggcaacagca

SEQ ID NO: 1096994 - RNA, 17 nt, Mycobacterium bovis subsp bovis AF2122/97
ucuccggcgccaccgcc

SEQ ID NO: 1096995 - RNA, 16 nt, Mycobacterium bovis subsp bovis AF2122/97
ucgucgucaacccggu

SEQ ID NO: 1096996 - RNA, 17 nt, Mycobacterium bovis subsp bovis AF2122/97
ucgucgucaacccggug

SEQ ID NO: 1096997 - RNA, 18 nt, Mycobacterium bovis subsp bovis AF2122/97
ucgucgucaacccggugu

SEQ ID NO: 1096998 - RNA, 22 nt, Mycobacterium bovis subsp bovis AF2122/97
ucgucggucaugucggccaccg

SEQ ID NO: 1096999 - RNA, 15 nt, Mycobacterium bovis subsp bovis AF2122/97
ucgucggucccaggu

SEQ ID NO: 1097000 - RNA, 20 nt, Mycobacterium bovis subsp bovis AF2122/97
ucgucgucaccgaugcgccg

SEQ ID NO: 1097001 - RNA, 21 nt, Mycobacterium bovis subsp bovis AF2122/97
ucgucggugaucaccgcggcg

SEQ ID NO: 1097002 - RNA, 16 nt, Mycobacterium bovis subsp bovis AF2122/97
ucgucggugucuucca

SEQ ID NO: 1097003 - RNA, 18 nt, Mycobacterium bovis subsp bovis AF2122/97
ucgucgguugccacgccg

SEQ ID NO: 1097004 - RNA, 19 nt, Mycobacterium bovis subsp bovis AF2122/97
ucgucgguugccacgccgc

SEQ ID NO: 1097005 - RNA, 13 nt, Mycobacterium bovis subsp bovis AF2122/97
ucgucgucgacgg

SEQ ID NO: 1097006 - RNA, 12 nt, Mycobacterium bovis subsp bovis AF2122/97
ucgucgucgaca

SEQ ID NO: 1097007 - RNA, 14 nt, Mycobacterium bovis subsp bovis AF2122/97
ucgucgucgacggc

SEQ ID NO: 1097008 - RNA, 15 nt, Mycobacterium bovis subsp bovis AF2122/97
ucgucgucgacggcc

SEQ ID NO: 1097009 - RNA, 23 nt, Mycobacterium bovis subsp bovis AF2122/97
ucgucguccggccacgguccggc

SEQ ID NO: 1097010 - RNA, 24 nt, Mycobacterium bovis subsp bovis AF2122/97
ucgucguccgacgggccgucgccg

SEQ ID NO: 1097011 - RNA, 18 nt, Mycobacterium bovis subsp bovis AF2122/97
ucguguacauugccgacc

SEQ ID NO: 1097012 - RNA, 14 nt, Mycobacterium bovis subsp bovis AF2122/97
ucguguccgccguc

SEQ ID NO: 1097013 - RNA, 16 nt, Mycobacterium bovis subsp bovis AF2122/97
ucgugucgcugcggcg

SEQ ID NO: 1097014 - RNA, 18 nt, Mycobacterium bovis subsp bovis AF2122/97
ucgugucugccucggggc

SEQ ID NO: 1097015 - RNA, 15 nt, Mycobacterium bovis subsp bovis AF2122/97
ucguggucgacguga

SEQ ID NO: 1097016 - RNA, 13 nt, Mycobacterium bovis subsp bovis AF2122/97
ucgucgucgacac

SEQ ID NO: 1097017 - RNA, 15 nt, Mycobacterium bovis subsp bovis AF2122/97
ucguggucgguggcu

SEQ ID NO: 1097018 - RNA, 15 nt, Mycobacterium bovis subsp bovis AF2122/97
ucgucgucgcagugc

SEQ ID NO: 1097019 - RNA, 20 nt, Mycobacterium bovis subsp bovis AF2122/97
ucgugguucggcgucgaccc

SEQ ID NO: 1097020 - RNA, 19 nt, Mycobacterium bovis subsp bovis AF2122/97
ucguggugcaacacgccgg

SEQ ID NO: 1097021 - RNA, 12 nt, Mycobacterium bovis subsp bovis AF2122/97
ucguuccgccgc

SEQ ID NO: 1097022 - RNA, 19 nt, Mycobacterium bovis subsp bovis AF2122/97
ucguucgucaccacgaucg

SEQ ID NO: 1097023 - RNA, 19 nt, Mycobacterium bovis subsp bovis AF2122/97
ucguguuguugaagcccga

SEQ ID NO: 1097024 - RNA, 22 nt, Mycobacterium bovis subsp bovis AF2122/97
ucguuaccacauaccccgaaca

SEQ ID NO: 1097025 - RNA, 14 nt, Mycobacterium bovis subsp bovis AF2122/97
ucguuagcggcggg

SEQ ID NO: 1097026 - RNA, 20 nt, Mycobacterium bovis subsp bovis AF2122/97
ucguuagcggcgggcacgca

SEQ ID NO: 1097027 - RNA, 16 nt, Mycobacterium bovis subsp bovis AF2122/97
ucguucagcgccagcg

SEQ ID NO: 1097028 - RNA, 16 nt, Mycobacterium bovis subsp bovis AF2122/97
ucguuaucgaccgccg

SEQ ID NO: 1097029 - RNA, 19 nt, Mycobacterium bovis subsp bovis AF2122/97
ucuacgucguccagcacca

SEQ ID NO: 1097030 - RNA, 13 nt, Mycobacterium bovis subsp bovis AF2122/97
ucuacgacgucgc

SEQ ID NO: 1097031 - RNA, 15 nt, Mycobacterium bovis subsp bovis AF2122/97
ucuaccuuagcgccg

SEQ ID NO: 1097032 - RNA, 21 nt, Mycobacterium bovis subsp bovis AF2122/97
ucguugaccgggucgccgaug

SEQ ID NO: 1097033 - RNA, 22 nt, Mycobacterium bovis subsp bovis AF2122/97
ucguugaccgggucgccgauga

SEQ ID NO: 1097034 - RNA, 23 nt, Mycobacterium bovis subsp bovis AF2122/97
ucguugaguggaugcgccgcacg

SEQ ID NO: 1097035 - RNA, 23 nt, Mycobacterium bovis subsp bovis AF2122/97
ucguugagcaagugggugccggc

SEQ ID NO: 1097036 - RNA, 20 nt, Mycobacterium bovis subsp bovis AF2122/97
ucguugagguauucgaaggg

SEQ ID NO: 1097037 - RNA, 15 nt, Mycobacterium bovis subsp bovis AF2122/97
ucguugaggccggug

SEQ ID NO: 1097038 - RNA, 16 nt, Mycobacterium bovis subsp bovis AF2122/97
ucguugaggccgguga

SEQ ID NO: 1097039 - RNA, 15 nt, Mycobacterium bovis subsp bovis AF2122/97
ucguugaugcuucga

SEQ ID NO: 1097040 - RNA, 16 nt, Mycobacterium bovis subsp bovis AF2122/97
ucguugcccgacccgc

SEQ ID NO: 1097041 - RNA, 21 nt, Mycobacterium bovis subsp bovis AF2122/97
ucguugccgcggucggcgacg

SEQ ID NO: 1097042 - RNA, 17 nt, Mycobacterium bovis subsp bovis AF2122/97
ucguugccggacaaccu

SEQ ID NO: 1097043 - RNA, 20 nt, Mycobacterium bovis subsp bovis AF2122/97
ucguugccggacaaccuggg

SEQ ID NO: 1097044 - RNA, 16 nt, Mycobacterium bovis subsp bovis AF2122/97
ucguugccggugccgc

SEQ ID NO: 1097045 - RNA, 20 nt, Mycobacterium bovis subsp bovis AF2122/97
ucguugccggugccgccgcg

SEQ ID NO: 1097046 - RNA, 16 nt, Mycobacterium bovis subsp bovis AF2122/97
ucguugccguagcuga

SEQ ID NO: 1097047 - RNA, 13 nt, Mycobacterium bovis subsp bovis AF2122/97
ucguugccggcga

SEQ ID NO: 1097048 - RNA, 15 nt, Mycobacterium bovis subsp bovis AF2122/97
ucguugccggugccg

SEQ ID NO: 1097049 - RNA, 14 nt, Mycobacterium bovis subsp bovis AF2122/97
ucugcguccaccac

SEQ ID NO: 1097050 - RNA, 14 nt, Mycobacterium bovis subsp bovis AF2122/97
ucugcguccaccgg

SEQ ID NO: 1097051 - RNA, 15 nt, Mycobacterium bovis subsp bovis AF2122/97
ucugcgggacgucgu

SEQ ID NO: 1097052 - RNA, 15 nt, Mycobacterium bovis subsp bovis AF2122/97
ucugcggccacgccg

SEQ ID NO: 1097053 - RNA, 20 nt, Mycobacterium bovis subsp bovis AF2122/97
ucugcggccacgccgaugcg

SEQ ID NO: 1097054 - RNA, 22 nt, Mycobacterium bovis subsp bovis AF2122/97
ucugcggccacgccgaugcggu

SEQ ID NO: 1097055 - RNA, 23 nt, Mycobacterium bovis subsp bovis AF2122/97
ucugcggccgcgugccgcccgcc

SEQ ID NO: 1097056 - RNA, 20 nt, Mycobacterium bovis subsp bovis AF2122/97
ucugcggcggucucgucaac

SEQ ID NO: 1097057 - RNA, 14 nt, Mycobacterium bovis subsp bovis AF2122/97
ucugcgcccguccg

SEQ ID NO: 1097058 - RNA, 18 nt, Mycobacterium bovis subsp bovis AF2122/97
ucugcgccacgucgacgg

SEQ ID NO: 1097059 - RNA, 14 nt, Mycobacterium bovis subsp bovis AF2122/97
ucugcgccacagca

SEQ ID NO: 1097060 - RNA, 23 nt, Mycobacterium bovis subsp bovis AF2122/97
ucugcgcagaaauguauugcggu

SEQ ID NO: 1097061 - RNA, 20 nt, Mycobacterium bovis subsp bovis AF2122/97
ucugcgcagguggucgauca

SEQ ID NO: 1097062 - RNA, 13 nt, Mycobacterium bovis subsp bovis AF2122/97
ucugcgacccggg

SEQ ID NO: 1097063 - RNA, 16 nt, Mycobacterium bovis subsp bovis AF2122/97
ucugcgacccgggccg

SEQ ID NO: 1097064 - RNA, 23 nt, Mycobacterium bovis subsp bovis AF2122/97
ucugccacguugaucccgaaccg

SEQ ID NO: 1097065 - RNA, 18 nt, Mycobacterium bovis subsp bovis AF2122/97
ucugcagcgucuccuuga

SEQ ID NO: 1097066 - RNA, 19 nt, Mycobacterium bovis subsp bovis AF2122/97
ucugacccaccgccccggc

SEQ ID NO: 1097067 - RNA, 18 nt, Mycobacterium bovis subsp bovis AF2122/97
ucugaccgguucccgggc

SEQ ID NO: 1097068 - RNA, 17 nt, Mycobacterium bovis subsp bovis AF2122/97
ucugaggcuuccagcuc

SEQ ID NO: 1097069 - RNA, 20 nt, Mycobacterium bovis subsp bovis AF2122/97
ucugaggcuuccagcucggg

SEQ ID NO: 1097070 - RNA, 21 nt, Mycobacterium bovis subsp bovis AF2122/97
ucugauccggugccgcgaucg

SEQ ID NO: 1097071 - RNA, 13 nt, Mycobacterium bovis subsp bovis AF2122/97
ucugaucggcgcg

SEQ ID NO: 1097072 - RNA, 13 nt, Mycobacterium bovis subsp bovis AF2122/97
ucugcacccgcca

SEQ ID NO: 1097073 - RNA, 17 nt, Mycobacterium bovis subsp bovis AF2122/97
ucugcacauucagcgcc

SEQ ID NO: 1097074 - RNA, 18 nt, Mycobacterium bovis subsp bovis AF2122/97
ucugcacauucagcgccg

SEQ ID NO: 1097075 - RNA, 15 nt, Mycobacterium bovis subsp bovis AF2122/97
ucugcaaugccucga

SEQ ID NO: 1097076 - RNA, 19 nt, Mycobacterium bovis subsp bovis AF2122/97
ucugacgaaauccgccggg

SEQ ID NO: 1097077 - RNA, 21 nt, Mycobacterium bovis subsp bovis AF2122/97
ucugacgaaauccgccgggcg

SEQ ID NO: 1097078 - RNA, 17 nt, Mycobacterium bovis subsp bovis AF2122/97
ucugacgacgcgacacg

SEQ ID NO: 1097079 - RNA, 20 nt, Mycobacterium bovis subsp bovis AF2122/97
ucugacagaccgggcaccag

SEQ ID NO: 1097080 - RNA, 19 nt, Mycobacterium bovis subsp bovis AF2122/97
ucugaagagcggagccggc

SEQ ID NO: 1097081 - RNA, 20 nt, Mycobacterium bovis subsp bovis AF2122/97
ucuggacggucauccggccg

SEQ ID NO: 1097082 - RNA, 23 nt, Mycobacterium bovis subsp bovis AF2122/97
ucugcucagggcgcaaaccaccc

SEQ ID NO: 1097083 - RNA, 14 nt, Mycobacterium bovis subsp bovis AF2122/97
ucugcucgccgggc

SEQ ID NO: 1097084 - RNA, 14 nt, Mycobacterium bovis subsp bovis AF2122/97
ucugcuccgcagca

SEQ ID NO: 1097085 - RNA, 23 nt, Mycobacterium bovis subsp bovis AF2122/97
ucugcugagcugcucgccggcca

SEQ ID NO: 1097086 - RNA, 18 nt, Mycobacterium bovis subsp bovis AF2122/97
ucuggcgaugacgaucgc

SEQ ID NO: 1097087 - RNA, 16 nt, Mycobacterium bovis subsp bovis AF2122/97
ucuggcggauggccgc

SEQ ID NO: 1097088 - RNA, 19 nt, Mycobacterium bovis subsp bovis AF2122/97
ucuggcguagugcucgccg

SEQ ID NO: 1097089 - RNA, 15 nt, Mycobacterium bovis subsp bovis AF2122/97
ucuggcuacgggccg

SEQ ID NO: 1097090 - RNA, 14 nt, Mycobacterium bovis subsp bovis AF2122/97
ucuggccgaagccc

SEQ ID NO: 1097091 - RNA, 16 nt, Mycobacterium bovis subsp bovis AF2122/97
ucuggucauggccgaa

SEQ ID NO: 1097092 - RNA, 17 nt, Mycobacterium bovis subsp bovis AF2122/97
ucugguccagcaccggg

SEQ ID NO: 1097093 - RNA, 13 nt, Mycobacterium bovis subsp bovis AF2122/97
ucugguggucggc

SEQ ID NO: 1097094 - RNA, 16 nt, Mycobacterium bovis subsp bovis AF2122/97
ucugguguccaccgca

SEQ ID NO: 1097095 - RNA, 22 nt, Mycobacterium bovis subsp bovis AF2122/97
ucugggcuuucgcgugcggcug

SEQ ID NO: 1097096 - RNA, 22 nt, Mycobacterium bovis subsp bovis AF2122/97
ucugggaccgauaaguucggcu

SEQ ID NO: 1097097 - RNA, 17 nt, Mycobacterium bovis subsp bovis AF2122/97
ucugggagccggugggu

SEQ ID NO: 1097098 - RNA, 21 nt, Mycobacterium bovis subsp bovis AF2122/97
ucugggcuuucugcacccgcc

SEQ ID NO: 1097099 - RNA, 20 nt, Mycobacterium bovis subsp bovis AF2122/97
ucugggguuggcucggcgca

SEQ ID NO: 1097100 - RNA, 23 nt, Mycobacterium bovis subsp bovis AF2122/97
ucuggguaagggacaccagcucg

SEQ ID NO: 1097101 - RNA, 16 nt, Mycobacterium bovis subsp bovis AF2122/97
ucugguuguugccgac

SEQ ID NO: 1097102 - RNA, 17 nt, Mycobacterium bovis subsp bovis AF2122/97
ucugguuguugccgacg

SEQ ID NO: 1097103 - RNA, 19 nt, Mycobacterium bovis subsp bovis AF2122/97
ucugguggcgcugaagccg

SEQ ID NO: 1097104 - RNA, 14 nt, Mycobacterium bovis subsp bovis AF2122/97
ucugugcugcgcug

SEQ ID NO: 1097105 - RNA, 14 nt, Mycobacterium bovis subsp bovis AF2122/97
ucuucacccaacgg

SEQ ID NO: 1097106 - RNA, 14 nt, Mycobacterium bovis subsp bovis AF2122/97
ucuucccaaccgcc

SEQ ID NO: 1097107 - RNA, 17 nt, Mycobacterium bovis subsp bovis AF2122/97
ucuucggacagcagccg

SEQ ID NO: 1097108 - RNA, 16 nt, Mycobacterium bovis subsp bovis AF2122/97
ucuucggaggugaccu

SEQ ID NO: 1097109 - RNA, 13 nt, Mycobacterium bovis subsp bovis AF2122/97
ucuucggccagcu

SEQ ID NO: 1097110 - RNA, 19 nt, Mycobacterium bovis subsp bovis AF2122/97
ucuucgggcucguccagca

SEQ ID NO: 1097111 - RNA, 19 nt, Mycobacterium bovis subsp bovis AF2122/97
ucuucggcggugcccagca

SEQ ID NO: 1097112 - RNA, 21 nt, Mycobacterium bovis subsp bovis AF2122/97
ucuucgccgccaccggcgacg

SEQ ID NO: 1097113 - RNA, 15 nt, Mycobacterium bovis subsp bovis AF2122/97
ucuucgcgcaaccag

SEQ ID NO: 1097114 - RNA, 13 nt, Mycobacterium bovis subsp bovis AF2122/97
ucuucgcgcagcc

SEQ ID NO: 1097115 - RNA, 12 nt, Mycobacterium bovis subsp bovis AF2122/97
ucuucucggcua

SEQ ID NO: 1097116 - RNA, 21 nt, Mycobacterium bovis subsp bovis AF2122/97
ucuugcccuucuucgaccgcg

SEQ ID NO: 1097117 - RNA, 16 nt, Mycobacterium bovis subsp bovis AF2122/97
ucuugcaccagggccu

SEQ ID NO: 1097118 - RNA, 16 nt, Mycobacterium bovis subsp bovis AF2122/97
ucuugcacucggcgcc

SEQ ID NO: 1097119 - RNA, 16 nt, Mycobacterium bovis subsp bovis AF2122/97
ucuugcgacgcccgcc

SEQ ID NO: 1097120 - RNA, 20 nt, Mycobacterium bovis subsp bovis AF2122/97
ucuugcgcaaugccgacgcc

SEQ ID NO: 1097121 - RNA, 21 nt, Mycobacterium bovis subsp bovis AF2122/97
ucuugcgggcagccgcccgcc

SEQ ID NO: 1097122 - RNA, 13 nt, Mycobacterium bovis subsp bovis AF2122/97
ucuugccaccgcu

SEQ ID NO: 1097123 - RNA, 17 nt, Mycobacterium bovis subsp bovis AF2122/97
ucuuggaaggcgcgcgc

SEQ ID NO: 1097124 - RNA, 14 nt, Mycobacterium bovis subsp bovis AF2122/97
ucuuggcgguggcc

SEQ ID NO: 1097125 - RNA, 12 nt, Mycobacterium bovis subsp bovis AF2122/97
ucuugggcgcgg

SEQ ID NO: 1097126 - RNA, 18 nt, Mycobacterium bovis subsp bovis AF2122/97
ucuugggcgcgggugcgc

SEQ ID NO: 1097127 - RNA, 19 nt, Mycobacterium bovis subsp bovis AF2122/97
ucuuggcgacaugcagcgc

SEQ ID NO: 1097128 - RNA, 15 nt, Mycobacterium bovis subsp bovis AF2122/97
ucuuggcacacaggu

SEQ ID NO: 1097129 - RNA, 16 nt, Mycobacterium bovis subsp bovis AF2122/97
ugaacaccgugggcgg

SEQ ID NO: 1097130 - RNA, 20 nt, Mycobacterium bovis subsp bovis AF2122/97
ugaacgcguagucgcgggug

SEQ ID NO: 1097131 - RNA, 22 nt, Mycobacterium bovis subsp bovis AF2122/97
ugaacgcggacaccgcggcgau

SEQ ID NO: 1097132 - RNA, 12 nt, Mycobacterium bovis subsp bovis AF2122/97
ugaacgcgugcu

SEQ ID NO: 1097133 - RNA, 22 nt, Mycobacterium bovis subsp bovis AF2122/97
ugaacgcgaauaccagaccggc

SEQ ID NO: 1097134 - RNA, 17 nt, Mycobacterium bovis subsp bovis AF2122/97
ugaacaugugaccggcg

SEQ ID NO: 1097135 - RNA, 20 nt, Mycobacterium bovis subsp bovis AF2122/97
ugaacgcauacagcgcccgg

SEQ ID NO: 1097136 - RNA, 17 nt, Mycobacterium bovis subsp bovis AF2122/97
ugaacaucuggcgacga

SEQ ID NO: 1097137 - RNA, 14 nt, Mycobacterium bovis subsp bovis AF2122/97
ugauggccgucagc

SEQ ID NO: 1097138 - RNA, 12 nt, Mycobacterium bovis subsp bovis AF2122/97
ugauggccucgc

SEQ ID NO: 1097139 - RNA, 24 nt, Mycobacterium bovis subsp bovis AF2122/97
ugauggcguauagcaugccgcggc

SEQ ID NO: 1097140 - RNA, 23 nt, Mycobacterium bovis subsp bovis AF2122/97
ugauggucuccaccaggugcgca

SEQ ID NO: 1097141 - RNA, 15 nt, Mycobacterium bovis subsp bovis AF2122/97
ugaugguaccgccac

SEQ ID NO: 1097142 - RNA, 15 nt, Mycobacterium bovis subsp bovis AF2122/97
ugaugccgucgucgu

SEQ ID NO: 1097143 - RNA, 17 nt, Mycobacterium bovis subsp bovis AF2122/97
ugaugccgaugaccgcc

SEQ ID NO: 1097144 - RNA, 13 nt, Mycobacterium bovis subsp bovis AF2122/97
ugaugucguuguc

SEQ ID NO: 1097145 - RNA, 18 nt, Mycobacterium bovis subsp bovis AF2122/97
ugaugucguuguccagcg

SEQ ID NO: 1097146 - RNA, 23 nt, Mycobacterium bovis subsp bovis AF2122/97
ugaugucuaccaacaccgcccgc

SEQ ID NO: 1097147 - RNA, 14 nt, Mycobacterium bovis subsp bovis AF2122/97
ugaugucggccgcg

SEQ ID NO: 1097148 - RNA, 13 nt, Mycobacterium bovis subsp bovis AF2122/97
ugaugucggccag

SEQ ID NO: 1097149 - RNA, 17 nt, Mycobacterium bovis subsp bovis AF2122/97
ugaugucacccgcccga

SEQ ID NO: 1097150 - RNA, 14 nt, Mycobacterium bovis subsp bovis AF2122/97
ugauguccgcgacg

SEQ ID NO: 1097151 - RNA, 16 nt, Mycobacterium bovis subsp bovis AF2122/97
ugauguccgcgacggc

SEQ ID NO: 1097152 - RNA, 16 nt, Mycobacterium bovis subsp bovis AF2122/97
ugauggugccgaaccg

SEQ ID NO: 1097153 - RNA, 17 nt, Mycobacterium bovis subsp bovis AF2122/97
ugauggucacggcgucg

SEQ ID NO: 1097154 - RNA, 14 nt, Mycobacterium bovis subsp bovis AF2122/97
ugaugguccgccag

SEQ ID NO: 1097155 - RNA, 19 nt, Mycobacterium bovis subsp bovis AF2122/97
ugauggugcugcggcgucc

SEQ ID NO: 1097156 - RNA, 18 nt, Mycobacterium bovis subsp bovis AF2122/97
ugaugguguccucgucga

SEQ ID NO: 1097157 - RNA, 23 nt, Mycobacterium bovis subsp bovis AF2122/97
ugaugguucaugaacaucggccg

SEQ ID NO: 1097158 - RNA, 14 nt, Mycobacterium bovis subsp bovis AF2122/97
ugaugaugccggcg

SEQ ID NO: 1097159 - RNA, 14 nt, Mycobacterium bovis subsp bovis AF2122/97
ugaugcaacucggc

SEQ ID NO: 1097160 - RNA, 21 nt, Mycobacterium bovis subsp bovis AF2122/97
ugaugcccauccggccgucgg

SEQ ID NO: 1097161 - RNA, 15 nt, Mycobacterium bovis subsp bovis AF2122/97
ugaugcccagcgccg

SEQ ID NO: 1097162 - RNA, 21 nt, Mycobacterium bovis subsp bovis AF2122/97
ugaugccaucaacgacuucgg

SEQ ID NO: 1097163 - RNA, 16 nt, Mycobacterium bovis subsp bovis AF2122/97
ugaugaccgccaucgc

SEQ ID NO: 1097164 - RNA, 22 nt, Mycobacterium bovis subsp bovis AF2122/97
ugaugaccgccaucgccaacac

SEQ ID NO: 1097165 - RNA, 21 nt, Mycobacterium bovis subsp bovis AF2122/97
ugaugaccaggucggucaggu

SEQ ID NO: 1097166 - RNA, 14 nt, Mycobacterium bovis subsp bovis AF2122/97
ugaugacggcgucg

SEQ ID NO: 1097167 - RNA, 18 nt, Mycobacterium bovis subsp bovis AF2122/97
ugaugaacaccggcgccu

SEQ ID NO: 1097168 - RNA, 22 nt, Mycobacterium bovis subsp bovis AF2122/97
ugaugaagaugauuucgccgag

SEQ ID NO: 1097169 - RNA, 14 nt, Mycobacterium bovis subsp bovis AF2122/97
ugaucagcgccgug

SEQ ID NO: 1097170 - RNA, 12 nt, Mycobacterium bovis subsp bovis AF2122/97
ugaucagcgcgu

SEQ ID NO: 1097171 - RNA, 22 nt, Mycobacterium bovis subsp bovis AF2122/97
ugaucagcccaucuaccagcuc

SEQ ID NO: 1097172 - RNA, 21 nt, Mycobacterium bovis subsp bovis AF2122/97
ugaucaccgggcccgacgcgu

SEQ ID NO: 1097173 - RNA, 21 nt, Mycobacterium bovis subsp bovis AF2122/97
ugcacggccaugaucacaccg

SEQ ID NO: 1097174 - RNA, 15 nt, Mycobacterium bovis subsp bovis AF2122/97
ugcacgcucggcgcc

SEQ ID NO: 1097175 - RNA, 16 nt, Mycobacterium bovis subsp bovis AF2122/97
ugcacgcucggcgccg

SEQ ID NO: 1097176 - RNA, 17 nt, Mycobacterium bovis subsp bovis AF2122/97
ugcaccauacucaccga

SEQ ID NO: 1097177 - RNA, 16 nt, Mycobacterium bovis subsp bovis AF2122/97
ugcacgcgcucgcgca

SEQ ID NO: 1097178 - RNA, 19 nt, Mycobacterium bovis subsp bovis AF2122/97
ugcaccauucgcaccggcc

SEQ ID NO: 1097179 - RNA, 22 nt, Mycobacterium bovis subsp bovis AF2122/97
ugcacccaccccgaagaugccu

SEQ ID NO: 1097180 - RNA, 19 nt, Mycobacterium bovis subsp bovis AF2122/97
ugcacggucaacgaucccg

SEQ ID NO: 1097181 - RNA, 21 nt, Mycobacterium bovis subsp bovis AF2122/97
ugcacggucaacgaucccggg

SEQ ID NO: 1097182 - RNA, 22 nt, Mycobacterium bovis subsp bovis AF2122/97
ugcacggcuuuucgacgcugug

SEQ ID NO: 1097183 - RNA, 15 nt, Mycobacterium bovis subsp bovis AF2122/97
ugcacggcgaggccg

SEQ ID NO: 1097184 - RNA, 12 nt, Mycobacterium bovis subsp bovis AF2122/97
ugcacgucggcg

SEQ ID NO: 1097185 - RNA, 14 nt, Mycobacterium bovis subsp bovis AF2122/97
ugcacgucggcggg

SEQ ID NO: 1097186 - RNA, 22 nt, Mycobacterium bovis subsp bovis AF2122/97
ugcacgucggcugccgcaaacg

SEQ ID NO: 1097187 - RNA, 23 nt, Mycobacterium bovis subsp bovis AF2122/97
ugcacggugcccagggcgaucug

SEQ ID NO: 1097188 - RNA, 15 nt, Mycobacterium bovis subsp bovis AF2122/97
ugcagaaaggccaac

SEQ ID NO: 1097189 - RNA, 18 nt, Mycobacterium bovis subsp bovis AF2122/97
ugcagaauucggcgcgac

SEQ ID NO: 1097190 - RNA, 20 nt, Mycobacterium bovis subsp bovis AF2122/97
ugcagacccgguaguccgcg

SEQ ID NO: 1097191 - RNA, 23 nt, Mycobacterium bovis subsp bovis AF2122/97
ugcagacccgguaguccgcgcuc

SEQ ID NO: 1097192 - RNA, 18 nt, Mycobacterium bovis subsp bovis AF2122/97
ugcagacccguucgccgu

SEQ ID NO: 1097193 - RNA, 14 nt, Mycobacterium bovis subsp bovis AF2122/97
ugcagaccgggugg

SEQ ID NO: 1097194 - RNA, 18 nt, Mycobacterium bovis subsp bovis AF2122/97
ugcagaccuguccggcau

SEQ ID NO: 1097195 - RNA, 15 nt, Mycobacterium bovis subsp bovis AF2122/97
ugcagacucggcgau

SEQ ID NO: 1097196 - RNA, 15 nt, Mycobacterium bovis subsp bovis AF2122/97
ugcacugaccgcggc

SEQ ID NO: 1097197 - RNA, 19 nt, Mycobacterium bovis subsp bovis AF2122/97
ugcacuucggugccgugau

SEQ ID NO: 1097198 - RNA, 13 nt, Mycobacterium bovis subsp bovis AF2122/97
ugcaccagggccu

SEQ ID NO: 1097199 - RNA, 17 nt, Mycobacterium bovis subsp bovis AF2122/97
ugcaccaggggcgcguc

SEQ ID NO: 1097200 - RNA, 19 nt, Mycobacterium bovis subsp bovis AF2122/97
ugcaacucgaauccggccc

SEQ ID NO: 1097201 - RNA, 11 nt, Mycobacterium bovis subsp bovis AF2122/97
ugcaacucggc

SEQ ID NO: 1097202 - RNA, 12 nt, Mycobacterium bovis subsp bovis AF2122/97
ugcaaccgccgg

SEQ ID NO: 1097203 - RNA, 19 nt, Mycobacterium bovis subsp bovis AF2122/97
ugcaaccgccggugccgau

SEQ ID NO: 1097204 - RNA, 19 nt, Mycobacterium bovis subsp bovis AF2122/97
ugcaacggcguuggcgccg

SEQ ID NO: 1097205 - RNA, 16 nt, Mycobacterium bovis subsp bovis AF2122/97
ugcaaccacggcggca

SEQ ID NO: 1097206 - RNA, 13 nt, Mycobacterium bovis subsp bovis AF2122/97
ugcaaccauggcg

SEQ ID NO: 1097207 - RNA, 16 nt, Mycobacterium bovis subsp bovis AF2122/97
ugcaacaccgcaccgg

SEQ ID NO: 1097208 - RNA, 14 nt, Mycobacterium bovis subsp bovis AF2122/97
ugauugcggccgcc

SEQ ID NO: 1097209 - RNA, 17 nt, Mycobacterium bovis subsp bovis AF2122/97
ugauugcggccgccgag

SEQ ID NO: 1097210 - RNA, 20 nt, Mycobacterium bovis subsp bovis AF2122/97
ugauuucggugacuccggcu

SEQ ID NO: 1097211 - RNA, 14 nt, Mycobacterium bovis subsp bovis AF2122/97
ugauuucggcggcg

SEQ ID NO: 1097212 - RNA, 20 nt, Mycobacterium bovis subsp bovis AF2122/97
ugaacgcuuuccggcggugg

SEQ ID NO: 1097213 - RNA, 22 nt, Mycobacterium bovis subsp bovis AF2122/97
ugaagcccaacagcaacccgcc

SEQ ID NO: 1097214 - RNA, 21 nt, Mycobacterium bovis subsp bovis AF2122/97
ugacguggugggcuuggcugu

SEQ ID NO: 1097215 - RNA, 14 nt, Mycobacterium bovis subsp bovis AF2122/97
ugacgucgucggcc

SEQ ID NO: 1097216 - RNA, 16 nt, Mycobacterium bovis subsp bovis AF2122/97
ugacgucgucggccaa

SEQ ID NO: 1097217 - RNA, 15 nt, Mycobacterium bovis subsp bovis AF2122/97
ugacguuggcaggca

SEQ ID NO: 1097218 - RNA, 14 nt, Mycobacterium bovis subsp bovis AF2122/97
ugacguugcagccg

SEQ ID NO: 1097219 - RNA, 12 nt, Mycobacterium bovis subsp bovis AF2122/97
ugacguuguagg

SEQ ID NO: 1097220 - RNA, 19 nt, Mycobacterium bovis subsp bovis AF2122/97
ugacguuguuggauccggc

SEQ ID NO: 1097221 - RNA, 21 nt, Mycobacterium bovis subsp bovis AF2122/97
ugagaacaacgggauccgcgc

SEQ ID NO: 1097222 - RNA, 15 nt, Mycobacterium bovis subsp bovis AF2122/97
ugacuugcacgcugu

SEQ ID NO: 1097223 - RNA, 16 nt, Mycobacterium bovis subsp bovis AF2122/97
ugagauaccgacgcgc

SEQ ID NO: 1097224 - RNA, 17 nt, Mycobacterium bovis subsp bovis AF2122/97
ugagagauggucgggcg

SEQ ID NO: 1097225 - RNA, 18 nt, Mycobacterium bovis subsp bovis AF2122/97
ugagagauggucgggcgg

SEQ ID NO: 1097226 - RNA, 17 nt, Mycobacterium bovis subsp bovis AF2122/97
ugagaccagguucucgg

SEQ ID NO: 1097227 - RNA, 22 nt, Mycobacterium bovis subsp bovis AF2122/97
ugagaccuagcagggugccggc

SEQ ID NO: 1097228 - RNA, 17 nt, Mycobacterium bovis subsp bovis AF2122/97
ugagacgaaaagccgcg

SEQ ID NO: 1097229 - RNA, 14 nt, Mycobacterium bovis subsp bovis AF2122/97
ugagacgccgucga

SEQ ID NO: 1097230 - RNA, 21 nt, Mycobacterium bovis subsp bovis AF2122/97
ugagcccggggagacgagcac

SEQ ID NO: 1097231 - RNA, 19 nt, Mycobacterium bovis subsp bovis AF2122/97
ugagcccguugaccugcgc

SEQ ID NO: 1097232 - RNA, 15 nt, Mycobacterium bovis subsp bovis AF2122/97
ugagcaauggcgcga

SEQ ID NO: 1097233 - RNA, 20 nt, Mycobacterium bovis subsp bovis AF2122/97
ugagcccugcgccucggcgg

SEQ ID NO: 1097234 - RNA, 16 nt, Mycobacterium bovis subsp bovis AF2122/97
ugagcccgccgcgacc

SEQ ID NO: 1097235 - RNA, 13 nt, Mycobacterium bovis subsp bovis AF2122/97
ugagcaacgcgac

SEQ ID NO: 1097236 - RNA, 15 nt, Mycobacterium bovis subsp bovis AF2122/97
ugagcaccagcagca

SEQ ID NO: 1097237 - RNA, 21 nt, Mycobacterium bovis subsp bovis AF2122/97
ugagcaaaauggccaccggcg

SEQ ID NO: 1097238 - RNA, 21 nt, Mycobacterium bovis subsp bovis AF2122/97
ugagccgcucaucgaucccgu

SEQ ID NO: 1097239 - RNA, 16 nt, Mycobacterium bovis subsp bovis AF2122/97
ugagcuuggucgccau

SEQ ID NO: 1097240 - RNA, 18 nt, Mycobacterium bovis subsp bovis AF2122/97
ugaggaacguuucgcugu

SEQ ID NO: 1097241 - RNA, 16 nt, Mycobacterium bovis subsp bovis AF2122/97
ugaggaacuccgcgau

SEQ ID NO: 1097242 - RNA, 11 nt, Mycobacterium bovis subsp bovis AF2122/97
ugaggaagccc

SEQ ID NO: 1097243 - RNA, 15 nt, Mycobacterium bovis subsp bovis AF2122/97
ugaggaagcggccgg

SEQ ID NO: 1097244 - RNA, 16 nt, Mycobacterium bovis subsp bovis AF2122/97
ugaggaagcggcggca

SEQ ID NO: 1097245 - RNA, 17 nt, Mycobacterium bovis subsp bovis AF2122/97
ugagccggcccugcucg

SEQ ID NO: 1097246 - RNA, 23 nt, Mycobacterium bovis subsp bovis AF2122/97
ugagccggcgccgccgugcgggu

SEQ ID NO: 1097247 - RNA, 22 nt, Mycobacterium bovis subsp bovis AF2122/97
ugagccggucuugcaucgccaa

SEQ ID NO: 1097248 - RNA, 13 nt, Mycobacterium bovis subsp bovis AF2122/97
ugaggccggugaa

SEQ ID NO: 1097249 - RNA, 14 nt, Mycobacterium bovis subsp bovis AF2122/97
ugaggacauccggc

SEQ ID NO: 1097250 - RNA, 16 nt, Mycobacterium bovis subsp bovis AF2122/97
ugaggacauccggcgc

SEQ ID NO: 1097251 - RNA, 17 nt, Mycobacterium bovis subsp bovis AF2122/97
ugaggacauccggcgcc

SEQ ID NO: 1097252 - RNA, 18 nt, Mycobacterium bovis subsp bovis AF2122/97
ugaggacauccggcgccg

SEQ ID NO: 1097253 - RNA, 20 nt, Mycobacterium bovis subsp bovis AF2122/97
ugaggacgagguucugccgc

SEQ ID NO: 1097254 - RNA, 16 nt, Mycobacterium bovis subsp bovis AF2122/97
ugaggaucccggccgg

SEQ ID NO: 1097255 - RNA, 16 nt, Mycobacterium bovis subsp bovis AF2122/97
ugagugaccacgcugc

SEQ ID NO: 1097256 - RNA, 20 nt, Mycobacterium bovis subsp bovis AF2122/97
ugagucguuggacggcaccg

SEQ ID NO: 1097257 - RNA, 17 nt, Mycobacterium bovis subsp bovis AF2122/97
ugagucccacgccagcg

SEQ ID NO: 1097258 - RNA, 21 nt, Mycobacterium bovis subsp bovis AF2122/97
ugaguccccaggugggcagca

SEQ ID NO: 1097259 - RNA, 18 nt, Mycobacterium bovis subsp bovis AF2122/97
ugagucuuucccgccacc

SEQ ID NO: 1097260 - RNA, 14 nt, Mycobacterium bovis subsp bovis AF2122/97
ugagucaggcgccg

SEQ ID NO: 1097261 - RNA, 15 nt, Mycobacterium bovis subsp bovis AF2122/97
ugaguccagccggcg

SEQ ID NO: 1097262 - RNA, 15 nt, Mycobacterium bovis subsp bovis AF2122/97
ugaggcgcagcgcca

SEQ ID NO: 1097263 - RNA, 17 nt, Mycobacterium bovis subsp bovis AF2122/97
ugagguuggagcgccag

SEQ ID NO: 1097264 - RNA, 16 nt, Mycobacterium bovis subsp bovis AF2122/97
ugagguucaucgccgg

SEQ ID NO: 1097265 - RNA, 17 nt, Mycobacterium bovis subsp bovis AF2122/97
ugaguagaucccaccac

SEQ ID NO: 1097266 - RNA, 17 nt, Mycobacterium bovis subsp bovis AF2122/97
ugauaguggcgcgcggc

SEQ ID NO: 1097267 - RNA, 14 nt, Mycobacterium bovis subsp bovis AF2122/97
ugaucaaaccggcg

SEQ ID NO: 1097268 - RNA, 15 nt, Mycobacterium bovis subsp bovis AF2122/97
ugaucaaaccggcgg

SEQ ID NO: 1097269 - RNA, 22 nt, Mycobacterium bovis subsp bovis AF2122/97
ugaucaaacuaccgaacagugg

SEQ ID NO: 1097270 - RNA, 14 nt, Mycobacterium bovis subsp bovis AF2122/97
ugccaguccgcagc

SEQ ID NO: 1097271 - RNA, 14 nt, Mycobacterium bovis subsp bovis AF2122/97
ugccagucgaucgc

SEQ ID NO: 1097272 - RNA, 22 nt, Mycobacterium bovis subsp bovis AF2122/97
ugccagucgaucgcggcccgca

SEQ ID NO: 1097273 - RNA, 17 nt, Mycobacterium bovis subsp bovis AF2122/97
ugccagugcaucgguca

SEQ ID NO: 1097274 - RNA, 17 nt, Mycobacterium bovis subsp bovis AF2122/97
ugccagugccgcccacc

SEQ ID NO: 1097275 - RNA, 15 nt, Mycobacterium bovis subsp bovis AF2122/97
ugccagugcugcacc

SEQ ID NO: 1097276 - RNA, 19 nt, Mycobacterium bovis subsp bovis AF2122/97
ugccagugggccgacguga

SEQ ID NO: 1097277 - RNA, 21 nt, Mycobacterium bovis subsp bovis AF2122/97
ugccagaccagggcagcggcc

SEQ ID NO: 1097278 - RNA, 14 nt, Mycobacterium bovis subsp bovis AF2122/97
ugccaggaccgcgc

SEQ ID NO: 1097279 - RNA, 12 nt, Mycobacterium bovis subsp bovis AF2122/97
ugccaggcccgu

SEQ ID NO: 1097280 - RNA, 14 nt, Mycobacterium bovis subsp bovis AF2122/97
ugccagaccagggc

SEQ ID NO: 1097281 - RNA, 16 nt, Mycobacterium bovis subsp bovis AF2122/97
ugccacuuggacgaac

SEQ ID NO: 1097282 - RNA, 22 nt, Mycobacterium bovis subsp bovis AF2122/97
ugccacuuggacgaacacaccg

SEQ ID NO: 1097283 - RNA, 19 nt, Mycobacterium bovis subsp bovis AF2122/97
ugccacuuccacggcgugg

SEQ ID NO: 1097284 - RNA, 21 nt, Mycobacterium bovis subsp bovis AF2122/97
ugccacugccguugccgccgg

SEQ ID NO: 1097285 - RNA, 23 nt, Mycobacterium bovis subsp bovis AF2122/97
ugccacugccguugccgccggug

SEQ ID NO: 1097286 - RNA, 23 nt, Mycobacterium bovis subsp bovis AF2122/97
ugccacggugacccugguggugc

SEQ ID NO: 1097287 - RNA, 20 nt, Mycobacterium bovis subsp bovis AF2122/97
ugcagggugagcacguaucg

SEQ ID NO: 1097288 - RNA, 16 nt, Mycobacterium bovis subsp bovis AF2122/97
ugcauggcuugcucug

SEQ ID NO: 1097289 - RNA, 15 nt, Mycobacterium bovis subsp bovis AF2122/97
ugcaugucaaguucg

SEQ ID NO: 1097290 - RNA, 15 nt, Mycobacterium bovis subsp bovis AF2122/97
ugcaugguggcgccg

SEQ ID NO: 1097291 - RNA, 16 nt, Mycobacterium bovis subsp bovis AF2122/97
ugcaugguggcgccga

SEQ ID NO: 1097292 - RNA, 23 nt, Mycobacterium bovis subsp bovis AF2122/97
ugcauuggcggugcgcaccaccg

SEQ ID NO: 1097293 - RNA, 13 nt, Mycobacterium bovis subsp bovis AF2122/97
ugccacggcgccu

SEQ ID NO: 1097294 - RNA, 21 nt, Mycobacterium bovis subsp bovis AF2122/97
ugccacggggcagguccgccc

SEQ ID NO: 1097295 - RNA, 16 nt, Mycobacterium bovis subsp bovis AF2122/97
ugccacagcucgccgu

SEQ ID NO: 1097296 - RNA, 21 nt, Mycobacterium bovis subsp bovis AF2122/97
ugccacgcucggugcugcgcc

SEQ ID NO: 1097297 - RNA, 18 nt, Mycobacterium bovis subsp bovis AF2122/97
ugccacagcgacagcgug

SEQ ID NO: 1097298 - RNA, 19 nt, Mycobacterium bovis subsp bovis AF2122/97
ugccacacacugccggaca

SEQ ID NO: 1097299 - RNA, 22 nt, Mycobacterium bovis subsp bovis AF2122/97
ugccacacaggcguccaucgcc

SEQ ID NO: 1097300 - RNA, 12 nt, Mycobacterium bovis subsp bovis AF2122/97
ugccaaucgcac

SEQ ID NO: 1097301 - RNA, 13 nt, Mycobacterium bovis subsp bovis AF2122/97
ugccaaucugcac

SEQ ID NO: 1097302 - RNA, 13 nt, Mycobacterium bovis subsp bovis AF2122/97
ugccaacugcgcc

SEQ ID NO: 1097303 - RNA, 23 nt, Mycobacterium bovis subsp bovis AF2122/97
ugccaacgaaccgcucagcgcag

SEQ ID NO: 1097304 - RNA, 22 nt, Mycobacterium bovis subsp bovis AF2122/97
ugccaacaacaucagcgacagc

SEQ ID NO: 1097305 - RNA, 13 nt, Mycobacterium bovis subsp bovis AF2122/97
ugccaaacgccgc

SEQ ID NO: 1097306 - RNA, 17 nt, Mycobacterium bovis subsp bovis AF2122/97
ugccaaacgccgcccgc

SEQ ID NO: 1097307 - RNA, 19 nt, Mycobacterium bovis subsp bovis AF2122/97
ugccaaaagggcggcagcg

SEQ ID NO: 1097308 - RNA, 22 nt, Mycobacterium bovis subsp bovis AF2122/97
ugccaaaagggcggcagcgagg

SEQ ID NO: 1097309 - RNA, 18 nt, Mycobacterium bovis subsp bovis AF2122/97
ugcagcgcguucggcacc

SEQ ID NO: 1097310 - RNA, 20 nt, Mycobacterium bovis subsp bovis AF2122/97
ugcagcggcuugcccaggcg

SEQ ID NO: 1097311 - RNA, 17 nt, Mycobacterium bovis subsp bovis AF2122/97
ugcagcuccccgccgga

SEQ ID NO: 1097312 - RNA, 16 nt, Mycobacterium bovis subsp bovis AF2122/97
ugcaggccgccggcca

SEQ ID NO: 1097313 - RNA, 12 nt, Mycobacterium bovis subsp bovis AF2122/97
ugcaggauucgg

SEQ ID NO: 1097314 - RNA, 23 nt, Mycobacterium bovis subsp bovis AF2122/97
ugcaggaucaaaaccucgugcgc

SEQ ID NO: 1097315 - RNA, 17 nt, Mycobacterium bovis subsp bovis AF2122/97
ugcaggcgcagcugggu

SEQ ID NO: 1097316 - RNA, 21 nt, Mycobacterium bovis subsp bovis AF2122/97
ugcaggcgaguuaggccgcca

SEQ ID NO: 1097317 - RNA, 18 nt, Mycobacterium bovis subsp bovis AF2122/97
ugcagggcauugcggccc

SEQ ID NO: 1097318 - RNA, 16 nt, Mycobacterium bovis subsp bovis AF2122/97
ugcagggccacuggcc

SEQ ID NO: 1097319 - RNA, 19 nt, Mycobacterium bovis subsp bovis AF2122/97
ugcagggaauagcggcgcc

SEQ ID NO: 1097320 - RNA, 13 nt, Mycobacterium bovis subsp bovis AF2122/97
ugcagggcccgca

SEQ ID NO: 1097321 - RNA, 11 nt, Mycobacterium bovis subsp bovis AF2122/97
ugcagcagcgc

SEQ ID NO: 1097322 - RNA, 14 nt, Mycobacterium bovis subsp bovis AF2122/97
ugcagcagcgcagu

SEQ ID NO: 1097323 - RNA, 18 nt, Mycobacterium bovis subsp bovis AF2122/97
ugcagcacggcgccgcca

SEQ ID NO: 1097324 - RNA, 22 nt, Mycobacterium bovis subsp bovis AF2122/97
ugcagcacucggugucggccgc

SEQ ID NO: 1097325 - RNA, 23 nt, Mycobacterium bovis subsp bovis AF2122/97
ugcagcaccagccacgccagcca

SEQ ID NO: 1097326 - RNA, 14 nt, Mycobacterium bovis subsp bovis AF2122/97
ugcagcacgcgugg

SEQ ID NO: 1097327 - RNA, 13 nt, Mycobacterium bovis subsp bovis AF2122/97
ugcagaucggccg

SEQ ID NO: 1097328 - RNA, 16 nt, Mycobacterium bovis subsp bovis AF2122/97
ugcagcgccucgaccu

SEQ ID NO: 1097329 - RNA, 20 nt, Mycobacterium bovis subsp bovis AF2122/97
ugcagccggcauagcggccc

SEQ ID NO: 1097330 - RNA, 22 nt, Mycobacterium bovis subsp bovis AF2122/97
ugcagcccgccggauccgccag

SEQ ID NO: 1097331 - RNA, 15 nt, Mycobacterium bovis subsp bovis AF2122/97
ugcagccccacuucg

SEQ ID NO: 1097332 - RNA, 17 nt, Mycobacterium bovis subsp bovis AF2122/97
ugcccgccucgcagcga

SEQ ID NO: 1097333 - RNA, 15 nt, Mycobacterium bovis subsp bovis AF2122/97
ugcccgccccgaccg

SEQ ID NO: 1097334 - RNA, 11 nt, Mycobacterium bovis subsp bovis AF2122/97
ugcccgccguu

SEQ ID NO: 1097335 - RNA, 23 nt, Mycobacterium bovis subsp bovis AF2122/97
ugcccggacgauggcgucggcca

SEQ ID NO: 1097336 - RNA, 20 nt, Mycobacterium bovis subsp bovis AF2122/97
ugcccgcgcucgcacccgcu

SEQ ID NO: 1097337 - RNA, 19 nt, Mycobacterium bovis subsp bovis AF2122/97
ugcccgggguccaucgggg

SEQ ID NO: 1097338 - RNA, 16 nt, Mycobacterium bovis subsp bovis AF2122/97
ugcccgggucggccgg

SEQ ID NO: 1097339 - RNA, 20 nt, Mycobacterium bovis subsp bovis AF2122/97
ugcccgggucggccggguug

SEQ ID NO: 1097340 - RNA, 19 nt, Mycobacterium bovis subsp bovis AF2122/97
ugcccguauaaccggccau

SEQ ID NO: 1097341 - RNA, 15 nt, Mycobacterium bovis subsp bovis AF2122/97
ugcccgucgucggca

SEQ ID NO: 1097342 - RNA, 14 nt, Mycobacterium bovis subsp bovis AF2122/97
ugcccuucgucggc

SEQ ID NO: 1097343 - RNA, 15 nt, Mycobacterium bovis subsp bovis AF2122/97
ugccgaaaaucgcag

SEQ ID NO: 1097344 - RNA, 16 nt, Mycobacterium bovis subsp bovis AF2122/97
ugcccugccggcagcg

SEQ ID NO: 1097345 - RNA, 14 nt, Mycobacterium bovis subsp bovis AF2122/97
ugcccucggccgcc

SEQ ID NO: 1097346 - RNA, 19 nt, Mycobacterium bovis subsp bovis AF2122/97
ugcccugcauaggcgcggu

SEQ ID NO: 1097347 - RNA, 16 nt, Mycobacterium bovis subsp bovis AF2122/97
ugcccucaacggcggc

SEQ ID NO: 1097348 - RNA, 20 nt, Mycobacterium bovis subsp bovis AF2122/97
ugcccguucaugcggcggcg

SEQ ID NO: 1097349 - RNA, 14 nt, Mycobacterium bovis subsp bovis AF2122/97
ugcccgcccagccc

SEQ ID NO: 1097350 - RNA, 17 nt, Mycobacterium bovis subsp bovis AF2122/97
ugcccgcccagcccggc

SEQ ID NO: 1097351 - RNA, 21 nt, Mycobacterium bovis subsp bovis AF2122/97
ugcccgccaccggcgcgaccg

SEQ ID NO: 1097352 - RNA, 17 nt, Mycobacterium bovis subsp bovis AF2122/97
ugcccgccacgcucggu

SEQ ID NO: 1097353 - RNA, 16 nt, Mycobacterium bovis subsp bovis AF2122/97
ugcccgcauugccaac

SEQ ID NO: 1097354 - RNA, 22 nt, Mycobacterium bovis subsp bovis AF2122/97
ugcccgcaccguagccgcugca

SEQ ID NO: 1097355 - RNA, 19 nt, Mycobacterium bovis subsp bovis AF2122/97
ugcccgcaccguagccgcu

SEQ ID NO: 1097356 - RNA, 16 nt, Mycobacterium bovis subsp bovis AF2122/97
ugcccgcaccacaccg

SEQ ID NO: 1097357 - RNA, 17 nt, Mycobacterium bovis subsp bovis AF2122/97
ugcccgacucggccgug

SEQ ID NO: 1097358 - RNA, 23 nt, Mycobacterium bovis subsp bovis AF2122/97
ugcccgacugaacgucaccguug

SEQ ID NO: 1097359 - RNA, 14 nt, Mycobacterium bovis subsp bovis AF2122/97
ugcccgacggcguc

SEQ ID NO: 1097360 - RNA, 16 nt, Mycobacterium bovis subsp bovis AF2122/97
ugcccgauacccggug

SEQ ID NO: 1097361 - RNA, 22 nt, Mycobacterium bovis subsp bovis AF2122/97
ugcccgaucgcuuccucguagg

SEQ ID NO: 1097362 - RNA, 21 nt, Mycobacterium bovis subsp bovis AF2122/97
ugcccgagcccagcgccucca

SEQ ID NO: 1097363 - RNA, 20 nt, Mycobacterium bovis subsp bovis AF2122/97
ugccaucuggguccgucgag

SEQ ID NO: 1097364 - RNA, 14 nt, Mycobacterium bovis subsp bovis AF2122/97
ugccaucgggcgcg

SEQ ID NO: 1097365 - RNA, 16 nt, Mycobacterium bovis subsp bovis AF2122/97
ugccaucgggcgcggu

SEQ ID NO: 1097366 - RNA, 15 nt, Mycobacterium bovis subsp bovis AF2122/97
ugccaucgguggugg

SEQ ID NO: 1097367 - RNA, 14 nt, Mycobacterium bovis subsp bovis AF2122/97
ugccaucuccggug

SEQ ID NO: 1097368 - RNA, 13 nt, Mycobacterium bovis subsp bovis AF2122/97
ugccauggcccgu

SEQ ID NO: 1097369 - RNA, 16 nt, Mycobacterium bovis subsp bovis AF2122/97
ugccgaacuccgcgga

SEQ ID NO: 1097370 - RNA, 17 nt, Mycobacterium bovis subsp bovis AF2122/97
ugccgaaccgcugcggg

SEQ ID NO: 1097371 - RNA, 17 nt, Mycobacterium bovis subsp bovis AF2122/97
ugccgaacgccagaccg

SEQ ID NO: 1097372 - RNA, 20 nt, Mycobacterium bovis subsp bovis AF2122/97
ugccgaaaaucgcagccacg

SEQ ID NO: 1097373 - RNA, 22 nt, Mycobacterium bovis subsp bovis AF2122/97
ugccgaaacgccgaccgcgccg

SEQ ID NO: 1097374 - RNA, 21 nt, Mycobacterium bovis subsp bovis AF2122/97
ugccgaagcugcccaaccggu

SEQ ID NO: 1097375 - RNA, 17 nt, Mycobacterium bovis subsp bovis AF2122/97
ugccgaagcccgagcuc

SEQ ID NO: 1097376 - RNA, 17 nt, Mycobacterium bovis subsp bovis AF2122/97
ugccgaagaugaccgcu

SEQ ID NO: 1097377 - RNA, 15 nt, Mycobacterium bovis subsp bovis AF2122/97
ugccgaucgaugcca

SEQ ID NO: 1097378 - RNA, 14 nt, Mycobacterium bovis subsp bovis AF2122/97
ugccgaucgaugcc

SEQ ID NO: 1097379 - RNA, 15 nt, Mycobacterium bovis subsp bovis AF2122/97
ugccgacccgccgcg

SEQ ID NO: 1097380 - RNA, 17 nt, Mycobacterium bovis subsp bovis AF2122/97
ugccgacccgccgcgcc

SEQ ID NO: 1097381 - RNA, 12 nt, Mycobacterium bovis subsp bovis AF2122/97
ugccgaucggcc

SEQ ID NO: 1097382 - RNA, 13 nt, Mycobacterium bovis subsp bovis AF2122/97
ugccgaucggcca

SEQ ID NO: 1097383 - RNA, 15 nt, Mycobacterium bovis subsp bovis AF2122/97
ugccgaucggccaac

SEQ ID NO: 1097384 - RNA, 16 nt, Mycobacterium bovis subsp bovis AF2122/97
ugccgaucucgcccag

SEQ ID NO: 1097385 - RNA, 23 nt, Mycobacterium bovis subsp bovis AF2122/97
ugccgaugaccgccugcuggccg

SEQ ID NO: 1097386 - RNA, 13 nt, Mycobacterium bovis subsp bovis AF2122/97
ugccgaucccggc

SEQ ID NO: 1097387 - RNA, 19 nt, Mycobacterium bovis subsp bovis AF2122/97
ugccgaucugcucgccgag

SEQ ID NO: 1097388 - RNA, 23 nt, Mycobacterium bovis subsp bovis AF2122/97
ugccgaucugcucgccgagcucg

SEQ ID NO: 1097389 - RNA, 19 nt, Mycobacterium bovis subsp bovis AF2122/97
ugccgaugcgacgcagacc

SEQ ID NO: 1097390 - RNA, 12 nt, Mycobacterium bovis subsp bovis AF2122/97
ugccgaugccgg

SEQ ID NO: 1097391 - RNA, 12 nt, Mycobacterium bovis subsp bovis AF2122/97
ugccgccaaccg

SEQ ID NO: 1097392 - RNA, 16 nt, Mycobacterium bovis subsp bovis AF2122/97
ugccgccaccgccacc

SEQ ID NO: 1097393 - RNA, 21 nt, Mycobacterium bovis subsp bovis AF2122/97
ugccgcaugcgcuccggcgcg

SEQ ID NO: 1097394 - RNA, 13 nt, Mycobacterium bovis subsp bovis AF2122/97
ugccgaugccggc

SEQ ID NO: 1097395 - RNA, 15 nt, Mycobacterium bovis subsp bovis AF2122/97
ugccgaugucgaugc

SEQ ID NO: 1097396 - RNA, 14 nt, Mycobacterium bovis subsp bovis AF2122/97
ugccgccaccaccg

SEQ ID NO: 1097397 - RNA, 23 nt, Mycobacterium bovis subsp bovis AF2122/97
ugccgcauaucacccggagaccg

SEQ ID NO: 1097398 - RNA, 13 nt, Mycobacterium bovis subsp bovis AF2122/97
ugccgcaucaccc

SEQ ID NO: 1097399 - RNA, 16 nt, Mycobacterium bovis subsp bovis AF2122/97
ugccgcaggaagucga

SEQ ID NO: 1097400 - RNA, 13 nt, Mycobacterium bovis subsp bovis AF2122/97
ugccgccgcggca

SEQ ID NO: 1097401 - RNA, 11 nt, Mycobacterium bovis subsp bovis AF2122/97
ugccgccggag

SEQ ID NO: 1097402 - RNA, 16 nt, Mycobacterium bovis subsp bovis AF2122/97
ugccgccggcaccgcc

SEQ ID NO: 1097403 - RNA, 21 nt, Mycobacterium bovis subsp bovis AF2122/97
ugccgccggcaccgccggugg

SEQ ID NO: 1097404 - RNA, 17 nt, Mycobacterium bovis subsp bovis AF2122/97
ugccgccggccccgcca

SEQ ID NO: 1097405 - RNA, 23 nt, Mycobacterium bovis subsp bovis AF2122/97
ugccgccggccccgccagcgccg

SEQ ID NO: 1097406 - RNA, 20 nt, Mycobacterium bovis subsp bovis AF2122/97
ugccgccggccccgccggcg

SEQ ID NO: 1097407 - RNA, 21 nt, Mycobacterium bovis subsp bovis AF2122/97
ugccgccggccccgccgucgc

SEQ ID NO: 1097408 - RNA, 14 nt, Mycobacterium bovis subsp bovis AF2122/97
ugccgccgccggcg

SEQ ID NO: 1097409 - RNA, 20 nt, Mycobacterium bovis subsp bovis AF2122/97
ugccgccgccuccgccgagg

SEQ ID NO: 1097410 - RNA, 16 nt, Mycobacterium bovis subsp bovis AF2122/97
ugccgccgacgccgcc

SEQ ID NO: 1097411 - RNA, 19 nt, Mycobacterium bovis subsp bovis AF2122/97
ugccgccauuggcaggcau

SEQ ID NO: 1097412 - RNA, 17 nt, Mycobacterium bovis subsp bovis AF2122/97
ugccgccgccgccggcg

SEQ ID NO: 1097413 - RNA, 16 nt, Mycobacterium bovis subsp bovis AF2122/97
ugccgccgagcuggcg

SEQ ID NO: 1097414 - RNA, 13 nt, Mycobacterium bovis subsp bovis AF2122/97
ugccgcaucggca

SEQ ID NO: 1097415 - RNA, 13 nt, Mycobacterium bovis subsp bovis AF2122/97
ugccgccaccggc

SEQ ID NO: 1097416 - RNA, 14 nt, Mycobacterium bovis subsp bovis AF2122/97
ugccgccaggcucg

SEQ ID NO: 1097417 - RNA, 20 nt, Mycobacterium bovis subsp bovis AF2122/97
ugccgccauuccagccggug

SEQ ID NO: 1097418 - RNA, 20 nt, Mycobacterium bovis subsp bovis AF2122/97
ugccgccaucgccgccggug

SEQ ID NO: 1097419 - RNA, 14 nt, Mycobacterium bovis subsp bovis AF2122/97
ugccgcgcaccaac

SEQ ID NO: 1097420 - RNA, 20 nt, Mycobacterium bovis subsp bovis AF2122/97
ugccgccuuugcccccggug

SEQ ID NO: 1097421 - RNA, 19 nt, Mycobacterium bovis subsp bovis AF2122/97
ugccgccuccgccugcccc

SEQ ID NO: 1097422 - RNA, 21 nt, Mycobacterium bovis subsp bovis AF2122/97
ugccgccuccgccugccccac

SEQ ID NO: 1097423 - RNA, 20 nt, Mycobacterium bovis subsp bovis AF2122/97
ugccgccuccggugcauauu

SEQ ID NO: 1097424 - RNA, 11 nt, Mycobacterium bovis subsp bovis AF2122/97
ugccgccuguc

SEQ ID NO: 1097425 - RNA, 19 nt, Mycobacterium bovis subsp bovis AF2122/97
ugcgcggccggcacgaccg

SEQ ID NO: 1097426 - RNA, 17 nt, Mycobacterium bovis subsp bovis AF2122/97
ugcgcggcgucgucgau

SEQ ID NO: 1097427 - RNA, 19 nt, Mycobacterium bovis subsp bovis AF2122/97
ugcgcggcgucgucgauga

SEQ ID NO: 1097428 - RNA, 17 nt, Mycobacterium bovis subsp bovis AF2122/97
ugcgcggcgugcgcggu

SEQ ID NO: 1097429 - RNA, 15 nt, Mycobacterium bovis subsp bovis AF2122/97
ugcgcgcccgggcgg

SEQ ID NO: 1097430 - RNA, 18 nt, Mycobacterium bovis subsp bovis AF2122/97
ugcgcgccguucacccug

SEQ ID NO: 1097431 - RNA, 19 nt, Mycobacterium bovis subsp bovis AF2122/97
ugcgcggccaccucaucgc

SEQ ID NO: 1097432 - RNA, 22 nt, Mycobacterium bovis subsp bovis AF2122/97
ugcgcggccaccucaucgccau

SEQ ID NO: 1097433 - RNA, 19 nt, Mycobacterium bovis subsp bovis AF2122/97
ugcgcugguggcggcgaca

SEQ ID NO: 1097434 - RNA, 16 nt, Mycobacterium bovis subsp bovis AF2122/97
ugcgcuguugcuggcg

SEQ ID NO: 1097435 - RNA, 18 nt, Mycobacterium bovis subsp bovis AF2122/97
ugcgcuuccaucgccacu

SEQ ID NO: 1097436 - RNA, 18 nt, Mycobacterium bovis subsp bovis AF2122/97
ugcgcuggaucucguugg

SEQ ID NO: 1097437 - RNA, 12 nt, Mycobacterium bovis subsp bovis AF2122/97
ugcgcuggcggc

SEQ ID NO: 1097438 - RNA, 14 nt, Mycobacterium bovis subsp bovis AF2122/97
ugcgcugcaccggg

SEQ ID NO: 1097439 - RNA, 18 nt, Mycobacterium bovis subsp bovis AF2122/97
ugcgcugcucacgcagca

SEQ ID NO: 1097440 - RNA, 23 nt, Mycobacterium bovis subsp bovis AF2122/97
ugcgcgggcaucgucgucgcugc

SEQ ID NO: 1097441 - RNA, 21 nt, Mycobacterium bovis subsp bovis AF2122/97
ugcgccccggagccucgaaca

SEQ ID NO: 1097442 - RNA, 23 nt, Mycobacterium bovis subsp bovis AF2122/97
ugcgcccggccaagccggcgagu

SEQ ID NO: 1097443 - RNA, 20 nt, Mycobacterium bovis subsp bovis AF2122/97
ugcgccgacuuugucgcgga

SEQ ID NO: 1097444 - RNA, 17 nt, Mycobacterium bovis subsp bovis AF2122/97
ugcgccgacccgcgcgc

SEQ ID NO: 1097445 - RNA, 15 nt, Mycobacterium bovis subsp bovis AF2122/97
ugcgcgaccacccgc

SEQ ID NO: 1097446 - RNA, 18 nt, Mycobacterium bovis subsp bovis AF2122/97
ugcgcgaccacccgccgc

SEQ ID NO: 1097447 - RNA, 21 nt, Mycobacterium bovis subsp bovis AF2122/97
ugcgccgaaugccaccucgac

SEQ ID NO: 1097448 - RNA, 17 nt, Mycobacterium bovis subsp bovis AF2122/97
ugcgcccugagcagaug

SEQ ID NO: 1097449 - RNA, 13 nt, Mycobacterium bovis subsp bovis AF2122/97
ugcgcgaugccca

SEQ ID NO: 1097450 - RNA, 22 nt, Mycobacterium bovis subsp bovis AF2122/97
ugcgcgaugcccacgcacagca

SEQ ID NO: 1097451 - RNA, 22 nt, Mycobacterium bovis subsp bovis AF2122/97
ugcgcgaugcgauucugcgucu

SEQ ID NO: 1097452 - RNA, 23 nt, Mycobacterium bovis subsp bovis AF2122/97
ugcgcgaugcgauucugcgucug

SEQ ID NO: 1097453 - RNA, 19 nt, Mycobacterium bovis subsp bovis AF2122/97
ugcgcgccaaacgccggau

SEQ ID NO: 1097454 - RNA, 23 nt, Mycobacterium bovis subsp bovis AF2122/97
ugcgcgccauuggcgccgccgau

SEQ ID NO: 1097455 - RNA, 18 nt, Mycobacterium bovis subsp bovis AF2122/97
ugcgcgcccaccgggcgg

SEQ ID NO: 1097456 - RNA, 19 nt, Mycobacterium bovis subsp bovis AF2122/97
ugcgcgacugauccucgau

SEQ ID NO: 1097457 - RNA, 18 nt, Mycobacterium bovis subsp bovis AF2122/97
ugcgcgaccgaccagccg

SEQ ID NO: 1097458 - RNA, 17 nt, Mycobacterium bovis subsp bovis AF2122/97
ugcgcgaguaagcgaac

SEQ ID NO: 1097459 - RNA, 18 nt, Mycobacterium bovis subsp bovis AF2122/97
ugcgcgagugccaguccg

SEQ ID NO: 1097460 - RNA, 21 nt, Mycobacterium bovis subsp bovis AF2122/97
ugcgcgauaggugcucgcgau

SEQ ID NO: 1097461 - RNA, 17 nt, Mycobacterium bovis subsp bovis AF2122/97
ugcgcgaggggccggcu

SEQ ID NO: 1097462 - RNA, 18 nt, Mycobacterium bovis subsp bovis AF2122/97
ugcggaaacccggccgcc

SEQ ID NO: 1097463 - RNA, 16 nt, Mycobacterium bovis subsp bovis AF2122/97
ugcgcuugcggccgcg

SEQ ID NO: 1097464 - RNA, 22 nt, Mycobacterium bovis subsp bovis AF2122/97
ugcgcuuggucgaccgccgaga

SEQ ID NO: 1097465 - RNA, 14 nt, Mycobacterium bovis subsp bovis AF2122/97
ugcggaaaucggac

SEQ ID NO: 1097466 - RNA, 20 nt, Mycobacterium bovis subsp bovis AF2122/97
ugcggaacaccaccaggcug

SEQ ID NO: 1097467 - RNA, 17 nt, Mycobacterium bovis subsp bovis AF2122/97
ugcggaagcaucggcug

SEQ ID NO: 1097468 - RNA, 16 nt, Mycobacterium bovis subsp bovis AF2122/97
ugcgcuuggucgaccg

SEQ ID NO: 1097469 - RNA, 14 nt, Mycobacterium bovis subsp bovis AF2122/97
ugcggaagccaccg

SEQ ID NO: 1097470 - RNA, 20 nt, Mycobacterium bovis subsp bovis AF2122/97
ugcggcccgggcucggcgaa

SEQ ID NO: 1097471 - RNA, 18 nt, Mycobacterium bovis subsp bovis AF2122/97
ugcggacacguugcgacg

SEQ ID NO: 1097472 - RNA, 12 nt, Mycobacterium bovis subsp bovis AF2122/97
ugcggccgcgcg

SEQ ID NO: 1097473 - RNA, 14 nt, Mycobacterium bovis subsp bovis AF2122/97
ugcggccgccggga

SEQ ID NO: 1097474 - RNA, 13 nt, Mycobacterium bovis subsp bovis AF2122/97
ugcggccgacggg

SEQ ID NO: 1097475 - RNA, 16 nt, Mycobacterium bovis subsp bovis AF2122/97
ugcggccuagggcggc

SEQ ID NO: 1097476 - RNA, 15 nt, Mycobacterium bovis subsp bovis AF2122/97
ugcggccgucgaugg

SEQ ID NO: 1097477 - RNA, 14 nt, Mycobacterium bovis subsp bovis AF2122/97
ugcggcgaccaggu

SEQ ID NO: 1097478 - RNA, 20 nt, Mycobacterium bovis subsp bovis AF2122/97
ugcggccuuggcgacgucgc

SEQ ID NO: 1097479 - RNA, 13 nt, Mycobacterium bovis subsp bovis AF2122/97
ugcggcgcgucgc

SEQ ID NO: 1097480 - RNA, 15 nt, Mycobacterium bovis subsp bovis AF2122/97
ugcggcgcgucgcgg

SEQ ID NO: 1097481 - RNA, 14 nt, Mycobacterium bovis subsp bovis AF2122/97
ugcggcgccgugau

SEQ ID NO: 1097482 - RNA, 17 nt, Mycobacterium bovis subsp bovis AF2122/97
ugcggcgcagcgacgcg

SEQ ID NO: 1097483 - RNA, 18 nt, Mycobacterium bovis subsp bovis AF2122/97
ugcggcugguguccagcc

SEQ ID NO: 1097484 - RNA, 23 nt, Mycobacterium bovis subsp bovis AF2122/97
ugcggcugguguccagccaggcg

SEQ ID NO: 1097485 - RNA, 13 nt, Mycobacterium bovis subsp bovis AF2122/97
ugcggcuggcgcc

SEQ ID NO: 1097486 - RNA, 16 nt, Mycobacterium bovis subsp bovis AF2122/97
ugcgggucucgccgac

SEQ ID NO: 1097487 - RNA, 20 nt, Mycobacterium bovis subsp bovis AF2122/97
ugcgggucugacaucggcca

SEQ ID NO: 1097488 - RNA, 18 nt, Mycobacterium bovis subsp bovis AF2122/97
ugcgggccgccaggcggc

SEQ ID NO: 1097489 - RNA, 19 nt, Mycobacterium bovis subsp bovis AF2122/97
ugcgggccgccaggcggcc

SEQ ID NO: 1097490 - RNA, 15 nt, Mycobacterium bovis subsp bovis AF2122/97
ugcgggacuugucgg

SEQ ID NO: 1097491 - RNA, 15 nt, Mycobacterium bovis subsp bovis AF2122/97
ugcgggacgccgaau

SEQ ID NO: 1097492 - RNA, 16 nt, Mycobacterium bovis subsp bovis AF2122/97
ugcgggcaugccggcg

SEQ ID NO: 1097493 - RNA, 11 nt, Mycobacterium bovis subsp bovis AF2122/97
ugcgggcagca

SEQ ID NO: 1097494 - RNA, 17 nt, Mycobacterium bovis subsp bovis AF2122/97
ugcgggcagccgcccgc

SEQ ID NO: 1097495 - RNA, 21 nt, Mycobacterium bovis subsp bovis AF2122/97
ugcgggucccaaucgucggcc

SEQ ID NO: 1097496 - RNA, 16 nt, Mycobacterium bovis subsp bovis AF2122/97
ugcggguggaguuggc

SEQ ID NO: 1097497 - RNA, 23 nt, Mycobacterium bovis subsp bovis AF2122/97
ugcgggugggacaccaucuccgc

SEQ ID NO: 1097498 - RNA, 17 nt, Mycobacterium bovis subsp bovis AF2122/97
ugcggguggugccggcg

SEQ ID NO: 1097499 - RNA, 15 nt, Mycobacterium bovis subsp bovis AF2122/97
ugcggguucgccgau

SEQ ID NO: 1097500 - RNA, 20 nt, Mycobacterium bovis subsp bovis AF2122/97
ugcggguguaguggaagacc

SEQ ID NO: 1097501 - RNA, 17 nt, Mycobacterium bovis subsp bovis AF2122/97
ugcgguaaucgccaccg

SEQ ID NO: 1097502 - RNA, 19 nt, Mycobacterium bovis subsp bovis AF2122/97
ugcgguaaucgccaccgca

SEQ ID NO: 1097503 - RNA, 13 nt, Mycobacterium bovis subsp bovis AF2122/97
ugcgguacccgau

SEQ ID NO: 1097504 - RNA, 15 nt, Mycobacterium bovis subsp bovis AF2122/97
ugcgguaggcgguga

SEQ ID NO: 1097505 - RNA, 14 nt, Mycobacterium bovis subsp bovis AF2122/97
ugcgguauugcccg

SEQ ID NO: 1097506 - RNA, 13 nt, Mycobacterium bovis subsp bovis AF2122/97
ugcggucaccgga

SEQ ID NO: 1097507 - RNA, 19 nt, Mycobacterium bovis subsp bovis AF2122/97
ugcggucagauucggcgau

SEQ ID NO: 1097508 - RNA, 16 nt, Mycobacterium bovis subsp bovis AF2122/97
ugcggucaacgacagc

SEQ ID NO: 1097509 - RNA, 14 nt, Mycobacterium bovis subsp bovis AF2122/97
ugcggucaacgcug

SEQ ID NO: 1097510 - RNA, 17 nt, Mycobacterium bovis subsp bovis AF2122/97
ugccgugcugggccgac

SEQ ID NO: 1097511 - RNA, 21 nt, Mycobacterium bovis subsp bovis AF2122/97
ugccgugccgaaguggagccc

SEQ ID NO: 1097512 - RNA, 15 nt, Mycobacterium bovis subsp bovis AF2122/97
ugccgucgucgccgu

SEQ ID NO: 1097513 - RNA, 17 nt, Mycobacterium bovis subsp bovis AF2122/97
ugccguucagcggcggg

SEQ ID NO: 1097514 - RNA, 23 nt, Mycobacterium bovis subsp bovis AF2122/97
ugccgugugcuucgagcaccgac

SEQ ID NO: 1097515 - RNA, 15 nt, Mycobacterium bovis subsp bovis AF2122/97
ugccguuaccgccaa

SEQ ID NO: 1097516 - RNA, 22 nt, Mycobacterium bovis subsp bovis AF2122/97
ugccgucuuugucacgcaccgc

SEQ ID NO: 1097517 - RNA, 14 nt, Mycobacterium bovis subsp bovis AF2122/97
ugccguccaccgau

SEQ ID NO: 1097518 - RNA, 16 nt, Mycobacterium bovis subsp bovis AF2122/97
ugccgucagcggcggc

SEQ ID NO: 1097519 - RNA, 12 nt, Mycobacterium bovis subsp bovis AF2122/97
ugccgucagcug

SEQ ID NO: 1097520 - RNA, 16 nt, Mycobacterium bovis subsp bovis AF2122/97
ugccgucagcugaccg

SEQ ID NO: 1097521 - RNA, 19 nt, Mycobacterium bovis subsp bovis AF2122/97
ugccgcggccaguacgucg

SEQ ID NO: 1097522 - RNA, 22 nt, Mycobacterium bovis subsp bovis AF2122/97
ugccgcggccaguacgucgauc

SEQ ID NO: 1097523 - RNA, 23 nt, Mycobacterium bovis subsp bovis AF2122/97
ugccgcggccggcgugccagcac

SEQ ID NO: 1097524 - RNA, 13 nt, Mycobacterium bovis subsp bovis AF2122/97
ugccgcggccacc

SEQ ID NO: 1097525 - RNA, 21 nt, Mycobacterium bovis subsp bovis AF2122/97
ugccgcggcugccaucccgau

SEQ ID NO: 1097526 - RNA, 19 nt, Mycobacterium bovis subsp bovis AF2122/97
ugccgcgguggaugcgaug

SEQ ID NO: 1097527 - RNA, 16 nt, Mycobacterium bovis subsp bovis AF2122/97
ugccgcggucggcgac

SEQ ID NO: 1097528 - RNA, 18 nt, Mycobacterium bovis subsp bovis AF2122/97
ugccgcgucaaccgaucg

SEQ ID NO: 1097529 - RNA, 22 nt, Mycobacterium bovis subsp bovis AF2122/97
ugccgcguagcuggucccacac

SEQ ID NO: 1097530 - RNA, 16 nt, Mycobacterium bovis subsp bovis AF2122/97
ugccguacagcccggc

SEQ ID NO: 1097531 - RNA, 14 nt, Mycobacterium bovis subsp bovis AF2122/97
ugccguauccaggc

SEQ ID NO: 1097532 - RNA, 19 nt, Mycobacterium bovis subsp bovis AF2122/97
ugccguuccagcaucggug

SEQ ID NO: 1097533 - RNA, 18 nt, Mycobacterium bovis subsp bovis AF2122/97
ugccguucucgucgagga

SEQ ID NO: 1097534 - RNA, 19 nt, Mycobacterium bovis subsp bovis AF2122/97
ugccguugauucggccgcc

SEQ ID NO: 1097535 - RNA, 15 nt, Mycobacterium bovis subsp bovis AF2122/97
ugccguucucgucga

SEQ ID NO: 1097536 - RNA, 17 nt, Mycobacterium bovis subsp bovis AF2122/97
ugccguuggagccgcca

SEQ ID NO: 1097537 - RNA, 14 nt, Mycobacterium bovis subsp bovis AF2122/97
ugccguugccgccg

SEQ ID NO: 1097538 - RNA, 17 nt, Mycobacterium bovis subsp bovis AF2122/97
ugccguugccgccggug

SEQ ID NO: 1097539 - RNA, 14 nt, Mycobacterium bovis subsp bovis AF2122/97
ugccguugcgaucg

SEQ ID NO: 1097540 - RNA, 15 nt, Mycobacterium bovis subsp bovis AF2122/97
ugccguugcgaucgc

SEQ ID NO: 1097541 - RNA, 22 nt, Mycobacterium bovis subsp bovis AF2122/97
ugccguugcgaucgcgugcggu

SEQ ID NO: 1097542 - RNA, 18 nt, Mycobacterium bovis subsp bovis AF2122/97
ugcgaacacgcgaugaug

SEQ ID NO: 1097543 - RNA, 17 nt, Mycobacterium bovis subsp bovis AF2122/97
ugcgaacccugcgcacu

SEQ ID NO: 1097544 - RNA, 21 nt, Mycobacterium bovis subsp bovis AF2122/97
ugccuuugcggcgggcaccgu

SEQ ID NO: 1097545 - RNA, 17 nt, Mycobacterium bovis subsp bovis AF2122/97
ugccuuggcagcccagu

SEQ ID NO: 1097546 - RNA, 16 nt, Mycobacterium bovis subsp bovis AF2122/97
ugccuugggaccgcgc

SEQ ID NO: 1097547 - RNA, 14 nt, Mycobacterium bovis subsp bovis AF2122/97
ugccuuucggcaga

SEQ ID NO: 1097548 - RNA, 23 nt, Mycobacterium bovis subsp bovis AF2122/97
ugccuuccucggcaaaccaagcg

SEQ ID NO: 1097549 - RNA, 20 nt, Mycobacterium bovis subsp bovis AF2122/97
ugccuucguagcggccgcag

SEQ ID NO: 1097550 - RNA, 17 nt, Mycobacterium bovis subsp bovis AF2122/97
ugccuugaucugagcgc

SEQ ID NO: 1097551 - RNA, 13 nt, Mycobacterium bovis subsp bovis AF2122/97
ugcgcccaccgaa

SEQ ID NO: 1097552 - RNA, 20 nt, Mycobacterium bovis subsp bovis AF2122/97
ugcgcccagcgacccggcca

SEQ ID NO: 1097553 - RNA, 16 nt, Mycobacterium bovis subsp bovis AF2122/97
ugcgcccaauccaccg

SEQ ID NO: 1097554 - RNA, 13 nt, Mycobacterium bovis subsp bovis AF2122/97
ugcgccacgucga

SEQ ID NO: 1097555 - RNA, 16 nt, Mycobacterium bovis subsp bovis AF2122/97
ugcgccacgucgacgg

SEQ ID NO: 1097556 - RNA, 21 nt, Mycobacterium bovis subsp bovis AF2122/97
ugcgcacucccggcucggcca

SEQ ID NO: 1097557 - RNA, 18 nt, Mycobacterium bovis subsp bovis AF2122/97
ugcgcagaacaccaccgc

SEQ ID NO: 1097558 - RNA, 13 nt, Mycobacterium bovis subsp bovis AF2122/97
ugcgccaccggug

SEQ ID NO: 1097559 - RNA, 20 nt, Mycobacterium bovis subsp bovis AF2122/97
ugcgcagcugcgggucgugc

SEQ ID NO: 1097560 - RNA, 19 nt, Mycobacterium bovis subsp bovis AF2122/97
ugcgagcgccggcuucggg

SEQ ID NO: 1097561 - RNA, 14 nt, Mycobacterium bovis subsp bovis AF2122/97
ugcgagcgcgccgg

SEQ ID NO: 1097562 - RNA, 16 nt, Mycobacterium bovis subsp bovis AF2122/97
ugcgaauagccaccaa

SEQ ID NO: 1097563 - RNA, 14 nt, Mycobacterium bovis subsp bovis AF2122/97
ugcgaaggcaucgc

SEQ ID NO: 1097564 - RNA, 13 nt, Mycobacterium bovis subsp bovis AF2122/97
ugcgaaccggccg

SEQ ID NO: 1097565 - RNA, 16 nt, Mycobacterium bovis subsp bovis AF2122/97
ugcgaagccgagcauc

SEQ ID NO: 1097566 - RNA, 15 nt, Mycobacterium bovis subsp bovis AF2122/97
ugcgaggugccgggg

SEQ ID NO: 1097567 - RNA, 18 nt, Mycobacterium bovis subsp bovis AF2122/97
ugcgaggugccggggugg

SEQ ID NO: 1097568 - RNA, 21 nt, Mycobacterium bovis subsp bovis AF2122/97
ugcgagguucagccugagcac

SEQ ID NO: 1097569 - RNA, 19 nt, Mycobacterium bovis subsp bovis AF2122/97
ugcgaggcguaaucaagca

SEQ ID NO: 1097570 - RNA, 18 nt, Mycobacterium bovis subsp bovis AF2122/97
ugcgagggcacgcgcaca

SEQ ID NO: 1097571 - RNA, 15 nt, Mycobacterium bovis subsp bovis AF2122/97
ugcgauccagggccg

SEQ ID NO: 1097572 - RNA, 22 nt, Mycobacterium bovis subsp bovis AF2122/97
ugcgaucccacccucgggucca

SEQ ID NO: 1097573 - RNA, 12 nt, Mycobacterium bovis subsp bovis AF2122/97
ugcgaucccgau

SEQ ID NO: 1097574 - RNA, 21 nt, Mycobacterium bovis subsp bovis AF2122/97
ugcgaucaacccuacccgcau

SEQ ID NO: 1097575 - RNA, 19 nt, Mycobacterium bovis subsp bovis AF2122/97
ugcgaucaccuccgcgacg

SEQ ID NO: 1097576 - RNA, 21 nt, Mycobacterium bovis subsp bovis AF2122/97
ugcgaucaccuccgcgacggc

SEQ ID NO: 1097577 - RNA, 16 nt, Mycobacterium bovis subsp bovis AF2122/97
ugcgauacacggcggc

SEQ ID NO: 1097578 - RNA, 17 nt, Mycobacterium bovis subsp bovis AF2122/97
ugcgauacacggcggcg

SEQ ID NO: 1097579 - RNA, 12 nt, Mycobacterium bovis subsp bovis AF2122/97
ugcgcaccgguc

SEQ ID NO: 1097580 - RNA, 19 nt, Mycobacterium bovis subsp bovis AF2122/97
ugcgcaccggucaacgugg

SEQ ID NO: 1097581 - RNA, 20 nt, Mycobacterium bovis subsp bovis AF2122/97
ugcgcacgaccccucuuguc

SEQ ID NO: 1097582 - RNA, 19 nt, Mycobacterium bovis subsp bovis AF2122/97
ugcgcaccaaggccgugau

SEQ ID NO: 1097583 - RNA, 12 nt, Mycobacterium bovis subsp bovis AF2122/97
ugcgcaccaccg

SEQ ID NO: 1097584 - RNA, 13 nt, Mycobacterium bovis subsp bovis AF2122/97
ugcgcacaccgac

SEQ ID NO: 1097585 - RNA, 20 nt, Mycobacterium bovis subsp bovis AF2122/97
ugcgcacccgcgggucgucc

SEQ ID NO: 1097586 - RNA, 19 nt, Mycobacterium bovis subsp bovis AF2122/97
ugcgcaccaguccagcggg

SEQ ID NO: 1097587 - RNA, 20 nt, Mycobacterium bovis subsp bovis AF2122/97
ugcgcaacccagccgcgcca

SEQ ID NO: 1097588 - RNA, 13 nt, Mycobacterium bovis subsp bovis AF2122/97
ugcgaucaguucg

SEQ ID NO: 1097589 - RNA, 14 nt, Mycobacterium bovis subsp bovis AF2122/97
ugcuggccgcggcc

SEQ ID NO: 1097590 - RNA, 21 nt, Mycobacterium bovis subsp bovis AF2122/97
ugcuggcgaacucgaggucga

SEQ ID NO: 1097591 - RNA, 13 nt, Mycobacterium bovis subsp bovis AF2122/97
ugcuggcggcgcg

SEQ ID NO: 1097592 - RNA, 14 nt, Mycobacterium bovis subsp bovis AF2122/97
ugcuggcggcgcga

SEQ ID NO: 1097593 - RNA, 12 nt, Mycobacterium bovis subsp bovis AF2122/97
ugcuggcgccga

SEQ ID NO: 1097594 - RNA, 13 nt, Mycobacterium bovis subsp bovis AF2122/97
ugcuggcccgcac

SEQ ID NO: 1097595 - RNA, 15 nt, Mycobacterium bovis subsp bovis AF2122/97
ugcuggcagaccaac

SEQ ID NO: 1097596 - RNA, 21 nt, Mycobacterium bovis subsp bovis AF2122/97
ugcuggaaguugugcgcacuc

SEQ ID NO: 1097597 - RNA, 19 nt, Mycobacterium bovis subsp bovis AF2122/97
ugcuggcaaaguaucgcag

SEQ ID NO: 1097598 - RNA, 20 nt, Mycobacterium bovis subsp bovis AF2122/97
ugcuggguaguucaccgcgu

SEQ ID NO: 1097599 - RNA, 18 nt, Mycobacterium bovis subsp bovis AF2122/97
ugcugggcccgccagccc

SEQ ID NO: 1097600 - RNA, 22 nt, Mycobacterium bovis subsp bovis AF2122/97
ugcugggccgacgggacaaccc

SEQ ID NO: 1097601 - RNA, 21 nt, Mycobacterium bovis subsp bovis AF2122/97
ugcuggugacgaaagcgccca

SEQ ID NO: 1097602 - RNA, 14 nt, Mycobacterium bovis subsp bovis AF2122/97
ugcuggucggcgau

SEQ ID NO: 1097603 - RNA, 16 nt, Mycobacterium bovis subsp bovis AF2122/97
ugcuggucgccgucga

SEQ ID NO: 1097604 - RNA, 16 nt, Mycobacterium bovis subsp bovis AF2122/97
ugcugguauagccggc

SEQ ID NO: 1097605 - RNA, 17 nt, Mycobacterium bovis subsp bovis AF2122/97
ugcuggucagcggcgcg

SEQ ID NO: 1097606 - RNA, 17 nt, Mycobacterium bovis subsp bovis AF2122/97
ugcugucguagcgcgag

SEQ ID NO: 1097607 - RNA, 13 nt, Mycobacterium bovis subsp bovis AF2122/97
ugcugucaccgca

SEQ ID NO: 1097608 - RNA, 14 nt, Mycobacterium bovis subsp bovis AF2122/97
ugcugucaccgcaa

SEQ ID NO: 1097609 - RNA, 15 nt, Mycobacterium bovis subsp bovis AF2122/97
ugcugucgacgucgg

SEQ ID NO: 1097610 - RNA, 14 nt, Mycobacterium bovis subsp bovis AF2122/97
ugcugguggcggca

SEQ ID NO: 1097611 - RNA, 22 nt, Mycobacterium bovis subsp bovis AF2122/97
ugcugguugccuuugcggcggg

SEQ ID NO: 1097612 - RNA, 19 nt, Mycobacterium bovis subsp bovis AF2122/97
ugcuugccgcauacgcggc

SEQ ID NO: 1097613 - RNA, 14 nt, Mycobacterium bovis subsp bovis AF2122/97
ugcuugcgcaucgc

SEQ ID NO: 1097614 - RNA, 16 nt, Mycobacterium bovis subsp bovis AF2122/97
ugcuugggccgcugau

SEQ ID NO: 1097615 - RNA, 19 nt, Mycobacterium bovis subsp bovis AF2122/97
ugcuuguugcgcgacgccg

SEQ ID NO: 1097616 - RNA, 20 nt, Mycobacterium bovis subsp bovis AF2122/97
ugcuugcgcguggcagugca

SEQ ID NO: 1097617 - RNA, 13 nt, Mycobacterium bovis subsp bovis AF2122/97
ugcuuggccgcaa

SEQ ID NO: 1097618 - RNA, 14 nt, Mycobacterium bovis subsp bovis AF2122/97
ugcuuggccgcgca

SEQ ID NO: 1097619 - RNA, 23 nt, Mycobacterium bovis subsp bovis AF2122/97
ugcuguugccagucgaucgcggc

SEQ ID NO: 1097620 - RNA, 22 nt, Mycobacterium bovis subsp bovis AF2122/97
ugcuguuccaucaaggucauca

SEQ ID NO: 1097621 - RNA, 16 nt, Mycobacterium bovis subsp bovis AF2122/97
ugcuguugcgcggucg

SEQ ID NO: 1097622 - RNA, 17 nt, Mycobacterium bovis subsp bovis AF2122/97
ugcuguguugcacccga

SEQ ID NO: 1097623 - RNA, 23 nt, Mycobacterium bovis subsp bovis AF2122/97
ugcuguugguauuagggccggcg

SEQ ID NO: 1097624 - RNA, 14 nt, Mycobacterium bovis subsp bovis AF2122/97
ugcuuagcgcgaaa

SEQ ID NO: 1097625 - RNA, 18 nt, Mycobacterium bovis subsp bovis AF2122/97
ugcugacauuuccaccac

SEQ ID NO: 1097626 - RNA, 20 nt, Mycobacterium bovis subsp bovis AF2122/97
ugcugacauuuccaccacgc

SEQ ID NO: 1097627 - RNA, 15 nt, Mycobacterium bovis subsp bovis AF2122/97
ugcugaccgcgccgg

SEQ ID NO: 1097628 - RNA, 18 nt, Mycobacterium bovis subsp bovis AF2122/97
ugcugaccgcgccggaca

SEQ ID NO: 1097629 - RNA, 20 nt, Mycobacterium bovis subsp bovis AF2122/97
ugcugacgacugggcgccca

SEQ ID NO: 1097630 - RNA, 21 nt, Mycobacterium bovis subsp bovis AF2122/97
ugcugacgaugcggucgacgg

SEQ ID NO: 1097631 - RNA, 18 nt, Mycobacterium bovis subsp bovis AF2122/97
ugcugaccaugaccgggc

SEQ ID NO: 1097632 - RNA, 23 nt, Mycobacterium bovis subsp bovis AF2122/97
ugcugagcaaguccugcagcugg

SEQ ID NO: 1097633 - RNA, 21 nt, Mycobacterium bovis subsp bovis AF2122/97
ugcugaacugguuggugacgu

SEQ ID NO: 1097634 - RNA, 20 nt, Mycobacterium bovis subsp bovis AF2122/97
ugcucugggauuugggcugc

SEQ ID NO: 1097635 - RNA, 19 nt, Mycobacterium bovis subsp bovis AF2122/97
ugcucgggcgugaucccgc

SEQ ID NO: 1097636 - RNA, 13 nt, Mycobacterium bovis subsp bovis AF2122/97
ugcucggcgcgcc

SEQ ID NO: 1097637 - RNA, 11 nt, Mycobacterium bovis subsp bovis AF2122/97
ugcucggcgac

SEQ ID NO: 1097638 - RNA, 14 nt, Mycobacterium bovis subsp bovis AF2122/97
ugcucggucgaugc

SEQ ID NO: 1097639 - RNA, 16 nt, Mycobacterium bovis subsp bovis AF2122/97
ugcucggugacguaga

SEQ ID NO: 1097640 - RNA, 17 nt, Mycobacterium bovis subsp bovis AF2122/97
ugcucgggggccgacca

SEQ ID NO: 1097641 - RNA, 18 nt, Mycobacterium bovis subsp bovis AF2122/97
ugcucgggucgugcgugc

SEQ ID NO: 1097642 - RNA, 16 nt, Mycobacterium bovis subsp bovis AF2122/97
ugcucgguggugacca

SEQ ID NO: 1097643 - RNA, 19 nt, Mycobacterium bovis subsp bovis AF2122/97
ugcucguagcccaggucga

SEQ ID NO: 1097644 - RNA, 20 nt, Mycobacterium bovis subsp bovis AF2122/97
ugcucgucccagaaccggcu

SEQ ID NO: 1097645 - RNA, 12 nt, Mycobacterium bovis subsp bovis AF2122/97
ugcucgucggcg

SEQ ID NO: 1097646 - RNA, 19 nt, Mycobacterium bovis subsp bovis AF2122/97
ugcucguccaagccggcca

SEQ ID NO: 1097647 - RNA, 16 nt, Mycobacterium bovis subsp bovis AF2122/97
ugcucguccaccccga

SEQ ID NO: 1097648 - RNA, 12 nt, Mycobacterium bovis subsp bovis AF2122/97
ugcugcgcggug

SEQ ID NO: 1097649 - RNA, 12 nt, Mycobacterium bovis subsp bovis AF2122/97
ugcugcgcguug

SEQ ID NO: 1097650 - RNA, 13 nt, Mycobacterium bovis subsp bovis AF2122/97
ugcugcgcguuug

SEQ ID NO: 1097651 - RNA, 16 nt, Mycobacterium bovis subsp bovis AF2122/97
ugcugcggcagcgcgg

SEQ ID NO: 1097652 - RNA, 14 nt, Mycobacterium bovis subsp bovis AF2122/97
ugcugcggugcggg

SEQ ID NO: 1097653 - RNA, 18 nt, Mycobacterium bovis subsp bovis AF2122/97
ugcugcgcaccaaggccg

SEQ ID NO: 1097654 - RNA, 16 nt, Mycobacterium bovis subsp bovis AF2122/97
ugcugccguggcggca

SEQ ID NO: 1097655 - RNA, 13 nt, Mycobacterium bovis subsp bovis AF2122/97
ugcugcugcagca

SEQ ID NO: 1097656 - RNA, 19 nt, Mycobacterium bovis subsp bovis AF2122/97
ugcugcugcagcgaugcgg

SEQ ID NO: 1097657 - RNA, 19 nt, Mycobacterium bovis subsp bovis AF2122/97
ugcugcagcaauugcaccu

SEQ ID NO: 1097658 - RNA, 13 nt, Mycobacterium bovis subsp bovis AF2122/97
ugcugcacgcucu

SEQ ID NO: 1097659 - RNA, 19 nt, Mycobacterium bovis subsp bovis AF2122/97
ugcugcaaggaauuccggc

SEQ ID NO: 1097660 - RNA, 14 nt, Mycobacterium bovis subsp bovis AF2122/97
ugcugcccgaguuc

SEQ ID NO: 1097661 - RNA, 20 nt, Mycobacterium bovis subsp bovis AF2122/97
ugcugccgggggcccgaccu

SEQ ID NO: 1097662 - RNA, 21 nt, Mycobacterium bovis subsp bovis AF2122/97
ugcugccgauagcgcggcacc

SEQ ID NO: 1097663 - RNA, 23 nt, Mycobacterium bovis subsp bovis AF2122/97
ugcugccgauguguggaacaucc

SEQ ID NO: 1097664 - RNA, 13 nt, Mycobacterium bovis subsp bovis AF2122/97
ugcugcaugccga

SEQ ID NO: 1097665 - RNA, 19 nt, Mycobacterium bovis subsp bovis AF2122/97
ugcugccauugccgcaugc

SEQ ID NO: 1097666 - RNA, 17 nt, Mycobacterium bovis subsp bovis AF2122/97
ugcgugaugguugcucg

SEQ ID NO: 1097667 - RNA, 23 nt, Mycobacterium bovis subsp bovis AF2122/97
ugcgugaucuggccgaagcccga

SEQ ID NO: 1097668 - RNA, 20 nt, Mycobacterium bovis subsp bovis AF2122/97
ugcgucucgcgcagccgggu

SEQ ID NO: 1097669 - RNA, 21 nt, Mycobacterium bovis subsp bovis AF2122/97
ugcguccagcaaaugcggcgc

SEQ ID NO: 1097670 - RNA, 15 nt, Mycobacterium bovis subsp bovis AF2122/97
ugcgucugcucggca

SEQ ID NO: 1097671 - RNA, 20 nt, Mycobacterium bovis subsp bovis AF2122/97
ugcgugcccguugguguugc

SEQ ID NO: 1097672 - RNA, 20 nt, Mycobacterium bovis subsp bovis AF2122/97
ugcgugccgcaccgccugcu

SEQ ID NO: 1097673 - RNA, 13 nt, Mycobacterium bovis subsp bovis AF2122/97
ugcgugcgggggc

SEQ ID NO: 1097674 - RNA, 15 nt, Mycobacterium bovis subsp bovis AF2122/97
ugcgugcgcgucggu

SEQ ID NO: 1097675 - RNA, 19 nt, Mycobacterium bovis subsp bovis AF2122/97
ugcgucgcggaaguaccgu

SEQ ID NO: 1097676 - RNA, 19 nt, Mycobacterium bovis subsp bovis AF2122/97
ugcgucgcggacggugcgg

SEQ ID NO: 1097677 - RNA, 15 nt, Mycobacterium bovis subsp bovis AF2122/97
ugcgucggcccggug

SEQ ID NO: 1097678 - RNA, 13 nt, Mycobacterium bovis subsp bovis AF2122/97
ugcgucggcggcu

SEQ ID NO: 1097679 - RNA, 17 nt, Mycobacterium bovis subsp bovis AF2122/97
ugcgucucgguggcugc

SEQ ID NO: 1097680 - RNA, 15 nt, Mycobacterium bovis subsp bovis AF2122/97
ugcguccggugcugg

SEQ ID NO: 1097681 - RNA, 23 nt, Mycobacterium bovis subsp bovis AF2122/97
ugcguccggugcugguccagccg

SEQ ID NO: 1097682 - RNA, 14 nt, Mycobacterium bovis subsp bovis AF2122/97
ugcguccugcucgc

SEQ ID NO: 1097683 - RNA, 15 nt, Mycobacterium bovis subsp bovis AF2122/97
ugcguccugcucgcg

SEQ ID NO: 1097684 - RNA, 15 nt, Mycobacterium bovis subsp bovis AF2122/97
ugcguccugguggcg

SEQ ID NO: 1097685 - RNA, 17 nt, Mycobacterium bovis subsp bovis AF2122/97
ugcguccugguggcggg

SEQ ID NO: 1097686 - RNA, 16 nt, Mycobacterium bovis subsp bovis AF2122/97
ugcguuccgaucggca

SEQ ID NO: 1097687 - RNA, 23 nt, Mycobacterium bovis subsp bovis AF2122/97
ugcguuccaguccccgccggccu

SEQ ID NO: 1097688 - RNA, 16 nt, Mycobacterium bovis subsp bovis AF2122/97
ugcguuccaucgccga

SEQ ID NO: 1097689 - RNA, 18 nt, Mycobacterium bovis subsp bovis AF2122/97
ugcguucggugaucucgu

SEQ ID NO: 1097690 - RNA, 12 nt, Mycobacterium bovis subsp bovis AF2122/97
ugcguuggcgcc

SEQ ID NO: 1097691 - RNA, 17 nt, Mycobacterium bovis subsp bovis AF2122/97
ugcguugggaucccagc

SEQ ID NO: 1097692 - RNA, 15 nt, Mycobacterium bovis subsp bovis AF2122/97
ugcguggcgggcugc

SEQ ID NO: 1097693 - RNA, 16 nt, Mycobacterium bovis subsp bovis AF2122/97
ugcguggcgggcugca

SEQ ID NO: 1097694 - RNA, 14 nt, Mycobacterium bovis subsp bovis AF2122/97
ugcgugggcgcggc

SEQ ID NO: 1097695 - RNA, 18 nt, Mycobacterium bovis subsp bovis AF2122/97
ugcgugggcgcggcgcca

SEQ ID NO: 1097696 - RNA, 22 nt, Mycobacterium bovis subsp bovis AF2122/97
ugcggugcacaaaauacuccgc

SEQ ID NO: 1097697 - RNA, 17 nt, Mycobacterium bovis subsp bovis AF2122/97
ugcggugacaaccgcgc

SEQ ID NO: 1097698 - RNA, 13 nt, Mycobacterium bovis subsp bovis AF2122/97
ugcgguccggcuu

SEQ ID NO: 1097699 - RNA, 13 nt, Mycobacterium bovis subsp bovis AF2122/97
ugcgguccucgau

SEQ ID NO: 1097700 - RNA, 22 nt, Mycobacterium bovis subsp bovis AF2122/97
ugcgguggcaggugaucccgau

SEQ ID NO: 1097701 - RNA, 17 nt, Mycobacterium bovis subsp bovis AF2122/97
ugcggugcaucgccacc

SEQ ID NO: 1097702 - RNA, 14 nt, Mycobacterium bovis subsp bovis AF2122/97
ugcggugccggccc

SEQ ID NO: 1097703 - RNA, 14 nt, Mycobacterium bovis subsp bovis AF2122/97
ugcgguggugcgca

SEQ ID NO: 1097704 - RNA, 19 nt, Mycobacterium bovis subsp bovis AF2122/97
ugcggugguaggacgccag

SEQ ID NO: 1097705 - RNA, 20 nt, Mycobacterium bovis subsp bovis AF2122/97
ugcgguggcuuuugcgucug

SEQ ID NO: 1097706 - RNA, 23 nt, Mycobacterium bovis subsp bovis AF2122/97
ugcgguggcuuuugcgucugcuc

SEQ ID NO: 1097707 - RNA, 21 nt, Mycobacterium bovis subsp bovis AF2122/97
ugcgguuucaccgacgacgcg

SEQ ID NO: 1097708 - RNA, 17 nt, Mycobacterium bovis subsp bovis AF2122/97
ugcgguuucaccgacga

SEQ ID NO: 1097709 - RNA, 20 nt, Mycobacterium bovis subsp bovis AF2122/97
ugcgguuucaccgacgacgc

SEQ ID NO: 1097710 - RNA, 16 nt, Mycobacterium bovis subsp bovis AF2122/97
ugcgguucgcugcggc

SEQ ID NO: 1097711 - RNA, 22 nt, Mycobacterium bovis subsp bovis AF2122/97
ugcguccacgugagugccggcg

SEQ ID NO: 1097712 - RNA, 13 nt, Mycobacterium bovis subsp bovis AF2122/97
ugcguccagcaaa

SEQ ID NO: 1097713 - RNA, 17 nt, Mycobacterium bovis subsp bovis AF2122/97
ugcguagcucacguuug

SEQ ID NO: 1097714 - RNA, 18 nt, Mycobacterium bovis subsp bovis AF2122/97
ugcguagcaggucgacgg

SEQ ID NO: 1097715 - RNA, 14 nt, Mycobacterium bovis subsp bovis AF2122/97
ugcgucacagccgg

SEQ ID NO: 1097716 - RNA, 15 nt, Mycobacterium bovis subsp bovis AF2122/97
ugcucgaucugucgc

SEQ ID NO: 1097717 - RNA, 22 nt, Mycobacterium bovis subsp bovis AF2122/97
ugcucgagugggugaggccaac

SEQ ID NO: 1097718 - RNA, 18 nt, Mycobacterium bovis subsp bovis AF2122/97
ugcucgaucaucgggagc

SEQ ID NO: 1097719 - RNA, 22 nt, Mycobacterium bovis subsp bovis AF2122/97
ugcucgccaggccuaggccgag

SEQ ID NO: 1097720 - RNA, 15 nt, Mycobacterium bovis subsp bovis AF2122/97
ugcucgcggguaccu

SEQ ID NO: 1097721 - RNA, 15 nt, Mycobacterium bovis subsp bovis AF2122/97
ugcucggccagaaag

SEQ ID NO: 1097722 - RNA, 15 nt, Mycobacterium bovis subsp bovis AF2122/97
ugcucgccgggcagc

SEQ ID NO: 1097723 - RNA, 15 nt, Mycobacterium bovis subsp bovis AF2122/97
ugcucgccgucucgg

SEQ ID NO: 1097724 - RNA, 22 nt, Mycobacterium bovis subsp bovis AF2122/97
ugcucgagagcaugguccagca

SEQ ID NO: 1097725 - RNA, 16 nt, Mycobacterium bovis subsp bovis AF2122/97
ugcucgagcaccucgg

SEQ ID NO: 1097726 - RNA, 19 nt, Mycobacterium bovis subsp bovis AF2122/97
ugcucgacgaucugcagca

SEQ ID NO: 1097727 - RNA, 13 nt, Mycobacterium bovis subsp bovis AF2122/97
ugcucgacgcccg

SEQ ID NO: 1097728 - RNA, 14 nt, Mycobacterium bovis subsp bovis AF2122/97
ugcucgaccgucau

SEQ ID NO: 1097729 - RNA, 22 nt, Mycobacterium bovis subsp bovis AF2122/97
ugcucgaaaucgcacagcgcag

SEQ ID NO: 1097730 - RNA, 14 nt, Mycobacterium bovis subsp bovis AF2122/97
ugcuccugguggca

SEQ ID NO: 1097731 - RNA, 15 nt, Mycobacterium bovis subsp bovis AF2122/97
ugcuccaggcgcgcc

SEQ ID NO: 1097732 - RNA, 17 nt, Mycobacterium bovis subsp bovis AF2122/97
ugcucccuauugcugcg

SEQ ID NO: 1097733 - RNA, 19 nt, Mycobacterium bovis subsp bovis AF2122/97
ugcucccuauugcugcggu

SEQ ID NO: 1097734 - RNA, 15 nt, Mycobacterium bovis subsp bovis AF2122/97
ugcuccgucgccgaa

SEQ ID NO: 1097735 - RNA, 23 nt, Mycobacterium bovis subsp bovis AF2122/97
ugcuccgucgccgaacagugcgg

SEQ ID NO: 1097736 - RNA, 13 nt, Mycobacterium bovis subsp bovis AF2122/97
ugcuccucgguca

SEQ ID NO: 1097737 - RNA, 14 nt, Mycobacterium bovis subsp bovis AF2122/97
ugcucaggucaccg

SEQ ID NO: 1097738 - RNA, 14 nt, Mycobacterium bovis subsp bovis AF2122/97
ugcucagccggccc

SEQ ID NO: 1097739 - RNA, 19 nt, Mycobacterium bovis subsp bovis AF2122/97
ugcucacgaucacccgcac

SEQ ID NO: 1097740 - RNA, 22 nt, Mycobacterium bovis subsp bovis AF2122/97
ugcucacgaucugcgcgucagg

SEQ ID NO: 1097741 - RNA, 16 nt, Mycobacterium bovis subsp bovis AF2122/97
ugcucacggcaggcgg

SEQ ID NO: 1097742 - RNA, 17 nt, Mycobacterium bovis subsp bovis AF2122/97
ugcucagcgcggccccg

SEQ ID NO: 1097743 - RNA, 14 nt, Mycobacterium bovis subsp bovis AF2122/97
ugcucagcacgccg

SEQ ID NO: 1097744 - RNA, 18 nt, Mycobacterium bovis subsp bovis AF2122/97
ugcuaccagagccgcgau

SEQ ID NO: 1097745 - RNA, 14 nt, Mycobacterium bovis subsp bovis AF2122/97
ugcuagcgccgcca

SEQ ID NO: 1097746 - RNA, 17 nt, Mycobacterium bovis subsp bovis AF2122/97
ugcuaggccaccggcga

SEQ ID NO: 1097747 - RNA, 18 nt, Mycobacterium bovis subsp bovis AF2122/97
gccuccagaaccgaagcc

SEQ ID NO: 1097748 - RNA, 13 nt, Mycobacterium bovis subsp bovis AF2122/97
gccucaucuccug

SEQ ID NO: 1097749 - RNA, 12 nt, Mycobacterium bovis subsp bovis AF2122/97
gccuccaccgcc

SEQ ID NO: 1097750 - RNA, 19 nt, Mycobacterium bovis subsp bovis AF2122/97
gccuccaccgccgcgcgga

SEQ ID NO: 1097751 - RNA, 16 nt, Mycobacterium bovis subsp bovis AF2122/97
gccuccaccaggucgu

SEQ ID NO: 1097752 - RNA, 15 nt, Mycobacterium bovis subsp bovis AF2122/97
gccucauccaccgau

SEQ ID NO: 1097753 - RNA, 16 nt, Mycobacterium bovis subsp bovis AF2122/97
gccucauccaccgaug

SEQ ID NO: 1097754 - RNA, 20 nt, Mycobacterium bovis subsp bovis AF2122/97
gccucauccaccgauggcgc

SEQ ID NO: 1097755 - RNA, 17 nt, Mycobacterium bovis subsp bovis AF2122/97
gccuccaagcccgccgg

SEQ ID NO: 1097756 - RNA, 23 nt, Mycobacterium bovis subsp bovis AF2122/97
gccucaugcuaggccaccggcga

SEQ ID NO: 1097757 - RNA, 20 nt, Mycobacterium bovis subsp bovis AF2122/97
gccucauuuauggacaccuu

SEQ ID NO: 1097758 - RNA, 18 nt, Mycobacterium bovis subsp bovis AF2122/97
gccuccaaaaucgcggcc

SEQ ID NO: 1097759 - RNA, 14 nt, Mycobacterium bovis subsp bovis AF2122/97
gccucagcccggcc

SEQ ID NO: 1097760 - RNA, 16 nt, Mycobacterium bovis subsp bovis AF2122/97
gccuaccagcaccggg

SEQ ID NO: 1097761 - RNA, 17 nt, Mycobacterium bovis subsp bovis AF2122/97
gccuaccaggcgcggcc

SEQ ID NO: 1097762 - RNA, 21 nt, Mycobacterium bovis subsp bovis AF2122/97
gccguuaccgccguugccgau

SEQ ID NO: 1097763 - RNA, 13 nt, Mycobacterium bovis subsp bovis AF2122/97
gccguucagcggc

SEQ ID NO: 1097764 - RNA, 19 nt, Mycobacterium bovis subsp bovis AF2122/97
gccguucacccuggugguc

SEQ ID NO: 1097765 - RNA, 16 nt, Mycobacterium bovis subsp bovis AF2122/97
gccguucccaccacca

SEQ ID NO: 1097766 - RNA, 14 nt, Mycobacterium bovis subsp bovis AF2122/97
gccguucccaccca

SEQ ID NO: 1097767 - RNA, 15 nt, Mycobacterium bovis subsp bovis AF2122/97
gccguucccggugac

SEQ ID NO: 1097768 - RNA, 19 nt, Mycobacterium bovis subsp bovis AF2122/97
gccguuccagcaucgagca

SEQ ID NO: 1097769 - RNA, 20 nt, Mycobacterium bovis subsp bovis AF2122/97
gccguuccagcaucgagcag

SEQ ID NO: 1097770 - RNA, 12 nt, Mycobacterium bovis subsp bovis AF2122/97
gccguucggcgc

SEQ ID NO: 1097771 - RNA, 17 nt, Mycobacterium bovis subsp bovis AF2122/97
gccguucgcgucgccga

SEQ ID NO: 1097772 - RNA, 15 nt, Mycobacterium bovis subsp bovis AF2122/97
gccguucggcgcccg

SEQ ID NO: 1097773 - RNA, 20 nt, Mycobacterium bovis subsp bovis AF2122/97
gccguucggcgcccgcucgg

SEQ ID NO: 1097774 - RNA, 14 nt, Mycobacterium bovis subsp bovis AF2122/97
gccguucgucgcgg

SEQ ID NO: 1097775 - RNA, 23 nt, Mycobacterium bovis subsp bovis AF2122/97
gccguucgugggcauugcggcgc

SEQ ID NO: 1097776 - RNA, 16 nt, Mycobacterium bovis subsp bovis AF2122/97
gccguucucgcccacc

SEQ ID NO: 1097777 - RNA, 15 nt, Mycobacterium bovis subsp bovis AF2122/97
gccguuuccgccgcc

SEQ ID NO: 1097778 - RNA, 15 nt, Mycobacterium bovis subsp bovis AF2122/97
gccguuucggcgccg

SEQ ID NO: 1097779 - RNA, 22 nt, Mycobacterium bovis subsp bovis AF2122/97
gccuaacucgccugcacccggc

SEQ ID NO: 1097780 - RNA, 17 nt, Mycobacterium bovis subsp bovis AF2122/97
gccuaaccccggcucga

SEQ ID NO: 1097781 - RNA, 15 nt, Mycobacterium bovis subsp bovis AF2122/97
gccgugccgccgaca

SEQ ID NO: 1097782 - RNA, 21 nt, Mycobacterium bovis subsp bovis AF2122/97
gccgugccgccgacaccaccg

SEQ ID NO: 1097783 - RNA, 23 nt, Mycobacterium bovis subsp bovis AF2122/97
gccgugccgccgacaccaccggc

SEQ ID NO: 1097784 - RNA, 16 nt, Mycobacterium bovis subsp bovis AF2122/97
gccgugccgcggcgac

SEQ ID NO: 1097785 - RNA, 20 nt, Mycobacterium bovis subsp bovis AF2122/97
gccgugcccaggccaccggc

SEQ ID NO: 1097786 - RNA, 22 nt, Mycobacterium bovis subsp bovis AF2122/97
gccgugcccaggccaccggcug

SEQ ID NO: 1097787 - RNA, 19 nt, Mycobacterium bovis subsp bovis AF2122/97
gccgugccccgggcccagg

SEQ ID NO: 1097788 - RNA, 17 nt, Mycobacterium bovis subsp bovis AF2122/97
gccguggaagacgucga

SEQ ID NO: 1097789 - RNA, 13 nt, Mycobacterium bovis subsp bovis AF2122/97
gccguggcacccg

SEQ ID NO: 1097790 - RNA, 18 nt, Mycobacterium bovis subsp bovis AF2122/97
gccguggauacgcacggc

SEQ ID NO: 1097791 - RNA, 20 nt, Mycobacterium bovis subsp bovis AF2122/97
gccguggaugucgcggucga

SEQ ID NO: 1097792 - RNA, 16 nt, Mycobacterium bovis subsp bovis AF2122/97
gccguggauacgcacg

SEQ ID NO: 1097793 - RNA, 16 nt, Mycobacterium bovis subsp bovis AF2122/97
gccguggaucaucccg

SEQ ID NO: 1097794 - RNA, 23 nt, Mycobacterium bovis subsp bovis AF2122/97
gccguggaucaucccgaccagca

SEQ ID NO: 1097795 - RNA, 20 nt, Mycobacterium bovis subsp bovis AF2122/97
gccgucggugauggagccgg

SEQ ID NO: 1097796 - RNA, 12 nt, Mycobacterium bovis subsp bovis AF2122/97
gccgucggugcc

SEQ ID NO: 1097797 - RNA, 15 nt, Mycobacterium bovis subsp bovis AF2122/97
gccgucggugccgcc

SEQ ID NO: 1097798 - RNA, 18 nt, Mycobacterium bovis subsp bovis AF2122/97
gccgucggugccgccgcc

SEQ ID NO: 1097799 - RNA, 20 nt, Mycobacterium bovis subsp bovis AF2122/97
gccgucggugccgccgccgg

SEQ ID NO: 1097800 - RNA, 14 nt, Mycobacterium bovis subsp bovis AF2122/97
gccgucggugccgg

SEQ ID NO: 1097801 - RNA, 23 nt, Mycobacterium bovis subsp bovis AF2122/97
gccgucggugguuuucccgucgc

SEQ ID NO: 1097802 - RNA, 20 nt, Mycobacterium bovis subsp bovis AF2122/97
gccgugcagcucggucagcg

SEQ ID NO: 1097803 - RNA, 19 nt, Mycobacterium bovis subsp bovis AF2122/97
gccgucggguaggccgccg

SEQ ID NO: 1097804 - RNA, 23 nt, Mycobacterium bovis subsp bovis AF2122/97
gccgucggggguaauugccagcc

SEQ ID NO: 1097805 - RNA, 23 nt, Mycobacterium bovis subsp bovis AF2122/97
gccgucgggugcagcacggcgcc

SEQ ID NO: 1097806 - RNA, 16 nt, Mycobacterium bovis subsp bovis AF2122/97
gccgucgggcagcagc

SEQ ID NO: 1097807 - RNA, 21 nt, Mycobacterium bovis subsp bovis AF2122/97
gccgucggguuccuccucggc

SEQ ID NO: 1097808 - RNA, 23 nt, Mycobacterium bovis subsp bovis AF2122/97
gccgucgguaaagggcucgaugg

SEQ ID NO: 1097809 - RNA, 14 nt, Mycobacterium bovis subsp bovis AF2122/97
gccgucggcgcgca

SEQ ID NO: 1097810 - RNA, 16 nt, Mycobacterium bovis subsp bovis AF2122/97
gccgucggcgcgcacc

SEQ ID NO: 1097811 - RNA, 19 nt, Mycobacterium bovis subsp bovis AF2122/97
gccgucggcgugcagcagc

SEQ ID NO: 1097812 - RNA, 12 nt, Mycobacterium bovis subsp bovis AF2122/97
gccguggucgag

SEQ ID NO: 1097813 - RNA, 18 nt, Mycobacterium bovis subsp bovis AF2122/97
gccguggucgagggcggc

SEQ ID NO: 1097814 - RNA, 21 nt, Mycobacterium bovis subsp bovis AF2122/97
gccgugggugucgguggccgc

SEQ ID NO: 1097815 - RNA, 23 nt, Mycobacterium bovis subsp bovis AF2122/97
gccguggcuggacccgcauggcg

SEQ ID NO: 1097816 - RNA, 14 nt, Mycobacterium bovis subsp bovis AF2122/97
gccguggcgucggc

SEQ ID NO: 1097817 - RNA, 17 nt, Mycobacterium bovis subsp bovis AF2122/97
gccguggcgucgguggc

SEQ ID NO: 1097818 - RNA, 18 nt, Mycobacterium bovis subsp bovis AF2122/97
gccguggcgucgguggca

SEQ ID NO: 1097819 - RNA, 20 nt, Mycobacterium bovis subsp bovis AF2122/97
gccguggcggcagcggugcu

SEQ ID NO: 1097820 - RNA, 21 nt, Mycobacterium bovis subsp bovis AF2122/97
gccguggcggcgggccucggc

SEQ ID NO: 1097821 - RNA, 16 nt, Mycobacterium bovis subsp bovis AF2122/97
gccguggcggcgggcc

SEQ ID NO: 1097822 - RNA, 13 nt, Mycobacterium bovis subsp bovis AF2122/97
gccguggcggcgg

SEQ ID NO: 1097823 - RNA, 13 nt, Mycobacterium bovis subsp bovis AF2122/97
gccguggccgcac

SEQ ID NO: 1097824 - RNA, 13 nt, Mycobacterium bovis subsp bovis AF2122/97
gccguggccgcca

SEQ ID NO: 1097825 - RNA, 22 nt, Mycobacterium bovis subsp bovis AF2122/97
gccguggcagucgcacggugcc

SEQ ID NO: 1097826 - RNA, 20 nt, Mycobacterium bovis subsp bovis AF2122/97
gccguggcauguugcggacc

SEQ ID NO: 1097827 - RNA, 19 nt, Mycobacterium bovis subsp bovis AF2122/97
gccgugugcuucgagcacc

SEQ ID NO: 1097828 - RNA, 20 nt, Mycobacterium bovis subsp bovis AF2122/97
gccgugugcuucgagcaccg

SEQ ID NO: 1097829 - RNA, 21 nt, Mycobacterium bovis subsp bovis AF2122/97
gccguguccagcaugcccgcc

SEQ ID NO: 1097830 - RNA, 19 nt, Mycobacterium bovis subsp bovis AF2122/97
gccgugugcaucggcgacc

SEQ ID NO: 1097831 - RNA, 17 nt, Mycobacterium bovis subsp bovis AF2122/97
gccguggugcgcauggc

SEQ ID NO: 1097832 - RNA, 20 nt, Mycobacterium bovis subsp bovis AF2122/97
gccgugguugcacguucggc

SEQ ID NO: 1097833 - RNA, 18 nt, Mycobacterium bovis subsp bovis AF2122/97
gccgugucaccgggugca

SEQ ID NO: 1097834 - RNA, 22 nt, Mycobacterium bovis subsp bovis AF2122/97
gccguguucgaccgcagggacc

SEQ ID NO: 1097835 - RNA, 17 nt, Mycobacterium bovis subsp bovis AF2122/97
gccguguucgauagcgg

SEQ ID NO: 1097836 - RNA, 22 nt, Mycobacterium bovis subsp bovis AF2122/97
gccguguucgggggcggucgcg

SEQ ID NO: 1097837 - RNA, 15 nt, Mycobacterium bovis subsp bovis AF2122/97
gccguuaccgacgcc

SEQ ID NO: 1097838 - RNA, 13 nt, Mycobacterium bovis subsp bovis AF2122/97
gccguuaccgcca

SEQ ID NO: 1097839 - RNA, 22 nt, Mycobacterium bovis subsp bovis AF2122/97
gccguuaccgccaaacgcugcg

SEQ ID NO: 1097840 - RNA, 14 nt, Mycobacterium bovis subsp bovis AF2122/97
gccguuaccgccgc

SEQ ID NO: 1097841 - RNA, 18 nt, Mycobacterium bovis subsp bovis AF2122/97
gccguuaccgccgcugcc

SEQ ID NO: 1097842 - RNA, 19 nt, Mycobacterium bovis subsp bovis AF2122/97
gccguuaccgccgcugccg

SEQ ID NO: 1097843 - RNA, 15 nt, Mycobacterium bovis subsp bovis AF2122/97
gccguuaccgccggc

SEQ ID NO: 1097844 - RNA, 14 nt, Mycobacterium bovis subsp bovis AF2122/97
gccguuaccgccgu

SEQ ID NO: 1097845 - RNA, 16 nt, Mycobacterium bovis subsp bovis AF2122/97
gccguuaccgccguug

SEQ ID NO: 1097846 - RNA, 17 nt, Mycobacterium bovis subsp bovis AF2122/97
gccgucgacgcggccgg

SEQ ID NO: 1097847 - RNA, 14 nt, Mycobacterium bovis subsp bovis AF2122/97
gccgucgacgcggc

SEQ ID NO: 1097848 - RNA, 16 nt, Mycobacterium bovis subsp bovis AF2122/97
gccgucgacgaucagc

SEQ ID NO: 1097849 - RNA, 17 nt, Mycobacterium bovis subsp bovis AF2122/97
gccgucgaccggcggga

SEQ ID NO: 1097850 - RNA, 14 nt, Mycobacterium bovis subsp bovis AF2122/97
gccgucgagcacgg

SEQ ID NO: 1097851 - RNA, 15 nt, Mycobacterium bovis subsp bovis AF2122/97
gccgucgagcagccg

SEQ ID NO: 1097852 - RNA, 16 nt, Mycobacterium bovis subsp bovis AF2122/97
gccgucgagcagccga

SEQ ID NO: 1097853 - RNA, 18 nt, Mycobacterium bovis subsp bovis AF2122/97
gccgucgagcagccgagc

SEQ ID NO: 1097854 - RNA, 19 nt, Mycobacterium bovis subsp bovis AF2122/97
gccgucgagcagccgagcu

SEQ ID NO: 1097855 - RNA, 21 nt, Mycobacterium bovis subsp bovis AF2122/97
gccgucgagcagccgagcuca

SEQ ID NO: 1097856 - RNA, 18 nt, Mycobacterium bovis subsp bovis AF2122/97
gccgucgagcauccaccc

SEQ ID NO: 1097857 - RNA, 22 nt, Mycobacterium bovis subsp bovis AF2122/97
gccgucgacguugaugaccugu

SEQ ID NO: 1097858 - RNA, 22 nt, Mycobacterium bovis subsp bovis AF2122/97
gccgucgagcaacgugacccgg

SEQ ID NO: 1097859 - RNA, 12 nt, Mycobacterium bovis subsp bovis AF2122/97
gccgucgccgau

SEQ ID NO: 1097860 - RNA, 14 nt, Mycobacterium bovis subsp bovis AF2122/97
gccgucgagcaacg

SEQ ID NO: 1097861 - RNA, 17 nt, Mycobacterium bovis subsp bovis AF2122/97
gccgucgccggagucga

SEQ ID NO: 1097862 - RNA, 14 nt, Mycobacterium bovis subsp bovis AF2122/97
gccgucgccgcccu

SEQ ID NO: 1097863 - RNA, 23 nt, Mycobacterium bovis subsp bovis AF2122/97
gccgucgccgcccuggccgccgg

SEQ ID NO: 1097864 - RNA, 14 nt, Mycobacterium bovis subsp bovis AF2122/97
gccgucgccgccgc

SEQ ID NO: 1097865 - RNA, 15 nt, Mycobacterium bovis subsp bovis AF2122/97
gccgucgccgccggc

SEQ ID NO: 1097866 - RNA, 18 nt, Mycobacterium bovis subsp bovis AF2122/97
gccgucgccgccggcgcc

SEQ ID NO: 1097867 - RNA, 16 nt, Mycobacterium bovis subsp bovis AF2122/97
gccgucgccgccggcu

SEQ ID NO: 1097868 - RNA, 21 nt, Mycobacterium bovis subsp bovis AF2122/97
gccgucgccgaucagcugcgc

SEQ ID NO: 1097869 - RNA, 20 nt, Mycobacterium bovis subsp bovis AF2122/97
gccgucgcgaaacaccagac

SEQ ID NO: 1097870 - RNA, 16 nt, Mycobacterium bovis subsp bovis AF2122/97
gccgucgcgaccgaug

SEQ ID NO: 1097871 - RNA, 16 nt, Mycobacterium bovis subsp bovis AF2122/97
gccgucgcgacgucgg

SEQ ID NO: 1097872 - RNA, 16 nt, Mycobacterium bovis subsp bovis AF2122/97
gccgucggccgagucg

SEQ ID NO: 1097873 - RNA, 17 nt, Mycobacterium bovis subsp bovis AF2122/97
gccgucgcgacgucggc

SEQ ID NO: 1097874 - RNA, 22 nt, Mycobacterium bovis subsp bovis AF2122/97
gccgucggccggaugagcgaac

SEQ ID NO: 1097875 - RNA, 15 nt, Mycobacterium bovis subsp bovis AF2122/97
gccgucggccucggc

SEQ ID NO: 1097876 - RNA, 19 nt, Mycobacterium bovis subsp bovis AF2122/97
gccgucggccucggcgguc

SEQ ID NO: 1097877 - RNA, 13 nt, Mycobacterium bovis subsp bovis AF2122/97
gccgucggcgaug

SEQ ID NO: 1097878 - RNA, 12 nt, Mycobacterium bovis subsp bovis AF2122/97
gccgucggcgac

SEQ ID NO: 1097879 - RNA, 14 nt, Mycobacterium bovis subsp bovis AF2122/97
gccgucggcgagca

SEQ ID NO: 1097880 - RNA, 21 nt, Mycobacterium bovis subsp bovis AF2122/97
gccgucggcgagcagacgccg

SEQ ID NO: 1097881 - RNA, 18 nt, Mycobacterium bovis subsp bovis AF2122/97
gccgucggcgccggcauc

SEQ ID NO: 1097882 - RNA, 19 nt, Mycobacterium bovis subsp bovis AF2122/97
gccgucggcgccggcaucg

SEQ ID NO: 1097883 - RNA, 16 nt, Mycobacterium bovis subsp bovis AF2122/97
gccgucggcgggcaug

SEQ ID NO: 1097884 - RNA, 15 nt, Mycobacterium bovis subsp bovis AF2122/97
gccguccccgccgac

SEQ ID NO: 1097885 - RNA, 16 nt, Mycobacterium bovis subsp bovis AF2122/97
gccguccccgccgacg

SEQ ID NO: 1097886 - RNA, 17 nt, Mycobacterium bovis subsp bovis AF2122/97
gccguccccgccgacgc

SEQ ID NO: 1097887 - RNA, 20 nt, Mycobacterium bovis subsp bovis AF2122/97
gccguccccgccgacgccga

SEQ ID NO: 1097888 - RNA, 21 nt, Mycobacterium bovis subsp bovis AF2122/97
gccguccccgccgucgccacc

SEQ ID NO: 1097889 - RNA, 14 nt, Mycobacterium bovis subsp bovis AF2122/97
gccgucccaccagc

SEQ ID NO: 1097890 - RNA, 15 nt, Mycobacterium bovis subsp bovis AF2122/97
gccgucccaccagcc

SEQ ID NO: 1097891 - RNA, 14 nt, Mycobacterium bovis subsp bovis AF2122/97
gccguccagucggu

SEQ ID NO: 1097892 - RNA, 21 nt, Mycobacterium bovis subsp bovis AF2122/97
gccguccaagccagcguuggc

SEQ ID NO: 1097893 - RNA, 15 nt, Mycobacterium bovis subsp bovis AF2122/97
gccguccaagccagc

SEQ ID NO: 1097894 - RNA, 16 nt, Mycobacterium bovis subsp bovis AF2122/97
gccguccaagccagcg

SEQ ID NO: 1097895 - RNA, 16 nt, Mycobacterium bovis subsp bovis AF2122/97
gccgucauggcccgau

SEQ ID NO: 1097896 - RNA, 17 nt, Mycobacterium bovis subsp bovis AF2122/97
gccgucagcucaccacc

SEQ ID NO: 1097897 - RNA, 20 nt, Mycobacterium bovis subsp bovis AF2122/97
gccgucaucuccgacucgau

SEQ ID NO: 1097898 - RNA, 20 nt, Mycobacterium bovis subsp bovis AF2122/97
gccgucccgauacggccggc

SEQ ID NO: 1097899 - RNA, 16 nt, Mycobacterium bovis subsp bovis AF2122/97
gccgucccgcgagcag

SEQ ID NO: 1097900 - RNA, 18 nt, Mycobacterium bovis subsp bovis AF2122/97
gccgucccgcgagcagcc

SEQ ID NO: 1097901 - RNA, 20 nt, Mycobacterium bovis subsp bovis AF2122/97
gccgucccgcgagcagcccg

SEQ ID NO: 1097902 - RNA, 23 nt, Mycobacterium bovis subsp bovis AF2122/97
gccgucccgaaacgccggguucg

SEQ ID NO: 1097903 - RNA, 14 nt, Mycobacterium bovis subsp bovis AF2122/97
gccguccgaccagg

SEQ ID NO: 1097904 - RNA, 20 nt, Mycobacterium bovis subsp bovis AF2122/97
gccgucccggcucgagcucg

SEQ ID NO: 1097905 - RNA, 20 nt, Mycobacterium bovis subsp bovis AF2122/97
gccgucccgguugacgccgg

SEQ ID NO: 1097906 - RNA, 20 nt, Mycobacterium bovis subsp bovis AF2122/97
gccguagcugacggccugca

SEQ ID NO: 1097907 - RNA, 13 nt, Mycobacterium bovis subsp bovis AF2122/97
gccguaggcggcg

SEQ ID NO: 1097908 - RNA, 14 nt, Mycobacterium bovis subsp bovis AF2122/97
gccguaggcggcga

SEQ ID NO: 1097909 - RNA, 17 nt, Mycobacterium bovis subsp bovis AF2122/97
gccguaguaaggagccg

SEQ ID NO: 1097910 - RNA, 21 nt, Mycobacterium bovis subsp bovis AF2122/97
gccguaguaaggagccgggcc

SEQ ID NO: 1097911 - RNA, 19 nt, Mycobacterium bovis subsp bovis AF2122/97
gccguaguaguggccgcca

SEQ ID NO: 1097912 - RNA, 22 nt, Mycobacterium bovis subsp bovis AF2122/97
gccguaguaguggccgccaccc

SEQ ID NO: 1097913 - RNA, 23 nt, Mycobacterium bovis subsp bovis AF2122/97
gccguaguaguggccgccacccg

SEQ ID NO: 1097914 - RNA, 22 nt, Mycobacterium bovis subsp bovis AF2122/97
gccguaguugguccaggugacc

SEQ ID NO: 1097915 - RNA, 15 nt, Mycobacterium bovis subsp bovis AF2122/97
gccguagugcgcauc

SEQ ID NO: 1097916 - RNA, 19 nt, Mycobacterium bovis subsp bovis AF2122/97
gccguagugcgcaucgccg

SEQ ID NO: 1097917 - RNA, 15 nt, Mycobacterium bovis subsp bovis AF2122/97
gccgucagcgucggc

SEQ ID NO: 1097918 - RNA, 14 nt, Mycobacterium bovis subsp bovis AF2122/97
gccgucagcucacc

SEQ ID NO: 1097919 - RNA, 19 nt, Mycobacterium bovis subsp bovis AF2122/97
gccgucagcugaccgaaga

SEQ ID NO: 1097920 - RNA, 23 nt, Mycobacterium bovis subsp bovis AF2122/97
gccgguucagggguggcgcgggc

SEQ ID NO: 1097921 - RNA, 19 nt, Mycobacterium bovis subsp bovis AF2122/97
gccgguugcggcugcguug

SEQ ID NO: 1097922 - RNA, 21 nt, Mycobacterium bovis subsp bovis AF2122/97
gccgguugcggcugcguuggc

SEQ ID NO: 1097923 - RNA, 16 nt, Mycobacterium bovis subsp bovis AF2122/97
gccgguuggcugccgg

SEQ ID NO: 1097924 - RNA, 15 nt, Mycobacterium bovis subsp bovis AF2122/97
gccgguugucgcagc

SEQ ID NO: 1097925 - RNA, 16 nt, Mycobacterium bovis subsp bovis AF2122/97
gccgguuugcacgcac

SEQ ID NO: 1097926 - RNA, 18 nt, Mycobacterium bovis subsp bovis AF2122/97
gccgguuugcacgcacca

SEQ ID NO: 1097927 - RNA, 16 nt, Mycobacterium bovis subsp bovis AF2122/97
gccguaacgcggaucg

SEQ ID NO: 1097928 - RNA, 14 nt, Mycobacterium bovis subsp bovis AF2122/97
gccguaacagccgg

SEQ ID NO: 1097929 - RNA, 15 nt, Mycobacterium bovis subsp bovis AF2122/97
gccguaacagccggc

SEQ ID NO: 1097930 - RNA, 22 nt, Mycobacterium bovis subsp bovis AF2122/97
gccgguucggcgaucuccggcg

SEQ ID NO: 1097931 - RNA, 20 nt, Mycobacterium bovis subsp bovis AF2122/97
gccgguuggccagccacagc

SEQ ID NO: 1097932 - RNA, 22 nt, Mycobacterium bovis subsp bovis AF2122/97
gccgggauaucgucgacgccca

SEQ ID NO: 1097933 - RNA, 22 nt, Mycobacterium bovis subsp bovis AF2122/97
gccgggaucucgaaggccgcca

SEQ ID NO: 1097934 - RNA, 18 nt, Mycobacterium bovis subsp bovis AF2122/97
gccgggaugaagccaccc

SEQ ID NO: 1097935 - RNA, 14 nt, Mycobacterium bovis subsp bovis AF2122/97
gccgggaugccgcc

SEQ ID NO: 1097936 - RNA, 14 nt, Mycobacterium bovis subsp bovis AF2122/97
gccgggaucgccgu

SEQ ID NO: 1097937 - RNA, 18 nt, Mycobacterium bovis subsp bovis AF2122/97
gccgggaucgccguccag

SEQ ID NO: 1097938 - RNA, 16 nt, Mycobacterium bovis subsp bovis AF2122/97
gccgggaugccgccgc

SEQ ID NO: 1097939 - RNA, 14 nt, Mycobacterium bovis subsp bovis AF2122/97
gccgguuccgccgg

SEQ ID NO: 1097940 - RNA, 16 nt, Mycobacterium bovis subsp bovis AF2122/97
gccgguuccgccggcc

SEQ ID NO: 1097941 - RNA, 20 nt, Mycobacterium bovis subsp bovis AF2122/97
gccgguuccgccggccccac

SEQ ID NO: 1097942 - RNA, 19 nt, Mycobacterium bovis subsp bovis AF2122/97
gccgguucgcccagcaggc

SEQ ID NO: 1097943 - RNA, 16 nt, Mycobacterium bovis subsp bovis AF2122/97
gccgguucgcccgagg

SEQ ID NO: 1097944 - RNA, 21 nt, Mycobacterium bovis subsp bovis AF2122/97
gccgguucgcccgaggcgaga

SEQ ID NO: 1097945 - RNA, 16 nt, Mycobacterium bovis subsp bovis AF2122/97
gccgggagucgucggc

SEQ ID NO: 1097946 - RNA, 21 nt, Mycobacterium bovis subsp bovis AF2122/97
gccgggagacgcugcgcgcca

SEQ ID NO: 1097947 - RNA, 16 nt, Mycobacterium bovis subsp bovis AF2122/97
gccgggauaucgucga

SEQ ID NO: 1097948 - RNA, 13 nt, Mycobacterium bovis subsp bovis AF2122/97
gccgggaccggug

SEQ ID NO: 1097949 - RNA, 15 nt, Mycobacterium bovis subsp bovis AF2122/97
gccguaccggugauc

SEQ ID NO: 1097950 - RNA, 13 nt, Mycobacterium bovis subsp bovis AF2122/97
gccguacgcccag

SEQ ID NO: 1097951 - RNA, 12 nt, Mycobacterium bovis subsp bovis AF2122/97
gccguacgccgu

SEQ ID NO: 1097952 - RNA, 15 nt, Mycobacterium bovis subsp bovis AF2122/97
gccguacaucagcgc

SEQ ID NO: 1097953 - RNA, 18 nt, Mycobacterium bovis subsp bovis AF2122/97
gccguacaucagcgcgaa

SEQ ID NO: 1097954 - RNA, 15 nt, Mycobacterium bovis subsp bovis AF2122/97
gccguacagcccggc

SEQ ID NO: 1097955 - RNA, 16 nt, Mycobacterium bovis subsp bovis AF2122/97
gccguacagcccggcc

SEQ ID NO: 1097956 - RNA, 14 nt, Mycobacterium bovis subsp bovis AF2122/97
gccguacagcggcg

SEQ ID NO: 1097957 - RNA, 15 nt, Mycobacterium bovis subsp bovis AF2122/97
gccguacagcggcgg

SEQ ID NO: 1097958 - RNA, 17 nt, Mycobacterium bovis subsp bovis AF2122/97
gccguacagcggcggcg

SEQ ID NO: 1097959 - RNA, 18 nt, Mycobacterium bovis subsp bovis AF2122/97
gccguacagcggcggcgu

SEQ ID NO: 1097960 - RNA, 19 nt, Mycobacterium bovis subsp bovis AF2122/97
gccguacagcggcggcguc

SEQ ID NO: 1097961 - RNA, 15 nt, Mycobacterium bovis subsp bovis AF2122/97
gccguaacggcgaaa

SEQ ID NO: 1097962 - RNA, 15 nt, Mycobacterium bovis subsp bovis AF2122/97
gccguaagcaccagc

SEQ ID NO: 1097963 - RNA, 19 nt, Mycobacterium bovis subsp bovis AF2122/97
gccguaacggucgcugucg

SEQ ID NO: 1097964 - RNA, 20 nt, Mycobacterium bovis subsp bovis AF2122/97
gccguaacggucgcugucgg

SEQ ID NO: 1097965 - RNA, 15 nt, Mycobacterium bovis subsp bovis AF2122/97
gccguagaucccgaa

SEQ ID NO: 1097966 - RNA, 20 nt, Mycobacterium bovis subsp bovis AF2122/97
gccguagcccacgacgaagu

SEQ ID NO: 1097967 - RNA, 22 nt, Mycobacterium bovis subsp bovis AF2122/97
gccguagccgaucaacagggcc

SEQ ID NO: 1097968 - RNA, 22 nt, Mycobacterium bovis subsp bovis AF2122/97
gccguagccgccguggauacgc

SEQ ID NO: 1097969 - RNA, 14 nt, Mycobacterium bovis subsp bovis AF2122/97
gccguagcggucga

SEQ ID NO: 1097970 - RNA, 18 nt, Mycobacterium bovis subsp bovis AF2122/97
gccguagcggucgaugau

SEQ ID NO: 1097971 - RNA, 22 nt, Mycobacterium bovis subsp bovis AF2122/97
gccguagagcuggugcgggacg

SEQ ID NO: 1097972 - RNA, 15 nt, Mycobacterium bovis subsp bovis AF2122/97
gccguagaccaggcc

SEQ ID NO: 1097973 - RNA, 13 nt, Mycobacterium bovis subsp bovis AF2122/97
gccguagaccagc

SEQ ID NO: 1097974 - RNA, 18 nt, Mycobacterium bovis subsp bovis AF2122/97
gccguagaccaggcccag

SEQ ID NO: 1097975 - RNA, 14 nt, Mycobacterium bovis subsp bovis AF2122/97
gccguagaucccga

SEQ ID NO: 1097976 - RNA, 14 nt, Mycobacterium bovis subsp bovis AF2122/97
gccguacucgauga

SEQ ID NO: 1097977 - RNA, 17 nt, Mycobacterium bovis subsp bovis AF2122/97
gccguagaccacuucga

SEQ ID NO: 1097978 - RNA, 14 nt, Mycobacterium bovis subsp bovis AF2122/97
gccguacggcgcgu

SEQ ID NO: 1097979 - RNA, 22 nt, Mycobacterium bovis subsp bovis AF2122/97
gccguacgguccgaacacggug

SEQ ID NO: 1097980 - RNA, 19 nt, Mycobacterium bovis subsp bovis AF2122/97
gccucggcgauaccgagga

SEQ ID NO: 1097981 - RNA, 15 nt, Mycobacterium bovis subsp bovis AF2122/97
gccucggcgccgccc

SEQ ID NO: 1097982 - RNA, 14 nt, Mycobacterium bovis subsp bovis AF2122/97
gccucggcggccag

SEQ ID NO: 1097983 - RNA, 14 nt, Mycobacterium bovis subsp bovis AF2122/97
gccucggcggccuc

SEQ ID NO: 1097984 - RNA, 18 nt, Mycobacterium bovis subsp bovis AF2122/97
gccucggcggccucgcug

SEQ ID NO: 1097985 - RNA, 16 nt, Mycobacterium bovis subsp bovis AF2122/97
gccucggcggcgccga

SEQ ID NO: 1097986 - RNA, 17 nt, Mycobacterium bovis subsp bovis AF2122/97
gccucggcggcgccgaa

SEQ ID NO: 1097987 - RNA, 18 nt, Mycobacterium bovis subsp bovis AF2122/97
gccucggccaucugcucg

SEQ ID NO: 1097988 - RNA, 16 nt, Mycobacterium bovis subsp bovis AF2122/97
gccucggcaugcagcc

SEQ ID NO: 1097989 - RNA, 13 nt, Mycobacterium bovis subsp bovis AF2122/97
gccucggcaucgc

SEQ ID NO: 1097990 - RNA, 16 nt, Mycobacterium bovis subsp bovis AF2122/97
gccucggcaucgccgc

SEQ ID NO: 1097991 - RNA, 15 nt, Mycobacterium bovis subsp bovis AF2122/97
gccucggcaugcagc

SEQ ID NO: 1097992 - RNA, 12 nt, Mycobacterium bovis subsp bovis AF2122/97
gccuccccgacc

SEQ ID NO: 1097993 - RNA, 12 nt, Mycobacterium bovis subsp bovis AF2122/97
gccucccgcgcc

SEQ ID NO: 1097994 - RNA, 14 nt, Mycobacterium bovis subsp bovis AF2122/97
gccucccgcgccgg

SEQ ID NO: 1097995 - RNA, 17 nt, Mycobacterium bovis subsp bovis AF2122/97
gccuccagauucgccgc

SEQ ID NO: 1097996 - RNA, 19 nt, Mycobacterium bovis subsp bovis AF2122/97
gccuccagcacccggucga

SEQ ID NO: 1097997 - RNA, 14 nt, Mycobacterium bovis subsp bovis AF2122/97
gccuccaggcgcca

SEQ ID NO: 1097998 - RNA, 15 nt, Mycobacterium bovis subsp bovis AF2122/97
gccuccaggcgccac

SEQ ID NO: 1097999 - RNA, 22 nt, Mycobacterium bovis subsp bovis AF2122/97
gccuccauaucgcagcguuggc

SEQ ID NO: 1098000 - RNA, 15 nt, Mycobacterium bovis subsp bovis AF2122/97
gccucgggccggcgu

SEQ ID NO: 1098001 - RNA, 14 nt, Mycobacterium bovis subsp bovis AF2122/97
gccucggcggucgc

SEQ ID NO: 1098002 - RNA, 22 nt, Mycobacterium bovis subsp bovis AF2122/97
gccucgggaggcagcgcgaggc

SEQ ID NO: 1098003 - RNA, 15 nt, Mycobacterium bovis subsp bovis AF2122/97
gccucggugagcagc

SEQ ID NO: 1098004 - RNA, 14 nt, Mycobacterium bovis subsp bovis AF2122/97
gccucguacggacc

SEQ ID NO: 1098005 - RNA, 20 nt, Mycobacterium bovis subsp bovis AF2122/97
gccucguacggaccgucgcc

SEQ ID NO: 1098006 - RNA, 19 nt, Mycobacterium bovis subsp bovis AF2122/97
gccucgguuagcugcucug

SEQ ID NO: 1098007 - RNA, 15 nt, Mycobacterium bovis subsp bovis AF2122/97
gccucgucccacaac

SEQ ID NO: 1098008 - RNA, 16 nt, Mycobacterium bovis subsp bovis AF2122/97
gccucgucgccgcggu

SEQ ID NO: 1098009 - RNA, 15 nt, Mycobacterium bovis subsp bovis AF2122/97
gccucgugcgugggc

SEQ ID NO: 1098010 - RNA, 21 nt, Mycobacterium bovis subsp bovis AF2122/97
gccucucuccgcgcucgucua

SEQ ID NO: 1098011 - RNA, 15 nt, Mycobacterium bovis subsp bovis AF2122/97
gccucugcaucgaac

SEQ ID NO: 1098012 - RNA, 17 nt, Mycobacterium bovis subsp bovis AF2122/97
gccugaaacggcugcag

SEQ ID NO: 1098013 - RNA, 24 nt, Mycobacterium bovis subsp bovis AF2122/97
gccugaugcugccagaucggucgg

SEQ ID NO: 1098014 - RNA, 22 nt, Mycobacterium bovis subsp bovis AF2122/97
gccugauuccacugggccugcc

SEQ ID NO: 1098015 - RNA, 21 nt, Mycobacterium bovis subsp bovis AF2122/97
gccugcaagacaaagccgucg

SEQ ID NO: 1098016 - RNA, 15 nt, Mycobacterium bovis subsp bovis AF2122/97
gccugcaacgccgcg

SEQ ID NO: 1098017 - RNA, 15 nt, Mycobacterium bovis subsp bovis AF2122/97
gccugcaccacggcg

SEQ ID NO: 1098018 - RNA, 18 nt, Mycobacterium bovis subsp bovis AF2122/97
gccugcaccacggcggcc

SEQ ID NO: 1098019 - RNA, 19 nt, Mycobacterium bovis subsp bovis AF2122/97
gccugcagcgaaacaccgg

SEQ ID NO: 1098020 - RNA, 21 nt, Mycobacterium bovis subsp bovis AF2122/97
gccugcagcgaaacaccggcc

SEQ ID NO: 1098021 - RNA, 16 nt, Mycobacterium bovis subsp bovis AF2122/97
gccugcaggccgccgg

SEQ ID NO: 1098022 - RNA, 17 nt, Mycobacterium bovis subsp bovis AF2122/97
gccugcaggccgccggc

SEQ ID NO: 1098023 - RNA, 12 nt, Mycobacterium bovis subsp bovis AF2122/97
gccugcagccga

SEQ ID NO: 1098024 - RNA, 15 nt, Mycobacterium bovis subsp bovis AF2122/97
gccugcagcgcgacc

SEQ ID NO: 1098025 - RNA, 15 nt, Mycobacterium bovis subsp bovis AF2122/97
gccugcaguucggcg

SEQ ID NO: 1098026 - RNA, 16 nt, Mycobacterium bovis subsp bovis AF2122/97
gccugcaguucggcgu

SEQ ID NO: 1098027 - RNA, 16 nt, Mycobacterium bovis subsp bovis AF2122/97
gccugcacgcccggcg

SEQ ID NO: 1098028 - RNA, 15 nt, Mycobacterium bovis subsp bovis AF2122/97
gccugcacgccggcg

SEQ ID NO: 1098029 - RNA, 18 nt, Mycobacterium bovis subsp bovis AF2122/97
gccugcacgccggcgcug

SEQ ID NO: 1098030 - RNA, 15 nt, Mycobacterium bovis subsp bovis AF2122/97
gccugcacggcgcug

SEQ ID NO: 1098031 - RNA, 17 nt, Mycobacterium bovis subsp bovis AF2122/97
gccugcacggcgcugac

SEQ ID NO: 1098032 - RNA, 18 nt, Mycobacterium bovis subsp bovis AF2122/97
gccugcacggcgcugacg

SEQ ID NO: 1098033 - RNA, 21 nt, Mycobacterium bovis subsp bovis AF2122/97
gccugaccggcucgccggcgc

SEQ ID NO: 1098034 - RNA, 15 nt, Mycobacterium bovis subsp bovis AF2122/97
gccugaccggucacc

SEQ ID NO: 1098035 - RNA, 19 nt, Mycobacterium bovis subsp bovis AF2122/97
gccugacgcgucagcggcg

SEQ ID NO: 1098036 - RNA, 20 nt, Mycobacterium bovis subsp bovis AF2122/97
gccugacgcgucagcggcga

SEQ ID NO: 1098037 - RNA, 22 nt, Mycobacterium bovis subsp bovis AF2122/97
gccugacgcgucagcggcgagc

SEQ ID NO: 1098038 - RNA, 19 nt, Mycobacterium bovis subsp bovis AF2122/97
gccugaagcuuguccagau

SEQ ID NO: 1098039 - RNA, 13 nt, Mycobacterium bovis subsp bovis AF2122/97
gccugaaugcgac

SEQ ID NO: 1098040 - RNA, 14 nt, Mycobacterium bovis subsp bovis AF2122/97
gccugacacgaugc

SEQ ID NO: 1098041 - RNA, 15 nt, Mycobacterium bovis subsp bovis AF2122/97
gccugacacgaugcc

SEQ ID NO: 1098042 - RNA, 14 nt, Mycobacterium bovis subsp bovis AF2122/97
gccugagcgccgcg

SEQ ID NO: 1098043 - RNA, 19 nt, Mycobacterium bovis subsp bovis AF2122/97
gccugagcgccgcggcgga

SEQ ID NO: 1098044 - RNA, 14 nt, Mycobacterium bovis subsp bovis AF2122/97
gccugagcggccau

SEQ ID NO: 1098045 - RNA, 16 nt, Mycobacterium bovis subsp bovis AF2122/97
gccugagcggccaucg

SEQ ID NO: 1098046 - RNA, 23 nt, Mycobacterium bovis subsp bovis AF2122/97
gccugagcggggauguccgcggc

SEQ ID NO: 1098047 - RNA, 21 nt, Mycobacterium bovis subsp bovis AF2122/97
gccugagccaccaacaccgcg

SEQ ID NO: 1098048 - RNA, 18 nt, Mycobacterium bovis subsp bovis AF2122/97
gccugauaugacuugcgc

SEQ ID NO: 1098049 - RNA, 18 nt, Mycobacterium bovis subsp bovis AF2122/97
gccugauaaagcccggcg

SEQ ID NO: 1098050 - RNA, 15 nt, Mycobacterium bovis subsp bovis AF2122/97
gccugaugcagggcc

SEQ ID NO: 1098051 - RNA, 21 nt, Mycobacterium bovis subsp bovis AF2122/97
gccugaucuuuguuggccucg

SEQ ID NO: 1098052 - RNA, 20 nt, Mycobacterium bovis subsp bovis AF2122/97
gccugaugagggacgaacac

SEQ ID NO: 1098053 - RNA, 16 nt, Mycobacterium bovis subsp bovis AF2122/97
gccugggacggcggca

SEQ ID NO: 1098054 - RNA, 15 nt, Mycobacterium bovis subsp bovis AF2122/97
gccugggcggccagc

SEQ ID NO: 1098055 - RNA, 16 nt, Mycobacterium bovis subsp bovis AF2122/97
gccugggcggccagca

SEQ ID NO: 1098056 - RNA, 21 nt, Mycobacterium bovis subsp bovis AF2122/97
gccuggggguucuggccguag

SEQ ID NO: 1098057 - RNA, 14 nt, Mycobacterium bovis subsp bovis AF2122/97
gccuggauggguug

SEQ ID NO: 1098058 - RNA, 19 nt, Mycobacterium bovis subsp bovis AF2122/97
gccugggcacggccgucga

SEQ ID NO: 1098059 - RNA, 16 nt, Mycobacterium bovis subsp bovis AF2122/97
gccugggaaacugggu

SEQ ID NO: 1098060 - RNA, 22 nt, Mycobacterium bovis subsp bovis AF2122/97
gccuggcuguccgcgggccgcg

SEQ ID NO: 1098061 - RNA, 13 nt, Mycobacterium bovis subsp bovis AF2122/97
gccugggacggcg

SEQ ID NO: 1098062 - RNA, 16 nt, Mycobacterium bovis subsp bovis AF2122/97
gccuggacgccgccgg

SEQ ID NO: 1098063 - RNA, 17 nt, Mycobacterium bovis subsp bovis AF2122/97
gccuggacgccgccgga

SEQ ID NO: 1098064 - RNA, 23 nt, Mycobacterium bovis subsp bovis AF2122/97
gccuggaaggaaccgaucggucg

SEQ ID NO: 1098065 - RNA, 21 nt, Mycobacterium bovis subsp bovis AF2122/97
gccuggaagaucacgcgucgu

SEQ ID NO: 1098066 - RNA, 17 nt, Mycobacterium bovis subsp bovis AF2122/97
gccuggaaaacccaggu

SEQ ID NO: 1098067 - RNA, 16 nt, Mycobacterium bovis subsp bovis AF2122/97
gccugcuugucaaccc

SEQ ID NO: 1098068 - RNA, 15 nt, Mycobacterium bovis subsp bovis AF2122/97
gccuggagcagccac

SEQ ID NO: 1098069 - RNA, 22 nt, Mycobacterium bovis subsp bovis AF2122/97
gccuggaucagcgcguugagcu

SEQ ID NO: 1098070 - RNA, 18 nt, Mycobacterium bovis subsp bovis AF2122/97
gccuggaugccgaucggg

SEQ ID NO: 1098071 - RNA, 15 nt, Mycobacterium bovis subsp bovis AF2122/97
gccugccaccggcgc

SEQ ID NO: 1098072 - RNA, 17 nt, Mycobacterium bovis subsp bovis AF2122/97
gccugcaguucggcgua

SEQ ID NO: 1098073 - RNA, 20 nt, Mycobacterium bovis subsp bovis AF2122/97
gccugcccccgcgcgcacgg

SEQ ID NO: 1098074 - RNA, 14 nt, Mycobacterium bovis subsp bovis AF2122/97
gccugcccccggcg

SEQ ID NO: 1098075 - RNA, 19 nt, Mycobacterium bovis subsp bovis AF2122/97
gccugcccccggcgcggcg

SEQ ID NO: 1098076 - RNA, 23 nt, Mycobacterium bovis subsp bovis AF2122/97
gccugcccgaaccaccaccggca

SEQ ID NO: 1098077 - RNA, 13 nt, Mycobacterium bovis subsp bovis AF2122/97
gccugcccggcgc

SEQ ID NO: 1098078 - RNA, 16 nt, Mycobacterium bovis subsp bovis AF2122/97
gccugcccggcgccgu

SEQ ID NO: 1098079 - RNA, 14 nt, Mycobacterium bovis subsp bovis AF2122/97
gccugcccgggaug

SEQ ID NO: 1098080 - RNA, 24 nt, Mycobacterium bovis subsp bovis AF2122/97
gccugcgggaacgcggcggcgaac

SEQ ID NO: 1098081 - RNA, 16 nt, Mycobacterium bovis subsp bovis AF2122/97
gccugcccaccuucga

SEQ ID NO: 1098082 - RNA, 19 nt, Mycobacterium bovis subsp bovis AF2122/97
gccugccauaggcccacgg

SEQ ID NO: 1098083 - RNA, 22 nt, Mycobacterium bovis subsp bovis AF2122/97
gccugccaucacgcgcucaccg

SEQ ID NO: 1098084 - RNA, 23 nt, Mycobacterium bovis subsp bovis AF2122/97
gccugccccacccgcggcgccgu

SEQ ID NO: 1098085 - RNA, 18 nt, Mycobacterium bovis subsp bovis AF2122/97
gccugcccagcaccaccg

SEQ ID NO: 1098086 - RNA, 19 nt, Mycobacterium bovis subsp bovis AF2122/97
gccugcuccaccgucgaac

SEQ ID NO: 1098087 - RNA, 15 nt, Mycobacterium bovis subsp bovis AF2122/97
gccugcuccucggcc

SEQ ID NO: 1098088 - RNA, 22 nt, Mycobacterium bovis subsp bovis AF2122/97
gccugcuuggccacuugcucgg

SEQ ID NO: 1098089 - RNA, 14 nt, Mycobacterium bovis subsp bovis AF2122/97
gccugcuuggccac

SEQ ID NO: 1098090 - RNA, 17 nt, Mycobacterium bovis subsp bovis AF2122/97
gccugcgggccggcauc

SEQ ID NO: 1098091 - RNA, 18 nt, Mycobacterium bovis subsp bovis AF2122/97
gccugcgggccggcaucg

SEQ ID NO: 1098092 - RNA, 16 nt, Mycobacterium bovis subsp bovis AF2122/97
gccugcuaaccacggu

SEQ ID NO: 1098093 - RNA, 12 nt, Mycobacterium bovis subsp bovis AF2122/97
gccugcggucag

SEQ ID NO: 1098094 - RNA, 15 nt, Mycobacterium bovis subsp bovis AF2122/97
gccugcuagcagcag

SEQ ID NO: 1098095 - RNA, 15 nt, Mycobacterium bovis subsp bovis AF2122/97
gccugcucaaccagc

SEQ ID NO: 1098096 - RNA, 16 nt, Mycobacterium bovis subsp bovis AF2122/97
gccuuaccccgcagcu

SEQ ID NO: 1098097 - RNA, 18 nt, Mycobacterium bovis subsp bovis AF2122/97
gccuuagcccggccgcgc

SEQ ID NO: 1098098 - RNA, 17 nt, Mycobacterium bovis subsp bovis AF2122/97
gccuuccuggcgggcgc

SEQ ID NO: 1098099 - RNA, 14 nt, Mycobacterium bovis subsp bovis AF2122/97
gccuuccgacccaa

SEQ ID NO: 1098100 - RNA, 23 nt, Mycobacterium bovis subsp bovis AF2122/97
gccuuccgacccaacgaccacca

SEQ ID NO: 1098101 - RNA, 18 nt, Mycobacterium bovis subsp bovis AF2122/97
gccugggcuuggcgacga

SEQ ID NO: 1098102 - RNA, 21 nt, Mycobacterium bovis subsp bovis AF2122/97
gccugguacucccgcgaucgc

SEQ ID NO: 1098103 - RNA, 18 nt, Mycobacterium bovis subsp bovis AF2122/97
gccugggugggagcguug

SEQ ID NO: 1098104 - RNA, 16 nt, Mycobacterium bovis subsp bovis AF2122/97
gccugguaccgcggug

SEQ ID NO: 1098105 - RNA, 13 nt, Mycobacterium bovis subsp bovis AF2122/97
gccuggucggcca

SEQ ID NO: 1098106 - RNA, 22 nt, Mycobacterium bovis subsp bovis AF2122/97
gccuguucgagaucgccgagca

SEQ ID NO: 1098107 - RNA, 18 nt, Mycobacterium bovis subsp bovis AF2122/97
gccugguccucacggguc

SEQ ID NO: 1098108 - RNA, 19 nt, Mycobacterium bovis subsp bovis AF2122/97
gccuggucggccaggucga

SEQ ID NO: 1098109 - RNA, 22 nt, Mycobacterium bovis subsp bovis AF2122/97
gccuguucgccgcgaaugucgc

SEQ ID NO: 1098110 - RNA, 15 nt, Mycobacterium bovis subsp bovis AF2122/97
gccuguucgccgucg

SEQ ID NO: 1098111 - RNA, 22 nt, Mycobacterium bovis subsp bovis AF2122/97
gccuugcucggugaugcccagc

SEQ ID NO: 1098112 - RNA, 19 nt, Mycobacterium bovis subsp bovis AF2122/97
gccuuggcaguccagccgg

SEQ ID NO: 1098113 - RNA, 20 nt, Mycobacterium bovis subsp bovis AF2122/97
gccuuggcagcccaguacgg

SEQ ID NO: 1098114 - RNA, 17 nt, Mycobacterium bovis subsp bovis AF2122/97
gccuuggcaguccagcc

SEQ ID NO: 1098115 - RNA, 22 nt, Mycobacterium bovis subsp bovis AF2122/97
gccuuggccaccaucgccgccg

SEQ ID NO: 1098116 - RNA, 23 nt, Mycobacterium bovis subsp bovis AF2122/97
gccuuggccaccaucgccgccgu

SEQ ID NO: 1098117 - RNA, 14 nt, Mycobacterium bovis subsp bovis AF2122/97
gccuuggcgcggca

SEQ ID NO: 1098118 - RNA, 17 nt, Mycobacterium bovis subsp bovis AF2122/97
gccuuggcgcggcaccc

SEQ ID NO: 1098119 - RNA, 21 nt, Mycobacterium bovis subsp bovis AF2122/97
gccuucucgcgaagaucagcg

SEQ ID NO: 1098120 - RNA, 14 nt, Mycobacterium bovis subsp bovis AF2122/97
gccuucucgccgug

SEQ ID NO: 1098121 - RNA, 17 nt, Mycobacterium bovis subsp bovis AF2122/97
gccuugcgggccuggug

SEQ ID NO: 1098122 - RNA, 17 nt, Mycobacterium bovis subsp bovis AF2122/97
gccuugcgggcucucgg

SEQ ID NO: 1098123 - RNA, 18 nt, Mycobacterium bovis subsp bovis AF2122/97
gccuugcgggcucucggc

SEQ ID NO: 1098124 - RNA, 23 nt, Mycobacterium bovis subsp bovis AF2122/97
gccuugcgggcucucggcgucga

SEQ ID NO: 1098125 - RNA, 13 nt, Mycobacterium bovis subsp bovis AF2122/97
gccuucgccagcg

SEQ ID NO: 1098126 - RNA, 16 nt, Mycobacterium bovis subsp bovis AF2122/97
gccuucgccagcggcg

SEQ ID NO: 1098127 - RNA, 21 nt, Mycobacterium bovis subsp bovis AF2122/97
gccuucuccaucgucggcaac

SEQ ID NO: 1098128 - RNA, 23 nt, Mycobacterium bovis subsp bovis AF2122/97
gccuucuccccgaucagcaccga

SEQ ID NO: 1098129 - RNA, 15 nt, Mycobacterium bovis subsp bovis AF2122/97
gccuucgucgaugcg

SEQ ID NO: 1098130 - RNA, 21 nt, Mycobacterium bovis subsp bovis AF2122/97
gccuucgucgaugcgguaucg

SEQ ID NO: 1098131 - RNA, 16 nt, Mycobacterium bovis subsp bovis AF2122/97
gccuucguaaccacga

SEQ ID NO: 1098132 - RNA, 20 nt, Mycobacterium bovis subsp bovis AF2122/97
gccuucguaaccacgacgac

SEQ ID NO: 1098133 - RNA, 17 nt, Mycobacterium bovis subsp bovis AF2122/97
gccuucguagaaggacc

SEQ ID NO: 1098134 - RNA, 23 nt, Mycobacterium bovis subsp bovis AF2122/97
gccuucguagaaggaccgcucgu

SEQ ID NO: 1098135 - RNA, 20 nt, Mycobacterium bovis subsp bovis AF2122/97
gcgaugauuucgucgaucgg

SEQ ID NO: 1098136 - RNA, 21 nt, Mycobacterium bovis subsp bovis AF2122/97
gcgaugauuucgucgaucggc

SEQ ID NO: 1098137 - RNA, 13 nt, Mycobacterium bovis subsp bovis AF2122/97
gcgaugcagccgg

SEQ ID NO: 1098138 - RNA, 15 nt, Mycobacterium bovis subsp bovis AF2122/97
gcgaugcagcgcgcc

SEQ ID NO: 1098139 - RNA, 20 nt, Mycobacterium bovis subsp bovis AF2122/97
gcgaugcacaaccgcugcug

SEQ ID NO: 1098140 - RNA, 16 nt, Mycobacterium bovis subsp bovis AF2122/97
gcgaugaucgcaucga

SEQ ID NO: 1098141 - RNA, 16 nt, Mycobacterium bovis subsp bovis AF2122/97
gcgaugagcgcgaucu

SEQ ID NO: 1098142 - RNA, 14 nt, Mycobacterium bovis subsp bovis AF2122/97
gcgaugagcggcgc

SEQ ID NO: 1098143 - RNA, 17 nt, Mycobacterium bovis subsp bovis AF2122/97
gcgaugagcgugccgca

SEQ ID NO: 1098144 - RNA, 23 nt, Mycobacterium bovis subsp bovis AF2122/97
gcgaugaggaacguuucgcuguc

SEQ ID NO: 1098145 - RNA, 19 nt, Mycobacterium bovis subsp bovis AF2122/97
gcgaugaugucggccgcgg

SEQ ID NO: 1098146 - RNA, 22 nt, Mycobacterium bovis subsp bovis AF2122/97
gcgaugauguugagcuggaccu

SEQ ID NO: 1098147 - RNA, 16 nt, Mycobacterium bovis subsp bovis AF2122/97
gcgaugauuucgucga

SEQ ID NO: 1098148 - RNA, 19 nt, Mycobacterium bovis subsp bovis AF2122/97
gcgaugccacccaacagcg

SEQ ID NO: 1098149 - RNA, 14 nt, Mycobacterium bovis subsp bovis AF2122/97
gcgaugcgcaccag

SEQ ID NO: 1098150 - RNA, 11 nt, Mycobacterium bovis subsp bovis AF2122/97
gcgaugcgacc

SEQ ID NO: 1098151 - RNA, 23 nt, Mycobacterium bovis subsp bovis AF2122/97
gcgaugccgugcugggccgacgg

SEQ ID NO: 1098152 - RNA, 11 nt, Mycobacterium bovis subsp bovis AF2122/97
gcgaugccguu

SEQ ID NO: 1098153 - RNA, 23 nt, Mycobacterium bovis subsp bovis AF2122/97
gcgaugcggcccucgaauucggc

SEQ ID NO: 1098154 - RNA, 17 nt, Mycobacterium bovis subsp bovis AF2122/97
gcgaugcggucggccac

SEQ ID NO: 1098155 - RNA, 21 nt, Mycobacterium bovis subsp bovis AF2122/97
gcgaugcgguguagggcggcg

SEQ ID NO: 1098156 - RNA, 13 nt, Mycobacterium bovis subsp bovis AF2122/97
gcgaugcguccgc

SEQ ID NO: 1098157 - RNA, 18 nt, Mycobacterium bovis subsp bovis AF2122/97
gcgaugcguccgcccagc

SEQ ID NO: 1098158 - RNA, 21 nt, Mycobacterium bovis subsp bovis AF2122/97
gcgaugcguccgcccagccgc

SEQ ID NO: 1098159 - RNA, 15 nt, Mycobacterium bovis subsp bovis AF2122/97
gcgaucgggcccagc

SEQ ID NO: 1098160 - RNA, 22 nt, Mycobacterium bovis subsp bovis AF2122/97
gcgaucgggccggcgcggucuc

SEQ ID NO: 1098161 - RNA, 22 nt, Mycobacterium bovis subsp bovis AF2122/97
gcgaucggggcgacgauccgca

SEQ ID NO: 1098162 - RNA, 15 nt, Mycobacterium bovis subsp bovis AF2122/97
gcgaucggugaaucg

SEQ ID NO: 1098163 - RNA, 17 nt, Mycobacterium bovis subsp bovis AF2122/97
gcgaucggugcgaucag

SEQ ID NO: 1098164 - RNA, 23 nt, Mycobacterium bovis subsp bovis AF2122/97
gcgaucggugcgaucaggcugcc

SEQ ID NO: 1098165 - RNA, 18 nt, Mycobacterium bovis subsp bovis AF2122/97
gcgaucggugcgggcgcc

SEQ ID NO: 1098166 - RNA, 21 nt, Mycobacterium bovis subsp bovis AF2122/97
gcgaucggugcgggcgccgcu

SEQ ID NO: 1098167 - RNA, 13 nt, Mycobacterium bovis subsp bovis AF2122/97
gcgaucucgaccg

SEQ ID NO: 1098168 - RNA, 24 nt, Mycobacterium bovis subsp bovis AF2122/97
gcgaucucgaccguauugaccagc

SEQ ID NO: 1098169 - RNA, 22 nt, Mycobacterium bovis subsp bovis AF2122/97
gcgaucuccgugagccggaccg

SEQ ID NO: 1098170 - RNA, 19 nt, Mycobacterium bovis subsp bovis AF2122/97
gcgaucuccuccaccagug

SEQ ID NO: 1098171 - RNA, 19 nt, Mycobacterium bovis subsp bovis AF2122/97
gcgaucgugcugcccgcaa

SEQ ID NO: 1098172 - RNA, 23 nt, Mycobacterium bovis subsp bovis AF2122/97
gcgaucgucgacucggcggcgcg

SEQ ID NO: 1098173 - RNA, 16 nt, Mycobacterium bovis subsp bovis AF2122/97
gcgaucgucagccagc

SEQ ID NO: 1098174 - RNA, 17 nt, Mycobacterium bovis subsp bovis AF2122/97
gcgaucgucagccagcg

SEQ ID NO: 1098175 - RNA, 14 nt, Mycobacterium bovis subsp bovis AF2122/97
gcgaucucuaccag

SEQ ID NO: 1098176 - RNA, 19 nt, Mycobacterium bovis subsp bovis AF2122/97
gcgaucucuaccagccgcc

SEQ ID NO: 1098177 - RNA, 15 nt, Mycobacterium bovis subsp bovis AF2122/97
gcgaucugcuguguc

SEQ ID NO: 1098178 - RNA, 13 nt, Mycobacterium bovis subsp bovis AF2122/97
gcgaucugcuacc

SEQ ID NO: 1098179 - RNA, 21 nt, Mycobacterium bovis subsp bovis AF2122/97
gcgaucuggucggcggccucg

SEQ ID NO: 1098180 - RNA, 18 nt, Mycobacterium bovis subsp bovis AF2122/97
gcgaucuguccgcgaacg

SEQ ID NO: 1098181 - RNA, 18 nt, Mycobacterium bovis subsp bovis AF2122/97
gcgaucugaaacagucga

SEQ ID NO: 1098182 - RNA, 13 nt, Mycobacterium bovis subsp bovis AF2122/97
gcgaucugcagcg

SEQ ID NO: 1098183 - RNA, 16 nt, Mycobacterium bovis subsp bovis AF2122/97
gcgaucugcgacaaga

SEQ ID NO: 1098184 - RNA, 21 nt, Mycobacterium bovis subsp bovis AF2122/97
gcgaucugcgacaagaccggc

SEQ ID NO: 1098185 - RNA, 23 nt, Mycobacterium bovis subsp bovis AF2122/97
gcgaucugcgacaagaccggcgg

SEQ ID NO: 1098186 - RNA, 20 nt, Mycobacterium bovis subsp bovis AF2122/97
gcgaugacaucaccgaccaa

SEQ ID NO: 1098187 - RNA, 22 nt, Mycobacterium bovis subsp bovis AF2122/97
gcgaugacaucaccgaccaacg

SEQ ID NO: 1098188 - RNA, 18 nt, Mycobacterium bovis subsp bovis AF2122/97
gcgaugaccacgccgacg

SEQ ID NO: 1098189 - RNA, 13 nt, Mycobacterium bovis subsp bovis AF2122/97
gcgaugacgaccg

SEQ ID NO: 1098190 - RNA, 17 nt, Mycobacterium bovis subsp bovis AF2122/97
gcgaugaccucggcgau

SEQ ID NO: 1098191 - RNA, 19 nt, Mycobacterium bovis subsp bovis AF2122/97
gcgaugacgaccgaucggc

SEQ ID NO: 1098192 - RNA, 20 nt, Mycobacterium bovis subsp bovis AF2122/97
gcgaugacgaccgaucggcg

SEQ ID NO: 1098193 - RNA, 22 nt, Mycobacterium bovis subsp bovis AF2122/97
gcgaugagccugcaggccgccg

SEQ ID NO: 1098194 - RNA, 21 nt, Mycobacterium bovis subsp bovis AF2122/97
gcgaugacggugccgaccgcg

SEQ ID NO: 1098195 - RNA, 22 nt, Mycobacterium bovis subsp bovis AF2122/97
gcgaugacgaccgaucggcgcg

SEQ ID NO: 1098196 - RNA, 23 nt, Mycobacterium bovis subsp bovis AF2122/97
gcgaugacgaccgaucggcgcgu

SEQ ID NO: 1098197 - RNA, 16 nt, Mycobacterium bovis subsp bovis AF2122/97
gcgaucuggccgaacg

SEQ ID NO: 1098198 - RNA, 16 nt, Mycobacterium bovis subsp bovis AF2122/97
gcgaugaacagcgacg

SEQ ID NO: 1098199 - RNA, 15 nt, Mycobacterium bovis subsp bovis AF2122/97
gcgaucuuggaucgg

SEQ ID NO: 1098200 - RNA, 13 nt, Mycobacterium bovis subsp bovis AF2122/97
gcgaggucggcgg

SEQ ID NO: 1098201 - RNA, 22 nt, Mycobacterium bovis subsp bovis AF2122/97
gcgaggucggugaggucgaugc

SEQ ID NO: 1098202 - RNA, 21 nt, Mycobacterium bovis subsp bovis AF2122/97
gcgagguauaaacgcggcgcg

SEQ ID NO: 1098203 - RNA, 23 nt, Mycobacterium bovis subsp bovis AF2122/97
gcgagguauaaacgcggcgcgcu

SEQ ID NO: 1098204 - RNA, 18 nt, Mycobacterium bovis subsp bovis AF2122/97
gcgaggucccggccgagc

SEQ ID NO: 1098205 - RNA, 19 nt, Mycobacterium bovis subsp bovis AF2122/97
gcgaggucccggccgagcg

SEQ ID NO: 1098206 - RNA, 18 nt, Mycobacterium bovis subsp bovis AF2122/97
gcgaggugaaucgcgucg

SEQ ID NO: 1098207 - RNA, 19 nt, Mycobacterium bovis subsp bovis AF2122/97
gcgaggugauuggucacac

SEQ ID NO: 1098208 - RNA, 15 nt, Mycobacterium bovis subsp bovis AF2122/97
gcgaucagcagccgc

SEQ ID NO: 1098209 - RNA, 16 nt, Mycobacterium bovis subsp bovis AF2122/97
gcgaucagcagccgcc

SEQ ID NO: 1098210 - RNA, 18 nt, Mycobacterium bovis subsp bovis AF2122/97
gcgaucagcagccgccga

SEQ ID NO: 1098211 - RNA, 16 nt, Mycobacterium bovis subsp bovis AF2122/97
gcgaucaggcugccgc

SEQ ID NO: 1098212 - RNA, 21 nt, Mycobacterium bovis subsp bovis AF2122/97
gcgaucaggcugccgcugcgc

SEQ ID NO: 1098213 - RNA, 16 nt, Mycobacterium bovis subsp bovis AF2122/97
gcgaucaugagcagca

SEQ ID NO: 1098214 - RNA, 19 nt, Mycobacterium bovis subsp bovis AF2122/97
gcgaucagguaccggcgga

SEQ ID NO: 1098215 - RNA, 13 nt, Mycobacterium bovis subsp bovis AF2122/97
gcgauccagggcc

SEQ ID NO: 1098216 - RNA, 14 nt, Mycobacterium bovis subsp bovis AF2122/97
gcgauccagggccg

SEQ ID NO: 1098217 - RNA, 17 nt, Mycobacterium bovis subsp bovis AF2122/97
gcgaucccaacgcccgg

SEQ ID NO: 1098218 - RNA, 21 nt, Mycobacterium bovis subsp bovis AF2122/97
gcgauccagggccgacgcgaa

SEQ ID NO: 1098219 - RNA, 17 nt, Mycobacterium bovis subsp bovis AF2122/97
gcgauccccgcgcugag

SEQ ID NO: 1098220 - RNA, 17 nt, Mycobacterium bovis subsp bovis AF2122/97
gcgauccgcugcgccga

SEQ ID NO: 1098221 - RNA, 13 nt, Mycobacterium bovis subsp bovis AF2122/97
gcgauccgcgcgc

SEQ ID NO: 1098222 - RNA, 12 nt, Mycobacterium bovis subsp bovis AF2122/97
gcgauccggcgc

SEQ ID NO: 1098223 - RNA, 14 nt, Mycobacterium bovis subsp bovis AF2122/97
gcgauccggcgcac

SEQ ID NO: 1098224 - RNA, 21 nt, Mycobacterium bovis subsp bovis AF2122/97
gcgauccggucggccaggccg

SEQ ID NO: 1098225 - RNA, 15 nt, Mycobacterium bovis subsp bovis AF2122/97
gcgauccggucgggg

SEQ ID NO: 1098226 - RNA, 17 nt, Mycobacterium bovis subsp bovis AF2122/97
gcgaucgauuccgcucg

SEQ ID NO: 1098227 - RNA, 18 nt, Mycobacterium bovis subsp bovis AF2122/97
gcgaucgauuccgcucgu

SEQ ID NO: 1098228 - RNA, 16 nt, Mycobacterium bovis subsp bovis AF2122/97
gcgaucgacgcucggc

SEQ ID NO: 1098229 - RNA, 20 nt, Mycobacterium bovis subsp bovis AF2122/97
gcgaucgacaccgugaccgc

SEQ ID NO: 1098230 - RNA, 16 nt, Mycobacterium bovis subsp bovis AF2122/97
gcgaucgacaccguga

SEQ ID NO: 1098231 - RNA, 19 nt, Mycobacterium bovis subsp bovis AF2122/97
gcgaucggcgucacgagcc

SEQ ID NO: 1098232 - RNA, 23 nt, Mycobacterium bovis subsp bovis AF2122/97
gcgaucggcacuuagcccgaugg

SEQ ID NO: 1098233 - RNA, 15 nt, Mycobacterium bovis subsp bovis AF2122/97
gcgaucggccgccga

SEQ ID NO: 1098234 - RNA, 16 nt, Mycobacterium bovis subsp bovis AF2122/97
gcgaucggccgccgaa

SEQ ID NO: 1098235 - RNA, 21 nt, Mycobacterium bovis subsp bovis AF2122/97
gcgaucggccgccgaauuggc

SEQ ID NO: 1098236 - RNA, 21 nt, Mycobacterium bovis subsp bovis AF2122/97
gcgaucgcgacccgaucgcgc

SEQ ID NO: 1098237 - RNA, 17 nt, Mycobacterium bovis subsp bovis AF2122/97
gcgaucgcgugcggugc

SEQ ID NO: 1098238 - RNA, 21 nt, Mycobacterium bovis subsp bovis AF2122/97
gcgaucgcucauucgugcccg

SEQ ID NO: 1098239 - RNA, 17 nt, Mycobacterium bovis subsp bovis AF2122/97
gcgaucgcuccgcggcg

SEQ ID NO: 1098240 - RNA, 18 nt, Mycobacterium bovis subsp bovis AF2122/97
gcgaucgcuccgcggcgc

SEQ ID NO: 1098241 - RNA, 22 nt, Mycobacterium bovis subsp bovis AF2122/97
gcgaucgccugggcuuggcgac

SEQ ID NO: 1098242 - RNA, 13 nt, Mycobacterium bovis subsp bovis AF2122/97
gcgaucgccgcgc

SEQ ID NO: 1098243 - RNA, 24 nt, Mycobacterium bovis subsp bovis AF2122/97
gcgaucgauuccgcucguucgugc

SEQ ID NO: 1098244 - RNA, 12 nt, Mycobacterium bovis subsp bovis AF2122/97
gcgaucgccgac

SEQ ID NO: 1098245 - RNA, 21 nt, Mycobacterium bovis subsp bovis AF2122/97
gcgaucgcccggccccgcaag

SEQ ID NO: 1098246 - RNA, 20 nt, Mycobacterium bovis subsp bovis AF2122/97
gcgcaacuucuucagcagcg

SEQ ID NO: 1098247 - RNA, 12 nt, Mycobacterium bovis subsp bovis AF2122/97
gcgcaacgccgc

SEQ ID NO: 1098248 - RNA, 19 nt, Mycobacterium bovis subsp bovis AF2122/97
gcgcaagaaugccgccgac

SEQ ID NO: 1098249 - RNA, 22 nt, Mycobacterium bovis subsp bovis AF2122/97
gcgcaagaaugccgccgacggg

SEQ ID NO: 1098250 - RNA, 14 nt, Mycobacterium bovis subsp bovis AF2122/97
gcgcaacggccagc

SEQ ID NO: 1098251 - RNA, 15 nt, Mycobacterium bovis subsp bovis AF2122/97
gcgcaacggccagcg

SEQ ID NO: 1098252 - RNA, 21 nt, Mycobacterium bovis subsp bovis AF2122/97
gcgcaacgcuggaggcgaucu

SEQ ID NO: 1098253 - RNA, 22 nt, Mycobacterium bovis subsp bovis AF2122/97
gcgcaacgcuggaggcgaucug

SEQ ID NO: 1098254 - RNA, 17 nt, Mycobacterium bovis subsp bovis AF2122/97
gcgcaacuaucgcaccu

SEQ ID NO: 1098255 - RNA, 14 nt, Mycobacterium bovis subsp bovis AF2122/97
gcgcaacucgccac

SEQ ID NO: 1098256 - RNA, 20 nt, Mycobacterium bovis subsp bovis AF2122/97
gcgcaacaccucgucggcuu

SEQ ID NO: 1098257 - RNA, 22 nt, Mycobacterium bovis subsp bovis AF2122/97
gcgcaacaccgugcaccagcuc

SEQ ID NO: 1098258 - RNA, 17 nt, Mycobacterium bovis subsp bovis AF2122/97
gcgcaacacauccagua

SEQ ID NO: 1098259 - RNA, 13 nt, Mycobacterium bovis subsp bovis AF2122/97
gcgcaaagacacc

SEQ ID NO: 1098260 - RNA, 17 nt, Mycobacterium bovis subsp bovis AF2122/97
gcgcaaagcccuccucg

SEQ ID NO: 1098261 - RNA, 13 nt, Mycobacterium bovis subsp bovis AF2122/97
gcgcaaccgcuca

SEQ ID NO: 1098262 - RNA, 19 nt, Mycobacterium bovis subsp bovis AF2122/97
gcgcaacgccgccagccug

SEQ ID NO: 1098263 - RNA, 14 nt, Mycobacterium bovis subsp bovis AF2122/97
gcgcaacgccgcca

SEQ ID NO: 1098264 - RNA, 12 nt, Mycobacterium bovis subsp bovis AF2122/97
gcgcaacccagc

SEQ ID NO: 1098265 - RNA, 14 nt, Mycobacterium bovis subsp bovis AF2122/97
gcgcaacccggacg

SEQ ID NO: 1098266 - RNA, 13 nt, Mycobacterium bovis subsp bovis AF2122/97
gcgcaaccagccc

SEQ ID NO: 1098267 - RNA, 23 nt, Mycobacterium bovis subsp bovis AF2122/97
gcgcaaccgagcggucgaucuga

SEQ ID NO: 1098268 - RNA, 21 nt, Mycobacterium bovis subsp bovis AF2122/97
gcgcaacaccaucagcgacaa

SEQ ID NO: 1098269 - RNA, 14 nt, Mycobacterium bovis subsp bovis AF2122/97
gcgcaaccgcggcc

SEQ ID NO: 1098270 - RNA, 16 nt, Mycobacterium bovis subsp bovis AF2122/97
gcgcaauagcgacagc

SEQ ID NO: 1098271 - RNA, 18 nt, Mycobacterium bovis subsp bovis AF2122/97
gcgcaauagcgacagcag

SEQ ID NO: 1098272 - RNA, 19 nt, Mycobacterium bovis subsp bovis AF2122/97
gcgcaagguggcaugcgac

SEQ ID NO: 1098273 - RNA, 18 nt, Mycobacterium bovis subsp bovis AF2122/97
gcgcaagguugccaacgc

SEQ ID NO: 1098274 - RNA, 16 nt, Mycobacterium bovis subsp bovis AF2122/97
gcgcaaggcgccgcag

SEQ ID NO: 1098275 - RNA, 15 nt, Mycobacterium bovis subsp bovis AF2122/97
gcgcaagcgccgcgc

SEQ ID NO: 1098276 - RNA, 18 nt, Mycobacterium bovis subsp bovis AF2122/97
gcgcaaggcgccgcaggg

SEQ ID NO: 1098277 - RNA, 20 nt, Mycobacterium bovis subsp bovis AF2122/97
gcgcaaugcaucgcggcggc

SEQ ID NO: 1098278 - RNA, 22 nt, Mycobacterium bovis subsp bovis AF2122/97
gcgcaaugcaucgcggcggcgc

SEQ ID NO: 1098279 - RNA, 13 nt, Mycobacterium bovis subsp bovis AF2122/97
gcgcaaugccgac

SEQ ID NO: 1098280 - RNA, 24 nt, Mycobacterium bovis subsp bovis AF2122/97
gcgcaaugccgacgccaacgccag

SEQ ID NO: 1098281 - RNA, 21 nt, Mycobacterium bovis subsp bovis AF2122/97
gcgcaaucgaccacgacgugg

SEQ ID NO: 1098282 - RNA, 13 nt, Mycobacterium bovis subsp bovis AF2122/97
gcgcaaucaacgu

SEQ ID NO: 1098283 - RNA, 20 nt, Mycobacterium bovis subsp bovis AF2122/97
gcgcaaucaacgucaccccc

SEQ ID NO: 1098284 - RNA, 13 nt, Mycobacterium bovis subsp bovis AF2122/97
gcgcacaggcgcg

SEQ ID NO: 1098285 - RNA, 14 nt, Mycobacterium bovis subsp bovis AF2122/97
gcgcacaucgcgaa

SEQ ID NO: 1098286 - RNA, 17 nt, Mycobacterium bovis subsp bovis AF2122/97
gcgcaccaagacgccac

SEQ ID NO: 1098287 - RNA, 19 nt, Mycobacterium bovis subsp bovis AF2122/97
gcgcaccaagacgccaccc

SEQ ID NO: 1098288 - RNA, 17 nt, Mycobacterium bovis subsp bovis AF2122/97
gcgcaccaacaccagcg

SEQ ID NO: 1098289 - RNA, 17 nt, Mycobacterium bovis subsp bovis AF2122/97
gcgcacaacccgucgag

SEQ ID NO: 1098290 - RNA, 22 nt, Mycobacterium bovis subsp bovis AF2122/97
gcgcacaacccgucgagccgug

SEQ ID NO: 1098291 - RNA, 21 nt, Mycobacterium bovis subsp bovis AF2122/97
gcgcacaaacgacucgcggug

SEQ ID NO: 1098292 - RNA, 17 nt, Mycobacterium bovis subsp bovis AF2122/97
gcgcacacuaccgccgc

SEQ ID NO: 1098293 - RNA, 18 nt, Mycobacterium bovis subsp bovis AF2122/97
gcgcacacuaccgccgcg

SEQ ID NO: 1098294 - RNA, 13 nt, Mycobacterium bovis subsp bovis AF2122/97
gcgcacacccugc

SEQ ID NO: 1098295 - RNA, 17 nt, Mycobacterium bovis subsp bovis AF2122/97
gcgauggccguccgacc

SEQ ID NO: 1098296 - RNA, 19 nt, Mycobacterium bovis subsp bovis AF2122/97
gcgauggccguccgaccga

SEQ ID NO: 1098297 - RNA, 13 nt, Mycobacterium bovis subsp bovis AF2122/97
gcgauggcggucc

SEQ ID NO: 1098298 - RNA, 16 nt, Mycobacterium bovis subsp bovis AF2122/97
gcgauggcgguccacc

SEQ ID NO: 1098299 - RNA, 18 nt, Mycobacterium bovis subsp bovis AF2122/97
gcgauggcggcgcguucg

SEQ ID NO: 1098300 - RNA, 17 nt, Mycobacterium bovis subsp bovis AF2122/97
gcgauggccaucaucga

SEQ ID NO: 1098301 - RNA, 14 nt, Mycobacterium bovis subsp bovis AF2122/97
gcgauggccgacgc

SEQ ID NO: 1098302 - RNA, 17 nt, Mycobacterium bovis subsp bovis AF2122/97
gcgauggcccggguguu

SEQ ID NO: 1098303 - RNA, 16 nt, Mycobacterium bovis subsp bovis AF2122/97
gcgauggcagcgccga

SEQ ID NO: 1098304 - RNA, 13 nt, Mycobacterium bovis subsp bovis AF2122/97
gcgaugcggucgu

SEQ ID NO: 1098305 - RNA, 18 nt, Mycobacterium bovis subsp bovis AF2122/97
gcgaugcucacuacccgc

SEQ ID NO: 1098306 - RNA, 14 nt, Mycobacterium bovis subsp bovis AF2122/97
gcgauggccguugc

SEQ ID NO: 1098307 - RNA, 20 nt, Mycobacterium bovis subsp bovis AF2122/97
gcgaugucccaucgcgucgg

SEQ ID NO: 1098308 - RNA, 14 nt, Mycobacterium bovis subsp bovis AF2122/97
gcgaugucgcgcau

SEQ ID NO: 1098309 - RNA, 16 nt, Mycobacterium bovis subsp bovis AF2122/97
gcgaugucguucgcgu

SEQ ID NO: 1098310 - RNA, 20 nt, Mycobacterium bovis subsp bovis AF2122/97
gcgaugugcgccaccucgac

SEQ ID NO: 1098311 - RNA, 22 nt, Mycobacterium bovis subsp bovis AF2122/97
gcgaugugcgccaccucgacgc

SEQ ID NO: 1098312 - RNA, 23 nt, Mycobacterium bovis subsp bovis AF2122/97
gcgaugugcgccaccucgacgca

SEQ ID NO: 1098313 - RNA, 18 nt, Mycobacterium bovis subsp bovis AF2122/97
gcgauggugcgcccgccg

SEQ ID NO: 1098314 - RNA, 19 nt, Mycobacterium bovis subsp bovis AF2122/97
gcgauggugcgcccgccgg

SEQ ID NO: 1098315 - RNA, 22 nt, Mycobacterium bovis subsp bovis AF2122/97
gcgauggugcgcccgccggcgc

SEQ ID NO: 1098316 - RNA, 15 nt, Mycobacterium bovis subsp bovis AF2122/97
gcgauggugcgccgg

SEQ ID NO: 1098317 - RNA, 19 nt, Mycobacterium bovis subsp bovis AF2122/97
gcgaugguagucgcgaccg

SEQ ID NO: 1098318 - RNA, 15 nt, Mycobacterium bovis subsp bovis AF2122/97
gcgauggucuccucg

SEQ ID NO: 1098319 - RNA, 17 nt, Mycobacterium bovis subsp bovis AF2122/97
gcgauggcgguccaccg

SEQ ID NO: 1098320 - RNA, 13 nt, Mycobacterium bovis subsp bovis AF2122/97
gcgaugggagccc

SEQ ID NO: 1098321 - RNA, 22 nt, Mycobacterium bovis subsp bovis AF2122/97
gcgaugggcccagcggccgcga

SEQ ID NO: 1098322 - RNA, 22 nt, Mycobacterium bovis subsp bovis AF2122/97
gcgaugggucugguguccaccg

SEQ ID NO: 1098323 - RNA, 20 nt, Mycobacterium bovis subsp bovis AF2122/97
gcgauggguguugcuggccg

SEQ ID NO: 1098324 - RNA, 21 nt, Mycobacterium bovis subsp bovis AF2122/97
gcgauggguguugcuggccgc

SEQ ID NO: 1098325 - RNA, 21 nt, Mycobacterium bovis subsp bovis AF2122/97
gcgauucugcguccugcucgc

SEQ ID NO: 1098326 - RNA, 17 nt, Mycobacterium bovis subsp bovis AF2122/97
gcgauucugcgucugcu

SEQ ID NO: 1098327 - RNA, 17 nt, Mycobacterium bovis subsp bovis AF2122/97
gcgauuccgcgucugcu

SEQ ID NO: 1098328 - RNA, 16 nt, Mycobacterium bovis subsp bovis AF2122/97
gcgauucccaaccggu

SEQ ID NO: 1098329 - RNA, 14 nt, Mycobacterium bovis subsp bovis AF2122/97
gcgauuccggcggc

SEQ ID NO: 1098330 - RNA, 20 nt, Mycobacterium bovis subsp bovis AF2122/97
gcgauucugugucugcucgc

SEQ ID NO: 1098331 - RNA, 22 nt, Mycobacterium bovis subsp bovis AF2122/97
gcgauucugggcuucaucggcg

SEQ ID NO: 1098332 - RNA, 19 nt, Mycobacterium bovis subsp bovis AF2122/97
gcgauucugugucugcucg

SEQ ID NO: 1098333 - RNA, 18 nt, Mycobacterium bovis subsp bovis AF2122/97
gcgauucugcgucugcuc

SEQ ID NO: 1098334 - RNA, 19 nt, Mycobacterium bovis subsp bovis AF2122/97
gcgauucugcgucugcucg

SEQ ID NO: 1098335 - RNA, 20 nt, Mycobacterium bovis subsp bovis AF2122/97
gcgauucugcgucugcucgc

SEQ ID NO: 1098336 - RNA, 21 nt, Mycobacterium bovis subsp bovis AF2122/97
gcgauucugcgucugcucgcc

SEQ ID NO: 1098337 - RNA, 21 nt, Mycobacterium bovis subsp bovis AF2122/97
gcgauuaccggcacgccggcg

SEQ ID NO: 1098338 - RNA, 23 nt, Mycobacterium bovis subsp bovis AF2122/97
gcgaugucgcgcauugccgacgc

SEQ ID NO: 1098339 - RNA, 15 nt, Mycobacterium bovis subsp bovis AF2122/97
gcgauguuggccagc

SEQ ID NO: 1098340 - RNA, 16 nt, Mycobacterium bovis subsp bovis AF2122/97
gcgauuggcugggucg

SEQ ID NO: 1098341 - RNA, 18 nt, Mycobacterium bovis subsp bovis AF2122/97
gcgauugcccgcgcucgc

SEQ ID NO: 1098342 - RNA, 22 nt, Mycobacterium bovis subsp bovis AF2122/97
gcgauugccgcgguugugcugg

SEQ ID NO: 1098343 - RNA, 16 nt, Mycobacterium bovis subsp bovis AF2122/97
gcgauugcgcacaccc

SEQ ID NO: 1098344 - RNA, 19 nt, Mycobacterium bovis subsp bovis AF2122/97
gcgauuucgaucacaucgu

SEQ ID NO: 1098345 - RNA, 17 nt, Mycobacterium bovis subsp bovis AF2122/97
gcgauuuccaucgcgac

SEQ ID NO: 1098346 - RNA, 16 nt, Mycobacterium bovis subsp bovis AF2122/97
gcgauuucggcgccgg

SEQ ID NO: 1098347 - RNA, 23 nt, Mycobacterium bovis subsp bovis AF2122/97
gcgauuucggcgccuggcggcgc

SEQ ID NO: 1098348 - RNA, 14 nt, Mycobacterium bovis subsp bovis AF2122/97
gcgauuuucggcac

SEQ ID NO: 1098349 - RNA, 17 nt, Mycobacterium bovis subsp bovis AF2122/97
gcgauuuugcgucgcgc

SEQ ID NO: 1098350 - RNA, 18 nt, Mycobacterium bovis subsp bovis AF2122/97
gcgauuuugcgucugcuc

SEQ ID NO: 1098351 - RNA, 17 nt, Mycobacterium bovis subsp bovis AF2122/97
gcgcaaaaucaccggug

SEQ ID NO: 1098352 - RNA, 19 nt, Mycobacterium bovis subsp bovis AF2122/97
gcgauuuugcgucugcucg

SEQ ID NO: 1098353 - RNA, 20 nt, Mycobacterium bovis subsp bovis AF2122/97
gcgauuuugcgucugcucgg

SEQ ID NO: 1098354 - RNA, 18 nt, Mycobacterium bovis subsp bovis AF2122/97
gcgauuuugugucugcuc

SEQ ID NO: 1098355 - RNA, 19 nt, Mycobacterium bovis subsp bovis AF2122/97
gcgauuuugugucugcucg

SEQ ID NO: 1098356 - RNA, 19 nt, Mycobacterium bovis subsp bovis AF2122/97
gcgagcacccguugaucgc

SEQ ID NO: 1098357 - RNA, 22 nt, Mycobacterium bovis subsp bovis AF2122/97
gcgagcggaauggaggccgccg

SEQ ID NO: 1098358 - RNA, 23 nt, Mycobacterium bovis subsp bovis AF2122/97
gcgagcggaauggaggccgccga

SEQ ID NO: 1098359 - RNA, 13 nt, Mycobacterium bovis subsp bovis AF2122/97
gcgaggcagcacc

SEQ ID NO: 1098360 - RNA, 16 nt, Mycobacterium bovis subsp bovis AF2122/97
gcgaggaugcgcaaca

SEQ ID NO: 1098361 - RNA, 15 nt, Mycobacterium bovis subsp bovis AF2122/97
gcgagcucggccccg

SEQ ID NO: 1098362 - RNA, 20 nt, Mycobacterium bovis subsp bovis AF2122/97
gcgagcucggccccgccgcc

SEQ ID NO: 1098363 - RNA, 22 nt, Mycobacterium bovis subsp bovis AF2122/97
gcgagcucggccccgccgccgg

SEQ ID NO: 1098364 - RNA, 20 nt, Mycobacterium bovis subsp bovis AF2122/97
gcgagcguuuggacgggcgu

SEQ ID NO: 1098365 - RNA, 18 nt, Mycobacterium bovis subsp bovis AF2122/97
gcgagcguuucaccaguc

SEQ ID NO: 1098366 - RNA, 13 nt, Mycobacterium bovis subsp bovis AF2122/97
gcgaggccucggc

SEQ ID NO: 1098367 - RNA, 14 nt, Mycobacterium bovis subsp bovis AF2122/97
gcgaggcgcucacc

SEQ ID NO: 1098368 - RNA, 15 nt, Mycobacterium bovis subsp bovis AF2122/97
gcgaggcgcucaccc

SEQ ID NO: 1098369 - RNA, 21 nt, Mycobacterium bovis subsp bovis AF2122/97
gcgaggcgcucacccgccgcg

SEQ ID NO: 1098370 - RNA, 22 nt, Mycobacterium bovis subsp bovis AF2122/97
gcgaggcgcucacccgccgcgg

SEQ ID NO: 1098371 - RNA, 21 nt, Mycobacterium bovis subsp bovis AF2122/97
gcgaggcguaaucaagcagcg

SEQ ID NO: 1098372 - RNA, 19 nt, Mycobacterium bovis subsp bovis AF2122/97
gcgaggcucgcguggccgc

SEQ ID NO: 1098373 - RNA, 14 nt, Mycobacterium bovis subsp bovis AF2122/97
gcgagggcaacgag

SEQ ID NO: 1098374 - RNA, 19 nt, Mycobacterium bovis subsp bovis AF2122/97
gcgaggcucguggcgacgg

SEQ ID NO: 1098375 - RNA, 22 nt, Mycobacterium bovis subsp bovis AF2122/97
gcgagggcggucagcggccaac

SEQ ID NO: 1098376 - RNA, 19 nt, Mycobacterium bovis subsp bovis AF2122/97
gcgagguaagcgagucgac

SEQ ID NO: 1098377 - RNA, 15 nt, Mycobacterium bovis subsp bovis AF2122/97
gcgagggcuaccggc

SEQ ID NO: 1098378 - RNA, 14 nt, Mycobacterium bovis subsp bovis AF2122/97
gcgaggggcggcaa

SEQ ID NO: 1098379 - RNA, 20 nt, Mycobacterium bovis subsp bovis AF2122/97
gcgagcaccaccccagcggc

SEQ ID NO: 1098380 - RNA, 16 nt, Mycobacterium bovis subsp bovis AF2122/97
gcgagauccuucgcgu

SEQ ID NO: 1098381 - RNA, 19 nt, Mycobacterium bovis subsp bovis AF2122/97
gcgagaucgggccggccgc

SEQ ID NO: 1098382 - RNA, 21 nt, Mycobacterium bovis subsp bovis AF2122/97
gcgagaucgggccggccgccg

SEQ ID NO: 1098383 - RNA, 22 nt, Mycobacterium bovis subsp bovis AF2122/97
gcgagaucgggccggccgccgc

SEQ ID NO: 1098384 - RNA, 23 nt, Mycobacterium bovis subsp bovis AF2122/97
gcgagaucuuuucaccaccucgg

SEQ ID NO: 1098385 - RNA, 17 nt, Mycobacterium bovis subsp bovis AF2122/97
gcgagaggugcugcacc

SEQ ID NO: 1098386 - RNA, 18 nt, Mycobacterium bovis subsp bovis AF2122/97
gcgagaucagcaugcccu

SEQ ID NO: 1098387 - RNA, 15 nt, Mycobacterium bovis subsp bovis AF2122/97
gcgagaucagcaugc

SEQ ID NO: 1098388 - RNA, 20 nt, Mycobacterium bovis subsp bovis AF2122/97
gcgagacuucgacgcggcga

SEQ ID NO: 1098389 - RNA, 21 nt, Mycobacterium bovis subsp bovis AF2122/97
gcgagacuucgacgcggcgac

SEQ ID NO: 1098390 - RNA, 13 nt, Mycobacterium bovis subsp bovis AF2122/97
gcgagagccggcg

SEQ ID NO: 1098391 - RNA, 14 nt, Mycobacterium bovis subsp bovis AF2122/97
gcgagagccggcgg

SEQ ID NO: 1098392 - RNA, 15 nt, Mycobacterium bovis subsp bovis AF2122/97
gcgagagccggcggc

SEQ ID NO: 1098393 - RNA, 16 nt, Mycobacterium bovis subsp bovis AF2122/97
gcgagagccggcggcg

SEQ ID NO: 1098394 - RNA, 22 nt, Mycobacterium bovis subsp bovis AF2122/97
gcgagaaucacggucaucucgg

SEQ ID NO: 1098395 - RNA, 17 nt, Mycobacterium bovis subsp bovis AF2122/97
gcgacucgugucugccu

SEQ ID NO: 1098396 - RNA, 24 nt, Mycobacterium bovis subsp bovis AF2122/97
gcgagacgcaugucgggccaggcg

SEQ ID NO: 1098397 - RNA, 23 nt, Mycobacterium bovis subsp bovis AF2122/97
gcgacucgugucugccucggggc

SEQ ID NO: 1098398 - RNA, 15 nt, Mycobacterium bovis subsp bovis AF2122/97
gcgagaccgcgagca

SEQ ID NO: 1098399 - RNA, 16 nt, Mycobacterium bovis subsp bovis AF2122/97
gcgacuccagcgcccg

SEQ ID NO: 1098400 - RNA, 14 nt, Mycobacterium bovis subsp bovis AF2122/97
gcgacuccacccca

SEQ ID NO: 1098401 - RNA, 21 nt, Mycobacterium bovis subsp bovis AF2122/97
gcgacuccaccccacccagcg

SEQ ID NO: 1098402 - RNA, 17 nt, Mycobacterium bovis subsp bovis AF2122/97
gcgacuagacgccgccg

SEQ ID NO: 1098403 - RNA, 18 nt, Mycobacterium bovis subsp bovis AF2122/97
gcgacuagacgccgccgc

SEQ ID NO: 1098404 - RNA, 18 nt, Mycobacterium bovis subsp bovis AF2122/97
gcgacgucugccaggcgc

SEQ ID NO: 1098405 - RNA, 20 nt, Mycobacterium bovis subsp bovis AF2122/97
gcgacgucugccaggcgcag

SEQ ID NO: 1098406 - RNA, 14 nt, Mycobacterium bovis subsp bovis AF2122/97
gcgacgucgcgcag

SEQ ID NO: 1098407 - RNA, 18 nt, Mycobacterium bovis subsp bovis AF2122/97
gcgacgucgcgggugaug

SEQ ID NO: 1098408 - RNA, 20 nt, Mycobacterium bovis subsp bovis AF2122/97
gcgacgucucgcaugcucac

SEQ ID NO: 1098409 - RNA, 16 nt, Mycobacterium bovis subsp bovis AF2122/97
gcgacguaguugccgg

SEQ ID NO: 1098410 - RNA, 21 nt, Mycobacterium bovis subsp bovis AF2122/97
gcgacgucaggguauccacgc

SEQ ID NO: 1098411 - RNA, 14 nt, Mycobacterium bovis subsp bovis AF2122/97
gcgacguccgcgac

SEQ ID NO: 1098412 - RNA, 19 nt, Mycobacterium bovis subsp bovis AF2122/97
gcgacguggauuguguccc

SEQ ID NO: 1098413 - RNA, 15 nt, Mycobacterium bovis subsp bovis AF2122/97
gcgacguggcgccga

SEQ ID NO: 1098414 - RNA, 16 nt, Mycobacterium bovis subsp bovis AF2122/97
gcgacguuccgcucga

SEQ ID NO: 1098415 - RNA, 18 nt, Mycobacterium bovis subsp bovis AF2122/97
gcgacguugaacucgagu

SEQ ID NO: 1098416 - RNA, 16 nt, Mycobacterium bovis subsp bovis AF2122/97
gcgacguuggcgggag

SEQ ID NO: 1098417 - RNA, 21 nt, Mycobacterium bovis subsp bovis AF2122/97
gcgacguugguugcguccgcc

SEQ ID NO: 1098418 - RNA, 23 nt, Mycobacterium bovis subsp bovis AF2122/97
gcgacguugguugcguccgccga

SEQ ID NO: 1098419 - RNA, 15 nt, Mycobacterium bovis subsp bovis AF2122/97
gcgacggcgucaccc

SEQ ID NO: 1098420 - RNA, 16 nt, Mycobacterium bovis subsp bovis AF2122/97
gcgacggcgucacccg

SEQ ID NO: 1098421 - RNA, 14 nt, Mycobacterium bovis subsp bovis AF2122/97
gcgacgggccgcga

SEQ ID NO: 1098422 - RNA, 21 nt, Mycobacterium bovis subsp bovis AF2122/97
gcgacggucccggcacgucga

SEQ ID NO: 1098423 - RNA, 21 nt, Mycobacterium bovis subsp bovis AF2122/97
gcgacggccaagaucggcgcc

SEQ ID NO: 1098424 - RNA, 21 nt, Mycobacterium bovis subsp bovis AF2122/97
gcgacggucccuucgucaccg

SEQ ID NO: 1098425 - RNA, 19 nt, Mycobacterium bovis subsp bovis AF2122/97
gcgacggccaagaucggcg

SEQ ID NO: 1098426 - RNA, 21 nt, Mycobacterium bovis subsp bovis AF2122/97
gcgacggcauguaccgaccgc

SEQ ID NO: 1098427 - RNA, 14 nt, Mycobacterium bovis subsp bovis AF2122/97
gcgacggcaacguc

SEQ ID NO: 1098428 - RNA, 20 nt, Mycobacterium bovis subsp bovis AF2122/97
gcgacggcaagcacgguggc

SEQ ID NO: 1098429 - RNA, 23 nt, Mycobacterium bovis subsp bovis AF2122/97
gcgacggcaagcacgguggccga

SEQ ID NO: 1098430 - RNA, 22 nt, Mycobacterium bovis subsp bovis AF2122/97
gcgacggcagcucggggcacaa

SEQ ID NO: 1098431 - RNA, 21 nt, Mycobacterium bovis subsp bovis AF2122/97
gcgacggcaggcucgggcaag

SEQ ID NO: 1098432 - RNA, 19 nt, Mycobacterium bovis subsp bovis AF2122/97
gcgaccuggucgcuggugc

SEQ ID NO: 1098433 - RNA, 16 nt, Mycobacterium bovis subsp bovis AF2122/97
gcgaccugccggaccg

SEQ ID NO: 1098434 - RNA, 20 nt, Mycobacterium bovis subsp bovis AF2122/97
gcgaccugccggaccgcgga

SEQ ID NO: 1098435 - RNA, 18 nt, Mycobacterium bovis subsp bovis AF2122/97
gcgaccgucgucaccgcg

SEQ ID NO: 1098436 - RNA, 22 nt, Mycobacterium bovis subsp bovis AF2122/97
gcgaccgucgucaccgcgacgg

SEQ ID NO: 1098437 - RNA, 15 nt, Mycobacterium bovis subsp bovis AF2122/97
gcgaccgucguccag

SEQ ID NO: 1098438 - RNA, 22 nt, Mycobacterium bovis subsp bovis AF2122/97
gcgaccgucagggucaccugcg

SEQ ID NO: 1098439 - RNA, 17 nt, Mycobacterium bovis subsp bovis AF2122/97
gcgaccgucccagcgcc

SEQ ID NO: 1098440 - RNA, 21 nt, Mycobacterium bovis subsp bovis AF2122/97
gcgaccgucccagcgccgcag

SEQ ID NO: 1098441 - RNA, 16 nt, Mycobacterium bovis subsp bovis AF2122/97
gcgaccggucugaucg

SEQ ID NO: 1098442 - RNA, 19 nt, Mycobacterium bovis subsp bovis AF2122/97
gcgaccggucugaucggcu

SEQ ID NO: 1098443 - RNA, 20 nt, Mycobacterium bovis subsp bovis AF2122/97
gcgaccggucugaucggcuu

SEQ ID NO: 1098444 - RNA, 15 nt, Mycobacterium bovis subsp bovis AF2122/97
gcgaccgguucggcg

SEQ ID NO: 1098445 - RNA, 16 nt, Mycobacterium bovis subsp bovis AF2122/97
gcgaccggggaucggg

SEQ ID NO: 1098446 - RNA, 15 nt, Mycobacterium bovis subsp bovis AF2122/97
gcgaccggguccggc

SEQ ID NO: 1098447 - RNA, 20 nt, Mycobacterium bovis subsp bovis AF2122/97
gcgaccggcuccggacaccc

SEQ ID NO: 1098448 - RNA, 14 nt, Mycobacterium bovis subsp bovis AF2122/97
gcgaccgggaucgg

SEQ ID NO: 1098449 - RNA, 20 nt, Mycobacterium bovis subsp bovis AF2122/97
gcgaccgguaauccguugcc

SEQ ID NO: 1098450 - RNA, 19 nt, Mycobacterium bovis subsp bovis AF2122/97
gcgaccuccggaaucgccc

SEQ ID NO: 1098451 - RNA, 13 nt, Mycobacterium bovis subsp bovis AF2122/97
gcgaccucgccgc

SEQ ID NO: 1098452 - RNA, 16 nt, Mycobacterium bovis subsp bovis AF2122/97
gcgaccucgccgcggc

SEQ ID NO: 1098453 - RNA, 18 nt, Mycobacterium bovis subsp bovis AF2122/97
gcgaccucgccgcggcgg

SEQ ID NO: 1098454 - RNA, 18 nt, Mycobacterium bovis subsp bovis AF2122/97
gcgaccucgcuggccgca

SEQ ID NO: 1098455 - RNA, 19 nt, Mycobacterium bovis subsp bovis AF2122/97
gcgaccucgcuggccgcac

SEQ ID NO: 1098456 - RNA, 21 nt, Mycobacterium bovis subsp bovis AF2122/97
gcgaccuagcagcgcugcgau

SEQ ID NO: 1098457 - RNA, 13 nt, Mycobacterium bovis subsp bovis AF2122/97
gcgaccucacgaa

SEQ ID NO: 1098458 - RNA, 17 nt, Mycobacterium bovis subsp bovis AF2122/97
gcgaccgucguccagac

SEQ ID NO: 1098459 - RNA, 14 nt, Mycobacterium bovis subsp bovis AF2122/97
gcgaccucacugcg

SEQ ID NO: 1098460 - RNA, 18 nt, Mycobacterium bovis subsp bovis AF2122/97
gcgaccucacugcggcgc

SEQ ID NO: 1098461 - RNA, 19 nt, Mycobacterium bovis subsp bovis AF2122/97
gcgaccucacugcggcgcc

SEQ ID NO: 1098462 - RNA, 24 nt, Mycobacterium bovis subsp bovis AF2122/97
gcgaccgucuggaguucgucaccg

SEQ ID NO: 1098463 - RNA, 16 nt, Mycobacterium bovis subsp bovis AF2122/97
gcgaccuccggaaucg

SEQ ID NO: 1098464 - RNA, 13 nt, Mycobacterium bovis subsp bovis AF2122/97
gcgaccgcgaugg

SEQ ID NO: 1098465 - RNA, 17 nt, Mycobacterium bovis subsp bovis AF2122/97
gcgaccgcgaugguggu

SEQ ID NO: 1098466 - RNA, 23 nt, Mycobacterium bovis subsp bovis AF2122/97
gcgaccgcgcacggcuggcguac

SEQ ID NO: 1098467 - RNA, 14 nt, Mycobacterium bovis subsp bovis AF2122/97
gcgaccgccugcgc

SEQ ID NO: 1098468 - RNA, 14 nt, Mycobacterium bovis subsp bovis AF2122/97
gcgaccgcgaccgc

SEQ ID NO: 1098469 - RNA, 12 nt, Mycobacterium bovis subsp bovis AF2122/97
gcgaccgcggcc

SEQ ID NO: 1098470 - RNA, 15 nt, Mycobacterium bovis subsp bovis AF2122/97
gcgaccgcggccccg

SEQ ID NO: 1098471 - RNA, 17 nt, Mycobacterium bovis subsp bovis AF2122/97
gcgaccgcgucguccca

SEQ ID NO: 1098472 - RNA, 17 nt, Mycobacterium bovis subsp bovis AF2122/97
gcgaccgcugagguauu

SEQ ID NO: 1098473 - RNA, 14 nt, Mycobacterium bovis subsp bovis AF2122/97
gcgaccgcggucgc

SEQ ID NO: 1098474 - RNA, 17 nt, Mycobacterium bovis subsp bovis AF2122/97
gcgaccgcggucgcugc

SEQ ID NO: 1098475 - RNA, 15 nt, Mycobacterium bovis subsp bovis AF2122/97
gcgaccggccggccg

SEQ ID NO: 1098476 - RNA, 17 nt, Mycobacterium bovis subsp bovis AF2122/97
gcgaccggccggccgcg

SEQ ID NO: 1098477 - RNA, 14 nt, Mycobacterium bovis subsp bovis AF2122/97
gcgaccggcgaccg

SEQ ID NO: 1098478 - RNA, 18 nt, Mycobacterium bovis subsp bovis AF2122/97
gcgaccggcgagcccgca

SEQ ID NO: 1098479 - RNA, 22 nt, Mycobacterium bovis subsp bovis AF2122/97
gcgaccggcgagcccgcaucgc

SEQ ID NO: 1098480 - RNA, 15 nt, Mycobacterium bovis subsp bovis AF2122/97
gcgacccaaaaugcc

SEQ ID NO: 1098481 - RNA, 14 nt, Mycobacterium bovis subsp bovis AF2122/97
gcgaccaucucgac

SEQ ID NO: 1098482 - RNA, 22 nt, Mycobacterium bovis subsp bovis AF2122/97
gcgaccaucucgacgucgguga

SEQ ID NO: 1098483 - RNA, 15 nt, Mycobacterium bovis subsp bovis AF2122/97
gcgaccaggucgcca

SEQ ID NO: 1098484 - RNA, 16 nt, Mycobacterium bovis subsp bovis AF2122/97
gcgaccaggucgccag

SEQ ID NO: 1098485 - RNA, 22 nt, Mycobacterium bovis subsp bovis AF2122/97
gcgaccaggucgccagcucggc

SEQ ID NO: 1098486 - RNA, 18 nt, Mycobacterium bovis subsp bovis AF2122/97
gcgaccaggucggcuucg

SEQ ID NO: 1098487 - RNA, 19 nt, Mycobacterium bovis subsp bovis AF2122/97
gcgaccauaaaccgcugcu

SEQ ID NO: 1098488 - RNA, 17 nt, Mycobacterium bovis subsp bovis AF2122/97
gcgaccaggcgcggcga

SEQ ID NO: 1098489 - RNA, 22 nt, Mycobacterium bovis subsp bovis AF2122/97
gcgaccaugcuccuaucacugg

SEQ ID NO: 1098490 - RNA, 13 nt, Mycobacterium bovis subsp bovis AF2122/97
gcgaccagcgccg

SEQ ID NO: 1098491 - RNA, 14 nt, Mycobacterium bovis subsp bovis AF2122/97
gcgaccagcgccgc

SEQ ID NO: 1098492 - RNA, 14 nt, Mycobacterium bovis subsp bovis AF2122/97
gcgaccagccgagc

SEQ ID NO: 1098493 - RNA, 16 nt, Mycobacterium bovis subsp bovis AF2122/97
gcgaccagcuggccgu

SEQ ID NO: 1098494 - RNA, 18 nt, Mycobacterium bovis subsp bovis AF2122/97
gcgaccagaaucucgccg

SEQ ID NO: 1098495 - RNA, 14 nt, Mycobacterium bovis subsp bovis AF2122/97
gcgaccagaaucuc

SEQ ID NO: 1098496 - RNA, 14 nt, Mycobacterium bovis subsp bovis AF2122/97
gcgacaucgguggc

SEQ ID NO: 1098497 - RNA, 23 nt, Mycobacterium bovis subsp bovis AF2122/97
gcgacaucgguggcggccuccga

SEQ ID NO: 1098498 - RNA, 22 nt, Mycobacterium bovis subsp bovis AF2122/97
gcgacaugucgaacgcccccca

SEQ ID NO: 1098499 - RNA, 15 nt, Mycobacterium bovis subsp bovis AF2122/97
gcgaccacgucggcg

SEQ ID NO: 1098500 - RNA, 18 nt, Mycobacterium bovis subsp bovis AF2122/97
gcgaccacggcaccgauc

SEQ ID NO: 1098501 - RNA, 22 nt, Mycobacterium bovis subsp bovis AF2122/97
gcgaccacggcaccgaucaacg

SEQ ID NO: 1098502 - RNA, 14 nt, Mycobacterium bovis subsp bovis AF2122/97
gcgaccacgcaccg

SEQ ID NO: 1098503 - RNA, 17 nt, Mycobacterium bovis subsp bovis AF2122/97
gcgaccacgcaccgccc

SEQ ID NO: 1098504 - RNA, 13 nt, Mycobacterium bovis subsp bovis AF2122/97
gcgaccacgccgc

SEQ ID NO: 1098505 - RNA, 16 nt, Mycobacterium bovis subsp bovis AF2122/97
gcgaccacgccgccgg

SEQ ID NO: 1098506 - RNA, 17 nt, Mycobacterium bovis subsp bovis AF2122/97
gcgaccacgccgccggc

SEQ ID NO: 1098507 - RNA, 19 nt, Mycobacterium bovis subsp bovis AF2122/97
gcgaccacgccgccggcgc

SEQ ID NO: 1098508 - RNA, 20 nt, Mycobacterium bovis subsp bovis AF2122/97
gcgaccacgccgccggcgcu

SEQ ID NO: 1098509 - RNA, 15 nt, Mycobacterium bovis subsp bovis AF2122/97
gcgaccacggcaccg

SEQ ID NO: 1098510 - RNA, 15 nt, Mycobacterium bovis subsp bovis AF2122/97
gcgacaucgggaaug

SEQ ID NO: 1098511 - RNA, 16 nt, Mycobacterium bovis subsp bovis AF2122/97
gcgacaucgagaucgc

SEQ ID NO: 1098512 - RNA, 19 nt, Mycobacterium bovis subsp bovis AF2122/97
gcgacaucgagaucgccgu

SEQ ID NO: 1098513 - RNA, 13 nt, Mycobacterium bovis subsp bovis AF2122/97
gcgacaucgguca

SEQ ID NO: 1098514 - RNA, 17 nt, Mycobacterium bovis subsp bovis AF2122/97
gcgacauccacaccgcg

SEQ ID NO: 1098515 - RNA, 14 nt, Mycobacterium bovis subsp bovis AF2122/97
gcgacauccgcggc

SEQ ID NO: 1098516 - RNA, 17 nt, Mycobacterium bovis subsp bovis AF2122/97
gcgacauccgcggcaug

SEQ ID NO: 1098517 - RNA, 22 nt, Mycobacterium bovis subsp bovis AF2122/97
gcgacaucaccaccgaccugga

SEQ ID NO: 1098518 - RNA, 14 nt, Mycobacterium bovis subsp bovis AF2122/97
gcgacaucaccgaa

SEQ ID NO: 1098519 - RNA, 16 nt, Mycobacterium bovis subsp bovis AF2122/97
gcgacagccguggcgc

SEQ ID NO: 1098520 - RNA, 14 nt, Mycobacterium bovis subsp bovis AF2122/97
gcgacauacccgau

SEQ ID NO: 1098521 - RNA, 16 nt, Mycobacterium bovis subsp bovis AF2122/97
gcgacagacagcaccg

SEQ ID NO: 1098522 - RNA, 15 nt, Mycobacterium bovis subsp bovis AF2122/97
gcgacagcagcgcca

SEQ ID NO: 1098523 - RNA, 13 nt, Mycobacterium bovis subsp bovis AF2122/97
gcgacagccaccu

SEQ ID NO: 1098524 - RNA, 17 nt, Mycobacterium bovis subsp bovis AF2122/97
gcgacagccaccucgac

SEQ ID NO: 1098525 - RNA, 19 nt, Mycobacterium bovis subsp bovis AF2122/97
gcgacagccaccucgacgg

SEQ ID NO: 1098526 - RNA, 17 nt, Mycobacterium bovis subsp bovis AF2122/97
gcgacagcagcgccacc

SEQ ID NO: 1098527 - RNA, 13 nt, Mycobacterium bovis subsp bovis AF2122/97
gcgacacgccagc

SEQ ID NO: 1098528 - RNA, 15 nt, Mycobacterium bovis subsp bovis AF2122/97
gcgacacgccagccg

SEQ ID NO: 1098529 - RNA, 21 nt, Mycobacterium bovis subsp bovis AF2122/97
gcgacaacccggcgucgacga

SEQ ID NO: 1098530 - RNA, 22 nt, Mycobacterium bovis subsp bovis AF2122/97
gcgacaacaccacggugccgac

SEQ ID NO: 1098531 - RNA, 23 nt, Mycobacterium bovis subsp bovis AF2122/97
gcgacaacaccacggugccgacg

SEQ ID NO: 1098532 - RNA, 23 nt, Mycobacterium bovis subsp bovis AF2122/97
gcgacaacacgaccucuugggca

SEQ ID NO: 1098533 - RNA, 14 nt, Mycobacterium bovis subsp bovis AF2122/97
gcgacaacaccacg

SEQ ID NO: 1098534 - RNA, 16 nt, Mycobacterium bovis subsp bovis AF2122/97
gcgacaacaccacggu

SEQ ID NO: 1098535 - RNA, 21 nt, Mycobacterium bovis subsp bovis AF2122/97
gcgacaacaccacggugccga

SEQ ID NO: 1098536 - RNA, 19 nt, Mycobacterium bovis subsp bovis AF2122/97
gcgacaaaucggucgacga

SEQ ID NO: 1098537 - RNA, 18 nt, Mycobacterium bovis subsp bovis AF2122/97
gcgaaguacccggcaaac

SEQ ID NO: 1098538 - RNA, 19 nt, Mycobacterium bovis subsp bovis AF2122/97
gcgaagggcaccggcgauc

SEQ ID NO: 1098539 - RNA, 21 nt, Mycobacterium bovis subsp bovis AF2122/97
gcgaagggcaccggcgaucgu

SEQ ID NO: 1098540 - RNA, 23 nt, Mycobacterium bovis subsp bovis AF2122/97
gcgaaggguaagaguucgcgcgc

SEQ ID NO: 1098541 - RNA, 14 nt, Mycobacterium bovis subsp bovis AF2122/97
gcgaagguaguacu

SEQ ID NO: 1098542 - RNA, 17 nt, Mycobacterium bovis subsp bovis AF2122/97
gcgaagguccgugccga

SEQ ID NO: 1098543 - RNA, 17 nt, Mycobacterium bovis subsp bovis AF2122/97
gcgaagucgagugccgc

SEQ ID NO: 1098544 - RNA, 16 nt, Mycobacterium bovis subsp bovis AF2122/97
gcgaaguacgacgacc

SEQ ID NO: 1098545 - RNA, 18 nt, Mycobacterium bovis subsp bovis AF2122/97
gcgaaguacgacgacccg

SEQ ID NO: 1098546 - RNA, 22 nt, Mycobacterium bovis subsp bovis AF2122/97
gcgaaguggaucuggcgcagca

SEQ ID NO: 1098547 - RNA, 23 nt, Mycobacterium bovis subsp bovis AF2122/97
gcgaagugucgcugcaaccgccg

SEQ ID NO: 1098548 - RNA, 20 nt, Mycobacterium bovis subsp bovis AF2122/97
gcgaagugcgcgcuggaucg

SEQ ID NO: 1098549 - RNA, 21 nt, Mycobacterium bovis subsp bovis AF2122/97
gcgaagcuguagaccuggccg

SEQ ID NO: 1098550 - RNA, 13 nt, Mycobacterium bovis subsp bovis AF2122/97
gcgaaggccagca

SEQ ID NO: 1098551 - RNA, 18 nt, Mycobacterium bovis subsp bovis AF2122/97
gcgaagcugugcccggcg

SEQ ID NO: 1098552 - RNA, 19 nt, Mycobacterium bovis subsp bovis AF2122/97
gcgaagcugugcccggcgc

SEQ ID NO: 1098553 - RNA, 17 nt, Mycobacterium bovis subsp bovis AF2122/97
gcgaagggcaccggcga

SEQ ID NO: 1098554 - RNA, 16 nt, Mycobacterium bovis subsp bovis AF2122/97
gccuuguugccgccgg

SEQ ID NO: 1098555 - RNA, 17 nt, Mycobacterium bovis subsp bovis AF2122/97
gccuuguugccgccggc

SEQ ID NO: 1098556 - RNA, 19 nt, Mycobacterium bovis subsp bovis AF2122/97
gcgaaggauuugauaggcg

SEQ ID NO: 1098557 - RNA, 15 nt, Mycobacterium bovis subsp bovis AF2122/97
gccuugucggcgaug

SEQ ID NO: 1098558 - RNA, 17 nt, Mycobacterium bovis subsp bovis AF2122/97
gccuugugcucgaugcg

SEQ ID NO: 1098559 - RNA, 16 nt, Mycobacterium bovis subsp bovis AF2122/97
gccuuguucgcccaca

SEQ ID NO: 1098560 - RNA, 13 nt, Mycobacterium bovis subsp bovis AF2122/97
gccuugggcggca

SEQ ID NO: 1098561 - RNA, 15 nt, Mycobacterium bovis subsp bovis AF2122/97
gccuugggcggcacu

SEQ ID NO: 1098562 - RNA, 22 nt, Mycobacterium bovis subsp bovis AF2122/97
gccuugggcguacucggcgcgc

SEQ ID NO: 1098563 - RNA, 23 nt, Mycobacterium bovis subsp bovis AF2122/97
gccuugggcguacucggcgcgca

SEQ ID NO: 1098564 - RNA, 23 nt, Mycobacterium bovis subsp bovis AF2122/97
gccuugguagccggccgcuuggc

SEQ ID NO: 1098565 - RNA, 16 nt, Mycobacterium bovis subsp bovis AF2122/97
gccuuggucgccgccu

SEQ ID NO: 1098566 - RNA, 16 nt, Mycobacterium bovis subsp bovis AF2122/97
gcgaauccggcgggug

SEQ ID NO: 1098567 - RNA, 15 nt, Mycobacterium bovis subsp bovis AF2122/97
gcgaauccgcacagg

SEQ ID NO: 1098568 - RNA, 22 nt, Mycobacterium bovis subsp bovis AF2122/97
gcgaauccagccgcgcgccggc

SEQ ID NO: 1098569 - RNA, 15 nt, Mycobacterium bovis subsp bovis AF2122/97
gcgaaguugcgcgac

SEQ ID NO: 1098570 - RNA, 17 nt, Mycobacterium bovis subsp bovis AF2122/97
gcgaauauagcggcguu

SEQ ID NO: 1098571 - RNA, 19 nt, Mycobacterium bovis subsp bovis AF2122/97
gcgaaucacguggaccacg

SEQ ID NO: 1098572 - RNA, 23 nt, Mycobacterium bovis subsp bovis AF2122/97
gcgaaugcgggccuccugcuggc

SEQ ID NO: 1098573 - RNA, 17 nt, Mycobacterium bovis subsp bovis AF2122/97
gcgaaucgcgacgcgac

SEQ ID NO: 1098574 - RNA, 16 nt, Mycobacterium bovis subsp bovis AF2122/97
gcgaaucgcgucgagc

SEQ ID NO: 1098575 - RNA, 21 nt, Mycobacterium bovis subsp bovis AF2122/97
gcgaauucgaccacucgccgc

SEQ ID NO: 1098576 - RNA, 16 nt, Mycobacterium bovis subsp bovis AF2122/97
gcgcgcagccgggcca

SEQ ID NO: 1098577 - RNA, 22 nt, Mycobacterium bovis subsp bovis AF2122/97
gcgcgcagcaguuggucgcggu

SEQ ID NO: 1098578 - RNA, 16 nt, Mycobacterium bovis subsp bovis AF2122/97
gcgcgcaggccgccgc

SEQ ID NO: 1098579 - RNA, 17 nt, Mycobacterium bovis subsp bovis AF2122/97
gcgcgccagcucggcgg

SEQ ID NO: 1098580 - RNA, 19 nt, Mycobacterium bovis subsp bovis AF2122/97
gcgcgccagaacgacaccg

SEQ ID NO: 1098581 - RNA, 14 nt, Mycobacterium bovis subsp bovis AF2122/97
gcgcgaugcuggcg

SEQ ID NO: 1098582 - RNA, 20 nt, Mycobacterium bovis subsp bovis AF2122/97
gcgcgaugcuggcgaacucg

SEQ ID NO: 1098583 - RNA, 20 nt, Mycobacterium bovis subsp bovis AF2122/97
gcgcgaugggagcccggcgg

SEQ ID NO: 1098584 - RNA, 21 nt, Mycobacterium bovis subsp bovis AF2122/97
gcgcgaugggagcccggcggc

SEQ ID NO: 1098585 - RNA, 12 nt, Mycobacterium bovis subsp bovis AF2122/97
gcgcgaugucgc

SEQ ID NO: 1098586 - RNA, 21 nt, Mycobacterium bovis subsp bovis AF2122/97
gcgcgcaacccugccgcgaug

SEQ ID NO: 1098587 - RNA, 19 nt, Mycobacterium bovis subsp bovis AF2122/97
gcgcgaugucguucgcguc

SEQ ID NO: 1098588 - RNA, 15 nt, Mycobacterium bovis subsp bovis AF2122/97
gcgcgauagauaccc

SEQ ID NO: 1098589 - RNA, 16 nt, Mycobacterium bovis subsp bovis AF2122/97
gcgcgcagaugagcgc

SEQ ID NO: 1098590 - RNA, 15 nt, Mycobacterium bovis subsp bovis AF2122/97
gcgcgcaaccgcuca

SEQ ID NO: 1098591 - RNA, 15 nt, Mycobacterium bovis subsp bovis AF2122/97
gcgcgcaaccgcuga

SEQ ID NO: 1098592 - RNA, 17 nt, Mycobacterium bovis subsp bovis AF2122/97
gcgcgaguaagcgaaca

SEQ ID NO: 1098593 - RNA, 18 nt, Mycobacterium bovis subsp bovis AF2122/97
gcgcgauacagacgggga

SEQ ID NO: 1098594 - RNA, 17 nt, Mycobacterium bovis subsp bovis AF2122/97
gcgcgaggaacgccggg

SEQ ID NO: 1098595 - RNA, 23 nt, Mycobacterium bovis subsp bovis AF2122/97
gcgcgaggaacgccggggcgaug

SEQ ID NO: 1098596 - RNA, 17 nt, Mycobacterium bovis subsp bovis AF2122/97
gcgcgacagccguggcg

SEQ ID NO: 1098597 - RNA, 16 nt, Mycobacterium bovis subsp bovis AF2122/97
gcgcgaauggcggaca

SEQ ID NO: 1098598 - RNA, 23 nt, Mycobacterium bovis subsp bovis AF2122/97
gcgcgacagacagcaccgccggu

SEQ ID NO: 1098599 - RNA, 21 nt, Mycobacterium bovis subsp bovis AF2122/97
gcgcgacaaaguucgacgaga

SEQ ID NO: 1098600 - RNA, 23 nt, Mycobacterium bovis subsp bovis AF2122/97
gcgcgacaacccggcgucgacga

SEQ ID NO: 1098601 - RNA, 12 nt, Mycobacterium bovis subsp bovis AF2122/97
gcgcgaucgucg

SEQ ID NO: 1098602 - RNA, 18 nt, Mycobacterium bovis subsp bovis AF2122/97
gcgcgaucgggccggcgc

SEQ ID NO: 1098603 - RNA, 15 nt, Mycobacterium bovis subsp bovis AF2122/97
gcgcgaucgcgguca

SEQ ID NO: 1098604 - RNA, 20 nt, Mycobacterium bovis subsp bovis AF2122/97
gcgcgaucgauuccgcucgu

SEQ ID NO: 1098605 - RNA, 16 nt, Mycobacterium bovis subsp bovis AF2122/97
gcgcgaugcccacgca

SEQ ID NO: 1098606 - RNA, 19 nt, Mycobacterium bovis subsp bovis AF2122/97
gcgcgaucccaacgcccgg

SEQ ID NO: 1098607 - RNA, 21 nt, Mycobacterium bovis subsp bovis AF2122/97
gcgcgauccccgcgcugagca

SEQ ID NO: 1098608 - RNA, 21 nt, Mycobacterium bovis subsp bovis AF2122/97
gcgcgaucaccgagucgacgg

SEQ ID NO: 1098609 - RNA, 17 nt, Mycobacterium bovis subsp bovis AF2122/97
gcgcgaucaacgcguug

SEQ ID NO: 1098610 - RNA, 13 nt, Mycobacterium bovis subsp bovis AF2122/97
gcgcgaucaccga

SEQ ID NO: 1098611 - RNA, 15 nt, Mycobacterium bovis subsp bovis AF2122/97
gcgccgugcgaucgu

SEQ ID NO: 1098612 - RNA, 16 nt, Mycobacterium bovis subsp bovis AF2122/97
gcgccgugcgaucguc

SEQ ID NO: 1098613 - RNA, 21 nt, Mycobacterium bovis subsp bovis AF2122/97
gcgccguggacgaucaacccg

SEQ ID NO: 1098614 - RNA, 13 nt, Mycobacterium bovis subsp bovis AF2122/97
gcgccguggauca

SEQ ID NO: 1098615 - RNA, 18 nt, Mycobacterium bovis subsp bovis AF2122/97
gcgccugacucaucaccg

SEQ ID NO: 1098616 - RNA, 18 nt, Mycobacterium bovis subsp bovis AF2122/97
gcgccugaugcggccggc

SEQ ID NO: 1098617 - RNA, 21 nt, Mycobacterium bovis subsp bovis AF2122/97
gcgccgucucgaucgcgguag

SEQ ID NO: 1098618 - RNA, 15 nt, Mycobacterium bovis subsp bovis AF2122/97
gcgccgucucgcggu

SEQ ID NO: 1098619 - RNA, 16 nt, Mycobacterium bovis subsp bovis AF2122/97
gcgccgucucgcggug

SEQ ID NO: 1098620 - RNA, 17 nt, Mycobacterium bovis subsp bovis AF2122/97
gcgccgucucgcggugc

SEQ ID NO: 1098621 - RNA, 15 nt, Mycobacterium bovis subsp bovis AF2122/97
gcgccgucucugcca

SEQ ID NO: 1098622 - RNA, 21 nt, Mycobacterium bovis subsp bovis AF2122/97
gcgccgucucugccacgcguu

SEQ ID NO: 1098623 - RNA, 17 nt, Mycobacterium bovis subsp bovis AF2122/97
gcgccugagcggccucg

SEQ ID NO: 1098624 - RNA, 14 nt, Mycobacterium bovis subsp bovis AF2122/97
gcgccugcgccacc

SEQ ID NO: 1098625 - RNA, 15 nt, Mycobacterium bovis subsp bovis AF2122/97
gcgcgaaaccgcaug

SEQ ID NO: 1098626 - RNA, 15 nt, Mycobacterium bovis subsp bovis AF2122/97
gcgcgaaccgcuccg

SEQ ID NO: 1098627 - RNA, 14 nt, Mycobacterium bovis subsp bovis AF2122/97
gcgcgaacggcggu

SEQ ID NO: 1098628 - RNA, 12 nt, Mycobacterium bovis subsp bovis AF2122/97
gcgcgaacguca

SEQ ID NO: 1098629 - RNA, 21 nt, Mycobacterium bovis subsp bovis AF2122/97
gcgcgaagucuugaccgcacc

SEQ ID NO: 1098630 - RNA, 15 nt, Mycobacterium bovis subsp bovis AF2122/97
gcgcgaaggucagcg

SEQ ID NO: 1098631 - RNA, 19 nt, Mycobacterium bovis subsp bovis AF2122/97
gcgcgaaccugcucggcgc

SEQ ID NO: 1098632 - RNA, 21 nt, Mycobacterium bovis subsp bovis AF2122/97
gcgcgaaccugcucggcgcgc

SEQ ID NO: 1098633 - RNA, 17 nt, Mycobacterium bovis subsp bovis AF2122/97
gcgcgaaccccagccga

SEQ ID NO: 1098634 - RNA, 16 nt, Mycobacterium bovis subsp bovis AF2122/97
gcgcgaacgucaaccg

SEQ ID NO: 1098635 - RNA, 18 nt, Mycobacterium bovis subsp bovis AF2122/97
gcgcgaaccccagccgau

SEQ ID NO: 1098636 - RNA, 22 nt, Mycobacterium bovis subsp bovis AF2122/97
gcgcgaacgucagugccccgca

SEQ ID NO: 1098637 - RNA, 16 nt, Mycobacterium bovis subsp bovis AF2122/97
gcgcgaagccaccagg

SEQ ID NO: 1098638 - RNA, 16 nt, Mycobacterium bovis subsp bovis AF2122/97
gcgccuuuggcgguga

SEQ ID NO: 1098639 - RNA, 16 nt, Mycobacterium bovis subsp bovis AF2122/97
gcgcgaaagcgccgaa

SEQ ID NO: 1098640 - RNA, 13 nt, Mycobacterium bovis subsp bovis AF2122/97
gcgcgaacacccg

SEQ ID NO: 1098641 - RNA, 23 nt, Mycobacterium bovis subsp bovis AF2122/97
gcgccuuugagcccgcgaucacc

SEQ ID NO: 1098642 - RNA, 15 nt, Mycobacterium bovis subsp bovis AF2122/97
gcgccuuugcccgau

SEQ ID NO: 1098643 - RNA, 16 nt, Mycobacterium bovis subsp bovis AF2122/97
gcgcgaaaccagucca

SEQ ID NO: 1098644 - RNA, 21 nt, Mycobacterium bovis subsp bovis AF2122/97
gcgcgaaaccaguccaucgac

SEQ ID NO: 1098645 - RNA, 21 nt, Mycobacterium bovis subsp bovis AF2122/97
gcgccuuguggcacacccgca

SEQ ID NO: 1098646 - RNA, 22 nt, Mycobacterium bovis subsp bovis AF2122/97
gcgccuuguggcacacccgcac

SEQ ID NO: 1098647 - RNA, 23 nt, Mycobacterium bovis subsp bovis AF2122/97
gcgccuuguggcacacccgcacc

SEQ ID NO: 1098648 - RNA, 13 nt, Mycobacterium bovis subsp bovis AF2122/97
gcgccgcccgcgc

SEQ ID NO: 1098649 - RNA, 14 nt, Mycobacterium bovis subsp bovis AF2122/97
gcgccgcccgcgcc

SEQ ID NO: 1098650 - RNA, 17 nt, Mycobacterium bovis subsp bovis AF2122/97
gcgccgcccgcgccacc

SEQ ID NO: 1098651 - RNA, 14 nt, Mycobacterium bovis subsp bovis AF2122/97
gcgccgcccaacgc

SEQ ID NO: 1098652 - RNA, 18 nt, Mycobacterium bovis subsp bovis AF2122/97
gcgccgcccaauccaccg

SEQ ID NO: 1098653 - RNA, 21 nt, Mycobacterium bovis subsp bovis AF2122/97
gcgccgcccgcgccaccagca

SEQ ID NO: 1098654 - RNA, 17 nt, Mycobacterium bovis subsp bovis AF2122/97
gcgccgccccgcucggu

SEQ ID NO: 1098655 - RNA, 23 nt, Mycobacterium bovis subsp bovis AF2122/97
gcgccgcccgcuccuccggcacc

SEQ ID NO: 1098656 - RNA, 18 nt, Mycobacterium bovis subsp bovis AF2122/97
gcgccgcccgcgcccccg

SEQ ID NO: 1098657 - RNA, 19 nt, Mycobacterium bovis subsp bovis AF2122/97
gcgccgcccgcgccgccgc

SEQ ID NO: 1098658 - RNA, 12 nt, Mycobacterium bovis subsp bovis AF2122/97
gcgccgccgagg

SEQ ID NO: 1098659 - RNA, 16 nt, Mycobacterium bovis subsp bovis AF2122/97
gcgccgccgccaccac

SEQ ID NO: 1098660 - RNA, 20 nt, Mycobacterium bovis subsp bovis AF2122/97
gcgccgcccuugccgccggc

SEQ ID NO: 1098661 - RNA, 10 nt, Mycobacterium bovis subsp bovis AF2122/97
gcgccgccgc

SEQ ID NO: 1098662 - RNA, 16 nt, Mycobacterium bovis subsp bovis AF2122/97
gcgccgccgccgacga

SEQ ID NO: 1098663 - RNA, 13 nt, Mycobacterium bovis subsp bovis AF2122/97
gcgccgccgccga

SEQ ID NO: 1098664 - RNA, 20 nt, Mycobacterium bovis subsp bovis AF2122/97
gcgccgccggacccaccguc

SEQ ID NO: 1098665 - RNA, 15 nt, Mycobacterium bovis subsp bovis AF2122/97
gcgccgccggcaccc

SEQ ID NO: 1098666 - RNA, 18 nt, Mycobacterium bovis subsp bovis AF2122/97
gcgccgccggcacccgcc

SEQ ID NO: 1098667 - RNA, 11 nt, Mycobacterium bovis subsp bovis AF2122/97
gcgccgccgcg

SEQ ID NO: 1098668 - RNA, 12 nt, Mycobacterium bovis subsp bovis AF2122/97
gcgccgccgcga

SEQ ID NO: 1098669 - RNA, 13 nt, Mycobacterium bovis subsp bovis AF2122/97
gcgccgccgcgag

SEQ ID NO: 1098670 - RNA, 20 nt, Mycobacterium bovis subsp bovis AF2122/97
gcgccgccgcgagcgccggc

SEQ ID NO: 1098671 - RNA, 14 nt, Mycobacterium bovis subsp bovis AF2122/97
gcgccgccggaagc

SEQ ID NO: 1098672 - RNA, 17 nt, Mycobacterium bovis subsp bovis AF2122/97
gcgccggauccacaccg

SEQ ID NO: 1098673 - RNA, 12 nt, Mycobacterium bovis subsp bovis AF2122/97
gcgccggaugua

SEQ ID NO: 1098674 - RNA, 13 nt, Mycobacterium bovis subsp bovis AF2122/97
gcgccggcaucgc

SEQ ID NO: 1098675 - RNA, 20 nt, Mycobacterium bovis subsp bovis AF2122/97
gcgccggcaucuccaccguc

SEQ ID NO: 1098676 - RNA, 16 nt, Mycobacterium bovis subsp bovis AF2122/97
gcgccggaugacaccg

SEQ ID NO: 1098677 - RNA, 22 nt, Mycobacterium bovis subsp bovis AF2122/97
gcgccggaugacaccgaccggg

SEQ ID NO: 1098678 - RNA, 14 nt, Mycobacterium bovis subsp bovis AF2122/97
gcgccggccagcca

SEQ ID NO: 1098679 - RNA, 17 nt, Mycobacterium bovis subsp bovis AF2122/97
gcgccggccagccagcg

SEQ ID NO: 1098680 - RNA, 18 nt, Mycobacterium bovis subsp bovis AF2122/97
gcgccggccacgagucgc

SEQ ID NO: 1098681 - RNA, 13 nt, Mycobacterium bovis subsp bovis AF2122/97
gcgccggccccgg

SEQ ID NO: 1098682 - RNA, 23 nt, Mycobacterium bovis subsp bovis AF2122/97
gcgccggccaggcuauggugccg

SEQ ID NO: 1098683 - RNA, 12 nt, Mycobacterium bovis subsp bovis AF2122/97
gcgccggccagu

SEQ ID NO: 1098684 - RNA, 23 nt, Mycobacterium bovis subsp bovis AF2122/97
gcgccggccgcacgccggccagc

SEQ ID NO: 1098685 - RNA, 13 nt, Mycobacterium bovis subsp bovis AF2122/97
gcgccggccgauc

SEQ ID NO: 1098686 - RNA, 17 nt, Mycobacterium bovis subsp bovis AF2122/97
gcgccggccgaucggcc

SEQ ID NO: 1098687 - RNA, 13 nt, Mycobacterium bovis subsp bovis AF2122/97
gcgccggccggca

SEQ ID NO: 1098688 - RNA, 14 nt, Mycobacterium bovis subsp bovis AF2122/97
gcgccggccgcugc

SEQ ID NO: 1098689 - RNA, 12 nt, Mycobacterium bovis subsp bovis AF2122/97
gcgccggccgcg

SEQ ID NO: 1098690 - RNA, 14 nt, Mycobacterium bovis subsp bovis AF2122/97
gcgccggccggcgc

SEQ ID NO: 1098691 - RNA, 17 nt, Mycobacterium bovis subsp bovis AF2122/97
gcgccggccggcgcagu

SEQ ID NO: 1098692 - RNA, 12 nt, Mycobacterium bovis subsp bovis AF2122/97
gcgccggcggcc

SEQ ID NO: 1098693 - RNA, 22 nt, Mycobacterium bovis subsp bovis AF2122/97
gcgccggcgcgucggcaccgau

SEQ ID NO: 1098694 - RNA, 16 nt, Mycobacterium bovis subsp bovis AF2122/97
gcgccggcgcugcugc

SEQ ID NO: 1098695 - RNA, 17 nt, Mycobacterium bovis subsp bovis AF2122/97
gcgccggcgcugcugcc

SEQ ID NO: 1098696 - RNA, 20 nt, Mycobacterium bovis subsp bovis AF2122/97
gcgccggcgguagucggcca

SEQ ID NO: 1098697 - RNA, 14 nt, Mycobacterium bovis subsp bovis AF2122/97
gcgccggcgggcgc

SEQ ID NO: 1098698 - RNA, 21 nt, Mycobacterium bovis subsp bovis AF2122/97
gcgccggcgggcgcgggcgcc

SEQ ID NO: 1098699 - RNA, 12 nt, Mycobacterium bovis subsp bovis AF2122/97
gcgccggcguuu

SEQ ID NO: 1098700 - RNA, 18 nt, Mycobacterium bovis subsp bovis AF2122/97
gcgccggcgucggucguc

SEQ ID NO: 1098701 - RNA, 14 nt, Mycobacterium bovis subsp bovis AF2122/97
gcgccggcgugcau

SEQ ID NO: 1098702 - RNA, 22 nt, Mycobacterium bovis subsp bovis AF2122/97
gcgccggcgguagucggccagc

SEQ ID NO: 1098703 - RNA, 15 nt, Mycobacterium bovis subsp bovis AF2122/97
gcgccggcgucggcg

SEQ ID NO: 1098704 - RNA, 23 nt, Mycobacterium bovis subsp bovis AF2122/97
gcgccggcuagggcccuggcggc

SEQ ID NO: 1098705 - RNA, 15 nt, Mycobacterium bovis subsp bovis AF2122/97
gcgccggcuggcggc

SEQ ID NO: 1098706 - RNA, 20 nt, Mycobacterium bovis subsp bovis AF2122/97
gcgccggcugccacacaggc

SEQ ID NO: 1098707 - RNA, 23 nt, Mycobacterium bovis subsp bovis AF2122/97
gcgccggcuucggguguucgcgc

SEQ ID NO: 1098708 - RNA, 17 nt, Mycobacterium bovis subsp bovis AF2122/97
gcgccggggacacagcg

SEQ ID NO: 1098709 - RNA, 18 nt, Mycobacterium bovis subsp bovis AF2122/97
gcgccggggggcugcugc

SEQ ID NO: 1098710 - RNA, 22 nt, Mycobacterium bovis subsp bovis AF2122/97
gcgccggggacacagcguccgu

SEQ ID NO: 1098711 - RNA, 21 nt, Mycobacterium bovis subsp bovis AF2122/97
gcgccgggcguccgccggcga

SEQ ID NO: 1098712 - RNA, 19 nt, Mycobacterium bovis subsp bovis AF2122/97
gcgccgguccucgucggcg

SEQ ID NO: 1098713 - RNA, 20 nt, Mycobacterium bovis subsp bovis AF2122/97
gcgccgguccucgucggcga

SEQ ID NO: 1098714 - RNA, 15 nt, Mycobacterium bovis subsp bovis AF2122/97
gcgccggucgccggc

SEQ ID NO: 1098715 - RNA, 16 nt, Mycobacterium bovis subsp bovis AF2122/97
gcgccggucggaucgg

SEQ ID NO: 1098716 - RNA, 19 nt, Mycobacterium bovis subsp bovis AF2122/97
gcgccggucggaucgguga

SEQ ID NO: 1098717 - RNA, 15 nt, Mycobacterium bovis subsp bovis AF2122/97
gcgccgucagcccag

SEQ ID NO: 1098718 - RNA, 13 nt, Mycobacterium bovis subsp bovis AF2122/97
gcgccgucgccgu

SEQ ID NO: 1098719 - RNA, 19 nt, Mycobacterium bovis subsp bovis AF2122/97
gcgccgucguugugccggu

SEQ ID NO: 1098720 - RNA, 20 nt, Mycobacterium bovis subsp bovis AF2122/97
gcgccgucgucgagcaccac

SEQ ID NO: 1098721 - RNA, 23 nt, Mycobacterium bovis subsp bovis AF2122/97
gcgccgucgucgagcaccacccg

SEQ ID NO: 1098722 - RNA, 18 nt, Mycobacterium bovis subsp bovis AF2122/97
gcgccgucgucgcgcagu

SEQ ID NO: 1098723 - RNA, 19 nt, Mycobacterium bovis subsp bovis AF2122/97
gcgccgucgucgcgcagua

SEQ ID NO: 1098724 - RNA, 18 nt, Mycobacterium bovis subsp bovis AF2122/97
gcgccgucgucgagcacc

SEQ ID NO: 1098725 - RNA, 14 nt, Mycobacterium bovis subsp bovis AF2122/97
gcgccgucggcgau

SEQ ID NO: 1098726 - RNA, 14 nt, Mycobacterium bovis subsp bovis AF2122/97
gcgccgucggccga

SEQ ID NO: 1098727 - RNA, 17 nt, Mycobacterium bovis subsp bovis AF2122/97
gcgccgucggagccggc

SEQ ID NO: 1098728 - RNA, 21 nt, Mycobacterium bovis subsp bovis AF2122/97
gcgccgucggagccggccacc

SEQ ID NO: 1098729 - RNA, 14 nt, Mycobacterium bovis subsp bovis AF2122/97
gcgccgucgucagc

SEQ ID NO: 1098730 - RNA, 13 nt, Mycobacterium bovis subsp bovis AF2122/97
gcgccgucgcagc

SEQ ID NO: 1098731 - RNA, 17 nt, Mycobacterium bovis subsp bovis AF2122/97
gcgccgucgcagccagc

SEQ ID NO: 1098732 - RNA, 16 nt, Mycobacterium bovis subsp bovis AF2122/97
gcgccggugccgccgg

SEQ ID NO: 1098733 - RNA, 23 nt, Mycobacterium bovis subsp bovis AF2122/97
gcgccggugccgccuccgccugc

SEQ ID NO: 1098734 - RNA, 18 nt, Mycobacterium bovis subsp bovis AF2122/97
gcgccggugcugcgggaa

SEQ ID NO: 1098735 - RNA, 13 nt, Mycobacterium bovis subsp bovis AF2122/97
gcgccggugugcg

SEQ ID NO: 1098736 - RNA, 17 nt, Mycobacterium bovis subsp bovis AF2122/97
gcgccggugggcggucc

SEQ ID NO: 1098737 - RNA, 21 nt, Mycobacterium bovis subsp bovis AF2122/97
gcgccggugggcgguccgcgu

SEQ ID NO: 1098738 - RNA, 15 nt, Mycobacterium bovis subsp bovis AF2122/97
gcgccggugguaacg

SEQ ID NO: 1098739 - RNA, 22 nt, Mycobacterium bovis subsp bovis AF2122/97
gcgccggugguaacggcggcca

SEQ ID NO: 1098740 - RNA, 20 nt, Mycobacterium bovis subsp bovis AF2122/97
gcgccggugguaccggcggc

SEQ ID NO: 1098741 - RNA, 13 nt, Mycobacterium bovis subsp bovis AF2122/97
gcgccggucgccg

SEQ ID NO: 1098742 - RNA, 15 nt, Mycobacterium bovis subsp bovis AF2122/97
gcgccggucgccgac

SEQ ID NO: 1098743 - RNA, 18 nt, Mycobacterium bovis subsp bovis AF2122/97
gcgccggucgccgacggc

SEQ ID NO: 1098744 - RNA, 19 nt, Mycobacterium bovis subsp bovis AF2122/97
gcgccgguuacccggaccg

SEQ ID NO: 1098745 - RNA, 13 nt, Mycobacterium bovis subsp bovis AF2122/97
gcgccgguuucga

SEQ ID NO: 1098746 - RNA, 20 nt, Mycobacterium bovis subsp bovis AF2122/97
gcgccguacagcggcggcgu

SEQ ID NO: 1098747 - RNA, 23 nt, Mycobacterium bovis subsp bovis AF2122/97
gcgccguaaagccaacuggucgc

SEQ ID NO: 1098748 - RNA, 13 nt, Mycobacterium bovis subsp bovis AF2122/97
gcgccgucaacac

SEQ ID NO: 1098749 - RNA, 14 nt, Mycobacterium bovis subsp bovis AF2122/97
gcgccguagccgau

SEQ ID NO: 1098750 - RNA, 16 nt, Mycobacterium bovis subsp bovis AF2122/97
gcgccguagaccagca

SEQ ID NO: 1098751 - RNA, 14 nt, Mycobacterium bovis subsp bovis AF2122/97
gcgccgacggugca

SEQ ID NO: 1098752 - RNA, 19 nt, Mycobacterium bovis subsp bovis AF2122/97
gcgccgaucacggugggcg

SEQ ID NO: 1098753 - RNA, 23 nt, Mycobacterium bovis subsp bovis AF2122/97
gcgccgaucacggugggcgccga

SEQ ID NO: 1098754 - RNA, 16 nt, Mycobacterium bovis subsp bovis AF2122/97
gcgccgauacccagcg

SEQ ID NO: 1098755 - RNA, 22 nt, Mycobacterium bovis subsp bovis AF2122/97
gcgccgauacccagcgggucgc

SEQ ID NO: 1098756 - RNA, 17 nt, Mycobacterium bovis subsp bovis AF2122/97
gcgccgauaccggcggc

SEQ ID NO: 1098757 - RNA, 19 nt, Mycobacterium bovis subsp bovis AF2122/97
gcgccgauaccggcggcga

SEQ ID NO: 1098758 - RNA, 14 nt, Mycobacterium bovis subsp bovis AF2122/97
gcgccgacggccag

SEQ ID NO: 1098759 - RNA, 20 nt, Mycobacterium bovis subsp bovis AF2122/97
gcgccgaggucgaacgcccg

SEQ ID NO: 1098760 - RNA, 19 nt, Mycobacterium bovis subsp bovis AF2122/97
gcgccgacgacuccggcaa

SEQ ID NO: 1098761 - RNA, 21 nt, Mycobacterium bovis subsp bovis AF2122/97
gcgccgaccucaucggcaccg

SEQ ID NO: 1098762 - RNA, 13 nt, Mycobacterium bovis subsp bovis AF2122/97
gcgccgaccugga

SEQ ID NO: 1098763 - RNA, 15 nt, Mycobacterium bovis subsp bovis AF2122/97
gcgccgaacaccaca

SEQ ID NO: 1098764 - RNA, 23 nt, Mycobacterium bovis subsp bovis AF2122/97
gcgccgaacacgcacacgaucgc

SEQ ID NO: 1098765 - RNA, 16 nt, Mycobacterium bovis subsp bovis AF2122/97
gcgccgaaacagcacc

SEQ ID NO: 1098766 - RNA, 19 nt, Mycobacterium bovis subsp bovis AF2122/97
gcgccgaaaaggucgggga

SEQ ID NO: 1098767 - RNA, 16 nt, Mycobacterium bovis subsp bovis AF2122/97
gcgcccuugccggcga

SEQ ID NO: 1098768 - RNA, 19 nt, Mycobacterium bovis subsp bovis AF2122/97
gcgcccuguccuuggcgaa

SEQ ID NO: 1098769 - RNA, 14 nt, Mycobacterium bovis subsp bovis AF2122/97
gcgcccgugccgcc

SEQ ID NO: 1098770 - RNA, 18 nt, Mycobacterium bovis subsp bovis AF2122/97
gcgccgcaaccgccgcgu

SEQ ID NO: 1098771 - RNA, 13 nt, Mycobacterium bovis subsp bovis AF2122/97
gcgccgaucggca

SEQ ID NO: 1098772 - RNA, 19 nt, Mycobacterium bovis subsp bovis AF2122/97
gcgccgcaaucagacggcg

SEQ ID NO: 1098773 - RNA, 23 nt, Mycobacterium bovis subsp bovis AF2122/97
gcgccgcaaugacgucgucggcc

SEQ ID NO: 1098774 - RNA, 14 nt, Mycobacterium bovis subsp bovis AF2122/97
gcgccgcaccaucg

SEQ ID NO: 1098775 - RNA, 18 nt, Mycobacterium bovis subsp bovis AF2122/97
gcgccgcaccaucggcga

SEQ ID NO: 1098776 - RNA, 12 nt, Mycobacterium bovis subsp bovis AF2122/97
gcgccgcacccg

SEQ ID NO: 1098777 - RNA, 13 nt, Mycobacterium bovis subsp bovis AF2122/97
gcgccgcacccgg

SEQ ID NO: 1098778 - RNA, 18 nt, Mycobacterium bovis subsp bovis AF2122/97
gcgccgcagcgcguacuu

SEQ ID NO: 1098779 - RNA, 17 nt, Mycobacterium bovis subsp bovis AF2122/97
gcgccgcagcgauaucc

SEQ ID NO: 1098780 - RNA, 15 nt, Mycobacterium bovis subsp bovis AF2122/97
gcgccgccacagcac

SEQ ID NO: 1098781 - RNA, 16 nt, Mycobacterium bovis subsp bovis AF2122/97
gcgccgccacagcacc

SEQ ID NO: 1098782 - RNA, 13 nt, Mycobacterium bovis subsp bovis AF2122/97
gcgccgcacgccg

SEQ ID NO: 1098783 - RNA, 15 nt, Mycobacterium bovis subsp bovis AF2122/97
gcgccgcacgccgac

SEQ ID NO: 1098784 - RNA, 17 nt, Mycobacterium bovis subsp bovis AF2122/97
gcgccgcacgccgaccg

SEQ ID NO: 1098785 - RNA, 20 nt, Mycobacterium bovis subsp bovis AF2122/97
gcgccgcaccaagcagcgac

SEQ ID NO: 1098786 - RNA, 15 nt, Mycobacterium bovis subsp bovis AF2122/97
gcgccgcacacucuc

SEQ ID NO: 1098787 - RNA, 22 nt, Mycobacterium bovis subsp bovis AF2122/97
gcgccgcacagaaaacgauggu

SEQ ID NO: 1098788 - RNA, 19 nt, Mycobacterium bovis subsp bovis AF2122/97
gcgccgcagaucaccgcca

SEQ ID NO: 1098789 - RNA, 20 nt, Mycobacterium bovis subsp bovis AF2122/97
gcgccgcagaucaccgccag

SEQ ID NO: 1098790 - RNA, 21 nt, Mycobacterium bovis subsp bovis AF2122/97
gcgccgcagcaggugcaucgc

SEQ ID NO: 1098791 - RNA, 13 nt, Mycobacterium bovis subsp bovis AF2122/97
gcgccgcccacgg

SEQ ID NO: 1098792 - RNA, 16 nt, Mycobacterium bovis subsp bovis AF2122/97
gcgccgccauugccau

SEQ ID NO: 1098793 - RNA, 20 nt, Mycobacterium bovis subsp bovis AF2122/97
gcgccgccacugccggcagc

SEQ ID NO: 1098794 - RNA, 18 nt, Mycobacterium bovis subsp bovis AF2122/97
gcgccgccagcaccaccg

SEQ ID NO: 1098795 - RNA, 23 nt, Mycobacterium bovis subsp bovis AF2122/97
gcgccgccaccgaagccgccggg

SEQ ID NO: 1098796 - RNA, 14 nt, Mycobacterium bovis subsp bovis AF2122/97
gcgccgccacugcc

SEQ ID NO: 1098797 - RNA, 17 nt, Mycobacterium bovis subsp bovis AF2122/97
gcgccgccacugccggc

SEQ ID NO: 1098798 - RNA, 22 nt, Mycobacterium bovis subsp bovis AF2122/97
gcgccgccacggaucgcggcgg

SEQ ID NO: 1098799 - RNA, 19 nt, Mycobacterium bovis subsp bovis AF2122/97
gcgccgccagcaccaccgg

SEQ ID NO: 1098800 - RNA, 21 nt, Mycobacterium bovis subsp bovis AF2122/97
gcgccgccagcgccgccggcg

SEQ ID NO: 1098801 - RNA, 18 nt, Mycobacterium bovis subsp bovis AF2122/97
gcgccaugcccucggcgc

SEQ ID NO: 1098802 - RNA, 13 nt, Mycobacterium bovis subsp bovis AF2122/97
gcgccaucucgac

SEQ ID NO: 1098803 - RNA, 15 nt, Mycobacterium bovis subsp bovis AF2122/97
gcgccaucucgacgg

SEQ ID NO: 1098804 - RNA, 14 nt, Mycobacterium bovis subsp bovis AF2122/97
gcgccccgccgcac

SEQ ID NO: 1098805 - RNA, 12 nt, Mycobacterium bovis subsp bovis AF2122/97
gcgccccgaugc

SEQ ID NO: 1098806 - RNA, 15 nt, Mycobacterium bovis subsp bovis AF2122/97
gcgcccccggugccg

SEQ ID NO: 1098807 - RNA, 22 nt, Mycobacterium bovis subsp bovis AF2122/97
gcgcccccgccauugccgccgg

SEQ ID NO: 1098808 - RNA, 18 nt, Mycobacterium bovis subsp bovis AF2122/97
gcgcccgcccgagccgcu

SEQ ID NO: 1098809 - RNA, 13 nt, Mycobacterium bovis subsp bovis AF2122/97
gcgccccggcgcg

SEQ ID NO: 1098810 - RNA, 13 nt, Mycobacterium bovis subsp bovis AF2122/97
gcgccccgcggca

SEQ ID NO: 1098811 - RNA, 13 nt, Mycobacterium bovis subsp bovis AF2122/97
gcgcccgccaccg

SEQ ID NO: 1098812 - RNA, 12 nt, Mycobacterium bovis subsp bovis AF2122/97
gcgccccggcgc

SEQ ID NO: 1098813 - RNA, 19 nt, Mycobacterium bovis subsp bovis AF2122/97
gcgcccgggcggaacgccg

SEQ ID NO: 1098814 - RNA, 18 nt, Mycobacterium bovis subsp bovis AF2122/97
gcgcccggcccgccaccc

SEQ ID NO: 1098815 - RNA, 14 nt, Mycobacterium bovis subsp bovis AF2122/97
gcgcccgucgcugg

SEQ ID NO: 1098816 - RNA, 16 nt, Mycobacterium bovis subsp bovis AF2122/97
gcgcccugagccaccc

SEQ ID NO: 1098817 - RNA, 16 nt, Mycobacterium bovis subsp bovis AF2122/97
gcgcccucagccgcgg

SEQ ID NO: 1098818 - RNA, 16 nt, Mycobacterium bovis subsp bovis AF2122/97
gcgcccguuggccaag

SEQ ID NO: 1098819 - RNA, 19 nt, Mycobacterium bovis subsp bovis AF2122/97
gcgcccgccucgaccgcca

SEQ ID NO: 1098820 - RNA, 21 nt, Mycobacterium bovis subsp bovis AF2122/97
gcgcccgccucgaccgccagc

SEQ ID NO: 1098821 - RNA, 12 nt, Mycobacterium bovis subsp bovis AF2122/97
gcgcccggcgca

SEQ ID NO: 1098822 - RNA, 12 nt, Mycobacterium bovis subsp bovis AF2122/97
gcgcccggcgcu

SEQ ID NO: 1098823 - RNA, 16 nt, Mycobacterium bovis subsp bovis AF2122/97
gcgcccggcgcuagcg

SEQ ID NO: 1098824 - RNA, 17 nt, Mycobacterium bovis subsp bovis AF2122/97
gcgcccggcguggugag

SEQ ID NO: 1098825 - RNA, 13 nt, Mycobacterium bovis subsp bovis AF2122/97
gcgcccggccagg

SEQ ID NO: 1098826 - RNA, 13 nt, Mycobacterium bovis subsp bovis AF2122/97
gcgcccgcgagag

SEQ ID NO: 1098827 - RNA, 17 nt, Mycobacterium bovis subsp bovis AF2122/97
gcgcccgccggcaaccg

SEQ ID NO: 1098828 - RNA, 21 nt, Mycobacterium bovis subsp bovis AF2122/97
gcgcccgccggcaaccgggag

SEQ ID NO: 1098829 - RNA, 13 nt, Mycobacterium bovis subsp bovis AF2122/97
gcgcccgccggcg

SEQ ID NO: 1098830 - RNA, 14 nt, Mycobacterium bovis subsp bovis AF2122/97
gcgcccgccgcgaa

SEQ ID NO: 1098831 - RNA, 18 nt, Mycobacterium bovis subsp bovis AF2122/97
gcgcaugucgauccggcg

SEQ ID NO: 1098832 - RNA, 19 nt, Mycobacterium bovis subsp bovis AF2122/97
gcgcaugucgauccggcgc

SEQ ID NO: 1098833 - RNA, 14 nt, Mycobacterium bovis subsp bovis AF2122/97
gcgcauuccggcgc

SEQ ID NO: 1098834 - RNA, 15 nt, Mycobacterium bovis subsp bovis AF2122/97
gcgcauuccggcgcc

SEQ ID NO: 1098835 - RNA, 20 nt, Mycobacterium bovis subsp bovis AF2122/97
gcgcauucgccgggcggcau

SEQ ID NO: 1098836 - RNA, 13 nt, Mycobacterium bovis subsp bovis AF2122/97
gcgcauucgccgg

SEQ ID NO: 1098837 - RNA, 21 nt, Mycobacterium bovis subsp bovis AF2122/97
gcgcaccacggcggucaacgg

SEQ ID NO: 1098838 - RNA, 18 nt, Mycobacterium bovis subsp bovis AF2122/97
gcgcaccagcggcugacc

SEQ ID NO: 1098839 - RNA, 19 nt, Mycobacterium bovis subsp bovis AF2122/97
gcgcaccagcggcugaccg

SEQ ID NO: 1098840 - RNA, 12 nt, Mycobacterium bovis subsp bovis AF2122/97
gcgcaccagcac

SEQ ID NO: 1098841 - RNA, 15 nt, Mycobacterium bovis subsp bovis AF2122/97
gcgccaaucgcccag

SEQ ID NO: 1098842 - RNA, 14 nt, Mycobacterium bovis subsp bovis AF2122/97
gcgccacagcagcg

SEQ ID NO: 1098843 - RNA, 20 nt, Mycobacterium bovis subsp bovis AF2122/97
gcgccacacccggcacaccc

SEQ ID NO: 1098844 - RNA, 13 nt, Mycobacterium bovis subsp bovis AF2122/97
gcgccacccgcga

SEQ ID NO: 1098845 - RNA, 21 nt, Mycobacterium bovis subsp bovis AF2122/97
gcgccacccgcgccgcccgcu

SEQ ID NO: 1098846 - RNA, 15 nt, Mycobacterium bovis subsp bovis AF2122/97
gcgccacccgaucgg

SEQ ID NO: 1098847 - RNA, 16 nt, Mycobacterium bovis subsp bovis AF2122/97
gcgccacccgcggugc

SEQ ID NO: 1098848 - RNA, 22 nt, Mycobacterium bovis subsp bovis AF2122/97
gcgccacccgcggugccugcag

SEQ ID NO: 1098849 - RNA, 14 nt, Mycobacterium bovis subsp bovis AF2122/97
gcgccacccccacc

SEQ ID NO: 1098850 - RNA, 19 nt, Mycobacterium bovis subsp bovis AF2122/97
gcgccacccccaccgucgc

SEQ ID NO: 1098851 - RNA, 17 nt, Mycobacterium bovis subsp bovis AF2122/97
gcgccaccacccggcgc

SEQ ID NO: 1098852 - RNA, 19 nt, Mycobacterium bovis subsp bovis AF2122/97
gcgccaccagcaccgccgc

SEQ ID NO: 1098853 - RNA, 16 nt, Mycobacterium bovis subsp bovis AF2122/97
gcgccaagacgucggc

SEQ ID NO: 1098854 - RNA, 18 nt, Mycobacterium bovis subsp bovis AF2122/97
gcgccaagacgucggcgu

SEQ ID NO: 1098855 - RNA, 15 nt, Mycobacterium bovis subsp bovis AF2122/97
gcgccaaguggcgcu

SEQ ID NO: 1098856 - RNA, 16 nt, Mycobacterium bovis subsp bovis AF2122/97
gcgcauuucguggcgc

SEQ ID NO: 1098857 - RNA, 21 nt, Mycobacterium bovis subsp bovis AF2122/97
gcgccaacagaugccacccag

SEQ ID NO: 1098858 - RNA, 17 nt, Mycobacterium bovis subsp bovis AF2122/97
gcgcauuucaccggggc

SEQ ID NO: 1098859 - RNA, 18 nt, Mycobacterium bovis subsp bovis AF2122/97
gcgcauuucaccggggcc

SEQ ID NO: 1098860 - RNA, 19 nt, Mycobacterium bovis subsp bovis AF2122/97
gcgcauuucggaucucgac

SEQ ID NO: 1098861 - RNA, 23 nt, Mycobacterium bovis subsp bovis AF2122/97
gcgcauuucggaucucgaccucg

SEQ ID NO: 1098862 - RNA, 16 nt, Mycobacterium bovis subsp bovis AF2122/97
gcgcauuuguugcugc

SEQ ID NO: 1098863 - RNA, 22 nt, Mycobacterium bovis subsp bovis AF2122/97
gcgccaaacccggcgggcccgc

SEQ ID NO: 1098864 - RNA, 17 nt, Mycobacterium bovis subsp bovis AF2122/97
gcgcauuuuucgccagc

SEQ ID NO: 1098865 - RNA, 22 nt, Mycobacterium bovis subsp bovis AF2122/97
gcgccaaaaaggaucccgccgc

SEQ ID NO: 1098866 - RNA, 17 nt, Mycobacterium bovis subsp bovis AF2122/97
gcgccaccgauaccguc

SEQ ID NO: 1098867 - RNA, 22 nt, Mycobacterium bovis subsp bovis AF2122/97
gcgccaccgccgcugccggugu

SEQ ID NO: 1098868 - RNA, 17 nt, Mycobacterium bovis subsp bovis AF2122/97
gcgccaccggcaccgcc

SEQ ID NO: 1098869 - RNA, 12 nt, Mycobacterium bovis subsp bovis AF2122/97
gcgccaccggcg

SEQ ID NO: 1098870 - RNA, 14 nt, Mycobacterium bovis subsp bovis AF2122/97
gcgccaccggcgcc

SEQ ID NO: 1098871 - RNA, 17 nt, Mycobacterium bovis subsp bovis AF2122/97
gcgccaccggcgccgga

SEQ ID NO: 1098872 - RNA, 15 nt, Mycobacterium bovis subsp bovis AF2122/97
gcgccaccguggugg

SEQ ID NO: 1098873 - RNA, 14 nt, Mycobacterium bovis subsp bovis AF2122/97
gcgccaccgucacc

SEQ ID NO: 1098874 - RNA, 15 nt, Mycobacterium bovis subsp bovis AF2122/97
gcgccaccgucaccg

SEQ ID NO: 1098875 - RNA, 13 nt, Mycobacterium bovis subsp bovis AF2122/97
gcgccaccgucgc

SEQ ID NO: 1098876 - RNA, 19 nt, Mycobacterium bovis subsp bovis AF2122/97
gcgccaccguuaccgccgu

SEQ ID NO: 1098877 - RNA, 21 nt, Mycobacterium bovis subsp bovis AF2122/97
gcgccaccguuaccgccguuu

SEQ ID NO: 1098878 - RNA, 16 nt, Mycobacterium bovis subsp bovis AF2122/97
gcgccaccucccacgc

SEQ ID NO: 1098879 - RNA, 18 nt, Mycobacterium bovis subsp bovis AF2122/97
gcgccaccuccgacgggc

SEQ ID NO: 1098880 - RNA, 19 nt, Mycobacterium bovis subsp bovis AF2122/97
gcgccaccugaaagcuacc

SEQ ID NO: 1098881 - RNA, 13 nt, Mycobacterium bovis subsp bovis AF2122/97
gcgccacgcaccc

SEQ ID NO: 1098882 - RNA, 17 nt, Mycobacterium bovis subsp bovis AF2122/97
gcgccacgcacccggca

SEQ ID NO: 1098883 - RNA, 13 nt, Mycobacterium bovis subsp bovis AF2122/97
gcgccacgaugac

SEQ ID NO: 1098884 - RNA, 11 nt, Mycobacterium bovis subsp bovis AF2122/97
gcgccacgccg

SEQ ID NO: 1098885 - RNA, 12 nt, Mycobacterium bovis subsp bovis AF2122/97
gcgccacgccga

SEQ ID NO: 1098886 - RNA, 13 nt, Mycobacterium bovis subsp bovis AF2122/97
gcgccacgccacc

SEQ ID NO: 1098887 - RNA, 16 nt, Mycobacterium bovis subsp bovis AF2122/97
gcgccacgccaccgcg

SEQ ID NO: 1098888 - RNA, 15 nt, Mycobacterium bovis subsp bovis AF2122/97
gcgccaggcggcaau

SEQ ID NO: 1098889 - RNA, 15 nt, Mycobacterium bovis subsp bovis AF2122/97
gcgccaggggugugc

SEQ ID NO: 1098890 - RNA, 21 nt, Mycobacterium bovis subsp bovis AF2122/97
gcgccaggucagcucgagcgc

SEQ ID NO: 1098891 - RNA, 19 nt, Mycobacterium bovis subsp bovis AF2122/97
gcgccaucgaggucguuuc

SEQ ID NO: 1098892 - RNA, 12 nt, Mycobacterium bovis subsp bovis AF2122/97
gcgccauccccg

SEQ ID NO: 1098893 - RNA, 13 nt, Mycobacterium bovis subsp bovis AF2122/97
gcgccauccccgc

SEQ ID NO: 1098894 - RNA, 17 nt, Mycobacterium bovis subsp bovis AF2122/97
gcgccauccccgccggc

SEQ ID NO: 1098895 - RNA, 23 nt, Mycobacterium bovis subsp bovis AF2122/97
gcgccauccccgccggcgccacc

SEQ ID NO: 1098896 - RNA, 13 nt, Mycobacterium bovis subsp bovis AF2122/97
gcgccagcggugg

SEQ ID NO: 1098897 - RNA, 14 nt, Mycobacterium bovis subsp bovis AF2122/97
gcgccagcggugga

SEQ ID NO: 1098898 - RNA, 23 nt, Mycobacterium bovis subsp bovis AF2122/97
gcgccagcguaaauagcgcccug

SEQ ID NO: 1098899 - RNA, 22 nt, Mycobacterium bovis subsp bovis AF2122/97
gcgccagcguuaggucgccggc

SEQ ID NO: 1098900 - RNA, 17 nt, Mycobacterium bovis subsp bovis AF2122/97
gcgccaggcgcgaucgc

SEQ ID NO: 1098901 - RNA, 18 nt, Mycobacterium bovis subsp bovis AF2122/97
gcgcgccaggcucgaugu

SEQ ID NO: 1098902 - RNA, 22 nt, Mycobacterium bovis subsp bovis AF2122/97
gcgcgccaucgccuccagccgg

SEQ ID NO: 1098903 - RNA, 19 nt, Mycobacterium bovis subsp bovis AF2122/97
gcgcgcccaccgggcggcg

SEQ ID NO: 1098904 - RNA, 15 nt, Mycobacterium bovis subsp bovis AF2122/97
gcgcgccauuggcgc

SEQ ID NO: 1098905 - RNA, 20 nt, Mycobacterium bovis subsp bovis AF2122/97
gcgcgccauuggcgccgccg

SEQ ID NO: 1098906 - RNA, 21 nt, Mycobacterium bovis subsp bovis AF2122/97
gcgcgccauuggcgccgccga

SEQ ID NO: 1098907 - RNA, 21 nt, Mycobacterium bovis subsp bovis AF2122/97
gcgcgccccaccgcgccgagc

SEQ ID NO: 1098908 - RNA, 17 nt, Mycobacterium bovis subsp bovis AF2122/97
gcgcgccccaccgcgcc

SEQ ID NO: 1098909 - RNA, 19 nt, Mycobacterium bovis subsp bovis AF2122/97
gcgcgccccaccgcgccga

SEQ ID NO: 1098910 - RNA, 16 nt, Mycobacterium bovis subsp bovis AF2122/97
gcgcgccccgccgcac

SEQ ID NO: 1098911 - RNA, 15 nt, Mycobacterium bovis subsp bovis AF2122/97
gcgcggcaucccgcc

SEQ ID NO: 1098912 - RNA, 15 nt, Mycobacterium bovis subsp bovis AF2122/97
gcgcgccccgccgca

SEQ ID NO: 1098913 - RNA, 24 nt, Mycobacterium bovis subsp bovis AF2122/97
gcgcggccaccagaucgcacacca

SEQ ID NO: 1098914 - RNA, 12 nt, Mycobacterium bovis subsp bovis AF2122/97
gcgcggccaccc

SEQ ID NO: 1098915 - RNA, 22 nt, Mycobacterium bovis subsp bovis AF2122/97
gcgcggccaaucagcccgccgg

SEQ ID NO: 1098916 - RNA, 13 nt, Mycobacterium bovis subsp bovis AF2122/97
gcgcggccaccuc

SEQ ID NO: 1098917 - RNA, 16 nt, Mycobacterium bovis subsp bovis AF2122/97
gcgcggccacgccgau

SEQ ID NO: 1098918 - RNA, 18 nt, Mycobacterium bovis subsp bovis AF2122/97
gcgcggccacgccgauca

SEQ ID NO: 1098919 - RNA, 21 nt, Mycobacterium bovis subsp bovis AF2122/97
gcgcggccagagccgcgcgcc

SEQ ID NO: 1098920 - RNA, 14 nt, Mycobacterium bovis subsp bovis AF2122/97
gcgcggccagcagc

SEQ ID NO: 1098921 - RNA, 22 nt, Mycobacterium bovis subsp bovis AF2122/97
gcgcggccagcccacucgucga

SEQ ID NO: 1098922 - RNA, 20 nt, Mycobacterium bovis subsp bovis AF2122/97
gcgcggccauuagcagcacc

SEQ ID NO: 1098923 - RNA, 23 nt, Mycobacterium bovis subsp bovis AF2122/97
gcgcggccguagugcacgucggc

SEQ ID NO: 1098924 - RNA, 22 nt, Mycobacterium bovis subsp bovis AF2122/97
gcgcggcgacaagccgagcccg

SEQ ID NO: 1098925 - RNA, 15 nt, Mycobacterium bovis subsp bovis AF2122/97
gcgcggcgacaucca

SEQ ID NO: 1098926 - RNA, 14 nt, Mycobacterium bovis subsp bovis AF2122/97
gcgcggcgaccugu

SEQ ID NO: 1098927 - RNA, 17 nt, Mycobacterium bovis subsp bovis AF2122/97
gcgcggcgacgacggcc

SEQ ID NO: 1098928 - RNA, 21 nt, Mycobacterium bovis subsp bovis AF2122/97
gcgcggcgacgacggccugcg

SEQ ID NO: 1098929 - RNA, 13 nt, Mycobacterium bovis subsp bovis AF2122/97
gcgcggcgaucga

SEQ ID NO: 1098930 - RNA, 18 nt, Mycobacterium bovis subsp bovis AF2122/97
gcgcggcgaucgcuccgc

SEQ ID NO: 1098931 - RNA, 12 nt, Mycobacterium bovis subsp bovis AF2122/97
gcgcggcgcccu

SEQ ID NO: 1098932 - RNA, 17 nt, Mycobacterium bovis subsp bovis AF2122/97
gcgcggcccagguccgc

SEQ ID NO: 1098933 - RNA, 20 nt, Mycobacterium bovis subsp bovis AF2122/97
gcgcggcccaccucaccgau

SEQ ID NO: 1098934 - RNA, 17 nt, Mycobacterium bovis subsp bovis AF2122/97
gcgcggcccgccucggc

SEQ ID NO: 1098935 - RNA, 21 nt, Mycobacterium bovis subsp bovis AF2122/97
gcgcggcccgccucggcggcg

SEQ ID NO: 1098936 - RNA, 21 nt, Mycobacterium bovis subsp bovis AF2122/97
gcgcggccgcaagccgcgagu

SEQ ID NO: 1098937 - RNA, 17 nt, Mycobacterium bovis subsp bovis AF2122/97
gcgcggccgcagccagc

SEQ ID NO: 1098938 - RNA, 16 nt, Mycobacterium bovis subsp bovis AF2122/97
gcgcggccguagugca

SEQ ID NO: 1098939 - RNA, 22 nt, Mycobacterium bovis subsp bovis AF2122/97
gcgcggccguagugcacgucgg

SEQ ID NO: 1098940 - RNA, 22 nt, Mycobacterium bovis subsp bovis AF2122/97
gcgcggcccagguccgcgugcu

SEQ ID NO: 1098941 - RNA, 18 nt, Mycobacterium bovis subsp bovis AF2122/97
gcgcggccgugaacggcg

SEQ ID NO: 1098942 - RNA, 12 nt, Mycobacterium bovis subsp bovis AF2122/97
gcgcggcgucgc

SEQ ID NO: 1098943 - RNA, 16 nt, Mycobacterium bovis subsp bovis AF2122/97
gcgcggcgugcgcggu

SEQ ID NO: 1098944 - RNA, 23 nt, Mycobacterium bovis subsp bovis AF2122/97
gcgcggcguguacgucgaucagg

SEQ ID NO: 1098945 - RNA, 13 nt, Mycobacterium bovis subsp bovis AF2122/97
gcgcgggcgacgu

SEQ ID NO: 1098946 - RNA, 14 nt, Mycobacterium bovis subsp bovis AF2122/97
gcgcgggcgacguc

SEQ ID NO: 1098947 - RNA, 14 nt, Mycobacterium bovis subsp bovis AF2122/97
gcgcgggcgccggg

SEQ ID NO: 1098948 - RNA, 15 nt, Mycobacterium bovis subsp bovis AF2122/97
gcgcgggcgccggga

SEQ ID NO: 1098949 - RNA, 15 nt, Mycobacterium bovis subsp bovis AF2122/97
gcgcgggcucggugg

SEQ ID NO: 1098950 - RNA, 19 nt, Mycobacterium bovis subsp bovis AF2122/97
gcgcggggaugcgaccgcc

SEQ ID NO: 1098951 - RNA, 12 nt, Mycobacterium bovis subsp bovis AF2122/97
gcgcggcggcgc

SEQ ID NO: 1098952 - RNA, 17 nt, Mycobacterium bovis subsp bovis AF2122/97
gcgcggcggccgcggcu

SEQ ID NO: 1098953 - RNA, 13 nt, Mycobacterium bovis subsp bovis AF2122/97
gcgcggcggucga

SEQ ID NO: 1098954 - RNA, 19 nt, Mycobacterium bovis subsp bovis AF2122/97
gcgcggucaccgcgucacc

SEQ ID NO: 1098955 - RNA, 21 nt, Mycobacterium bovis subsp bovis AF2122/97
gcgcggucgagguggcgggcg

SEQ ID NO: 1098956 - RNA, 19 nt, Mycobacterium bovis subsp bovis AF2122/97
gcgcgguggucagcaccgg

SEQ ID NO: 1098957 - RNA, 19 nt, Mycobacterium bovis subsp bovis AF2122/97
gcgcgguuggcugaugacg

SEQ ID NO: 1098958 - RNA, 16 nt, Mycobacterium bovis subsp bovis AF2122/97
gcgcgguuucggcgau

SEQ ID NO: 1098959 - RNA, 17 nt, Mycobacterium bovis subsp bovis AF2122/97
gcgcgguuucggcgaug

SEQ ID NO: 1098960 - RNA, 20 nt, Mycobacterium bovis subsp bovis AF2122/97
gcgcgguuucggcgucaccg

SEQ ID NO: 1098961 - RNA, 21 nt, Mycobacterium bovis subsp bovis AF2122/97
gcgcgguuuucggcugccgcu

SEQ ID NO: 1098962 - RNA, 22 nt, Mycobacterium bovis subsp bovis AF2122/97
gcgcgguuuucggcugccgcuc

SEQ ID NO: 1098963 - RNA, 16 nt, Mycobacterium bovis subsp bovis AF2122/97
gcgcguauggcucacc

SEQ ID NO: 1098964 - RNA, 19 nt, Mycobacterium bovis subsp bovis AF2122/97
gcgcgucagaccgcgaaca

SEQ ID NO: 1098965 - RNA, 16 nt, Mycobacterium bovis subsp bovis AF2122/97
gcgcgucagccgcacc

SEQ ID NO: 1098966 - RNA, 19 nt, Mycobacterium bovis subsp bovis AF2122/97
gcgcgucagccgcaccccg

SEQ ID NO: 1098967 - RNA, 17 nt, Mycobacterium bovis subsp bovis AF2122/97
gcgcgucaggccagcgc

SEQ ID NO: 1098968 - RNA, 14 nt, Mycobacterium bovis subsp bovis AF2122/97
gcgcgucaggccag

SEQ ID NO: 1098969 - RNA, 16 nt, Mycobacterium bovis subsp bovis AF2122/97
gcgcgucaggccagcg

SEQ ID NO: 1098970 - RNA, 14 nt, Mycobacterium bovis subsp bovis AF2122/97
gcgcggggcggccu

SEQ ID NO: 1098971 - RNA, 15 nt, Mycobacterium bovis subsp bovis AF2122/97
gcgcggggcggccug

SEQ ID NO: 1098972 - RNA, 13 nt, Mycobacterium bovis subsp bovis AF2122/97
gcgcgguaaccac

SEQ ID NO: 1098973 - RNA, 17 nt, Mycobacterium bovis subsp bovis AF2122/97
gcgcgguaccgcucggg

SEQ ID NO: 1098974 - RNA, 23 nt, Mycobacterium bovis subsp bovis AF2122/97
gcgcgguaccggugucaguccga

SEQ ID NO: 1098975 - RNA, 17 nt, Mycobacterium bovis subsp bovis AF2122/97
gcgcgguacugcgcagc

SEQ ID NO: 1098976 - RNA, 13 nt, Mycobacterium bovis subsp bovis AF2122/97
gcgcgguggucgc

SEQ ID NO: 1098977 - RNA, 18 nt, Mycobacterium bovis subsp bovis AF2122/97
gcgcgguggucgcgaccg

SEQ ID NO: 1098978 - RNA, 20 nt, Mycobacterium bovis subsp bovis AF2122/97
gcgcgguggucgcgaccgac

SEQ ID NO: 1098979 - RNA, 17 nt, Mycobacterium bovis subsp bovis AF2122/97
gcgcgguccaucccgag

SEQ ID NO: 1098980 - RNA, 14 nt, Mycobacterium bovis subsp bovis AF2122/97
gcgcggggccgccg

SEQ ID NO: 1098981 - RNA, 12 nt, Mycobacterium bovis subsp bovis AF2122/97
gcgcggucaccg

SEQ ID NO: 1098982 - RNA, 23 nt, Mycobacterium bovis subsp bovis AF2122/97
gcgcucggcgagcaacacgagcg

SEQ ID NO: 1098983 - RNA, 14 nt, Mycobacterium bovis subsp bovis AF2122/97
gcgcucgggcgaga

SEQ ID NO: 1098984 - RNA, 13 nt, Mycobacterium bovis subsp bovis AF2122/97
gcgcucgggcaac

SEQ ID NO: 1098985 - RNA, 21 nt, Mycobacterium bovis subsp bovis AF2122/97
gcgcucucauagcgacggcgc

SEQ ID NO: 1098986 - RNA, 15 nt, Mycobacterium bovis subsp bovis AF2122/97
gcgcugaacgcgagc

SEQ ID NO: 1098987 - RNA, 14 nt, Mycobacterium bovis subsp bovis AF2122/97
gcgcucgauggcgg

SEQ ID NO: 1098988 - RNA, 20 nt, Mycobacterium bovis subsp bovis AF2122/97
gcgcucgauggcggccacca

SEQ ID NO: 1098989 - RNA, 17 nt, Mycobacterium bovis subsp bovis AF2122/97
gcgcucgaucacuagcg

SEQ ID NO: 1098990 - RNA, 14 nt, Mycobacterium bovis subsp bovis AF2122/97
gcgcucgcaccacc

SEQ ID NO: 1098991 - RNA, 16 nt, Mycobacterium bovis subsp bovis AF2122/97
gcgcucgcaccaccac

SEQ ID NO: 1098992 - RNA, 17 nt, Mycobacterium bovis subsp bovis AF2122/97
gcgcucgcaccaccacg

SEQ ID NO: 1098993 - RNA, 21 nt, Mycobacterium bovis subsp bovis AF2122/97
gcgcucgcacccgcucggcgc

SEQ ID NO: 1098994 - RNA, 22 nt, Mycobacterium bovis subsp bovis AF2122/97
gcgcucgcaguggagggcccgg

SEQ ID NO: 1098995 - RNA, 23 nt, Mycobacterium bovis subsp bovis AF2122/97
gcgcucgcccgcggccguggugg

SEQ ID NO: 1098996 - RNA, 20 nt, Mycobacterium bovis subsp bovis AF2122/97
gcgcucgcccaggaagccga

SEQ ID NO: 1098997 - RNA, 15 nt, Mycobacterium bovis subsp bovis AF2122/97
gcgcucggccagcau

SEQ ID NO: 1098998 - RNA, 17 nt, Mycobacterium bovis subsp bovis AF2122/97
gcgcucgcucaccggcg

SEQ ID NO: 1098999 - RNA, 13 nt, Mycobacterium bovis subsp bovis AF2122/97
gcgcucgcggcgg

SEQ ID NO: 1099000 - RNA, 13 nt, Mycobacterium bovis subsp bovis AF2122/97
gcgcugcagcacg

SEQ ID NO: 1099001 - RNA, 17 nt, Mycobacterium bovis subsp bovis AF2122/97
gcgcugaagguggcgaa

SEQ ID NO: 1099002 - RNA, 23 nt, Mycobacterium bovis subsp bovis AF2122/97
gcgcugaagguggcgaacccggu

SEQ ID NO: 1099003 - RNA, 15 nt, Mycobacterium bovis subsp bovis AF2122/97
gcgcugaaucacccc

SEQ ID NO: 1099004 - RNA, 14 nt, Mycobacterium bovis subsp bovis AF2122/97
gcgcugcagcaugg

SEQ ID NO: 1099005 - RNA, 18 nt, Mycobacterium bovis subsp bovis AF2122/97
gcgcugccaggccgcuga

SEQ ID NO: 1099006 - RNA, 22 nt, Mycobacterium bovis subsp bovis AF2122/97
gcgcugcccgccgccccguuca

SEQ ID NO: 1099007 - RNA, 16 nt, Mycobacterium bovis subsp bovis AF2122/97
gcgcugcagcugcucg

SEQ ID NO: 1099008 - RNA, 22 nt, Mycobacterium bovis subsp bovis AF2122/97
gcgcugccaaacuaacggcagc

SEQ ID NO: 1099009 - RNA, 20 nt, Mycobacterium bovis subsp bovis AF2122/97
gcgcugccaauccgaucgag

SEQ ID NO: 1099010 - RNA, 18 nt, Mycobacterium bovis subsp bovis AF2122/97
gcgcugcuugaggucccg

SEQ ID NO: 1099011 - RNA, 12 nt, Mycobacterium bovis subsp bovis AF2122/97
gcgcugcucacg

SEQ ID NO: 1099012 - RNA, 13 nt, Mycobacterium bovis subsp bovis AF2122/97
gcgcugccgccgu

SEQ ID NO: 1099013 - RNA, 14 nt, Mycobacterium bovis subsp bovis AF2122/97
gcgcugcggccagc

SEQ ID NO: 1099014 - RNA, 21 nt, Mycobacterium bovis subsp bovis AF2122/97
gcgcugcugccgaugugugga

SEQ ID NO: 1099015 - RNA, 13 nt, Mycobacterium bovis subsp bovis AF2122/97
gcgcuggcgcccu

SEQ ID NO: 1099016 - RNA, 18 nt, Mycobacterium bovis subsp bovis AF2122/97
gcgcuggcgccggccagc

SEQ ID NO: 1099017 - RNA, 18 nt, Mycobacterium bovis subsp bovis AF2122/97
gcgcuggaccgggucggg

SEQ ID NO: 1099018 - RNA, 21 nt, Mycobacterium bovis subsp bovis AF2122/97
gcgcucgaacuccccggucgc

SEQ ID NO: 1099019 - RNA, 22 nt, Mycobacterium bovis subsp bovis AF2122/97
gcgcucgaacuccccggucgcc

SEQ ID NO: 1099020 - RNA, 20 nt, Mycobacterium bovis subsp bovis AF2122/97
gcgcuccuucagggcgucga

SEQ ID NO: 1099021 - RNA, 21 nt, Mycobacterium bovis subsp bovis AF2122/97
gcgcucgacgagcacgccgac

SEQ ID NO: 1099022 - RNA, 18 nt, Mycobacterium bovis subsp bovis AF2122/97
gcgcucagcuccggcgac

SEQ ID NO: 1099023 - RNA, 19 nt, Mycobacterium bovis subsp bovis AF2122/97
gcgcucaucacccagcgcc

SEQ ID NO: 1099024 - RNA, 20 nt, Mycobacterium bovis subsp bovis AF2122/97
gcgcucaucacccagcgccg

SEQ ID NO: 1099025 - RNA, 18 nt, Mycobacterium bovis subsp bovis AF2122/97
gcgcucaucugcgcgcgg

SEQ ID NO: 1099026 - RNA, 23 nt, Mycobacterium bovis subsp bovis AF2122/97
gcgcucaggucaucggcggcggg

SEQ ID NO: 1099027 - RNA, 15 nt, Mycobacterium bovis subsp bovis AF2122/97
gcgcucaucgaccgc

SEQ ID NO: 1099028 - RNA, 22 nt, Mycobacterium bovis subsp bovis AF2122/97
gcgcucaucgaccgcggccggg

SEQ ID NO: 1099029 - RNA, 17 nt, Mycobacterium bovis subsp bovis AF2122/97
gcgcucaucgcggcgaa

SEQ ID NO: 1099030 - RNA, 21 nt, Mycobacterium bovis subsp bovis AF2122/97
gcgcucauguucucgaccgcg

SEQ ID NO: 1099031 - RNA, 17 nt, Mycobacterium bovis subsp bovis AF2122/97
gcgcuauaggccgcaug

SEQ ID NO: 1099032 - RNA, 18 nt, Mycobacterium bovis subsp bovis AF2122/97
gcgcuacuacugcagucc

SEQ ID NO: 1099033 - RNA, 19 nt, Mycobacterium bovis subsp bovis AF2122/97
gcgcucagcgcggccacgc

SEQ ID NO: 1099034 - RNA, 14 nt, Mycobacterium bovis subsp bovis AF2122/97
gcgcguccccagcg

SEQ ID NO: 1099035 - RNA, 22 nt, Mycobacterium bovis subsp bovis AF2122/97
gcgcgugcucgacgcgcaucgc

SEQ ID NO: 1099036 - RNA, 20 nt, Mycobacterium bovis subsp bovis AF2122/97
gcgcgugcugcagaucggcc

SEQ ID NO: 1099037 - RNA, 15 nt, Mycobacterium bovis subsp bovis AF2122/97
gcgcguggcagugca

SEQ ID NO: 1099038 - RNA, 21 nt, Mycobacterium bovis subsp bovis AF2122/97
gcgcguggcagugcaggcggc

SEQ ID NO: 1099039 - RNA, 15 nt, Mycobacterium bovis subsp bovis AF2122/97
gcgcgugggcgugca

SEQ ID NO: 1099040 - RNA, 17 nt, Mycobacterium bovis subsp bovis AF2122/97
gcgcguggucgccccga

SEQ ID NO: 1099041 - RNA, 19 nt, Mycobacterium bovis subsp bovis AF2122/97
gcgcgugugcgucgcacga

SEQ ID NO: 1099042 - RNA, 21 nt, Mycobacterium bovis subsp bovis AF2122/97
gcgcguuacccaucgccacac

SEQ ID NO: 1099043 - RNA, 18 nt, Mycobacterium bovis subsp bovis AF2122/97
gcgcguugaagucgccgg

SEQ ID NO: 1099044 - RNA, 22 nt, Mycobacterium bovis subsp bovis AF2122/97
gcgcguugaagucgccggugac

SEQ ID NO: 1099045 - RNA, 14 nt, Mycobacterium bovis subsp bovis AF2122/97
gcgcguugaccgaa

SEQ ID NO: 1099046 - RNA, 23 nt, Mycobacterium bovis subsp bovis AF2122/97
gcgcguugaccgaacgcacgucg

SEQ ID NO: 1099047 - RNA, 18 nt, Mycobacterium bovis subsp bovis AF2122/97
gcgcuacagcaucaaccg

SEQ ID NO: 1099048 - RNA, 15 nt, Mycobacterium bovis subsp bovis AF2122/97
gcgcuaccagccaua

SEQ ID NO: 1099049 - RNA, 20 nt, Mycobacterium bovis subsp bovis AF2122/97
gcgcguuccagcacacccag

SEQ ID NO: 1099050 - RNA, 18 nt, Mycobacterium bovis subsp bovis AF2122/97
gcgcguucccacgguucu

SEQ ID NO: 1099051 - RNA, 15 nt, Mycobacterium bovis subsp bovis AF2122/97
gcgcguucgaccucg

SEQ ID NO: 1099052 - RNA, 16 nt, Mycobacterium bovis subsp bovis AF2122/97
gcgcguucgaccucga

SEQ ID NO: 1099053 - RNA, 18 nt, Mycobacterium bovis subsp bovis AF2122/97
gcgcguucgaccucgacu

SEQ ID NO: 1099054 - RNA, 17 nt, Mycobacterium bovis subsp bovis AF2122/97
gcgcguucggcgagcag

SEQ ID NO: 1099055 - RNA, 19 nt, Mycobacterium bovis subsp bovis AF2122/97
gcgcguucggcgagcagcg

SEQ ID NO: 1099056 - RNA, 16 nt, Mycobacterium bovis subsp bovis AF2122/97
gcgcguuccaucaggg

SEQ ID NO: 1099057 - RNA, 13 nt, Mycobacterium bovis subsp bovis AF2122/97
gcgcuggcggcgc

SEQ ID NO: 1099058 - RNA, 14 nt, Mycobacterium bovis subsp bovis AF2122/97
gcgcuggcggcgca

SEQ ID NO: 1099059 - RNA, 21 nt, Mycobacterium bovis subsp bovis AF2122/97
gcgcugggauguucgaucagc

SEQ ID NO: 1099060 - RNA, 23 nt, Mycobacterium bovis subsp bovis AF2122/97
gcgcugggcgcgcucaucgaccg

SEQ ID NO: 1099061 - RNA, 17 nt, Mycobacterium bovis subsp bovis AF2122/97
gcgcugggcgccguagc

SEQ ID NO: 1099062 - RNA, 19 nt, Mycobacterium bovis subsp bovis AF2122/97
gcgcugggcgcgcucaucg

SEQ ID NO: 1099063 - RNA, 20 nt, Mycobacterium bovis subsp bovis AF2122/97
gcgcugggcgcgcucaucga

SEQ ID NO: 1099064 - RNA, 19 nt, Mycobacterium bovis subsp bovis AF2122/97
gcgcuggcgggcggcgugg

SEQ ID NO: 1099065 - RNA, 16 nt, Mycobacterium bovis subsp bovis AF2122/97
gcgcugggacggucgc

SEQ ID NO: 1099066 - RNA, 20 nt, Mycobacterium bovis subsp bovis AF2122/97
gcggaacgaaagucuccgga

SEQ ID NO: 1099067 - RNA, 13 nt, Mycobacterium bovis subsp bovis AF2122/97
gcggaacccagca

SEQ ID NO: 1099068 - RNA, 15 nt, Mycobacterium bovis subsp bovis AF2122/97
gcggaacccagcacu

SEQ ID NO: 1099069 - RNA, 21 nt, Mycobacterium bovis subsp bovis AF2122/97
gcgcugggacggucgcucggc

SEQ ID NO: 1099070 - RNA, 21 nt, Mycobacterium bovis subsp bovis AF2122/97
gcggaacacgaugcgcggugc

SEQ ID NO: 1099071 - RNA, 22 nt, Mycobacterium bovis subsp bovis AF2122/97
gcggaacagcuucgcgcagccg

SEQ ID NO: 1099072 - RNA, 13 nt, Mycobacterium bovis subsp bovis AF2122/97
gcggaacgccggc

SEQ ID NO: 1099073 - RNA, 14 nt, Mycobacterium bovis subsp bovis AF2122/97
gcggaagaccggau

SEQ ID NO: 1099074 - RNA, 13 nt, Mycobacterium bovis subsp bovis AF2122/97
gcggaagcgggcg

SEQ ID NO: 1099075 - RNA, 18 nt, Mycobacterium bovis subsp bovis AF2122/97
gcggaagcaucggcugcg

SEQ ID NO: 1099076 - RNA, 22 nt, Mycobacterium bovis subsp bovis AF2122/97
gcggaagugucgucggaccucg

SEQ ID NO: 1099077 - RNA, 20 nt, Mycobacterium bovis subsp bovis AF2122/97
gcggaaucgcaucggcgggg

SEQ ID NO: 1099078 - RNA, 14 nt, Mycobacterium bovis subsp bovis AF2122/97
gcggaaucaccgaa

SEQ ID NO: 1099079 - RNA, 17 nt, Mycobacterium bovis subsp bovis AF2122/97
gcggaaucgcaucggcg

SEQ ID NO: 1099080 - RNA, 16 nt, Mycobacterium bovis subsp bovis AF2122/97
gcggacagggcggcaa

SEQ ID NO: 1099081 - RNA, 17 nt, Mycobacterium bovis subsp bovis AF2122/97
gcggacagggcggcaac

SEQ ID NO: 1099082 - RNA, 18 nt, Mycobacterium bovis subsp bovis AF2122/97
gcggacagggcggcaacg

SEQ ID NO: 1099083 - RNA, 22 nt, Mycobacterium bovis subsp bovis AF2122/97
gcggacaggauauugaccuucu

SEQ ID NO: 1099084 - RNA, 12 nt, Mycobacterium bovis subsp bovis AF2122/97
gcggacaggccc

SEQ ID NO: 1099085 - RNA, 14 nt, Mycobacterium bovis subsp bovis AF2122/97
gcggaccacaccgu

SEQ ID NO: 1099086 - RNA, 20 nt, Mycobacterium bovis subsp bovis AF2122/97
gcggaccacaccgucaccga

SEQ ID NO: 1099087 - RNA, 21 nt, Mycobacterium bovis subsp bovis AF2122/97
gcggacaugacagccccgccg

SEQ ID NO: 1099088 - RNA, 23 nt, Mycobacterium bovis subsp bovis AF2122/97
gcggacaugacagccccgccgcc

SEQ ID NO: 1099089 - RNA, 17 nt, Mycobacterium bovis subsp bovis AF2122/97
gcggaccaccgcucgcc

SEQ ID NO: 1099090 - RNA, 16 nt, Mycobacterium bovis subsp bovis AF2122/97
gcggaccaggccgcgc

SEQ ID NO: 1099091 - RNA, 22 nt, Mycobacterium bovis subsp bovis AF2122/97
gcggaccaggccgcgcgcaccg

SEQ ID NO: 1099092 - RNA, 18 nt, Mycobacterium bovis subsp bovis AF2122/97
gcggacaccucgggcgcc

SEQ ID NO: 1099093 - RNA, 22 nt, Mycobacterium bovis subsp bovis AF2122/97
gcggacaccucgggcgcccgcg

SEQ ID NO: 1099094 - RNA, 16 nt, Mycobacterium bovis subsp bovis AF2122/97
gcggacacguugcgac

SEQ ID NO: 1099095 - RNA, 19 nt, Mycobacterium bovis subsp bovis AF2122/97
gcggaauggaggccgccga

SEQ ID NO: 1099096 - RNA, 15 nt, Mycobacterium bovis subsp bovis AF2122/97
gcggaauggcgccgg

SEQ ID NO: 1099097 - RNA, 16 nt, Mycobacterium bovis subsp bovis AF2122/97
gcggaauggcgccggc

SEQ ID NO: 1099098 - RNA, 22 nt, Mycobacterium bovis subsp bovis AF2122/97
gcggaauggcgccggccggcgc

SEQ ID NO: 1099099 - RNA, 15 nt, Mycobacterium bovis subsp bovis AF2122/97
gcggacaccgcggcg

SEQ ID NO: 1099100 - RNA, 19 nt, Mycobacterium bovis subsp bovis AF2122/97
gcggacaccgcggcgaucu

SEQ ID NO: 1099101 - RNA, 15 nt, Mycobacterium bovis subsp bovis AF2122/97
gcggaccucggcgac

SEQ ID NO: 1099102 - RNA, 12 nt, Mycobacterium bovis subsp bovis AF2122/97
gcggaccuggcg

SEQ ID NO: 1099103 - RNA, 15 nt, Mycobacterium bovis subsp bovis AF2122/97
gcggaccuggcggcg

SEQ ID NO: 1099104 - RNA, 16 nt, Mycobacterium bovis subsp bovis AF2122/97
gcggaccuggcggcgg

SEQ ID NO: 1099105 - RNA, 17 nt, Mycobacterium bovis subsp bovis AF2122/97
gcggaccuggcggcggu

SEQ ID NO: 1099106 - RNA, 14 nt, Mycobacterium bovis subsp bovis AF2122/97
gcggaccguguugu

SEQ ID NO: 1099107 - RNA, 14 nt, Mycobacterium bovis subsp bovis AF2122/97
gcggaccggcgcgc

SEQ ID NO: 1099108 - RNA, 15 nt, Mycobacterium bovis subsp bovis AF2122/97
gcggaccggcgcgcu

SEQ ID NO: 1099109 - RNA, 13 nt, Mycobacterium bovis subsp bovis AF2122/97
gcggaccguccga

SEQ ID NO: 1099110 - RNA, 16 nt, Mycobacterium bovis subsp bovis AF2122/97
gcggaccguccgacgg

SEQ ID NO: 1099111 - RNA, 19 nt, Mycobacterium bovis subsp bovis AF2122/97
gcggaccguccgacggcgg

SEQ ID NO: 1099112 - RNA, 17 nt, Mycobacterium bovis subsp bovis AF2122/97
gcggaccugcgccggug

SEQ ID NO: 1099113 - RNA, 15 nt, Mycobacterium bovis subsp bovis AF2122/97
gcggacgacgucggg

SEQ ID NO: 1099114 - RNA, 15 nt, Mycobacterium bovis subsp bovis AF2122/97
gcggaccgcagcgug

SEQ ID NO: 1099115 - RNA, 15 nt, Mycobacterium bovis subsp bovis AF2122/97
gcggacccgaccguc

SEQ ID NO: 1099116 - RNA, 17 nt, Mycobacterium bovis subsp bovis AF2122/97
gcggacccgaccgucgu

SEQ ID NO: 1099117 - RNA, 14 nt, Mycobacterium bovis subsp bovis AF2122/97
gcggaccgauuguc

SEQ ID NO: 1099118 - RNA, 19 nt, Mycobacterium bovis subsp bovis AF2122/97
gcggacccgaccgucgucg

SEQ ID NO: 1099119 - RNA, 16 nt, Mycobacterium bovis subsp bovis AF2122/97
gcggaccccucgaccg

SEQ ID NO: 1099120 - RNA, 14 nt, Mycobacterium bovis subsp bovis AF2122/97
gcggacccgaccgu

SEQ ID NO: 1099121 - RNA, 22 nt, Mycobacterium bovis subsp bovis AF2122/97
gcggauacgccccugguccacc

SEQ ID NO: 1099122 - RNA, 15 nt, Mycobacterium bovis subsp bovis AF2122/97
gcggauacagccgcc

SEQ ID NO: 1099123 - RNA, 19 nt, Mycobacterium bovis subsp bovis AF2122/97
gcggauacaugguccggcc

SEQ ID NO: 1099124 - RNA, 15 nt, Mycobacterium bovis subsp bovis AF2122/97
gcggauaggccgcgc

SEQ ID NO: 1099125 - RNA, 19 nt, Mycobacterium bovis subsp bovis AF2122/97
gcggauaggccgcgcggcg

SEQ ID NO: 1099126 - RNA, 23 nt, Mycobacterium bovis subsp bovis AF2122/97
gcggauaggccgcgcggcggcgc

SEQ ID NO: 1099127 - RNA, 14 nt, Mycobacterium bovis subsp bovis AF2122/97
gcggaguucgcuga

SEQ ID NO: 1099128 - RNA, 22 nt, Mycobacterium bovis subsp bovis AF2122/97
gcggagucugcugaucgagcgg

SEQ ID NO: 1099129 - RNA, 20 nt, Mycobacterium bovis subsp bovis AF2122/97
gcggaguaaacaaacccaac

SEQ ID NO: 1099130 - RNA, 23 nt, Mycobacterium bovis subsp bovis AF2122/97
gcggaguaaacaaacccaacacc

SEQ ID NO: 1099131 - RNA, 13 nt, Mycobacterium bovis subsp bovis AF2122/97
gcggagccgccgc

SEQ ID NO: 1099132 - RNA, 14 nt, Mycobacterium bovis subsp bovis AF2122/97
gcggaguccgucga

SEQ ID NO: 1099133 - RNA, 20 nt, Mycobacterium bovis subsp bovis AF2122/97
gcggaguccgucgacaccgc

SEQ ID NO: 1099134 - RNA, 18 nt, Mycobacterium bovis subsp bovis AF2122/97
gcggaguuuuucggggug

SEQ ID NO: 1099135 - RNA, 17 nt, Mycobacterium bovis subsp bovis AF2122/97
gcggaucgaccgccagc

SEQ ID NO: 1099136 - RNA, 19 nt, Mycobacterium bovis subsp bovis AF2122/97
gcggaucgacuucgacgac

SEQ ID NO: 1099137 - RNA, 22 nt, Mycobacterium bovis subsp bovis AF2122/97
gcggaucgacuucgacgacacg

SEQ ID NO: 1099138 - RNA, 21 nt, Mycobacterium bovis subsp bovis AF2122/97
gcggaucccgaggcgcccaac

SEQ ID NO: 1099139 - RNA, 22 nt, Mycobacterium bovis subsp bovis AF2122/97
gcggaucauccuucgccggcgc

SEQ ID NO: 1099140 - RNA, 19 nt, Mycobacterium bovis subsp bovis AF2122/97
gcggaucagcccgcgcagc

SEQ ID NO: 1099141 - RNA, 19 nt, Mycobacterium bovis subsp bovis AF2122/97
gcggaucauccuucgccgg

SEQ ID NO: 1099142 - RNA, 19 nt, Mycobacterium bovis subsp bovis AF2122/97
gcggaucaggucuggcgcg

SEQ ID NO: 1099143 - RNA, 20 nt, Mycobacterium bovis subsp bovis AF2122/97
gcggaucaccaucgccgccg

SEQ ID NO: 1099144 - RNA, 21 nt, Mycobacterium bovis subsp bovis AF2122/97
gcggaucaacaggccggcucg

SEQ ID NO: 1099145 - RNA, 22 nt, Mycobacterium bovis subsp bovis AF2122/97
gcggaucaacaggccggcucgc

SEQ ID NO: 1099146 - RNA, 15 nt, Mycobacterium bovis subsp bovis AF2122/97
gcggaggcgaccccg

SEQ ID NO: 1099147 - RNA, 12 nt, Mycobacterium bovis subsp bovis AF2122/97
gcggagccgcca

SEQ ID NO: 1099148 - RNA, 14 nt, Mycobacterium bovis subsp bovis AF2122/97
gcggagcgcccuug

SEQ ID NO: 1099149 - RNA, 15 nt, Mycobacterium bovis subsp bovis AF2122/97
gcggagcgggccagc

SEQ ID NO: 1099150 - RNA, 17 nt, Mycobacterium bovis subsp bovis AF2122/97
gcggagcgggccagcac

SEQ ID NO: 1099151 - RNA, 12 nt, Mycobacterium bovis subsp bovis AF2122/97
gcggaggcggcc

SEQ ID NO: 1099152 - RNA, 14 nt, Mycobacterium bovis subsp bovis AF2122/97
gcggaggcggccag

SEQ ID NO: 1099153 - RNA, 16 nt, Mycobacterium bovis subsp bovis AF2122/97
gcggaggcggccagcc

SEQ ID NO: 1099154 - RNA, 16 nt, Mycobacterium bovis subsp bovis AF2122/97
gcggaggcugggcuga

SEQ ID NO: 1099155 - RNA, 13 nt, Mycobacterium bovis subsp bovis AF2122/97
gcggagauaccgg

SEQ ID NO: 1099156 - RNA, 20 nt, Mycobacterium bovis subsp bovis AF2122/97
gcggagauaccggaccccaa

SEQ ID NO: 1099157 - RNA, 20 nt, Mycobacterium bovis subsp bovis AF2122/97
gcggagcaauuccacgaucg

SEQ ID NO: 1099158 - RNA, 21 nt, Mycobacterium bovis subsp bovis AF2122/97
gcggagcaauuccacgaucgg

SEQ ID NO: 1099159 - RNA, 13 nt, Mycobacterium bovis subsp bovis AF2122/97
gcggagccggcgc

SEQ ID NO: 1099160 - RNA, 15 nt, Mycobacterium bovis subsp bovis AF2122/97
gcggagccggcgcau

SEQ ID NO: 1099161 - RNA, 15 nt, Mycobacterium bovis subsp bovis AF2122/97
gcggagccgucgcau

SEQ ID NO: 1099162 - RNA, 13 nt, Mycobacterium bovis subsp bovis AF2122/97
gcggagccaggac

SEQ ID NO: 1099163 - RNA, 18 nt, Mycobacterium bovis subsp bovis AF2122/97
gcggagccaggacgacgc

SEQ ID NO: 1099164 - RNA, 21 nt, Mycobacterium bovis subsp bovis AF2122/97
gcggagccaggacgacgccga

SEQ ID NO: 1099165 - RNA, 14 nt, Mycobacterium bovis subsp bovis AF2122/97
gcggagacgaucgc

SEQ ID NO: 1099166 - RNA, 23 nt, Mycobacterium bovis subsp bovis AF2122/97
gcggagaacaucccccggcuggu

SEQ ID NO: 1099167 - RNA, 19 nt, Mycobacterium bovis subsp bovis AF2122/97
gcggagacgaucgccaggc

SEQ ID NO: 1099168 - RNA, 22 nt, Mycobacterium bovis subsp bovis AF2122/97
gcggagacgaucgccaggccga

SEQ ID NO: 1099169 - RNA, 23 nt, Mycobacterium bovis subsp bovis AF2122/97
gcggagacuccagcaaggccagc

SEQ ID NO: 1099170 - RNA, 17 nt, Mycobacterium bovis subsp bovis AF2122/97
gcggagagccugcucgc

SEQ ID NO: 1099171 - RNA, 20 nt, Mycobacterium bovis subsp bovis AF2122/97
gcggagagccugcucgcagc

SEQ ID NO: 1099172 - RNA, 19 nt, Mycobacterium bovis subsp bovis AF2122/97
gcggagagcgccuuagcca

SEQ ID NO: 1099173 - RNA, 13 nt, Mycobacterium bovis subsp bovis AF2122/97
gcggacgccgcgc

SEQ ID NO: 1099174 - RNA, 18 nt, Mycobacterium bovis subsp bovis AF2122/97
gcggacgccgcgccggcg

SEQ ID NO: 1099175 - RNA, 17 nt, Mycobacterium bovis subsp bovis AF2122/97
gcggacgggacgcaugc

SEQ ID NO: 1099176 - RNA, 14 nt, Mycobacterium bovis subsp bovis AF2122/97
gcggacucgggcag

SEQ ID NO: 1099177 - RNA, 15 nt, Mycobacterium bovis subsp bovis AF2122/97
gcggacugacgucga

SEQ ID NO: 1099178 - RNA, 16 nt, Mycobacterium bovis subsp bovis AF2122/97
gcggacuucgccgccc

SEQ ID NO: 1099179 - RNA, 14 nt, Mycobacterium bovis subsp bovis AF2122/97
gcggagaaaagcgc

SEQ ID NO: 1099180 - RNA, 20 nt, Mycobacterium bovis subsp bovis AF2122/97
gcggagaaaagcgcgcuacg

SEQ ID NO: 1099181 - RNA, 22 nt, Mycobacterium bovis subsp bovis AF2122/97
gcggacgguguacaggucgccg

SEQ ID NO: 1099182 - RNA, 23 nt, Mycobacterium bovis subsp bovis AF2122/97
gcggacgguguacaggucgccgg

SEQ ID NO: 1099183 - RNA, 15 nt, Mycobacterium bovis subsp bovis AF2122/97
gcggacgucgccccg

SEQ ID NO: 1099184 - RNA, 19 nt, Mycobacterium bovis subsp bovis AF2122/97
gcggacucacgaggcacaa

SEQ ID NO: 1099185 - RNA, 15 nt, Mycobacterium bovis subsp bovis AF2122/97
gcggaugucgucgac

SEQ ID NO: 1099186 - RNA, 19 nt, Mycobacterium bovis subsp bovis AF2122/97
gcggauguccuugcggucc

SEQ ID NO: 1099187 - RNA, 22 nt, Mycobacterium bovis subsp bovis AF2122/97
gcggaugucgucgaccaggcca

SEQ ID NO: 1099188 - RNA, 19 nt, Mycobacterium bovis subsp bovis AF2122/97
gcggaugucgucgaccagg

SEQ ID NO: 1099189 - RNA, 17 nt, Mycobacterium bovis subsp bovis AF2122/97
gcggauuaagucggcgg

SEQ ID NO: 1099190 - RNA, 15 nt, Mycobacterium bovis subsp bovis AF2122/97
gcggauuccggcucg

SEQ ID NO: 1099191 - RNA, 14 nt, Mycobacterium bovis subsp bovis AF2122/97
gcggauucgcgcug

SEQ ID NO: 1099192 - RNA, 21 nt, Mycobacterium bovis subsp bovis AF2122/97
gcggauucgcgcuguccacga

SEQ ID NO: 1099193 - RNA, 23 nt, Mycobacterium bovis subsp bovis AF2122/97
gcggauucgcgcuguccacgaug

SEQ ID NO: 1099194 - RNA, 15 nt, Mycobacterium bovis subsp bovis AF2122/97
gcggauucggcgcug

SEQ ID NO: 1099195 - RNA, 17 nt, Mycobacterium bovis subsp bovis AF2122/97
gcggauucggcgcugcg

SEQ ID NO: 1099196 - RNA, 19 nt, Mycobacterium bovis subsp bovis AF2122/97
gcggauucggcgcugcggc

SEQ ID NO: 1099197 - RNA, 12 nt, Mycobacterium bovis subsp bovis AF2122/97
gcggaugcccgc

SEQ ID NO: 1099198 - RNA, 16 nt, Mycobacterium bovis subsp bovis AF2122/97
gcggauguccccgacg

SEQ ID NO: 1099199 - RNA, 17 nt, Mycobacterium bovis subsp bovis AF2122/97
gcggaucgucgucgugu

SEQ ID NO: 1099200 - RNA, 22 nt, Mycobacterium bovis subsp bovis AF2122/97
gcggaucucaccacccgucggc

SEQ ID NO: 1099201 - RNA, 22 nt, Mycobacterium bovis subsp bovis AF2122/97
gcggaucucaucgggccacagc

SEQ ID NO: 1099202 - RNA, 21 nt, Mycobacterium bovis subsp bovis AF2122/97
gcggaucuguuccucggugac

SEQ ID NO: 1099203 - RNA, 13 nt, Mycobacterium bovis subsp bovis AF2122/97
gcggaucgcgcug

SEQ ID NO: 1099204 - RNA, 22 nt, Mycobacterium bovis subsp bovis AF2122/97
gcggaucgcgcugaucagccca

SEQ ID NO: 1099205 - RNA, 15 nt, Mycobacterium bovis subsp bovis AF2122/97
gcggaucgcgcugau

SEQ ID NO: 1099206 - RNA, 12 nt, Mycobacterium bovis subsp bovis AF2122/97
gcggaucgccgg

SEQ ID NO: 1099207 - RNA, 16 nt, Mycobacterium bovis subsp bovis AF2122/97
gcggaucgagcaguuc

SEQ ID NO: 1099208 - RNA, 15 nt, Mycobacterium bovis subsp bovis AF2122/97
gcggaucgcgcugcg

SEQ ID NO: 1099209 - RNA, 13 nt, Mycobacterium bovis subsp bovis AF2122/97
gcggaucggcgga

SEQ ID NO: 1099210 - RNA, 20 nt, Mycobacterium bovis subsp bovis AF2122/97
gcggaucggcggaccgcagc

SEQ ID NO: 1099211 - RNA, 14 nt, Mycobacterium bovis subsp bovis AF2122/97
gcggaucggcggcc

SEQ ID NO: 1099212 - RNA, 15 nt, Mycobacterium bovis subsp bovis AF2122/97
gcggaucggcggccg

SEQ ID NO: 1099213 - RNA, 16 nt, Mycobacterium bovis subsp bovis AF2122/97
gcggaucggcggccgg

SEQ ID NO: 1099214 - RNA, 20 nt, Mycobacterium bovis subsp bovis AF2122/97
gcggauugccgcgcgcaagc

SEQ ID NO: 1099215 - RNA, 17 nt, Mycobacterium bovis subsp bovis AF2122/97
gcggauuugccccguug

SEQ ID NO: 1099216 - RNA, 21 nt, Mycobacterium bovis subsp bovis AF2122/97
gcggcaaaguuggccgcccga

SEQ ID NO: 1099217 - RNA, 12 nt, Mycobacterium bovis subsp bovis AF2122/97
gcggcaacagcg

SEQ ID NO: 1099218 - RNA, 17 nt, Mycobacterium bovis subsp bovis AF2122/97
gcggaugagcucggcca

SEQ ID NO: 1099219 - RNA, 15 nt, Mycobacterium bovis subsp bovis AF2122/97
gcggcaacaccaccu

SEQ ID NO: 1099220 - RNA, 17 nt, Mycobacterium bovis subsp bovis AF2122/97
gcggcaacaccaccucg

SEQ ID NO: 1099221 - RNA, 15 nt, Mycobacterium bovis subsp bovis AF2122/97
gcggcaaccgccgcc

SEQ ID NO: 1099222 - RNA, 18 nt, Mycobacterium bovis subsp bovis AF2122/97
gcggcaaccgccgccacc

SEQ ID NO: 1099223 - RNA, 20 nt, Mycobacterium bovis subsp bovis AF2122/97
gcggcaaccgccgccaccag

SEQ ID NO: 1099224 - RNA, 21 nt, Mycobacterium bovis subsp bovis AF2122/97
gcggcaaccgccgccaccagg

SEQ ID NO: 1099225 - RNA, 16 nt, Mycobacterium bovis subsp bovis AF2122/97
gcggcaaccgucgaaa

SEQ ID NO: 1099226 - RNA, 21 nt, Mycobacterium bovis subsp bovis AF2122/97
gcggcaaccucaugcacgccg

SEQ ID NO: 1099227 - RNA, 15 nt, Mycobacterium bovis subsp bovis AF2122/97
gcggcaacaugucac

SEQ ID NO: 1099228 - RNA, 22 nt, Mycobacterium bovis subsp bovis AF2122/97
gcggcacacccaucaccgccag

SEQ ID NO: 1099229 - RNA, 21 nt, Mycobacterium bovis subsp bovis AF2122/97
gcggcacacccaucaccgcca

SEQ ID NO: 1099230 - RNA, 18 nt, Mycobacterium bovis subsp bovis AF2122/97
gcggcaaugaggccgucu

SEQ ID NO: 1099231 - RNA, 22 nt, Mycobacterium bovis subsp bovis AF2122/97
gcggcaauucgggcauggucgc

SEQ ID NO: 1099232 - RNA, 18 nt, Mycobacterium bovis subsp bovis AF2122/97
gcggcaacgaucgacacc

SEQ ID NO: 1099233 - RNA, 17 nt, Mycobacterium bovis subsp bovis AF2122/97
gcggcaacgcggucugc

SEQ ID NO: 1099234 - RNA, 14 nt, Mycobacterium bovis subsp bovis AF2122/97
gcggcaacggcggc

SEQ ID NO: 1099235 - RNA, 16 nt, Mycobacterium bovis subsp bovis AF2122/97
gcggcaacggcggcau

SEQ ID NO: 1099236 - RNA, 18 nt, Mycobacterium bovis subsp bovis AF2122/97
gcggcaacggcggcaucg

SEQ ID NO: 1099237 - RNA, 15 nt, Mycobacterium bovis subsp bovis AF2122/97
gcggcaacggcggcg

SEQ ID NO: 1099238 - RNA, 22 nt, Mycobacterium bovis subsp bovis AF2122/97
gcggcaacggcggcgacggcgg

SEQ ID NO: 1099239 - RNA, 16 nt, Mycobacterium bovis subsp bovis AF2122/97
gcggcaacggcgguga

SEQ ID NO: 1099240 - RNA, 15 nt, Mycobacterium bovis subsp bovis AF2122/97
gcggcaacggcucgu

SEQ ID NO: 1099241 - RNA, 18 nt, Mycobacterium bovis subsp bovis AF2122/97
gcggcaacggcucgucga

SEQ ID NO: 1099242 - RNA, 15 nt, Mycobacterium bovis subsp bovis AF2122/97
gcggcaacgggggcg

SEQ ID NO: 1099243 - RNA, 17 nt, Mycobacterium bovis subsp bovis AF2122/97
gcggcaagggcggcaac

SEQ ID NO: 1099244 - RNA, 21 nt, Mycobacterium bovis subsp bovis AF2122/97
gcggcaaggguggggccggcg

SEQ ID NO: 1099245 - RNA, 22 nt, Mycobacterium bovis subsp bovis AF2122/97
gcggcaaggguggggccggcgg

SEQ ID NO: 1099246 - RNA, 15 nt, Mycobacterium bovis subsp bovis AF2122/97
gcggcaagcgcacgc

SEQ ID NO: 1099247 - RNA, 22 nt, Mycobacterium bovis subsp bovis AF2122/97
gcggcaccucauugccguucuc

SEQ ID NO: 1099248 - RNA, 15 nt, Mycobacterium bovis subsp bovis AF2122/97
gcggcaccuggcuug

SEQ ID NO: 1099249 - RNA, 13 nt, Mycobacterium bovis subsp bovis AF2122/97
gcggcaccggcuc

SEQ ID NO: 1099250 - RNA, 15 nt, Mycobacterium bovis subsp bovis AF2122/97
gcggcacgaucggca

SEQ ID NO: 1099251 - RNA, 20 nt, Mycobacterium bovis subsp bovis AF2122/97
gcggcacgaucgccaacgac

SEQ ID NO: 1099252 - RNA, 13 nt, Mycobacterium bovis subsp bovis AF2122/97
gcggcacgaucgg

SEQ ID NO: 1099253 - RNA, 17 nt, Mycobacterium bovis subsp bovis AF2122/97
gcggcaccgccccgcca

SEQ ID NO: 1099254 - RNA, 14 nt, Mycobacterium bovis subsp bovis AF2122/97
gcggcaccgcgccg

SEQ ID NO: 1099255 - RNA, 18 nt, Mycobacterium bovis subsp bovis AF2122/97
gcggcaccgcgccggcgg

SEQ ID NO: 1099256 - RNA, 20 nt, Mycobacterium bovis subsp bovis AF2122/97
gcggcaccgcgccggcggaa

SEQ ID NO: 1099257 - RNA, 14 nt, Mycobacterium bovis subsp bovis AF2122/97
gcggcaccgcggcc

SEQ ID NO: 1099258 - RNA, 17 nt, Mycobacterium bovis subsp bovis AF2122/97
gcggcaccgcggccagc

SEQ ID NO: 1099259 - RNA, 19 nt, Mycobacterium bovis subsp bovis AF2122/97
gcggcaccgcggccagcgg

SEQ ID NO: 1099260 - RNA, 16 nt, Mycobacterium bovis subsp bovis AF2122/97
gcggcaccgauggcgc

SEQ ID NO: 1099261 - RNA, 23 nt, Mycobacterium bovis subsp bovis AF2122/97
gcggcaccgauggcgcaccggcg

SEQ ID NO: 1099262 - RNA, 23 nt, Mycobacterium bovis subsp bovis AF2122/97
gcggcacccagucggcgccgccg

SEQ ID NO: 1099263 - RNA, 20 nt, Mycobacterium bovis subsp bovis AF2122/97
gcggcacccggguggcacgc

SEQ ID NO: 1099264 - RNA, 19 nt, Mycobacterium bovis subsp bovis AF2122/97
gcggcacccaaccaggccg

SEQ ID NO: 1099265 - RNA, 22 nt, Mycobacterium bovis subsp bovis AF2122/97
gcggcacccaaccaggccgcga

SEQ ID NO: 1099266 - RNA, 18 nt, Mycobacterium bovis subsp bovis AF2122/97
gcggcacccagucggcgc

SEQ ID NO: 1099267 - RNA, 23 nt, Mycobacterium bovis subsp bovis AF2122/97
gcggcaccagcaccgucggggug

SEQ ID NO: 1099268 - RNA, 13 nt, Mycobacterium bovis subsp bovis AF2122/97
gcggcaccagcac

SEQ ID NO: 1099269 - RNA, 15 nt, Mycobacterium bovis subsp bovis AF2122/97
gcggcaccagcaccg

SEQ ID NO: 1099270 - RNA, 15 nt, Mycobacterium bovis subsp bovis AF2122/97
gcggcaccacgucga

SEQ ID NO: 1099271 - RNA, 12 nt, Mycobacterium bovis subsp bovis AF2122/97
gcggcaccaccc

SEQ ID NO: 1099272 - RNA, 20 nt, Mycobacterium bovis subsp bovis AF2122/97
gcggcagcuacuaugccaac

SEQ ID NO: 1099273 - RNA, 15 nt, Mycobacterium bovis subsp bovis AF2122/97
gcggcagcggcgauc

SEQ ID NO: 1099274 - RNA, 14 nt, Mycobacterium bovis subsp bovis AF2122/97
gcggcagcgguggc

SEQ ID NO: 1099275 - RNA, 15 nt, Mycobacterium bovis subsp bovis AF2122/97
gcggcagcgguggcu

SEQ ID NO: 1099276 - RNA, 14 nt, Mycobacterium bovis subsp bovis AF2122/97
gcggcagcgcggcc

SEQ ID NO: 1099277 - RNA, 17 nt, Mycobacterium bovis subsp bovis AF2122/97
gcggcagcgcggccaau

SEQ ID NO: 1099278 - RNA, 17 nt, Mycobacterium bovis subsp bovis AF2122/97
gcggcagcggcgccgcc

SEQ ID NO: 1099279 - RNA, 16 nt, Mycobacterium bovis subsp bovis AF2122/97
gcggcagcggcguagc

SEQ ID NO: 1099280 - RNA, 14 nt, Mycobacterium bovis subsp bovis AF2122/97
gcggcagcgaggcu

SEQ ID NO: 1099281 - RNA, 21 nt, Mycobacterium bovis subsp bovis AF2122/97
gcggcagcgagucgacgucga

SEQ ID NO: 1099282 - RNA, 19 nt, Mycobacterium bovis subsp bovis AF2122/97
gcggcagcgaaagcgucga

SEQ ID NO: 1099283 - RNA, 14 nt, Mycobacterium bovis subsp bovis AF2122/97
gcggcagccggcgg

SEQ ID NO: 1099284 - RNA, 16 nt, Mycobacterium bovis subsp bovis AF2122/97
gcggcagccggcggag

SEQ ID NO: 1099285 - RNA, 23 nt, Mycobacterium bovis subsp bovis AF2122/97
gcggcagcauauccgccggcgac

SEQ ID NO: 1099286 - RNA, 17 nt, Mycobacterium bovis subsp bovis AF2122/97
gcggcagcccgcuggcc

SEQ ID NO: 1099287 - RNA, 14 nt, Mycobacterium bovis subsp bovis AF2122/97
gcggcagcccccgg

SEQ ID NO: 1099288 - RNA, 14 nt, Mycobacterium bovis subsp bovis AF2122/97
gcggcacgcucgcg

SEQ ID NO: 1099289 - RNA, 15 nt, Mycobacterium bovis subsp bovis AF2122/97
gcggcacgcugaccg

SEQ ID NO: 1099290 - RNA, 14 nt, Mycobacterium bovis subsp bovis AF2122/97
gcggcacggugugc

SEQ ID NO: 1099291 - RNA, 18 nt, Mycobacterium bovis subsp bovis AF2122/97
gcggcagcaacgacgucg

SEQ ID NO: 1099292 - RNA, 19 nt, Mycobacterium bovis subsp bovis AF2122/97
gcggcagauacucggcgac

SEQ ID NO: 1099293 - RNA, 18 nt, Mycobacterium bovis subsp bovis AF2122/97
gcggcagauacucggcga

SEQ ID NO: 1099294 - RNA, 23 nt, Mycobacterium bovis subsp bovis AF2122/97
gcggcacuuuguagcccgcgauc

SEQ ID NO: 1099295 - RNA, 23 nt, Mycobacterium bovis subsp bovis AF2122/97
gcggcgaccagcucagcugcgga

SEQ ID NO: 1099296 - RNA, 12 nt, Mycobacterium bovis subsp bovis AF2122/97
gcggcgaccagg

SEQ ID NO: 1099297 - RNA, 22 nt, Mycobacterium bovis subsp bovis AF2122/97
gcggcgaccgcggucgccaaga

SEQ ID NO: 1099298 - RNA, 13 nt, Mycobacterium bovis subsp bovis AF2122/97
gcggcgaccguca

SEQ ID NO: 1099299 - RNA, 12 nt, Mycobacterium bovis subsp bovis AF2122/97
gcggcgaccgcc

SEQ ID NO: 1099300 - RNA, 16 nt, Mycobacterium bovis subsp bovis AF2122/97
gcggcgaccgccagcg

SEQ ID NO: 1099301 - RNA, 13 nt, Mycobacterium bovis subsp bovis AF2122/97
gcggcgacgaccg

SEQ ID NO: 1099302 - RNA, 14 nt, Mycobacterium bovis subsp bovis AF2122/97
gcggcgacgaccgu

SEQ ID NO: 1099303 - RNA, 15 nt, Mycobacterium bovis subsp bovis AF2122/97
gcggcgacgaccguc

SEQ ID NO: 1099304 - RNA, 16 nt, Mycobacterium bovis subsp bovis AF2122/97
gcggcgacgaccgucg

SEQ ID NO: 1099305 - RNA, 22 nt, Mycobacterium bovis subsp bovis AF2122/97
gcggcgacgauucgagcgguug

SEQ ID NO: 1099306 - RNA, 17 nt, Mycobacterium bovis subsp bovis AF2122/97
gcggcgacgaccgucgg

SEQ ID NO: 1099307 - RNA, 13 nt, Mycobacterium bovis subsp bovis AF2122/97
gcggcgacccgcc

SEQ ID NO: 1099308 - RNA, 18 nt, Mycobacterium bovis subsp bovis AF2122/97
gcggcgacgaccgucggc

SEQ ID NO: 1099309 - RNA, 15 nt, Mycobacterium bovis subsp bovis AF2122/97
gcggcgacgucucgc

SEQ ID NO: 1099310 - RNA, 13 nt, Mycobacterium bovis subsp bovis AF2122/97
gcggcgacggcgg

SEQ ID NO: 1099311 - RNA, 14 nt, Mycobacterium bovis subsp bovis AF2122/97
gcggcgacggcggc

SEQ ID NO: 1099312 - RNA, 18 nt, Mycobacterium bovis subsp bovis AF2122/97
gcggcgacggcggcacgg

SEQ ID NO: 1099313 - RNA, 15 nt, Mycobacterium bovis subsp bovis AF2122/97
gcggcgaucaacucg

SEQ ID NO: 1099314 - RNA, 23 nt, Mycobacterium bovis subsp bovis AF2122/97
gcggcgaucaacucgggcagcgc

SEQ ID NO: 1099315 - RNA, 11 nt, Mycobacterium bovis subsp bovis AF2122/97
gcggcgaucaa

SEQ ID NO: 1099316 - RNA, 22 nt, Mycobacterium bovis subsp bovis AF2122/97
gcggcgauacccaucgaucgaa

SEQ ID NO: 1099317 - RNA, 20 nt, Mycobacterium bovis subsp bovis AF2122/97
gcggcgaguuggccguggcg

SEQ ID NO: 1099318 - RNA, 22 nt, Mycobacterium bovis subsp bovis AF2122/97
gcggcgagguauaaacgcggcg

SEQ ID NO: 1099319 - RNA, 15 nt, Mycobacterium bovis subsp bovis AF2122/97
gcggcgaggcggucg

SEQ ID NO: 1099320 - RNA, 16 nt, Mycobacterium bovis subsp bovis AF2122/97
gcggcgaggcggucgc

SEQ ID NO: 1099321 - RNA, 19 nt, Mycobacterium bovis subsp bovis AF2122/97
gcggcgaggcggucgccga

SEQ ID NO: 1099322 - RNA, 16 nt, Mycobacterium bovis subsp bovis AF2122/97
gcggcgaguuggccgu

SEQ ID NO: 1099323 - RNA, 21 nt, Mycobacterium bovis subsp bovis AF2122/97
gcggcgagcggccuccagcac

SEQ ID NO: 1099324 - RNA, 21 nt, Mycobacterium bovis subsp bovis AF2122/97
gcggcgacguggcgccgacag

SEQ ID NO: 1099325 - RNA, 14 nt, Mycobacterium bovis subsp bovis AF2122/97
gcggcgagcacgcg

SEQ ID NO: 1099326 - RNA, 18 nt, Mycobacterium bovis subsp bovis AF2122/97
gcggcgacggugccaccg

SEQ ID NO: 1099327 - RNA, 14 nt, Mycobacterium bovis subsp bovis AF2122/97
gcggcgaagccggg

SEQ ID NO: 1099328 - RNA, 20 nt, Mycobacterium bovis subsp bovis AF2122/97
gcggcgaagauaucggcacg

SEQ ID NO: 1099329 - RNA, 21 nt, Mycobacterium bovis subsp bovis AF2122/97
gcggcgaaccgucucgccccc

SEQ ID NO: 1099330 - RNA, 22 nt, Mycobacterium bovis subsp bovis AF2122/97
gcggcgaagucuuucuccccca

SEQ ID NO: 1099331 - RNA, 16 nt, Mycobacterium bovis subsp bovis AF2122/97
gcggcgaagugcaccc

SEQ ID NO: 1099332 - RNA, 18 nt, Mycobacterium bovis subsp bovis AF2122/97
gcggcgaaugccagugac

SEQ ID NO: 1099333 - RNA, 15 nt, Mycobacterium bovis subsp bovis AF2122/97
gcggcagguucggcg

SEQ ID NO: 1099334 - RNA, 13 nt, Mycobacterium bovis subsp bovis AF2122/97
gcggcgacacgcc

SEQ ID NO: 1099335 - RNA, 18 nt, Mycobacterium bovis subsp bovis AF2122/97
gcggcgacauccacaccg

SEQ ID NO: 1099336 - RNA, 19 nt, Mycobacterium bovis subsp bovis AF2122/97
gcggcgacauccacaccgc

SEQ ID NO: 1099337 - RNA, 20 nt, Mycobacterium bovis subsp bovis AF2122/97
gcggcgacauccacaccgcg

SEQ ID NO: 1099338 - RNA, 21 nt, Mycobacterium bovis subsp bovis AF2122/97
gcggcaggugcccaucgggug

SEQ ID NO: 1099339 - RNA, 22 nt, Mycobacterium bovis subsp bovis AF2122/97
gcggcaggugcggcggcaucgg

SEQ ID NO: 1099340 - RNA, 20 nt, Mycobacterium bovis subsp bovis AF2122/97
gcggcgaacaucaccgucgc

SEQ ID NO: 1099341 - RNA, 22 nt, Mycobacterium bovis subsp bovis AF2122/97
gcggcaguaccccucgcacaau

SEQ ID NO: 1099342 - RNA, 15 nt, Mycobacterium bovis subsp bovis AF2122/97
gcggcgaaccagcgc

SEQ ID NO: 1099343 - RNA, 15 nt, Mycobacterium bovis subsp bovis AF2122/97
gcggcaggccggcca

SEQ ID NO: 1099344 - RNA, 17 nt, Mycobacterium bovis subsp bovis AF2122/97
gcggcaggccggccacc

SEQ ID NO: 1099345 - RNA, 18 nt, Mycobacterium bovis subsp bovis AF2122/97
gcggcaggccggccaccg

SEQ ID NO: 1099346 - RNA, 16 nt, Mycobacterium bovis subsp bovis AF2122/97
gcggcaggccuggcga

SEQ ID NO: 1099347 - RNA, 17 nt, Mycobacterium bovis subsp bovis AF2122/97
gcggcaggccuggcgag

SEQ ID NO: 1099348 - RNA, 21 nt, Mycobacterium bovis subsp bovis AF2122/97
gcggcagggcggugccaucgg

SEQ ID NO: 1099349 - RNA, 16 nt, Mycobacterium bovis subsp bovis AF2122/97
gcggcaggguguuuau

SEQ ID NO: 1099350 - RNA, 16 nt, Mycobacterium bovis subsp bovis AF2122/97
gcggcagguagaucag

SEQ ID NO: 1099351 - RNA, 18 nt, Mycobacterium bovis subsp bovis AF2122/97
gcggcgccgccacgguac

SEQ ID NO: 1099352 - RNA, 15 nt, Mycobacterium bovis subsp bovis AF2122/97
gcggcgccgccacgg

SEQ ID NO: 1099353 - RNA, 14 nt, Mycobacterium bovis subsp bovis AF2122/97
gcggcgccgccauc

SEQ ID NO: 1099354 - RNA, 13 nt, Mycobacterium bovis subsp bovis AF2122/97
gcggcgccgccca

SEQ ID NO: 1099355 - RNA, 13 nt, Mycobacterium bovis subsp bovis AF2122/97
gcggcgccgcccu

SEQ ID NO: 1099356 - RNA, 18 nt, Mycobacterium bovis subsp bovis AF2122/97
gcggcgccggaggcggcg

SEQ ID NO: 1099357 - RNA, 16 nt, Mycobacterium bovis subsp bovis AF2122/97
gcggcgccggccucgc

SEQ ID NO: 1099358 - RNA, 18 nt, Mycobacterium bovis subsp bovis AF2122/97
gcggcgccggggggcugc

SEQ ID NO: 1099359 - RNA, 12 nt, Mycobacterium bovis subsp bovis AF2122/97
gcggcgccguga

SEQ ID NO: 1099360 - RNA, 21 nt, Mycobacterium bovis subsp bovis AF2122/97
gcggcgccgugaucagcucgc

SEQ ID NO: 1099361 - RNA, 14 nt, Mycobacterium bovis subsp bovis AF2122/97
gcggcgccguugcc

SEQ ID NO: 1099362 - RNA, 12 nt, Mycobacterium bovis subsp bovis AF2122/97
gcggcgccguug

SEQ ID NO: 1099363 - RNA, 14 nt, Mycobacterium bovis subsp bovis AF2122/97
gcggcgcgaccguc

SEQ ID NO: 1099364 - RNA, 15 nt, Mycobacterium bovis subsp bovis AF2122/97
gcggcgcgaagucuu

SEQ ID NO: 1099365 - RNA, 14 nt, Mycobacterium bovis subsp bovis AF2122/97
gcggcgccuccgcu

SEQ ID NO: 1099366 - RNA, 12 nt, Mycobacterium bovis subsp bovis AF2122/97
gcggcgcgagcc

SEQ ID NO: 1099367 - RNA, 13 nt, Mycobacterium bovis subsp bovis AF2122/97
gcggcgcuggcug

SEQ ID NO: 1099368 - RNA, 14 nt, Mycobacterium bovis subsp bovis AF2122/97
gcggcgcugggacg

SEQ ID NO: 1099369 - RNA, 12 nt, Mycobacterium bovis subsp bovis AF2122/97
gcggcgcuggcu

SEQ ID NO: 1099370 - RNA, 12 nt, Mycobacterium bovis subsp bovis AF2122/97
gcggcgcuggcg

SEQ ID NO: 1099371 - RNA, 16 nt, Mycobacterium bovis subsp bovis AF2122/97
gcggcgcuggccagca

SEQ ID NO: 1099372 - RNA, 12 nt, Mycobacterium bovis subsp bovis AF2122/97
gcggcgcucguc

SEQ ID NO: 1099373 - RNA, 22 nt, Mycobacterium bovis subsp bovis AF2122/97
gcggcgcauaggcggccaucga

SEQ ID NO: 1099374 - RNA, 13 nt, Mycobacterium bovis subsp bovis AF2122/97
gcggcgccgcacc

SEQ ID NO: 1099375 - RNA, 17 nt, Mycobacterium bovis subsp bovis AF2122/97
gcggcgccgcacccaca

SEQ ID NO: 1099376 - RNA, 13 nt, Mycobacterium bovis subsp bovis AF2122/97
gcggcgccgcaga

SEQ ID NO: 1099377 - RNA, 17 nt, Mycobacterium bovis subsp bovis AF2122/97
gcggcgccacguggucg

SEQ ID NO: 1099378 - RNA, 13 nt, Mycobacterium bovis subsp bovis AF2122/97
gcggcgccacgug

SEQ ID NO: 1099379 - RNA, 21 nt, Mycobacterium bovis subsp bovis AF2122/97
gcggcgcaugcaagucaaacg

SEQ ID NO: 1099380 - RNA, 16 nt, Mycobacterium bovis subsp bovis AF2122/97
gcggcgaucgagguga

SEQ ID NO: 1099381 - RNA, 16 nt, Mycobacterium bovis subsp bovis AF2122/97
gcggcgaucaggcgga

SEQ ID NO: 1099382 - RNA, 19 nt, Mycobacterium bovis subsp bovis AF2122/97
gcggcgaugguagucgcga

SEQ ID NO: 1099383 - RNA, 22 nt, Mycobacterium bovis subsp bovis AF2122/97
gcggcgaugguagucgcgaccg

SEQ ID NO: 1099384 - RNA, 19 nt, Mycobacterium bovis subsp bovis AF2122/97
gcggcgaugguaucgccgc

SEQ ID NO: 1099385 - RNA, 23 nt, Mycobacterium bovis subsp bovis AF2122/97
gcggcgaugaccgggcgauucgc

SEQ ID NO: 1099386 - RNA, 21 nt, Mycobacterium bovis subsp bovis AF2122/97
gcggcgaucgcuccgcggcgc

SEQ ID NO: 1099387 - RNA, 17 nt, Mycobacterium bovis subsp bovis AF2122/97
gcggcuaggcaccagcg

SEQ ID NO: 1099388 - RNA, 16 nt, Mycobacterium bovis subsp bovis AF2122/97
gcggcuaggccagcac

SEQ ID NO: 1099389 - RNA, 16 nt, Mycobacterium bovis subsp bovis AF2122/97
gcggcuacggcugccc

SEQ ID NO: 1099390 - RNA, 22 nt, Mycobacterium bovis subsp bovis AF2122/97
gcggcuacuccaacugaucccg

SEQ ID NO: 1099391 - RNA, 16 nt, Mycobacterium bovis subsp bovis AF2122/97
gcggcuaccgagauca

SEQ ID NO: 1099392 - RNA, 14 nt, Mycobacterium bovis subsp bovis AF2122/97
gcggcuccaccggg

SEQ ID NO: 1099393 - RNA, 19 nt, Mycobacterium bovis subsp bovis AF2122/97
gcggcuccaccgggcccgc

SEQ ID NO: 1099394 - RNA, 19 nt, Mycobacterium bovis subsp bovis AF2122/97
gcggcuauggcgccgcggc

SEQ ID NO: 1099395 - RNA, 12 nt, Mycobacterium bovis subsp bovis AF2122/97
gcggcucacgac

SEQ ID NO: 1099396 - RNA, 17 nt, Mycobacterium bovis subsp bovis AF2122/97
gcggcugaauucggcga

SEQ ID NO: 1099397 - RNA, 22 nt, Mycobacterium bovis subsp bovis AF2122/97
gcggcugagccgcaucuggccg

SEQ ID NO: 1099398 - RNA, 22 nt, Mycobacterium bovis subsp bovis AF2122/97
gcggcugcaacgauugaacucu

SEQ ID NO: 1099399 - RNA, 14 nt, Mycobacterium bovis subsp bovis AF2122/97
gcggcugcaccggc

SEQ ID NO: 1099400 - RNA, 15 nt, Mycobacterium bovis subsp bovis AF2122/97
gcggcugcaccggcu

SEQ ID NO: 1099401 - RNA, 20 nt, Mycobacterium bovis subsp bovis AF2122/97
gcggcgucguggaucuucgc

SEQ ID NO: 1099402 - RNA, 23 nt, Mycobacterium bovis subsp bovis AF2122/97
gcggcgucguggaucuucgcgcu

SEQ ID NO: 1099403 - RNA, 22 nt, Mycobacterium bovis subsp bovis AF2122/97
gcggcgucuucgucggagucuu

SEQ ID NO: 1099404 - RNA, 14 nt, Mycobacterium bovis subsp bovis AF2122/97
gcggcgucgucgau

SEQ ID NO: 1099405 - RNA, 13 nt, Mycobacterium bovis subsp bovis AF2122/97
gcggcgucgguga

SEQ ID NO: 1099406 - RNA, 16 nt, Mycobacterium bovis subsp bovis AF2122/97
gcggcuacaucggcgg

SEQ ID NO: 1099407 - RNA, 22 nt, Mycobacterium bovis subsp bovis AF2122/97
gcggcuacaucggcggcgucga

SEQ ID NO: 1099408 - RNA, 21 nt, Mycobacterium bovis subsp bovis AF2122/97
gcggcuacccauggcccguug

SEQ ID NO: 1099409 - RNA, 15 nt, Mycobacterium bovis subsp bovis AF2122/97
gcggcgucgaugagg

SEQ ID NO: 1099410 - RNA, 21 nt, Mycobacterium bovis subsp bovis AF2122/97
gcggcgguuucggugguaacg

SEQ ID NO: 1099411 - RNA, 13 nt, Mycobacterium bovis subsp bovis AF2122/97
gcggcgucgacgg

SEQ ID NO: 1099412 - RNA, 16 nt, Mycobacterium bovis subsp bovis AF2122/97
gcggcgucgacggcuc

SEQ ID NO: 1099413 - RNA, 14 nt, Mycobacterium bovis subsp bovis AF2122/97
gcggcgucgaacgu

SEQ ID NO: 1099414 - RNA, 17 nt, Mycobacterium bovis subsp bovis AF2122/97
gcggcggaaggcgucga

SEQ ID NO: 1099415 - RNA, 18 nt, Mycobacterium bovis subsp bovis AF2122/97
gcggcggaacaccgacga

SEQ ID NO: 1099416 - RNA, 20 nt, Mycobacterium bovis subsp bovis AF2122/97
gcggcgcgaucgacgcucgg

SEQ ID NO: 1099417 - RNA, 22 nt, Mycobacterium bovis subsp bovis AF2122/97
gcggcggaacaccgacgacacc

SEQ ID NO: 1099418 - RNA, 17 nt, Mycobacterium bovis subsp bovis AF2122/97
gcggcggauggcgucga

SEQ ID NO: 1099419 - RNA, 13 nt, Mycobacterium bovis subsp bovis AF2122/97
gcggcggauuccg

SEQ ID NO: 1099420 - RNA, 16 nt, Mycobacterium bovis subsp bovis AF2122/97
gcggcggcaaccccga

SEQ ID NO: 1099421 - RNA, 14 nt, Mycobacterium bovis subsp bovis AF2122/97
gcggcggcaacggc

SEQ ID NO: 1099422 - RNA, 21 nt, Mycobacterium bovis subsp bovis AF2122/97
gcggcgguaccggaaucggcg

SEQ ID NO: 1099423 - RNA, 16 nt, Mycobacterium bovis subsp bovis AF2122/97
gcggcggucaccaccg

SEQ ID NO: 1099424 - RNA, 19 nt, Mycobacterium bovis subsp bovis AF2122/97
gcggcgguaugccacaggc

SEQ ID NO: 1099425 - RNA, 13 nt, Mycobacterium bovis subsp bovis AF2122/97
gcggcgguggcga

SEQ ID NO: 1099426 - RNA, 20 nt, Mycobacterium bovis subsp bovis AF2122/97
gcggcggugguaccggcgcc

SEQ ID NO: 1099427 - RNA, 23 nt, Mycobacterium bovis subsp bovis AF2122/97
gcggcggugguaccggcgccacc

SEQ ID NO: 1099428 - RNA, 20 nt, Mycobacterium bovis subsp bovis AF2122/97
gcggcgguggccagcgucgc

SEQ ID NO: 1099429 - RNA, 22 nt, Mycobacterium bovis subsp bovis AF2122/97
gcggcgguggccagcgucgcga

SEQ ID NO: 1099430 - RNA, 21 nt, Mycobacterium bovis subsp bovis AF2122/97
gcggcgguuaucgucggguca

SEQ ID NO: 1099431 - RNA, 23 nt, Mycobacterium bovis subsp bovis AF2122/97
gcggcgguuaucgucgggucacc

SEQ ID NO: 1099432 - RNA, 15 nt, Mycobacterium bovis subsp bovis AF2122/97
gcggcggucgagcga

SEQ ID NO: 1099433 - RNA, 17 nt, Mycobacterium bovis subsp bovis AF2122/97
gcggcggucgagcgaac

SEQ ID NO: 1099434 - RNA, 15 nt, Mycobacterium bovis subsp bovis AF2122/97
gcggcggucaugggc

SEQ ID NO: 1099435 - RNA, 23 nt, Mycobacterium bovis subsp bovis AF2122/97
gcggcggucaugggcgcguagcu

SEQ ID NO: 1099436 - RNA, 17 nt, Mycobacterium bovis subsp bovis AF2122/97
gcggcggucguugccga

SEQ ID NO: 1099437 - RNA, 19 nt, Mycobacterium bovis subsp bovis AF2122/97
gcggcggucucggcgucga

SEQ ID NO: 1099438 - RNA, 20 nt, Mycobacterium bovis subsp bovis AF2122/97
gcggcggucucggcgucgac

SEQ ID NO: 1099439 - RNA, 22 nt, Mycobacterium bovis subsp bovis AF2122/97
gcggcggucucgucaaccugcg

SEQ ID NO: 1099440 - RNA, 22 nt, Mycobacterium bovis subsp bovis AF2122/97
gcggcggucugagacucgucga

SEQ ID NO: 1099441 - RNA, 22 nt, Mycobacterium bovis subsp bovis AF2122/97
gcggcggucuuuuugggcuugc

SEQ ID NO: 1099442 - RNA, 18 nt, Mycobacterium bovis subsp bovis AF2122/97
gcggcggucaccaccgac

SEQ ID NO: 1099443 - RNA, 19 nt, Mycobacterium bovis subsp bovis AF2122/97
gcggcggucaccaccgacc

SEQ ID NO: 1099444 - RNA, 17 nt, Mycobacterium bovis subsp bovis AF2122/97
gcggcggugcagcaggg

SEQ ID NO: 1099445 - RNA, 21 nt, Mycobacterium bovis subsp bovis AF2122/97
gcggcugcuuggucgcccagc

SEQ ID NO: 1099446 - RNA, 23 nt, Mycobacterium bovis subsp bovis AF2122/97
gcggcuggcccgcaugccggcgc

SEQ ID NO: 1099447 - RNA, 22 nt, Mycobacterium bovis subsp bovis AF2122/97
gcggcugccagugccgcccacc

SEQ ID NO: 1099448 - RNA, 23 nt, Mycobacterium bovis subsp bovis AF2122/97
gcggcugccagugccgcccacca

SEQ ID NO: 1099449 - RNA, 15 nt, Mycobacterium bovis subsp bovis AF2122/97
gcggcugccaucccg

SEQ ID NO: 1099450 - RNA, 16 nt, Mycobacterium bovis subsp bovis AF2122/97
gcggcugcugcgcggu

SEQ ID NO: 1099451 - RNA, 14 nt, Mycobacterium bovis subsp bovis AF2122/97
gcggcugugcccga

SEQ ID NO: 1099452 - RNA, 19 nt, Mycobacterium bovis subsp bovis AF2122/97
gcggcugugcccgaucagc

SEQ ID NO: 1099453 - RNA, 20 nt, Mycobacterium bovis subsp bovis AF2122/97
gcggcugugcccgaucagcc

SEQ ID NO: 1099454 - RNA, 19 nt, Mycobacterium bovis subsp bovis AF2122/97
gcggcuguggucgcugcug

SEQ ID NO: 1099455 - RNA, 21 nt, Mycobacterium bovis subsp bovis AF2122/97
gcggcuuagaacgugcuggug

SEQ ID NO: 1099456 - RNA, 19 nt, Mycobacterium bovis subsp bovis AF2122/97
gcggcuguugaagaggcgc

SEQ ID NO: 1099457 - RNA, 23 nt, Mycobacterium bovis subsp bovis AF2122/97
gcggcuguugaagaggcgcaccu

SEQ ID NO: 1099458 - RNA, 17 nt, Mycobacterium bovis subsp bovis AF2122/97
gcggcuggugucgggcg

SEQ ID NO: 1099459 - RNA, 17 nt, Mycobacterium bovis subsp bovis AF2122/97
gcggcuugucgccccau

SEQ ID NO: 1099460 - RNA, 21 nt, Mycobacterium bovis subsp bovis AF2122/97
gcggcuugucgccccaugcgg

SEQ ID NO: 1099461 - RNA, 18 nt, Mycobacterium bovis subsp bovis AF2122/97
gcggcuugucgcggugcg

SEQ ID NO: 1099462 - RNA, 23 nt, Mycobacterium bovis subsp bovis AF2122/97
gcggcugucgugauacagcucgg

SEQ ID NO: 1099463 - RNA, 13 nt, Mycobacterium bovis subsp bovis AF2122/97
gcggcugucacgc

SEQ ID NO: 1099464 - RNA, 16 nt, Mycobacterium bovis subsp bovis AF2122/97
gcggcuggggccccgc

SEQ ID NO: 1099465 - RNA, 19 nt, Mycobacterium bovis subsp bovis AF2122/97
gcggcuggggccccgcgcc

SEQ ID NO: 1099466 - RNA, 16 nt, Mycobacterium bovis subsp bovis AF2122/97
gcgggauggccgccga

SEQ ID NO: 1099467 - RNA, 18 nt, Mycobacterium bovis subsp bovis AF2122/97
gcgggauggccgccgaca

SEQ ID NO: 1099468 - RNA, 19 nt, Mycobacterium bovis subsp bovis AF2122/97
gcgggauggccgccgacaa

SEQ ID NO: 1099469 - RNA, 17 nt, Mycobacterium bovis subsp bovis AF2122/97
gcgggauggggcccgca

SEQ ID NO: 1099470 - RNA, 18 nt, Mycobacterium bovis subsp bovis AF2122/97
gcgggcaagucgcccagc

SEQ ID NO: 1099471 - RNA, 21 nt, Mycobacterium bovis subsp bovis AF2122/97
gcgggcaagucgcccagccga

SEQ ID NO: 1099472 - RNA, 18 nt, Mycobacterium bovis subsp bovis AF2122/97
gcgggcaaucaccgccgg

SEQ ID NO: 1099473 - RNA, 21 nt, Mycobacterium bovis subsp bovis AF2122/97
gcgggcaaucaccgccggcgg

SEQ ID NO: 1099474 - RNA, 21 nt, Mycobacterium bovis subsp bovis AF2122/97
gcgggcacaauaggcuccagc

SEQ ID NO: 1099475 - RNA, 13 nt, Mycobacterium bovis subsp bovis AF2122/97
gcgggaaccccag

SEQ ID NO: 1099476 - RNA, 17 nt, Mycobacterium bovis subsp bovis AF2122/97
gcgggaaacacguucuc

SEQ ID NO: 1099477 - RNA, 22 nt, Mycobacterium bovis subsp bovis AF2122/97
gcgggaaacccaugcaugcguu

SEQ ID NO: 1099478 - RNA, 19 nt, Mycobacterium bovis subsp bovis AF2122/97
gcggcuuugacgcccggca

SEQ ID NO: 1099479 - RNA, 20 nt, Mycobacterium bovis subsp bovis AF2122/97
gcgggaacgaugccgccggc

SEQ ID NO: 1099480 - RNA, 21 nt, Mycobacterium bovis subsp bovis AF2122/97
gcgggaacgaugccgccggcg

SEQ ID NO: 1099481 - RNA, 23 nt, Mycobacterium bovis subsp bovis AF2122/97
gcgggaacgcggcggcgaacucg

SEQ ID NO: 1099482 - RNA, 19 nt, Mycobacterium bovis subsp bovis AF2122/97
gcgggaacgagccacgcca

SEQ ID NO: 1099483 - RNA, 22 nt, Mycobacterium bovis subsp bovis AF2122/97
gcgggaacgagccacgccagcg

SEQ ID NO: 1099484 - RNA, 20 nt, Mycobacterium bovis subsp bovis AF2122/97
gcgggaacggugccgaucgg

SEQ ID NO: 1099485 - RNA, 21 nt, Mycobacterium bovis subsp bovis AF2122/97
gcgggaacggugccgaucggg

SEQ ID NO: 1099486 - RNA, 19 nt, Mycobacterium bovis subsp bovis AF2122/97
gcgggaucgguggcggcac

SEQ ID NO: 1099487 - RNA, 15 nt, Mycobacterium bovis subsp bovis AF2122/97
gcgggauccaggccc

SEQ ID NO: 1099488 - RNA, 21 nt, Mycobacterium bovis subsp bovis AF2122/97
gcgggaugcagcugcccggcg

SEQ ID NO: 1099489 - RNA, 20 nt, Mycobacterium bovis subsp bovis AF2122/97
gcggucgaucaacaccaacg

SEQ ID NO: 1099490 - RNA, 13 nt, Mycobacterium bovis subsp bovis AF2122/97
gcgguccgccgcc

SEQ ID NO: 1099491 - RNA, 15 nt, Mycobacterium bovis subsp bovis AF2122/97
gcggucgaucacacg

SEQ ID NO: 1099492 - RNA, 20 nt, Mycobacterium bovis subsp bovis AF2122/97
gcggucgaucugacugacgg

SEQ ID NO: 1099493 - RNA, 19 nt, Mycobacterium bovis subsp bovis AF2122/97
gcggucgagguggcgggcg

SEQ ID NO: 1099494 - RNA, 22 nt, Mycobacterium bovis subsp bovis AF2122/97
gcggucgagguggcgggcgaug

SEQ ID NO: 1099495 - RNA, 14 nt, Mycobacterium bovis subsp bovis AF2122/97
gcggucgauagcgg

SEQ ID NO: 1099496 - RNA, 13 nt, Mycobacterium bovis subsp bovis AF2122/97
gcgguccgaugcg

SEQ ID NO: 1099497 - RNA, 21 nt, Mycobacterium bovis subsp bovis AF2122/97
gcgguccgaugcgcgcggcgc

SEQ ID NO: 1099498 - RNA, 20 nt, Mycobacterium bovis subsp bovis AF2122/97
gcggucccugaucaaggacc

SEQ ID NO: 1099499 - RNA, 23 nt, Mycobacterium bovis subsp bovis AF2122/97
gcggucccugaagccagcgcaag

SEQ ID NO: 1099500 - RNA, 13 nt, Mycobacterium bovis subsp bovis AF2122/97
gcgguccgagcgg

SEQ ID NO: 1099501 - RNA, 17 nt, Mycobacterium bovis subsp bovis AF2122/97
gcgguccgagcggcauc

SEQ ID NO: 1099502 - RNA, 20 nt, Mycobacterium bovis subsp bovis AF2122/97
gcggucgcgcccucagccgc

SEQ ID NO: 1099503 - RNA, 15 nt, Mycobacterium bovis subsp bovis AF2122/97
gcggucgcgcgaugg

SEQ ID NO: 1099504 - RNA, 20 nt, Mycobacterium bovis subsp bovis AF2122/97
gcggucgccagucgauucgg

SEQ ID NO: 1099505 - RNA, 16 nt, Mycobacterium bovis subsp bovis AF2122/97
gcggucgccaagaucg

SEQ ID NO: 1099506 - RNA, 22 nt, Mycobacterium bovis subsp bovis AF2122/97
gcggucgccaagaucggguggc

SEQ ID NO: 1099507 - RNA, 16 nt, Mycobacterium bovis subsp bovis AF2122/97
gcggucgccacacccg

SEQ ID NO: 1099508 - RNA, 20 nt, Mycobacterium bovis subsp bovis AF2122/97
gcgguccagacaucagugcg

SEQ ID NO: 1099509 - RNA, 18 nt, Mycobacterium bovis subsp bovis AF2122/97
gcgguauuugaacgcccg

SEQ ID NO: 1099510 - RNA, 21 nt, Mycobacterium bovis subsp bovis AF2122/97
gcggucaacaagacgaugcug

SEQ ID NO: 1099511 - RNA, 23 nt, Mycobacterium bovis subsp bovis AF2122/97
gcgguccagacaucagugcgccg

SEQ ID NO: 1099512 - RNA, 19 nt, Mycobacterium bovis subsp bovis AF2122/97
gcgguccagcgucgccgcc

SEQ ID NO: 1099513 - RNA, 14 nt, Mycobacterium bovis subsp bovis AF2122/97
gcgguccaucagca

SEQ ID NO: 1099514 - RNA, 16 nt, Mycobacterium bovis subsp bovis AF2122/97
gcgguccaggccggca

SEQ ID NO: 1099515 - RNA, 18 nt, Mycobacterium bovis subsp bovis AF2122/97
gcggucccacggccggcc

SEQ ID NO: 1099516 - RNA, 21 nt, Mycobacterium bovis subsp bovis AF2122/97
gcggucccacucgucgucggu

SEQ ID NO: 1099517 - RNA, 16 nt, Mycobacterium bovis subsp bovis AF2122/97
gcgguaucggucagcc

SEQ ID NO: 1099518 - RNA, 20 nt, Mycobacterium bovis subsp bovis AF2122/97
gcgguaucggucagccacgc

SEQ ID NO: 1099519 - RNA, 22 nt, Mycobacterium bovis subsp bovis AF2122/97
gcgguaucggucagccacgcca

SEQ ID NO: 1099520 - RNA, 23 nt, Mycobacterium bovis subsp bovis AF2122/97
gcgguaucccccagccgcggcgc

SEQ ID NO: 1099521 - RNA, 13 nt, Mycobacterium bovis subsp bovis AF2122/97
gcgguaugcucgc

SEQ ID NO: 1099522 - RNA, 18 nt, Mycobacterium bovis subsp bovis AF2122/97
gcgguaugcucgcuggcg

SEQ ID NO: 1099523 - RNA, 16 nt, Mycobacterium bovis subsp bovis AF2122/97
gcgguagucggccagc

SEQ ID NO: 1099524 - RNA, 13 nt, Mycobacterium bovis subsp bovis AF2122/97
gcgguagucgccg

SEQ ID NO: 1099525 - RNA, 19 nt, Mycobacterium bovis subsp bovis AF2122/97
gcgguagcuuccgcgacgc

SEQ ID NO: 1099526 - RNA, 15 nt, Mycobacterium bovis subsp bovis AF2122/97
gcgguagcgccguga

SEQ ID NO: 1099527 - RNA, 14 nt, Mycobacterium bovis subsp bovis AF2122/97
gcgguaggcgguga

SEQ ID NO: 1099528 - RNA, 17 nt, Mycobacterium bovis subsp bovis AF2122/97
gcgguacugcgcagcgc

SEQ ID NO: 1099529 - RNA, 14 nt, Mycobacterium bovis subsp bovis AF2122/97
gcgguagacgccgc

SEQ ID NO: 1099530 - RNA, 17 nt, Mycobacterium bovis subsp bovis AF2122/97
gcgguagacgccgccgu

SEQ ID NO: 1099531 - RNA, 12 nt, Mycobacterium bovis subsp bovis AF2122/97
gcgguagcgccg

SEQ ID NO: 1099532 - RNA, 22 nt, Mycobacterium bovis subsp bovis AF2122/97
gcgguaccaaccugcgcggcga

SEQ ID NO: 1099533 - RNA, 19 nt, Mycobacterium bovis subsp bovis AF2122/97
gcgguaccaucaccgcgcc

SEQ ID NO: 1099534 - RNA, 18 nt, Mycobacterium bovis subsp bovis AF2122/97
gcgguaccccccagcgac

SEQ ID NO: 1099535 - RNA, 20 nt, Mycobacterium bovis subsp bovis AF2122/97
gcgguaccccccagcgacgg

SEQ ID NO: 1099536 - RNA, 19 nt, Mycobacterium bovis subsp bovis AF2122/97
gcgguaccgccgcggucgg

SEQ ID NO: 1099537 - RNA, 23 nt, Mycobacterium bovis subsp bovis AF2122/97
gcgguaccgccgcggucggacca

SEQ ID NO: 1099538 - RNA, 15 nt, Mycobacterium bovis subsp bovis AF2122/97
gcgguaccgcucggg

SEQ ID NO: 1099539 - RNA, 20 nt, Mycobacterium bovis subsp bovis AF2122/97
gcgguaccggaaucggcggc

SEQ ID NO: 1099540 - RNA, 22 nt, Mycobacterium bovis subsp bovis AF2122/97
gcgguaccggaaucggcggcgg

SEQ ID NO: 1099541 - RNA, 14 nt, Mycobacterium bovis subsp bovis AF2122/97
gcgguaccgguguc

SEQ ID NO: 1099542 - RNA, 21 nt, Mycobacterium bovis subsp bovis AF2122/97
gcgguaccgggaucccacggc

SEQ ID NO: 1099543 - RNA, 17 nt, Mycobacterium bovis subsp bovis AF2122/97
gcgguacgggucgccgg

SEQ ID NO: 1099544 - RNA, 20 nt, Mycobacterium bovis subsp bovis AF2122/97
gcgguacgggucgccggacu

SEQ ID NO: 1099545 - RNA, 20 nt, Mycobacterium bovis subsp bovis AF2122/97
gcgguacguaaucgagcgcg

SEQ ID NO: 1099546 - RNA, 20 nt, Mycobacterium bovis subsp bovis AF2122/97
gcggugacucggccuccgcc

SEQ ID NO: 1099547 - RNA, 21 nt, Mycobacterium bovis subsp bovis AF2122/97
gcggugacucggccuccgccg

SEQ ID NO: 1099548 - RNA, 22 nt, Mycobacterium bovis subsp bovis AF2122/97
gcggugacucggccuccgccga

SEQ ID NO: 1099549 - RNA, 15 nt, Mycobacterium bovis subsp bovis AF2122/97
gcggugacgcaacau

SEQ ID NO: 1099550 - RNA, 17 nt, Mycobacterium bovis subsp bovis AF2122/97
gcggugacgcaacaucg

SEQ ID NO: 1099551 - RNA, 15 nt, Mycobacterium bovis subsp bovis AF2122/97
gcggugacggcggcu

SEQ ID NO: 1099552 - RNA, 20 nt, Mycobacterium bovis subsp bovis AF2122/97
gcggugacggcggcugucgg

SEQ ID NO: 1099553 - RNA, 22 nt, Mycobacterium bovis subsp bovis AF2122/97
gcggugcagugccucggcggcg

SEQ ID NO: 1099554 - RNA, 16 nt, Mycobacterium bovis subsp bovis AF2122/97
gcggugcaucgccacc

SEQ ID NO: 1099555 - RNA, 17 nt, Mycobacterium bovis subsp bovis AF2122/97
gcggugcaucgccacca

SEQ ID NO: 1099556 - RNA, 19 nt, Mycobacterium bovis subsp bovis AF2122/97
gcggugcaucgccaccacc

SEQ ID NO: 1099557 - RNA, 12 nt, Mycobacterium bovis subsp bovis AF2122/97
gcggugccacca

SEQ ID NO: 1099558 - RNA, 15 nt, Mycobacterium bovis subsp bovis AF2122/97
gcggugccacgaucg

SEQ ID NO: 1099559 - RNA, 21 nt, Mycobacterium bovis subsp bovis AF2122/97
gcggugccacgaucggcgggg

SEQ ID NO: 1099560 - RNA, 16 nt, Mycobacterium bovis subsp bovis AF2122/97
gcggugcccagcagcg

SEQ ID NO: 1099561 - RNA, 15 nt, Mycobacterium bovis subsp bovis AF2122/97
gcggugaccggcucg

SEQ ID NO: 1099562 - RNA, 17 nt, Mycobacterium bovis subsp bovis AF2122/97
gcggugaccggcucggc

SEQ ID NO: 1099563 - RNA, 21 nt, Mycobacterium bovis subsp bovis AF2122/97
gcggugaccgugaacggcucg

SEQ ID NO: 1099564 - RNA, 17 nt, Mycobacterium bovis subsp bovis AF2122/97
gcggugacgagccacca

SEQ ID NO: 1099565 - RNA, 21 nt, Mycobacterium bovis subsp bovis AF2122/97
gcggugacccggaagccgacc

SEQ ID NO: 1099566 - RNA, 15 nt, Mycobacterium bovis subsp bovis AF2122/97
gcggugacccguuca

SEQ ID NO: 1099567 - RNA, 17 nt, Mycobacterium bovis subsp bovis AF2122/97
gcggugacccguucagc

SEQ ID NO: 1099568 - RNA, 21 nt, Mycobacterium bovis subsp bovis AF2122/97
gcggugacccguucagcgacg

SEQ ID NO: 1099569 - RNA, 13 nt, Mycobacterium bovis subsp bovis AF2122/97
gcggugaccaccc

SEQ ID NO: 1099570 - RNA, 17 nt, Mycobacterium bovis subsp bovis AF2122/97
gcggugaccaccccggc

SEQ ID NO: 1099571 - RNA, 16 nt, Mycobacterium bovis subsp bovis AF2122/97
gcggugaacugcuggc

SEQ ID NO: 1099572 - RNA, 13 nt, Mycobacterium bovis subsp bovis AF2122/97
gcggucggccaca

SEQ ID NO: 1099573 - RNA, 20 nt, Mycobacterium bovis subsp bovis AF2122/97
gcggucggccacauccagcg

SEQ ID NO: 1099574 - RNA, 19 nt, Mycobacterium bovis subsp bovis AF2122/97
gcggucggagucgagcaca

SEQ ID NO: 1099575 - RNA, 22 nt, Mycobacterium bovis subsp bovis AF2122/97
gcggucggaaugccgucgccgg

SEQ ID NO: 1099576 - RNA, 16 nt, Mycobacterium bovis subsp bovis AF2122/97
gcggucggaccacccg

SEQ ID NO: 1099577 - RNA, 21 nt, Mycobacterium bovis subsp bovis AF2122/97
gcggucggaccacccggcgcg

SEQ ID NO: 1099578 - RNA, 12 nt, Mycobacterium bovis subsp bovis AF2122/97
gcggucgcguac

SEQ ID NO: 1099579 - RNA, 18 nt, Mycobacterium bovis subsp bovis AF2122/97
gcggucgcagcagaccac

SEQ ID NO: 1099580 - RNA, 18 nt, Mycobacterium bovis subsp bovis AF2122/97
gcggucgccgcgcguucc

SEQ ID NO: 1099581 - RNA, 18 nt, Mycobacterium bovis subsp bovis AF2122/97
gcggucugguugucgauc

SEQ ID NO: 1099582 - RNA, 21 nt, Mycobacterium bovis subsp bovis AF2122/97
gcggucggccacauccagcgc

SEQ ID NO: 1099583 - RNA, 16 nt, Mycobacterium bovis subsp bovis AF2122/97
gcggucuuguccagga

SEQ ID NO: 1099584 - RNA, 20 nt, Mycobacterium bovis subsp bovis AF2122/97
gcggucuuugagccgguagc

SEQ ID NO: 1099585 - RNA, 19 nt, Mycobacterium bovis subsp bovis AF2122/97
gcggugcccugccggcagc

SEQ ID NO: 1099586 - RNA, 22 nt, Mycobacterium bovis subsp bovis AF2122/97
gcggugcccugccggcagcggc

SEQ ID NO: 1099587 - RNA, 16 nt, Mycobacterium bovis subsp bovis AF2122/97
gcggugaggcagcgac

SEQ ID NO: 1099588 - RNA, 18 nt, Mycobacterium bovis subsp bovis AF2122/97
gcggugaggcagcgaccg

SEQ ID NO: 1099589 - RNA, 16 nt, Mycobacterium bovis subsp bovis AF2122/97
gcggugcccgcccucg

SEQ ID NO: 1099590 - RNA, 15 nt, Mycobacterium bovis subsp bovis AF2122/97
gcggugcccgcgaac

SEQ ID NO: 1099591 - RNA, 13 nt, Mycobacterium bovis subsp bovis AF2122/97
gcggugccgacgg

SEQ ID NO: 1099592 - RNA, 19 nt, Mycobacterium bovis subsp bovis AF2122/97
gcggugccgacggugggcg

SEQ ID NO: 1099593 - RNA, 20 nt, Mycobacterium bovis subsp bovis AF2122/97
gcggugccgcggcuaggcca

SEQ ID NO: 1099594 - RNA, 23 nt, Mycobacterium bovis subsp bovis AF2122/97
gcggugccgcggcuaggccaagc

SEQ ID NO: 1099595 - RNA, 22 nt, Mycobacterium bovis subsp bovis AF2122/97
gcggugccgguggugacggcgg

SEQ ID NO: 1099596 - RNA, 14 nt, Mycobacterium bovis subsp bovis AF2122/97
gcgguggcggcggu

SEQ ID NO: 1099597 - RNA, 14 nt, Mycobacterium bovis subsp bovis AF2122/97
gcggugccgccacc

SEQ ID NO: 1099598 - RNA, 20 nt, Mycobacterium bovis subsp bovis AF2122/97
gcggugccggcccugcucgg

SEQ ID NO: 1099599 - RNA, 15 nt, Mycobacterium bovis subsp bovis AF2122/97
gcggugccggcggcg

SEQ ID NO: 1099600 - RNA, 12 nt, Mycobacterium bovis subsp bovis AF2122/97
gcgguggcgucg

SEQ ID NO: 1099601 - RNA, 14 nt, Mycobacterium bovis subsp bovis AF2122/97
gcggugggcacagc

SEQ ID NO: 1099602 - RNA, 13 nt, Mycobacterium bovis subsp bovis AF2122/97
gcggugggcagca

SEQ ID NO: 1099603 - RNA, 18 nt, Mycobacterium bovis subsp bovis AF2122/97
gcgguggcgucgucggcg

SEQ ID NO: 1099604 - RNA, 23 nt, Mycobacterium bovis subsp bovis AF2122/97
gcggugagacgaaaagccgcguc

SEQ ID NO: 1099605 - RNA, 17 nt, Mycobacterium bovis subsp bovis AF2122/97
gcggugggcuuggcgcc

SEQ ID NO: 1099606 - RNA, 19 nt, Mycobacterium bovis subsp bovis AF2122/97
gcggugggcuuggcgccga

SEQ ID NO: 1099607 - RNA, 18 nt, Mycobacterium bovis subsp bovis AF2122/97
gcgguggggcgcgccggc

SEQ ID NO: 1099608 - RNA, 17 nt, Mycobacterium bovis subsp bovis AF2122/97
gcggugguaccggcgcc

SEQ ID NO: 1099609 - RNA, 21 nt, Mycobacterium bovis subsp bovis AF2122/97
gcggugguaccggcgccaccg

SEQ ID NO: 1099610 - RNA, 18 nt, Mycobacterium bovis subsp bovis AF2122/97
gcggugugcgugucaccc

SEQ ID NO: 1099611 - RNA, 15 nt, Mycobacterium bovis subsp bovis AF2122/97
gcggugugcggcagc

SEQ ID NO: 1099612 - RNA, 16 nt, Mycobacterium bovis subsp bovis AF2122/97
gcggugugcagggacc

SEQ ID NO: 1099613 - RNA, 22 nt, Mycobacterium bovis subsp bovis AF2122/97
gcggugugcagggacccggcgc

SEQ ID NO: 1099614 - RNA, 23 nt, Mycobacterium bovis subsp bovis AF2122/97
gcggugugcagggacccggcgcc

SEQ ID NO: 1099615 - RNA, 18 nt, Mycobacterium bovis subsp bovis AF2122/97
gcgguggucccgauggcg

SEQ ID NO: 1099616 - RNA, 19 nt, Mycobacterium bovis subsp bovis AF2122/97
gcggugguaggacgccagc

SEQ ID NO: 1099617 - RNA, 23 nt, Mycobacterium bovis subsp bovis AF2122/97
gcgguguugcucccggccgccga

SEQ ID NO: 1099618 - RNA, 14 nt, Mycobacterium bovis subsp bovis AF2122/97
gcgguguuggacgc

SEQ ID NO: 1099619 - RNA, 14 nt, Mycobacterium bovis subsp bovis AF2122/97
gcgguguugccgga

SEQ ID NO: 1099620 - RNA, 16 nt, Mycobacterium bovis subsp bovis AF2122/97
gcgguguggucgcagg

SEQ ID NO: 1099621 - RNA, 21 nt, Mycobacterium bovis subsp bovis AF2122/97
gcggugugugcaagccgaaca

SEQ ID NO: 1099622 - RNA, 15 nt, Mycobacterium bovis subsp bovis AF2122/97
gcgguuagcagccgc

SEQ ID NO: 1099623 - RNA, 13 nt, Mycobacterium bovis subsp bovis AF2122/97
gcgggcgucgcgg

SEQ ID NO: 1099624 - RNA, 15 nt, Mycobacterium bovis subsp bovis AF2122/97
gcgggcgugugcagu

SEQ ID NO: 1099625 - RNA, 16 nt, Mycobacterium bovis subsp bovis AF2122/97
gcgggcguuggccagc

SEQ ID NO: 1099626 - RNA, 19 nt, Mycobacterium bovis subsp bovis AF2122/97
gcgggcgugccgaccagca

SEQ ID NO: 1099627 - RNA, 22 nt, Mycobacterium bovis subsp bovis AF2122/97
gcgggccagcaccucgaccgcc

SEQ ID NO: 1099628 - RNA, 20 nt, Mycobacterium bovis subsp bovis AF2122/97
gcgggccagcacccgcucca

SEQ ID NO: 1099629 - RNA, 17 nt, Mycobacterium bovis subsp bovis AF2122/97
gcgggcacugguggcga

SEQ ID NO: 1099630 - RNA, 21 nt, Mycobacterium bovis subsp bovis AF2122/97
gcgggcacugguggcgauccg

SEQ ID NO: 1099631 - RNA, 20 nt, Mycobacterium bovis subsp bovis AF2122/97
gcgggccaccguaaacagcg

SEQ ID NO: 1099632 - RNA, 17 nt, Mycobacterium bovis subsp bovis AF2122/97
gcggggcaucggugcgg

SEQ ID NO: 1099633 - RNA, 22 nt, Mycobacterium bovis subsp bovis AF2122/97
gcggggauguuuuuggccgcgg

SEQ ID NO: 1099634 - RNA, 21 nt, Mycobacterium bovis subsp bovis AF2122/97
gcggggauuggugcccagcgc

SEQ ID NO: 1099635 - RNA, 20 nt, Mycobacterium bovis subsp bovis AF2122/97
gcggggcagaagucguugcg

SEQ ID NO: 1099636 - RNA, 17 nt, Mycobacterium bovis subsp bovis AF2122/97
gcgggcugaccaaccca

SEQ ID NO: 1099637 - RNA, 12 nt, Mycobacterium bovis subsp bovis AF2122/97
gcggggacggcg

SEQ ID NO: 1099638 - RNA, 16 nt, Mycobacterium bovis subsp bovis AF2122/97
gcggggaucgcuggcc

SEQ ID NO: 1099639 - RNA, 17 nt, Mycobacterium bovis subsp bovis AF2122/97
gcggggaugcgaccgcc

SEQ ID NO: 1099640 - RNA, 23 nt, Mycobacterium bovis subsp bovis AF2122/97
gcggggauguccgcggccaccac

SEQ ID NO: 1099641 - RNA, 13 nt, Mycobacterium bovis subsp bovis AF2122/97
gcggggccgccgc

SEQ ID NO: 1099642 - RNA, 21 nt, Mycobacterium bovis subsp bovis AF2122/97
gcggggccgccgcggccggcg

SEQ ID NO: 1099643 - RNA, 13 nt, Mycobacterium bovis subsp bovis AF2122/97
gcggggccggcgg

SEQ ID NO: 1099644 - RNA, 22 nt, Mycobacterium bovis subsp bovis AF2122/97
gcggggcgauccccagcaccac

SEQ ID NO: 1099645 - RNA, 13 nt, Mycobacterium bovis subsp bovis AF2122/97
gcgggcucggugg

SEQ ID NO: 1099646 - RNA, 12 nt, Mycobacterium bovis subsp bovis AF2122/97
gcgggcucgccc

SEQ ID NO: 1099647 - RNA, 18 nt, Mycobacterium bovis subsp bovis AF2122/97
gcggggaccgcggucaug

SEQ ID NO: 1099648 - RNA, 18 nt, Mycobacterium bovis subsp bovis AF2122/97
gcgggcuccggcucgaca

SEQ ID NO: 1099649 - RNA, 20 nt, Mycobacterium bovis subsp bovis AF2122/97
gcgggcucgcccgcuacggc

SEQ ID NO: 1099650 - RNA, 20 nt, Mycobacterium bovis subsp bovis AF2122/97
gcgggcucgguggcggacgg

SEQ ID NO: 1099651 - RNA, 16 nt, Mycobacterium bovis subsp bovis AF2122/97
gcgggcucguguccgc

SEQ ID NO: 1099652 - RNA, 16 nt, Mycobacterium bovis subsp bovis AF2122/97
gcggguauauggugcg

SEQ ID NO: 1099653 - RNA, 18 nt, Mycobacterium bovis subsp bovis AF2122/97
gcggguauauggugcgcc

SEQ ID NO: 1099654 - RNA, 15 nt, Mycobacterium bovis subsp bovis AF2122/97
gcggguagccgucga

SEQ ID NO: 1099655 - RNA, 20 nt, Mycobacterium bovis subsp bovis AF2122/97
gcggguagaaccagcccggc

SEQ ID NO: 1099656 - RNA, 16 nt, Mycobacterium bovis subsp bovis AF2122/97
gcggguaaccggcucc

SEQ ID NO: 1099657 - RNA, 17 nt, Mycobacterium bovis subsp bovis AF2122/97
gcggguaaccggcuccg

SEQ ID NO: 1099658 - RNA, 15 nt, Mycobacterium bovis subsp bovis AF2122/97
gcggguaacgauugu

SEQ ID NO: 1099659 - RNA, 18 nt, Mycobacterium bovis subsp bovis AF2122/97
gcggguaauacggcgccu

SEQ ID NO: 1099660 - RNA, 20 nt, Mycobacterium bovis subsp bovis AF2122/97
gcggguaagcgaccgacgcc

SEQ ID NO: 1099661 - RNA, 19 nt, Mycobacterium bovis subsp bovis AF2122/97
gcgggguugaccguggucg

SEQ ID NO: 1099662 - RNA, 19 nt, Mycobacterium bovis subsp bovis AF2122/97
gcgggguuggccguggucg

SEQ ID NO: 1099663 - RNA, 17 nt, Mycobacterium bovis subsp bovis AF2122/97
gcgggguugggcggagc

SEQ ID NO: 1099664 - RNA, 13 nt, Mycobacterium bovis subsp bovis AF2122/97
gcggggcggcggu

SEQ ID NO: 1099665 - RNA, 17 nt, Mycobacterium bovis subsp bovis AF2122/97
gcggggcggcggugggc

SEQ ID NO: 1099666 - RNA, 23 nt, Mycobacterium bovis subsp bovis AF2122/97
gcggggccggcggcucgggugcg

SEQ ID NO: 1099667 - RNA, 13 nt, Mycobacterium bovis subsp bovis AF2122/97
gcgggggcgucgc

SEQ ID NO: 1099668 - RNA, 18 nt, Mycobacterium bovis subsp bovis AF2122/97
gcgggggcgucgccgccg

SEQ ID NO: 1099669 - RNA, 19 nt, Mycobacterium bovis subsp bovis AF2122/97
gcgggggcgucgccgccgg

SEQ ID NO: 1099670 - RNA, 17 nt, Mycobacterium bovis subsp bovis AF2122/97
gcggggcugggcgccau

SEQ ID NO: 1099671 - RNA, 22 nt, Mycobacterium bovis subsp bovis AF2122/97
gcggggcugggcgccaugcgcc

SEQ ID NO: 1099672 - RNA, 19 nt, Mycobacterium bovis subsp bovis AF2122/97
gcggggucgaacagcucga

SEQ ID NO: 1099673 - RNA, 17 nt, Mycobacterium bovis subsp bovis AF2122/97
gcggggguacgucaccg

SEQ ID NO: 1099674 - RNA, 17 nt, Mycobacterium bovis subsp bovis AF2122/97
gcgggguaggcccagca

SEQ ID NO: 1099675 - RNA, 18 nt, Mycobacterium bovis subsp bovis AF2122/97
gcggggucuugacggcgc

SEQ ID NO: 1099676 - RNA, 19 nt, Mycobacterium bovis subsp bovis AF2122/97
gcggggucuugacggcgcc

SEQ ID NO: 1099677 - RNA, 17 nt, Mycobacterium bovis subsp bovis AF2122/97
gcggggugcgcgcgacc

SEQ ID NO: 1099678 - RNA, 23 nt, Mycobacterium bovis subsp bovis AF2122/97
gcggggugagugaccacgcugcu

SEQ ID NO: 1099679 - RNA, 18 nt, Mycobacterium bovis subsp bovis AF2122/97
gcgggucagcgccgagag

SEQ ID NO: 1099680 - RNA, 23 nt, Mycobacterium bovis subsp bovis AF2122/97
gcgggucagcugacgggccgcug

SEQ ID NO: 1099681 - RNA, 20 nt, Mycobacterium bovis subsp bovis AF2122/97
gcgggucagcucgaccugag

SEQ ID NO: 1099682 - RNA, 14 nt, Mycobacterium bovis subsp bovis AF2122/97
gcgggucagcucga

SEQ ID NO: 1099683 - RNA, 19 nt, Mycobacterium bovis subsp bovis AF2122/97
gcgggucccaaucgucggc

SEQ ID NO: 1099684 - RNA, 21 nt, Mycobacterium bovis subsp bovis AF2122/97
gcgggucccaaucgucggcca

SEQ ID NO: 1099685 - RNA, 14 nt, Mycobacterium bovis subsp bovis AF2122/97
gcggguccccaccg

SEQ ID NO: 1099686 - RNA, 15 nt, Mycobacterium bovis subsp bovis AF2122/97
gcgggucccgccacc

SEQ ID NO: 1099687 - RNA, 15 nt, Mycobacterium bovis subsp bovis AF2122/97
gcggguccgacgggc

SEQ ID NO: 1099688 - RNA, 16 nt, Mycobacterium bovis subsp bovis AF2122/97
gcggguccagccaccg

SEQ ID NO: 1099689 - RNA, 23 nt, Mycobacterium bovis subsp bovis AF2122/97
gcggguccucgcggagccgucgc

SEQ ID NO: 1099690 - RNA, 18 nt, Mycobacterium bovis subsp bovis AF2122/97
gcgggucgcggcuauggc

SEQ ID NO: 1099691 - RNA, 17 nt, Mycobacterium bovis subsp bovis AF2122/97
gcgggugaucuccaccg

SEQ ID NO: 1099692 - RNA, 23 nt, Mycobacterium bovis subsp bovis AF2122/97
gcgggugaucuccaccggcgauc

SEQ ID NO: 1099693 - RNA, 22 nt, Mycobacterium bovis subsp bovis AF2122/97
gcgggugaugacgccgucggcg

SEQ ID NO: 1099694 - RNA, 23 nt, Mycobacterium bovis subsp bovis AF2122/97
gcgggugcauucgcaugucggac

SEQ ID NO: 1099695 - RNA, 13 nt, Mycobacterium bovis subsp bovis AF2122/97
gcgggugccagcc

SEQ ID NO: 1099696 - RNA, 17 nt, Mycobacterium bovis subsp bovis AF2122/97
gcgggugccgagcuggc

SEQ ID NO: 1099697 - RNA, 21 nt, Mycobacterium bovis subsp bovis AF2122/97
gcgggugccaucggugguggc

SEQ ID NO: 1099698 - RNA, 19 nt, Mycobacterium bovis subsp bovis AF2122/97
gcggguccuucugccggga

SEQ ID NO: 1099699 - RNA, 14 nt, Mycobacterium bovis subsp bovis AF2122/97
gcgggucgcgcgaa

SEQ ID NO: 1099700 - RNA, 18 nt, Mycobacterium bovis subsp bovis AF2122/97
gcgggucgcgggugccga

SEQ ID NO: 1099701 - RNA, 18 nt, Mycobacterium bovis subsp bovis AF2122/97
gcgggucuuggcacacag

SEQ ID NO: 1099702 - RNA, 18 nt, Mycobacterium bovis subsp bovis AF2122/97
gcgggugacuucguggcc

SEQ ID NO: 1099703 - RNA, 19 nt, Mycobacterium bovis subsp bovis AF2122/97
gcgggugacuucguggccu

SEQ ID NO: 1099704 - RNA, 12 nt, Mycobacterium bovis subsp bovis AF2122/97
gcgggugcgcug

SEQ ID NO: 1099705 - RNA, 14 nt, Mycobacterium bovis subsp bovis AF2122/97
gcgggugcgccggc

SEQ ID NO: 1099706 - RNA, 21 nt, Mycobacterium bovis subsp bovis AF2122/97
gcggguggaguuggcugccgg

SEQ ID NO: 1099707 - RNA, 18 nt, Mycobacterium bovis subsp bovis AF2122/97
gcgggugcgcugcagcga

SEQ ID NO: 1099708 - RNA, 18 nt, Mycobacterium bovis subsp bovis AF2122/97
gcgggugcggacaccgag

SEQ ID NO: 1099709 - RNA, 12 nt, Mycobacterium bovis subsp bovis AF2122/97
gcggguggcagc

SEQ ID NO: 1099710 - RNA, 21 nt, Mycobacterium bovis subsp bovis AF2122/97
gcggguggcagcggcgaucgg

SEQ ID NO: 1099711 - RNA, 14 nt, Mycobacterium bovis subsp bovis AF2122/97
gcgggugguccagc

SEQ ID NO: 1099712 - RNA, 15 nt, Mycobacterium bovis subsp bovis AF2122/97
gcgggugguccagcc

SEQ ID NO: 1099713 - RNA, 17 nt, Mycobacterium bovis subsp bovis AF2122/97
gcggguuccacacccag

SEQ ID NO: 1099714 - RNA, 22 nt, Mycobacterium bovis subsp bovis AF2122/97
gcggguucgagucccgucacuc

SEQ ID NO: 1099715 - RNA, 17 nt, Mycobacterium bovis subsp bovis AF2122/97
gcgggugggcacaccgg

SEQ ID NO: 1099716 - RNA, 16 nt, Mycobacterium bovis subsp bovis AF2122/97
gcggguggugccggcg

SEQ ID NO: 1099717 - RNA, 23 nt, Mycobacterium bovis subsp bovis AF2122/97
gcggguggugaaguagucggcgc

SEQ ID NO: 1099718 - RNA, 13 nt, Mycobacterium bovis subsp bovis AF2122/97
gcggguggugagc

SEQ ID NO: 1099719 - RNA, 14 nt, Mycobacterium bovis subsp bovis AF2122/97
gcggguuggucccg

SEQ ID NO: 1099720 - RNA, 16 nt, Mycobacterium bovis subsp bovis AF2122/97
gcggguugucggcgac

SEQ ID NO: 1099721 - RNA, 24 nt, Mycobacterium bovis subsp bovis AF2122/97
gcggguuugccgggcgcuggacgg

SEQ ID NO: 1099722 - RNA, 23 nt, Mycobacterium bovis subsp bovis AF2122/97
gcgguaagaaucgaagcggcugc

SEQ ID NO: 1099723 - RNA, 16 nt, Mycobacterium bovis subsp bovis AF2122/97
gcgguaagggcgggcu

SEQ ID NO: 1099724 - RNA, 13 nt, Mycobacterium bovis subsp bovis AF2122/97
gcgguaaagcccc

SEQ ID NO: 1099725 - RNA, 20 nt, Mycobacterium bovis subsp bovis AF2122/97
gcgguaaagccccgcuccgc

SEQ ID NO: 1099726 - RNA, 21 nt, Mycobacterium bovis subsp bovis AF2122/97
gcgguaaagaucuugucgcgu

SEQ ID NO: 1099727 - RNA, 19 nt, Mycobacterium bovis subsp bovis AF2122/97
gcgucgacugcgugccgca

SEQ ID NO: 1099728 - RNA, 19 nt, Mycobacterium bovis subsp bovis AF2122/97
gcgucgagcagcaccaccc

SEQ ID NO: 1099729 - RNA, 20 nt, Mycobacterium bovis subsp bovis AF2122/97
gcgucgagcagcaccacccg

SEQ ID NO: 1099730 - RNA, 20 nt, Mycobacterium bovis subsp bovis AF2122/97
gcgucgagcgacccccagcg

SEQ ID NO: 1099731 - RNA, 23 nt, Mycobacterium bovis subsp bovis AF2122/97
gcgucgagccggauucggcugcc

SEQ ID NO: 1099732 - RNA, 14 nt, Mycobacterium bovis subsp bovis AF2122/97
gcgucgagcgaccc

SEQ ID NO: 1099733 - RNA, 18 nt, Mycobacterium bovis subsp bovis AF2122/97
gcgucgauaaccuggcgg

SEQ ID NO: 1099734 - RNA, 15 nt, Mycobacterium bovis subsp bovis AF2122/97
gcgucgauaucgcga

SEQ ID NO: 1099735 - RNA, 21 nt, Mycobacterium bovis subsp bovis AF2122/97
gcgucgaucaacaacagccgc

SEQ ID NO: 1099736 - RNA, 17 nt, Mycobacterium bovis subsp bovis AF2122/97
gcgucgaucacgucguc

SEQ ID NO: 1099737 - RNA, 22 nt, Mycobacterium bovis subsp bovis AF2122/97
gcgucgagguggcgcacaucgc

SEQ ID NO: 1099738 - RNA, 16 nt, Mycobacterium bovis subsp bovis AF2122/97
gcgucgaguggccgug

SEQ ID NO: 1099739 - RNA, 18 nt, Mycobacterium bovis subsp bovis AF2122/97
gcgucgaguggccgugga

SEQ ID NO: 1099740 - RNA, 18 nt, Mycobacterium bovis subsp bovis AF2122/97
gcgucgagcgccggccgc

SEQ ID NO: 1099741 - RNA, 15 nt, Mycobacterium bovis subsp bovis AF2122/97
gcgucgaucagggcc

SEQ ID NO: 1099742 - RNA, 17 nt, Mycobacterium bovis subsp bovis AF2122/97
gcgucgaucguuccgcu

SEQ ID NO: 1099743 - RNA, 20 nt, Mycobacterium bovis subsp bovis AF2122/97
gcgucgaucguuccgcugga

SEQ ID NO: 1099744 - RNA, 12 nt, Mycobacterium bovis subsp bovis AF2122/97
gcgucgaugcgc

SEQ ID NO: 1099745 - RNA, 23 nt, Mycobacterium bovis subsp bovis AF2122/97
gcgucgauggccacccgguggcg

SEQ ID NO: 1099746 - RNA, 16 nt, Mycobacterium bovis subsp bovis AF2122/97
gcgucgauggcgucgg

SEQ ID NO: 1099747 - RNA, 22 nt, Mycobacterium bovis subsp bovis AF2122/97
gcgucgaucguuccgcuggacg

SEQ ID NO: 1099748 - RNA, 13 nt, Mycobacterium bovis subsp bovis AF2122/97
gcgucgcacgcgc

SEQ ID NO: 1099749 - RNA, 21 nt, Mycobacterium bovis subsp bovis AF2122/97
gcgucgcaacgcgaucaccuc

SEQ ID NO: 1099750 - RNA, 23 nt, Mycobacterium bovis subsp bovis AF2122/97
gcgucgccauuccaucgcgcacc

SEQ ID NO: 1099751 - RNA, 16 nt, Mycobacterium bovis subsp bovis AF2122/97
gcgucgcccagugcgc

SEQ ID NO: 1099752 - RNA, 20 nt, Mycobacterium bovis subsp bovis AF2122/97
gcgucgcucgucgucaccga

SEQ ID NO: 1099753 - RNA, 21 nt, Mycobacterium bovis subsp bovis AF2122/97
gcgucgcgcgcggcaugggcc

SEQ ID NO: 1099754 - RNA, 21 nt, Mycobacterium bovis subsp bovis AF2122/97
gcgucggaccguuucgucggc

SEQ ID NO: 1099755 - RNA, 15 nt, Mycobacterium bovis subsp bovis AF2122/97
gcgucgcuacgcaac

SEQ ID NO: 1099756 - RNA, 21 nt, Mycobacterium bovis subsp bovis AF2122/97
gcgucggcgcaucaccacccg

SEQ ID NO: 1099757 - RNA, 18 nt, Mycobacterium bovis subsp bovis AF2122/97
gcgucggcgcccagcucg

SEQ ID NO: 1099758 - RNA, 15 nt, Mycobacterium bovis subsp bovis AF2122/97
gcgucggcggcgacc

SEQ ID NO: 1099759 - RNA, 19 nt, Mycobacterium bovis subsp bovis AF2122/97
gcgucggcggcgaccgcca

SEQ ID NO: 1099760 - RNA, 21 nt, Mycobacterium bovis subsp bovis AF2122/97
gcgucggcggcgaccgccagc

SEQ ID NO: 1099761 - RNA, 22 nt, Mycobacterium bovis subsp bovis AF2122/97
gcgucggcggcgaccgccagcg

SEQ ID NO: 1099762 - RNA, 13 nt, Mycobacterium bovis subsp bovis AF2122/97
gcgucgucggcgg

SEQ ID NO: 1099763 - RNA, 17 nt, Mycobacterium bovis subsp bovis AF2122/97
gcgucgucggcggcgac

SEQ ID NO: 1099764 - RNA, 16 nt, Mycobacterium bovis subsp bovis AF2122/97
gcgucgucgcgcugaa

SEQ ID NO: 1099765 - RNA, 13 nt, Mycobacterium bovis subsp bovis AF2122/97
gcgucgucgaguu

SEQ ID NO: 1099766 - RNA, 19 nt, Mycobacterium bovis subsp bovis AF2122/97
gcgucgucugcagaccugu

SEQ ID NO: 1099767 - RNA, 13 nt, Mycobacterium bovis subsp bovis AF2122/97
gcgucgucgauga

SEQ ID NO: 1099768 - RNA, 14 nt, Mycobacterium bovis subsp bovis AF2122/97
gcgucgucuucuuc

SEQ ID NO: 1099769 - RNA, 12 nt, Mycobacterium bovis subsp bovis AF2122/97
gcgucggcggcu

SEQ ID NO: 1099770 - RNA, 14 nt, Mycobacterium bovis subsp bovis AF2122/97
gcgucggcugccgc

SEQ ID NO: 1099771 - RNA, 17 nt, Mycobacterium bovis subsp bovis AF2122/97
gcgucggcugccgcggc

SEQ ID NO: 1099772 - RNA, 18 nt, Mycobacterium bovis subsp bovis AF2122/97
gcgucggcugccgcggcu

SEQ ID NO: 1099773 - RNA, 14 nt, Mycobacterium bovis subsp bovis AF2122/97
gcgucguccgcgcc

SEQ ID NO: 1099774 - RNA, 21 nt, Mycobacterium bovis subsp bovis AF2122/97
gcgucggcuucucgaucggcg

SEQ ID NO: 1099775 - RNA, 18 nt, Mycobacterium bovis subsp bovis AF2122/97
gcguccucgccgcacgcc

SEQ ID NO: 1099776 - RNA, 21 nt, Mycobacterium bovis subsp bovis AF2122/97
gcguccucgccgcacgccggc

SEQ ID NO: 1099777 - RNA, 19 nt, Mycobacterium bovis subsp bovis AF2122/97
gcguccgucgucggcgucc

SEQ ID NO: 1099778 - RNA, 20 nt, Mycobacterium bovis subsp bovis AF2122/97
gcguccgucucgcaggcgca

SEQ ID NO: 1099779 - RNA, 16 nt, Mycobacterium bovis subsp bovis AF2122/97
gcguccgucgucggcg

SEQ ID NO: 1099780 - RNA, 13 nt, Mycobacterium bovis subsp bovis AF2122/97
gcguccucgucga

SEQ ID NO: 1099781 - RNA, 15 nt, Mycobacterium bovis subsp bovis AF2122/97
gcguccucgucgaga

SEQ ID NO: 1099782 - RNA, 23 nt, Mycobacterium bovis subsp bovis AF2122/97
gcguccugguggcgggaucacca

SEQ ID NO: 1099783 - RNA, 19 nt, Mycobacterium bovis subsp bovis AF2122/97
gcguccugguggcgggauc

SEQ ID NO: 1099784 - RNA, 20 nt, Mycobacterium bovis subsp bovis AF2122/97
gcgucgaacagugccucgcg

SEQ ID NO: 1099785 - RNA, 18 nt, Mycobacterium bovis subsp bovis AF2122/97
gcgucgaaggugaccagg

SEQ ID NO: 1099786 - RNA, 14 nt, Mycobacterium bovis subsp bovis AF2122/97
gcgucgacacaccc

SEQ ID NO: 1099787 - RNA, 17 nt, Mycobacterium bovis subsp bovis AF2122/97
gcgucgacacacccacc

SEQ ID NO: 1099788 - RNA, 22 nt, Mycobacterium bovis subsp bovis AF2122/97
gcgucgaccaagguguccagca

SEQ ID NO: 1099789 - RNA, 22 nt, Mycobacterium bovis subsp bovis AF2122/97
gcgucgacagauugcucggugg

SEQ ID NO: 1099790 - RNA, 23 nt, Mycobacterium bovis subsp bovis AF2122/97
gcgucgaauuccggcucaccgau

SEQ ID NO: 1099791 - RNA, 21 nt, Mycobacterium bovis subsp bovis AF2122/97
gcgucgacaacacgccgucga

SEQ ID NO: 1099792 - RNA, 23 nt, Mycobacterium bovis subsp bovis AF2122/97
gcgucgacccagaacaugccgga

SEQ ID NO: 1099793 - RNA, 13 nt, Mycobacterium bovis subsp bovis AF2122/97
gcgucgacccgaa

SEQ ID NO: 1099794 - RNA, 21 nt, Mycobacterium bovis subsp bovis AF2122/97
gcgucgaccgcggcccggacg

SEQ ID NO: 1099795 - RNA, 19 nt, Mycobacterium bovis subsp bovis AF2122/97
gcgucgaccggaaccagcg

SEQ ID NO: 1099796 - RNA, 18 nt, Mycobacterium bovis subsp bovis AF2122/97
gcgucgaccucgcgggcg

SEQ ID NO: 1099797 - RNA, 14 nt, Mycobacterium bovis subsp bovis AF2122/97
gcgucgacgucggc

SEQ ID NO: 1099798 - RNA, 19 nt, Mycobacterium bovis subsp bovis AF2122/97
gcguccggguggcacacca

SEQ ID NO: 1099799 - RNA, 17 nt, Mycobacterium bovis subsp bovis AF2122/97
gcguccggugcaccagg

SEQ ID NO: 1099800 - RNA, 14 nt, Mycobacterium bovis subsp bovis AF2122/97
gcguccggugcugg

SEQ ID NO: 1099801 - RNA, 21 nt, Mycobacterium bovis subsp bovis AF2122/97
gcguccggugcugguccagcc

SEQ ID NO: 1099802 - RNA, 18 nt, Mycobacterium bovis subsp bovis AF2122/97
gcguccguagcgauucug

SEQ ID NO: 1099803 - RNA, 15 nt, Mycobacterium bovis subsp bovis AF2122/97
gcguaaaccggcuga

SEQ ID NO: 1099804 - RNA, 23 nt, Mycobacterium bovis subsp bovis AF2122/97
gcguaaaggccuugggcggcacu

SEQ ID NO: 1099805 - RNA, 14 nt, Mycobacterium bovis subsp bovis AF2122/97
gcguccgcccagca

SEQ ID NO: 1099806 - RNA, 15 nt, Mycobacterium bovis subsp bovis AF2122/97
gcguccgcccagcac

SEQ ID NO: 1099807 - RNA, 22 nt, Mycobacterium bovis subsp bovis AF2122/97
gcgguucgaucccguccgcgcc

SEQ ID NO: 1099808 - RNA, 18 nt, Mycobacterium bovis subsp bovis AF2122/97
gcgguucgaacgcgaucg

SEQ ID NO: 1099809 - RNA, 21 nt, Mycobacterium bovis subsp bovis AF2122/97
gcgguuccauacagccgccga

SEQ ID NO: 1099810 - RNA, 18 nt, Mycobacterium bovis subsp bovis AF2122/97
gcgguuccggccggcucc

SEQ ID NO: 1099811 - RNA, 15 nt, Mycobacterium bovis subsp bovis AF2122/97
gcgguucggugaucg

SEQ ID NO: 1099812 - RNA, 24 nt, Mycobacterium bovis subsp bovis AF2122/97
gcgguucgaugacaggcuuggcau

SEQ ID NO: 1099813 - RNA, 15 nt, Mycobacterium bovis subsp bovis AF2122/97
gcgguucucgagcuc

SEQ ID NO: 1099814 - RNA, 16 nt, Mycobacterium bovis subsp bovis AF2122/97
gcgguucucgagcucg

SEQ ID NO: 1099815 - RNA, 19 nt, Mycobacterium bovis subsp bovis AF2122/97
gcgguuucaccgacgacgc

SEQ ID NO: 1099816 - RNA, 22 nt, Mycobacterium bovis subsp bovis AF2122/97
gcgguuuccgcacgaucgcccg

SEQ ID NO: 1099817 - RNA, 18 nt, Mycobacterium bovis subsp bovis AF2122/97
gcgguuuucggcugccgc

SEQ ID NO: 1099818 - RNA, 17 nt, Mycobacterium bovis subsp bovis AF2122/97
gcgguuugccggugcgg

SEQ ID NO: 1099819 - RNA, 18 nt, Mycobacterium bovis subsp bovis AF2122/97
gcgugcaggcugucaauc

SEQ ID NO: 1099820 - RNA, 19 nt, Mycobacterium bovis subsp bovis AF2122/97
gcgugcaguacaccccauc

SEQ ID NO: 1099821 - RNA, 16 nt, Mycobacterium bovis subsp bovis AF2122/97
gcgugccagcacacgc

SEQ ID NO: 1099822 - RNA, 21 nt, Mycobacterium bovis subsp bovis AF2122/97
gcgugccagcacacgccuacc

SEQ ID NO: 1099823 - RNA, 15 nt, Mycobacterium bovis subsp bovis AF2122/97
gcgugcauaggccgc

SEQ ID NO: 1099824 - RNA, 16 nt, Mycobacterium bovis subsp bovis AF2122/97
gcgugcaucgcgauuc

SEQ ID NO: 1099825 - RNA, 15 nt, Mycobacterium bovis subsp bovis AF2122/97
gcgugcccaguacgu

SEQ ID NO: 1099826 - RNA, 18 nt, Mycobacterium bovis subsp bovis AF2122/97
gcgugcaucgcgauuccg

SEQ ID NO: 1099827 - RNA, 13 nt, Mycobacterium bovis subsp bovis AF2122/97
gcgugcugccgcc

SEQ ID NO: 1099828 - RNA, 24 nt, Mycobacterium bovis subsp bovis AF2122/97
gcgugccaucgugguuuggaccgc

SEQ ID NO: 1099829 - RNA, 16 nt, Mycobacterium bovis subsp bovis AF2122/97
gcgugcuccugcccga

SEQ ID NO: 1099830 - RNA, 13 nt, Mycobacterium bovis subsp bovis AF2122/97
gcgugcuggcgca

SEQ ID NO: 1099831 - RNA, 22 nt, Mycobacterium bovis subsp bovis AF2122/97
gcgugcugcggacaagucggca

SEQ ID NO: 1099832 - RNA, 13 nt, Mycobacterium bovis subsp bovis AF2122/97
gcgugcugcuagc

SEQ ID NO: 1099833 - RNA, 14 nt, Mycobacterium bovis subsp bovis AF2122/97
gcgugcuugaccgc

SEQ ID NO: 1099834 - RNA, 16 nt, Mycobacterium bovis subsp bovis AF2122/97
gcgugcuugagcacgu

SEQ ID NO: 1099835 - RNA, 15 nt, Mycobacterium bovis subsp bovis AF2122/97
gcgugcuuggcagcg

SEQ ID NO: 1099836 - RNA, 14 nt, Mycobacterium bovis subsp bovis AF2122/97
gcguggccccaccg

SEQ ID NO: 1099837 - RNA, 14 nt, Mycobacterium bovis subsp bovis AF2122/97
gcguggcccucggc

SEQ ID NO: 1099838 - RNA, 16 nt, Mycobacterium bovis subsp bovis AF2122/97
gcguggcccucggcga

SEQ ID NO: 1099839 - RNA, 17 nt, Mycobacterium bovis subsp bovis AF2122/97
gcguggcccucggcgau

SEQ ID NO: 1099840 - RNA, 13 nt, Mycobacterium bovis subsp bovis AF2122/97
gcguggccgccgg

SEQ ID NO: 1099841 - RNA, 14 nt, Mycobacterium bovis subsp bovis AF2122/97
gcguggccgccggc

SEQ ID NO: 1099842 - RNA, 19 nt, Mycobacterium bovis subsp bovis AF2122/97
gcguggccgccggcgcugg

SEQ ID NO: 1099843 - RNA, 14 nt, Mycobacterium bovis subsp bovis AF2122/97
gcguggcgacggga

SEQ ID NO: 1099844 - RNA, 13 nt, Mycobacterium bovis subsp bovis AF2122/97
gcguggcgccggc

SEQ ID NO: 1099845 - RNA, 20 nt, Mycobacterium bovis subsp bovis AF2122/97
gcgucucgcgcagccggguc

SEQ ID NO: 1099846 - RNA, 17 nt, Mycobacterium bovis subsp bovis AF2122/97
gcgucgugcgcggccgg

SEQ ID NO: 1099847 - RNA, 15 nt, Mycobacterium bovis subsp bovis AF2122/97
gcgucucgcagcaac

SEQ ID NO: 1099848 - RNA, 21 nt, Mycobacterium bovis subsp bovis AF2122/97
gcgucucgccgggaaacaccg

SEQ ID NO: 1099849 - RNA, 13 nt, Mycobacterium bovis subsp bovis AF2122/97
gcgucucgagcgc

SEQ ID NO: 1099850 - RNA, 18 nt, Mycobacterium bovis subsp bovis AF2122/97
gcgucucgagcgcgccgc

SEQ ID NO: 1099851 - RNA, 23 nt, Mycobacterium bovis subsp bovis AF2122/97
gcgucucgaugagcgcgaaguac

SEQ ID NO: 1099852 - RNA, 13 nt, Mycobacterium bovis subsp bovis AF2122/97
gcgugacgaccag

SEQ ID NO: 1099853 - RNA, 17 nt, Mycobacterium bovis subsp bovis AF2122/97
gcgucugcccgcccagc

SEQ ID NO: 1099854 - RNA, 18 nt, Mycobacterium bovis subsp bovis AF2122/97
gcgucugcccgcccagcc

SEQ ID NO: 1099855 - RNA, 20 nt, Mycobacterium bovis subsp bovis AF2122/97
gcgucugagcgccggcaucg

SEQ ID NO: 1099856 - RNA, 21 nt, Mycobacterium bovis subsp bovis AF2122/97
gcgucugagcgccggcaucgc

SEQ ID NO: 1099857 - RNA, 17 nt, Mycobacterium bovis subsp bovis AF2122/97
gcgugacgcuaacgucg

SEQ ID NO: 1099858 - RNA, 18 nt, Mycobacterium bovis subsp bovis AF2122/97
gcgugaccgugccgucgg

SEQ ID NO: 1099859 - RNA, 14 nt, Mycobacterium bovis subsp bovis AF2122/97
gcgugaccuaccuc

SEQ ID NO: 1099860 - RNA, 23 nt, Mycobacterium bovis subsp bovis AF2122/97
gcgugcagcaggaaguagccgag

SEQ ID NO: 1099861 - RNA, 15 nt, Mycobacterium bovis subsp bovis AF2122/97
gcgugcagcaccccc

SEQ ID NO: 1099862 - RNA, 18 nt, Mycobacterium bovis subsp bovis AF2122/97
gcgugcacggggaccuug

SEQ ID NO: 1099863 - RNA, 18 nt, Mycobacterium bovis subsp bovis AF2122/97
gcgugcacugaccgcggc

SEQ ID NO: 1099864 - RNA, 21 nt, Mycobacterium bovis subsp bovis AF2122/97
gcgugcacugaccgcggcugu

SEQ ID NO: 1099865 - RNA, 13 nt, Mycobacterium bovis subsp bovis AF2122/97
gcgugcagaaucc

SEQ ID NO: 1099866 - RNA, 19 nt, Mycobacterium bovis subsp bovis AF2122/97
gcgugcagaauccguucga

SEQ ID NO: 1099867 - RNA, 20 nt, Mycobacterium bovis subsp bovis AF2122/97
gcgugcagaauccguucgac

SEQ ID NO: 1099868 - RNA, 15 nt, Mycobacterium bovis subsp bovis AF2122/97
gcgugcagcggcggg

SEQ ID NO: 1099869 - RNA, 16 nt, Mycobacterium bovis subsp bovis AF2122/97
gcgugcagcggcgggc

SEQ ID NO: 1099870 - RNA, 15 nt, Mycobacterium bovis subsp bovis AF2122/97
gcgugacgggcagga

SEQ ID NO: 1099871 - RNA, 17 nt, Mycobacterium bovis subsp bovis AF2122/97
gcgugcacaggucagcg

SEQ ID NO: 1099872 - RNA, 12 nt, Mycobacterium bovis subsp bovis AF2122/97
gcgugcacaccc

SEQ ID NO: 1099873 - RNA, 16 nt, Mycobacterium bovis subsp bovis AF2122/97
gcgugcacacccgcaa

SEQ ID NO: 1099874 - RNA, 19 nt, Mycobacterium bovis subsp bovis AF2122/97
gcguggugaagucggugcc

SEQ ID NO: 1099875 - RNA, 21 nt, Mycobacterium bovis subsp bovis AF2122/97
gcguggugagccucggcgagc

SEQ ID NO: 1099876 - RNA, 20 nt, Mycobacterium bovis subsp bovis AF2122/97
gcguggugauccggucuccg

SEQ ID NO: 1099877 - RNA, 19 nt, Mycobacterium bovis subsp bovis AF2122/97
gcguggucgggaacccggu

SEQ ID NO: 1099878 - RNA, 15 nt, Mycobacterium bovis subsp bovis AF2122/97
gcguggucggcgaac

SEQ ID NO: 1099879 - RNA, 19 nt, Mycobacterium bovis subsp bovis AF2122/97
gcguggugcugaccgcgcc

SEQ ID NO: 1099880 - RNA, 20 nt, Mycobacterium bovis subsp bovis AF2122/97
gcgugguggacgcagaguca

SEQ ID NO: 1099881 - RNA, 15 nt, Mycobacterium bovis subsp bovis AF2122/97
gcguggugggcggga

SEQ ID NO: 1099882 - RNA, 19 nt, Mycobacterium bovis subsp bovis AF2122/97
gcgugguguccaccgcauc

SEQ ID NO: 1099883 - RNA, 14 nt, Mycobacterium bovis subsp bovis AF2122/97
gcgugguucggucg

SEQ ID NO: 1099884 - RNA, 15 nt, Mycobacterium bovis subsp bovis AF2122/97
gcguggucgcgcggc

SEQ ID NO: 1099885 - RNA, 19 nt, Mycobacterium bovis subsp bovis AF2122/97
gcguggucgcgcggcaccg

SEQ ID NO: 1099886 - RNA, 22 nt, Mycobacterium bovis subsp bovis AF2122/97
gcguggucggcaaagcgcucgu

SEQ ID NO: 1099887 - RNA, 14 nt, Mycobacterium bovis subsp bovis AF2122/97
gcguggucgccccg

SEQ ID NO: 1099888 - RNA, 14 nt, Mycobacterium bovis subsp bovis AF2122/97
gcguggggccgcca

SEQ ID NO: 1099889 - RNA, 16 nt, Mycobacterium bovis subsp bovis AF2122/97
gcguggggccgccacc

SEQ ID NO: 1099890 - RNA, 21 nt, Mycobacterium bovis subsp bovis AF2122/97
gcgugguaccgcuuguccacc

SEQ ID NO: 1099891 - RNA, 17 nt, Mycobacterium bovis subsp bovis AF2122/97
gcgugguaucgccggga

SEQ ID NO: 1099892 - RNA, 22 nt, Mycobacterium bovis subsp bovis AF2122/97
gcguggcuugguggucgccacc

SEQ ID NO: 1099893 - RNA, 24 nt, Mycobacterium bovis subsp bovis AF2122/97
gcgugggaagagccgggcucgucg

SEQ ID NO: 1099894 - RNA, 22 nt, Mycobacterium bovis subsp bovis AF2122/97
gcgugggaugucgagcguggcg

SEQ ID NO: 1099895 - RNA, 14 nt, Mycobacterium bovis subsp bovis AF2122/97
gcgugggcgcggcg

SEQ ID NO: 1099896 - RNA, 15 nt, Mycobacterium bovis subsp bovis AF2122/97
gcgugggcgcggcgc

SEQ ID NO: 1099897 - RNA, 16 nt, Mycobacterium bovis subsp bovis AF2122/97
gcgugggcgcggcgcc

SEQ ID NO: 1099898 - RNA, 14 nt, Mycobacterium bovis subsp bovis AF2122/97
gcgugggccugcgc

SEQ ID NO: 1099899 - RNA, 17 nt, Mycobacterium bovis subsp bovis AF2122/97
gcguggcugccuucggc

SEQ ID NO: 1099900 - RNA, 19 nt, Mycobacterium bovis subsp bovis AF2122/97
gcguggcugccuucggcga

SEQ ID NO: 1099901 - RNA, 22 nt, Mycobacterium bovis subsp bovis AF2122/97
gcgugggcacuugcccgucggc

SEQ ID NO: 1099902 - RNA, 12 nt, Mycobacterium bovis subsp bovis AF2122/97
gcgugggcagcg

SEQ ID NO: 1099903 - RNA, 23 nt, Mycobacterium bovis subsp bovis AF2122/97
gcgugggcagcgcgaucaccgag

SEQ ID NO: 1099904 - RNA, 14 nt, Mycobacterium bovis subsp bovis AF2122/97
gcguucggccgacu

SEQ ID NO: 1099905 - RNA, 13 nt, Mycobacterium bovis subsp bovis AF2122/97
gcguucggcgagc

SEQ ID NO: 1099906 - RNA, 14 nt, Mycobacterium bovis subsp bovis AF2122/97
gcguucggcgagca

SEQ ID NO: 1099907 - RNA, 17 nt, Mycobacterium bovis subsp bovis AF2122/97
gcguucggcgagcagcg

SEQ ID NO: 1099908 - RNA, 17 nt, Mycobacterium bovis subsp bovis AF2122/97
gcguuccaucgccgacg

SEQ ID NO: 1099909 - RNA, 19 nt, Mycobacterium bovis subsp bovis AF2122/97
gcguuccaucgccgacgcc

SEQ ID NO: 1099910 - RNA, 17 nt, Mycobacterium bovis subsp bovis AF2122/97
gcguuccaguccccgcc

SEQ ID NO: 1099911 - RNA, 20 nt, Mycobacterium bovis subsp bovis AF2122/97
gcguuccauggcccgcucgu

SEQ ID NO: 1099912 - RNA, 23 nt, Mycobacterium bovis subsp bovis AF2122/97
gcguucccgccauugccgccguc

SEQ ID NO: 1099913 - RNA, 14 nt, Mycobacterium bovis subsp bovis AF2122/97
gcguucccgccggc

SEQ ID NO: 1099914 - RNA, 21 nt, Mycobacterium bovis subsp bovis AF2122/97
gcguucccgccggcuccgcca

SEQ ID NO: 1099915 - RNA, 14 nt, Mycobacterium bovis subsp bovis AF2122/97
gcguucccgcucgg

SEQ ID NO: 1099916 - RNA, 16 nt, Mycobacterium bovis subsp bovis AF2122/97
gcguuccccgagaacg

SEQ ID NO: 1099917 - RNA, 18 nt, Mycobacterium bovis subsp bovis AF2122/97
gcguuccaacucgguucg

SEQ ID NO: 1099918 - RNA, 16 nt, Mycobacterium bovis subsp bovis AF2122/97
gcguucagcggccagc

SEQ ID NO: 1099919 - RNA, 18 nt, Mycobacterium bovis subsp bovis AF2122/97
gcguguaaccccaggcgc

SEQ ID NO: 1099920 - RNA, 21 nt, Mycobacterium bovis subsp bovis AF2122/97
gcguguaaccccaggcgcugc

SEQ ID NO: 1099921 - RNA, 22 nt, Mycobacterium bovis subsp bovis AF2122/97
gcguguaaccccaggcgcugcc

SEQ ID NO: 1099922 - RNA, 16 nt, Mycobacterium bovis subsp bovis AF2122/97
gcguguagccugcggc

SEQ ID NO: 1099923 - RNA, 17 nt, Mycobacterium bovis subsp bovis AF2122/97
gcguguccuuugccacc

SEQ ID NO: 1099924 - RNA, 13 nt, Mycobacterium bovis subsp bovis AF2122/97
gcguguccgccga

SEQ ID NO: 1099925 - RNA, 16 nt, Mycobacterium bovis subsp bovis AF2122/97
gcguguugcguucggu

SEQ ID NO: 1099926 - RNA, 22 nt, Mycobacterium bovis subsp bovis AF2122/97
gcgugucacccaauggagccgc

SEQ ID NO: 1099927 - RNA, 22 nt, Mycobacterium bovis subsp bovis AF2122/97
gcguguccuuugccaccucggc

SEQ ID NO: 1099928 - RNA, 23 nt, Mycobacterium bovis subsp bovis AF2122/97
gcguuaccaccgucaccgccggc

SEQ ID NO: 1099929 - RNA, 20 nt, Mycobacterium bovis subsp bovis AF2122/97
gcguuacccaucgccacacc

SEQ ID NO: 1099930 - RNA, 20 nt, Mycobacterium bovis subsp bovis AF2122/97
gcguuaaugcuucgcgucga

SEQ ID NO: 1099931 - RNA, 14 nt, Mycobacterium bovis subsp bovis AF2122/97
gcguuacgcucggc

SEQ ID NO: 1099932 - RNA, 18 nt, Mycobacterium bovis subsp bovis AF2122/97
gcucacguaaccagugac

SEQ ID NO: 1099933 - RNA, 19 nt, Mycobacterium bovis subsp bovis AF2122/97
gcucacguaaccagugacc

SEQ ID NO: 1099934 - RNA, 13 nt, Mycobacterium bovis subsp bovis AF2122/97
gcucacgguggcc

SEQ ID NO: 1099935 - RNA, 24 nt, Mycobacterium bovis subsp bovis AF2122/97
gcucacucgccgaaucgcugaccg

SEQ ID NO: 1099936 - RNA, 15 nt, Mycobacterium bovis subsp bovis AF2122/97
gcucacgguggccgc

SEQ ID NO: 1099937 - RNA, 20 nt, Mycobacterium bovis subsp bovis AF2122/97
gcucacgugcugccgauagc

SEQ ID NO: 1099938 - RNA, 21 nt, Mycobacterium bovis subsp bovis AF2122/97
gcucacuggugacccugauga

SEQ ID NO: 1099939 - RNA, 17 nt, Mycobacterium bovis subsp bovis AF2122/97
gcucagaccggcgccgu

SEQ ID NO: 1099940 - RNA, 18 nt, Mycobacterium bovis subsp bovis AF2122/97
gcucagacgacgaucgcg

SEQ ID NO: 1099941 - RNA, 17 nt, Mycobacterium bovis subsp bovis AF2122/97
gcucagcaacgucacgu

SEQ ID NO: 1099942 - RNA, 11 nt, Mycobacterium bovis subsp bovis AF2122/97
gcucagcagcg

SEQ ID NO: 1099943 - RNA, 18 nt, Mycobacterium bovis subsp bovis AF2122/97
gcucacggacgcugggcg

SEQ ID NO: 1099944 - RNA, 23 nt, Mycobacterium bovis subsp bovis AF2122/97
gcucacggacgcugggcgguagc

SEQ ID NO: 1099945 - RNA, 16 nt, Mycobacterium bovis subsp bovis AF2122/97
gcucacggcaggcggu

SEQ ID NO: 1099946 - RNA, 17 nt, Mycobacterium bovis subsp bovis AF2122/97
gcucacggcggcgaacu

SEQ ID NO: 1099947 - RNA, 13 nt, Mycobacterium bovis subsp bovis AF2122/97
gcucacgcucacc

SEQ ID NO: 1099948 - RNA, 15 nt, Mycobacterium bovis subsp bovis AF2122/97
gcucacgcuccgccg

SEQ ID NO: 1099949 - RNA, 21 nt, Mycobacterium bovis subsp bovis AF2122/97
gcucacgcugaagccgcugga

SEQ ID NO: 1099950 - RNA, 17 nt, Mycobacterium bovis subsp bovis AF2122/97
gcucacgaucugcgcgu

SEQ ID NO: 1099951 - RNA, 18 nt, Mycobacterium bovis subsp bovis AF2122/97
gcucacccggagcacccg

SEQ ID NO: 1099952 - RNA, 13 nt, Mycobacterium bovis subsp bovis AF2122/97
gcucaccggcgcc

SEQ ID NO: 1099953 - RNA, 17 nt, Mycobacterium bovis subsp bovis AF2122/97
gcucaccggcgcccagc

SEQ ID NO: 1099954 - RNA, 14 nt, Mycobacterium bovis subsp bovis AF2122/97
gcucaccggcgucg

SEQ ID NO: 1099955 - RNA, 15 nt, Mycobacterium bovis subsp bovis AF2122/97
gcucaccggcuggug

SEQ ID NO: 1099956 - RNA, 17 nt, Mycobacterium bovis subsp bovis AF2122/97
gcucaccgcgcaucauc

SEQ ID NO: 1099957 - RNA, 19 nt, Mycobacterium bovis subsp bovis AF2122/97
gcucaccgaucccgcggcc

SEQ ID NO: 1099958 - RNA, 18 nt, Mycobacterium bovis subsp bovis AF2122/97
gcucaccgcacaccugcg

SEQ ID NO: 1099959 - RNA, 19 nt, Mycobacterium bovis subsp bovis AF2122/97
gcucacgaagaccgcgucg

SEQ ID NO: 1099960 - RNA, 20 nt, Mycobacterium bovis subsp bovis AF2122/97
gcucacgaagaccgcgucgg

SEQ ID NO: 1099961 - RNA, 22 nt, Mycobacterium bovis subsp bovis AF2122/97
gcucacgaagaccgcgucggcg

SEQ ID NO: 1099962 - RNA, 15 nt, Mycobacterium bovis subsp bovis AF2122/97
gcucacgaccggcca

SEQ ID NO: 1099963 - RNA, 22 nt, Mycobacterium bovis subsp bovis AF2122/97
gcucacgaccggccaacgccgc

SEQ ID NO: 1099964 - RNA, 22 nt, Mycobacterium bovis subsp bovis AF2122/97
gcucaccggggccgucggcaau

SEQ ID NO: 1099965 - RNA, 14 nt, Mycobacterium bovis subsp bovis AF2122/97
gcucaccgucgagg

SEQ ID NO: 1099966 - RNA, 15 nt, Mycobacterium bovis subsp bovis AF2122/97
gcucagccggguauc

SEQ ID NO: 1099967 - RNA, 19 nt, Mycobacterium bovis subsp bovis AF2122/97
gcucagcgcgcgccgcugg

SEQ ID NO: 1099968 - RNA, 14 nt, Mycobacterium bovis subsp bovis AF2122/97
gcucagccguucgc

SEQ ID NO: 1099969 - RNA, 21 nt, Mycobacterium bovis subsp bovis AF2122/97
gcucagcgaugcggcccucga

SEQ ID NO: 1099970 - RNA, 15 nt, Mycobacterium bovis subsp bovis AF2122/97
gcucagcggcgaccg

SEQ ID NO: 1099971 - RNA, 21 nt, Mycobacterium bovis subsp bovis AF2122/97
gcucagcggcgaccgcauccg

SEQ ID NO: 1099972 - RNA, 14 nt, Mycobacterium bovis subsp bovis AF2122/97
gcucagcgcggccc

SEQ ID NO: 1099973 - RNA, 13 nt, Mycobacterium bovis subsp bovis AF2122/97
gcucagcgcggcc

SEQ ID NO: 1099974 - RNA, 12 nt, Mycobacterium bovis subsp bovis AF2122/97
gcucagcgcgcg

SEQ ID NO: 1099975 - RNA, 14 nt, Mycobacterium bovis subsp bovis AF2122/97
gcucagcgugcgcu

SEQ ID NO: 1099976 - RNA, 22 nt, Mycobacterium bovis subsp bovis AF2122/97
gcucagcuaaaaaccgcugccg

SEQ ID NO: 1099977 - RNA, 15 nt, Mycobacterium bovis subsp bovis AF2122/97
gcucagcuggucggc

SEQ ID NO: 1099978 - RNA, 18 nt, Mycobacterium bovis subsp bovis AF2122/97
gcucagcugguggcggcg

SEQ ID NO: 1099979 - RNA, 22 nt, Mycobacterium bovis subsp bovis AF2122/97
gcucaggaacaaugagaucggg

SEQ ID NO: 1099980 - RNA, 22 nt, Mycobacterium bovis subsp bovis AF2122/97
gcucaggguguucacguucagc

SEQ ID NO: 1099981 - RNA, 19 nt, Mycobacterium bovis subsp bovis AF2122/97
gcucaggucaucggcggcg

SEQ ID NO: 1099982 - RNA, 21 nt, Mycobacterium bovis subsp bovis AF2122/97
gcucagggcgcaaaccacccg

SEQ ID NO: 1099983 - RNA, 14 nt, Mycobacterium bovis subsp bovis AF2122/97
gcucagggcaguag

SEQ ID NO: 1099984 - RNA, 23 nt, Mycobacterium bovis subsp bovis AF2122/97
gcucagcuucuuaccgcgggccg

SEQ ID NO: 1099985 - RNA, 17 nt, Mycobacterium bovis subsp bovis AF2122/97
gcucauuagcccccgcg

SEQ ID NO: 1099986 - RNA, 24 nt, Mycobacterium bovis subsp bovis AF2122/97
gcucauucgugcccgggcggucga

SEQ ID NO: 1099987 - RNA, 18 nt, Mycobacterium bovis subsp bovis AF2122/97
gcucaucugcgcgcggaa

SEQ ID NO: 1099988 - RNA, 17 nt, Mycobacterium bovis subsp bovis AF2122/97
gcucaugaccgcucgga

SEQ ID NO: 1099989 - RNA, 14 nt, Mycobacterium bovis subsp bovis AF2122/97
gcucaucgcgcacg

SEQ ID NO: 1099990 - RNA, 14 nt, Mycobacterium bovis subsp bovis AF2122/97
gcucaucgcgcccg

SEQ ID NO: 1099991 - RNA, 16 nt, Mycobacterium bovis subsp bovis AF2122/97
gcucaucgcggcgaac

SEQ ID NO: 1099992 - RNA, 14 nt, Mycobacterium bovis subsp bovis AF2122/97
gcucaucgaccgcg

SEQ ID NO: 1099993 - RNA, 18 nt, Mycobacterium bovis subsp bovis AF2122/97
gcucaucgaccgcggccg

SEQ ID NO: 1099994 - RNA, 22 nt, Mycobacterium bovis subsp bovis AF2122/97
gcucaucgacgagccgcggucg

SEQ ID NO: 1099995 - RNA, 23 nt, Mycobacterium bovis subsp bovis AF2122/97
gcucaucgauccucgcccgcacc

SEQ ID NO: 1099996 - RNA, 21 nt, Mycobacterium bovis subsp bovis AF2122/97
gcucauccauucggcggcggc

SEQ ID NO: 1099997 - RNA, 13 nt, Mycobacterium bovis subsp bovis AF2122/97
gcucauccagcgc

SEQ ID NO: 1099998 - RNA, 21 nt, Mycobacterium bovis subsp bovis AF2122/97
gcucauaccgggaggacacca

SEQ ID NO: 1099999 - RNA, 14 nt, Mycobacterium bovis subsp bovis AF2122/97
gcucaucacccagc

SEQ ID NO: 1100000 - RNA, 16 nt, Mycobacterium bovis subsp bovis AF2122/97
gcucaucacccagcgc

SEQ ID NO: 1100001 - RNA, 17 nt, Mycobacterium bovis subsp bovis AF2122/97
gcucaucacccagcgcc

SEQ ID NO: 1100002 - RNA, 14 nt, Mycobacterium bovis subsp bovis AF2122/97
gcucagucacgcac

SEQ ID NO: 1100003 - RNA, 19 nt, Mycobacterium bovis subsp bovis AF2122/97
gcucagugaugcgccccgg

SEQ ID NO: 1100004 - RNA, 15 nt, Mycobacterium bovis subsp bovis AF2122/97
gcuccagcgcgcgcc

SEQ ID NO: 1100005 - RNA, 16 nt, Mycobacterium bovis subsp bovis AF2122/97
gcuccagcgcgcgccg

SEQ ID NO: 1100006 - RNA, 14 nt, Mycobacterium bovis subsp bovis AF2122/97
gcuccagcucggcc

SEQ ID NO: 1100007 - RNA, 17 nt, Mycobacterium bovis subsp bovis AF2122/97
gcuccagcucggccagu

SEQ ID NO: 1100008 - RNA, 15 nt, Mycobacterium bovis subsp bovis AF2122/97
gcuccagcucggcgg

SEQ ID NO: 1100009 - RNA, 18 nt, Mycobacterium bovis subsp bovis AF2122/97
gcuccagcucggcgggcu

SEQ ID NO: 1100010 - RNA, 17 nt, Mycobacterium bovis subsp bovis AF2122/97
gcuccagcaccgugacc

SEQ ID NO: 1100011 - RNA, 13 nt, Mycobacterium bovis subsp bovis AF2122/97
gcuccaccgucga

SEQ ID NO: 1100012 - RNA, 15 nt, Mycobacterium bovis subsp bovis AF2122/97
gcuccacguacgcgg

SEQ ID NO: 1100013 - RNA, 14 nt, Mycobacterium bovis subsp bovis AF2122/97
gcuccagcacccgc

SEQ ID NO: 1100014 - RNA, 19 nt, Mycobacterium bovis subsp bovis AF2122/97
gcuccagcaaaacccgcuc

SEQ ID NO: 1100015 - RNA, 21 nt, Mycobacterium bovis subsp bovis AF2122/97
gcuccagcaaaacccgcucca

SEQ ID NO: 1100016 - RNA, 11 nt, Mycobacterium bovis subsp bovis AF2122/97
gcuccagcacc

SEQ ID NO: 1100017 - RNA, 21 nt, Mycobacterium bovis subsp bovis AF2122/97
gcuccaccgggcccgccggcc

SEQ ID NO: 1100018 - RNA, 17 nt, Mycobacterium bovis subsp bovis AF2122/97
gcuccacccuugccgcu

SEQ ID NO: 1100019 - RNA, 13 nt, Mycobacterium bovis subsp bovis AF2122/97
gcuccaccaggac

SEQ ID NO: 1100020 - RNA, 19 nt, Mycobacterium bovis subsp bovis AF2122/97
gcuccaccaggacgugguc

SEQ ID NO: 1100021 - RNA, 16 nt, Mycobacterium bovis subsp bovis AF2122/97
gcuccaccacgaccgc

SEQ ID NO: 1100022 - RNA, 17 nt, Mycobacterium bovis subsp bovis AF2122/97
gcuccaacacccgccgg

SEQ ID NO: 1100023 - RNA, 16 nt, Mycobacterium bovis subsp bovis AF2122/97
gcuccacaaguagccg

SEQ ID NO: 1100024 - RNA, 17 nt, Mycobacterium bovis subsp bovis AF2122/97
gcuagguaccguucgau

SEQ ID NO: 1100025 - RNA, 12 nt, Mycobacterium bovis subsp bovis AF2122/97
gcuagggcagca

SEQ ID NO: 1100026 - RNA, 16 nt, Mycobacterium bovis subsp bovis AF2122/97
gcuagggcccuggcgg

SEQ ID NO: 1100027 - RNA, 19 nt, Mycobacterium bovis subsp bovis AF2122/97
gcuagugugaccgucagcc

SEQ ID NO: 1100028 - RNA, 13 nt, Mycobacterium bovis subsp bovis AF2122/97
gcuaggaccacca

SEQ ID NO: 1100029 - RNA, 17 nt, Mycobacterium bovis subsp bovis AF2122/97
gcuaggaccaccagcgc

SEQ ID NO: 1100030 - RNA, 15 nt, Mycobacterium bovis subsp bovis AF2122/97
gcuaggaccgcggug

SEQ ID NO: 1100031 - RNA, 16 nt, Mycobacterium bovis subsp bovis AF2122/97
gcuaggacggcugccg

SEQ ID NO: 1100032 - RNA, 21 nt, Mycobacterium bovis subsp bovis AF2122/97
gcuaggacggcugccgucagc

SEQ ID NO: 1100033 - RNA, 16 nt, Mycobacterium bovis subsp bovis AF2122/97
gcuagcuuggcggcca

SEQ ID NO: 1100034 - RNA, 17 nt, Mycobacterium bovis subsp bovis AF2122/97
gcuagcuuggcggccag

SEQ ID NO: 1100035 - RNA, 18 nt, Mycobacterium bovis subsp bovis AF2122/97
gcuagcuuggcggccagc

SEQ ID NO: 1100036 - RNA, 20 nt, Mycobacterium bovis subsp bovis AF2122/97
gcuaggcaccagcggaucgc

SEQ ID NO: 1100037 - RNA, 17 nt, Mycobacterium bovis subsp bovis AF2122/97
gcuaggccaccggcgac

SEQ ID NO: 1100038 - RNA, 14 nt, Mycobacterium bovis subsp bovis AF2122/97
gcuaggccagcacg

SEQ ID NO: 1100039 - RNA, 24 nt, Mycobacterium bovis subsp bovis AF2122/97
gcuagcgguuuagccgcuugggcc

SEQ ID NO: 1100040 - RNA, 15 nt, Mycobacterium bovis subsp bovis AF2122/97
gcuagcgcuugcgac

SEQ ID NO: 1100041 - RNA, 22 nt, Mycobacterium bovis subsp bovis AF2122/97
gcuagcggauucagcgucgcca

SEQ ID NO: 1100042 - RNA, 13 nt, Mycobacterium bovis subsp bovis AF2122/97
gcuagcucggcgg

SEQ ID NO: 1100043 - RNA, 18 nt, Mycobacterium bovis subsp bovis AF2122/97
gcuaucguggcggcgucg

SEQ ID NO: 1100044 - RNA, 22 nt, Mycobacterium bovis subsp bovis AF2122/97
gcuauggcauuaccacuucggc

SEQ ID NO: 1100045 - RNA, 16 nt, Mycobacterium bovis subsp bovis AF2122/97
gcuauccgcgggaagu

SEQ ID NO: 1100046 - RNA, 15 nt, Mycobacterium bovis subsp bovis AF2122/97
gcuaucccaggggca

SEQ ID NO: 1100047 - RNA, 16 nt, Mycobacterium bovis subsp bovis AF2122/97
gcucacccgccgcggu

SEQ ID NO: 1100048 - RNA, 20 nt, Mycobacterium bovis subsp bovis AF2122/97
gcucacauacagcaggccgc

SEQ ID NO: 1100049 - RNA, 18 nt, Mycobacterium bovis subsp bovis AF2122/97
gcucaccaaucugcgggc

SEQ ID NO: 1100050 - RNA, 12 nt, Mycobacterium bovis subsp bovis AF2122/97
gcucaccacauc

SEQ ID NO: 1100051 - RNA, 21 nt, Mycobacterium bovis subsp bovis AF2122/97
gcucaccaccgaccucgacgc

SEQ ID NO: 1100052 - RNA, 17 nt, Mycobacterium bovis subsp bovis AF2122/97
gcucaccaggcgagccg

SEQ ID NO: 1100053 - RNA, 21 nt, Mycobacterium bovis subsp bovis AF2122/97
gcucaccaggcgagccggcgc

SEQ ID NO: 1100054 - RNA, 16 nt, Mycobacterium bovis subsp bovis AF2122/97
gcucaccaucucgcaa

SEQ ID NO: 1100055 - RNA, 16 nt, Mycobacterium bovis subsp bovis AF2122/97
gcucacagcacagcgc

SEQ ID NO: 1100056 - RNA, 14 nt, Mycobacterium bovis subsp bovis AF2122/97
gcucaagcgcgucg

SEQ ID NO: 1100057 - RNA, 20 nt, Mycobacterium bovis subsp bovis AF2122/97
gcucaaggcuucggcggccg

SEQ ID NO: 1100058 - RNA, 18 nt, Mycobacterium bovis subsp bovis AF2122/97
gcucaagucucccggccg

SEQ ID NO: 1100059 - RNA, 22 nt, Mycobacterium bovis subsp bovis AF2122/97
gcucaagucucccggccgcacc

SEQ ID NO: 1100060 - RNA, 23 nt, Mycobacterium bovis subsp bovis AF2122/97
gcucaagucucccggccgcaccc

SEQ ID NO: 1100061 - RNA, 14 nt, Mycobacterium bovis subsp bovis AF2122/97
gcucaacggcgaca

SEQ ID NO: 1100062 - RNA, 12 nt, Mycobacterium bovis subsp bovis AF2122/97
gcucaaacccga

SEQ ID NO: 1100063 - RNA, 16 nt, Mycobacterium bovis subsp bovis AF2122/97
gcucaaaucaugcgau

SEQ ID NO: 1100064 - RNA, 14 nt, Mycobacterium bovis subsp bovis AF2122/97
gcuauucggugucg

SEQ ID NO: 1100065 - RNA, 20 nt, Mycobacterium bovis subsp bovis AF2122/97
gcuaugucauagcgcaccac

SEQ ID NO: 1100066 - RNA, 17 nt, Mycobacterium bovis subsp bovis AF2122/97
gcuauggguucgcgguu

SEQ ID NO: 1100067 - RNA, 20 nt, Mycobacterium bovis subsp bovis AF2122/97
gcuaugcuggcgcagcgcca

SEQ ID NO: 1100068 - RNA, 17 nt, Mycobacterium bovis subsp bovis AF2122/97
gcuauggcgccgcggcu

SEQ ID NO: 1100069 - RNA, 13 nt, Mycobacterium bovis subsp bovis AF2122/97
gcguugccgccgg

SEQ ID NO: 1100070 - RNA, 14 nt, Mycobacterium bovis subsp bovis AF2122/97
gcguugccgccggc

SEQ ID NO: 1100071 - RNA, 23 nt, Mycobacterium bovis subsp bovis AF2122/97
gcguugccgccggcuccacccuu

SEQ ID NO: 1100072 - RNA, 13 nt, Mycobacterium bovis subsp bovis AF2122/97
gcguugccgccgu

SEQ ID NO: 1100073 - RNA, 15 nt, Mycobacterium bovis subsp bovis AF2122/97
gcguugccgccguug

SEQ ID NO: 1100074 - RNA, 16 nt, Mycobacterium bovis subsp bovis AF2122/97
gcguugcaucagcacg

SEQ ID NO: 1100075 - RNA, 23 nt, Mycobacterium bovis subsp bovis AF2122/97
gcuacccauggcccguuggcagc

SEQ ID NO: 1100076 - RNA, 22 nt, Mycobacterium bovis subsp bovis AF2122/97
gcuacccccgauggcgucgccg

SEQ ID NO: 1100077 - RNA, 13 nt, Mycobacterium bovis subsp bovis AF2122/97
gcuacccgagccg

SEQ ID NO: 1100078 - RNA, 16 nt, Mycobacterium bovis subsp bovis AF2122/97
gcuacccgagccggca

SEQ ID NO: 1100079 - RNA, 18 nt, Mycobacterium bovis subsp bovis AF2122/97
gcuacccgagccggcacg

SEQ ID NO: 1100080 - RNA, 16 nt, Mycobacterium bovis subsp bovis AF2122/97
gcuaccccgacggcga

SEQ ID NO: 1100081 - RNA, 18 nt, Mycobacterium bovis subsp bovis AF2122/97
gcuaccccgacggcgacc

SEQ ID NO: 1100082 - RNA, 17 nt, Mycobacterium bovis subsp bovis AF2122/97
gcuaccccgcagaaucc

SEQ ID NO: 1100083 - RNA, 18 nt, Mycobacterium bovis subsp bovis AF2122/97
gcuacccauucggcggcg

SEQ ID NO: 1100084 - RNA, 19 nt, Mycobacterium bovis subsp bovis AF2122/97
gcuacccccgauggcgucg

SEQ ID NO: 1100085 - RNA, 21 nt, Mycobacterium bovis subsp bovis AF2122/97
gcuacccccgauggcgucgcc

SEQ ID NO: 1100086 - RNA, 19 nt, Mycobacterium bovis subsp bovis AF2122/97
gcuaccgcgcucccggcgu

SEQ ID NO: 1100087 - RNA, 21 nt, Mycobacterium bovis subsp bovis AF2122/97
gcuaccgccuugucggcgaug

SEQ ID NO: 1100088 - RNA, 22 nt, Mycobacterium bovis subsp bovis AF2122/97
gcuacccggacagggcggcgag

SEQ ID NO: 1100089 - RNA, 22 nt, Mycobacterium bovis subsp bovis AF2122/97
gcuaccgaacaguaggccuccg

SEQ ID NO: 1100090 - RNA, 23 nt, Mycobacterium bovis subsp bovis AF2122/97
gcuaccgaacaguaggccuccgc

SEQ ID NO: 1100091 - RNA, 19 nt, Mycobacterium bovis subsp bovis AF2122/97
gcuaccgcccgcgccaccg

SEQ ID NO: 1100092 - RNA, 13 nt, Mycobacterium bovis subsp bovis AF2122/97
gcuaccgaucgcc

SEQ ID NO: 1100093 - RNA, 16 nt, Mycobacterium bovis subsp bovis AF2122/97
gcuaccgcccgcgcca

SEQ ID NO: 1100094 - RNA, 18 nt, Mycobacterium bovis subsp bovis AF2122/97
gcuaccgcccgcgccacc

SEQ ID NO: 1100095 - RNA, 22 nt, Mycobacterium bovis subsp bovis AF2122/97
gcguucggcgagcaucucgaca

SEQ ID NO: 1100096 - RNA, 17 nt, Mycobacterium bovis subsp bovis AF2122/97
gcguucggcgcugaucg

SEQ ID NO: 1100097 - RNA, 18 nt, Mycobacterium bovis subsp bovis AF2122/97
gcguucggcgcugaucgc

SEQ ID NO: 1100098 - RNA, 21 nt, Mycobacterium bovis subsp bovis AF2122/97
gcguucggcgcugaucgcgcg

SEQ ID NO: 1100099 - RNA, 22 nt, Mycobacterium bovis subsp bovis AF2122/97
gcguugagcuggcgguugcccg

SEQ ID NO: 1100100 - RNA, 22 nt, Mycobacterium bovis subsp bovis AF2122/97
gcguugagugcccauagccggu

SEQ ID NO: 1100101 - RNA, 17 nt, Mycobacterium bovis subsp bovis AF2122/97
gcguugauacgcgucga

SEQ ID NO: 1100102 - RNA, 17 nt, Mycobacterium bovis subsp bovis AF2122/97
gcguugaugaccgccgc

SEQ ID NO: 1100103 - RNA, 23 nt, Mycobacterium bovis subsp bovis AF2122/97
gcguugauccgcaccccauacuc

SEQ ID NO: 1100104 - RNA, 21 nt, Mycobacterium bovis subsp bovis AF2122/97
gcguugcaggaaaguggccga

SEQ ID NO: 1100105 - RNA, 16 nt, Mycobacterium bovis subsp bovis AF2122/97
gcguugcacagcagcg

SEQ ID NO: 1100106 - RNA, 17 nt, Mycobacterium bovis subsp bovis AF2122/97
gcguugcaccauucgca

SEQ ID NO: 1100107 - RNA, 15 nt, Mycobacterium bovis subsp bovis AF2122/97
gcuacggggcggucg

SEQ ID NO: 1100108 - RNA, 18 nt, Mycobacterium bovis subsp bovis AF2122/97
gcuacgggccgcgguacc

SEQ ID NO: 1100109 - RNA, 23 nt, Mycobacterium bovis subsp bovis AF2122/97
gcuacggccagugccaucgccau

SEQ ID NO: 1100110 - RNA, 16 nt, Mycobacterium bovis subsp bovis AF2122/97
gcuacggcgacacgcc

SEQ ID NO: 1100111 - RNA, 21 nt, Mycobacterium bovis subsp bovis AF2122/97
gcuacggcgacacgccagccg

SEQ ID NO: 1100112 - RNA, 14 nt, Mycobacterium bovis subsp bovis AF2122/97
gcuacgcgcgcucg

SEQ ID NO: 1100113 - RNA, 16 nt, Mycobacterium bovis subsp bovis AF2122/97
gcuacgcgcgcucgcu

SEQ ID NO: 1100114 - RNA, 18 nt, Mycobacterium bovis subsp bovis AF2122/97
gcuacgcggccgagguca

SEQ ID NO: 1100115 - RNA, 13 nt, Mycobacterium bovis subsp bovis AF2122/97
gcuacgcgaucag

SEQ ID NO: 1100116 - RNA, 14 nt, Mycobacterium bovis subsp bovis AF2122/97
gcuacgcgcgcccg

SEQ ID NO: 1100117 - RNA, 13 nt, Mycobacterium bovis subsp bovis AF2122/97
gcuacgcgcgcuc

SEQ ID NO: 1100118 - RNA, 20 nt, Mycobacterium bovis subsp bovis AF2122/97
gcuaccggcgccgcgcggcu

SEQ ID NO: 1100119 - RNA, 22 nt, Mycobacterium bovis subsp bovis AF2122/97
gcuacgacgagugguccggcgg

SEQ ID NO: 1100120 - RNA, 14 nt, Mycobacterium bovis subsp bovis AF2122/97
gcuacgacggcgcc

SEQ ID NO: 1100121 - RNA, 16 nt, Mycobacterium bovis subsp bovis AF2122/97
gcuaccuccgccacca

SEQ ID NO: 1100122 - RNA, 21 nt, Mycobacterium bovis subsp bovis AF2122/97
gcuaccuuggacucggcggga

SEQ ID NO: 1100123 - RNA, 17 nt, Mycobacterium bovis subsp bovis AF2122/97
gcuaccuuguccggccc

SEQ ID NO: 1100124 - RNA, 22 nt, Mycobacterium bovis subsp bovis AF2122/97
gcuacgguaccgagaacaccac

SEQ ID NO: 1100125 - RNA, 16 nt, Mycobacterium bovis subsp bovis AF2122/97
gcuacguuacgccgag

SEQ ID NO: 1100126 - RNA, 13 nt, Mycobacterium bovis subsp bovis AF2122/97
gcuacgucgaccg

SEQ ID NO: 1100127 - RNA, 14 nt, Mycobacterium bovis subsp bovis AF2122/97
gcuacgucgaccga

SEQ ID NO: 1100128 - RNA, 16 nt, Mycobacterium bovis subsp bovis AF2122/97
gcuacgucgaccgacg

SEQ ID NO: 1100129 - RNA, 17 nt, Mycobacterium bovis subsp bovis AF2122/97
gcuacgucgaccgacgg

SEQ ID NO: 1100130 - RNA, 14 nt, Mycobacterium bovis subsp bovis AF2122/97
gcuacgucggcucg

SEQ ID NO: 1100131 - RNA, 18 nt, Mycobacterium bovis subsp bovis AF2122/97
gcuacgucggcucgucgc

SEQ ID NO: 1100132 - RNA, 22 nt, Mycobacterium bovis subsp bovis AF2122/97
gcuacgucggcucgucgcucga

SEQ ID NO: 1100133 - RNA, 17 nt, Mycobacterium bovis subsp bovis AF2122/97
gcuacuaggcccagcac

SEQ ID NO: 1100134 - RNA, 23 nt, Mycobacterium bovis subsp bovis AF2122/97
gcuacuaugccaacgacaggcgc

SEQ ID NO: 1100135 - RNA, 20 nt, Mycobacterium bovis subsp bovis AF2122/97
gcuacucacggugaucguuc

SEQ ID NO: 1100136 - RNA, 18 nt, Mycobacterium bovis subsp bovis AF2122/97
gcuagcgcccgcgagaga

SEQ ID NO: 1100137 - RNA, 23 nt, Mycobacterium bovis subsp bovis AF2122/97
gcuagcgccgaucuucgcgcgcu

SEQ ID NO: 1100138 - RNA, 13 nt, Mycobacterium bovis subsp bovis AF2122/97
gcuagcgccgcgc

SEQ ID NO: 1100139 - RNA, 15 nt, Mycobacterium bovis subsp bovis AF2122/97
gcuagccagucggcc

SEQ ID NO: 1100140 - RNA, 18 nt, Mycobacterium bovis subsp bovis AF2122/97
gcuagccagucggccacc

SEQ ID NO: 1100141 - RNA, 24 nt, Mycobacterium bovis subsp bovis AF2122/97
gcuagccccgaucaucgacgauuc

SEQ ID NO: 1100142 - RNA, 17 nt, Mycobacterium bovis subsp bovis AF2122/97
gcuagccgggcgcgccg

SEQ ID NO: 1100143 - RNA, 14 nt, Mycobacterium bovis subsp bovis AF2122/97
gcuagccguucggc

SEQ ID NO: 1100144 - RNA, 22 nt, Mycobacterium bovis subsp bovis AF2122/97
gcuagcagagacaugccggcga

SEQ ID NO: 1100145 - RNA, 15 nt, Mycobacterium bovis subsp bovis AF2122/97
gcuagcagcagcccg

SEQ ID NO: 1100146 - RNA, 21 nt, Mycobacterium bovis subsp bovis AF2122/97
gcuagacccgucaccgccgac

SEQ ID NO: 1100147 - RNA, 19 nt, Mycobacterium bovis subsp bovis AF2122/97
gcuggugccaacugcgccg

SEQ ID NO: 1100148 - RNA, 20 nt, Mycobacterium bovis subsp bovis AF2122/97
gcuguaggcgauaucgcccg

SEQ ID NO: 1100149 - RNA, 17 nt, Mycobacterium bovis subsp bovis AF2122/97
gcuguagucgcgccucg

SEQ ID NO: 1100150 - RNA, 19 nt, Mycobacterium bovis subsp bovis AF2122/97
gcugucaagcgggcuggcg

SEQ ID NO: 1100151 - RNA, 20 nt, Mycobacterium bovis subsp bovis AF2122/97
gcugucauccccggccagcc

SEQ ID NO: 1100152 - RNA, 16 nt, Mycobacterium bovis subsp bovis AF2122/97
gcugucaccgcaaccg

SEQ ID NO: 1100153 - RNA, 15 nt, Mycobacterium bovis subsp bovis AF2122/97
gcugucaccguacgg

SEQ ID NO: 1100154 - RNA, 19 nt, Mycobacterium bovis subsp bovis AF2122/97
gcugucaccguacggccac

SEQ ID NO: 1100155 - RNA, 19 nt, Mycobacterium bovis subsp bovis AF2122/97
gcugucacgccugccaccg

SEQ ID NO: 1100156 - RNA, 14 nt, Mycobacterium bovis subsp bovis AF2122/97
gcugucagacggcg

SEQ ID NO: 1100157 - RNA, 16 nt, Mycobacterium bovis subsp bovis AF2122/97
gcugucggcgaccgag

SEQ ID NO: 1100158 - RNA, 22 nt, Mycobacterium bovis subsp bovis AF2122/97
gcugucggcgaccgagacggcg

SEQ ID NO: 1100159 - RNA, 19 nt, Mycobacterium bovis subsp bovis AF2122/97
gcugucggauagccucggc

SEQ ID NO: 1100160 - RNA, 19 nt, Mycobacterium bovis subsp bovis AF2122/97
gcugucgcgggccaccacc

SEQ ID NO: 1100161 - RNA, 17 nt, Mycobacterium bovis subsp bovis AF2122/97
gcugucggugccgucga

SEQ ID NO: 1100162 - RNA, 23 nt, Mycobacterium bovis subsp bovis AF2122/97
gcugucgucuuggcgaucggguu

SEQ ID NO: 1100163 - RNA, 12 nt, Mycobacterium bovis subsp bovis AF2122/97
gcugucggugcc

SEQ ID NO: 1100164 - RNA, 17 nt, Mycobacterium bovis subsp bovis AF2122/97
gcugucgugcucucggc

SEQ ID NO: 1100165 - RNA, 19 nt, Mycobacterium bovis subsp bovis AF2122/97
gcugucguugaucggcacg

SEQ ID NO: 1100166 - RNA, 20 nt, Mycobacterium bovis subsp bovis AF2122/97
gcugucguugaucggcacgc

SEQ ID NO: 1100167 - RNA, 16 nt, Mycobacterium bovis subsp bovis AF2122/97
gcugugaacaggccga

SEQ ID NO: 1100168 - RNA, 14 nt, Mycobacterium bovis subsp bovis AF2122/97
gcugugcgacccgc

SEQ ID NO: 1100169 - RNA, 15 nt, Mycobacterium bovis subsp bovis AF2122/97
gcugugcgcuggucg

SEQ ID NO: 1100170 - RNA, 19 nt, Mycobacterium bovis subsp bovis AF2122/97
gcugugccgugcgaucacc

SEQ ID NO: 1100171 - RNA, 12 nt, Mycobacterium bovis subsp bovis AF2122/97
gcugugcagcgg

SEQ ID NO: 1100172 - RNA, 18 nt, Mycobacterium bovis subsp bovis AF2122/97
gcugugcaggcgggaacg

SEQ ID NO: 1100173 - RNA, 20 nt, Mycobacterium bovis subsp bovis AF2122/97
gcuggucgugggccaccacc

SEQ ID NO: 1100174 - RNA, 20 nt, Mycobacterium bovis subsp bovis AF2122/97
gcuggucuacccgcggcgcg

SEQ ID NO: 1100175 - RNA, 22 nt, Mycobacterium bovis subsp bovis AF2122/97
gcuggugauggccaucuggccg

SEQ ID NO: 1100176 - RNA, 23 nt, Mycobacterium bovis subsp bovis AF2122/97
gcuggugcgccacgccaccgcgg

SEQ ID NO: 1100177 - RNA, 18 nt, Mycobacterium bovis subsp bovis AF2122/97
gcuggugcgcccaucaug

SEQ ID NO: 1100178 - RNA, 20 nt, Mycobacterium bovis subsp bovis AF2122/97
gcuguaggccagcccggcgu

SEQ ID NO: 1100179 - RNA, 13 nt, Mycobacterium bovis subsp bovis AF2122/97
gcuguaggcgacc

SEQ ID NO: 1100180 - RNA, 15 nt, Mycobacterium bovis subsp bovis AF2122/97
gcuggucgagcagug

SEQ ID NO: 1100181 - RNA, 12 nt, Mycobacterium bovis subsp bovis AF2122/97
gcuggucgaugg

SEQ ID NO: 1100182 - RNA, 14 nt, Mycobacterium bovis subsp bovis AF2122/97
gcuggucgauggcg

SEQ ID NO: 1100183 - RNA, 21 nt, Mycobacterium bovis subsp bovis AF2122/97
gcuggucgauggcguacagca

SEQ ID NO: 1100184 - RNA, 23 nt, Mycobacterium bovis subsp bovis AF2122/97
gcuggucgauggcguacagcacc

SEQ ID NO: 1100185 - RNA, 21 nt, Mycobacterium bovis subsp bovis AF2122/97
gcuggucggcuaccgccgacc

SEQ ID NO: 1100186 - RNA, 22 nt, Mycobacterium bovis subsp bovis AF2122/97
gcuggucggcuaccgccgaccg

SEQ ID NO: 1100187 - RNA, 12 nt, Mycobacterium bovis subsp bovis AF2122/97
gcuggucgccgc

SEQ ID NO: 1100188 - RNA, 15 nt, Mycobacterium bovis subsp bovis AF2122/97
gcuggucgccgucga

SEQ ID NO: 1100189 - RNA, 20 nt, Mycobacterium bovis subsp bovis AF2122/97
gcuggucgccgucgaagcgg

SEQ ID NO: 1100190 - RNA, 13 nt, Mycobacterium bovis subsp bovis AF2122/97
gcuggucggucaa

SEQ ID NO: 1100191 - RNA, 14 nt, Mycobacterium bovis subsp bovis AF2122/97
gcuggucggagacc

SEQ ID NO: 1100192 - RNA, 19 nt, Mycobacterium bovis subsp bovis AF2122/97
gcugguccuugucgacccc

SEQ ID NO: 1100193 - RNA, 15 nt, Mycobacterium bovis subsp bovis AF2122/97
gcugggggcggucgc

SEQ ID NO: 1100194 - RNA, 23 nt, Mycobacterium bovis subsp bovis AF2122/97
gcugggucagguugucggcgauc

SEQ ID NO: 1100195 - RNA, 23 nt, Mycobacterium bovis subsp bovis AF2122/97
gcugguccuccaaggcggucacc

SEQ ID NO: 1100196 - RNA, 16 nt, Mycobacterium bovis subsp bovis AF2122/97
gcugggguccgcgucg

SEQ ID NO: 1100197 - RNA, 17 nt, Mycobacterium bovis subsp bovis AF2122/97
gcuggggccccgcgccg

SEQ ID NO: 1100198 - RNA, 20 nt, Mycobacterium bovis subsp bovis AF2122/97
gcuggggccccgcgccggcc

SEQ ID NO: 1100199 - RNA, 20 nt, Mycobacterium bovis subsp bovis AF2122/97
gcuggcgaucuggucggcgg

SEQ ID NO: 1100200 - RNA, 18 nt, Mycobacterium bovis subsp bovis AF2122/97
gcuggcgccgccggugcc

SEQ ID NO: 1100201 - RNA, 20 nt, Mycobacterium bovis subsp bovis AF2122/97
gcuggcgcccuugccggcga

SEQ ID NO: 1100202 - RNA, 13 nt, Mycobacterium bovis subsp bovis AF2122/97
gcuggcgcccccg

SEQ ID NO: 1100203 - RNA, 17 nt, Mycobacterium bovis subsp bovis AF2122/97
gcuggcgcccccgacga

SEQ ID NO: 1100204 - RNA, 14 nt, Mycobacterium bovis subsp bovis AF2122/97
gcuggcgcagccug

SEQ ID NO: 1100205 - RNA, 17 nt, Mycobacterium bovis subsp bovis AF2122/97
gcuggcgcagcgccauc

SEQ ID NO: 1100206 - RNA, 18 nt, Mycobacterium bovis subsp bovis AF2122/97
gcuggcgagcagacgcga

SEQ ID NO: 1100207 - RNA, 16 nt, Mycobacterium bovis subsp bovis AF2122/97
gcuggcgauacagcga

SEQ ID NO: 1100208 - RNA, 16 nt, Mycobacterium bovis subsp bovis AF2122/97
gcuggcgaccuggucg

SEQ ID NO: 1100209 - RNA, 17 nt, Mycobacterium bovis subsp bovis AF2122/97
gcuggccuccagcuugg

SEQ ID NO: 1100210 - RNA, 12 nt, Mycobacterium bovis subsp bovis AF2122/97
gcuggccggcac

SEQ ID NO: 1100211 - RNA, 17 nt, Mycobacterium bovis subsp bovis AF2122/97
gcuggccggcaccguga

SEQ ID NO: 1100212 - RNA, 14 nt, Mycobacterium bovis subsp bovis AF2122/97
gcuggccguaacgc

SEQ ID NO: 1100213 - RNA, 22 nt, Mycobacterium bovis subsp bovis AF2122/97
gcuggccguauaggcccgggcg

SEQ ID NO: 1100214 - RNA, 19 nt, Mycobacterium bovis subsp bovis AF2122/97
gcuggccgucagcgucggc

SEQ ID NO: 1100215 - RNA, 22 nt, Mycobacterium bovis subsp bovis AF2122/97
gcuggccgucgaagacgaacgu

SEQ ID NO: 1100216 - RNA, 22 nt, Mycobacterium bovis subsp bovis AF2122/97
gcuggccuccuggaaggaggcc

SEQ ID NO: 1100217 - RNA, 14 nt, Mycobacterium bovis subsp bovis AF2122/97
gcugggcgccacca

SEQ ID NO: 1100218 - RNA, 14 nt, Mycobacterium bovis subsp bovis AF2122/97
gcugggcgccgcgc

SEQ ID NO: 1100219 - RNA, 22 nt, Mycobacterium bovis subsp bovis AF2122/97
gcugggcgguagcuuccgcgac

SEQ ID NO: 1100220 - RNA, 22 nt, Mycobacterium bovis subsp bovis AF2122/97
gcugggcggucggaaugccguc

SEQ ID NO: 1100221 - RNA, 13 nt, Mycobacterium bovis subsp bovis AF2122/97
gcugggcgaccac

SEQ ID NO: 1100222 - RNA, 23 nt, Mycobacterium bovis subsp bovis AF2122/97
gcugggcgccaugcgccaacccg

SEQ ID NO: 1100223 - RNA, 22 nt, Mycobacterium bovis subsp bovis AF2122/97
gcugggcccgccagcccagcac

SEQ ID NO: 1100224 - RNA, 19 nt, Mycobacterium bovis subsp bovis AF2122/97
gcugggcccgccgucaccg

SEQ ID NO: 1100225 - RNA, 18 nt, Mycobacterium bovis subsp bovis AF2122/97
gcugggcccaucgcgacu

SEQ ID NO: 1100226 - RNA, 14 nt, Mycobacterium bovis subsp bovis AF2122/97
gcuggcgccggcca

SEQ ID NO: 1100227 - RNA, 18 nt, Mycobacterium bovis subsp bovis AF2122/97
gcuggcgccggccagcca

SEQ ID NO: 1100228 - RNA, 15 nt, Mycobacterium bovis subsp bovis AF2122/97
gcuggcgggcggcgu

SEQ ID NO: 1100229 - RNA, 16 nt, Mycobacterium bovis subsp bovis AF2122/97
gcuggcgggcgaucgc

SEQ ID NO: 1100230 - RNA, 23 nt, Mycobacterium bovis subsp bovis AF2122/97
gcuggcgggcagcuguucggcca

SEQ ID NO: 1100231 - RNA, 13 nt, Mycobacterium bovis subsp bovis AF2122/97
gcuggcgggcgau

SEQ ID NO: 1100232 - RNA, 22 nt, Mycobacterium bovis subsp bovis AF2122/97
gcuggcggcguggcgccggcca

SEQ ID NO: 1100233 - RNA, 14 nt, Mycobacterium bovis subsp bovis AF2122/97
gcuggcgucaccgc

SEQ ID NO: 1100234 - RNA, 14 nt, Mycobacterium bovis subsp bovis AF2122/97
gcuggcggguuggu

SEQ ID NO: 1100235 - RNA, 19 nt, Mycobacterium bovis subsp bovis AF2122/97
gcuggcggguuggucccga

SEQ ID NO: 1100236 - RNA, 16 nt, Mycobacterium bovis subsp bovis AF2122/97
gcuggcgguguagccg

SEQ ID NO: 1100237 - RNA, 24 nt, Mycobacterium bovis subsp bovis AF2122/97
gcuggcauaggaucgcgcccaccg

SEQ ID NO: 1100238 - RNA, 23 nt, Mycobacterium bovis subsp bovis AF2122/97
gcuggcauaucccuugccguccu

SEQ ID NO: 1100239 - RNA, 17 nt, Mycobacterium bovis subsp bovis AF2122/97
gcuggcaucccgggcag

SEQ ID NO: 1100240 - RNA, 14 nt, Mycobacterium bovis subsp bovis AF2122/97
gcuggcaugccggc

SEQ ID NO: 1100241 - RNA, 15 nt, Mycobacterium bovis subsp bovis AF2122/97
gcuggccaacuugac

SEQ ID NO: 1100242 - RNA, 18 nt, Mycobacterium bovis subsp bovis AF2122/97
gcuggccaacuugacccg

SEQ ID NO: 1100243 - RNA, 14 nt, Mycobacterium bovis subsp bovis AF2122/97
gcuggcagacucga

SEQ ID NO: 1100244 - RNA, 15 nt, Mycobacterium bovis subsp bovis AF2122/97
gcuggcaugccggcg

SEQ ID NO: 1100245 - RNA, 18 nt, Mycobacterium bovis subsp bovis AF2122/97
gcuggcaugccggcgugc

SEQ ID NO: 1100246 - RNA, 15 nt, Mycobacterium bovis subsp bovis AF2122/97
gcuggcaacgccgcg

SEQ ID NO: 1100247 - RNA, 21 nt, Mycobacterium bovis subsp bovis AF2122/97
gcuggcaacgccgcgccguuc

SEQ ID NO: 1100248 - RNA, 18 nt, Mycobacterium bovis subsp bovis AF2122/97
gcuggaugucgucgacga

SEQ ID NO: 1100249 - RNA, 21 nt, Mycobacterium bovis subsp bovis AF2122/97
gcuggaugucgucgacgauca

SEQ ID NO: 1100250 - RNA, 20 nt, Mycobacterium bovis subsp bovis AF2122/97
gcuggaugugggcgcucgca

SEQ ID NO: 1100251 - RNA, 23 nt, Mycobacterium bovis subsp bovis AF2122/97
gcuggaucuucgacaggccaccg

SEQ ID NO: 1100252 - RNA, 15 nt, Mycobacterium bovis subsp bovis AF2122/97
gcuggaggcggcgcc

SEQ ID NO: 1100253 - RNA, 15 nt, Mycobacterium bovis subsp bovis AF2122/97
gcuggaucaacccgg

SEQ ID NO: 1100254 - RNA, 21 nt, Mycobacterium bovis subsp bovis AF2122/97
gcuggacggccuccaucgcga

SEQ ID NO: 1100255 - RNA, 16 nt, Mycobacterium bovis subsp bovis AF2122/97
gcuggaagccgucucu

SEQ ID NO: 1100256 - RNA, 18 nt, Mycobacterium bovis subsp bovis AF2122/97
gcuggacuccggucagcg

SEQ ID NO: 1100257 - RNA, 13 nt, Mycobacterium bovis subsp bovis AF2122/97
gcuggacggcggg

SEQ ID NO: 1100258 - RNA, 16 nt, Mycobacterium bovis subsp bovis AF2122/97
gcuggagaucacgccg

SEQ ID NO: 1100259 - RNA, 20 nt, Mycobacterium bovis subsp bovis AF2122/97
gcuggagaucacgccgacga

SEQ ID NO: 1100260 - RNA, 22 nt, Mycobacterium bovis subsp bovis AF2122/97
gcuggacuccggucagcgcggc

SEQ ID NO: 1100261 - RNA, 20 nt, Mycobacterium bovis subsp bovis AF2122/97
gcuggcccgaaucucgcccc

SEQ ID NO: 1100262 - RNA, 21 nt, Mycobacterium bovis subsp bovis AF2122/97
gcuggcccgaaucucgccccc

SEQ ID NO: 1100263 - RNA, 18 nt, Mycobacterium bovis subsp bovis AF2122/97
gcuggcccgcacgaaccg

SEQ ID NO: 1100264 - RNA, 23 nt, Mycobacterium bovis subsp bovis AF2122/97
gcuggcccgcucauaccgggagg

SEQ ID NO: 1100265 - RNA, 19 nt, Mycobacterium bovis subsp bovis AF2122/97
gcuggcccugcuccucgcg

SEQ ID NO: 1100266 - RNA, 20 nt, Mycobacterium bovis subsp bovis AF2122/97
gcuggcccugcuccucgcgg

SEQ ID NO: 1100267 - RNA, 13 nt, Mycobacterium bovis subsp bovis AF2122/97
gcuggccgccacc

SEQ ID NO: 1100268 - RNA, 16 nt, Mycobacterium bovis subsp bovis AF2122/97
gcuggccgccaccgca

SEQ ID NO: 1100269 - RNA, 23 nt, Mycobacterium bovis subsp bovis AF2122/97
gcuggccgccaccgcacgcacgc

SEQ ID NO: 1100270 - RNA, 20 nt, Mycobacterium bovis subsp bovis AF2122/97
gcuggccgaugugggcggag

SEQ ID NO: 1100271 - RNA, 14 nt, Mycobacterium bovis subsp bovis AF2122/97
gcuggccgcggccu

SEQ ID NO: 1100272 - RNA, 13 nt, Mycobacterium bovis subsp bovis AF2122/97
gcuggccgcggcg

SEQ ID NO: 1100273 - RNA, 14 nt, Mycobacterium bovis subsp bovis AF2122/97
gcuggccgcggcga

SEQ ID NO: 1100274 - RNA, 16 nt, Mycobacterium bovis subsp bovis AF2122/97
gcuggccaggccggca

SEQ ID NO: 1100275 - RNA, 12 nt, Mycobacterium bovis subsp bovis AF2122/97
gcuggccagcgc

SEQ ID NO: 1100276 - RNA, 23 nt, Mycobacterium bovis subsp bovis AF2122/97
gcuggccagcacaccgucgacga

SEQ ID NO: 1100277 - RNA, 21 nt, Mycobacterium bovis subsp bovis AF2122/97
gcuggccagguugccgucggc

SEQ ID NO: 1100278 - RNA, 14 nt, Mycobacterium bovis subsp bovis AF2122/97
gcuggcccagcgac

SEQ ID NO: 1100279 - RNA, 19 nt, Mycobacterium bovis subsp bovis AF2122/97
gcuggcccagcgaccagug

SEQ ID NO: 1100280 - RNA, 14 nt, Mycobacterium bovis subsp bovis AF2122/97
gcuggcccaacauc

SEQ ID NO: 1100281 - RNA, 21 nt, Mycobacterium bovis subsp bovis AF2122/97
gcuggcccaauugcgccgagc

SEQ ID NO: 1100282 - RNA, 21 nt, Mycobacterium bovis subsp bovis AF2122/97
gcuggcccaccuccucgccgg

SEQ ID NO: 1100283 - RNA, 16 nt, Mycobacterium bovis subsp bovis AF2122/97
gcuggccagcacgccc

SEQ ID NO: 1100284 - RNA, 21 nt, Mycobacterium bovis subsp bovis AF2122/97
gcuggccacucacauuggcca

SEQ ID NO: 1100285 - RNA, 23 nt, Mycobacterium bovis subsp bovis AF2122/97
gcuggccacucacauuggccagg

SEQ ID NO: 1100286 - RNA, 16 nt, Mycobacterium bovis subsp bovis AF2122/97
gcuggccagcacaccg

SEQ ID NO: 1100287 - RNA, 19 nt, Mycobacterium bovis subsp bovis AF2122/97
gcuggccagcacaccgucg

SEQ ID NO: 1100288 - RNA, 19 nt, Mycobacterium bovis subsp bovis AF2122/97
gcuggccaccgcaucgccg

SEQ ID NO: 1100289 - RNA, 16 nt, Mycobacterium bovis subsp bovis AF2122/97
gcuggccacgauccgc

SEQ ID NO: 1100290 - RNA, 21 nt, Mycobacterium bovis subsp bovis AF2122/97
gcuggccaccgcaucgccgaa

SEQ ID NO: 1100291 - RNA, 16 nt, Mycobacterium bovis subsp bovis AF2122/97
gcugccggagacaccc

SEQ ID NO: 1100292 - RNA, 20 nt, Mycobacterium bovis subsp bovis AF2122/97
gcugccggagacacccgcca

SEQ ID NO: 1100293 - RNA, 15 nt, Mycobacterium bovis subsp bovis AF2122/97
gcugccggcaacagc

SEQ ID NO: 1100294 - RNA, 13 nt, Mycobacterium bovis subsp bovis AF2122/97
gcugccggcacca

SEQ ID NO: 1100295 - RNA, 19 nt, Mycobacterium bovis subsp bovis AF2122/97
gcugccggcaccaaccacc

SEQ ID NO: 1100296 - RNA, 22 nt, Mycobacterium bovis subsp bovis AF2122/97
gcugccggcaccaaccaccgac

SEQ ID NO: 1100297 - RNA, 16 nt, Mycobacterium bovis subsp bovis AF2122/97
gcugccggccagacgg

SEQ ID NO: 1100298 - RNA, 17 nt, Mycobacterium bovis subsp bovis AF2122/97
gcugccggcccaccagg

SEQ ID NO: 1100299 - RNA, 20 nt, Mycobacterium bovis subsp bovis AF2122/97
gcugccgcaaacgcggcguc

SEQ ID NO: 1100300 - RNA, 24 nt, Mycobacterium bovis subsp bovis AF2122/97
gcugccggcagcguccgaaccacc

SEQ ID NO: 1100301 - RNA, 12 nt, Mycobacterium bovis subsp bovis AF2122/97
gcugccgcugcg

SEQ ID NO: 1100302 - RNA, 12 nt, Mycobacterium bovis subsp bovis AF2122/97
gcugcggcuggu

SEQ ID NO: 1100303 - RNA, 19 nt, Mycobacterium bovis subsp bovis AF2122/97
gcugcggguagccgucgau

SEQ ID NO: 1100304 - RNA, 19 nt, Mycobacterium bovis subsp bovis AF2122/97
gcugcggcuuggccaucac

SEQ ID NO: 1100305 - RNA, 15 nt, Mycobacterium bovis subsp bovis AF2122/97
gcugcggguagccgu

SEQ ID NO: 1100306 - RNA, 18 nt, Mycobacterium bovis subsp bovis AF2122/97
gcugcggguagccgucga

SEQ ID NO: 1100307 - RNA, 20 nt, Mycobacterium bovis subsp bovis AF2122/97
gcugcucgugagccccagcg

SEQ ID NO: 1100308 - RNA, 23 nt, Mycobacterium bovis subsp bovis AF2122/97
gcugcucugagcuuggucgccgg

SEQ ID NO: 1100309 - RNA, 20 nt, Mycobacterium bovis subsp bovis AF2122/97
gcugcucuccgucgcgcacg

SEQ ID NO: 1100310 - RNA, 13 nt, Mycobacterium bovis subsp bovis AF2122/97
gcugcucgacggc

SEQ ID NO: 1100311 - RNA, 15 nt, Mycobacterium bovis subsp bovis AF2122/97
gcugcucgccggcca

SEQ ID NO: 1100312 - RNA, 15 nt, Mycobacterium bovis subsp bovis AF2122/97
gcugcucgaucaucg

SEQ ID NO: 1100313 - RNA, 23 nt, Mycobacterium bovis subsp bovis AF2122/97
gcugcgggugggaaacacgugga

SEQ ID NO: 1100314 - RNA, 20 nt, Mycobacterium bovis subsp bovis AF2122/97
gcugcgguaagaaucgaagc

SEQ ID NO: 1100315 - RNA, 20 nt, Mycobacterium bovis subsp bovis AF2122/97
gcugcgguaaucgccaccgc

SEQ ID NO: 1100316 - RNA, 15 nt, Mycobacterium bovis subsp bovis AF2122/97
gcugcggugccggcc

SEQ ID NO: 1100317 - RNA, 23 nt, Mycobacterium bovis subsp bovis AF2122/97
gcugcgguggaaccuggcgauag

SEQ ID NO: 1100318 - RNA, 22 nt, Mycobacterium bovis subsp bovis AF2122/97
gcugcucccgaaaagcgccucg

SEQ ID NO: 1100319 - RNA, 14 nt, Mycobacterium bovis subsp bovis AF2122/97
gcuggaaugcgguc

SEQ ID NO: 1100320 - RNA, 18 nt, Mycobacterium bovis subsp bovis AF2122/97
gcuggaccacucgccggc

SEQ ID NO: 1100321 - RNA, 19 nt, Mycobacterium bovis subsp bovis AF2122/97
gcuggaccacucgccggcg

SEQ ID NO: 1100322 - RNA, 20 nt, Mycobacterium bovis subsp bovis AF2122/97
gcuggaccacucgccggcgg

SEQ ID NO: 1100323 - RNA, 24 nt, Mycobacterium bovis subsp bovis AF2122/97
gcuggaccacucgccggcggacgc

SEQ ID NO: 1100324 - RNA, 19 nt, Mycobacterium bovis subsp bovis AF2122/97
gcuggacccgcauggcgcg

SEQ ID NO: 1100325 - RNA, 21 nt, Mycobacterium bovis subsp bovis AF2122/97
gcuggacccgcauggcgcggg

SEQ ID NO: 1100326 - RNA, 18 nt, Mycobacterium bovis subsp bovis AF2122/97
gcuggaacuuggcgucga

SEQ ID NO: 1100327 - RNA, 19 nt, Mycobacterium bovis subsp bovis AF2122/97
gcuggaagcggcgacuacc

SEQ ID NO: 1100328 - RNA, 20 nt, Mycobacterium bovis subsp bovis AF2122/97
gcuggaacuuggcgucgaca

SEQ ID NO: 1100329 - RNA, 13 nt, Mycobacterium bovis subsp bovis AF2122/97
gcugcuggugacg

SEQ ID NO: 1100330 - RNA, 23 nt, Mycobacterium bovis subsp bovis AF2122/97
gcugcugucgauuucgccgucgc

SEQ ID NO: 1100331 - RNA, 21 nt, Mycobacterium bovis subsp bovis AF2122/97
gcugcuuggucgcccagccac

SEQ ID NO: 1100332 - RNA, 23 nt, Mycobacterium bovis subsp bovis AF2122/97
gcugcuugcgcccggccugcugg

SEQ ID NO: 1100333 - RNA, 23 nt, Mycobacterium bovis subsp bovis AF2122/97
gcugcagguccaggguggucguc

SEQ ID NO: 1100334 - RNA, 13 nt, Mycobacterium bovis subsp bovis AF2122/97
gcugcagaggcgc

SEQ ID NO: 1100335 - RNA, 19 nt, Mycobacterium bovis subsp bovis AF2122/97
gcugcagugguaccggcgc

SEQ ID NO: 1100336 - RNA, 21 nt, Mycobacterium bovis subsp bovis AF2122/97
gcugcagugguaccggcgccg

SEQ ID NO: 1100337 - RNA, 15 nt, Mycobacterium bovis subsp bovis AF2122/97
gcugcagugacucga

SEQ ID NO: 1100338 - RNA, 16 nt, Mycobacterium bovis subsp bovis AF2122/97
gcugcagugacucgau

SEQ ID NO: 1100339 - RNA, 22 nt, Mycobacterium bovis subsp bovis AF2122/97
gcugcauccuccucgucgacgu

SEQ ID NO: 1100340 - RNA, 14 nt, Mycobacterium bovis subsp bovis AF2122/97
gcugccaacgggcc

SEQ ID NO: 1100341 - RNA, 13 nt, Mycobacterium bovis subsp bovis AF2122/97
gcugccaccgcgg

SEQ ID NO: 1100342 - RNA, 14 nt, Mycobacterium bovis subsp bovis AF2122/97
gcugccaccgcggu

SEQ ID NO: 1100343 - RNA, 11 nt, Mycobacterium bovis subsp bovis AF2122/97
gcugccaccgg

SEQ ID NO: 1100344 - RNA, 13 nt, Mycobacterium bovis subsp bovis AF2122/97
gcugccaccggcc

SEQ ID NO: 1100345 - RNA, 14 nt, Mycobacterium bovis subsp bovis AF2122/97
gcugccacgaacgc

SEQ ID NO: 1100346 - RNA, 14 nt, Mycobacterium bovis subsp bovis AF2122/97
gcugcaccggguca

SEQ ID NO: 1100347 - RNA, 16 nt, Mycobacterium bovis subsp bovis AF2122/97
gcugcaaccgacuucg

SEQ ID NO: 1100348 - RNA, 15 nt, Mycobacterium bovis subsp bovis AF2122/97
gcugcaccguuuccg

SEQ ID NO: 1100349 - RNA, 21 nt, Mycobacterium bovis subsp bovis AF2122/97
gcugcaccgauucgggcuucu

SEQ ID NO: 1100350 - RNA, 18 nt, Mycobacterium bovis subsp bovis AF2122/97
gcugcaacgauugaacuc

SEQ ID NO: 1100351 - RNA, 19 nt, Mycobacterium bovis subsp bovis AF2122/97
gcugcacgacaucgucgcg

SEQ ID NO: 1100352 - RNA, 18 nt, Mycobacterium bovis subsp bovis AF2122/97
gcugcaccuccgacggcc

SEQ ID NO: 1100353 - RNA, 17 nt, Mycobacterium bovis subsp bovis AF2122/97
gcugcacgcugcggguc

SEQ ID NO: 1100354 - RNA, 14 nt, Mycobacterium bovis subsp bovis AF2122/97
gcugcacggccaug

SEQ ID NO: 1100355 - RNA, 15 nt, Mycobacterium bovis subsp bovis AF2122/97
gcugcacgcucugcg

SEQ ID NO: 1100356 - RNA, 18 nt, Mycobacterium bovis subsp bovis AF2122/97
gcugcagcugcucgucgu

SEQ ID NO: 1100357 - RNA, 16 nt, Mycobacterium bovis subsp bovis AF2122/97
gcugcacguggccacg

SEQ ID NO: 1100358 - RNA, 19 nt, Mycobacterium bovis subsp bovis AF2122/97
gcugcagaaaggccaacug

SEQ ID NO: 1100359 - RNA, 13 nt, Mycobacterium bovis subsp bovis AF2122/97
gcugcagacccgu

SEQ ID NO: 1100360 - RNA, 19 nt, Mycobacterium bovis subsp bovis AF2122/97
gcugcagacccguucgccg

SEQ ID NO: 1100361 - RNA, 21 nt, Mycobacterium bovis subsp bovis AF2122/97
gcugcagacccguucgccguc

SEQ ID NO: 1100362 - RNA, 22 nt, Mycobacterium bovis subsp bovis AF2122/97
gcugcccgccagcgccgccgcg

SEQ ID NO: 1100363 - RNA, 20 nt, Mycobacterium bovis subsp bovis AF2122/97
gcugcccgggcugccgccca

SEQ ID NO: 1100364 - RNA, 21 nt, Mycobacterium bovis subsp bovis AF2122/97
gcugcccguucugcccaggca

SEQ ID NO: 1100365 - RNA, 18 nt, Mycobacterium bovis subsp bovis AF2122/97
gcugccgaagcggccacc

SEQ ID NO: 1100366 - RNA, 19 nt, Mycobacterium bovis subsp bovis AF2122/97
gcugccgaagcggccaccg

SEQ ID NO: 1100367 - RNA, 19 nt, Mycobacterium bovis subsp bovis AF2122/97
gcugccgaacaguucggcg

SEQ ID NO: 1100368 - RNA, 15 nt, Mycobacterium bovis subsp bovis AF2122/97
gcugcccugguuggu

SEQ ID NO: 1100369 - RNA, 19 nt, Mycobacterium bovis subsp bovis AF2122/97
gcugcccugguuggugacg

SEQ ID NO: 1100370 - RNA, 23 nt, Mycobacterium bovis subsp bovis AF2122/97
gcugccgaccuuccguuggcggc

SEQ ID NO: 1100371 - RNA, 13 nt, Mycobacterium bovis subsp bovis AF2122/97
gcugccgaaguug

SEQ ID NO: 1100372 - RNA, 14 nt, Mycobacterium bovis subsp bovis AF2122/97
gcugccgaucaguc

SEQ ID NO: 1100373 - RNA, 18 nt, Mycobacterium bovis subsp bovis AF2122/97
gcugccgagaucccagcg

SEQ ID NO: 1100374 - RNA, 17 nt, Mycobacterium bovis subsp bovis AF2122/97
gcugccgauagcgcggc

SEQ ID NO: 1100375 - RNA, 14 nt, Mycobacterium bovis subsp bovis AF2122/97
gcugccgcgcggcg

SEQ ID NO: 1100376 - RNA, 14 nt, Mycobacterium bovis subsp bovis AF2122/97
gcugccgcggccgg

SEQ ID NO: 1100377 - RNA, 17 nt, Mycobacterium bovis subsp bovis AF2122/97
gcugccgcggccggcgu

SEQ ID NO: 1100378 - RNA, 13 nt, Mycobacterium bovis subsp bovis AF2122/97
gcugcccgccgcc

SEQ ID NO: 1100379 - RNA, 17 nt, Mycobacterium bovis subsp bovis AF2122/97
gcugcccgggcugccgc

SEQ ID NO: 1100380 - RNA, 19 nt, Mycobacterium bovis subsp bovis AF2122/97
gcugcccgcggacgugccg

SEQ ID NO: 1100381 - RNA, 21 nt, Mycobacterium bovis subsp bovis AF2122/97
gcugcccgcggacgugccggu

SEQ ID NO: 1100382 - RNA, 18 nt, Mycobacterium bovis subsp bovis AF2122/97
gcugccagaucggucggc

SEQ ID NO: 1100383 - RNA, 13 nt, Mycobacterium bovis subsp bovis AF2122/97
gcugcccgacacc

SEQ ID NO: 1100384 - RNA, 15 nt, Mycobacterium bovis subsp bovis AF2122/97
gcugcccgacacccg

SEQ ID NO: 1100385 - RNA, 17 nt, Mycobacterium bovis subsp bovis AF2122/97
gcugcccgacacccgca

SEQ ID NO: 1100386 - RNA, 14 nt, Mycobacterium bovis subsp bovis AF2122/97
gcugccccgccacc

SEQ ID NO: 1100387 - RNA, 21 nt, Mycobacterium bovis subsp bovis AF2122/97
gcugccccgccaccucgccgg

SEQ ID NO: 1100388 - RNA, 15 nt, Mycobacterium bovis subsp bovis AF2122/97
gcugccccgccgcca

SEQ ID NO: 1100389 - RNA, 16 nt, Mycobacterium bovis subsp bovis AF2122/97
gcugccagcgccgccg

SEQ ID NO: 1100390 - RNA, 12 nt, Mycobacterium bovis subsp bovis AF2122/97
gcugccagcggc

SEQ ID NO: 1100391 - RNA, 15 nt, Mycobacterium bovis subsp bovis AF2122/97
gcugccagcggccgg

SEQ ID NO: 1100392 - RNA, 17 nt, Mycobacterium bovis subsp bovis AF2122/97
gcugccagcggccgggc

SEQ ID NO: 1100393 - RNA, 16 nt, Mycobacterium bovis subsp bovis AF2122/97
gcugaagccgucguau

SEQ ID NO: 1100394 - RNA, 23 nt, Mycobacterium bovis subsp bovis AF2122/97
gcugaagccaaaugcgcugucgc

SEQ ID NO: 1100395 - RNA, 22 nt, Mycobacterium bovis subsp bovis AF2122/97
gcugaaggcccguugucgaccg

SEQ ID NO: 1100396 - RNA, 14 nt, Mycobacterium bovis subsp bovis AF2122/97
gcugaacucaacgg

SEQ ID NO: 1100397 - RNA, 20 nt, Mycobacterium bovis subsp bovis AF2122/97
gcugaaaauaggccgggcag

SEQ ID NO: 1100398 - RNA, 15 nt, Mycobacterium bovis subsp bovis AF2122/97
gcugacgccgagcug

SEQ ID NO: 1100399 - RNA, 15 nt, Mycobacterium bovis subsp bovis AF2122/97
gcugacuccugcggc

SEQ ID NO: 1100400 - RNA, 23 nt, Mycobacterium bovis subsp bovis AF2122/97
gcugacgguucggucggggagcu

SEQ ID NO: 1100401 - RNA, 17 nt, Mycobacterium bovis subsp bovis AF2122/97
gcugaucccggccaggc

SEQ ID NO: 1100402 - RNA, 19 nt, Mycobacterium bovis subsp bovis AF2122/97
gcugauccggguggcguca

SEQ ID NO: 1100403 - RNA, 22 nt, Mycobacterium bovis subsp bovis AF2122/97
gcugauccacgauaucgaugcg

SEQ ID NO: 1100404 - RNA, 21 nt, Mycobacterium bovis subsp bovis AF2122/97
gcugagcuggcagcuccucgc

SEQ ID NO: 1100405 - RNA, 16 nt, Mycobacterium bovis subsp bovis AF2122/97
gcugaggaacgccggc

SEQ ID NO: 1100406 - RNA, 17 nt, Mycobacterium bovis subsp bovis AF2122/97
gcugaggaacgccggca

SEQ ID NO: 1100407 - RNA, 22 nt, Mycobacterium bovis subsp bovis AF2122/97
gcugaggaacgccggcaucgcg

SEQ ID NO: 1100408 - RNA, 15 nt, Mycobacterium bovis subsp bovis AF2122/97
gcugaggaacgccgg

SEQ ID NO: 1100409 - RNA, 14 nt, Mycobacterium bovis subsp bovis AF2122/97
gcugagcugcucgc

SEQ ID NO: 1100410 - RNA, 22 nt, Mycobacterium bovis subsp bovis AF2122/97
gcugagcugcucgccggccaac

SEQ ID NO: 1100411 - RNA, 23 nt, Mycobacterium bovis subsp bovis AF2122/97
gcugagcucgaugucagcggccg

SEQ ID NO: 1100412 - RNA, 19 nt, Mycobacterium bovis subsp bovis AF2122/97
gcugagcucgaugucagcg

SEQ ID NO: 1100413 - RNA, 16 nt, Mycobacterium bovis subsp bovis AF2122/97
gcugagccgcucaucg

SEQ ID NO: 1100414 - RNA, 19 nt, Mycobacterium bovis subsp bovis AF2122/97
gcugagcgccaggccgcac

SEQ ID NO: 1100415 - RNA, 16 nt, Mycobacterium bovis subsp bovis AF2122/97
gcugagcggccggcau

SEQ ID NO: 1100416 - RNA, 19 nt, Mycobacterium bovis subsp bovis AF2122/97
gcugaucgguccggcgaac

SEQ ID NO: 1100417 - RNA, 20 nt, Mycobacterium bovis subsp bovis AF2122/97
gcugaucgguccggcgaacu

SEQ ID NO: 1100418 - RNA, 18 nt, Mycobacterium bovis subsp bovis AF2122/97
gcugaucgagcggguguc

SEQ ID NO: 1100419 - RNA, 21 nt, Mycobacterium bovis subsp bovis AF2122/97
gcugauccggguggcgucacc

SEQ ID NO: 1100420 - RNA, 18 nt, Mycobacterium bovis subsp bovis AF2122/97
gcugaucgcgcgcaccgg

SEQ ID NO: 1100421 - RNA, 15 nt, Mycobacterium bovis subsp bovis AF2122/97
gcugcaaccagcggc

SEQ ID NO: 1100422 - RNA, 14 nt, Mycobacterium bovis subsp bovis AF2122/97
gcugauugcgaccg

SEQ ID NO: 1100423 - RNA, 17 nt, Mycobacterium bovis subsp bovis AF2122/97
gcugauuaccgacaccg

SEQ ID NO: 1100424 - RNA, 16 nt, Mycobacterium bovis subsp bovis AF2122/97
gcugauugcggucguc

SEQ ID NO: 1100425 - RNA, 15 nt, Mycobacterium bovis subsp bovis AF2122/97
gcugauuggcccacc

SEQ ID NO: 1100426 - RNA, 22 nt, Mycobacterium bovis subsp bovis AF2122/97
gcugauuggcccaccgccguug

SEQ ID NO: 1100427 - RNA, 20 nt, Mycobacterium bovis subsp bovis AF2122/97
gcugauuguguuccaccagc

SEQ ID NO: 1100428 - RNA, 23 nt, Mycobacterium bovis subsp bovis AF2122/97
gcucguccggguuuugcgcggcc

SEQ ID NO: 1100429 - RNA, 21 nt, Mycobacterium bovis subsp bovis AF2122/97
gcucguccggugcgaucccac

SEQ ID NO: 1100430 - RNA, 14 nt, Mycobacterium bovis subsp bovis AF2122/97
gcucguccucgucu

SEQ ID NO: 1100431 - RNA, 13 nt, Mycobacterium bovis subsp bovis AF2122/97
gcucgucgagccg

SEQ ID NO: 1100432 - RNA, 21 nt, Mycobacterium bovis subsp bovis AF2122/97
gcucguccucgucuucgucgg

SEQ ID NO: 1100433 - RNA, 19 nt, Mycobacterium bovis subsp bovis AF2122/97
gcucgucgagccgaccgcg

SEQ ID NO: 1100434 - RNA, 14 nt, Mycobacterium bovis subsp bovis AF2122/97
gcucgucgcggccc

SEQ ID NO: 1100435 - RNA, 17 nt, Mycobacterium bovis subsp bovis AF2122/97
gcucgucgaguggauca

SEQ ID NO: 1100436 - RNA, 13 nt, Mycobacterium bovis subsp bovis AF2122/97
gcucgucgauccc

SEQ ID NO: 1100437 - RNA, 20 nt, Mycobacterium bovis subsp bovis AF2122/97
gcucguccaccccgauccgc

SEQ ID NO: 1100438 - RNA, 17 nt, Mycobacterium bovis subsp bovis AF2122/97
gcucguccaggucggcc

SEQ ID NO: 1100439 - RNA, 19 nt, Mycobacterium bovis subsp bovis AF2122/97
gcucguccaggucggccgc

SEQ ID NO: 1100440 - RNA, 20 nt, Mycobacterium bovis subsp bovis AF2122/97
gcucguccaggucggccgcc

SEQ ID NO: 1100441 - RNA, 17 nt, Mycobacterium bovis subsp bovis AF2122/97
gcucgguuagcccgauc

SEQ ID NO: 1100442 - RNA, 16 nt, Mycobacterium bovis subsp bovis AF2122/97
gcucggugagccucuu

SEQ ID NO: 1100443 - RNA, 15 nt, Mycobacterium bovis subsp bovis AF2122/97
gcucggugcugcgcc

SEQ ID NO: 1100444 - RNA, 19 nt, Mycobacterium bovis subsp bovis AF2122/97
gcucggugcugcgccgaua

SEQ ID NO: 1100445 - RNA, 21 nt, Mycobacterium bovis subsp bovis AF2122/97
gcucggugcgccagaucaccg

SEQ ID NO: 1100446 - RNA, 22 nt, Mycobacterium bovis subsp bovis AF2122/97
gcucggugcuguugcgcggucg

SEQ ID NO: 1100447 - RNA, 19 nt, Mycobacterium bovis subsp bovis AF2122/97
gcucgguggcgccggggcg

SEQ ID NO: 1100448 - RNA, 21 nt, Mycobacterium bovis subsp bovis AF2122/97
gcucguaaccuucgaccucca

SEQ ID NO: 1100449 - RNA, 20 nt, Mycobacterium bovis subsp bovis AF2122/97
gcucguagaaucggcucagc

SEQ ID NO: 1100450 - RNA, 21 nt, Mycobacterium bovis subsp bovis AF2122/97
gcucguagacuugcugcuccu

SEQ ID NO: 1100451 - RNA, 14 nt, Mycobacterium bovis subsp bovis AF2122/97
gcucggugaccccc

SEQ ID NO: 1100452 - RNA, 14 nt, Mycobacterium bovis subsp bovis AF2122/97
gcucggugacguag

SEQ ID NO: 1100453 - RNA, 15 nt, Mycobacterium bovis subsp bovis AF2122/97
gcucggugacguaga

SEQ ID NO: 1100454 - RNA, 15 nt, Mycobacterium bovis subsp bovis AF2122/97
gcucggugcacggcg

SEQ ID NO: 1100455 - RNA, 19 nt, Mycobacterium bovis subsp bovis AF2122/97
gcucggugaugcccagcgc

SEQ ID NO: 1100456 - RNA, 22 nt, Mycobacterium bovis subsp bovis AF2122/97
gcucggugaugcccagcgccga

SEQ ID NO: 1100457 - RNA, 18 nt, Mycobacterium bovis subsp bovis AF2122/97
gcucggugaugcccagcg

SEQ ID NO: 1100458 - RNA, 17 nt, Mycobacterium bovis subsp bovis AF2122/97
gcucggucuccaccacc

SEQ ID NO: 1100459 - RNA, 14 nt, Mycobacterium bovis subsp bovis AF2122/97
gcucggucgccacc

SEQ ID NO: 1100460 - RNA, 16 nt, Mycobacterium bovis subsp bovis AF2122/97
gcucggucgccaccgc

SEQ ID NO: 1100461 - RNA, 15 nt, Mycobacterium bovis subsp bovis AF2122/97
gcucggucaggcggc

SEQ ID NO: 1100462 - RNA, 23 nt, Mycobacterium bovis subsp bovis AF2122/97
gcucgucggcgauggccagcacg

SEQ ID NO: 1100463 - RNA, 20 nt, Mycobacterium bovis subsp bovis AF2122/97
gcucgucggcgccggcggcc

SEQ ID NO: 1100464 - RNA, 22 nt, Mycobacterium bovis subsp bovis AF2122/97
gcucgucggcgccggcggccgc

SEQ ID NO: 1100465 - RNA, 14 nt, Mycobacterium bovis subsp bovis AF2122/97
gcucgucggccacc

SEQ ID NO: 1100466 - RNA, 20 nt, Mycobacterium bovis subsp bovis AF2122/97
gcucgucggccaccgcggcg

SEQ ID NO: 1100467 - RNA, 13 nt, Mycobacterium bovis subsp bovis AF2122/97
gcucucggcgaau

SEQ ID NO: 1100468 - RNA, 11 nt, Mycobacterium bovis subsp bovis AF2122/97
gcucucggcgu

SEQ ID NO: 1100469 - RNA, 13 nt, Mycobacterium bovis subsp bovis AF2122/97
gcucucggcgucg

SEQ ID NO: 1100470 - RNA, 16 nt, Mycobacterium bovis subsp bovis AF2122/97
gcucucggucaguucc

SEQ ID NO: 1100471 - RNA, 18 nt, Mycobacterium bovis subsp bovis AF2122/97
gcucucggugguccagcg

SEQ ID NO: 1100472 - RNA, 21 nt, Mycobacterium bovis subsp bovis AF2122/97
gcucucuucgcgcgcugggcg

SEQ ID NO: 1100473 - RNA, 18 nt, Mycobacterium bovis subsp bovis AF2122/97
gcucugaggucaccggcg

SEQ ID NO: 1100474 - RNA, 15 nt, Mycobacterium bovis subsp bovis AF2122/97
gcucugcggccacgc

SEQ ID NO: 1100475 - RNA, 14 nt, Mycobacterium bovis subsp bovis AF2122/97
gcucugcgccacag

SEQ ID NO: 1100476 - RNA, 17 nt, Mycobacterium bovis subsp bovis AF2122/97
gcucuggacggucaucc

SEQ ID NO: 1100477 - RNA, 14 nt, Mycobacterium bovis subsp bovis AF2122/97
gcucuucggcacca

SEQ ID NO: 1100478 - RNA, 20 nt, Mycobacterium bovis subsp bovis AF2122/97
gcucuucgcagcgguggucg

SEQ ID NO: 1100479 - RNA, 23 nt, Mycobacterium bovis subsp bovis AF2122/97
gcucggcuucccuaggcuccaac

SEQ ID NO: 1100480 - RNA, 18 nt, Mycobacterium bovis subsp bovis AF2122/97
gcucgggcaaggccaccg

SEQ ID NO: 1100481 - RNA, 22 nt, Mycobacterium bovis subsp bovis AF2122/97
gcucgggcaaggccaccggcgg

SEQ ID NO: 1100482 - RNA, 17 nt, Mycobacterium bovis subsp bovis AF2122/97
gcucgggcgcacggucc

SEQ ID NO: 1100483 - RNA, 18 nt, Mycobacterium bovis subsp bovis AF2122/97
gcucgggaacuucgccga

SEQ ID NO: 1100484 - RNA, 16 nt, Mycobacterium bovis subsp bovis AF2122/97
gcucgggcgugauccc

SEQ ID NO: 1100485 - RNA, 18 nt, Mycobacterium bovis subsp bovis AF2122/97
gcucgggcgugaucccgc

SEQ ID NO: 1100486 - RNA, 14 nt, Mycobacterium bovis subsp bovis AF2122/97
gcucgggcugccgc

SEQ ID NO: 1100487 - RNA, 21 nt, Mycobacterium bovis subsp bovis AF2122/97
gcucgggaacuucgccgaagc

SEQ ID NO: 1100488 - RNA, 17 nt, Mycobacterium bovis subsp bovis AF2122/97
gcucgggggcgccggcg

SEQ ID NO: 1100489 - RNA, 22 nt, Mycobacterium bovis subsp bovis AF2122/97
gcucgggguugcucgcgaucgc

SEQ ID NO: 1100490 - RNA, 15 nt, Mycobacterium bovis subsp bovis AF2122/97
gcucgggggccgacc

SEQ ID NO: 1100491 - RNA, 19 nt, Mycobacterium bovis subsp bovis AF2122/97
gcucggucaacgcuucggc

SEQ ID NO: 1100492 - RNA, 18 nt, Mycobacterium bovis subsp bovis AF2122/97
gcucggucaccacggcgg

SEQ ID NO: 1100493 - RNA, 20 nt, Mycobacterium bovis subsp bovis AF2122/97
gcucgguaagugccucgcgg

SEQ ID NO: 1100494 - RNA, 21 nt, Mycobacterium bovis subsp bovis AF2122/97
gcucgguaccaaagcugucga

SEQ ID NO: 1100495 - RNA, 16 nt, Mycobacterium bovis subsp bovis AF2122/97
gcucgguaggccggca

SEQ ID NO: 1100496 - RNA, 19 nt, Mycobacterium bovis subsp bovis AF2122/97
gcucgguaggccggcaaga

SEQ ID NO: 1100497 - RNA, 20 nt, Mycobacterium bovis subsp bovis AF2122/97
gcucggcguccgcccagcac

SEQ ID NO: 1100498 - RNA, 21 nt, Mycobacterium bovis subsp bovis AF2122/97
gcucggcguccgcccagcacc

SEQ ID NO: 1100499 - RNA, 14 nt, Mycobacterium bovis subsp bovis AF2122/97
gcucggcgugucgg

SEQ ID NO: 1100500 - RNA, 15 nt, Mycobacterium bovis subsp bovis AF2122/97
gcucggcgucgccgc

SEQ ID NO: 1100501 - RNA, 18 nt, Mycobacterium bovis subsp bovis AF2122/97
gcucggcguccgcccagc

SEQ ID NO: 1100502 - RNA, 15 nt, Mycobacterium bovis subsp bovis AF2122/97
gcucggcgggcucgu

SEQ ID NO: 1100503 - RNA, 14 nt, Mycobacterium bovis subsp bovis AF2122/97
gcucggcggcccgg

SEQ ID NO: 1100504 - RNA, 15 nt, Mycobacterium bovis subsp bovis AF2122/97
gcucggcggcccggc

SEQ ID NO: 1100505 - RNA, 18 nt, Mycobacterium bovis subsp bovis AF2122/97
gcucggcggcccggccga

SEQ ID NO: 1100506 - RNA, 19 nt, Mycobacterium bovis subsp bovis AF2122/97
gcucggcggcccggccgaa

SEQ ID NO: 1100507 - RNA, 15 nt, Mycobacterium bovis subsp bovis AF2122/97
gcucggcggcagcgg

SEQ ID NO: 1100508 - RNA, 17 nt, Mycobacterium bovis subsp bovis AF2122/97
gcucggcggcagcggcg

SEQ ID NO: 1100509 - RNA, 13 nt, Mycobacterium bovis subsp bovis AF2122/97
gcucggccgccgg

SEQ ID NO: 1100510 - RNA, 14 nt, Mycobacterium bovis subsp bovis AF2122/97
gcucggccgcagcc

SEQ ID NO: 1100511 - RNA, 13 nt, Mycobacterium bovis subsp bovis AF2122/97
gcucggccaccag

SEQ ID NO: 1100512 - RNA, 15 nt, Mycobacterium bovis subsp bovis AF2122/97
gcucggccaccagcg

SEQ ID NO: 1100513 - RNA, 18 nt, Mycobacterium bovis subsp bovis AF2122/97
gcucggcccuguucggcc

SEQ ID NO: 1100514 - RNA, 17 nt, Mycobacterium bovis subsp bovis AF2122/97
gcucggccuguucggcg

SEQ ID NO: 1100515 - RNA, 21 nt, Mycobacterium bovis subsp bovis AF2122/97
gcucggcgaccgucgggguca

SEQ ID NO: 1100516 - RNA, 16 nt, Mycobacterium bovis subsp bovis AF2122/97
gcucggcgaaacccgg

SEQ ID NO: 1100517 - RNA, 20 nt, Mycobacterium bovis subsp bovis AF2122/97
gcucggcgagcucagugacc

SEQ ID NO: 1100518 - RNA, 17 nt, Mycobacterium bovis subsp bovis AF2122/97
gcucggcacccgccgga

SEQ ID NO: 1100519 - RNA, 21 nt, Mycobacterium bovis subsp bovis AF2122/97
gcucggcaucgagcagcccgg

SEQ ID NO: 1100520 - RNA, 16 nt, Mycobacterium bovis subsp bovis AF2122/97
gcucggcaucggaagu

SEQ ID NO: 1100521 - RNA, 19 nt, Mycobacterium bovis subsp bovis AF2122/97
gcucggcaugagucgaacc

SEQ ID NO: 1100522 - RNA, 13 nt, Mycobacterium bovis subsp bovis AF2122/97
gcucggaucggcu

SEQ ID NO: 1100523 - RNA, 13 nt, Mycobacterium bovis subsp bovis AF2122/97
gcucggaucgguu

SEQ ID NO: 1100524 - RNA, 17 nt, Mycobacterium bovis subsp bovis AF2122/97
gcuccaggcgcgccgca

SEQ ID NO: 1100525 - RNA, 18 nt, Mycobacterium bovis subsp bovis AF2122/97
ggauggccgccaggcgcu

SEQ ID NO: 1100526 - RNA, 13 nt, Mycobacterium bovis subsp bovis AF2122/97
ggauggccgccga

SEQ ID NO: 1100527 - RNA, 16 nt, Mycobacterium bovis subsp bovis AF2122/97
ggauggcgcccugcgc

SEQ ID NO: 1100528 - RNA, 17 nt, Mycobacterium bovis subsp bovis AF2122/97
ggauggcucacccaggc

SEQ ID NO: 1100529 - RNA, 15 nt, Mycobacterium bovis subsp bovis AF2122/97
ggauggcuggccagc

SEQ ID NO: 1100530 - RNA, 17 nt, Mycobacterium bovis subsp bovis AF2122/97
ggaugcugucagcagcc

SEQ ID NO: 1100531 - RNA, 13 nt, Mycobacterium bovis subsp bovis AF2122/97
ggaugcgauggcc

SEQ ID NO: 1100532 - RNA, 17 nt, Mycobacterium bovis subsp bovis AF2122/97
ggaugcgccgcacggcg

SEQ ID NO: 1100533 - RNA, 12 nt, Mycobacterium bovis subsp bovis AF2122/97
ggaugcggucga

SEQ ID NO: 1100534 - RNA, 19 nt, Mycobacterium bovis subsp bovis AF2122/97
ggaugccggucggcgucga

SEQ ID NO: 1100535 - RNA, 19 nt, Mycobacterium bovis subsp bovis AF2122/97
ggaugccuaccgugcuggc

SEQ ID NO: 1100536 - RNA, 14 nt, Mycobacterium bovis subsp bovis AF2122/97
ggaugccgacggcg

SEQ ID NO: 1100537 - RNA, 13 nt, Mycobacterium bovis subsp bovis AF2122/97
ggaugcgcggcgg

SEQ ID NO: 1100538 - RNA, 13 nt, Mycobacterium bovis subsp bovis AF2122/97
ggaugcgcgcccg

SEQ ID NO: 1100539 - RNA, 19 nt, Mycobacterium bovis subsp bovis AF2122/97
ggaugcccguagacgccga

SEQ ID NO: 1100540 - RNA, 20 nt, Mycobacterium bovis subsp bovis AF2122/97
ggaugcccguagacgccgag

SEQ ID NO: 1100541 - RNA, 20 nt, Mycobacterium bovis subsp bovis AF2122/97
ggaugcagcugcccggcgug

SEQ ID NO: 1100542 - RNA, 22 nt, Mycobacterium bovis subsp bovis AF2122/97
ggaucugagcuagccguucggc

SEQ ID NO: 1100543 - RNA, 15 nt, Mycobacterium bovis subsp bovis AF2122/97
ggaucucgagccgcg

SEQ ID NO: 1100544 - RNA, 23 nt, Mycobacterium bovis subsp bovis AF2122/97
ggaucgucguugucagcgaacgg

SEQ ID NO: 1100545 - RNA, 17 nt, Mycobacterium bovis subsp bovis AF2122/97
ggaucgucucgcgcacc

SEQ ID NO: 1100546 - RNA, 14 nt, Mycobacterium bovis subsp bovis AF2122/97
ggaucgugccggcg

SEQ ID NO: 1100547 - RNA, 23 nt, Mycobacterium bovis subsp bovis AF2122/97
ggaucguucgcgugccagcgccc

SEQ ID NO: 1100548 - RNA, 18 nt, Mycobacterium bovis subsp bovis AF2122/97
ggaucgcugccagcggcc

SEQ ID NO: 1100549 - RNA, 15 nt, Mycobacterium bovis subsp bovis AF2122/97
ggaucggcugcgcgc

SEQ ID NO: 1100550 - RNA, 22 nt, Mycobacterium bovis subsp bovis AF2122/97
ggaucggcuaccuaacccgcac

SEQ ID NO: 1100551 - RNA, 16 nt, Mycobacterium bovis subsp bovis AF2122/97
ggaucggcuccgccgc

SEQ ID NO: 1100552 - RNA, 17 nt, Mycobacterium bovis subsp bovis AF2122/97
ggaucggcuccgccgcg

SEQ ID NO: 1100553 - RNA, 20 nt, Mycobacterium bovis subsp bovis AF2122/97
ggaucggcuccgccgcgggc

SEQ ID NO: 1100554 - RNA, 23 nt, Mycobacterium bovis subsp bovis AF2122/97
ggaucgucaggcccauggcagcc

SEQ ID NO: 1100555 - RNA, 14 nt, Mycobacterium bovis subsp bovis AF2122/97
ggaucguccggccg

SEQ ID NO: 1100556 - RNA, 18 nt, Mycobacterium bovis subsp bovis AF2122/97
ggaucgguuccggccccg

SEQ ID NO: 1100557 - RNA, 18 nt, Mycobacterium bovis subsp bovis AF2122/97
ggaugaccuuggccgugc

SEQ ID NO: 1100558 - RNA, 23 nt, Mycobacterium bovis subsp bovis AF2122/97
ggaugaccuuggccgugcccgaa

SEQ ID NO: 1100559 - RNA, 22 nt, Mycobacterium bovis subsp bovis AF2122/97
ggaugaccuucccgucgacgag

SEQ ID NO: 1100560 - RNA, 20 nt, Mycobacterium bovis subsp bovis AF2122/97
ggaugaccagugaucagcgc

SEQ ID NO: 1100561 - RNA, 15 nt, Mycobacterium bovis subsp bovis AF2122/97
ggaugaccaccgguu

SEQ ID NO: 1100562 - RNA, 14 nt, Mycobacterium bovis subsp bovis AF2122/97
ggaugcagcugccc

SEQ ID NO: 1100563 - RNA, 18 nt, Mycobacterium bovis subsp bovis AF2122/97
ggaucugguccaguggga

SEQ ID NO: 1100564 - RNA, 14 nt, Mycobacterium bovis subsp bovis AF2122/97
ggaucugcgccgcg

SEQ ID NO: 1100565 - RNA, 15 nt, Mycobacterium bovis subsp bovis AF2122/97
ggaucugcgccgcgc

SEQ ID NO: 1100566 - RNA, 21 nt, Mycobacterium bovis subsp bovis AF2122/97
ggaucugcgccgcgcgcggcg

SEQ ID NO: 1100567 - RNA, 21 nt, Mycobacterium bovis subsp bovis AF2122/97
ggaucugcggaggcgaccccg

SEQ ID NO: 1100568 - RNA, 22 nt, Mycobacterium bovis subsp bovis AF2122/97
ggaugaauucauguggcgcggg

SEQ ID NO: 1100569 - RNA, 15 nt, Mycobacterium bovis subsp bovis AF2122/97
ggaugacaccgaccg

SEQ ID NO: 1100570 - RNA, 14 nt, Mycobacterium bovis subsp bovis AF2122/97
ggaugaaaugacgg

SEQ ID NO: 1100571 - RNA, 18 nt, Mycobacterium bovis subsp bovis AF2122/97
ggaucgccggggacgccg

SEQ ID NO: 1100572 - RNA, 13 nt, Mycobacterium bovis subsp bovis AF2122/97
ggaucgccgucgc

SEQ ID NO: 1100573 - RNA, 16 nt, Mycobacterium bovis subsp bovis AF2122/97
ggaucgccgucggcgg

SEQ ID NO: 1100574 - RNA, 22 nt, Mycobacterium bovis subsp bovis AF2122/97
ggaucgccugagcgccgcggcg

SEQ ID NO: 1100575 - RNA, 14 nt, Mycobacterium bovis subsp bovis AF2122/97
ggaucgcgauggcc

SEQ ID NO: 1100576 - RNA, 14 nt, Mycobacterium bovis subsp bovis AF2122/97
ggaucgcgcagcgc

SEQ ID NO: 1100577 - RNA, 16 nt, Mycobacterium bovis subsp bovis AF2122/97
ggaucgcgcagcgccg

SEQ ID NO: 1100578 - RNA, 15 nt, Mycobacterium bovis subsp bovis AF2122/97
ggaucgcgcccaccg

SEQ ID NO: 1100579 - RNA, 13 nt, Mycobacterium bovis subsp bovis AF2122/97
ggaucgcgcugau

SEQ ID NO: 1100580 - RNA, 12 nt, Mycobacterium bovis subsp bovis AF2122/97
ggaucgcggcgc

SEQ ID NO: 1100581 - RNA, 14 nt, Mycobacterium bovis subsp bovis AF2122/97
ggaucgcggcggcg

SEQ ID NO: 1100582 - RNA, 14 nt, Mycobacterium bovis subsp bovis AF2122/97
ggaucgcguggcgc

SEQ ID NO: 1100583 - RNA, 22 nt, Mycobacterium bovis subsp bovis AF2122/97
ggaucgcuacgucgaccgacgg

SEQ ID NO: 1100584 - RNA, 17 nt, Mycobacterium bovis subsp bovis AF2122/97
ggaucgcggucagcggg

SEQ ID NO: 1100585 - RNA, 13 nt, Mycobacterium bovis subsp bovis AF2122/97
ggaucggcggccg

SEQ ID NO: 1100586 - RNA, 14 nt, Mycobacterium bovis subsp bovis AF2122/97
ggaucggcggccgg

SEQ ID NO: 1100587 - RNA, 16 nt, Mycobacterium bovis subsp bovis AF2122/97
ggaucggcggccggca

SEQ ID NO: 1100588 - RNA, 15 nt, Mycobacterium bovis subsp bovis AF2122/97
ggaucggcagcagag

SEQ ID NO: 1100589 - RNA, 21 nt, Mycobacterium bovis subsp bovis AF2122/97
ggaucgcagggaucaccccgg

SEQ ID NO: 1100590 - RNA, 14 nt, Mycobacterium bovis subsp bovis AF2122/97
ggaucgccaccggc

SEQ ID NO: 1100591 - RNA, 17 nt, Mycobacterium bovis subsp bovis AF2122/97
ggaucgccaccggcgcc

SEQ ID NO: 1100592 - RNA, 24 nt, Mycobacterium bovis subsp bovis AF2122/97
ggaucgcaagccguugcacggccg

SEQ ID NO: 1100593 - RNA, 14 nt, Mycobacterium bovis subsp bovis AF2122/97
ggaucgcagcgcca

SEQ ID NO: 1100594 - RNA, 12 nt, Mycobacterium bovis subsp bovis AF2122/97
ggaucgccacgg

SEQ ID NO: 1100595 - RNA, 14 nt, Mycobacterium bovis subsp bovis AF2122/97
ggaucgccacggug

SEQ ID NO: 1100596 - RNA, 19 nt, Mycobacterium bovis subsp bovis AF2122/97
ggaucgaccgccagcgccg

SEQ ID NO: 1100597 - RNA, 17 nt, Mycobacterium bovis subsp bovis AF2122/97
ggauccguagaaggcga

SEQ ID NO: 1100598 - RNA, 16 nt, Mycobacterium bovis subsp bovis AF2122/97
ggauccggcagcagcc

SEQ ID NO: 1100599 - RNA, 12 nt, Mycobacterium bovis subsp bovis AF2122/97
ggauccggcggc

SEQ ID NO: 1100600 - RNA, 21 nt, Mycobacterium bovis subsp bovis AF2122/97
ggaucgaccaauucgaccgcg

SEQ ID NO: 1100601 - RNA, 22 nt, Mycobacterium bovis subsp bovis AF2122/97
ggaucgacaccgacgcggucgg

SEQ ID NO: 1100602 - RNA, 23 nt, Mycobacterium bovis subsp bovis AF2122/97
ggaucgaccaauucgaccgcgcg

SEQ ID NO: 1100603 - RNA, 18 nt, Mycobacterium bovis subsp bovis AF2122/97
ggaucgacuucgacgaca

SEQ ID NO: 1100604 - RNA, 16 nt, Mycobacterium bovis subsp bovis AF2122/97
ggaucgagagccgacc

SEQ ID NO: 1100605 - RNA, 19 nt, Mycobacterium bovis subsp bovis AF2122/97
ggaucgagagccgaccggg

SEQ ID NO: 1100606 - RNA, 20 nt, Mycobacterium bovis subsp bovis AF2122/97
ggaucgagagccgaccgggu

SEQ ID NO: 1100607 - RNA, 20 nt, Mycobacterium bovis subsp bovis AF2122/97
ggaucccgccggugugcccg

SEQ ID NO: 1100608 - RNA, 16 nt, Mycobacterium bovis subsp bovis AF2122/97
ggaucccgaggcgccc

SEQ ID NO: 1100609 - RNA, 18 nt, Mycobacterium bovis subsp bovis AF2122/97
ggaucccgaggcgcccaa

SEQ ID NO: 1100610 - RNA, 15 nt, Mycobacterium bovis subsp bovis AF2122/97
ggauccaugcgggug

SEQ ID NO: 1100611 - RNA, 14 nt, Mycobacterium bovis subsp bovis AF2122/97
ggaucccccgcgcg

SEQ ID NO: 1100612 - RNA, 13 nt, Mycobacterium bovis subsp bovis AF2122/97
ggauccagcaggc

SEQ ID NO: 1100613 - RNA, 15 nt, Mycobacterium bovis subsp bovis AF2122/97
ggaucccagcgcagc

SEQ ID NO: 1100614 - RNA, 20 nt, Mycobacterium bovis subsp bovis AF2122/97
ggauccgccagaccgcggcg

SEQ ID NO: 1100615 - RNA, 15 nt, Mycobacterium bovis subsp bovis AF2122/97
ggauccgcaccacgc

SEQ ID NO: 1100616 - RNA, 14 nt, Mycobacterium bovis subsp bovis AF2122/97
ggauccgauccgca

SEQ ID NO: 1100617 - RNA, 22 nt, Mycobacterium bovis subsp bovis AF2122/97
ggaucccugugccagcagcagc

SEQ ID NO: 1100618 - RNA, 19 nt, Mycobacterium bovis subsp bovis AF2122/97
ggauccgaagagccagcaa

SEQ ID NO: 1100619 - RNA, 20 nt, Mycobacterium bovis subsp bovis AF2122/97
ggauccacccagugccacgc

SEQ ID NO: 1100620 - RNA, 21 nt, Mycobacterium bovis subsp bovis AF2122/97
ggaucagaggacccgugcacg

SEQ ID NO: 1100621 - RNA, 16 nt, Mycobacterium bovis subsp bovis AF2122/97
ggaucagcccggacgu

SEQ ID NO: 1100622 - RNA, 13 nt, Mycobacterium bovis subsp bovis AF2122/97
ggaucaccaucgc

SEQ ID NO: 1100623 - RNA, 18 nt, Mycobacterium bovis subsp bovis AF2122/97
ggaucacacccacgucga

SEQ ID NO: 1100624 - RNA, 19 nt, Mycobacterium bovis subsp bovis AF2122/97
ggaucacacuggccugcuc

SEQ ID NO: 1100625 - RNA, 15 nt, Mycobacterium bovis subsp bovis AF2122/97
ggaucacaucggcca

SEQ ID NO: 1100626 - RNA, 18 nt, Mycobacterium bovis subsp bovis AF2122/97
ggaucacccacucgacgu

SEQ ID NO: 1100627 - RNA, 20 nt, Mycobacterium bovis subsp bovis AF2122/97
ggaucaccgcgcccgccgcg

SEQ ID NO: 1100628 - RNA, 14 nt, Mycobacterium bovis subsp bovis AF2122/97
ggaucacgccgccg

SEQ ID NO: 1100629 - RNA, 15 nt, Mycobacterium bovis subsp bovis AF2122/97
ggaucacccgccgcg

SEQ ID NO: 1100630 - RNA, 13 nt, Mycobacterium bovis subsp bovis AF2122/97
ggauaucgucgac

SEQ ID NO: 1100631 - RNA, 21 nt, Mycobacterium bovis subsp bovis AF2122/97
ggauagcgucgucccagcgcg

SEQ ID NO: 1100632 - RNA, 14 nt, Mycobacterium bovis subsp bovis AF2122/97
ggaucaacgcacgg

SEQ ID NO: 1100633 - RNA, 14 nt, Mycobacterium bovis subsp bovis AF2122/97
ggagaucaccucgg

SEQ ID NO: 1100634 - RNA, 20 nt, Mycobacterium bovis subsp bovis AF2122/97
ggagaggcggugcagcuccg

SEQ ID NO: 1100635 - RNA, 17 nt, Mycobacterium bovis subsp bovis AF2122/97
ggacgcgaugaccgcac

SEQ ID NO: 1100636 - RNA, 16 nt, Mycobacterium bovis subsp bovis AF2122/97
ggacgcgaucggcguc

SEQ ID NO: 1100637 - RNA, 18 nt, Mycobacterium bovis subsp bovis AF2122/97
ggacgcgacucggcgguc

SEQ ID NO: 1100638 - RNA, 23 nt, Mycobacterium bovis subsp bovis AF2122/97
ggagaucaccucggugccggccg

SEQ ID NO: 1100639 - RNA, 13 nt, Mycobacterium bovis subsp bovis AF2122/97
ggagaucacgccg

SEQ ID NO: 1100640 - RNA, 13 nt, Mycobacterium bovis subsp bovis AF2122/97
ggagauacgggcc

SEQ ID NO: 1100641 - RNA, 20 nt, Mycobacterium bovis subsp bovis AF2122/97
ggagaucucugagcgggcgg

SEQ ID NO: 1100642 - RNA, 19 nt, Mycobacterium bovis subsp bovis AF2122/97
ggacgagguucugccgcga

SEQ ID NO: 1100643 - RNA, 22 nt, Mycobacterium bovis subsp bovis AF2122/97
ggagauccagggccuucgggcc

SEQ ID NO: 1100644 - RNA, 18 nt, Mycobacterium bovis subsp bovis AF2122/97
ggagaucgccgccggcgc

SEQ ID NO: 1100645 - RNA, 19 nt, Mycobacterium bovis subsp bovis AF2122/97
ggagcaccgaccagggccg

SEQ ID NO: 1100646 - RNA, 22 nt, Mycobacterium bovis subsp bovis AF2122/97
ggagcaccgaccagggccgccg

SEQ ID NO: 1100647 - RNA, 23 nt, Mycobacterium bovis subsp bovis AF2122/97
ggagcaccgaccagggccgccgc

SEQ ID NO: 1100648 - RNA, 20 nt, Mycobacterium bovis subsp bovis AF2122/97
ggagauguaguccucggugg

SEQ ID NO: 1100649 - RNA, 12 nt, Mycobacterium bovis subsp bovis AF2122/97
ggacgccggcgc

SEQ ID NO: 1100650 - RNA, 17 nt, Mycobacterium bovis subsp bovis AF2122/97
ggacgccggcgccgcca

SEQ ID NO: 1100651 - RNA, 14 nt, Mycobacterium bovis subsp bovis AF2122/97
ggacgccgcggcgc

SEQ ID NO: 1100652 - RNA, 19 nt, Mycobacterium bovis subsp bovis AF2122/97
ggacgccuugaucggcgag

SEQ ID NO: 1100653 - RNA, 23 nt, Mycobacterium bovis subsp bovis AF2122/97
ggacgccgcccucucacggcggu

SEQ ID NO: 1100654 - RNA, 16 nt, Mycobacterium bovis subsp bovis AF2122/97
ggacgccgccggagau

SEQ ID NO: 1100655 - RNA, 15 nt, Mycobacterium bovis subsp bovis AF2122/97
ggacgcccgugcggc

SEQ ID NO: 1100656 - RNA, 16 nt, Mycobacterium bovis subsp bovis AF2122/97
ggacgcccgugcggcu

SEQ ID NO: 1100657 - RNA, 22 nt, Mycobacterium bovis subsp bovis AF2122/97
ggacgcccgugcggcucgccgg

SEQ ID NO: 1100658 - RNA, 14 nt, Mycobacterium bovis subsp bovis AF2122/97
ggacgcccggcgca

SEQ ID NO: 1100659 - RNA, 20 nt, Mycobacterium bovis subsp bovis AF2122/97
ggacgcccggcgcaccaucg

SEQ ID NO: 1100660 - RNA, 12 nt, Mycobacterium bovis subsp bovis AF2122/97
ggacgacaccgc

SEQ ID NO: 1100661 - RNA, 15 nt, Mycobacterium bovis subsp bovis AF2122/97
ggacgacaacaggcc

SEQ ID NO: 1100662 - RNA, 16 nt, Mycobacterium bovis subsp bovis AF2122/97
ggacgaaucccgcgcc

SEQ ID NO: 1100663 - RNA, 24 nt, Mycobacterium bovis subsp bovis AF2122/97
ggacgaaucccgcgcccggccggu

SEQ ID NO: 1100664 - RNA, 16 nt, Mycobacterium bovis subsp bovis AF2122/97
ggacgacgaucaagcc

SEQ ID NO: 1100665 - RNA, 16 nt, Mycobacterium bovis subsp bovis AF2122/97
ggacgaccaugccgau

SEQ ID NO: 1100666 - RNA, 13 nt, Mycobacterium bovis subsp bovis AF2122/97
ggacgacccgggc

SEQ ID NO: 1100667 - RNA, 21 nt, Mycobacterium bovis subsp bovis AF2122/97
ggacgacccgggccggucggu

SEQ ID NO: 1100668 - RNA, 20 nt, Mycobacterium bovis subsp bovis AF2122/97
ggacgacgccgacgaugacg

SEQ ID NO: 1100669 - RNA, 21 nt, Mycobacterium bovis subsp bovis AF2122/97
ggagcgcgaugaccucggcga

SEQ ID NO: 1100670 - RNA, 18 nt, Mycobacterium bovis subsp bovis AF2122/97
ggagcgcgccucgcccag

SEQ ID NO: 1100671 - RNA, 17 nt, Mycobacterium bovis subsp bovis AF2122/97
ggagcggguggccggga

SEQ ID NO: 1100672 - RNA, 18 nt, Mycobacterium bovis subsp bovis AF2122/97
ggagcggguggccgggau

SEQ ID NO: 1100673 - RNA, 22 nt, Mycobacterium bovis subsp bovis AF2122/97
ggagcggaguguagacaggacc

SEQ ID NO: 1100674 - RNA, 13 nt, Mycobacterium bovis subsp bovis AF2122/97
ggagcggcugcac

SEQ ID NO: 1100675 - RNA, 17 nt, Mycobacterium bovis subsp bovis AF2122/97
ggagcggcugcggcaac

SEQ ID NO: 1100676 - RNA, 14 nt, Mycobacterium bovis subsp bovis AF2122/97
ggagcgaacggcgc

SEQ ID NO: 1100677 - RNA, 20 nt, Mycobacterium bovis subsp bovis AF2122/97
ggagccuugguagccggccg

SEQ ID NO: 1100678 - RNA, 17 nt, Mycobacterium bovis subsp bovis AF2122/97
ggagcgccagccgcugc

SEQ ID NO: 1100679 - RNA, 23 nt, Mycobacterium bovis subsp bovis AF2122/97
ggagcgcaaguugagcagcuugg

SEQ ID NO: 1100680 - RNA, 18 nt, Mycobacterium bovis subsp bovis AF2122/97
ggagcgcgaugaccucgg

SEQ ID NO: 1100681 - RNA, 13 nt, Mycobacterium bovis subsp bovis AF2122/97
ggagcgccgcagg

SEQ ID NO: 1100682 - RNA, 16 nt, Mycobacterium bovis subsp bovis AF2122/97
ggagccgugcggucgc

SEQ ID NO: 1100683 - RNA, 13 nt, Mycobacterium bovis subsp bovis AF2122/97
ggagccuccagcg

SEQ ID NO: 1100684 - RNA, 12 nt, Mycobacterium bovis subsp bovis AF2122/97
ggagccggugac

SEQ ID NO: 1100685 - RNA, 13 nt, Mycobacterium bovis subsp bovis AF2122/97
ggagccggugacg

SEQ ID NO: 1100686 - RNA, 14 nt, Mycobacterium bovis subsp bovis AF2122/97
ggagccgccggcgg

SEQ ID NO: 1100687 - RNA, 15 nt, Mycobacterium bovis subsp bovis AF2122/97
ggagccgccggcggu

SEQ ID NO: 1100688 - RNA, 16 nt, Mycobacterium bovis subsp bovis AF2122/97
ggagccgccggcggug

SEQ ID NO: 1100689 - RNA, 14 nt, Mycobacterium bovis subsp bovis AF2122/97
ggagccggugacgg

SEQ ID NO: 1100690 - RNA, 17 nt, Mycobacterium bovis subsp bovis AF2122/97
ggagccggugccgacgg

SEQ ID NO: 1100691 - RNA, 19 nt, Mycobacterium bovis subsp bovis AF2122/97
ggagccgaugaccugcccg

SEQ ID NO: 1100692 - RNA, 14 nt, Mycobacterium bovis subsp bovis AF2122/97
ggagccgcacccga

SEQ ID NO: 1100693 - RNA, 22 nt, Mycobacterium bovis subsp bovis AF2122/97
ggagccgccaggugcucgucga

SEQ ID NO: 1100694 - RNA, 13 nt, Mycobacterium bovis subsp bovis AF2122/97
ggagccgcccaag

SEQ ID NO: 1100695 - RNA, 23 nt, Mycobacterium bovis subsp bovis AF2122/97
ggagccgcccaagccgccggcgc

SEQ ID NO: 1100696 - RNA, 20 nt, Mycobacterium bovis subsp bovis AF2122/97
ggagccggccaccucggugc

SEQ ID NO: 1100697 - RNA, 19 nt, Mycobacterium bovis subsp bovis AF2122/97
ggagcccgagcucgccgca

SEQ ID NO: 1100698 - RNA, 12 nt, Mycobacterium bovis subsp bovis AF2122/97
ggagcccggcau

SEQ ID NO: 1100699 - RNA, 13 nt, Mycobacterium bovis subsp bovis AF2122/97
ggagccgacaacg

SEQ ID NO: 1100700 - RNA, 16 nt, Mycobacterium bovis subsp bovis AF2122/97
ggagccaccggcgucg

SEQ ID NO: 1100701 - RNA, 15 nt, Mycobacterium bovis subsp bovis AF2122/97
ggagccaggacgacg

SEQ ID NO: 1100702 - RNA, 16 nt, Mycobacterium bovis subsp bovis AF2122/97
ggagcagagaaaccgc

SEQ ID NO: 1100703 - RNA, 20 nt, Mycobacterium bovis subsp bovis AF2122/97
ggagcagccgaaccggcacc

SEQ ID NO: 1100704 - RNA, 13 nt, Mycobacterium bovis subsp bovis AF2122/97
ggagcugcggcgg

SEQ ID NO: 1100705 - RNA, 23 nt, Mycobacterium bovis subsp bovis AF2122/97
ggaggccaacccugcggcgucgu

SEQ ID NO: 1100706 - RNA, 20 nt, Mycobacterium bovis subsp bovis AF2122/97
ggaggcccgccacaacggcg

SEQ ID NO: 1100707 - RNA, 19 nt, Mycobacterium bovis subsp bovis AF2122/97
ggaggccaacccugcggcg

SEQ ID NO: 1100708 - RNA, 15 nt, Mycobacterium bovis subsp bovis AF2122/97
ggagcuuggcccagc

SEQ ID NO: 1100709 - RNA, 14 nt, Mycobacterium bovis subsp bovis AF2122/97
ggaggaaccccgcg

SEQ ID NO: 1100710 - RNA, 18 nt, Mycobacterium bovis subsp bovis AF2122/97
ggaggaaggucgaaucgc

SEQ ID NO: 1100711 - RNA, 14 nt, Mycobacterium bovis subsp bovis AF2122/97
ggagcucgcggcgc

SEQ ID NO: 1100712 - RNA, 15 nt, Mycobacterium bovis subsp bovis AF2122/97
ggagcgugucggccg

SEQ ID NO: 1100713 - RNA, 15 nt, Mycobacterium bovis subsp bovis AF2122/97
ggagcgugcacgggg

SEQ ID NO: 1100714 - RNA, 20 nt, Mycobacterium bovis subsp bovis AF2122/97
ggagcggguccccaccgguu

SEQ ID NO: 1100715 - RNA, 16 nt, Mycobacterium bovis subsp bovis AF2122/97
ggagcggugccgacgg

SEQ ID NO: 1100716 - RNA, 21 nt, Mycobacterium bovis subsp bovis AF2122/97
ggagcuuuuugcgucuguucg

SEQ ID NO: 1100717 - RNA, 15 nt, Mycobacterium bovis subsp bovis AF2122/97
ggagcugaucacgca

SEQ ID NO: 1100718 - RNA, 22 nt, Mycobacterium bovis subsp bovis AF2122/97
ggaggcuaggcguuugguguga

SEQ ID NO: 1100719 - RNA, 18 nt, Mycobacterium bovis subsp bovis AF2122/97
ggaggcggaccaggccgc

SEQ ID NO: 1100720 - RNA, 13 nt, Mycobacterium bovis subsp bovis AF2122/97
ggagucccaccau

SEQ ID NO: 1100721 - RNA, 14 nt, Mycobacterium bovis subsp bovis AF2122/97
ggaggcggcgccgc

SEQ ID NO: 1100722 - RNA, 17 nt, Mycobacterium bovis subsp bovis AF2122/97
ggaguaggugugcggga

SEQ ID NO: 1100723 - RNA, 13 nt, Mycobacterium bovis subsp bovis AF2122/97
ggagucaccagca

SEQ ID NO: 1100724 - RNA, 14 nt, Mycobacterium bovis subsp bovis AF2122/97
ggagucacgcagcc

SEQ ID NO: 1100725 - RNA, 17 nt, Mycobacterium bovis subsp bovis AF2122/97
ggagucacgcagccgcg

SEQ ID NO: 1100726 - RNA, 23 nt, Mycobacterium bovis subsp bovis AF2122/97
ggagucgacccugcccagcaccc

SEQ ID NO: 1100727 - RNA, 17 nt, Mycobacterium bovis subsp bovis AF2122/97
ggagucgacggugccgu

SEQ ID NO: 1100728 - RNA, 22 nt, Mycobacterium bovis subsp bovis AF2122/97
ggagucgacgguuugcaccgcg

SEQ ID NO: 1100729 - RNA, 15 nt, Mycobacterium bovis subsp bovis AF2122/97
ggagucgcccggucc

SEQ ID NO: 1100730 - RNA, 16 nt, Mycobacterium bovis subsp bovis AF2122/97
ggagucgcgcagggcg

SEQ ID NO: 1100731 - RNA, 20 nt, Mycobacterium bovis subsp bovis AF2122/97
ggagucgacggugccgucgg

SEQ ID NO: 1100732 - RNA, 23 nt, Mycobacterium bovis subsp bovis AF2122/97
ggauagcaccggcacccgcacgg

SEQ ID NO: 1100733 - RNA, 17 nt, Mycobacterium bovis subsp bovis AF2122/97
ggauagccucggcggcg

SEQ ID NO: 1100734 - RNA, 16 nt, Mycobacterium bovis subsp bovis AF2122/97
ggauacggugcgacga

SEQ ID NO: 1100735 - RNA, 18 nt, Mycobacterium bovis subsp bovis AF2122/97
ggauaccgaaaucaccuc

SEQ ID NO: 1100736 - RNA, 21 nt, Mycobacterium bovis subsp bovis AF2122/97
ggauaccgcugggucgccguu

SEQ ID NO: 1100737 - RNA, 19 nt, Mycobacterium bovis subsp bovis AF2122/97
ggauacgccccugguccac

SEQ ID NO: 1100738 - RNA, 17 nt, Mycobacterium bovis subsp bovis AF2122/97
ggagugguacggcucgg

SEQ ID NO: 1100739 - RNA, 19 nt, Mycobacterium bovis subsp bovis AF2122/97
ggauacauuucgucgucgc

SEQ ID NO: 1100740 - RNA, 16 nt, Mycobacterium bovis subsp bovis AF2122/97
ggauacccagcgcccg

SEQ ID NO: 1100741 - RNA, 19 nt, Mycobacterium bovis subsp bovis AF2122/97
ggauacccagcgcccggcc

SEQ ID NO: 1100742 - RNA, 19 nt, Mycobacterium bovis subsp bovis AF2122/97
ggaguuuaagacgcccgag

SEQ ID NO: 1100743 - RNA, 17 nt, Mycobacterium bovis subsp bovis AF2122/97
ggaguuuccgaagcccg

SEQ ID NO: 1100744 - RNA, 18 nt, Mycobacterium bovis subsp bovis AF2122/97
ggaguugcgacgauacac

SEQ ID NO: 1100745 - RNA, 19 nt, Mycobacterium bovis subsp bovis AF2122/97
ggauaaacugccgcggcac

SEQ ID NO: 1100746 - RNA, 12 nt, Mycobacterium bovis subsp bovis AF2122/97
ggaguggccagu

SEQ ID NO: 1100747 - RNA, 14 nt, Mycobacterium bovis subsp bovis AF2122/97
ggaguggccgggcg

SEQ ID NO: 1100748 - RNA, 22 nt, Mycobacterium bovis subsp bovis AF2122/97
ggaguuccucgaucgucgacgc

SEQ ID NO: 1100749 - RNA, 17 nt, Mycobacterium bovis subsp bovis AF2122/97
ggaguucucgcugauca

SEQ ID NO: 1100750 - RNA, 13 nt, Mycobacterium bovis subsp bovis AF2122/97
ggaccuccucgcc

SEQ ID NO: 1100751 - RNA, 21 nt, Mycobacterium bovis subsp bovis AF2122/97
ggaccucguugcugccggcgu

SEQ ID NO: 1100752 - RNA, 13 nt, Mycobacterium bovis subsp bovis AF2122/97
ggaccucggcgau

SEQ ID NO: 1100753 - RNA, 16 nt, Mycobacterium bovis subsp bovis AF2122/97
ggaccguccgacggcg

SEQ ID NO: 1100754 - RNA, 23 nt, Mycobacterium bovis subsp bovis AF2122/97
ggaccgcgccgaucaccaccggc

SEQ ID NO: 1100755 - RNA, 14 nt, Mycobacterium bovis subsp bovis AF2122/97
ggaccgucguggcg

SEQ ID NO: 1100756 - RNA, 14 nt, Mycobacterium bovis subsp bovis AF2122/97
ggaccgcgcccaga

SEQ ID NO: 1100757 - RNA, 17 nt, Mycobacterium bovis subsp bovis AF2122/97
ggaccguccgacggcgg

SEQ ID NO: 1100758 - RNA, 19 nt, Mycobacterium bovis subsp bovis AF2122/97
ggaccgcgacggcgccggc

SEQ ID NO: 1100759 - RNA, 20 nt, Mycobacterium bovis subsp bovis AF2122/97
ggaccugggcgacuaccggc

SEQ ID NO: 1100760 - RNA, 18 nt, Mycobacterium bovis subsp bovis AF2122/97
ggacgaaaaaaucgugcg

SEQ ID NO: 1100761 - RNA, 14 nt, Mycobacterium bovis subsp bovis AF2122/97
ggacgaaacgaucg

SEQ ID NO: 1100762 - RNA, 15 nt, Mycobacterium bovis subsp bovis AF2122/97
ggacgaaaucggcgg

SEQ ID NO: 1100763 - RNA, 15 nt, Mycobacterium bovis subsp bovis AF2122/97
ggacgaacacaccgg

SEQ ID NO: 1100764 - RNA, 19 nt, Mycobacterium bovis subsp bovis AF2122/97
ggacgaacacaccgguguc

SEQ ID NO: 1100765 - RNA, 18 nt, Mycobacterium bovis subsp bovis AF2122/97
ggacgaaccggccgacgc

SEQ ID NO: 1100766 - RNA, 16 nt, Mycobacterium bovis subsp bovis AF2122/97
ggacgaacgccgucga

SEQ ID NO: 1100767 - RNA, 15 nt, Mycobacterium bovis subsp bovis AF2122/97
ggaccgaccaccgcg

SEQ ID NO: 1100768 - RNA, 14 nt, Mycobacterium bovis subsp bovis AF2122/97
ggaccgaccggcuc

SEQ ID NO: 1100769 - RNA, 18 nt, Mycobacterium bovis subsp bovis AF2122/97
ggaccgaugacgaucggc

SEQ ID NO: 1100770 - RNA, 12 nt, Mycobacterium bovis subsp bovis AF2122/97
ggacccgucggc

SEQ ID NO: 1100771 - RNA, 20 nt, Mycobacterium bovis subsp bovis AF2122/97
ggacccgugagcucgucgag

SEQ ID NO: 1100772 - RNA, 15 nt, Mycobacterium bovis subsp bovis AF2122/97
ggaccgccgaucggc

SEQ ID NO: 1100773 - RNA, 13 nt, Mycobacterium bovis subsp bovis AF2122/97
ggaccgccgccga

SEQ ID NO: 1100774 - RNA, 14 nt, Mycobacterium bovis subsp bovis AF2122/97
ggaccgccgccgac

SEQ ID NO: 1100775 - RNA, 22 nt, Mycobacterium bovis subsp bovis AF2122/97
ggaccgcagcgacgggaaagcc

SEQ ID NO: 1100776 - RNA, 15 nt, Mycobacterium bovis subsp bovis AF2122/97
ggacccgccagggca

SEQ ID NO: 1100777 - RNA, 20 nt, Mycobacterium bovis subsp bovis AF2122/97
ggaccgcccgugccgucgcc

SEQ ID NO: 1100778 - RNA, 15 nt, Mycobacterium bovis subsp bovis AF2122/97
ggacccggaccuucg

SEQ ID NO: 1100779 - RNA, 13 nt, Mycobacterium bovis subsp bovis AF2122/97
ggacccggccggc

SEQ ID NO: 1100780 - RNA, 15 nt, Mycobacterium bovis subsp bovis AF2122/97
ggacccggccggccc

SEQ ID NO: 1100781 - RNA, 21 nt, Mycobacterium bovis subsp bovis AF2122/97
ggacccgcccuugccgccgag

SEQ ID NO: 1100782 - RNA, 16 nt, Mycobacterium bovis subsp bovis AF2122/97
ggacccgcccuugccg

SEQ ID NO: 1100783 - RNA, 20 nt, Mycobacterium bovis subsp bovis AF2122/97
ggacccgcccuugccgccga

SEQ ID NO: 1100784 - RNA, 18 nt, Mycobacterium bovis subsp bovis AF2122/97
ggaccagcgccccggcgc

SEQ ID NO: 1100785 - RNA, 17 nt, Mycobacterium bovis subsp bovis AF2122/97
ggaccacucgccggcgg

SEQ ID NO: 1100786 - RNA, 14 nt, Mycobacterium bovis subsp bovis AF2122/97
ggaccacuguuggu

SEQ ID NO: 1100787 - RNA, 16 nt, Mycobacterium bovis subsp bovis AF2122/97
ggaccagcaccgccgc

SEQ ID NO: 1100788 - RNA, 20 nt, Mycobacterium bovis subsp bovis AF2122/97
ggaccagcaccgccgcgccg

SEQ ID NO: 1100789 - RNA, 21 nt, Mycobacterium bovis subsp bovis AF2122/97
ggaccagcaccgccgcgccgg

SEQ ID NO: 1100790 - RNA, 20 nt, Mycobacterium bovis subsp bovis AF2122/97
ggaccacgugaucgacgacc

SEQ ID NO: 1100791 - RNA, 15 nt, Mycobacterium bovis subsp bovis AF2122/97
ggaccagaguggugg

SEQ ID NO: 1100792 - RNA, 18 nt, Mycobacterium bovis subsp bovis AF2122/97
ggaccagagugguggcga

SEQ ID NO: 1100793 - RNA, 15 nt, Mycobacterium bovis subsp bovis AF2122/97
ggacaccugcugcac

SEQ ID NO: 1100794 - RNA, 16 nt, Mycobacterium bovis subsp bovis AF2122/97
ggacaccugcugcacc

SEQ ID NO: 1100795 - RNA, 14 nt, Mycobacterium bovis subsp bovis AF2122/97
ggacaccugcugca

SEQ ID NO: 1100796 - RNA, 23 nt, Mycobacterium bovis subsp bovis AF2122/97
ggacaccuaccgagaucaccgcc

SEQ ID NO: 1100797 - RNA, 22 nt, Mycobacterium bovis subsp bovis AF2122/97
ggacaccuaccgagaucaccgc

SEQ ID NO: 1100798 - RNA, 16 nt, Mycobacterium bovis subsp bovis AF2122/97
ggacaccgucaugccg

SEQ ID NO: 1100799 - RNA, 16 nt, Mycobacterium bovis subsp bovis AF2122/97
ggacaccgcggcgauc

SEQ ID NO: 1100800 - RNA, 11 nt, Mycobacterium bovis subsp bovis AF2122/97
ggacaccagcu

SEQ ID NO: 1100801 - RNA, 11 nt, Mycobacterium bovis subsp bovis AF2122/97
ggacaccagga

SEQ ID NO: 1100802 - RNA, 11 nt, Mycobacterium bovis subsp bovis AF2122/97
ggacaccaucu

SEQ ID NO: 1100803 - RNA, 21 nt, Mycobacterium bovis subsp bovis AF2122/97
ggacaccaucuccgccgucgc

SEQ ID NO: 1100804 - RNA, 13 nt, Mycobacterium bovis subsp bovis AF2122/97
ggacacguggcgu

SEQ ID NO: 1100805 - RNA, 18 nt, Mycobacterium bovis subsp bovis AF2122/97
ggacacguuguucaccga

SEQ ID NO: 1100806 - RNA, 21 nt, Mycobacterium bovis subsp bovis AF2122/97
ggacacguuguucaccgacgc

SEQ ID NO: 1100807 - RNA, 13 nt, Mycobacterium bovis subsp bovis AF2122/97
ggacagcagccgg

SEQ ID NO: 1100808 - RNA, 16 nt, Mycobacterium bovis subsp bovis AF2122/97
ggacagcagccggcgu

SEQ ID NO: 1100809 - RNA, 18 nt, Mycobacterium bovis subsp bovis AF2122/97
ggacaccgcggcgaucug

SEQ ID NO: 1100810 - RNA, 12 nt, Mycobacterium bovis subsp bovis AF2122/97
ggacagcgaguu

SEQ ID NO: 1100811 - RNA, 11 nt, Mycobacterium bovis subsp bovis AF2122/97
ggacagcgccu

SEQ ID NO: 1100812 - RNA, 16 nt, Mycobacterium bovis subsp bovis AF2122/97
ggacagcgccuggccg

SEQ ID NO: 1100813 - RNA, 14 nt, Mycobacterium bovis subsp bovis AF2122/97
ggacaugcgggcag

SEQ ID NO: 1100814 - RNA, 17 nt, Mycobacterium bovis subsp bovis AF2122/97
ggacaugcgggcagcac

SEQ ID NO: 1100815 - RNA, 17 nt, Mycobacterium bovis subsp bovis AF2122/97
ggacaugacagccccgc

SEQ ID NO: 1100816 - RNA, 21 nt, Mycobacterium bovis subsp bovis AF2122/97
ggacaugacagccccgccgcc

SEQ ID NO: 1100817 - RNA, 16 nt, Mycobacterium bovis subsp bovis AF2122/97
ggacaggcccgguggc

SEQ ID NO: 1100818 - RNA, 15 nt, Mycobacterium bovis subsp bovis AF2122/97
ggacaggauauugac

SEQ ID NO: 1100819 - RNA, 16 nt, Mycobacterium bovis subsp bovis AF2122/97
ggacaucggccggcgu

SEQ ID NO: 1100820 - RNA, 17 nt, Mycobacterium bovis subsp bovis AF2122/97
ggacaucggccggcguc

SEQ ID NO: 1100821 - RNA, 14 nt, Mycobacterium bovis subsp bovis AF2122/97
ggaccacccggcgc

SEQ ID NO: 1100822 - RNA, 15 nt, Mycobacterium bovis subsp bovis AF2122/97
ggaccaccgcucgcc

SEQ ID NO: 1100823 - RNA, 15 nt, Mycobacterium bovis subsp bovis AF2122/97
ggaccacaccgucac

SEQ ID NO: 1100824 - RNA, 14 nt, Mycobacterium bovis subsp bovis AF2122/97
ggaccacagccgcg

SEQ ID NO: 1100825 - RNA, 18 nt, Mycobacterium bovis subsp bovis AF2122/97
ggaccacaucuggucacg

SEQ ID NO: 1100826 - RNA, 12 nt, Mycobacterium bovis subsp bovis AF2122/97
ggaccaccagcg

SEQ ID NO: 1100827 - RNA, 16 nt, Mycobacterium bovis subsp bovis AF2122/97
ggaccaacgccaacgc

SEQ ID NO: 1100828 - RNA, 19 nt, Mycobacterium bovis subsp bovis AF2122/97
ggacaucggccggcgucag

SEQ ID NO: 1100829 - RNA, 19 nt, Mycobacterium bovis subsp bovis AF2122/97
ggaacgccgugccguacgc

SEQ ID NO: 1100830 - RNA, 16 nt, Mycobacterium bovis subsp bovis AF2122/97
ggaacgccgagcacgc

SEQ ID NO: 1100831 - RNA, 20 nt, Mycobacterium bovis subsp bovis AF2122/97
ggaacgccggcaucgcgcgc

SEQ ID NO: 1100832 - RNA, 12 nt, Mycobacterium bovis subsp bovis AF2122/97
ggaacgcggcga

SEQ ID NO: 1100833 - RNA, 12 nt, Mycobacterium bovis subsp bovis AF2122/97
ggaacgcggcgg

SEQ ID NO: 1100834 - RNA, 14 nt, Mycobacterium bovis subsp bovis AF2122/97
ggaacgcucgucga

SEQ ID NO: 1100835 - RNA, 18 nt, Mycobacterium bovis subsp bovis AF2122/97
ggaacgcucgucgacagu

SEQ ID NO: 1100836 - RNA, 22 nt, Mycobacterium bovis subsp bovis AF2122/97
ggaacgggcaaaccauugcgcc

SEQ ID NO: 1100837 - RNA, 13 nt, Mycobacterium bovis subsp bovis AF2122/97
ggaacggcgucgu

SEQ ID NO: 1100838 - RNA, 20 nt, Mycobacterium bovis subsp bovis AF2122/97
ggaacguccagccguggcgg

SEQ ID NO: 1100839 - RNA, 23 nt, Mycobacterium bovis subsp bovis AF2122/97
ggaacguccagccguggcggcgg

SEQ ID NO: 1100840 - RNA, 19 nt, Mycobacterium bovis subsp bovis AF2122/97
ggaacguccgcgccgagcc

SEQ ID NO: 1100841 - RNA, 17 nt, Mycobacterium bovis subsp bovis AF2122/97
ggaaccgagggccguca

SEQ ID NO: 1100842 - RNA, 13 nt, Mycobacterium bovis subsp bovis AF2122/97
ggaaccgaucggu

SEQ ID NO: 1100843 - RNA, 21 nt, Mycobacterium bovis subsp bovis AF2122/97
ggaaaacugaguugagcgcca

SEQ ID NO: 1100844 - RNA, 13 nt, Mycobacterium bovis subsp bovis AF2122/97
ggaacgaccccac

SEQ ID NO: 1100845 - RNA, 17 nt, Mycobacterium bovis subsp bovis AF2122/97
ggaacgagguagcgcgc

SEQ ID NO: 1100846 - RNA, 17 nt, Mycobacterium bovis subsp bovis AF2122/97
ggaacgaugccgccggc

SEQ ID NO: 1100847 - RNA, 19 nt, Mycobacterium bovis subsp bovis AF2122/97
ggaaaaccccggccaccag

SEQ ID NO: 1100848 - RNA, 19 nt, Mycobacterium bovis subsp bovis AF2122/97
ggaaaaauuucuucgccga

SEQ ID NO: 1100849 - RNA, 16 nt, Mycobacterium bovis subsp bovis AF2122/97
ggaaggcgcgcgcccg

SEQ ID NO: 1100850 - RNA, 19 nt, Mycobacterium bovis subsp bovis AF2122/97
ggaaggcccggcgcggccg

SEQ ID NO: 1100851 - RNA, 23 nt, Mycobacterium bovis subsp bovis AF2122/97
ggaaggggcgucugcagcgggcg

SEQ ID NO: 1100852 - RNA, 19 nt, Mycobacterium bovis subsp bovis AF2122/97
ggaaguacuccacccaggc

SEQ ID NO: 1100853 - RNA, 22 nt, Mycobacterium bovis subsp bovis AF2122/97
ggaaguacuccacccaggccga

SEQ ID NO: 1100854 - RNA, 17 nt, Mycobacterium bovis subsp bovis AF2122/97
ggaaguaucgccggccg

SEQ ID NO: 1100855 - RNA, 23 nt, Mycobacterium bovis subsp bovis AF2122/97
ggaaguaucgccggccgcgggcg

SEQ ID NO: 1100856 - RNA, 20 nt, Mycobacterium bovis subsp bovis AF2122/97
ggaauccaccagccgguagc

SEQ ID NO: 1100857 - RNA, 14 nt, Mycobacterium bovis subsp bovis AF2122/97
ggaaucagcacccc

SEQ ID NO: 1100858 - RNA, 22 nt, Mycobacterium bovis subsp bovis AF2122/97
ggaaucagggucugcgccgccg

SEQ ID NO: 1100859 - RNA, 17 nt, Mycobacterium bovis subsp bovis AF2122/97
ggaaguacuucgcggcg

SEQ ID NO: 1100860 - RNA, 18 nt, Mycobacterium bovis subsp bovis AF2122/97
ggaaguacuucgcggcgg

SEQ ID NO: 1100861 - RNA, 17 nt, Mycobacterium bovis subsp bovis AF2122/97
ggaauccuggccgccgc

SEQ ID NO: 1100862 - RNA, 19 nt, Mycobacterium bovis subsp bovis AF2122/97
ggaaucccucggccgcagg

SEQ ID NO: 1100863 - RNA, 20 nt, Mycobacterium bovis subsp bovis AF2122/97
ggaaucccucggccgcaggc

SEQ ID NO: 1100864 - RNA, 14 nt, Mycobacterium bovis subsp bovis AF2122/97
ggaauccgaacucg

SEQ ID NO: 1100865 - RNA, 21 nt, Mycobacterium bovis subsp bovis AF2122/97
ggaauccgaacucgcgggcga

SEQ ID NO: 1100866 - RNA, 23 nt, Mycobacterium bovis subsp bovis AF2122/97
ggaaucgucggcgcggcugucgu

SEQ ID NO: 1100867 - RNA, 22 nt, Mycobacterium bovis subsp bovis AF2122/97
ggaaucgcgagcuuggccggca

SEQ ID NO: 1100868 - RNA, 23 nt, Mycobacterium bovis subsp bovis AF2122/97
ggaaucgcgagcuuggccggcag

SEQ ID NO: 1100869 - RNA, 20 nt, Mycobacterium bovis subsp bovis AF2122/97
ggaaucgguuucgaccugcg

SEQ ID NO: 1100870 - RNA, 15 nt, Mycobacterium bovis subsp bovis AF2122/97
ggaaucgcaccgugu

SEQ ID NO: 1100871 - RNA, 16 nt, Mycobacterium bovis subsp bovis AF2122/97
ggaaucgcaucggcgg

SEQ ID NO: 1100872 - RNA, 21 nt, Mycobacterium bovis subsp bovis AF2122/97
ggaaucggcggcggauucggu

SEQ ID NO: 1100873 - RNA, 16 nt, Mycobacterium bovis subsp bovis AF2122/97
ggaaucgucgcggccg

SEQ ID NO: 1100874 - RNA, 13 nt, Mycobacterium bovis subsp bovis AF2122/97
ggaaucgucgcgg

SEQ ID NO: 1100875 - RNA, 22 nt, Mycobacterium bovis subsp bovis AF2122/97
ggacaaaucgaugaccgucgca

SEQ ID NO: 1100876 - RNA, 14 nt, Mycobacterium bovis subsp bovis AF2122/97
ggacaaagcugcuc

SEQ ID NO: 1100877 - RNA, 22 nt, Mycobacterium bovis subsp bovis AF2122/97
ggacaaagcugcucgucggcgc

SEQ ID NO: 1100878 - RNA, 19 nt, Mycobacterium bovis subsp bovis AF2122/97
ggacaaccuggggccacca

SEQ ID NO: 1100879 - RNA, 14 nt, Mycobacterium bovis subsp bovis AF2122/97
ggacaacagcuugg

SEQ ID NO: 1100880 - RNA, 17 nt, Mycobacterium bovis subsp bovis AF2122/97
ggacaaggucaucggca

SEQ ID NO: 1100881 - RNA, 14 nt, Mycobacterium bovis subsp bovis AF2122/97
ggacaagucggcac

SEQ ID NO: 1100882 - RNA, 15 nt, Mycobacterium bovis subsp bovis AF2122/97
ggacaagucggcacc

SEQ ID NO: 1100883 - RNA, 23 nt, Mycobacterium bovis subsp bovis AF2122/97
ggacacaauccacgucgcggcgu

SEQ ID NO: 1100884 - RNA, 22 nt, Mycobacterium bovis subsp bovis AF2122/97
ggacacagcccacaggcggcgc

SEQ ID NO: 1100885 - RNA, 20 nt, Mycobacterium bovis subsp bovis AF2122/97
ggacaagucggcaccggugc

SEQ ID NO: 1100886 - RNA, 18 nt, Mycobacterium bovis subsp bovis AF2122/97
ggacaauggacaccaacc

SEQ ID NO: 1100887 - RNA, 19 nt, Mycobacterium bovis subsp bovis AF2122/97
ggacaccaacccacccccc

SEQ ID NO: 1100888 - RNA, 15 nt, Mycobacterium bovis subsp bovis AF2122/97
ggacaccaccguggc

SEQ ID NO: 1100889 - RNA, 16 nt, Mycobacterium bovis subsp bovis AF2122/97
gcuuuuucccggcggc

SEQ ID NO: 1100890 - RNA, 20 nt, Mycobacterium bovis subsp bovis AF2122/97
gcuuuugcgucuucucggcg

SEQ ID NO: 1100891 - RNA, 21 nt, Mycobacterium bovis subsp bovis AF2122/97
gcuuuugcgucugcucgcgca

SEQ ID NO: 1100892 - RNA, 20 nt, Mycobacterium bovis subsp bovis AF2122/97
gcuuuugcgucugcucgcca

SEQ ID NO: 1100893 - RNA, 17 nt, Mycobacterium bovis subsp bovis AF2122/97
gcuuuuacgucugcucg

SEQ ID NO: 1100894 - RNA, 16 nt, Mycobacterium bovis subsp bovis AF2122/97
gcuuuuacgucugcuc

SEQ ID NO: 1100895 - RNA, 18 nt, Mycobacterium bovis subsp bovis AF2122/97
gcuuucagcaccggaucg

SEQ ID NO: 1100896 - RNA, 16 nt, Mycobacterium bovis subsp bovis AF2122/97
gcuugucagccgcgac

SEQ ID NO: 1100897 - RNA, 13 nt, Mycobacterium bovis subsp bovis AF2122/97
gcuugucgaccac

SEQ ID NO: 1100898 - RNA, 20 nt, Mycobacterium bovis subsp bovis AF2122/97
gcuuguccgugagcaguucg

SEQ ID NO: 1100899 - RNA, 14 nt, Mycobacterium bovis subsp bovis AF2122/97
gcuugucgaccacg

SEQ ID NO: 1100900 - RNA, 19 nt, Mycobacterium bovis subsp bovis AF2122/97
gcuugucgaccacgaccgu

SEQ ID NO: 1100901 - RNA, 19 nt, Mycobacterium bovis subsp bovis AF2122/97
gcuuuagugucugcucgcg

SEQ ID NO: 1100902 - RNA, 17 nt, Mycobacterium bovis subsp bovis AF2122/97
gcuuggccgccgccacc

SEQ ID NO: 1100903 - RNA, 14 nt, Mycobacterium bovis subsp bovis AF2122/97
gcuuggccgcgccg

SEQ ID NO: 1100904 - RNA, 12 nt, Mycobacterium bovis subsp bovis AF2122/97
gcuuggcggcga

SEQ ID NO: 1100905 - RNA, 13 nt, Mycobacterium bovis subsp bovis AF2122/97
gcuuggcgggacc

SEQ ID NO: 1100906 - RNA, 17 nt, Mycobacterium bovis subsp bovis AF2122/97
gcuuggcgcggcccacc

SEQ ID NO: 1100907 - RNA, 13 nt, Mycobacterium bovis subsp bovis AF2122/97
gcuuggcggccag

SEQ ID NO: 1100908 - RNA, 15 nt, Mycobacterium bovis subsp bovis AF2122/97
gcuuggcggccagcg

SEQ ID NO: 1100909 - RNA, 13 nt, Mycobacterium bovis subsp bovis AF2122/97
gcuugggccagcg

SEQ ID NO: 1100910 - RNA, 20 nt, Mycobacterium bovis subsp bovis AF2122/97
gcuugggcacuucggcgaag

SEQ ID NO: 1100911 - RNA, 13 nt, Mycobacterium bovis subsp bovis AF2122/97
gcuuggcgucggc

SEQ ID NO: 1100912 - RNA, 16 nt, Mycobacterium bovis subsp bovis AF2122/97
gcuuggcgggaccgug

SEQ ID NO: 1100913 - RNA, 13 nt, Mycobacterium bovis subsp bovis AF2122/97
gcuuggcgugacc

SEQ ID NO: 1100914 - RNA, 18 nt, Mycobacterium bovis subsp bovis AF2122/97
gcuugguggucgccaccc

SEQ ID NO: 1100915 - RNA, 20 nt, Mycobacterium bovis subsp bovis AF2122/97
gcuugguggucgccacccga

SEQ ID NO: 1100916 - RNA, 14 nt, Mycobacterium bovis subsp bovis AF2122/97
gcuuguagcgcucg

SEQ ID NO: 1100917 - RNA, 15 nt, Mycobacterium bovis subsp bovis AF2122/97
gcuuggucgaccgcc

SEQ ID NO: 1100918 - RNA, 19 nt, Mycobacterium bovis subsp bovis AF2122/97
gcuuggucgccaugucggc

SEQ ID NO: 1100919 - RNA, 18 nt, Mycobacterium bovis subsp bovis AF2122/97
gcuuggucgcccagccac

SEQ ID NO: 1100920 - RNA, 18 nt, Mycobacterium bovis subsp bovis AF2122/97
gcuuggugaaccgcgcgg

SEQ ID NO: 1100921 - RNA, 15 nt, Mycobacterium bovis subsp bovis AF2122/97
gcuuggugcccagcg

SEQ ID NO: 1100922 - RNA, 18 nt, Mycobacterium bovis subsp bovis AF2122/97
gcuuggccguaggcggcg

SEQ ID NO: 1100923 - RNA, 21 nt, Mycobacterium bovis subsp bovis AF2122/97
gcuuggccuagccgcggcacc

SEQ ID NO: 1100924 - RNA, 22 nt, Mycobacterium bovis subsp bovis AF2122/97
gcuuggccuagccgcggcaccg

SEQ ID NO: 1100925 - RNA, 12 nt, Mycobacterium bovis subsp bovis AF2122/97
gcuuggccgccg

SEQ ID NO: 1100926 - RNA, 13 nt, Mycobacterium bovis subsp bovis AF2122/97
gcuuggccgccgc

SEQ ID NO: 1100927 - RNA, 15 nt, Mycobacterium bovis subsp bovis AF2122/97
gcuuggccgccgcca

SEQ ID NO: 1100928 - RNA, 13 nt, Mycobacterium bovis subsp bovis AF2122/97
gcuuggcccagcg

SEQ ID NO: 1100929 - RNA, 13 nt, Mycobacterium bovis subsp bovis AF2122/97
gcuuggaccagcg

SEQ ID NO: 1100930 - RNA, 17 nt, Mycobacterium bovis subsp bovis AF2122/97
gcuuggagaggcggugc

SEQ ID NO: 1100931 - RNA, 17 nt, Mycobacterium bovis subsp bovis AF2122/97
gcuugcucucgcagcau

SEQ ID NO: 1100932 - RNA, 18 nt, Mycobacterium bovis subsp bovis AF2122/97
gcuugcggggccgggcga

SEQ ID NO: 1100933 - RNA, 14 nt, Mycobacterium bovis subsp bovis AF2122/97
gcuugcguagcuca

SEQ ID NO: 1100934 - RNA, 19 nt, Mycobacterium bovis subsp bovis AF2122/97
gcuugcggugaucccacga

SEQ ID NO: 1100935 - RNA, 18 nt, Mycobacterium bovis subsp bovis AF2122/97
gcuugauccacccgacga

SEQ ID NO: 1100936 - RNA, 19 nt, Mycobacterium bovis subsp bovis AF2122/97
gcuugaucagccgccaacc

SEQ ID NO: 1100937 - RNA, 14 nt, Mycobacterium bovis subsp bovis AF2122/97
gcuugaucgccgag

SEQ ID NO: 1100938 - RNA, 17 nt, Mycobacterium bovis subsp bovis AF2122/97
gcuugaguuucggcgca

SEQ ID NO: 1100939 - RNA, 23 nt, Mycobacterium bovis subsp bovis AF2122/97
gcuugaguugguugaugcccuug

SEQ ID NO: 1100940 - RNA, 20 nt, Mycobacterium bovis subsp bovis AF2122/97
gcuugagcgugagcgccgcg

SEQ ID NO: 1100941 - RNA, 16 nt, Mycobacterium bovis subsp bovis AF2122/97
gcuugacugcacacca

SEQ ID NO: 1100942 - RNA, 14 nt, Mycobacterium bovis subsp bovis AF2122/97
gcuugacuccgcgc

SEQ ID NO: 1100943 - RNA, 18 nt, Mycobacterium bovis subsp bovis AF2122/97
gcuugacuccgcgcgcug

SEQ ID NO: 1100944 - RNA, 21 nt, Mycobacterium bovis subsp bovis AF2122/97
gcuugacuccgcgcgcugggc

SEQ ID NO: 1100945 - RNA, 15 nt, Mycobacterium bovis subsp bovis AF2122/97
gcuugacugcacacc

SEQ ID NO: 1100946 - RNA, 21 nt, Mycobacterium bovis subsp bovis AF2122/97
gcuugacgcagcucgugaccg

SEQ ID NO: 1100947 - RNA, 21 nt, Mycobacterium bovis subsp bovis AF2122/97
gcuugacccuugggcaccacc

SEQ ID NO: 1100948 - RNA, 22 nt, Mycobacterium bovis subsp bovis AF2122/97
gcuugaccccuggccgccggcg

SEQ ID NO: 1100949 - RNA, 17 nt, Mycobacterium bovis subsp bovis AF2122/97
gcuugacccgcggaccg

SEQ ID NO: 1100950 - RNA, 19 nt, Mycobacterium bovis subsp bovis AF2122/97
gcuguuuggggucgcgcug

SEQ ID NO: 1100951 - RNA, 20 nt, Mycobacterium bovis subsp bovis AF2122/97
gcuguuugguugcgccagga

SEQ ID NO: 1100952 - RNA, 18 nt, Mycobacterium bovis subsp bovis AF2122/97
gcuguugacuaccaccgc

SEQ ID NO: 1100953 - RNA, 19 nt, Mycobacterium bovis subsp bovis AF2122/97
gcuguugacuaccaccgcg

SEQ ID NO: 1100954 - RNA, 13 nt, Mycobacterium bovis subsp bovis AF2122/97
gcugugcucacga

SEQ ID NO: 1100955 - RNA, 16 nt, Mycobacterium bovis subsp bovis AF2122/97
gcuguugcgcggucgc

SEQ ID NO: 1100956 - RNA, 16 nt, Mycobacterium bovis subsp bovis AF2122/97
gcuguugcggcggcgc

SEQ ID NO: 1100957 - RNA, 18 nt, Mycobacterium bovis subsp bovis AF2122/97
gcuguugaucgacaccga

SEQ ID NO: 1100958 - RNA, 17 nt, Mycobacterium bovis subsp bovis AF2122/97
gcuguugcaucgccgcg

SEQ ID NO: 1100959 - RNA, 20 nt, Mycobacterium bovis subsp bovis AF2122/97
gcuguugccagucgaucgcg

SEQ ID NO: 1100960 - RNA, 14 nt, Mycobacterium bovis subsp bovis AF2122/97
gcuguuggccagcc

SEQ ID NO: 1100961 - RNA, 16 nt, Mycobacterium bovis subsp bovis AF2122/97
gcuguuggccagccga

SEQ ID NO: 1100962 - RNA, 19 nt, Mycobacterium bovis subsp bovis AF2122/97
gcuguuguugucgggauug

SEQ ID NO: 1100963 - RNA, 15 nt, Mycobacterium bovis subsp bovis AF2122/97
gcuugccgcugagcc

SEQ ID NO: 1100964 - RNA, 19 nt, Mycobacterium bovis subsp bovis AF2122/97
gcuugccgucuucgccgcc

SEQ ID NO: 1100965 - RNA, 16 nt, Mycobacterium bovis subsp bovis AF2122/97
gcuugcgcaucgccga

SEQ ID NO: 1100966 - RNA, 14 nt, Mycobacterium bovis subsp bovis AF2122/97
gcuugcgcccggcc

SEQ ID NO: 1100967 - RNA, 21 nt, Mycobacterium bovis subsp bovis AF2122/97
gcuugcgccggaugacaccga

SEQ ID NO: 1100968 - RNA, 14 nt, Mycobacterium bovis subsp bovis AF2122/97
gcuugcggagccgc

SEQ ID NO: 1100969 - RNA, 18 nt, Mycobacterium bovis subsp bovis AF2122/97
gcuugcggccgcgcgccg

SEQ ID NO: 1100970 - RNA, 17 nt, Mycobacterium bovis subsp bovis AF2122/97
gcuugcccggcucggca

SEQ ID NO: 1100971 - RNA, 21 nt, Mycobacterium bovis subsp bovis AF2122/97
gcuugccgauagaacuagauc

SEQ ID NO: 1100972 - RNA, 18 nt, Mycobacterium bovis subsp bovis AF2122/97
gcuugcagugccgccggc

SEQ ID NO: 1100973 - RNA, 14 nt, Mycobacterium bovis subsp bovis AF2122/97
gcuugccaccgccg

SEQ ID NO: 1100974 - RNA, 18 nt, Mycobacterium bovis subsp bovis AF2122/97
gcuugccaccgccgccgg

SEQ ID NO: 1100975 - RNA, 17 nt, Mycobacterium bovis subsp bovis AF2122/97
gcuugcaaggucgcugc

SEQ ID NO: 1100976 - RNA, 16 nt, Mycobacterium bovis subsp bovis AF2122/97
gcuugcaauugcgcgg

SEQ ID NO: 1100977 - RNA, 18 nt, Mycobacterium bovis subsp bovis AF2122/97
ggccguguacgugcucgu

SEQ ID NO: 1100978 - RNA, 17 nt, Mycobacterium bovis subsp bovis AF2122/97
ggccguggucgaggugg

SEQ ID NO: 1100979 - RNA, 15 nt, Mycobacterium bovis subsp bovis AF2122/97
ggccguguccgccgg

SEQ ID NO: 1100980 - RNA, 24 nt, Mycobacterium bovis subsp bovis AF2122/97
ggccguggcuggacccgcauggcg

SEQ ID NO: 1100981 - RNA, 17 nt, Mycobacterium bovis subsp bovis AF2122/97
ggccguggucgagggcg

SEQ ID NO: 1100982 - RNA, 22 nt, Mycobacterium bovis subsp bovis AF2122/97
ggccguggucgagggcggcguc

SEQ ID NO: 1100983 - RNA, 22 nt, Mycobacterium bovis subsp bovis AF2122/97
ggccguucggcgcccgcucggc

SEQ ID NO: 1100984 - RNA, 22 nt, Mycobacterium bovis subsp bovis AF2122/97
ggccguucgugggcauugcggc

SEQ ID NO: 1100985 - RNA, 21 nt, Mycobacterium bovis subsp bovis AF2122/97
ggccguugcuauucgccagcg

SEQ ID NO: 1100986 - RNA, 16 nt, Mycobacterium bovis subsp bovis AF2122/97
ggccguugugcgguug

SEQ ID NO: 1100987 - RNA, 15 nt, Mycobacterium bovis subsp bovis AF2122/97
ggccguuucggcgcc

SEQ ID NO: 1100988 - RNA, 20 nt, Mycobacterium bovis subsp bovis AF2122/97
ggccuaacgaguaggcggcu

SEQ ID NO: 1100989 - RNA, 14 nt, Mycobacterium bovis subsp bovis AF2122/97
ggccucccccaaac

SEQ ID NO: 1100990 - RNA, 21 nt, Mycobacterium bovis subsp bovis AF2122/97
ggccucccgcaaugcgagcgc

SEQ ID NO: 1100991 - RNA, 17 nt, Mycobacterium bovis subsp bovis AF2122/97
ggccucccacggcgcgu

SEQ ID NO: 1100992 - RNA, 17 nt, Mycobacterium bovis subsp bovis AF2122/97
ggccuaggacaccggca

SEQ ID NO: 1100993 - RNA, 21 nt, Mycobacterium bovis subsp bovis AF2122/97
ggccuccgcugccgcccgcgc

SEQ ID NO: 1100994 - RNA, 17 nt, Mycobacterium bovis subsp bovis AF2122/97
ggccucccgggccgccg

SEQ ID NO: 1100995 - RNA, 12 nt, Mycobacterium bovis subsp bovis AF2122/97
ggccuccgccga

SEQ ID NO: 1100996 - RNA, 19 nt, Mycobacterium bovis subsp bovis AF2122/97
ggccuagccgcggcaccgc

SEQ ID NO: 1100997 - RNA, 23 nt, Mycobacterium bovis subsp bovis AF2122/97
ggccuagccgcggcaccgccgag

SEQ ID NO: 1100998 - RNA, 14 nt, Mycobacterium bovis subsp bovis AF2122/97
ggccuagcgcggcg

SEQ ID NO: 1100999 - RNA, 12 nt, Mycobacterium bovis subsp bovis AF2122/97
ggccuagggcgg

SEQ ID NO: 1101000 - RNA, 15 nt, Mycobacterium bovis subsp bovis AF2122/97
ggccuagggcggcgg

SEQ ID NO: 1101001 - RNA, 17 nt, Mycobacterium bovis subsp bovis AF2122/97
ggccgugccgccgacac

SEQ ID NO: 1101002 - RNA, 14 nt, Mycobacterium bovis subsp bovis AF2122/97
ggccgugccgccga

SEQ ID NO: 1101003 - RNA, 18 nt, Mycobacterium bovis subsp bovis AF2122/97
ggccguggcacccgcagu

SEQ ID NO: 1101004 - RNA, 20 nt, Mycobacterium bovis subsp bovis AF2122/97
ggccguggcacccgcagugg

SEQ ID NO: 1101005 - RNA, 13 nt, Mycobacterium bovis subsp bovis AF2122/97
ggccguggcgaau

SEQ ID NO: 1101006 - RNA, 17 nt, Mycobacterium bovis subsp bovis AF2122/97
ggccguggcggacggcg

SEQ ID NO: 1101007 - RNA, 19 nt, Mycobacterium bovis subsp bovis AF2122/97
ggccguggcggacggcguc

SEQ ID NO: 1101008 - RNA, 17 nt, Mycobacterium bovis subsp bovis AF2122/97
ggccguggccucgaugu

SEQ ID NO: 1101009 - RNA, 15 nt, Mycobacterium bovis subsp bovis AF2122/97
ggccguggcuggacc

SEQ ID NO: 1101010 - RNA, 16 nt, Mycobacterium bovis subsp bovis AF2122/97
ggccgucucgacacug

SEQ ID NO: 1101011 - RNA, 18 nt, Mycobacterium bovis subsp bovis AF2122/97
ggccgucguugccggcga

SEQ ID NO: 1101012 - RNA, 14 nt, Mycobacterium bovis subsp bovis AF2122/97
ggccgugaacggcg

SEQ ID NO: 1101013 - RNA, 22 nt, Mycobacterium bovis subsp bovis AF2122/97
ggccgugacccucagcaccgcu

SEQ ID NO: 1101014 - RNA, 23 nt, Mycobacterium bovis subsp bovis AF2122/97
ggccgugacccucagcaccgcug

SEQ ID NO: 1101015 - RNA, 21 nt, Mycobacterium bovis subsp bovis AF2122/97
ggccgguccggggcaacgauc

SEQ ID NO: 1101016 - RNA, 15 nt, Mycobacterium bovis subsp bovis AF2122/97
ggccgucggcgucga

SEQ ID NO: 1101017 - RNA, 13 nt, Mycobacterium bovis subsp bovis AF2122/97
ggccggucgguga

SEQ ID NO: 1101018 - RNA, 12 nt, Mycobacterium bovis subsp bovis AF2122/97
ggccggugaacg

SEQ ID NO: 1101019 - RNA, 23 nt, Mycobacterium bovis subsp bovis AF2122/97
ggccggugaacggcagcacgguc

SEQ ID NO: 1101020 - RNA, 13 nt, Mycobacterium bovis subsp bovis AF2122/97
ggccgucggcguc

SEQ ID NO: 1101021 - RNA, 20 nt, Mycobacterium bovis subsp bovis AF2122/97
ggccgucggggaguucgcgc

SEQ ID NO: 1101022 - RNA, 17 nt, Mycobacterium bovis subsp bovis AF2122/97
ggccggucacguccgcg

SEQ ID NO: 1101023 - RNA, 22 nt, Mycobacterium bovis subsp bovis AF2122/97
ggccgucgggugcagcacggcg

SEQ ID NO: 1101024 - RNA, 13 nt, Mycobacterium bovis subsp bovis AF2122/97
ggccggucgagac

SEQ ID NO: 1101025 - RNA, 15 nt, Mycobacterium bovis subsp bovis AF2122/97
ggccgguccacggug

SEQ ID NO: 1101026 - RNA, 18 nt, Mycobacterium bovis subsp bovis AF2122/97
ggccgguauuucggcgac

SEQ ID NO: 1101027 - RNA, 16 nt, Mycobacterium bovis subsp bovis AF2122/97
ggccggggcgaacggc

SEQ ID NO: 1101028 - RNA, 23 nt, Mycobacterium bovis subsp bovis AF2122/97
ggccgggucuuccggugcgccga

SEQ ID NO: 1101029 - RNA, 18 nt, Mycobacterium bovis subsp bovis AF2122/97
ggccggguuccagcggca

SEQ ID NO: 1101030 - RNA, 19 nt, Mycobacterium bovis subsp bovis AF2122/97
ggccggguuccagcggcac

SEQ ID NO: 1101031 - RNA, 18 nt, Mycobacterium bovis subsp bovis AF2122/97
ggccggguuggccggcgc

SEQ ID NO: 1101032 - RNA, 16 nt, Mycobacterium bovis subsp bovis AF2122/97
ggccugagcggccauc

SEQ ID NO: 1101033 - RNA, 14 nt, Mycobacterium bovis subsp bovis AF2122/97
ggccugaaccacgc

SEQ ID NO: 1101034 - RNA, 15 nt, Mycobacterium bovis subsp bovis AF2122/97
ggccugaccggucac

SEQ ID NO: 1101035 - RNA, 23 nt, Mycobacterium bovis subsp bovis AF2122/97
ggccucguugaccgggucgccga

SEQ ID NO: 1101036 - RNA, 19 nt, Mycobacterium bovis subsp bovis AF2122/97
ggccucuggaucacgucga

SEQ ID NO: 1101037 - RNA, 16 nt, Mycobacterium bovis subsp bovis AF2122/97
ggccuccucgucgcuc

SEQ ID NO: 1101038 - RNA, 18 nt, Mycobacterium bovis subsp bovis AF2122/97
ggccuccuccccgaccgc

SEQ ID NO: 1101039 - RNA, 14 nt, Mycobacterium bovis subsp bovis AF2122/97
ggccuccugcuggc

SEQ ID NO: 1101040 - RNA, 20 nt, Mycobacterium bovis subsp bovis AF2122/97
ggccucgaagggcuugucgc

SEQ ID NO: 1101041 - RNA, 12 nt, Mycobacterium bovis subsp bovis AF2122/97
ggccucgaccgc

SEQ ID NO: 1101042 - RNA, 15 nt, Mycobacterium bovis subsp bovis AF2122/97
ggccucgaccgccag

SEQ ID NO: 1101043 - RNA, 13 nt, Mycobacterium bovis subsp bovis AF2122/97
ggccucgaccgcg

SEQ ID NO: 1101044 - RNA, 15 nt, Mycobacterium bovis subsp bovis AF2122/97
ggccuggcagggugg

SEQ ID NO: 1101045 - RNA, 19 nt, Mycobacterium bovis subsp bovis AF2122/97
ggccuggccacacucagca

SEQ ID NO: 1101046 - RNA, 17 nt, Mycobacterium bovis subsp bovis AF2122/97
ggccuggccccggcugu

SEQ ID NO: 1101047 - RNA, 20 nt, Mycobacterium bovis subsp bovis AF2122/97
ggccuggaagacggugcggg

SEQ ID NO: 1101048 - RNA, 21 nt, Mycobacterium bovis subsp bovis AF2122/97
ggccuggaagacggugcgggc

SEQ ID NO: 1101049 - RNA, 13 nt, Mycobacterium bovis subsp bovis AF2122/97
ggccuggcacccg

SEQ ID NO: 1101050 - RNA, 17 nt, Mycobacterium bovis subsp bovis AF2122/97
ggccuggcacccggggu

SEQ ID NO: 1101051 - RNA, 14 nt, Mycobacterium bovis subsp bovis AF2122/97
ggccugcucggcga

SEQ ID NO: 1101052 - RNA, 19 nt, Mycobacterium bovis subsp bovis AF2122/97
ggccugcguccgacgccug

SEQ ID NO: 1101053 - RNA, 23 nt, Mycobacterium bovis subsp bovis AF2122/97
ggccugauuccacugggccugcc

SEQ ID NO: 1101054 - RNA, 16 nt, Mycobacterium bovis subsp bovis AF2122/97
ggccuucggccggcgu

SEQ ID NO: 1101055 - RNA, 12 nt, Mycobacterium bovis subsp bovis AF2122/97
ggccuucgccga

SEQ ID NO: 1101056 - RNA, 18 nt, Mycobacterium bovis subsp bovis AF2122/97
ggccuugaucaccgugcg

SEQ ID NO: 1101057 - RNA, 17 nt, Mycobacterium bovis subsp bovis AF2122/97
ggccuugccgccggcgc

SEQ ID NO: 1101058 - RNA, 14 nt, Mycobacterium bovis subsp bovis AF2122/97
ggccuugaucggca

SEQ ID NO: 1101059 - RNA, 18 nt, Mycobacterium bovis subsp bovis AF2122/97
ggccuugaucgugcuggc

SEQ ID NO: 1101060 - RNA, 22 nt, Mycobacterium bovis subsp bovis AF2122/97
ggccuugaucgugcuggcgacg

SEQ ID NO: 1101061 - RNA, 15 nt, Mycobacterium bovis subsp bovis AF2122/97
ggccuugcugcgcga

SEQ ID NO: 1101062 - RNA, 20 nt, Mycobacterium bovis subsp bovis AF2122/97
ggccuugcugcgcgauggcc

SEQ ID NO: 1101063 - RNA, 18 nt, Mycobacterium bovis subsp bovis AF2122/97
ggccuuggcaggugucgg

SEQ ID NO: 1101064 - RNA, 18 nt, Mycobacterium bovis subsp bovis AF2122/97
ggccuggccugcccagca

SEQ ID NO: 1101065 - RNA, 18 nt, Mycobacterium bovis subsp bovis AF2122/97
ggccuggaucgugccgaa

SEQ ID NO: 1101066 - RNA, 16 nt, Mycobacterium bovis subsp bovis AF2122/97
ggccugcuggucacca

SEQ ID NO: 1101067 - RNA, 13 nt, Mycobacterium bovis subsp bovis AF2122/97
ggccuggccgcca

SEQ ID NO: 1101068 - RNA, 13 nt, Mycobacterium bovis subsp bovis AF2122/97
ggccgcgcggucg

SEQ ID NO: 1101069 - RNA, 18 nt, Mycobacterium bovis subsp bovis AF2122/97
ggccgcgcggucguacgc

SEQ ID NO: 1101070 - RNA, 20 nt, Mycobacterium bovis subsp bovis AF2122/97
ggccgcgcucaucgcggcga

SEQ ID NO: 1101071 - RNA, 22 nt, Mycobacterium bovis subsp bovis AF2122/97
ggccgcgcucaucgcggcgaac

SEQ ID NO: 1101072 - RNA, 23 nt, Mycobacterium bovis subsp bovis AF2122/97
ggccgcggagaaggcgcgggcga

SEQ ID NO: 1101073 - RNA, 20 nt, Mycobacterium bovis subsp bovis AF2122/97
ggccgcggccacaucgccag

SEQ ID NO: 1101074 - RNA, 20 nt, Mycobacterium bovis subsp bovis AF2122/97
ggccgcggcacccagguguc

SEQ ID NO: 1101075 - RNA, 15 nt, Mycobacterium bovis subsp bovis AF2122/97
ggccgcggcacccag

SEQ ID NO: 1101076 - RNA, 13 nt, Mycobacterium bovis subsp bovis AF2122/97
ggccgcggccucg

SEQ ID NO: 1101077 - RNA, 13 nt, Mycobacterium bovis subsp bovis AF2122/97
ggccgcggcgauc

SEQ ID NO: 1101078 - RNA, 22 nt, Mycobacterium bovis subsp bovis AF2122/97
ggccgcggcgccuagcacgaag

SEQ ID NO: 1101079 - RNA, 13 nt, Mycobacterium bovis subsp bovis AF2122/97
ggccgcggcgguc

SEQ ID NO: 1101080 - RNA, 20 nt, Mycobacterium bovis subsp bovis AF2122/97
ggccgcggcggccagcgcau

SEQ ID NO: 1101081 - RNA, 22 nt, Mycobacterium bovis subsp bovis AF2122/97
ggccgcggccacaucgccagca

SEQ ID NO: 1101082 - RNA, 22 nt, Mycobacterium bovis subsp bovis AF2122/97
ggccgcggcggucugggugagc

SEQ ID NO: 1101083 - RNA, 14 nt, Mycobacterium bovis subsp bovis AF2122/97
ggccgcggcgucgu

SEQ ID NO: 1101084 - RNA, 19 nt, Mycobacterium bovis subsp bovis AF2122/97
ggccgcgggucgcugcgac

SEQ ID NO: 1101085 - RNA, 13 nt, Mycobacterium bovis subsp bovis AF2122/97
ggccgcggucggc

SEQ ID NO: 1101086 - RNA, 18 nt, Mycobacterium bovis subsp bovis AF2122/97
ggccgcggucggccacca

SEQ ID NO: 1101087 - RNA, 13 nt, Mycobacterium bovis subsp bovis AF2122/97
ggccgcggugacg

SEQ ID NO: 1101088 - RNA, 16 nt, Mycobacterium bovis subsp bovis AF2122/97
ggccgcggugacggcg

SEQ ID NO: 1101089 - RNA, 17 nt, Mycobacterium bovis subsp bovis AF2122/97
ggccgcggugacggcgg

SEQ ID NO: 1101090 - RNA, 15 nt, Mycobacterium bovis subsp bovis AF2122/97
ggccgcgucgucgag

SEQ ID NO: 1101091 - RNA, 23 nt, Mycobacterium bovis subsp bovis AF2122/97
ggccgcgucucggugcagcagcg

SEQ ID NO: 1101092 - RNA, 17 nt, Mycobacterium bovis subsp bovis AF2122/97
ggccgcgucuuggugcg

SEQ ID NO: 1101093 - RNA, 22 nt, Mycobacterium bovis subsp bovis AF2122/97
ggccgcgucuuggugcgcguca

SEQ ID NO: 1101094 - RNA, 23 nt, Mycobacterium bovis subsp bovis AF2122/97
ggccgagucgauugccaccgaga

SEQ ID NO: 1101095 - RNA, 14 nt, Mycobacterium bovis subsp bovis AF2122/97
ggccgagugcccag

SEQ ID NO: 1101096 - RNA, 15 nt, Mycobacterium bovis subsp bovis AF2122/97
ggccgaggccgucgc

SEQ ID NO: 1101097 - RNA, 16 nt, Mycobacterium bovis subsp bovis AF2122/97
ggccgaggccgucgcg

SEQ ID NO: 1101098 - RNA, 17 nt, Mycobacterium bovis subsp bovis AF2122/97
ggccgaggccgucgcga

SEQ ID NO: 1101099 - RNA, 15 nt, Mycobacterium bovis subsp bovis AF2122/97
ggccgaguaccagcc

SEQ ID NO: 1101100 - RNA, 23 nt, Mycobacterium bovis subsp bovis AF2122/97
ggccgaguaccagcccaccggcg

SEQ ID NO: 1101101 - RNA, 16 nt, Mycobacterium bovis subsp bovis AF2122/97
ggccgaguagaugguc

SEQ ID NO: 1101102 - RNA, 13 nt, Mycobacterium bovis subsp bovis AF2122/97
ggccgaguccggc

SEQ ID NO: 1101103 - RNA, 19 nt, Mycobacterium bovis subsp bovis AF2122/97
ggccgauacgaagccgccg

SEQ ID NO: 1101104 - RNA, 13 nt, Mycobacterium bovis subsp bovis AF2122/97
ggccgaucacccc

SEQ ID NO: 1101105 - RNA, 16 nt, Mycobacterium bovis subsp bovis AF2122/97
ggccgaucaccccggu

SEQ ID NO: 1101106 - RNA, 17 nt, Mycobacterium bovis subsp bovis AF2122/97
ggccgaucaccccggug

SEQ ID NO: 1101107 - RNA, 19 nt, Mycobacterium bovis subsp bovis AF2122/97
ggccgaucaccccggugga

SEQ ID NO: 1101108 - RNA, 13 nt, Mycobacterium bovis subsp bovis AF2122/97
ggccgaucagcgc

SEQ ID NO: 1101109 - RNA, 13 nt, Mycobacterium bovis subsp bovis AF2122/97
ggccgaucagcgu

SEQ ID NO: 1101110 - RNA, 13 nt, Mycobacterium bovis subsp bovis AF2122/97
ggccgcgcagggg

SEQ ID NO: 1101111 - RNA, 15 nt, Mycobacterium bovis subsp bovis AF2122/97
ggccgcgcaggggcg

SEQ ID NO: 1101112 - RNA, 22 nt, Mycobacterium bovis subsp bovis AF2122/97
ggccgcgcgacaacccggcguc

SEQ ID NO: 1101113 - RNA, 15 nt, Mycobacterium bovis subsp bovis AF2122/97
ggccgcgcgcaccgg

SEQ ID NO: 1101114 - RNA, 22 nt, Mycobacterium bovis subsp bovis AF2122/97
ggccgcgcgcacuugcguggcg

SEQ ID NO: 1101115 - RNA, 14 nt, Mycobacterium bovis subsp bovis AF2122/97
ggccgcgcgcucga

SEQ ID NO: 1101116 - RNA, 22 nt, Mycobacterium bovis subsp bovis AF2122/97
ggccgcgcgcucgagcaggcug

SEQ ID NO: 1101117 - RNA, 16 nt, Mycobacterium bovis subsp bovis AF2122/97
ggccgcgcggcggcgc

SEQ ID NO: 1101118 - RNA, 19 nt, Mycobacterium bovis subsp bovis AF2122/97
ggccgcgcggcggcgccgg

SEQ ID NO: 1101119 - RNA, 20 nt, Mycobacterium bovis subsp bovis AF2122/97
ggccgcgcggcggcgccggc

SEQ ID NO: 1101120 - RNA, 22 nt, Mycobacterium bovis subsp bovis AF2122/97
ggccgcgcggcggcgccggcgc

SEQ ID NO: 1101121 - RNA, 12 nt, Mycobacterium bovis subsp bovis AF2122/97
ggccgcgcggcg

SEQ ID NO: 1101122 - RNA, 13 nt, Mycobacterium bovis subsp bovis AF2122/97
ggccgcgcggcga

SEQ ID NO: 1101123 - RNA, 14 nt, Mycobacterium bovis subsp bovis AF2122/97
ggccgcgcggcgac

SEQ ID NO: 1101124 - RNA, 18 nt, Mycobacterium bovis subsp bovis AF2122/97
ggccgcgccggccccggg

SEQ ID NO: 1101125 - RNA, 13 nt, Mycobacterium bovis subsp bovis AF2122/97
ggccgcgccgggg

SEQ ID NO: 1101126 - RNA, 22 nt, Mycobacterium bovis subsp bovis AF2122/97
ggccgaucagcguggcgcccgu

SEQ ID NO: 1101127 - RNA, 19 nt, Mycobacterium bovis subsp bovis AF2122/97
ggccggccgcucaccccgc

SEQ ID NO: 1101128 - RNA, 14 nt, Mycobacterium bovis subsp bovis AF2122/97
ggccggcgauggcc

SEQ ID NO: 1101129 - RNA, 12 nt, Mycobacterium bovis subsp bovis AF2122/97
ggccggcgccgc

SEQ ID NO: 1101130 - RNA, 15 nt, Mycobacterium bovis subsp bovis AF2122/97
ggccggcgccgcacc

SEQ ID NO: 1101131 - RNA, 14 nt, Mycobacterium bovis subsp bovis AF2122/97
ggccggcgucggcg

SEQ ID NO: 1101132 - RNA, 16 nt, Mycobacterium bovis subsp bovis AF2122/97
ggccggcgugccagca

SEQ ID NO: 1101133 - RNA, 13 nt, Mycobacterium bovis subsp bovis AF2122/97
ggccggcuagcgg

SEQ ID NO: 1101134 - RNA, 22 nt, Mycobacterium bovis subsp bovis AF2122/97
ggccggcguguucugaucggug

SEQ ID NO: 1101135 - RNA, 15 nt, Mycobacterium bovis subsp bovis AF2122/97
ggccgggacagcgcc

SEQ ID NO: 1101136 - RNA, 16 nt, Mycobacterium bovis subsp bovis AF2122/97
ggccgggacagcgccg

SEQ ID NO: 1101137 - RNA, 18 nt, Mycobacterium bovis subsp bovis AF2122/97
ggccgggaccgccccggc

SEQ ID NO: 1101138 - RNA, 19 nt, Mycobacterium bovis subsp bovis AF2122/97
ggccggcucgccgacccgc

SEQ ID NO: 1101139 - RNA, 17 nt, Mycobacterium bovis subsp bovis AF2122/97
ggccggggccacccgca

SEQ ID NO: 1101140 - RNA, 18 nt, Mycobacterium bovis subsp bovis AF2122/97
ggccggggccacccgcag

SEQ ID NO: 1101141 - RNA, 19 nt, Mycobacterium bovis subsp bovis AF2122/97
ggccggggugccggcgaug

SEQ ID NO: 1101142 - RNA, 23 nt, Mycobacterium bovis subsp bovis AF2122/97
ggccgggucgaacaggccggccg

SEQ ID NO: 1101143 - RNA, 17 nt, Mycobacterium bovis subsp bovis AF2122/97
ggccgggucgaucaccg

SEQ ID NO: 1101144 - RNA, 17 nt, Mycobacterium bovis subsp bovis AF2122/97
ggccgcgugccgcccgc

SEQ ID NO: 1101145 - RNA, 21 nt, Mycobacterium bovis subsp bovis AF2122/97
ggccgcgugacguaccacggc

SEQ ID NO: 1101146 - RNA, 22 nt, Mycobacterium bovis subsp bovis AF2122/97
ggccgcgugacguaccacggcg

SEQ ID NO: 1101147 - RNA, 16 nt, Mycobacterium bovis subsp bovis AF2122/97
ggccggaccaucagcg

SEQ ID NO: 1101148 - RNA, 20 nt, Mycobacterium bovis subsp bovis AF2122/97
ggccggaccaucagcgucga

SEQ ID NO: 1101149 - RNA, 20 nt, Mycobacterium bovis subsp bovis AF2122/97
ggccggacccauuggaccga

SEQ ID NO: 1101150 - RNA, 12 nt, Mycobacterium bovis subsp bovis AF2122/97
ggccgcuccacc

SEQ ID NO: 1101151 - RNA, 20 nt, Mycobacterium bovis subsp bovis AF2122/97
ggccgcuccaccacgaccgc

SEQ ID NO: 1101152 - RNA, 21 nt, Mycobacterium bovis subsp bovis AF2122/97
ggccgcuccaccacgaccgcg

SEQ ID NO: 1101153 - RNA, 16 nt, Mycobacterium bovis subsp bovis AF2122/97
ggccgcuccaccucgg

SEQ ID NO: 1101154 - RNA, 20 nt, Mycobacterium bovis subsp bovis AF2122/97
ggccgcucgccucgauggcg

SEQ ID NO: 1101155 - RNA, 20 nt, Mycobacterium bovis subsp bovis AF2122/97
ggccggaccuuguuggccau

SEQ ID NO: 1101156 - RNA, 21 nt, Mycobacterium bovis subsp bovis AF2122/97
ggccggaggcuugcaacaccc

SEQ ID NO: 1101157 - RNA, 13 nt, Mycobacterium bovis subsp bovis AF2122/97
ggccggagucgac

SEQ ID NO: 1101158 - RNA, 15 nt, Mycobacterium bovis subsp bovis AF2122/97
ggccggagucgacga

SEQ ID NO: 1101159 - RNA, 16 nt, Mycobacterium bovis subsp bovis AF2122/97
ggccggagucgacgac

SEQ ID NO: 1101160 - RNA, 11 nt, Mycobacterium bovis subsp bovis AF2122/97
ggccggccggu

SEQ ID NO: 1101161 - RNA, 12 nt, Mycobacterium bovis subsp bovis AF2122/97
ggccggccgcga

SEQ ID NO: 1101162 - RNA, 18 nt, Mycobacterium bovis subsp bovis AF2122/97
ggccggccggcaaugccg

SEQ ID NO: 1101163 - RNA, 20 nt, Mycobacterium bovis subsp bovis AF2122/97
ggccggcccggguaucgcca

SEQ ID NO: 1101164 - RNA, 17 nt, Mycobacterium bovis subsp bovis AF2122/97
ggccggagucgacgacg

SEQ ID NO: 1101165 - RNA, 16 nt, Mycobacterium bovis subsp bovis AF2122/97
ggccggccaucgcccg

SEQ ID NO: 1101166 - RNA, 19 nt, Mycobacterium bovis subsp bovis AF2122/97
ggccggauacggcgacacc

SEQ ID NO: 1101167 - RNA, 20 nt, Mycobacterium bovis subsp bovis AF2122/97
ggccggauacgggcugacga

SEQ ID NO: 1101168 - RNA, 17 nt, Mycobacterium bovis subsp bovis AF2122/97
ggcgauuucggcgccgg

SEQ ID NO: 1101169 - RNA, 20 nt, Mycobacterium bovis subsp bovis AF2122/97
ggcgauuucggcgccggcgu

SEQ ID NO: 1101170 - RNA, 22 nt, Mycobacterium bovis subsp bovis AF2122/97
ggcgauucugugucugcucgcg

SEQ ID NO: 1101171 - RNA, 17 nt, Mycobacterium bovis subsp bovis AF2122/97
ggcgauugcagcuucgg

SEQ ID NO: 1101172 - RNA, 18 nt, Mycobacterium bovis subsp bovis AF2122/97
ggcgauuuugcgucugcu

SEQ ID NO: 1101173 - RNA, 19 nt, Mycobacterium bovis subsp bovis AF2122/97
ggcgauuuugcgucugcuc

SEQ ID NO: 1101174 - RNA, 23 nt, Mycobacterium bovis subsp bovis AF2122/97
ggcgauuuugcgucugcucgccg

SEQ ID NO: 1101175 - RNA, 22 nt, Mycobacterium bovis subsp bovis AF2122/97
ggcgauuuugcgucugcucgcg

SEQ ID NO: 1101176 - RNA, 21 nt, Mycobacterium bovis subsp bovis AF2122/97
ggcgauuuugcgucugcucgg

SEQ ID NO: 1101177 - RNA, 13 nt, Mycobacterium bovis subsp bovis AF2122/97
ggcgcaccaccgc

SEQ ID NO: 1101178 - RNA, 23 nt, Mycobacterium bovis subsp bovis AF2122/97
ggcgcaccaccgccccgcgccca

SEQ ID NO: 1101179 - RNA, 18 nt, Mycobacterium bovis subsp bovis AF2122/97
ggcgcaaaccacccgcaa

SEQ ID NO: 1101180 - RNA, 20 nt, Mycobacterium bovis subsp bovis AF2122/97
ggcgaugacccggaaucccg

SEQ ID NO: 1101181 - RNA, 21 nt, Mycobacterium bovis subsp bovis AF2122/97
ggcgaugagggcuugugguga

SEQ ID NO: 1101182 - RNA, 23 nt, Mycobacterium bovis subsp bovis AF2122/97
ggcgaugaucaccagucgcugau

SEQ ID NO: 1101183 - RNA, 12 nt, Mycobacterium bovis subsp bovis AF2122/97
ggcgaugagcgc

SEQ ID NO: 1101184 - RNA, 19 nt, Mycobacterium bovis subsp bovis AF2122/97
ggcgaugaggaacguuucg

SEQ ID NO: 1101185 - RNA, 17 nt, Mycobacterium bovis subsp bovis AF2122/97
ggcgaugauguugagcu

SEQ ID NO: 1101186 - RNA, 20 nt, Mycobacterium bovis subsp bovis AF2122/97
ggcgauucgcaaucagcugg

SEQ ID NO: 1101187 - RNA, 18 nt, Mycobacterium bovis subsp bovis AF2122/97
ggcgauucugcgucugcu

SEQ ID NO: 1101188 - RNA, 20 nt, Mycobacterium bovis subsp bovis AF2122/97
ggcgauucugcgucugcucg

SEQ ID NO: 1101189 - RNA, 20 nt, Mycobacterium bovis subsp bovis AF2122/97
ggcgauucugugucugcucg

SEQ ID NO: 1101190 - RNA, 24 nt, Mycobacterium bovis subsp bovis AF2122/97
ggcgaugauggcgcgaucggugcc

SEQ ID NO: 1101191 - RNA, 16 nt, Mycobacterium bovis subsp bovis AF2122/97
ggcgaucuccggcgga

SEQ ID NO: 1101192 - RNA, 16 nt, Mycobacterium bovis subsp bovis AF2122/97
ggcgaucucgaccgua

SEQ ID NO: 1101193 - RNA, 13 nt, Mycobacterium bovis subsp bovis AF2122/97
ggcgaucugcucg

SEQ ID NO: 1101194 - RNA, 12 nt, Mycobacterium bovis subsp bovis AF2122/97
ggcgaucugcug

SEQ ID NO: 1101195 - RNA, 20 nt, Mycobacterium bovis subsp bovis AF2122/97
ggcgaucucgucgcggucga

SEQ ID NO: 1101196 - RNA, 22 nt, Mycobacterium bovis subsp bovis AF2122/97
ggcgaugaacgggaucgacccg

SEQ ID NO: 1101197 - RNA, 16 nt, Mycobacterium bovis subsp bovis AF2122/97
ggcgaugaacagcgac

SEQ ID NO: 1101198 - RNA, 20 nt, Mycobacterium bovis subsp bovis AF2122/97
ggcgaugaccacgccgacga

SEQ ID NO: 1101199 - RNA, 21 nt, Mycobacterium bovis subsp bovis AF2122/97
ggcgaugaccacgccgacgaa

SEQ ID NO: 1101200 - RNA, 16 nt, Mycobacterium bovis subsp bovis AF2122/97
ggcgaucugcugcucg

SEQ ID NO: 1101201 - RNA, 21 nt, Mycobacterium bovis subsp bovis AF2122/97
ggcgaucugcugcucgaucau

SEQ ID NO: 1101202 - RNA, 23 nt, Mycobacterium bovis subsp bovis AF2122/97
ggcgaucugggcuuucagcaccg

SEQ ID NO: 1101203 - RNA, 20 nt, Mycobacterium bovis subsp bovis AF2122/97
ggcgaucugggugccggugu

SEQ ID NO: 1101204 - RNA, 16 nt, Mycobacterium bovis subsp bovis AF2122/97
ggcgaucgucaagccg

SEQ ID NO: 1101205 - RNA, 21 nt, Mycobacterium bovis subsp bovis AF2122/97
ggcgaucgggcgggugaacgc

SEQ ID NO: 1101206 - RNA, 15 nt, Mycobacterium bovis subsp bovis AF2122/97
ggcgaucaccgcgcc

SEQ ID NO: 1101207 - RNA, 15 nt, Mycobacterium bovis subsp bovis AF2122/97
ggcgauccggucggg

SEQ ID NO: 1101208 - RNA, 22 nt, Mycobacterium bovis subsp bovis AF2122/97
ggcgauccgauacagugcgcgg

SEQ ID NO: 1101209 - RNA, 23 nt, Mycobacterium bovis subsp bovis AF2122/97
ggcgagcucggccccgccgccgg

SEQ ID NO: 1101210 - RNA, 15 nt, Mycobacterium bovis subsp bovis AF2122/97
ggcgagcucgucgag

SEQ ID NO: 1101211 - RNA, 22 nt, Mycobacterium bovis subsp bovis AF2122/97
ggcgagcgucgggcuaauccag

SEQ ID NO: 1101212 - RNA, 17 nt, Mycobacterium bovis subsp bovis AF2122/97
ggcgagcguuuggacgg

SEQ ID NO: 1101213 - RNA, 18 nt, Mycobacterium bovis subsp bovis AF2122/97
ggcgagcuaacacccgag

SEQ ID NO: 1101214 - RNA, 22 nt, Mycobacterium bovis subsp bovis AF2122/97
ggcgagcgcgccaaucgcccag

SEQ ID NO: 1101215 - RNA, 23 nt, Mycobacterium bovis subsp bovis AF2122/97
ggcgagcgcggccugcaccagcg

SEQ ID NO: 1101216 - RNA, 13 nt, Mycobacterium bovis subsp bovis AF2122/97
ggcgagccgccac

SEQ ID NO: 1101217 - RNA, 17 nt, Mycobacterium bovis subsp bovis AF2122/97
ggcgagccgcgcccaau

SEQ ID NO: 1101218 - RNA, 14 nt, Mycobacterium bovis subsp bovis AF2122/97
ggcgagccacggca

SEQ ID NO: 1101219 - RNA, 17 nt, Mycobacterium bovis subsp bovis AF2122/97
ggcgagccagcuucccg

SEQ ID NO: 1101220 - RNA, 21 nt, Mycobacterium bovis subsp bovis AF2122/97
ggcgagccagcuucccgcugg

SEQ ID NO: 1101221 - RNA, 17 nt, Mycobacterium bovis subsp bovis AF2122/97
ggcgagccgugccagca

SEQ ID NO: 1101222 - RNA, 17 nt, Mycobacterium bovis subsp bovis AF2122/97
ggcgagcgcaucggcca

SEQ ID NO: 1101223 - RNA, 17 nt, Mycobacterium bovis subsp bovis AF2122/97
ggcgagggcugacggga

SEQ ID NO: 1101224 - RNA, 18 nt, Mycobacterium bovis subsp bovis AF2122/97
ggcgagcucgucgagcgc

SEQ ID NO: 1101225 - RNA, 15 nt, Mycobacterium bovis subsp bovis AF2122/97
ggcgaggcagcaccc

SEQ ID NO: 1101226 - RNA, 19 nt, Mycobacterium bovis subsp bovis AF2122/97
ggcgaggccucggcggccg

SEQ ID NO: 1101227 - RNA, 13 nt, Mycobacterium bovis subsp bovis AF2122/97
ggcgaggucccgg

SEQ ID NO: 1101228 - RNA, 23 nt, Mycobacterium bovis subsp bovis AF2122/97
ggcgaggucccggccgagcgugg

SEQ ID NO: 1101229 - RNA, 24 nt, Mycobacterium bovis subsp bovis AF2122/97
ggcgauaucgaucggaucgaugcc

SEQ ID NO: 1101230 - RNA, 14 nt, Mycobacterium bovis subsp bovis AF2122/97
ggcgauaucgcaca

SEQ ID NO: 1101231 - RNA, 14 nt, Mycobacterium bovis subsp bovis AF2122/97
ggcgaucaacucgg

SEQ ID NO: 1101232 - RNA, 16 nt, Mycobacterium bovis subsp bovis AF2122/97
ggcgaucaauugcccg

SEQ ID NO: 1101233 - RNA, 20 nt, Mycobacterium bovis subsp bovis AF2122/97
ggcgaucaauugcccggcac

SEQ ID NO: 1101234 - RNA, 14 nt, Mycobacterium bovis subsp bovis AF2122/97
ggcgaucaccgaga

SEQ ID NO: 1101235 - RNA, 12 nt, Mycobacterium bovis subsp bovis AF2122/97
ggcgaucaccgu

SEQ ID NO: 1101236 - RNA, 18 nt, Mycobacterium bovis subsp bovis AF2122/97
ggcgaucagcagccgccg

SEQ ID NO: 1101237 - RNA, 23 nt, Mycobacterium bovis subsp bovis AF2122/97
ggcgaucagcagccgccgaugau

SEQ ID NO: 1101238 - RNA, 20 nt, Mycobacterium bovis subsp bovis AF2122/97
ggcgaucaucaggugcgccu

SEQ ID NO: 1101239 - RNA, 15 nt, Mycobacterium bovis subsp bovis AF2122/97
ggcgagugguccagc

SEQ ID NO: 1101240 - RNA, 17 nt, Mycobacterium bovis subsp bovis AF2122/97
ggcgagucgggggccgc

SEQ ID NO: 1101241 - RNA, 20 nt, Mycobacterium bovis subsp bovis AF2122/97
ggcgagguugcgccgaccgg

SEQ ID NO: 1101242 - RNA, 17 nt, Mycobacterium bovis subsp bovis AF2122/97
ggcgaguacggccugcc

SEQ ID NO: 1101243 - RNA, 18 nt, Mycobacterium bovis subsp bovis AF2122/97
ggcgaguacggccugccg

SEQ ID NO: 1101244 - RNA, 16 nt, Mycobacterium bovis subsp bovis AF2122/97
ggcgaguagucgacgu

SEQ ID NO: 1101245 - RNA, 16 nt, Mycobacterium bovis subsp bovis AF2122/97
ggcgaguuaggccgcc

SEQ ID NO: 1101246 - RNA, 21 nt, Mycobacterium bovis subsp bovis AF2122/97
ggcgauaaggaccgcgcccag

SEQ ID NO: 1101247 - RNA, 15 nt, Mycobacterium bovis subsp bovis AF2122/97
ggcgauacagcgaca

SEQ ID NO: 1101248 - RNA, 15 nt, Mycobacterium bovis subsp bovis AF2122/97
ggcgauaccgguugc

SEQ ID NO: 1101249 - RNA, 16 nt, Mycobacterium bovis subsp bovis AF2122/97
ggcgacgacccggguc

SEQ ID NO: 1101250 - RNA, 20 nt, Mycobacterium bovis subsp bovis AF2122/97
ggcgacgacccgggucggca

SEQ ID NO: 1101251 - RNA, 16 nt, Mycobacterium bovis subsp bovis AF2122/97
ggcgacgaccgucggc

SEQ ID NO: 1101252 - RNA, 19 nt, Mycobacterium bovis subsp bovis AF2122/97
ggcgacgaugccgggucgc

SEQ ID NO: 1101253 - RNA, 22 nt, Mycobacterium bovis subsp bovis AF2122/97
ggcgacgaucucggcggccgcg

SEQ ID NO: 1101254 - RNA, 16 nt, Mycobacterium bovis subsp bovis AF2122/97
ggcgacgauccgcacg

SEQ ID NO: 1101255 - RNA, 17 nt, Mycobacterium bovis subsp bovis AF2122/97
ggcgacgauucgagcgg

SEQ ID NO: 1101256 - RNA, 22 nt, Mycobacterium bovis subsp bovis AF2122/97
ggcgacgaugucgagcgcgauc

SEQ ID NO: 1101257 - RNA, 16 nt, Mycobacterium bovis subsp bovis AF2122/97
ggcgacgcggcgccgc

SEQ ID NO: 1101258 - RNA, 17 nt, Mycobacterium bovis subsp bovis AF2122/97
ggcgacgcggcgccgcc

SEQ ID NO: 1101259 - RNA, 23 nt, Mycobacterium bovis subsp bovis AF2122/97
ggcgacgcgacacacgccgccgg

SEQ ID NO: 1101260 - RNA, 13 nt, Mycobacterium bovis subsp bovis AF2122/97
ggcgacgcgccgg

SEQ ID NO: 1101261 - RNA, 15 nt, Mycobacterium bovis subsp bovis AF2122/97
ggcgacgcgccgguu

SEQ ID NO: 1101262 - RNA, 17 nt, Mycobacterium bovis subsp bovis AF2122/97
ggcgacgcuaccgccgg

SEQ ID NO: 1101263 - RNA, 17 nt, Mycobacterium bovis subsp bovis AF2122/97
ggcgacggccagcgcgu

SEQ ID NO: 1101264 - RNA, 21 nt, Mycobacterium bovis subsp bovis AF2122/97
ggcgacggccagcgcgucggg

SEQ ID NO: 1101265 - RNA, 20 nt, Mycobacterium bovis subsp bovis AF2122/97
ggcgacggcccucgagcagc

SEQ ID NO: 1101266 - RNA, 17 nt, Mycobacterium bovis subsp bovis AF2122/97
ggcgacggcgcccauag

SEQ ID NO: 1101267 - RNA, 13 nt, Mycobacterium bovis subsp bovis AF2122/97
ggcgacggccaag

SEQ ID NO: 1101268 - RNA, 21 nt, Mycobacterium bovis subsp bovis AF2122/97
ggcgacggccaagaucggcgc

SEQ ID NO: 1101269 - RNA, 15 nt, Mycobacterium bovis subsp bovis AF2122/97
ggcgacggccagcgc

SEQ ID NO: 1101270 - RNA, 21 nt, Mycobacterium bovis subsp bovis AF2122/97
ggcgacggcggcgucgaugag

SEQ ID NO: 1101271 - RNA, 13 nt, Mycobacterium bovis subsp bovis AF2122/97
ggcgacgucucgc

SEQ ID NO: 1101272 - RNA, 19 nt, Mycobacterium bovis subsp bovis AF2122/97
ggcgacgucucgcaugcuc

SEQ ID NO: 1101273 - RNA, 19 nt, Mycobacterium bovis subsp bovis AF2122/97
ggcgacggcgucacccgca

SEQ ID NO: 1101274 - RNA, 21 nt, Mycobacterium bovis subsp bovis AF2122/97
ggcgacgucaucgccgacccg

SEQ ID NO: 1101275 - RNA, 16 nt, Mycobacterium bovis subsp bovis AF2122/97
ggcgacgucgcgggug

SEQ ID NO: 1101276 - RNA, 22 nt, Mycobacterium bovis subsp bovis AF2122/97
ggcgacgguucccagcuuccgc

SEQ ID NO: 1101277 - RNA, 16 nt, Mycobacterium bovis subsp bovis AF2122/97
ggcgacggugccaccg

SEQ ID NO: 1101278 - RNA, 17 nt, Mycobacterium bovis subsp bovis AF2122/97
ggcgacggugccaccgc

SEQ ID NO: 1101279 - RNA, 19 nt, Mycobacterium bovis subsp bovis AF2122/97
ggcgacggugccaccgcga

SEQ ID NO: 1101280 - RNA, 19 nt, Mycobacterium bovis subsp bovis AF2122/97
ggcgagcaacucguccagc

SEQ ID NO: 1101281 - RNA, 12 nt, Mycobacterium bovis subsp bovis AF2122/97
ggcgagcaccac

SEQ ID NO: 1101282 - RNA, 14 nt, Mycobacterium bovis subsp bovis AF2122/97
ggcgagcaccaccc

SEQ ID NO: 1101283 - RNA, 16 nt, Mycobacterium bovis subsp bovis AF2122/97
ggcgagcaccacccca

SEQ ID NO: 1101284 - RNA, 13 nt, Mycobacterium bovis subsp bovis AF2122/97
ggcgagcacccgc

SEQ ID NO: 1101285 - RNA, 16 nt, Mycobacterium bovis subsp bovis AF2122/97
ggcgagcaggccguug

SEQ ID NO: 1101286 - RNA, 17 nt, Mycobacterium bovis subsp bovis AF2122/97
ggcgagcaucucgacau

SEQ ID NO: 1101287 - RNA, 13 nt, Mycobacterium bovis subsp bovis AF2122/97
ggcgagcaugccg

SEQ ID NO: 1101288 - RNA, 16 nt, Mycobacterium bovis subsp bovis AF2122/97
ggcgacguuccgcucg

SEQ ID NO: 1101289 - RNA, 17 nt, Mycobacterium bovis subsp bovis AF2122/97
ggcgacguuccgcucga

SEQ ID NO: 1101290 - RNA, 18 nt, Mycobacterium bovis subsp bovis AF2122/97
ggcgacguuccgcucgag

SEQ ID NO: 1101291 - RNA, 17 nt, Mycobacterium bovis subsp bovis AF2122/97
ggcgacucgugucugcc

SEQ ID NO: 1101292 - RNA, 18 nt, Mycobacterium bovis subsp bovis AF2122/97
ggcgacuucuucgcgcaa

SEQ ID NO: 1101293 - RNA, 20 nt, Mycobacterium bovis subsp bovis AF2122/97
ggcgacugucuggucggcua

SEQ ID NO: 1101294 - RNA, 16 nt, Mycobacterium bovis subsp bovis AF2122/97
ggcgacugcagcgaag

SEQ ID NO: 1101295 - RNA, 15 nt, Mycobacterium bovis subsp bovis AF2122/97
ggcgagaacccacgc

SEQ ID NO: 1101296 - RNA, 22 nt, Mycobacterium bovis subsp bovis AF2122/97
ggcgagaaaaugacccacacac

SEQ ID NO: 1101297 - RNA, 20 nt, Mycobacterium bovis subsp bovis AF2122/97
ggcgagacauugacgaggcg

SEQ ID NO: 1101298 - RNA, 15 nt, Mycobacterium bovis subsp bovis AF2122/97
ggcgacccagcggua

SEQ ID NO: 1101299 - RNA, 22 nt, Mycobacterium bovis subsp bovis AF2122/97
ggcgaccaucugaucgggcccg

SEQ ID NO: 1101300 - RNA, 14 nt, Mycobacterium bovis subsp bovis AF2122/97
ggcgacccggucgc

SEQ ID NO: 1101301 - RNA, 19 nt, Mycobacterium bovis subsp bovis AF2122/97
ggcgacccgucccccgcac

SEQ ID NO: 1101302 - RNA, 23 nt, Mycobacterium bovis subsp bovis AF2122/97
ggcgacccgucccccgcacgcgg

SEQ ID NO: 1101303 - RNA, 20 nt, Mycobacterium bovis subsp bovis AF2122/97
ggcgaccgagacggcgucgg

SEQ ID NO: 1101304 - RNA, 16 nt, Mycobacterium bovis subsp bovis AF2122/97
ggcgaccgcgcucacc

SEQ ID NO: 1101305 - RNA, 18 nt, Mycobacterium bovis subsp bovis AF2122/97
ggcgaccgcgcucaccgg

SEQ ID NO: 1101306 - RNA, 19 nt, Mycobacterium bovis subsp bovis AF2122/97
ggcgaccgcgcucaccggg

SEQ ID NO: 1101307 - RNA, 21 nt, Mycobacterium bovis subsp bovis AF2122/97
ggcgaccgcgcucaccggggc

SEQ ID NO: 1101308 - RNA, 15 nt, Mycobacterium bovis subsp bovis AF2122/97
ggcgaccgcggucgc

SEQ ID NO: 1101309 - RNA, 18 nt, Mycobacterium bovis subsp bovis AF2122/97
ggcgaccgagacggcguc

SEQ ID NO: 1101310 - RNA, 21 nt, Mycobacterium bovis subsp bovis AF2122/97
ggcgaccgccaucacgaccag

SEQ ID NO: 1101311 - RNA, 13 nt, Mycobacterium bovis subsp bovis AF2122/97
ggcgaccgccauu

SEQ ID NO: 1101312 - RNA, 19 nt, Mycobacterium bovis subsp bovis AF2122/97
ggcgaccgcccccagcggu

SEQ ID NO: 1101313 - RNA, 15 nt, Mycobacterium bovis subsp bovis AF2122/97
ggcgaccggccggcc

SEQ ID NO: 1101314 - RNA, 21 nt, Mycobacterium bovis subsp bovis AF2122/97
ggcgaccggcgagcccgcauc

SEQ ID NO: 1101315 - RNA, 12 nt, Mycobacterium bovis subsp bovis AF2122/97
ggcgaccggugc

SEQ ID NO: 1101316 - RNA, 14 nt, Mycobacterium bovis subsp bovis AF2122/97
ggcgaccgucaacc

SEQ ID NO: 1101317 - RNA, 17 nt, Mycobacterium bovis subsp bovis AF2122/97
ggcgaccggguccggcg

SEQ ID NO: 1101318 - RNA, 14 nt, Mycobacterium bovis subsp bovis AF2122/97
ggcgaccggggauc

SEQ ID NO: 1101319 - RNA, 13 nt, Mycobacterium bovis subsp bovis AF2122/97
ggcgaccugcucg

SEQ ID NO: 1101320 - RNA, 21 nt, Mycobacterium bovis subsp bovis AF2122/97
ggcgaccuccggaaucgcccg

SEQ ID NO: 1101321 - RNA, 15 nt, Mycobacterium bovis subsp bovis AF2122/97
ggcgaccgacgccgg

SEQ ID NO: 1101322 - RNA, 13 nt, Mycobacterium bovis subsp bovis AF2122/97
ggcgaccgucggg

SEQ ID NO: 1101323 - RNA, 23 nt, Mycobacterium bovis subsp bovis AF2122/97
ggcgacgaagaagaacucggcgu

SEQ ID NO: 1101324 - RNA, 17 nt, Mycobacterium bovis subsp bovis AF2122/97
ggcgaccucggcggcgg

SEQ ID NO: 1101325 - RNA, 17 nt, Mycobacterium bovis subsp bovis AF2122/97
ggcgaccugcucgcugg

SEQ ID NO: 1101326 - RNA, 14 nt, Mycobacterium bovis subsp bovis AF2122/97
ggcgacgaacgccg

SEQ ID NO: 1101327 - RNA, 16 nt, Mycobacterium bovis subsp bovis AF2122/97
ggcgacgaaguccccg

SEQ ID NO: 1101328 - RNA, 22 nt, Mycobacterium bovis subsp bovis AF2122/97
ggcgacgaaguccccguagucg

SEQ ID NO: 1101329 - RNA, 13 nt, Mycobacterium bovis subsp bovis AF2122/97
ggcgaccaccacc

SEQ ID NO: 1101330 - RNA, 14 nt, Mycobacterium bovis subsp bovis AF2122/97
ggcgaccaccaccg

SEQ ID NO: 1101331 - RNA, 20 nt, Mycobacterium bovis subsp bovis AF2122/97
ggcgacaugaucugccaccg

SEQ ID NO: 1101332 - RNA, 21 nt, Mycobacterium bovis subsp bovis AF2122/97
ggcgacaugcagcgccaacgc

SEQ ID NO: 1101333 - RNA, 18 nt, Mycobacterium bovis subsp bovis AF2122/97
ggcgacauccacaccgcg

SEQ ID NO: 1101334 - RNA, 22 nt, Mycobacterium bovis subsp bovis AF2122/97
ggcgacauccacaccgcggcgg

SEQ ID NO: 1101335 - RNA, 16 nt, Mycobacterium bovis subsp bovis AF2122/97
ggcgacaucgagaucg

SEQ ID NO: 1101336 - RNA, 13 nt, Mycobacterium bovis subsp bovis AF2122/97
ggcgacagcuugg

SEQ ID NO: 1101337 - RNA, 13 nt, Mycobacterium bovis subsp bovis AF2122/97
ggcgacagcgcgg

SEQ ID NO: 1101338 - RNA, 14 nt, Mycobacterium bovis subsp bovis AF2122/97
ggcgacagcgcggc

SEQ ID NO: 1101339 - RNA, 17 nt, Mycobacterium bovis subsp bovis AF2122/97
ggcgacagcgcggcggu

SEQ ID NO: 1101340 - RNA, 17 nt, Mycobacterium bovis subsp bovis AF2122/97
ggcgacagcggcgacau

SEQ ID NO: 1101341 - RNA, 11 nt, Mycobacterium bovis subsp bovis AF2122/97
ggcgaccacgc

SEQ ID NO: 1101342 - RNA, 13 nt, Mycobacterium bovis subsp bovis AF2122/97
ggcgaccaccgcg

SEQ ID NO: 1101343 - RNA, 15 nt, Mycobacterium bovis subsp bovis AF2122/97
ggcgaccaccaccgc

SEQ ID NO: 1101344 - RNA, 17 nt, Mycobacterium bovis subsp bovis AF2122/97
ggcgaccacgccgccgg

SEQ ID NO: 1101345 - RNA, 18 nt, Mycobacterium bovis subsp bovis AF2122/97
ggcgaccacgccgccggc

SEQ ID NO: 1101346 - RNA, 20 nt, Mycobacterium bovis subsp bovis AF2122/97
ggcgaccacgccgccggcgc

SEQ ID NO: 1101347 - RNA, 12 nt, Mycobacterium bovis subsp bovis AF2122/97
ggcgaccacggc

SEQ ID NO: 1101348 - RNA, 23 nt, Mycobacterium bovis subsp bovis AF2122/97
ggcgaccaccguuugagcggcca

SEQ ID NO: 1101349 - RNA, 19 nt, Mycobacterium bovis subsp bovis AF2122/97
ggcgaccacgucggcgaac

SEQ ID NO: 1101350 - RNA, 17 nt, Mycobacterium bovis subsp bovis AF2122/97
ggcgaccaccagcgccg

SEQ ID NO: 1101351 - RNA, 18 nt, Mycobacterium bovis subsp bovis AF2122/97
ggcgaccaccagcgccga

SEQ ID NO: 1101352 - RNA, 13 nt, Mycobacterium bovis subsp bovis AF2122/97
ggcgaccaccccc

SEQ ID NO: 1101353 - RNA, 17 nt, Mycobacterium bovis subsp bovis AF2122/97
ggcgaccaccaccgccg

SEQ ID NO: 1101354 - RNA, 22 nt, Mycobacterium bovis subsp bovis AF2122/97
ggcgaccaccaccgccgccgaa

SEQ ID NO: 1101355 - RNA, 23 nt, Mycobacterium bovis subsp bovis AF2122/97
ggcgaccaccaccgccgccgaag

SEQ ID NO: 1101356 - RNA, 19 nt, Mycobacterium bovis subsp bovis AF2122/97
ggccuugcgggcucucggc

SEQ ID NO: 1101357 - RNA, 21 nt, Mycobacterium bovis subsp bovis AF2122/97
ggcgaaaucgucgaaccggau

SEQ ID NO: 1101358 - RNA, 22 nt, Mycobacterium bovis subsp bovis AF2122/97
ggcgaacaacuuggccaucccg

SEQ ID NO: 1101359 - RNA, 23 nt, Mycobacterium bovis subsp bovis AF2122/97
ggcgaacagcaugauccgcuggg

SEQ ID NO: 1101360 - RNA, 20 nt, Mycobacterium bovis subsp bovis AF2122/97
ggcgacacgccagccgugcc

SEQ ID NO: 1101361 - RNA, 21 nt, Mycobacterium bovis subsp bovis AF2122/97
ggcgacacgccagccgugccg

SEQ ID NO: 1101362 - RNA, 23 nt, Mycobacterium bovis subsp bovis AF2122/97
ggcgacacgccagccgugccggu

SEQ ID NO: 1101363 - RNA, 23 nt, Mycobacterium bovis subsp bovis AF2122/97
ggcgacacccugggugccggcag

SEQ ID NO: 1101364 - RNA, 22 nt, Mycobacterium bovis subsp bovis AF2122/97
ggcgaacaucaccgucgcccgg

SEQ ID NO: 1101365 - RNA, 17 nt, Mycobacterium bovis subsp bovis AF2122/97
ggcgaacagugacgcca

SEQ ID NO: 1101366 - RNA, 15 nt, Mycobacterium bovis subsp bovis AF2122/97
ggcccggccgaacgc

SEQ ID NO: 1101367 - RNA, 11 nt, Mycobacterium bovis subsp bovis AF2122/97
ggcccgguggu

SEQ ID NO: 1101368 - RNA, 23 nt, Mycobacterium bovis subsp bovis AF2122/97
ggcccgucacaaugcccaggcuc

SEQ ID NO: 1101369 - RNA, 17 nt, Mycobacterium bovis subsp bovis AF2122/97
ggcccgucaccgcgggc

SEQ ID NO: 1101370 - RNA, 17 nt, Mycobacterium bovis subsp bovis AF2122/97
ggcccgucacgcccgcg

SEQ ID NO: 1101371 - RNA, 18 nt, Mycobacterium bovis subsp bovis AF2122/97
ggcccgucacgcccgcga

SEQ ID NO: 1101372 - RNA, 20 nt, Mycobacterium bovis subsp bovis AF2122/97
ggcccgucauacucgacacc

SEQ ID NO: 1101373 - RNA, 22 nt, Mycobacterium bovis subsp bovis AF2122/97
ggcccgucauacucgacaccga

SEQ ID NO: 1101374 - RNA, 13 nt, Mycobacterium bovis subsp bovis AF2122/97
ggcccguccugcg

SEQ ID NO: 1101375 - RNA, 13 nt, Mycobacterium bovis subsp bovis AF2122/97
ggcccuccggcgc

SEQ ID NO: 1101376 - RNA, 16 nt, Mycobacterium bovis subsp bovis AF2122/97
ggcccguucgaccgug

SEQ ID NO: 1101377 - RNA, 15 nt, Mycobacterium bovis subsp bovis AF2122/97
ggcccuagccggcgc

SEQ ID NO: 1101378 - RNA, 21 nt, Mycobacterium bovis subsp bovis AF2122/97
ggcccuaucguuaucgacacc

SEQ ID NO: 1101379 - RNA, 19 nt, Mycobacterium bovis subsp bovis AF2122/97
ggcccuccacugcgagcgc

SEQ ID NO: 1101380 - RNA, 16 nt, Mycobacterium bovis subsp bovis AF2122/97
ggcccgucgucgucga

SEQ ID NO: 1101381 - RNA, 20 nt, Mycobacterium bovis subsp bovis AF2122/97
ggcccgucgugaccgaccgc

SEQ ID NO: 1101382 - RNA, 13 nt, Mycobacterium bovis subsp bovis AF2122/97
ggcccgucggcgu

SEQ ID NO: 1101383 - RNA, 12 nt, Mycobacterium bovis subsp bovis AF2122/97
ggcccgugcggu

SEQ ID NO: 1101384 - RNA, 19 nt, Mycobacterium bovis subsp bovis AF2122/97
ggccgacaccgccaccacg

SEQ ID NO: 1101385 - RNA, 18 nt, Mycobacterium bovis subsp bovis AF2122/97
ggccgacaaugucggcga

SEQ ID NO: 1101386 - RNA, 20 nt, Mycobacterium bovis subsp bovis AF2122/97
ggccgacaccgccaccacgc

SEQ ID NO: 1101387 - RNA, 18 nt, Mycobacterium bovis subsp bovis AF2122/97
ggccgacacgccgaugcc

SEQ ID NO: 1101388 - RNA, 19 nt, Mycobacterium bovis subsp bovis AF2122/97
ggccgacacgccgaugccg

SEQ ID NO: 1101389 - RNA, 23 nt, Mycobacterium bovis subsp bovis AF2122/97
ggcccucuaugcgggcagcgauc

SEQ ID NO: 1101390 - RNA, 13 nt, Mycobacterium bovis subsp bovis AF2122/97
ggcccucgacggc

SEQ ID NO: 1101391 - RNA, 16 nt, Mycobacterium bovis subsp bovis AF2122/97
ggcccucgacggcguc

SEQ ID NO: 1101392 - RNA, 17 nt, Mycobacterium bovis subsp bovis AF2122/97
ggccgacagccaccgcg

SEQ ID NO: 1101393 - RNA, 12 nt, Mycobacterium bovis subsp bovis AF2122/97
ggccgaccagcc

SEQ ID NO: 1101394 - RNA, 18 nt, Mycobacterium bovis subsp bovis AF2122/97
ggccgaccagcacaccgg

SEQ ID NO: 1101395 - RNA, 18 nt, Mycobacterium bovis subsp bovis AF2122/97
ggccgaccagagcuucgc

SEQ ID NO: 1101396 - RNA, 17 nt, Mycobacterium bovis subsp bovis AF2122/97
ggccgagcgcaccgcug

SEQ ID NO: 1101397 - RNA, 14 nt, Mycobacterium bovis subsp bovis AF2122/97
ggccgagcgcgccg

SEQ ID NO: 1101398 - RNA, 15 nt, Mycobacterium bovis subsp bovis AF2122/97
ggccgagcgcgauga

SEQ ID NO: 1101399 - RNA, 21 nt, Mycobacterium bovis subsp bovis AF2122/97
ggccgagcgcgaugaugaucg

SEQ ID NO: 1101400 - RNA, 22 nt, Mycobacterium bovis subsp bovis AF2122/97
ggccgagcucguugcuggcggc

SEQ ID NO: 1101401 - RNA, 13 nt, Mycobacterium bovis subsp bovis AF2122/97
ggccgagcugguu

SEQ ID NO: 1101402 - RNA, 13 nt, Mycobacterium bovis subsp bovis AF2122/97
ggccgagcccggu

SEQ ID NO: 1101403 - RNA, 20 nt, Mycobacterium bovis subsp bovis AF2122/97
ggccgacuuguacgcaucgc

SEQ ID NO: 1101404 - RNA, 15 nt, Mycobacterium bovis subsp bovis AF2122/97
ggccgagcagggccg

SEQ ID NO: 1101405 - RNA, 18 nt, Mycobacterium bovis subsp bovis AF2122/97
ggccgagcagggccggca

SEQ ID NO: 1101406 - RNA, 14 nt, Mycobacterium bovis subsp bovis AF2122/97
ggccgagcccggug

SEQ ID NO: 1101407 - RNA, 15 nt, Mycobacterium bovis subsp bovis AF2122/97
ggccgagcccggugc

SEQ ID NO: 1101408 - RNA, 12 nt, Mycobacterium bovis subsp bovis AF2122/97
ggccgagccgac

SEQ ID NO: 1101409 - RNA, 13 nt, Mycobacterium bovis subsp bovis AF2122/97
ggccgagcgcacc

SEQ ID NO: 1101410 - RNA, 19 nt, Mycobacterium bovis subsp bovis AF2122/97
ggccgagcgcaccacggcg

SEQ ID NO: 1101411 - RNA, 15 nt, Mycobacterium bovis subsp bovis AF2122/97
ggccgagcgcaccgc

SEQ ID NO: 1101412 - RNA, 15 nt, Mycobacterium bovis subsp bovis AF2122/97
ggccgacucggucuc

SEQ ID NO: 1101413 - RNA, 19 nt, Mycobacterium bovis subsp bovis AF2122/97
ggccgacgggacaacccgu

SEQ ID NO: 1101414 - RNA, 14 nt, Mycobacterium bovis subsp bovis AF2122/97
ggccgagaucacgc

SEQ ID NO: 1101415 - RNA, 18 nt, Mycobacterium bovis subsp bovis AF2122/97
ggccgagagcagccagcc

SEQ ID NO: 1101416 - RNA, 12 nt, Mycobacterium bovis subsp bovis AF2122/97
ggcccgcagguc

SEQ ID NO: 1101417 - RNA, 14 nt, Mycobacterium bovis subsp bovis AF2122/97
ggcccgcagcccgc

SEQ ID NO: 1101418 - RNA, 18 nt, Mycobacterium bovis subsp bovis AF2122/97
ggcccgcagcccgccggg

SEQ ID NO: 1101419 - RNA, 15 nt, Mycobacterium bovis subsp bovis AF2122/97
ggcccgcauccgcac

SEQ ID NO: 1101420 - RNA, 11 nt, Mycobacterium bovis subsp bovis AF2122/97
ggcccgccacg

SEQ ID NO: 1101421 - RNA, 17 nt, Mycobacterium bovis subsp bovis AF2122/97
ggcccgccacgaugucg

SEQ ID NO: 1101422 - RNA, 21 nt, Mycobacterium bovis subsp bovis AF2122/97
ggcccgccaucauggcggccc

SEQ ID NO: 1101423 - RNA, 12 nt, Mycobacterium bovis subsp bovis AF2122/97
ggcccgcccgua

SEQ ID NO: 1101424 - RNA, 19 nt, Mycobacterium bovis subsp bovis AF2122/97
ggcccgccagcccagcacg

SEQ ID NO: 1101425 - RNA, 11 nt, Mycobacterium bovis subsp bovis AF2122/97
ggcccgccggc

SEQ ID NO: 1101426 - RNA, 20 nt, Mycobacterium bovis subsp bovis AF2122/97
ggcccgcgagauagcaccag

SEQ ID NO: 1101427 - RNA, 16 nt, Mycobacterium bovis subsp bovis AF2122/97
ggcccgccggccccgc

SEQ ID NO: 1101428 - RNA, 20 nt, Mycobacterium bovis subsp bovis AF2122/97
ggcccgccggccccgccggc

SEQ ID NO: 1101429 - RNA, 21 nt, Mycobacterium bovis subsp bovis AF2122/97
ggcccgccgucaccgccguug

SEQ ID NO: 1101430 - RNA, 17 nt, Mycobacterium bovis subsp bovis AF2122/97
ggcccgccguccggcgc

SEQ ID NO: 1101431 - RNA, 18 nt, Mycobacterium bovis subsp bovis AF2122/97
ggcccgccucggcggcgg

SEQ ID NO: 1101432 - RNA, 17 nt, Mycobacterium bovis subsp bovis AF2122/97
ggcccgccugaccgcca

SEQ ID NO: 1101433 - RNA, 17 nt, Mycobacterium bovis subsp bovis AF2122/97
ggcccggacgucggcgg

SEQ ID NO: 1101434 - RNA, 18 nt, Mycobacterium bovis subsp bovis AF2122/97
ggcccggaggccgcugcc

SEQ ID NO: 1101435 - RNA, 18 nt, Mycobacterium bovis subsp bovis AF2122/97
ggcccggcgaacaggcga

SEQ ID NO: 1101436 - RNA, 19 nt, Mycobacterium bovis subsp bovis AF2122/97
ggcccggcgaacaggcgac

SEQ ID NO: 1101437 - RNA, 19 nt, Mycobacterium bovis subsp bovis AF2122/97
ggcccggcgcggccgcaag

SEQ ID NO: 1101438 - RNA, 22 nt, Mycobacterium bovis subsp bovis AF2122/97
ggcccggugaugaagcgcgguu

SEQ ID NO: 1101439 - RNA, 12 nt, Mycobacterium bovis subsp bovis AF2122/97
ggcccguagccg

SEQ ID NO: 1101440 - RNA, 20 nt, Mycobacterium bovis subsp bovis AF2122/97
ggcccguagcguccgcgccc

SEQ ID NO: 1101441 - RNA, 13 nt, Mycobacterium bovis subsp bovis AF2122/97
ggccccaccggca

SEQ ID NO: 1101442 - RNA, 17 nt, Mycobacterium bovis subsp bovis AF2122/97
ggccccaccggcacccc

SEQ ID NO: 1101443 - RNA, 13 nt, Mycobacterium bovis subsp bovis AF2122/97
ggccccaccggua

SEQ ID NO: 1101444 - RNA, 17 nt, Mycobacterium bovis subsp bovis AF2122/97
ggccccaccggugccgc

SEQ ID NO: 1101445 - RNA, 20 nt, Mycobacterium bovis subsp bovis AF2122/97
ggcccagccgagcggcggca

SEQ ID NO: 1101446 - RNA, 13 nt, Mycobacterium bovis subsp bovis AF2122/97
ggccccacggcgg

SEQ ID NO: 1101447 - RNA, 21 nt, Mycobacterium bovis subsp bovis AF2122/97
ggcccagccgagcggcggcac

SEQ ID NO: 1101448 - RNA, 13 nt, Mycobacterium bovis subsp bovis AF2122/97
ggcccccggcagc

SEQ ID NO: 1101449 - RNA, 17 nt, Mycobacterium bovis subsp bovis AF2122/97
ggccccccggggccgca

SEQ ID NO: 1101450 - RNA, 20 nt, Mycobacterium bovis subsp bovis AF2122/97
ggccccccggggccgcaacc

SEQ ID NO: 1101451 - RNA, 18 nt, Mycobacterium bovis subsp bovis AF2122/97
ggcccccgaggcuggcau

SEQ ID NO: 1101452 - RNA, 11 nt, Mycobacterium bovis subsp bovis AF2122/97
ggccccccgcg

SEQ ID NO: 1101453 - RNA, 13 nt, Mycobacterium bovis subsp bovis AF2122/97
ggccccccgcgcc

SEQ ID NO: 1101454 - RNA, 20 nt, Mycobacterium bovis subsp bovis AF2122/97
ggccccccgcgccugccuca

SEQ ID NO: 1101455 - RNA, 16 nt, Mycobacterium bovis subsp bovis AF2122/97
ggcccgcacguuggcg

SEQ ID NO: 1101456 - RNA, 14 nt, Mycobacterium bovis subsp bovis AF2122/97
ggcccgcagcagca

SEQ ID NO: 1101457 - RNA, 20 nt, Mycobacterium bovis subsp bovis AF2122/97
ggcccgcagcagcaucggca

SEQ ID NO: 1101458 - RNA, 13 nt, Mycobacterium bovis subsp bovis AF2122/97
ggcccgacgacga

SEQ ID NO: 1101459 - RNA, 15 nt, Mycobacterium bovis subsp bovis AF2122/97
ggcccgacgacgacg

SEQ ID NO: 1101460 - RNA, 21 nt, Mycobacterium bovis subsp bovis AF2122/97
ggcccgacccggccgauggug

SEQ ID NO: 1101461 - RNA, 13 nt, Mycobacterium bovis subsp bovis AF2122/97
ggcccgaccggga

SEQ ID NO: 1101462 - RNA, 12 nt, Mycobacterium bovis subsp bovis AF2122/97
ggcccgaccugu

SEQ ID NO: 1101463 - RNA, 16 nt, Mycobacterium bovis subsp bovis AF2122/97
ggcccgacacggcggc

SEQ ID NO: 1101464 - RNA, 13 nt, Mycobacterium bovis subsp bovis AF2122/97
ggccccgaucccg

SEQ ID NO: 1101465 - RNA, 19 nt, Mycobacterium bovis subsp bovis AF2122/97
ggccccgauggcgauacgc

SEQ ID NO: 1101466 - RNA, 13 nt, Mycobacterium bovis subsp bovis AF2122/97
ggcccccggucga

SEQ ID NO: 1101467 - RNA, 13 nt, Mycobacterium bovis subsp bovis AF2122/97
ggccccaggggca

SEQ ID NO: 1101468 - RNA, 15 nt, Mycobacterium bovis subsp bovis AF2122/97
ggccccggcugucgg

SEQ ID NO: 1101469 - RNA, 20 nt, Mycobacterium bovis subsp bovis AF2122/97
ggccccggugacgccgucga

SEQ ID NO: 1101470 - RNA, 12 nt, Mycobacterium bovis subsp bovis AF2122/97
ggccccgucgcc

SEQ ID NO: 1101471 - RNA, 19 nt, Mycobacterium bovis subsp bovis AF2122/97
ggccccgggggaagcgcca

SEQ ID NO: 1101472 - RNA, 20 nt, Mycobacterium bovis subsp bovis AF2122/97
ggccccgaaacgauggccgg

SEQ ID NO: 1101473 - RNA, 19 nt, Mycobacterium bovis subsp bovis AF2122/97
ggccccgacggucaacgac

SEQ ID NO: 1101474 - RNA, 16 nt, Mycobacterium bovis subsp bovis AF2122/97
ggccccgucgccgauc

SEQ ID NO: 1101475 - RNA, 19 nt, Mycobacterium bovis subsp bovis AF2122/97
ggccagcgaugugaaccgg

SEQ ID NO: 1101476 - RNA, 22 nt, Mycobacterium bovis subsp bovis AF2122/97
ggccagccguucucgcccaccc

SEQ ID NO: 1101477 - RNA, 14 nt, Mycobacterium bovis subsp bovis AF2122/97
ggccagcccgccca

SEQ ID NO: 1101478 - RNA, 14 nt, Mycobacterium bovis subsp bovis AF2122/97
ggccagcgcaccgc

SEQ ID NO: 1101479 - RNA, 13 nt, Mycobacterium bovis subsp bovis AF2122/97
ggccagcgcccgc

SEQ ID NO: 1101480 - RNA, 16 nt, Mycobacterium bovis subsp bovis AF2122/97
ggccagcgcccgcagg

SEQ ID NO: 1101481 - RNA, 20 nt, Mycobacterium bovis subsp bovis AF2122/97
ggccaggcgguacgggucgc

SEQ ID NO: 1101482 - RNA, 15 nt, Mycobacterium bovis subsp bovis AF2122/97
ggccaggggcgcagc

SEQ ID NO: 1101483 - RNA, 19 nt, Mycobacterium bovis subsp bovis AF2122/97
ggccagggcgguggccacc

SEQ ID NO: 1101484 - RNA, 17 nt, Mycobacterium bovis subsp bovis AF2122/97
ggccagggucagcucgg

SEQ ID NO: 1101485 - RNA, 16 nt, Mycobacterium bovis subsp bovis AF2122/97
ggccagggucagcucg

SEQ ID NO: 1101486 - RNA, 14 nt, Mycobacterium bovis subsp bovis AF2122/97
ggccagggugcccu

SEQ ID NO: 1101487 - RNA, 20 nt, Mycobacterium bovis subsp bovis AF2122/97
ggccagggugcccucggccg

SEQ ID NO: 1101488 - RNA, 22 nt, Mycobacterium bovis subsp bovis AF2122/97
ggccagggugcccucggccgcc

SEQ ID NO: 1101489 - RNA, 23 nt, Mycobacterium bovis subsp bovis AF2122/97
ggccagguaauugccgaccgccu

SEQ ID NO: 1101490 - RNA, 15 nt, Mycobacterium bovis subsp bovis AF2122/97
ggccaggucgacacc

SEQ ID NO: 1101491 - RNA, 20 nt, Mycobacterium bovis subsp bovis AF2122/97
ggccaggucgccuuucauag

SEQ ID NO: 1101492 - RNA, 14 nt, Mycobacterium bovis subsp bovis AF2122/97
ggccaggucggcca

SEQ ID NO: 1101493 - RNA, 14 nt, Mycobacterium bovis subsp bovis AF2122/97
ggccaggucgacgg

SEQ ID NO: 1101494 - RNA, 16 nt, Mycobacterium bovis subsp bovis AF2122/97
ggccaggucgacgggc

SEQ ID NO: 1101495 - RNA, 16 nt, Mycobacterium bovis subsp bovis AF2122/97
ggccaggucgagcacc

SEQ ID NO: 1101496 - RNA, 18 nt, Mycobacterium bovis subsp bovis AF2122/97
ggccaggucgagcaccgg

SEQ ID NO: 1101497 - RNA, 15 nt, Mycobacterium bovis subsp bovis AF2122/97
ggccaggucggcgau

SEQ ID NO: 1101498 - RNA, 16 nt, Mycobacterium bovis subsp bovis AF2122/97
ggccaguacgucgauc

SEQ ID NO: 1101499 - RNA, 17 nt, Mycobacterium bovis subsp bovis AF2122/97
ggccaguacgucgauca

SEQ ID NO: 1101500 - RNA, 17 nt, Mycobacterium bovis subsp bovis AF2122/97
ggccagguugccgucgg

SEQ ID NO: 1101501 - RNA, 18 nt, Mycobacterium bovis subsp bovis AF2122/97
ggccagguugccgucggc

SEQ ID NO: 1101502 - RNA, 18 nt, Mycobacterium bovis subsp bovis AF2122/97
ggccagguuguagacggc

SEQ ID NO: 1101503 - RNA, 15 nt, Mycobacterium bovis subsp bovis AF2122/97
ggccaguaugcggug

SEQ ID NO: 1101504 - RNA, 20 nt, Mycobacterium bovis subsp bovis AF2122/97
ggccagucaggaaaccggcg

SEQ ID NO: 1101505 - RNA, 21 nt, Mycobacterium bovis subsp bovis AF2122/97
ggccagucaggaaaccggcgc

SEQ ID NO: 1101506 - RNA, 17 nt, Mycobacterium bovis subsp bovis AF2122/97
ggccagucgaaucguca

SEQ ID NO: 1101507 - RNA, 22 nt, Mycobacterium bovis subsp bovis AF2122/97
ggccaguccgaaagccgccgag

SEQ ID NO: 1101508 - RNA, 23 nt, Mycobacterium bovis subsp bovis AF2122/97
ggccaguucggugagccgggcgg

SEQ ID NO: 1101509 - RNA, 14 nt, Mycobacterium bovis subsp bovis AF2122/97
ggccagugcgacgu

SEQ ID NO: 1101510 - RNA, 19 nt, Mycobacterium bovis subsp bovis AF2122/97
ggccagugccaucgccaug

SEQ ID NO: 1101511 - RNA, 18 nt, Mycobacterium bovis subsp bovis AF2122/97
ggccagugacucaccgug

SEQ ID NO: 1101512 - RNA, 17 nt, Mycobacterium bovis subsp bovis AF2122/97
ggccaguucggcggccg

SEQ ID NO: 1101513 - RNA, 19 nt, Mycobacterium bovis subsp bovis AF2122/97
ggccaucacggcggggauc

SEQ ID NO: 1101514 - RNA, 16 nt, Mycobacterium bovis subsp bovis AF2122/97
ggccaucacggucagc

SEQ ID NO: 1101515 - RNA, 20 nt, Mycobacterium bovis subsp bovis AF2122/97
ggccaugcuaggaccaccag

SEQ ID NO: 1101516 - RNA, 14 nt, Mycobacterium bovis subsp bovis AF2122/97
ggccaugcucgcca

SEQ ID NO: 1101517 - RNA, 15 nt, Mycobacterium bovis subsp bovis AF2122/97
ggccauggcgcgcaa

SEQ ID NO: 1101518 - RNA, 13 nt, Mycobacterium bovis subsp bovis AF2122/97
ggccaugcugguc

SEQ ID NO: 1101519 - RNA, 16 nt, Mycobacterium bovis subsp bovis AF2122/97
ggccaugccacaacgc

SEQ ID NO: 1101520 - RNA, 12 nt, Mycobacterium bovis subsp bovis AF2122/97
ggccaugaugau

SEQ ID NO: 1101521 - RNA, 14 nt, Mycobacterium bovis subsp bovis AF2122/97
ggccaucgaccguc

SEQ ID NO: 1101522 - RNA, 17 nt, Mycobacterium bovis subsp bovis AF2122/97
ggccaucucgucgaugu

SEQ ID NO: 1101523 - RNA, 23 nt, Mycobacterium bovis subsp bovis AF2122/97
ggccaucgggauggacaccaccu

SEQ ID NO: 1101524 - RNA, 21 nt, Mycobacterium bovis subsp bovis AF2122/97
ggccaucgucaggaaccaccc

SEQ ID NO: 1101525 - RNA, 21 nt, Mycobacterium bovis subsp bovis AF2122/97
ggccaucugcucguggguacc

SEQ ID NO: 1101526 - RNA, 19 nt, Mycobacterium bovis subsp bovis AF2122/97
ggccaucucgucgaugucg

SEQ ID NO: 1101527 - RNA, 15 nt, Mycobacterium bovis subsp bovis AF2122/97
ggccaucugauccgg

SEQ ID NO: 1101528 - RNA, 22 nt, Mycobacterium bovis subsp bovis AF2122/97
ggccaucugauccggugccgcg

SEQ ID NO: 1101529 - RNA, 17 nt, Mycobacterium bovis subsp bovis AF2122/97
ggccauccgggcugcca

SEQ ID NO: 1101530 - RNA, 14 nt, Mycobacterium bovis subsp bovis AF2122/97
ggcccaccaggccc

SEQ ID NO: 1101531 - RNA, 14 nt, Mycobacterium bovis subsp bovis AF2122/97
ggcccaccagcgca

SEQ ID NO: 1101532 - RNA, 14 nt, Mycobacterium bovis subsp bovis AF2122/97
ggcccaccggucgc

SEQ ID NO: 1101533 - RNA, 17 nt, Mycobacterium bovis subsp bovis AF2122/97
ggcccaccagcgcagcc

SEQ ID NO: 1101534 - RNA, 19 nt, Mycobacterium bovis subsp bovis AF2122/97
ggcccaccggucgcgcauu

SEQ ID NO: 1101535 - RNA, 13 nt, Mycobacterium bovis subsp bovis AF2122/97
ggcccacggcgac

SEQ ID NO: 1101536 - RNA, 18 nt, Mycobacterium bovis subsp bovis AF2122/97
ggcccacguuggccccgc

SEQ ID NO: 1101537 - RNA, 22 nt, Mycobacterium bovis subsp bovis AF2122/97
ggcccacucucgccacgccgug

SEQ ID NO: 1101538 - RNA, 19 nt, Mycobacterium bovis subsp bovis AF2122/97
ggcccagcaaccgcucggc

SEQ ID NO: 1101539 - RNA, 22 nt, Mycobacterium bovis subsp bovis AF2122/97
ggccaugguguucggcagcgcg

SEQ ID NO: 1101540 - RNA, 22 nt, Mycobacterium bovis subsp bovis AF2122/97
ggccaugguccaagugggccgg

SEQ ID NO: 1101541 - RNA, 16 nt, Mycobacterium bovis subsp bovis AF2122/97
ggccaugucagcggcc

SEQ ID NO: 1101542 - RNA, 20 nt, Mycobacterium bovis subsp bovis AF2122/97
ggccaugucagcggccugcu

SEQ ID NO: 1101543 - RNA, 22 nt, Mycobacterium bovis subsp bovis AF2122/97
ggccaugucagcggccugcucg

SEQ ID NO: 1101544 - RNA, 16 nt, Mycobacterium bovis subsp bovis AF2122/97
ggccauguggacggca

SEQ ID NO: 1101545 - RNA, 17 nt, Mycobacterium bovis subsp bovis AF2122/97
ggccauuagcagcaccc

SEQ ID NO: 1101546 - RNA, 19 nt, Mycobacterium bovis subsp bovis AF2122/97
ggccauuagcagcacccgg

SEQ ID NO: 1101547 - RNA, 21 nt, Mycobacterium bovis subsp bovis AF2122/97
ggccauucuuggugaucgcga

SEQ ID NO: 1101548 - RNA, 18 nt, Mycobacterium bovis subsp bovis AF2122/97
ggcccacacuaggcccca

SEQ ID NO: 1101549 - RNA, 14 nt, Mycobacterium bovis subsp bovis AF2122/97
ggcccacaccagcg

SEQ ID NO: 1101550 - RNA, 17 nt, Mycobacterium bovis subsp bovis AF2122/97
ggcccacaccagcgcag

SEQ ID NO: 1101551 - RNA, 18 nt, Mycobacterium bovis subsp bovis AF2122/97
ggcccacaccagcgcagc

SEQ ID NO: 1101552 - RNA, 22 nt, Mycobacterium bovis subsp bovis AF2122/97
ggccauucuuggugaucgcgaa

SEQ ID NO: 1101553 - RNA, 15 nt, Mycobacterium bovis subsp bovis AF2122/97
ggcccaacgacggca

SEQ ID NO: 1101554 - RNA, 16 nt, Mycobacterium bovis subsp bovis AF2122/97
ggcccaacaccgccag

SEQ ID NO: 1101555 - RNA, 17 nt, Mycobacterium bovis subsp bovis AF2122/97
ggcccaacaccgccaga

SEQ ID NO: 1101556 - RNA, 16 nt, Mycobacterium bovis subsp bovis AF2122/97
ggauggucagcagcuc

SEQ ID NO: 1101557 - RNA, 22 nt, Mycobacterium bovis subsp bovis AF2122/97
ggaugggagccacugcggcaug

SEQ ID NO: 1101558 - RNA, 22 nt, Mycobacterium bovis subsp bovis AF2122/97
ggauguaguuggcgaccugcgc

SEQ ID NO: 1101559 - RNA, 17 nt, Mycobacterium bovis subsp bovis AF2122/97
ggaugguugcgacggcg

SEQ ID NO: 1101560 - RNA, 14 nt, Mycobacterium bovis subsp bovis AF2122/97
ggauguaccccggc

SEQ ID NO: 1101561 - RNA, 20 nt, Mycobacterium bovis subsp bovis AF2122/97
ggaugucccaugcacggccg

SEQ ID NO: 1101562 - RNA, 18 nt, Mycobacterium bovis subsp bovis AF2122/97
ggauguccgcggccacca

SEQ ID NO: 1101563 - RNA, 23 nt, Mycobacterium bovis subsp bovis AF2122/97
ggaugucgacgagcaccgcgccg

SEQ ID NO: 1101564 - RNA, 21 nt, Mycobacterium bovis subsp bovis AF2122/97
ggauguccuugaaccagcgcg

SEQ ID NO: 1101565 - RNA, 16 nt, Mycobacterium bovis subsp bovis AF2122/97
ggaugucggggcgaag

SEQ ID NO: 1101566 - RNA, 14 nt, Mycobacterium bovis subsp bovis AF2122/97
ggaugucgcggucg

SEQ ID NO: 1101567 - RNA, 16 nt, Mycobacterium bovis subsp bovis AF2122/97
ggaugugggcgcucgc

SEQ ID NO: 1101568 - RNA, 17 nt, Mycobacterium bovis subsp bovis AF2122/97
ggaugugggcgcucgca

SEQ ID NO: 1101569 - RNA, 15 nt, Mycobacterium bovis subsp bovis AF2122/97
ggaugucgucgacga

SEQ ID NO: 1101570 - RNA, 13 nt, Mycobacterium bovis subsp bovis AF2122/97
ggaugucgugcgg

SEQ ID NO: 1101571 - RNA, 13 nt, Mycobacterium bovis subsp bovis AF2122/97
ggaugugccgcgc

SEQ ID NO: 1101572 - RNA, 18 nt, Mycobacterium bovis subsp bovis AF2122/97
ggaugugccgcgcacggc

SEQ ID NO: 1101573 - RNA, 19 nt, Mycobacterium bovis subsp bovis AF2122/97
ggcagagccgccguugccg

SEQ ID NO: 1101574 - RNA, 16 nt, Mycobacterium bovis subsp bovis AF2122/97
ggcagaggcuggcgca

SEQ ID NO: 1101575 - RNA, 18 nt, Mycobacterium bovis subsp bovis AF2122/97
ggcagaggcuggcgcaga

SEQ ID NO: 1101576 - RNA, 21 nt, Mycobacterium bovis subsp bovis AF2122/97
ggaugugggcgcucgcaucau

SEQ ID NO: 1101577 - RNA, 18 nt, Mycobacterium bovis subsp bovis AF2122/97
ggcagcacgccagcccca

SEQ ID NO: 1101578 - RNA, 13 nt, Mycobacterium bovis subsp bovis AF2122/97
ggcagcacgaccu

SEQ ID NO: 1101579 - RNA, 12 nt, Mycobacterium bovis subsp bovis AF2122/97
ggcagcacccgc

SEQ ID NO: 1101580 - RNA, 15 nt, Mycobacterium bovis subsp bovis AF2122/97
ggcagauucuucacc

SEQ ID NO: 1101581 - RNA, 21 nt, Mycobacterium bovis subsp bovis AF2122/97
ggcagcaaaaaccagcgucca

SEQ ID NO: 1101582 - RNA, 16 nt, Mycobacterium bovis subsp bovis AF2122/97
ggcagcaacaggccca

SEQ ID NO: 1101583 - RNA, 20 nt, Mycobacterium bovis subsp bovis AF2122/97
ggcagauggugaaguugccg

SEQ ID NO: 1101584 - RNA, 14 nt, Mycobacterium bovis subsp bovis AF2122/97
ggcagaucgauacc

SEQ ID NO: 1101585 - RNA, 24 nt, Mycobacterium bovis subsp bovis AF2122/97
ggcagccgcauaggccccgccagc

SEQ ID NO: 1101586 - RNA, 14 nt, Mycobacterium bovis subsp bovis AF2122/97
ggcagccgaagcgc

SEQ ID NO: 1101587 - RNA, 16 nt, Mycobacterium bovis subsp bovis AF2122/97
ggcagcccgggcgugg

SEQ ID NO: 1101588 - RNA, 20 nt, Mycobacterium bovis subsp bovis AF2122/97
ggcagcccggugugcugcac

SEQ ID NO: 1101589 - RNA, 16 nt, Mycobacterium bovis subsp bovis AF2122/97
ggcagcccggcggccg

SEQ ID NO: 1101590 - RNA, 16 nt, Mycobacterium bovis subsp bovis AF2122/97
ggcagccgcgccgcgg

SEQ ID NO: 1101591 - RNA, 18 nt, Mycobacterium bovis subsp bovis AF2122/97
ggcagccgcgccgcggcc

SEQ ID NO: 1101592 - RNA, 16 nt, Mycobacterium bovis subsp bovis AF2122/97
ggcagccgggcgucgc

SEQ ID NO: 1101593 - RNA, 17 nt, Mycobacterium bovis subsp bovis AF2122/97
ggcagccccagcuugcg

SEQ ID NO: 1101594 - RNA, 15 nt, Mycobacterium bovis subsp bovis AF2122/97
ggcagcccccggauc

SEQ ID NO: 1101595 - RNA, 18 nt, Mycobacterium bovis subsp bovis AF2122/97
ggcagccccuccgcgccg

SEQ ID NO: 1101596 - RNA, 20 nt, Mycobacterium bovis subsp bovis AF2122/97
ggcagcccaaagcgccagca

SEQ ID NO: 1101597 - RNA, 17 nt, Mycobacterium bovis subsp bovis AF2122/97
ggcagccagggcgccga

SEQ ID NO: 1101598 - RNA, 12 nt, Mycobacterium bovis subsp bovis AF2122/97
ggcagccaccag

SEQ ID NO: 1101599 - RNA, 14 nt, Mycobacterium bovis subsp bovis AF2122/97
ggcagccaccagcg

SEQ ID NO: 1101600 - RNA, 21 nt, Mycobacterium bovis subsp bovis AF2122/97
ggcagccaaaaacgcugccgc

SEQ ID NO: 1101601 - RNA, 17 nt, Mycobacterium bovis subsp bovis AF2122/97
ggcagcaccgcacggag

SEQ ID NO: 1101602 - RNA, 17 nt, Mycobacterium bovis subsp bovis AF2122/97
ggcagcaucaacaccgg

SEQ ID NO: 1101603 - RNA, 18 nt, Mycobacterium bovis subsp bovis AF2122/97
ggcagcaucaacaccggc

SEQ ID NO: 1101604 - RNA, 17 nt, Mycobacterium bovis subsp bovis AF2122/97
ggcagcaucggcacccc

SEQ ID NO: 1101605 - RNA, 20 nt, Mycobacterium bovis subsp bovis AF2122/97
ggcagcaucggcaccccggc

SEQ ID NO: 1101606 - RNA, 18 nt, Mycobacterium bovis subsp bovis AF2122/97
ggcagcaucuccgucggc

SEQ ID NO: 1101607 - RNA, 14 nt, Mycobacterium bovis subsp bovis AF2122/97
ggcagcagccggcg

SEQ ID NO: 1101608 - RNA, 11 nt, Mycobacterium bovis subsp bovis AF2122/97
ggcagcagcgg

SEQ ID NO: 1101609 - RNA, 21 nt, Mycobacterium bovis subsp bovis AF2122/97
ggcagcagcaaaacccgagcc

SEQ ID NO: 1101610 - RNA, 21 nt, Mycobacterium bovis subsp bovis AF2122/97
ggcagcgcccagaucgccgag

SEQ ID NO: 1101611 - RNA, 18 nt, Mycobacterium bovis subsp bovis AF2122/97
ggcagcucggggcacaag

SEQ ID NO: 1101612 - RNA, 15 nt, Mycobacterium bovis subsp bovis AF2122/97
ggcagcuccgccgcc

SEQ ID NO: 1101613 - RNA, 15 nt, Mycobacterium bovis subsp bovis AF2122/97
ggcagcuucaacacc

SEQ ID NO: 1101614 - RNA, 17 nt, Mycobacterium bovis subsp bovis AF2122/97
ggcagcuucaacaccgg

SEQ ID NO: 1101615 - RNA, 19 nt, Mycobacterium bovis subsp bovis AF2122/97
ggcagcuucaacaccggca

SEQ ID NO: 1101616 - RNA, 22 nt, Mycobacterium bovis subsp bovis AF2122/97
ggcagcuucucgccgacgaacu

SEQ ID NO: 1101617 - RNA, 22 nt, Mycobacterium bovis subsp bovis AF2122/97
ggcagcuuggacucaucggcgu

SEQ ID NO: 1101618 - RNA, 16 nt, Mycobacterium bovis subsp bovis AF2122/97
ggcaggaaugccgcgg

SEQ ID NO: 1101619 - RNA, 19 nt, Mycobacterium bovis subsp bovis AF2122/97
ggcagcgagacuucgacgc

SEQ ID NO: 1101620 - RNA, 19 nt, Mycobacterium bovis subsp bovis AF2122/97
ggcagcgagucgacgucga

SEQ ID NO: 1101621 - RNA, 15 nt, Mycobacterium bovis subsp bovis AF2122/97
ggcagcgaggcucgc

SEQ ID NO: 1101622 - RNA, 20 nt, Mycobacterium bovis subsp bovis AF2122/97
ggcagccugcugcacaucgc

SEQ ID NO: 1101623 - RNA, 13 nt, Mycobacterium bovis subsp bovis AF2122/97
ggcagcgacgccg

SEQ ID NO: 1101624 - RNA, 21 nt, Mycobacterium bovis subsp bovis AF2122/97
ggcaggcccgacggcgcccag

SEQ ID NO: 1101625 - RNA, 14 nt, Mycobacterium bovis subsp bovis AF2122/97
ggcaggugcggcgg

SEQ ID NO: 1101626 - RNA, 21 nt, Mycobacterium bovis subsp bovis AF2122/97
ggcaggaucgaggcgucggca

SEQ ID NO: 1101627 - RNA, 13 nt, Mycobacterium bovis subsp bovis AF2122/97
ggcaggcauggcg

SEQ ID NO: 1101628 - RNA, 13 nt, Mycobacterium bovis subsp bovis AF2122/97
ggcaggccagcau

SEQ ID NO: 1101629 - RNA, 17 nt, Mycobacterium bovis subsp bovis AF2122/97
ggcaguucgcggccauc

SEQ ID NO: 1101630 - RNA, 16 nt, Mycobacterium bovis subsp bovis AF2122/97
ggcaguggccagaccc

SEQ ID NO: 1101631 - RNA, 16 nt, Mycobacterium bovis subsp bovis AF2122/97
ggcaguggcagcccgu

SEQ ID NO: 1101632 - RNA, 19 nt, Mycobacterium bovis subsp bovis AF2122/97
ggcauaaacaucgguggcg

SEQ ID NO: 1101633 - RNA, 15 nt, Mycobacterium bovis subsp bovis AF2122/97
ggcaguugacccaug

SEQ ID NO: 1101634 - RNA, 23 nt, Mycobacterium bovis subsp bovis AF2122/97
ggcauaaacaucgguggcgccga

SEQ ID NO: 1101635 - RNA, 19 nt, Mycobacterium bovis subsp bovis AF2122/97
ggcauaaaccgcguccgcg

SEQ ID NO: 1101636 - RNA, 20 nt, Mycobacterium bovis subsp bovis AF2122/97
ggcauaacccgcaccggggu

SEQ ID NO: 1101637 - RNA, 21 nt, Mycobacterium bovis subsp bovis AF2122/97
ggcagugcgcggcgucgucga

SEQ ID NO: 1101638 - RNA, 12 nt, Mycobacterium bovis subsp bovis AF2122/97
ggcagugcgcgg

SEQ ID NO: 1101639 - RNA, 15 nt, Mycobacterium bovis subsp bovis AF2122/97
ggccaccaccgcgcc

SEQ ID NO: 1101640 - RNA, 16 nt, Mycobacterium bovis subsp bovis AF2122/97
ggccaccaccgccgcc

SEQ ID NO: 1101641 - RNA, 21 nt, Mycobacterium bovis subsp bovis AF2122/97
ggccaccaccgccgccggcac

SEQ ID NO: 1101642 - RNA, 12 nt, Mycobacterium bovis subsp bovis AF2122/97
ggccaccaccgu

SEQ ID NO: 1101643 - RNA, 14 nt, Mycobacterium bovis subsp bovis AF2122/97
ggccaccaccguga

SEQ ID NO: 1101644 - RNA, 11 nt, Mycobacterium bovis subsp bovis AF2122/97
ggccaccaccu

SEQ ID NO: 1101645 - RNA, 14 nt, Mycobacterium bovis subsp bovis AF2122/97
ggccaccagaacca

SEQ ID NO: 1101646 - RNA, 17 nt, Mycobacterium bovis subsp bovis AF2122/97
ggccaccacgugcgcgu

SEQ ID NO: 1101647 - RNA, 22 nt, Mycobacterium bovis subsp bovis AF2122/97
ggccaccccgaccucccggcaa

SEQ ID NO: 1101648 - RNA, 13 nt, Mycobacterium bovis subsp bovis AF2122/97
ggccaccccgagc

SEQ ID NO: 1101649 - RNA, 11 nt, Mycobacterium bovis subsp bovis AF2122/97
ggccaccaucg

SEQ ID NO: 1101650 - RNA, 18 nt, Mycobacterium bovis subsp bovis AF2122/97
ggccaccaucgccgccgu

SEQ ID NO: 1101651 - RNA, 22 nt, Mycobacterium bovis subsp bovis AF2122/97
ggccaccaucgccgccguugcc

SEQ ID NO: 1101652 - RNA, 14 nt, Mycobacterium bovis subsp bovis AF2122/97
ggccaccagcgccc

SEQ ID NO: 1101653 - RNA, 15 nt, Mycobacterium bovis subsp bovis AF2122/97
ggccaccagcgcccg

SEQ ID NO: 1101654 - RNA, 18 nt, Mycobacterium bovis subsp bovis AF2122/97
ggccaccagcgcccggcc

SEQ ID NO: 1101655 - RNA, 23 nt, Mycobacterium bovis subsp bovis AF2122/97
ggccaccagcgcccggcccgcca

SEQ ID NO: 1101656 - RNA, 14 nt, Mycobacterium bovis subsp bovis AF2122/97
ggccaccagggcca

SEQ ID NO: 1101657 - RNA, 21 nt, Mycobacterium bovis subsp bovis AF2122/97
ggccaccagggccaccgcgcc

SEQ ID NO: 1101658 - RNA, 14 nt, Mycobacterium bovis subsp bovis AF2122/97
ggccacgccggcgu

SEQ ID NO: 1101659 - RNA, 21 nt, Mycobacterium bovis subsp bovis AF2122/97
ggccacugccgaccagcgcgc

SEQ ID NO: 1101660 - RNA, 18 nt, Mycobacterium bovis subsp bovis AF2122/97
ggccacgaccucgggauc

SEQ ID NO: 1101661 - RNA, 18 nt, Mycobacterium bovis subsp bovis AF2122/97
ggccacgccagcucgccg

SEQ ID NO: 1101662 - RNA, 14 nt, Mycobacterium bovis subsp bovis AF2122/97
ggccacccgcagac

SEQ ID NO: 1101663 - RNA, 13 nt, Mycobacterium bovis subsp bovis AF2122/97
ggccacccgcagg

SEQ ID NO: 1101664 - RNA, 13 nt, Mycobacterium bovis subsp bovis AF2122/97
ggccacgauccgc

SEQ ID NO: 1101665 - RNA, 13 nt, Mycobacterium bovis subsp bovis AF2122/97
ggccagcaggaug

SEQ ID NO: 1101666 - RNA, 16 nt, Mycobacterium bovis subsp bovis AF2122/97
ggccagcaggaugaug

SEQ ID NO: 1101667 - RNA, 19 nt, Mycobacterium bovis subsp bovis AF2122/97
ggccagcagggccaccacc

SEQ ID NO: 1101668 - RNA, 14 nt, Mycobacterium bovis subsp bovis AF2122/97
ggccagcaggcggc

SEQ ID NO: 1101669 - RNA, 13 nt, Mycobacterium bovis subsp bovis AF2122/97
ggccagcaggguu

SEQ ID NO: 1101670 - RNA, 17 nt, Mycobacterium bovis subsp bovis AF2122/97
ggccagcccgagcucgg

SEQ ID NO: 1101671 - RNA, 13 nt, Mycobacterium bovis subsp bovis AF2122/97
ggccagccgacgc

SEQ ID NO: 1101672 - RNA, 17 nt, Mycobacterium bovis subsp bovis AF2122/97
ggccagccgcuccacgu

SEQ ID NO: 1101673 - RNA, 13 nt, Mycobacterium bovis subsp bovis AF2122/97
ggccagaucgccg

SEQ ID NO: 1101674 - RNA, 20 nt, Mycobacterium bovis subsp bovis AF2122/97
ggccagaucacgcacucgcg

SEQ ID NO: 1101675 - RNA, 17 nt, Mycobacterium bovis subsp bovis AF2122/97
ggccagcagccgcgacg

SEQ ID NO: 1101676 - RNA, 21 nt, Mycobacterium bovis subsp bovis AF2122/97
ggccagcagccgcgacgcggc

SEQ ID NO: 1101677 - RNA, 22 nt, Mycobacterium bovis subsp bovis AF2122/97
ggccagcagccgcgacgcggcg

SEQ ID NO: 1101678 - RNA, 21 nt, Mycobacterium bovis subsp bovis AF2122/97
ggccagcagcgacuccagcgc

SEQ ID NO: 1101679 - RNA, 23 nt, Mycobacterium bovis subsp bovis AF2122/97
ggccagacccgaauccaccagcu

SEQ ID NO: 1101680 - RNA, 12 nt, Mycobacterium bovis subsp bovis AF2122/97
ggccagaccgaa

SEQ ID NO: 1101681 - RNA, 21 nt, Mycobacterium bovis subsp bovis AF2122/97
ggccagagccgcgcgccgguu

SEQ ID NO: 1101682 - RNA, 20 nt, Mycobacterium bovis subsp bovis AF2122/97
ggccagaguuaccaggucgg

SEQ ID NO: 1101683 - RNA, 14 nt, Mycobacterium bovis subsp bovis AF2122/97
ggccagaaacccgg

SEQ ID NO: 1101684 - RNA, 19 nt, Mycobacterium bovis subsp bovis AF2122/97
ggccagaaacgcgauggug

SEQ ID NO: 1101685 - RNA, 16 nt, Mycobacterium bovis subsp bovis AF2122/97
ggccacuugaugcucg

SEQ ID NO: 1101686 - RNA, 23 nt, Mycobacterium bovis subsp bovis AF2122/97
ggccacuggccgguucgcccgag

SEQ ID NO: 1101687 - RNA, 13 nt, Mycobacterium bovis subsp bovis AF2122/97
ggccaccaccacg

SEQ ID NO: 1101688 - RNA, 15 nt, Mycobacterium bovis subsp bovis AF2122/97
ggccaccaccacggc

SEQ ID NO: 1101689 - RNA, 20 nt, Mycobacterium bovis subsp bovis AF2122/97
ggccaccaaccucaucgcgg

SEQ ID NO: 1101690 - RNA, 13 nt, Mycobacterium bovis subsp bovis AF2122/97
ggccaccacaacg

SEQ ID NO: 1101691 - RNA, 14 nt, Mycobacterium bovis subsp bovis AF2122/97
ggccacaugccaca

SEQ ID NO: 1101692 - RNA, 20 nt, Mycobacterium bovis subsp bovis AF2122/97
ggccacaugccacagcggcg

SEQ ID NO: 1101693 - RNA, 19 nt, Mycobacterium bovis subsp bovis AF2122/97
ggccacaccuuggccgccg

SEQ ID NO: 1101694 - RNA, 21 nt, Mycobacterium bovis subsp bovis AF2122/97
ggccacaccuuggccgccggc

SEQ ID NO: 1101695 - RNA, 20 nt, Mycobacterium bovis subsp bovis AF2122/97
ggccacacucagcacccaau

SEQ ID NO: 1101696 - RNA, 22 nt, Mycobacterium bovis subsp bovis AF2122/97
ggccacagcaacgugugcacca

SEQ ID NO: 1101697 - RNA, 18 nt, Mycobacterium bovis subsp bovis AF2122/97
ggccaauagaagcacguc

SEQ ID NO: 1101698 - RNA, 20 nt, Mycobacterium bovis subsp bovis AF2122/97
ggccaauagaagcacgucgu

SEQ ID NO: 1101699 - RNA, 15 nt, Mycobacterium bovis subsp bovis AF2122/97
ggccaagccggcgag

SEQ ID NO: 1101700 - RNA, 17 nt, Mycobacterium bovis subsp bovis AF2122/97
ggccaagguggccacca

SEQ ID NO: 1101701 - RNA, 18 nt, Mycobacterium bovis subsp bovis AF2122/97
ggccaagucagcccgaag

SEQ ID NO: 1101702 - RNA, 17 nt, Mycobacterium bovis subsp bovis AF2122/97
ggccaacuuggcggcca

SEQ ID NO: 1101703 - RNA, 22 nt, Mycobacterium bovis subsp bovis AF2122/97
ggccaagacuucuccgcguccg

SEQ ID NO: 1101704 - RNA, 16 nt, Mycobacterium bovis subsp bovis AF2122/97
ggccaacucggcgaug

SEQ ID NO: 1101705 - RNA, 19 nt, Mycobacterium bovis subsp bovis AF2122/97
ggccaacuucugcacgaac

SEQ ID NO: 1101706 - RNA, 14 nt, Mycobacterium bovis subsp bovis AF2122/97
ggccaagaucggcg

SEQ ID NO: 1101707 - RNA, 19 nt, Mycobacterium bovis subsp bovis AF2122/97
ggccaacgacggccgacaa

SEQ ID NO: 1101708 - RNA, 17 nt, Mycobacterium bovis subsp bovis AF2122/97
ggccaacggcgcugccg

SEQ ID NO: 1101709 - RNA, 11 nt, Mycobacterium bovis subsp bovis AF2122/97
ggccaacggca

SEQ ID NO: 1101710 - RNA, 14 nt, Mycobacterium bovis subsp bovis AF2122/97
ggccaacgccgccg

SEQ ID NO: 1101711 - RNA, 18 nt, Mycobacterium bovis subsp bovis AF2122/97
ggccaaccgggugugcgu

SEQ ID NO: 1101712 - RNA, 18 nt, Mycobacterium bovis subsp bovis AF2122/97
ggccaacccugcggcguc

SEQ ID NO: 1101713 - RNA, 15 nt, Mycobacterium bovis subsp bovis AF2122/97
ggccaacccgggccg

SEQ ID NO: 1101714 - RNA, 17 nt, Mycobacterium bovis subsp bovis AF2122/97
ggcauugcgcccaccga

SEQ ID NO: 1101715 - RNA, 15 nt, Mycobacterium bovis subsp bovis AF2122/97
ggcauugcggcccgc

SEQ ID NO: 1101716 - RNA, 18 nt, Mycobacterium bovis subsp bovis AF2122/97
ggcauugcggcgcgggug

SEQ ID NO: 1101717 - RNA, 18 nt, Mycobacterium bovis subsp bovis AF2122/97
ggcauugcuccgguuggc

SEQ ID NO: 1101718 - RNA, 19 nt, Mycobacterium bovis subsp bovis AF2122/97
ggcauucucgagcacccgc

SEQ ID NO: 1101719 - RNA, 15 nt, Mycobacterium bovis subsp bovis AF2122/97
ggcauugaccaccga

SEQ ID NO: 1101720 - RNA, 14 nt, Mycobacterium bovis subsp bovis AF2122/97
ggcauugccgccag

SEQ ID NO: 1101721 - RNA, 15 nt, Mycobacterium bovis subsp bovis AF2122/97
ggcauugccgccagc

SEQ ID NO: 1101722 - RNA, 15 nt, Mycobacterium bovis subsp bovis AF2122/97
ggcauugcccgagcc

SEQ ID NO: 1101723 - RNA, 20 nt, Mycobacterium bovis subsp bovis AF2122/97
ggcauugcccgagcccagcg

SEQ ID NO: 1101724 - RNA, 22 nt, Mycobacterium bovis subsp bovis AF2122/97
ggcauggcgccguugccggcgu

SEQ ID NO: 1101725 - RNA, 13 nt, Mycobacterium bovis subsp bovis AF2122/97
ggcauggcgccgu

SEQ ID NO: 1101726 - RNA, 15 nt, Mycobacterium bovis subsp bovis AF2122/97
ggcauggcgccguug

SEQ ID NO: 1101727 - RNA, 16 nt, Mycobacterium bovis subsp bovis AF2122/97
ggcauggucaggcggc

SEQ ID NO: 1101728 - RNA, 14 nt, Mycobacterium bovis subsp bovis AF2122/97
ggcauggucgccgg

SEQ ID NO: 1101729 - RNA, 22 nt, Mycobacterium bovis subsp bovis AF2122/97
ggcauguauuucgugccggcgu

SEQ ID NO: 1101730 - RNA, 19 nt, Mycobacterium bovis subsp bovis AF2122/97
ggcauguaccgaccgcguu

SEQ ID NO: 1101731 - RNA, 20 nt, Mycobacterium bovis subsp bovis AF2122/97
ggcauguaccgaccgcguug

SEQ ID NO: 1101732 - RNA, 14 nt, Mycobacterium bovis subsp bovis AF2122/97
ggcauucgucgagu

SEQ ID NO: 1101733 - RNA, 16 nt, Mycobacterium bovis subsp bovis AF2122/97
ggcauucccgcggcaa

SEQ ID NO: 1101734 - RNA, 16 nt, Mycobacterium bovis subsp bovis AF2122/97
ggcauucccgcucgca

SEQ ID NO: 1101735 - RNA, 15 nt, Mycobacterium bovis subsp bovis AF2122/97
ggcauuccggugugc

SEQ ID NO: 1101736 - RNA, 18 nt, Mycobacterium bovis subsp bovis AF2122/97
ggcaugggccggcgccgc

SEQ ID NO: 1101737 - RNA, 23 nt, Mycobacterium bovis subsp bovis AF2122/97
ggcauuaggccggggucgaacgc

SEQ ID NO: 1101738 - RNA, 13 nt, Mycobacterium bovis subsp bovis AF2122/97
ggcauucaccgcg

SEQ ID NO: 1101739 - RNA, 14 nt, Mycobacterium bovis subsp bovis AF2122/97
ggcaucaucgacgc

SEQ ID NO: 1101740 - RNA, 22 nt, Mycobacterium bovis subsp bovis AF2122/97
ggcaucaagaaacguggugacg

SEQ ID NO: 1101741 - RNA, 14 nt, Mycobacterium bovis subsp bovis AF2122/97
ggcaucaccgacgc

SEQ ID NO: 1101742 - RNA, 22 nt, Mycobacterium bovis subsp bovis AF2122/97
ggcaucaccgacgcgucggcga

SEQ ID NO: 1101743 - RNA, 14 nt, Mycobacterium bovis subsp bovis AF2122/97
ggcaucaccgccgc

SEQ ID NO: 1101744 - RNA, 18 nt, Mycobacterium bovis subsp bovis AF2122/97
ggcaucaccgccgcggcc

SEQ ID NO: 1101745 - RNA, 19 nt, Mycobacterium bovis subsp bovis AF2122/97
ggcaucaccgccgcggccg

SEQ ID NO: 1101746 - RNA, 20 nt, Mycobacterium bovis subsp bovis AF2122/97
ggcauacccaucaacaucgg

SEQ ID NO: 1101747 - RNA, 22 nt, Mycobacterium bovis subsp bovis AF2122/97
ggcauagaucgggucguuggcg

SEQ ID NO: 1101748 - RNA, 19 nt, Mycobacterium bovis subsp bovis AF2122/97
ggcauagcucagaccggcg

SEQ ID NO: 1101749 - RNA, 20 nt, Mycobacterium bovis subsp bovis AF2122/97
ggcauagcucagaccggcgc

SEQ ID NO: 1101750 - RNA, 22 nt, Mycobacterium bovis subsp bovis AF2122/97
ggcauaggaucgcgcccaccga

SEQ ID NO: 1101751 - RNA, 16 nt, Mycobacterium bovis subsp bovis AF2122/97
ggcauagcagccagcg

SEQ ID NO: 1101752 - RNA, 20 nt, Mycobacterium bovis subsp bovis AF2122/97
ggcgcgcagguagcgcucga

SEQ ID NO: 1101753 - RNA, 15 nt, Mycobacterium bovis subsp bovis AF2122/97
ggcgcgccccaccgc

SEQ ID NO: 1101754 - RNA, 18 nt, Mycobacterium bovis subsp bovis AF2122/97
ggcgcgccccaccgcgcc

SEQ ID NO: 1101755 - RNA, 21 nt, Mycobacterium bovis subsp bovis AF2122/97
ggcgcgccccaccgcgccgag

SEQ ID NO: 1101756 - RNA, 19 nt, Mycobacterium bovis subsp bovis AF2122/97
ggcgcgccccgccgcacgc

SEQ ID NO: 1101757 - RNA, 12 nt, Mycobacterium bovis subsp bovis AF2122/97
ggcgcgcccaca

SEQ ID NO: 1101758 - RNA, 18 nt, Mycobacterium bovis subsp bovis AF2122/97
ggcgcgccgcaucggcga

SEQ ID NO: 1101759 - RNA, 18 nt, Mycobacterium bovis subsp bovis AF2122/97
ggcgcgccgaucggcacc

SEQ ID NO: 1101760 - RNA, 21 nt, Mycobacterium bovis subsp bovis AF2122/97
ggcgcgccgaucggcaccgug

SEQ ID NO: 1101761 - RNA, 21 nt, Mycobacterium bovis subsp bovis AF2122/97
ggcgcgccggucgccgacggc

SEQ ID NO: 1101762 - RNA, 23 nt, Mycobacterium bovis subsp bovis AF2122/97
ggcgcgccguacguucaccaccg

SEQ ID NO: 1101763 - RNA, 18 nt, Mycobacterium bovis subsp bovis AF2122/97
ggcgcgcucaucgaccgc

SEQ ID NO: 1101764 - RNA, 19 nt, Mycobacterium bovis subsp bovis AF2122/97
ggcgcgcucaucgaccggg

SEQ ID NO: 1101765 - RNA, 16 nt, Mycobacterium bovis subsp bovis AF2122/97
ggcgcgcugcccacgg

SEQ ID NO: 1101766 - RNA, 17 nt, Mycobacterium bovis subsp bovis AF2122/97
ggcgcgcuggcgggcgg

SEQ ID NO: 1101767 - RNA, 15 nt, Mycobacterium bovis subsp bovis AF2122/97
ggcgcgcaccccggc

SEQ ID NO: 1101768 - RNA, 17 nt, Mycobacterium bovis subsp bovis AF2122/97
ggcgcgcaccccggcau

SEQ ID NO: 1101769 - RNA, 14 nt, Mycobacterium bovis subsp bovis AF2122/97
ggcgcgcaccucgg

SEQ ID NO: 1101770 - RNA, 21 nt, Mycobacterium bovis subsp bovis AF2122/97
ggcgcgauagauacccgcggc

SEQ ID NO: 1101771 - RNA, 21 nt, Mycobacterium bovis subsp bovis AF2122/97
ggcgcgcaucugcucggcauc

SEQ ID NO: 1101772 - RNA, 16 nt, Mycobacterium bovis subsp bovis AF2122/97
ggcgcgauccccgcgc

SEQ ID NO: 1101773 - RNA, 24 nt, Mycobacterium bovis subsp bovis AF2122/97
ggcgcgaucgcucauucgugcccg

SEQ ID NO: 1101774 - RNA, 12 nt, Mycobacterium bovis subsp bovis AF2122/97
ggcgcgauucag

SEQ ID NO: 1101775 - RNA, 18 nt, Mycobacterium bovis subsp bovis AF2122/97
ggcgcgauacagacgggg

SEQ ID NO: 1101776 - RNA, 21 nt, Mycobacterium bovis subsp bovis AF2122/97
ggcgcgauacagacggggauc

SEQ ID NO: 1101777 - RNA, 13 nt, Mycobacterium bovis subsp bovis AF2122/97
ggcgcaccggcgu

SEQ ID NO: 1101778 - RNA, 14 nt, Mycobacterium bovis subsp bovis AF2122/97
ggcgcggcggcguc

SEQ ID NO: 1101779 - RNA, 17 nt, Mycobacterium bovis subsp bovis AF2122/97
ggcgcguggucgggaac

SEQ ID NO: 1101780 - RNA, 20 nt, Mycobacterium bovis subsp bovis AF2122/97
ggcgcggccgugaacggcgc

SEQ ID NO: 1101781 - RNA, 21 nt, Mycobacterium bovis subsp bovis AF2122/97
ggcgcuaccagccauagugcg

SEQ ID NO: 1101782 - RNA, 23 nt, Mycobacterium bovis subsp bovis AF2122/97
ggcgcucgcggcggcgcuggcgg

SEQ ID NO: 1101783 - RNA, 14 nt, Mycobacterium bovis subsp bovis AF2122/97
ggcgcucggcgagc

SEQ ID NO: 1101784 - RNA, 16 nt, Mycobacterium bovis subsp bovis AF2122/97
ggcgcucgcgcgcugg

SEQ ID NO: 1101785 - RNA, 13 nt, Mycobacterium bovis subsp bovis AF2122/97
ggcgcuagcgccg

SEQ ID NO: 1101786 - RNA, 16 nt, Mycobacterium bovis subsp bovis AF2122/97
ggcgcuagcgccgcgc

SEQ ID NO: 1101787 - RNA, 16 nt, Mycobacterium bovis subsp bovis AF2122/97
ggcgcugccaggccgc

SEQ ID NO: 1101788 - RNA, 23 nt, Mycobacterium bovis subsp bovis AF2122/97
ggcgcuggugcgccacgccaccg

SEQ ID NO: 1101789 - RNA, 14 nt, Mycobacterium bovis subsp bovis AF2122/97
ggcgcugccgggau

SEQ ID NO: 1101790 - RNA, 15 nt, Mycobacterium bovis subsp bovis AF2122/97
ggcgcugccgggauc

SEQ ID NO: 1101791 - RNA, 17 nt, Mycobacterium bovis subsp bovis AF2122/97
ggcgcugcagcugcucg

SEQ ID NO: 1101792 - RNA, 13 nt, Mycobacterium bovis subsp bovis AF2122/97
ggcgcugcgcacc

SEQ ID NO: 1101793 - RNA, 14 nt, Mycobacterium bovis subsp bovis AF2122/97
ggcgcugcgcgauc

SEQ ID NO: 1101794 - RNA, 14 nt, Mycobacterium bovis subsp bovis AF2122/97
ggcgcugaucgcgc

SEQ ID NO: 1101795 - RNA, 19 nt, Mycobacterium bovis subsp bovis AF2122/97
ggcgcugaucgcgcgcacc

SEQ ID NO: 1101796 - RNA, 15 nt, Mycobacterium bovis subsp bovis AF2122/97
ggcgcugaugcuggc

SEQ ID NO: 1101797 - RNA, 12 nt, Mycobacterium bovis subsp bovis AF2122/97
ggcggcaucccc

SEQ ID NO: 1101798 - RNA, 17 nt, Mycobacterium bovis subsp bovis AF2122/97
ggcggcaucucgcaccg

SEQ ID NO: 1101799 - RNA, 18 nt, Mycobacterium bovis subsp bovis AF2122/97
ggcggccaccgucagcgc

SEQ ID NO: 1101800 - RNA, 11 nt, Mycobacterium bovis subsp bovis AF2122/97
ggcggccaccg

SEQ ID NO: 1101801 - RNA, 14 nt, Mycobacterium bovis subsp bovis AF2122/97
ggcggccaccgcac

SEQ ID NO: 1101802 - RNA, 20 nt, Mycobacterium bovis subsp bovis AF2122/97
ggcggccaccgucagcgcga

SEQ ID NO: 1101803 - RNA, 18 nt, Mycobacterium bovis subsp bovis AF2122/97
ggcggccaaggucgaccc

SEQ ID NO: 1101804 - RNA, 23 nt, Mycobacterium bovis subsp bovis AF2122/97
ggcggccaccgucagcgcgaccg

SEQ ID NO: 1101805 - RNA, 15 nt, Mycobacterium bovis subsp bovis AF2122/97
ggcggccacgccggc

SEQ ID NO: 1101806 - RNA, 16 nt, Mycobacterium bovis subsp bovis AF2122/97
ggcggccacgccggcg

SEQ ID NO: 1101807 - RNA, 13 nt, Mycobacterium bovis subsp bovis AF2122/97
ggcggccagcgca

SEQ ID NO: 1101808 - RNA, 20 nt, Mycobacterium bovis subsp bovis AF2122/97
ggcggccagcaucgcggugg

SEQ ID NO: 1101809 - RNA, 15 nt, Mycobacterium bovis subsp bovis AF2122/97
ggcggccagcaucgg

SEQ ID NO: 1101810 - RNA, 22 nt, Mycobacterium bovis subsp bovis AF2122/97
ggcggcccgcucgggguugcuc

SEQ ID NO: 1101811 - RNA, 18 nt, Mycobacterium bovis subsp bovis AF2122/97
ggcggcccggguuggccg

SEQ ID NO: 1101812 - RNA, 18 nt, Mycobacterium bovis subsp bovis AF2122/97
ggcggcccggccgaacgc

SEQ ID NO: 1101813 - RNA, 15 nt, Mycobacterium bovis subsp bovis AF2122/97
ggcggccgagcgcac

SEQ ID NO: 1101814 - RNA, 16 nt, Mycobacterium bovis subsp bovis AF2122/97
ggcggccgagcgcacc

SEQ ID NO: 1101815 - RNA, 16 nt, Mycobacterium bovis subsp bovis AF2122/97
ggcggccgcagcggcc

SEQ ID NO: 1101816 - RNA, 17 nt, Mycobacterium bovis subsp bovis AF2122/97
ggcggccgccaguucgg

SEQ ID NO: 1101817 - RNA, 12 nt, Mycobacterium bovis subsp bovis AF2122/97
ggcggccgccgc

SEQ ID NO: 1101818 - RNA, 18 nt, Mycobacterium bovis subsp bovis AF2122/97
ggcggaaggacggcagcc

SEQ ID NO: 1101819 - RNA, 16 nt, Mycobacterium bovis subsp bovis AF2122/97
ggcggaauaucggccg

SEQ ID NO: 1101820 - RNA, 17 nt, Mycobacterium bovis subsp bovis AF2122/97
ggcggaauaucggccga

SEQ ID NO: 1101821 - RNA, 15 nt, Mycobacterium bovis subsp bovis AF2122/97
ggcggaacgaugccg

SEQ ID NO: 1101822 - RNA, 14 nt, Mycobacterium bovis subsp bovis AF2122/97
ggcggaagaccgga

SEQ ID NO: 1101823 - RNA, 13 nt, Mycobacterium bovis subsp bovis AF2122/97
ggcggaagcggcg

SEQ ID NO: 1101824 - RNA, 17 nt, Mycobacterium bovis subsp bovis AF2122/97
ggcggaagcggcggccc

SEQ ID NO: 1101825 - RNA, 17 nt, Mycobacterium bovis subsp bovis AF2122/97
ggcggaaggacggcagc

SEQ ID NO: 1101826 - RNA, 21 nt, Mycobacterium bovis subsp bovis AF2122/97
ggcggaaauggcgucgccggc

SEQ ID NO: 1101827 - RNA, 19 nt, Mycobacterium bovis subsp bovis AF2122/97
ggcggaacaccgacgacac

SEQ ID NO: 1101828 - RNA, 22 nt, Mycobacterium bovis subsp bovis AF2122/97
ggcggaacagcuucgcgcagcc

SEQ ID NO: 1101829 - RNA, 24 nt, Mycobacterium bovis subsp bovis AF2122/97
ggcggaacagcuucgcgcagccgg

SEQ ID NO: 1101830 - RNA, 20 nt, Mycobacterium bovis subsp bovis AF2122/97
ggcggaaacaaccccgcggu

SEQ ID NO: 1101831 - RNA, 23 nt, Mycobacterium bovis subsp bovis AF2122/97
ggcggacaccucgggcgcccgcg

SEQ ID NO: 1101832 - RNA, 14 nt, Mycobacterium bovis subsp bovis AF2122/97
ggcggcacgcucgc

SEQ ID NO: 1101833 - RNA, 16 nt, Mycobacterium bovis subsp bovis AF2122/97
ggcggcacgcucgcgc

SEQ ID NO: 1101834 - RNA, 15 nt, Mycobacterium bovis subsp bovis AF2122/97
ggcggcaagggcggc

SEQ ID NO: 1101835 - RNA, 16 nt, Mycobacterium bovis subsp bovis AF2122/97
ggcggcaagggcggca

SEQ ID NO: 1101836 - RNA, 17 nt, Mycobacterium bovis subsp bovis AF2122/97
ggcggcaagggcggcaa

SEQ ID NO: 1101837 - RNA, 20 nt, Mycobacterium bovis subsp bovis AF2122/97
ggcggcaaggguggggccgg

SEQ ID NO: 1101838 - RNA, 18 nt, Mycobacterium bovis subsp bovis AF2122/97
ggcggcaacggcggcauc

SEQ ID NO: 1101839 - RNA, 18 nt, Mycobacterium bovis subsp bovis AF2122/97
ggcggcaacggcggcgac

SEQ ID NO: 1101840 - RNA, 17 nt, Mycobacterium bovis subsp bovis AF2122/97
ggcggcaagcucgacga

SEQ ID NO: 1101841 - RNA, 16 nt, Mycobacterium bovis subsp bovis AF2122/97
ggcggcagcacccaca

SEQ ID NO: 1101842 - RNA, 21 nt, Mycobacterium bovis subsp bovis AF2122/97
ggcggcacuggauccgggagu

SEQ ID NO: 1101843 - RNA, 19 nt, Mycobacterium bovis subsp bovis AF2122/97
ggcggcacgcucgcgcacc

SEQ ID NO: 1101844 - RNA, 13 nt, Mycobacterium bovis subsp bovis AF2122/97
ggcggcacgcuga

SEQ ID NO: 1101845 - RNA, 13 nt, Mycobacterium bovis subsp bovis AF2122/97
ggcggcagcggcg

SEQ ID NO: 1101846 - RNA, 20 nt, Mycobacterium bovis subsp bovis AF2122/97
ggcggcagcgaggcucgcag

SEQ ID NO: 1101847 - RNA, 22 nt, Mycobacterium bovis subsp bovis AF2122/97
ggcggcagcgagucgacgucga

SEQ ID NO: 1101848 - RNA, 15 nt, Mycobacterium bovis subsp bovis AF2122/97
ggcggcaggccggcc

SEQ ID NO: 1101849 - RNA, 14 nt, Mycobacterium bovis subsp bovis AF2122/97
ggcggcaucgccga

SEQ ID NO: 1101850 - RNA, 15 nt, Mycobacterium bovis subsp bovis AF2122/97
ggcggcaucgccgag

SEQ ID NO: 1101851 - RNA, 21 nt, Mycobacterium bovis subsp bovis AF2122/97
ggcggcaucgaguucggcccg

SEQ ID NO: 1101852 - RNA, 13 nt, Mycobacterium bovis subsp bovis AF2122/97
ggcggcaucgccg

SEQ ID NO: 1101853 - RNA, 18 nt, Mycobacterium bovis subsp bovis AF2122/97
ggcggcaggugcggcggc

SEQ ID NO: 1101854 - RNA, 18 nt, Mycobacterium bovis subsp bovis AF2122/97
ggcggcauagcucagacc

SEQ ID NO: 1101855 - RNA, 18 nt, Mycobacterium bovis subsp bovis AF2122/97
ggcggcagucgcgguacc

SEQ ID NO: 1101856 - RNA, 15 nt, Mycobacterium bovis subsp bovis AF2122/97
ggcggcgacggccgc

SEQ ID NO: 1101857 - RNA, 16 nt, Mycobacterium bovis subsp bovis AF2122/97
ggcggcgacggccgcu

SEQ ID NO: 1101858 - RNA, 13 nt, Mycobacterium bovis subsp bovis AF2122/97
ggcggcgacgccg

SEQ ID NO: 1101859 - RNA, 11 nt, Mycobacterium bovis subsp bovis AF2122/97
ggcggcgccgg

SEQ ID NO: 1101860 - RNA, 13 nt, Mycobacterium bovis subsp bovis AF2122/97
ggcggcgccgcag

SEQ ID NO: 1101861 - RNA, 13 nt, Mycobacterium bovis subsp bovis AF2122/97
ggcggcgaccgcc

SEQ ID NO: 1101862 - RNA, 16 nt, Mycobacterium bovis subsp bovis AF2122/97
ggcggcgaccgccagc

SEQ ID NO: 1101863 - RNA, 21 nt, Mycobacterium bovis subsp bovis AF2122/97
ggcggcgaccgccagcgugga

SEQ ID NO: 1101864 - RNA, 19 nt, Mycobacterium bovis subsp bovis AF2122/97
ggcggcgaacucggcgaug

SEQ ID NO: 1101865 - RNA, 11 nt, Mycobacterium bovis subsp bovis AF2122/97
ggcggcgacgc

SEQ ID NO: 1101866 - RNA, 14 nt, Mycobacterium bovis subsp bovis AF2122/97
ggcggcgacgagcg

SEQ ID NO: 1101867 - RNA, 19 nt, Mycobacterium bovis subsp bovis AF2122/97
ggcggcgaccucggcggcg

SEQ ID NO: 1101868 - RNA, 13 nt, Mycobacterium bovis subsp bovis AF2122/97
ggcggccuugccg

SEQ ID NO: 1101869 - RNA, 13 nt, Mycobacterium bovis subsp bovis AF2122/97
ggcggccgccggg

SEQ ID NO: 1101870 - RNA, 18 nt, Mycobacterium bovis subsp bovis AF2122/97
ggcggccuucggccggcg

SEQ ID NO: 1101871 - RNA, 21 nt, Mycobacterium bovis subsp bovis AF2122/97
ggcggccuugccgggccgcgc

SEQ ID NO: 1101872 - RNA, 19 nt, Mycobacterium bovis subsp bovis AF2122/97
ggcggcgccggaggcggcg

SEQ ID NO: 1101873 - RNA, 20 nt, Mycobacterium bovis subsp bovis AF2122/97
ggcggcgccggaggcggcgc

SEQ ID NO: 1101874 - RNA, 17 nt, Mycobacterium bovis subsp bovis AF2122/97
ggcggcgccggccucgc

SEQ ID NO: 1101875 - RNA, 14 nt, Mycobacterium bovis subsp bovis AF2122/97
ggcggcgccggcgc

SEQ ID NO: 1101876 - RNA, 13 nt, Mycobacterium bovis subsp bovis AF2122/97
ggcggcggcacgc

SEQ ID NO: 1101877 - RNA, 18 nt, Mycobacterium bovis subsp bovis AF2122/97
ggcggcggauuccggcau

SEQ ID NO: 1101878 - RNA, 13 nt, Mycobacterium bovis subsp bovis AF2122/97
ggcggcgccgaag

SEQ ID NO: 1101879 - RNA, 15 nt, Mycobacterium bovis subsp bovis AF2122/97
ggcggcggcgcgauc

SEQ ID NO: 1101880 - RNA, 23 nt, Mycobacterium bovis subsp bovis AF2122/97
ggcggcggccauagugaggccga

SEQ ID NO: 1101881 - RNA, 14 nt, Mycobacterium bovis subsp bovis AF2122/97
ggcggcggccagcc

SEQ ID NO: 1101882 - RNA, 14 nt, Mycobacterium bovis subsp bovis AF2122/97
ggcggcggcggcaa

SEQ ID NO: 1101883 - RNA, 15 nt, Mycobacterium bovis subsp bovis AF2122/97
ggcggcggcggcaac

SEQ ID NO: 1101884 - RNA, 14 nt, Mycobacterium bovis subsp bovis AF2122/97
ggcggcggcggccc

SEQ ID NO: 1101885 - RNA, 14 nt, Mycobacterium bovis subsp bovis AF2122/97
ggcggcggcguagc

SEQ ID NO: 1101886 - RNA, 20 nt, Mycobacterium bovis subsp bovis AF2122/97
ggcggcggugguaccggcgc

SEQ ID NO: 1101887 - RNA, 22 nt, Mycobacterium bovis subsp bovis AF2122/97
ggcggcggugguaccggcgcca

SEQ ID NO: 1101888 - RNA, 14 nt, Mycobacterium bovis subsp bovis AF2122/97
ggcggcgggccucg

SEQ ID NO: 1101889 - RNA, 18 nt, Mycobacterium bovis subsp bovis AF2122/97
ggcggcgggccucggcga

SEQ ID NO: 1101890 - RNA, 17 nt, Mycobacterium bovis subsp bovis AF2122/97
ggcggcgggggcggcgg

SEQ ID NO: 1101891 - RNA, 17 nt, Mycobacterium bovis subsp bovis AF2122/97
ggcggcggucaccaccg

SEQ ID NO: 1101892 - RNA, 16 nt, Mycobacterium bovis subsp bovis AF2122/97
ggcggcguccaucgcg

SEQ ID NO: 1101893 - RNA, 22 nt, Mycobacterium bovis subsp bovis AF2122/97
ggcggcgucgacggcuccuccg

SEQ ID NO: 1101894 - RNA, 20 nt, Mycobacterium bovis subsp bovis AF2122/97
ggcggcguccaccugcuccg

SEQ ID NO: 1101895 - RNA, 13 nt, Mycobacterium bovis subsp bovis AF2122/97
ggcggcguccagc

SEQ ID NO: 1101896 - RNA, 16 nt, Mycobacterium bovis subsp bovis AF2122/97
ggcggcguagcagaag

SEQ ID NO: 1101897 - RNA, 14 nt, Mycobacterium bovis subsp bovis AF2122/97
ggcggcgucugcgc

SEQ ID NO: 1101898 - RNA, 14 nt, Mycobacterium bovis subsp bovis AF2122/97
ggcggcguugagcu

SEQ ID NO: 1101899 - RNA, 19 nt, Mycobacterium bovis subsp bovis AF2122/97
ggcggcguugagcuggcgg

SEQ ID NO: 1101900 - RNA, 16 nt, Mycobacterium bovis subsp bovis AF2122/97
ggcggcguuugaggca

SEQ ID NO: 1101901 - RNA, 18 nt, Mycobacterium bovis subsp bovis AF2122/97
ggcggcuaggcaccagcg

SEQ ID NO: 1101902 - RNA, 16 nt, Mycobacterium bovis subsp bovis AF2122/97
ggcggcucacgaccgg

SEQ ID NO: 1101903 - RNA, 20 nt, Mycobacterium bovis subsp bovis AF2122/97
ggcggcucaaccucuggcgg

SEQ ID NO: 1101904 - RNA, 22 nt, Mycobacterium bovis subsp bovis AF2122/97
ggcggcucaaccucuggcggcg

SEQ ID NO: 1101905 - RNA, 17 nt, Mycobacterium bovis subsp bovis AF2122/97
ggcggcuuuggccgccg

SEQ ID NO: 1101906 - RNA, 13 nt, Mycobacterium bovis subsp bovis AF2122/97
ggcggcuccaccg

SEQ ID NO: 1101907 - RNA, 14 nt, Mycobacterium bovis subsp bovis AF2122/97
ggcggcuccaccgg

SEQ ID NO: 1101908 - RNA, 15 nt, Mycobacterium bovis subsp bovis AF2122/97
ggcggcuccaccggg

SEQ ID NO: 1101909 - RNA, 22 nt, Mycobacterium bovis subsp bovis AF2122/97
ggcggcuccaccgggcccgccg

SEQ ID NO: 1101910 - RNA, 16 nt, Mycobacterium bovis subsp bovis AF2122/97
ggcgggacucggcgag

SEQ ID NO: 1101911 - RNA, 14 nt, Mycobacterium bovis subsp bovis AF2122/97
ggcgggacgggggc

SEQ ID NO: 1101912 - RNA, 15 nt, Mycobacterium bovis subsp bovis AF2122/97
ggcgggaacgaucga

SEQ ID NO: 1101913 - RNA, 12 nt, Mycobacterium bovis subsp bovis AF2122/97
ggcguugccgcc

SEQ ID NO: 1101914 - RNA, 14 nt, Mycobacterium bovis subsp bovis AF2122/97
ggcguugccaccgg

SEQ ID NO: 1101915 - RNA, 18 nt, Mycobacterium bovis subsp bovis AF2122/97
ggcguugccaccggagcc

SEQ ID NO: 1101916 - RNA, 20 nt, Mycobacterium bovis subsp bovis AF2122/97
ggcguugcugaugucgccgg

SEQ ID NO: 1101917 - RNA, 22 nt, Mycobacterium bovis subsp bovis AF2122/97
ggcguugccgccggcuccaccc

SEQ ID NO: 1101918 - RNA, 13 nt, Mycobacterium bovis subsp bovis AF2122/97
ggcguugccgccu

SEQ ID NO: 1101919 - RNA, 14 nt, Mycobacterium bovis subsp bovis AF2122/97
ggcguuggcgccgu

SEQ ID NO: 1101920 - RNA, 14 nt, Mycobacterium bovis subsp bovis AF2122/97
ggcguuggcggcaa

SEQ ID NO: 1101921 - RNA, 14 nt, Mycobacterium bovis subsp bovis AF2122/97
ggcguuggcaugag

SEQ ID NO: 1101922 - RNA, 17 nt, Mycobacterium bovis subsp bovis AF2122/97
ggcuacaucggcggcgu

SEQ ID NO: 1101923 - RNA, 22 nt, Mycobacterium bovis subsp bovis AF2122/97
ggcuacaucggcggcgucgacg

SEQ ID NO: 1101924 - RNA, 17 nt, Mycobacterium bovis subsp bovis AF2122/97
ggcuacccaauaggcga

SEQ ID NO: 1101925 - RNA, 22 nt, Mycobacterium bovis subsp bovis AF2122/97
ggcuaccccagggagugccgca

SEQ ID NO: 1101926 - RNA, 20 nt, Mycobacterium bovis subsp bovis AF2122/97
ggcuaauagcucgccggcga

SEQ ID NO: 1101927 - RNA, 14 nt, Mycobacterium bovis subsp bovis AF2122/97
ggcuaacaccgcag

SEQ ID NO: 1101928 - RNA, 19 nt, Mycobacterium bovis subsp bovis AF2122/97
ggcgugggugucggcuagc

SEQ ID NO: 1101929 - RNA, 22 nt, Mycobacterium bovis subsp bovis AF2122/97
ggcguggucaccccuucgccag

SEQ ID NO: 1101930 - RNA, 20 nt, Mycobacterium bovis subsp bovis AF2122/97
ggcgugguagacggccugcg

SEQ ID NO: 1101931 - RNA, 24 nt, Mycobacterium bovis subsp bovis AF2122/97
ggcguggucaccccuucgccagcg

SEQ ID NO: 1101932 - RNA, 19 nt, Mycobacterium bovis subsp bovis AF2122/97
ggcguggucgcgcggcacc

SEQ ID NO: 1101933 - RNA, 23 nt, Mycobacterium bovis subsp bovis AF2122/97
ggcgugguggaaacugaugucgc

SEQ ID NO: 1101934 - RNA, 14 nt, Mycobacterium bovis subsp bovis AF2122/97
ggcguguacgucga

SEQ ID NO: 1101935 - RNA, 16 nt, Mycobacterium bovis subsp bovis AF2122/97
ggcguguacgucgauc

SEQ ID NO: 1101936 - RNA, 12 nt, Mycobacterium bovis subsp bovis AF2122/97
ggcgugucugcc

SEQ ID NO: 1101937 - RNA, 17 nt, Mycobacterium bovis subsp bovis AF2122/97
ggcguugagcuggcggu

SEQ ID NO: 1101938 - RNA, 13 nt, Mycobacterium bovis subsp bovis AF2122/97
ggcguugacgauc

SEQ ID NO: 1101939 - RNA, 20 nt, Mycobacterium bovis subsp bovis AF2122/97
ggcguugaccagcacgacug

SEQ ID NO: 1101940 - RNA, 18 nt, Mycobacterium bovis subsp bovis AF2122/97
ggcguuaaugcuucgcgu

SEQ ID NO: 1101941 - RNA, 14 nt, Mycobacterium bovis subsp bovis AF2122/97
ggcguuacgcucgg

SEQ ID NO: 1101942 - RNA, 19 nt, Mycobacterium bovis subsp bovis AF2122/97
ggcguuagcguagcccgag

SEQ ID NO: 1101943 - RNA, 13 nt, Mycobacterium bovis subsp bovis AF2122/97
ggcgugccccagu

SEQ ID NO: 1101944 - RNA, 22 nt, Mycobacterium bovis subsp bovis AF2122/97
ggcguggaagccgacgaccagc

SEQ ID NO: 1101945 - RNA, 23 nt, Mycobacterium bovis subsp bovis AF2122/97
ggcguggaucuuggccagcagcg

SEQ ID NO: 1101946 - RNA, 17 nt, Mycobacterium bovis subsp bovis AF2122/97
ggcguggccccaccgaa

SEQ ID NO: 1101947 - RNA, 17 nt, Mycobacterium bovis subsp bovis AF2122/97
ggcguggcccucggcga

SEQ ID NO: 1101948 - RNA, 14 nt, Mycobacterium bovis subsp bovis AF2122/97
ggcgugggaggugg

SEQ ID NO: 1101949 - RNA, 19 nt, Mycobacterium bovis subsp bovis AF2122/97
ggcgugggcaccccgcggu

SEQ ID NO: 1101950 - RNA, 20 nt, Mycobacterium bovis subsp bovis AF2122/97
ggcgugggugucggcgaagc

SEQ ID NO: 1101951 - RNA, 23 nt, Mycobacterium bovis subsp bovis AF2122/97
ggcgucgaagugggugaaccgga

SEQ ID NO: 1101952 - RNA, 23 nt, Mycobacterium bovis subsp bovis AF2122/97
ggcgucgaugacgacgccgucgg

SEQ ID NO: 1101953 - RNA, 21 nt, Mycobacterium bovis subsp bovis AF2122/97
ggcgucgauggccacccggug

SEQ ID NO: 1101954 - RNA, 23 nt, Mycobacterium bovis subsp bovis AF2122/97
ggcgucgauggccacccgguggc

SEQ ID NO: 1101955 - RNA, 23 nt, Mycobacterium bovis subsp bovis AF2122/97
ggcgucgaugucauccgacaagc

SEQ ID NO: 1101956 - RNA, 19 nt, Mycobacterium bovis subsp bovis AF2122/97
ggcgucgcaacgcgaucac

SEQ ID NO: 1101957 - RNA, 15 nt, Mycobacterium bovis subsp bovis AF2122/97
ggcgucgccgccauu

SEQ ID NO: 1101958 - RNA, 15 nt, Mycobacterium bovis subsp bovis AF2122/97
ggcgugacugguggc

SEQ ID NO: 1101959 - RNA, 19 nt, Mycobacterium bovis subsp bovis AF2122/97
ggcgugacugguggcgcca

SEQ ID NO: 1101960 - RNA, 23 nt, Mycobacterium bovis subsp bovis AF2122/97
ggcgugcagaauccguucgacga

SEQ ID NO: 1101961 - RNA, 15 nt, Mycobacterium bovis subsp bovis AF2122/97
ggcgugcagacccgg

SEQ ID NO: 1101962 - RNA, 19 nt, Mycobacterium bovis subsp bovis AF2122/97
ggcgugauagcccuugccg

SEQ ID NO: 1101963 - RNA, 12 nt, Mycobacterium bovis subsp bovis AF2122/97
ggcgugaucccg

SEQ ID NO: 1101964 - RNA, 16 nt, Mycobacterium bovis subsp bovis AF2122/97
ggcgugaucccgccca

SEQ ID NO: 1101965 - RNA, 18 nt, Mycobacterium bovis subsp bovis AF2122/97
ggcgugaucccgcccaag

SEQ ID NO: 1101966 - RNA, 14 nt, Mycobacterium bovis subsp bovis AF2122/97
ggcgugcagcaccc

SEQ ID NO: 1101967 - RNA, 13 nt, Mycobacterium bovis subsp bovis AF2122/97
ggcgugcaucgcg

SEQ ID NO: 1101968 - RNA, 20 nt, Mycobacterium bovis subsp bovis AF2122/97
ggcgugcaucgcgauuccgg

SEQ ID NO: 1101969 - RNA, 16 nt, Mycobacterium bovis subsp bovis AF2122/97
ggcucgaauacggugc

SEQ ID NO: 1101970 - RNA, 17 nt, Mycobacterium bovis subsp bovis AF2122/97
ggcuccuggucgccgug

SEQ ID NO: 1101971 - RNA, 16 nt, Mycobacterium bovis subsp bovis AF2122/97
ggcucgagucgcagca

SEQ ID NO: 1101972 - RNA, 15 nt, Mycobacterium bovis subsp bovis AF2122/97
ggcucgacugccacc

SEQ ID NO: 1101973 - RNA, 22 nt, Mycobacterium bovis subsp bovis AF2122/97
ggcucgaguguggccgaaagcc

SEQ ID NO: 1101974 - RNA, 23 nt, Mycobacterium bovis subsp bovis AF2122/97
ggcucgcauguucuccacgccga

SEQ ID NO: 1101975 - RNA, 23 nt, Mycobacterium bovis subsp bovis AF2122/97
ggcucgcaccgugaguacucggu

SEQ ID NO: 1101976 - RNA, 21 nt, Mycobacterium bovis subsp bovis AF2122/97
ggcucgcccgcuacggcagcc

SEQ ID NO: 1101977 - RNA, 13 nt, Mycobacterium bovis subsp bovis AF2122/97
ggcucgccgaacc

SEQ ID NO: 1101978 - RNA, 18 nt, Mycobacterium bovis subsp bovis AF2122/97
ggcucgccgacccgccgc

SEQ ID NO: 1101979 - RNA, 20 nt, Mycobacterium bovis subsp bovis AF2122/97
ggcucgccgacccgccgcgg

SEQ ID NO: 1101980 - RNA, 21 nt, Mycobacterium bovis subsp bovis AF2122/97
ggcucgcugaucuggggcacc

SEQ ID NO: 1101981 - RNA, 17 nt, Mycobacterium bovis subsp bovis AF2122/97
ggcucgcugcaccagcu

SEQ ID NO: 1101982 - RNA, 15 nt, Mycobacterium bovis subsp bovis AF2122/97
ggcucggcccccgag

SEQ ID NO: 1101983 - RNA, 17 nt, Mycobacterium bovis subsp bovis AF2122/97
ggcucggcccccgagag

SEQ ID NO: 1101984 - RNA, 18 nt, Mycobacterium bovis subsp bovis AF2122/97
ggcucggccagccagcgg

SEQ ID NO: 1101985 - RNA, 16 nt, Mycobacterium bovis subsp bovis AF2122/97
ggcucggccagccagc

SEQ ID NO: 1101986 - RNA, 17 nt, Mycobacterium bovis subsp bovis AF2122/97
ggcucggccagccagcg

SEQ ID NO: 1101987 - RNA, 13 nt, Mycobacterium bovis subsp bovis AF2122/97
ggcucggcggccc

SEQ ID NO: 1101988 - RNA, 13 nt, Mycobacterium bovis subsp bovis AF2122/97
ggcucggcggcgc

SEQ ID NO: 1101989 - RNA, 21 nt, Mycobacterium bovis subsp bovis AF2122/97
ggcucggcgaaacccgggauc

SEQ ID NO: 1101990 - RNA, 14 nt, Mycobacterium bovis subsp bovis AF2122/97
ggcucgccggcggc

SEQ ID NO: 1101991 - RNA, 17 nt, Mycobacterium bovis subsp bovis AF2122/97
ggcucgcguggccgccg

SEQ ID NO: 1101992 - RNA, 21 nt, Mycobacterium bovis subsp bovis AF2122/97
ggcucgcguggccgccggcgc

SEQ ID NO: 1101993 - RNA, 24 nt, Mycobacterium bovis subsp bovis AF2122/97
ggcucgcgcucgauggcggccacc

SEQ ID NO: 1101994 - RNA, 15 nt, Mycobacterium bovis subsp bovis AF2122/97
ggcucgcucgccgag

SEQ ID NO: 1101995 - RNA, 19 nt, Mycobacterium bovis subsp bovis AF2122/97
ggcuccggcggcagcggcg

SEQ ID NO: 1101996 - RNA, 20 nt, Mycobacterium bovis subsp bovis AF2122/97
ggcuccggcggcagcggcgc

SEQ ID NO: 1101997 - RNA, 20 nt, Mycobacterium bovis subsp bovis AF2122/97
ggcuccggcggugccgucgc

SEQ ID NO: 1101998 - RNA, 16 nt, Mycobacterium bovis subsp bovis AF2122/97
ggcuccgggcgcucgg

SEQ ID NO: 1101999 - RNA, 17 nt, Mycobacterium bovis subsp bovis AF2122/97
ggcuccgggcgcucggu

SEQ ID NO: 1102000 - RNA, 19 nt, Mycobacterium bovis subsp bovis AF2122/97
ggcuccgugguugccgaag

SEQ ID NO: 1102001 - RNA, 19 nt, Mycobacterium bovis subsp bovis AF2122/97
ggcuccguuguccagcgcg

SEQ ID NO: 1102002 - RNA, 23 nt, Mycobacterium bovis subsp bovis AF2122/97
ggcuccguuguccagcgcgacgu

SEQ ID NO: 1102003 - RNA, 21 nt, Mycobacterium bovis subsp bovis AF2122/97
ggcuccuccgguaucggcgac

SEQ ID NO: 1102004 - RNA, 19 nt, Mycobacterium bovis subsp bovis AF2122/97
ggcuccagcgcgcgccgca

SEQ ID NO: 1102005 - RNA, 21 nt, Mycobacterium bovis subsp bovis AF2122/97
ggcuccagcgcgcgccgcagc

SEQ ID NO: 1102006 - RNA, 23 nt, Mycobacterium bovis subsp bovis AF2122/97
ggcuccacgucaucuggcgcugc

SEQ ID NO: 1102007 - RNA, 19 nt, Mycobacterium bovis subsp bovis AF2122/97
ggcuccacuuggggcgcca

SEQ ID NO: 1102008 - RNA, 17 nt, Mycobacterium bovis subsp bovis AF2122/97
ggcuccaccgggcccgc

SEQ ID NO: 1102009 - RNA, 14 nt, Mycobacterium bovis subsp bovis AF2122/97
ggcuccaacgaugg

SEQ ID NO: 1102010 - RNA, 15 nt, Mycobacterium bovis subsp bovis AF2122/97
ggcuccaauugcggc

SEQ ID NO: 1102011 - RNA, 21 nt, Mycobacterium bovis subsp bovis AF2122/97
ggcuccaauugcggccgcgcg

SEQ ID NO: 1102012 - RNA, 20 nt, Mycobacterium bovis subsp bovis AF2122/97
ggcuccacccuugccgcugg

SEQ ID NO: 1102013 - RNA, 16 nt, Mycobacterium bovis subsp bovis AF2122/97
ggcucagucacgcacu

SEQ ID NO: 1102014 - RNA, 13 nt, Mycobacterium bovis subsp bovis AF2122/97
ggcucaucccgac

SEQ ID NO: 1102015 - RNA, 12 nt, Mycobacterium bovis subsp bovis AF2122/97
ggcucagcagcg

SEQ ID NO: 1102016 - RNA, 13 nt, Mycobacterium bovis subsp bovis AF2122/97
ggcucagcagcgc

SEQ ID NO: 1102017 - RNA, 15 nt, Mycobacterium bovis subsp bovis AF2122/97
ggcucagcagcgccg

SEQ ID NO: 1102018 - RNA, 18 nt, Mycobacterium bovis subsp bovis AF2122/97
ggcucagcagcgccgcgc

SEQ ID NO: 1102019 - RNA, 19 nt, Mycobacterium bovis subsp bovis AF2122/97
ggcucagcagcgccgcgcg

SEQ ID NO: 1102020 - RNA, 21 nt, Mycobacterium bovis subsp bovis AF2122/97
ggcucagcagcgccgcgcggg

SEQ ID NO: 1102021 - RNA, 15 nt, Mycobacterium bovis subsp bovis AF2122/97
ggcucacucgccgaa

SEQ ID NO: 1102022 - RNA, 20 nt, Mycobacterium bovis subsp bovis AF2122/97
ggcucagaacccuccgcacc

SEQ ID NO: 1102023 - RNA, 16 nt, Mycobacterium bovis subsp bovis AF2122/97
ggcucagacgacgauc

SEQ ID NO: 1102024 - RNA, 20 nt, Mycobacterium bovis subsp bovis AF2122/97
ggcuaccgcaggugccaccu

SEQ ID NO: 1102025 - RNA, 13 nt, Mycobacterium bovis subsp bovis AF2122/97
ggcuaccgccgac

SEQ ID NO: 1102026 - RNA, 20 nt, Mycobacterium bovis subsp bovis AF2122/97
ggcuaccgccuugucggcga

SEQ ID NO: 1102027 - RNA, 18 nt, Mycobacterium bovis subsp bovis AF2122/97
ggcuaccggcgccgcgcg

SEQ ID NO: 1102028 - RNA, 19 nt, Mycobacterium bovis subsp bovis AF2122/97
ggcuaccggcgccgcgcgg

SEQ ID NO: 1102029 - RNA, 12 nt, Mycobacterium bovis subsp bovis AF2122/97
ggcuaccggcgu

SEQ ID NO: 1102030 - RNA, 14 nt, Mycobacterium bovis subsp bovis AF2122/97
ggcuaccggcgugu

SEQ ID NO: 1102031 - RNA, 17 nt, Mycobacterium bovis subsp bovis AF2122/97
ggcuaccgcgcucccgg

SEQ ID NO: 1102032 - RNA, 17 nt, Mycobacterium bovis subsp bovis AF2122/97
ggcuaccuaacccgcac

SEQ ID NO: 1102033 - RNA, 17 nt, Mycobacterium bovis subsp bovis AF2122/97
ggcuaccuaacccgcgc

SEQ ID NO: 1102034 - RNA, 17 nt, Mycobacterium bovis subsp bovis AF2122/97
ggcucagcggcgaccgc

SEQ ID NO: 1102035 - RNA, 18 nt, Mycobacterium bovis subsp bovis AF2122/97
ggcucagcggcgaccgca

SEQ ID NO: 1102036 - RNA, 21 nt, Mycobacterium bovis subsp bovis AF2122/97
ggcucagcugguggcggcggu

SEQ ID NO: 1102037 - RNA, 14 nt, Mycobacterium bovis subsp bovis AF2122/97
ggcucagcggcgac

SEQ ID NO: 1102038 - RNA, 15 nt, Mycobacterium bovis subsp bovis AF2122/97
ggcucagcgugcgcu

SEQ ID NO: 1102039 - RNA, 17 nt, Mycobacterium bovis subsp bovis AF2122/97
ggcguacuucgacagcg

SEQ ID NO: 1102040 - RNA, 15 nt, Mycobacterium bovis subsp bovis AF2122/97
ggcguagggcugucc

SEQ ID NO: 1102041 - RNA, 15 nt, Mycobacterium bovis subsp bovis AF2122/97
ggcguacucggcauc

SEQ ID NO: 1102042 - RNA, 14 nt, Mycobacterium bovis subsp bovis AF2122/97
ggcguacucggcgc

SEQ ID NO: 1102043 - RNA, 15 nt, Mycobacterium bovis subsp bovis AF2122/97
ggcguacucggcgcg

SEQ ID NO: 1102044 - RNA, 14 nt, Mycobacterium bovis subsp bovis AF2122/97
ggcguacucgguga

SEQ ID NO: 1102045 - RNA, 16 nt, Mycobacterium bovis subsp bovis AF2122/97
ggcguaauugucgaug

SEQ ID NO: 1102046 - RNA, 18 nt, Mycobacterium bovis subsp bovis AF2122/97
ggcguaaucaagcagcgu

SEQ ID NO: 1102047 - RNA, 21 nt, Mycobacterium bovis subsp bovis AF2122/97
ggcgguuccauacagccgccg

SEQ ID NO: 1102048 - RNA, 16 nt, Mycobacterium bovis subsp bovis AF2122/97
ggcgguuccggccggc

SEQ ID NO: 1102049 - RNA, 22 nt, Mycobacterium bovis subsp bovis AF2122/97
ggcggugucacgacccaagucg

SEQ ID NO: 1102050 - RNA, 20 nt, Mycobacterium bovis subsp bovis AF2122/97
ggcgguguccagaacggugg

SEQ ID NO: 1102051 - RNA, 17 nt, Mycobacterium bovis subsp bovis AF2122/97
ggcgguggugucgcucg

SEQ ID NO: 1102052 - RNA, 14 nt, Mycobacterium bovis subsp bovis AF2122/97
ggcgguguugcccg

SEQ ID NO: 1102053 - RNA, 21 nt, Mycobacterium bovis subsp bovis AF2122/97
ggcgguguugcucccggccgc

SEQ ID NO: 1102054 - RNA, 22 nt, Mycobacterium bovis subsp bovis AF2122/97
ggcgguuaucgucgggucaccc

SEQ ID NO: 1102055 - RNA, 18 nt, Mycobacterium bovis subsp bovis AF2122/97
ggcgguggggccggcguc

SEQ ID NO: 1102056 - RNA, 17 nt, Mycobacterium bovis subsp bovis AF2122/97
ggcggugguaccggcgc

SEQ ID NO: 1102057 - RNA, 21 nt, Mycobacterium bovis subsp bovis AF2122/97
ggcggugguaccggcgccacc

SEQ ID NO: 1102058 - RNA, 16 nt, Mycobacterium bovis subsp bovis AF2122/97
ggcgguggugucgcuc

SEQ ID NO: 1102059 - RNA, 12 nt, Mycobacterium bovis subsp bovis AF2122/97
ggcggugccgcc

SEQ ID NO: 1102060 - RNA, 16 nt, Mycobacterium bovis subsp bovis AF2122/97
ggcgggcuuggcgucg

SEQ ID NO: 1102061 - RNA, 20 nt, Mycobacterium bovis subsp bovis AF2122/97
ggcgggcuuggcgucgacgu

SEQ ID NO: 1102062 - RNA, 23 nt, Mycobacterium bovis subsp bovis AF2122/97
ggcgggcucuacucgcggccggc

SEQ ID NO: 1102063 - RNA, 18 nt, Mycobacterium bovis subsp bovis AF2122/97
ggcgggcgauuucggcgc

SEQ ID NO: 1102064 - RNA, 19 nt, Mycobacterium bovis subsp bovis AF2122/97
ggcggggaaaccggccagc

SEQ ID NO: 1102065 - RNA, 15 nt, Mycobacterium bovis subsp bovis AF2122/97
ggcggugccgucgcc

SEQ ID NO: 1102066 - RNA, 13 nt, Mycobacterium bovis subsp bovis AF2122/97
ggcggugccgaac

SEQ ID NO: 1102067 - RNA, 13 nt, Mycobacterium bovis subsp bovis AF2122/97
ggcggugccgccg

SEQ ID NO: 1102068 - RNA, 14 nt, Mycobacterium bovis subsp bovis AF2122/97
ggcggugccggcgg

SEQ ID NO: 1102069 - RNA, 15 nt, Mycobacterium bovis subsp bovis AF2122/97
ggcggugccggcggc

SEQ ID NO: 1102070 - RNA, 15 nt, Mycobacterium bovis subsp bovis AF2122/97
ggcggugccgguagc

SEQ ID NO: 1102071 - RNA, 15 nt, Mycobacterium bovis subsp bovis AF2122/97
ggcggugccgguggu

SEQ ID NO: 1102072 - RNA, 16 nt, Mycobacterium bovis subsp bovis AF2122/97
ggcggugccgucagcg

SEQ ID NO: 1102073 - RNA, 13 nt, Mycobacterium bovis subsp bovis AF2122/97
ggcggugggcagc

SEQ ID NO: 1102074 - RNA, 16 nt, Mycobacterium bovis subsp bovis AF2122/97
ggcggugggcgcggac

SEQ ID NO: 1102075 - RNA, 18 nt, Mycobacterium bovis subsp bovis AF2122/97
ggcggugggcuuggcgcc

SEQ ID NO: 1102076 - RNA, 21 nt, Mycobacterium bovis subsp bovis AF2122/97
ggcggugggcuuggcgccgau

SEQ ID NO: 1102077 - RNA, 23 nt, Mycobacterium bovis subsp bovis AF2122/97
ggcgguggccggcgagggugagc

SEQ ID NO: 1102078 - RNA, 23 nt, Mycobacterium bovis subsp bovis AF2122/97
ggcggugcggguggugccggcgg

SEQ ID NO: 1102079 - RNA, 14 nt, Mycobacterium bovis subsp bovis AF2122/97
ggcgguggccaccc

SEQ ID NO: 1102080 - RNA, 21 nt, Mycobacterium bovis subsp bovis AF2122/97
ggcgguggccacccggccgcg

SEQ ID NO: 1102081 - RNA, 12 nt, Mycobacterium bovis subsp bovis AF2122/97
ggcgggcggcag

SEQ ID NO: 1102082 - RNA, 12 nt, Mycobacterium bovis subsp bovis AF2122/97
ggcgggcugguu

SEQ ID NO: 1102083 - RNA, 15 nt, Mycobacterium bovis subsp bovis AF2122/97
ggcgggcguccacgc

SEQ ID NO: 1102084 - RNA, 16 nt, Mycobacterium bovis subsp bovis AF2122/97
ggcgggcacucagcag

SEQ ID NO: 1102085 - RNA, 19 nt, Mycobacterium bovis subsp bovis AF2122/97
ggcgggcacaccgcaccug

SEQ ID NO: 1102086 - RNA, 20 nt, Mycobacterium bovis subsp bovis AF2122/97
ggcgggcgaucuuggcgaca

SEQ ID NO: 1102087 - RNA, 16 nt, Mycobacterium bovis subsp bovis AF2122/97
ggcgggagucgucgag

SEQ ID NO: 1102088 - RNA, 21 nt, Mycobacterium bovis subsp bovis AF2122/97
ggcgggaugcgcgcccgacga

SEQ ID NO: 1102089 - RNA, 22 nt, Mycobacterium bovis subsp bovis AF2122/97
ggcgucccagggcacaucgggc

SEQ ID NO: 1102090 - RNA, 15 nt, Mycobacterium bovis subsp bovis AF2122/97
ggcgucccggcgguc

SEQ ID NO: 1102091 - RNA, 22 nt, Mycobacterium bovis subsp bovis AF2122/97
ggcguccaguccgaucacccgc

SEQ ID NO: 1102092 - RNA, 18 nt, Mycobacterium bovis subsp bovis AF2122/97
ggcgucccaaucgggauc

SEQ ID NO: 1102093 - RNA, 15 nt, Mycobacterium bovis subsp bovis AF2122/97
ggcguccgcccagca

SEQ ID NO: 1102094 - RNA, 14 nt, Mycobacterium bovis subsp bovis AF2122/97
ggcguccgccggcg

SEQ ID NO: 1102095 - RNA, 14 nt, Mycobacterium bovis subsp bovis AF2122/97
ggcguccucgucga

SEQ ID NO: 1102096 - RNA, 22 nt, Mycobacterium bovis subsp bovis AF2122/97
ggcgucgaacagugccucgcgu

SEQ ID NO: 1102097 - RNA, 16 nt, Mycobacterium bovis subsp bovis AF2122/97
ggcgucgaagacggca

SEQ ID NO: 1102098 - RNA, 15 nt, Mycobacterium bovis subsp bovis AF2122/97
ggcgucgaccaguuc

SEQ ID NO: 1102099 - RNA, 20 nt, Mycobacterium bovis subsp bovis AF2122/97
ggcgucgaauucagcugcac

SEQ ID NO: 1102100 - RNA, 13 nt, Mycobacterium bovis subsp bovis AF2122/97
ggcgucgaccacg

SEQ ID NO: 1102101 - RNA, 22 nt, Mycobacterium bovis subsp bovis AF2122/97
ggcgucgagauagucggccggc

SEQ ID NO: 1102102 - RNA, 23 nt, Mycobacterium bovis subsp bovis AF2122/97
ggcgucgagauagucggccggcg

SEQ ID NO: 1102103 - RNA, 17 nt, Mycobacterium bovis subsp bovis AF2122/97
ggcgucgaccgcggccc

SEQ ID NO: 1102104 - RNA, 18 nt, Mycobacterium bovis subsp bovis AF2122/97
ggcgucgaccgcggcccg

SEQ ID NO: 1102105 - RNA, 19 nt, Mycobacterium bovis subsp bovis AF2122/97
ggcgucgacgucgacggcg

SEQ ID NO: 1102106 - RNA, 22 nt, Mycobacterium bovis subsp bovis AF2122/97
ggcgucgacgucgacggcgaug

SEQ ID NO: 1102107 - RNA, 12 nt, Mycobacterium bovis subsp bovis AF2122/97
ggcgucgacggc

SEQ ID NO: 1102108 - RNA, 14 nt, Mycobacterium bovis subsp bovis AF2122/97
ggcgucgacgucga

SEQ ID NO: 1102109 - RNA, 13 nt, Mycobacterium bovis subsp bovis AF2122/97
ggcgucgagcucg

SEQ ID NO: 1102110 - RNA, 20 nt, Mycobacterium bovis subsp bovis AF2122/97
ggcgucgagguuuuucgaug

SEQ ID NO: 1102111 - RNA, 16 nt, Mycobacterium bovis subsp bovis AF2122/97
ggcgucgaugacgacg

SEQ ID NO: 1102112 - RNA, 22 nt, Mycobacterium bovis subsp bovis AF2122/97
ggcgucaugaacgaucggacca

SEQ ID NO: 1102113 - RNA, 16 nt, Mycobacterium bovis subsp bovis AF2122/97
ggcgucaugaugucga

SEQ ID NO: 1102114 - RNA, 19 nt, Mycobacterium bovis subsp bovis AF2122/97
ggcgucaugaugucgacau

SEQ ID NO: 1102115 - RNA, 16 nt, Mycobacterium bovis subsp bovis AF2122/97
ggcguccacgcugacc

SEQ ID NO: 1102116 - RNA, 23 nt, Mycobacterium bovis subsp bovis AF2122/97
ggcguccagaagaagaugaucgc

SEQ ID NO: 1102117 - RNA, 14 nt, Mycobacterium bovis subsp bovis AF2122/97
ggcgucaggcacaa

SEQ ID NO: 1102118 - RNA, 16 nt, Mycobacterium bovis subsp bovis AF2122/97
ggcgucagugcagaag

SEQ ID NO: 1102119 - RNA, 22 nt, Mycobacterium bovis subsp bovis AF2122/97
ggcgucaucgacuugccgccgc

SEQ ID NO: 1102120 - RNA, 22 nt, Mycobacterium bovis subsp bovis AF2122/97
ggcgucaagccacacccggcgu

SEQ ID NO: 1102121 - RNA, 13 nt, Mycobacterium bovis subsp bovis AF2122/97
ggcgucaccgcgg

SEQ ID NO: 1102122 - RNA, 12 nt, Mycobacterium bovis subsp bovis AF2122/97
ggcgucaccgcg

SEQ ID NO: 1102123 - RNA, 22 nt, Mycobacterium bovis subsp bovis AF2122/97
ggcgucaccgccggugcugacg

SEQ ID NO: 1102124 - RNA, 20 nt, Mycobacterium bovis subsp bovis AF2122/97
ggcgucacccgcaacgacug

SEQ ID NO: 1102125 - RNA, 20 nt, Mycobacterium bovis subsp bovis AF2122/97
ggcgucaaaggccuugacgu

SEQ ID NO: 1102126 - RNA, 20 nt, Mycobacterium bovis subsp bovis AF2122/97
ggcgucaccgccggugcuga

SEQ ID NO: 1102127 - RNA, 21 nt, Mycobacterium bovis subsp bovis AF2122/97
ggcgucaaaggccuugacgua

SEQ ID NO: 1102128 - RNA, 20 nt, Mycobacterium bovis subsp bovis AF2122/97
ggcgucaagcaaguccaccg

SEQ ID NO: 1102129 - RNA, 22 nt, Mycobacterium bovis subsp bovis AF2122/97
ggcgucaagcaaguccaccgga

SEQ ID NO: 1102130 - RNA, 23 nt, Mycobacterium bovis subsp bovis AF2122/97
ggcgucaagcaaguccaccggau

SEQ ID NO: 1102131 - RNA, 19 nt, Mycobacterium bovis subsp bovis AF2122/97
ggcguagucgcugucggca

SEQ ID NO: 1102132 - RNA, 12 nt, Mycobacterium bovis subsp bovis AF2122/97
ggcguagucggc

SEQ ID NO: 1102133 - RNA, 14 nt, Mycobacterium bovis subsp bovis AF2122/97
ggcguagucggcgg

SEQ ID NO: 1102134 - RNA, 21 nt, Mycobacterium bovis subsp bovis AF2122/97
ggcguagucggcggugcagau

SEQ ID NO: 1102135 - RNA, 17 nt, Mycobacterium bovis subsp bovis AF2122/97
ggcguauucggugcacg

SEQ ID NO: 1102136 - RNA, 16 nt, Mycobacterium bovis subsp bovis AF2122/97
gggcgcgaacggcggu

SEQ ID NO: 1102137 - RNA, 16 nt, Mycobacterium bovis subsp bovis AF2122/97
gggcgcgagcagacgc

SEQ ID NO: 1102138 - RNA, 15 nt, Mycobacterium bovis subsp bovis AF2122/97
gggcgcgcaucugcu

SEQ ID NO: 1102139 - RNA, 16 nt, Mycobacterium bovis subsp bovis AF2122/97
gggcgucugcagcggg

SEQ ID NO: 1102140 - RNA, 19 nt, Mycobacterium bovis subsp bovis AF2122/97
gggcgucguagucgucggc

SEQ ID NO: 1102141 - RNA, 14 nt, Mycobacterium bovis subsp bovis AF2122/97
gggcgugccgccgc

SEQ ID NO: 1102142 - RNA, 16 nt, Mycobacterium bovis subsp bovis AF2122/97
gggcuccucgugcacg

SEQ ID NO: 1102143 - RNA, 19 nt, Mycobacterium bovis subsp bovis AF2122/97
gggcuaccggcagcugcuc

SEQ ID NO: 1102144 - RNA, 20 nt, Mycobacterium bovis subsp bovis AF2122/97
gggcuaccggcagcugcucg

SEQ ID NO: 1102145 - RNA, 14 nt, Mycobacterium bovis subsp bovis AF2122/97
gggcuaccggcgcc

SEQ ID NO: 1102146 - RNA, 18 nt, Mycobacterium bovis subsp bovis AF2122/97
gggcuacuaggcccagca

SEQ ID NO: 1102147 - RNA, 23 nt, Mycobacterium bovis subsp bovis AF2122/97
gggcuacuaggcccagcacgguc

SEQ ID NO: 1102148 - RNA, 15 nt, Mycobacterium bovis subsp bovis AF2122/97
gggcuaucguggcgg

SEQ ID NO: 1102149 - RNA, 23 nt, Mycobacterium bovis subsp bovis AF2122/97
gggcguucccccggcaccgccgg

SEQ ID NO: 1102150 - RNA, 21 nt, Mycobacterium bovis subsp bovis AF2122/97
gggcguugcugauggugccga

SEQ ID NO: 1102151 - RNA, 18 nt, Mycobacterium bovis subsp bovis AF2122/97
gggcgugugcaguccgau

SEQ ID NO: 1102152 - RNA, 18 nt, Mycobacterium bovis subsp bovis AF2122/97
gggcucgguggcgccggg

SEQ ID NO: 1102153 - RNA, 14 nt, Mycobacterium bovis subsp bovis AF2122/97
gggcucgguggcgg

SEQ ID NO: 1102154 - RNA, 21 nt, Mycobacterium bovis subsp bovis AF2122/97
gggcucggcgucgccgccauu

SEQ ID NO: 1102155 - RNA, 13 nt, Mycobacterium bovis subsp bovis AF2122/97
gggcucggcggcc

SEQ ID NO: 1102156 - RNA, 14 nt, Mycobacterium bovis subsp bovis AF2122/97
gggcucggcggccc

SEQ ID NO: 1102157 - RNA, 20 nt, Mycobacterium bovis subsp bovis AF2122/97
gggcucggcggcccggccga

SEQ ID NO: 1102158 - RNA, 23 nt, Mycobacterium bovis subsp bovis AF2122/97
gggcucgcgcucgauggcggcca

SEQ ID NO: 1102159 - RNA, 14 nt, Mycobacterium bovis subsp bovis AF2122/97
gggcucgcucgccg

SEQ ID NO: 1102160 - RNA, 20 nt, Mycobacterium bovis subsp bovis AF2122/97
gggcucggcgaaggccgcgc

SEQ ID NO: 1102161 - RNA, 18 nt, Mycobacterium bovis subsp bovis AF2122/97
gggcugaggaacgccggc

SEQ ID NO: 1102162 - RNA, 15 nt, Mycobacterium bovis subsp bovis AF2122/97
gggcugaggcggcga

SEQ ID NO: 1102163 - RNA, 18 nt, Mycobacterium bovis subsp bovis AF2122/97
gggcucguguccgccguc

SEQ ID NO: 1102164 - RNA, 13 nt, Mycobacterium bovis subsp bovis AF2122/97
gggcucucggcgu

SEQ ID NO: 1102165 - RNA, 16 nt, Mycobacterium bovis subsp bovis AF2122/97
gggcucucggcgucga

SEQ ID NO: 1102166 - RNA, 14 nt, Mycobacterium bovis subsp bovis AF2122/97
gggcugaccgccac

SEQ ID NO: 1102167 - RNA, 14 nt, Mycobacterium bovis subsp bovis AF2122/97
gggcucuggccagu

SEQ ID NO: 1102168 - RNA, 14 nt, Mycobacterium bovis subsp bovis AF2122/97
gggcuguccaccga

SEQ ID NO: 1102169 - RNA, 18 nt, Mycobacterium bovis subsp bovis AF2122/97
gggcuuaugcgucugcuc

SEQ ID NO: 1102170 - RNA, 23 nt, Mycobacterium bovis subsp bovis AF2122/97
gggcugcccgcggacgugccggu

SEQ ID NO: 1102171 - RNA, 20 nt, Mycobacterium bovis subsp bovis AF2122/97
gggcugauggacggugcgca

SEQ ID NO: 1102172 - RNA, 15 nt, Mycobacterium bovis subsp bovis AF2122/97
gggcugguaucgagc

SEQ ID NO: 1102173 - RNA, 18 nt, Mycobacterium bovis subsp bovis AF2122/97
gggcugcuugcgcccggc

SEQ ID NO: 1102174 - RNA, 12 nt, Mycobacterium bovis subsp bovis AF2122/97
gggcugcggaug

SEQ ID NO: 1102175 - RNA, 16 nt, Mycobacterium bovis subsp bovis AF2122/97
ggggagcuauucggug

SEQ ID NO: 1102176 - RNA, 19 nt, Mycobacterium bovis subsp bovis AF2122/97
ggggagcuauucggugucg

SEQ ID NO: 1102177 - RNA, 21 nt, Mycobacterium bovis subsp bovis AF2122/97
ggggacgcccgugcggcucgc

SEQ ID NO: 1102178 - RNA, 23 nt, Mycobacterium bovis subsp bovis AF2122/97
ggggacgcccgugcggcucgccg

SEQ ID NO: 1102179 - RNA, 13 nt, Mycobacterium bovis subsp bovis AF2122/97
ggggacgccgcgg

SEQ ID NO: 1102180 - RNA, 16 nt, Mycobacterium bovis subsp bovis AF2122/97
ggggacgccgcggcgc

SEQ ID NO: 1102181 - RNA, 20 nt, Mycobacterium bovis subsp bovis AF2122/97
ggggaaggggcucagcggug

SEQ ID NO: 1102182 - RNA, 22 nt, Mycobacterium bovis subsp bovis AF2122/97
ggggaaugaguguugccgacga

SEQ ID NO: 1102183 - RNA, 11 nt, Mycobacterium bovis subsp bovis AF2122/97
ggggacccgga

SEQ ID NO: 1102184 - RNA, 14 nt, Mycobacterium bovis subsp bovis AF2122/97
ggggaccgcggcgc

SEQ ID NO: 1102185 - RNA, 22 nt, Mycobacterium bovis subsp bovis AF2122/97
ggggaccuauuggucgcucgcg

SEQ ID NO: 1102186 - RNA, 20 nt, Mycobacterium bovis subsp bovis AF2122/97
ggggaccacgccgacgugga

SEQ ID NO: 1102187 - RNA, 12 nt, Mycobacterium bovis subsp bovis AF2122/97
ggggaccagaua

SEQ ID NO: 1102188 - RNA, 12 nt, Mycobacterium bovis subsp bovis AF2122/97
ggggaucagcgu

SEQ ID NO: 1102189 - RNA, 15 nt, Mycobacterium bovis subsp bovis AF2122/97
ggggaguuggugaac

SEQ ID NO: 1102190 - RNA, 15 nt, Mycobacterium bovis subsp bovis AF2122/97
ggggauaccgcuggg

SEQ ID NO: 1102191 - RNA, 17 nt, Mycobacterium bovis subsp bovis AF2122/97
ggggaguaguggugggc

SEQ ID NO: 1102192 - RNA, 11 nt, Mycobacterium bovis subsp bovis AF2122/97
ggggagccggu

SEQ ID NO: 1102193 - RNA, 16 nt, Mycobacterium bovis subsp bovis AF2122/97
ggggacagcccggcag

SEQ ID NO: 1102194 - RNA, 12 nt, Mycobacterium bovis subsp bovis AF2122/97
ggggagcugcgg

SEQ ID NO: 1102195 - RNA, 12 nt, Mycobacterium bovis subsp bovis AF2122/97
ggggaucggugg

SEQ ID NO: 1102196 - RNA, 14 nt, Mycobacterium bovis subsp bovis AF2122/97
ggggaucucggucg

SEQ ID NO: 1102197 - RNA, 14 nt, Mycobacterium bovis subsp bovis AF2122/97
ggggaagacgaccg

SEQ ID NO: 1102198 - RNA, 18 nt, Mycobacterium bovis subsp bovis AF2122/97
ggggaacgcggaagccgc

SEQ ID NO: 1102199 - RNA, 16 nt, Mycobacterium bovis subsp bovis AF2122/97
ggggaacaccgcggug

SEQ ID NO: 1102200 - RNA, 20 nt, Mycobacterium bovis subsp bovis AF2122/97
gggcuuuugcgucugcucgc

SEQ ID NO: 1102201 - RNA, 18 nt, Mycobacterium bovis subsp bovis AF2122/97
gggcuuuugcgucugcuc

SEQ ID NO: 1102202 - RNA, 18 nt, Mycobacterium bovis subsp bovis AF2122/97
gggcuuuuacgucugcuc

SEQ ID NO: 1102203 - RNA, 20 nt, Mycobacterium bovis subsp bovis AF2122/97
gggcuuuuacgucugcucgc

SEQ ID NO: 1102204 - RNA, 18 nt, Mycobacterium bovis subsp bovis AF2122/97
gggcuuuagugucugcuc

SEQ ID NO: 1102205 - RNA, 14 nt, Mycobacterium bovis subsp bovis AF2122/97
gggcuuggugccca

SEQ ID NO: 1102206 - RNA, 20 nt, Mycobacterium bovis subsp bovis AF2122/97
gggcuuggggucccgccggg

SEQ ID NO: 1102207 - RNA, 16 nt, Mycobacterium bovis subsp bovis AF2122/97
gggcuuggccgcgccg

SEQ ID NO: 1102208 - RNA, 16 nt, Mycobacterium bovis subsp bovis AF2122/97
gggcuuucgcgugcgg

SEQ ID NO: 1102209 - RNA, 23 nt, Mycobacterium bovis subsp bovis AF2122/97
gggcuuugcagcguugacggcgg

SEQ ID NO: 1102210 - RNA, 20 nt, Mycobacterium bovis subsp bovis AF2122/97
gggcuuuagugucugcucgc

SEQ ID NO: 1102211 - RNA, 19 nt, Mycobacterium bovis subsp bovis AF2122/97
gggcuuuagugucugcucg

SEQ ID NO: 1102212 - RNA, 15 nt, Mycobacterium bovis subsp bovis AF2122/97
gggcuugugggccgg

SEQ ID NO: 1102213 - RNA, 13 nt, Mycobacterium bovis subsp bovis AF2122/97
ggggccgccgcgg

SEQ ID NO: 1102214 - RNA, 20 nt, Mycobacterium bovis subsp bovis AF2122/97
ggggccgccgcggccggcgc

SEQ ID NO: 1102215 - RNA, 12 nt, Mycobacterium bovis subsp bovis AF2122/97
ggggccggcggu

SEQ ID NO: 1102216 - RNA, 14 nt, Mycobacterium bovis subsp bovis AF2122/97
ggggccggcgucga

SEQ ID NO: 1102217 - RNA, 11 nt, Mycobacterium bovis subsp bovis AF2122/97
ggggccgucgg

SEQ ID NO: 1102218 - RNA, 20 nt, Mycobacterium bovis subsp bovis AF2122/97
ggggccgucgucggucaccg

SEQ ID NO: 1102219 - RNA, 15 nt, Mycobacterium bovis subsp bovis AF2122/97
ggggcgccgccguug

SEQ ID NO: 1102220 - RNA, 13 nt, Mycobacterium bovis subsp bovis AF2122/97
ggggcgcgccggc

SEQ ID NO: 1102221 - RNA, 14 nt, Mycobacterium bovis subsp bovis AF2122/97
ggggcggccggcgg

SEQ ID NO: 1102222 - RNA, 15 nt, Mycobacterium bovis subsp bovis AF2122/97
ggggcggugggcgcu

SEQ ID NO: 1102223 - RNA, 20 nt, Mycobacterium bovis subsp bovis AF2122/97
ggggcacuccgggcucggcg

SEQ ID NO: 1102224 - RNA, 15 nt, Mycobacterium bovis subsp bovis AF2122/97
ggggcacgacgccgg

SEQ ID NO: 1102225 - RNA, 16 nt, Mycobacterium bovis subsp bovis AF2122/97
ggggcacgacgccggc

SEQ ID NO: 1102226 - RNA, 16 nt, Mycobacterium bovis subsp bovis AF2122/97
ggggcaauugccugcg

SEQ ID NO: 1102227 - RNA, 20 nt, Mycobacterium bovis subsp bovis AF2122/97
ggggcaccacgcugugcucg

SEQ ID NO: 1102228 - RNA, 18 nt, Mycobacterium bovis subsp bovis AF2122/97
ggggcaccgagcugagcg

SEQ ID NO: 1102229 - RNA, 20 nt, Mycobacterium bovis subsp bovis AF2122/97
ggggcaccguuaccgccguc

SEQ ID NO: 1102230 - RNA, 21 nt, Mycobacterium bovis subsp bovis AF2122/97
ggggcaccguuaccgccgucg

SEQ ID NO: 1102231 - RNA, 21 nt, Mycobacterium bovis subsp bovis AF2122/97
ggggauuuauugagucggcug

SEQ ID NO: 1102232 - RNA, 21 nt, Mycobacterium bovis subsp bovis AF2122/97
ggggcaacuacgaaggccuau

SEQ ID NO: 1102233 - RNA, 20 nt, Mycobacterium bovis subsp bovis AF2122/97
ggggauuuugcgucugcucg

SEQ ID NO: 1102234 - RNA, 23 nt, Mycobacterium bovis subsp bovis AF2122/97
ggggauuucgcgucugcucgcca

SEQ ID NO: 1102235 - RNA, 18 nt, Mycobacterium bovis subsp bovis AF2122/97
ggggaucguccggccggg

SEQ ID NO: 1102236 - RNA, 18 nt, Mycobacterium bovis subsp bovis AF2122/97
ggggcagccgggcgucgc

SEQ ID NO: 1102237 - RNA, 13 nt, Mycobacterium bovis subsp bovis AF2122/97
ggggcagcgacgg

SEQ ID NO: 1102238 - RNA, 18 nt, Mycobacterium bovis subsp bovis AF2122/97
ggggcaggucgagcgccc

SEQ ID NO: 1102239 - RNA, 18 nt, Mycobacterium bovis subsp bovis AF2122/97
ggggccccgcggcgccgc

SEQ ID NO: 1102240 - RNA, 15 nt, Mycobacterium bovis subsp bovis AF2122/97
ggggccaccagaacc

SEQ ID NO: 1102241 - RNA, 16 nt, Mycobacterium bovis subsp bovis AF2122/97
ggguacacccgcucgc

SEQ ID NO: 1102242 - RNA, 14 nt, Mycobacterium bovis subsp bovis AF2122/97
ggguaaccagcgcc

SEQ ID NO: 1102243 - RNA, 21 nt, Mycobacterium bovis subsp bovis AF2122/97
ggguaagaguucgcgcgccgc

SEQ ID NO: 1102244 - RNA, 16 nt, Mycobacterium bovis subsp bovis AF2122/97
ggguacugcggcucgc

SEQ ID NO: 1102245 - RNA, 20 nt, Mycobacterium bovis subsp bovis AF2122/97
ggguagaccuucucgccgcc

SEQ ID NO: 1102246 - RNA, 22 nt, Mycobacterium bovis subsp bovis AF2122/97
ggguagaccuucucgccgccgc

SEQ ID NO: 1102247 - RNA, 19 nt, Mycobacterium bovis subsp bovis AF2122/97
ggguagacggggcgagcau

SEQ ID NO: 1102248 - RNA, 14 nt, Mycobacterium bovis subsp bovis AF2122/97
ggguacaucgaggc

SEQ ID NO: 1102249 - RNA, 13 nt, Mycobacterium bovis subsp bovis AF2122/97
ggguagccgucga

SEQ ID NO: 1102250 - RNA, 13 nt, Mycobacterium bovis subsp bovis AF2122/97
ggguagccgccgg

SEQ ID NO: 1102251 - RNA, 16 nt, Mycobacterium bovis subsp bovis AF2122/97
ggguagccgccggcgc

SEQ ID NO: 1102252 - RNA, 19 nt, Mycobacterium bovis subsp bovis AF2122/97
ggguagccgccggcgccga

SEQ ID NO: 1102253 - RNA, 17 nt, Mycobacterium bovis subsp bovis AF2122/97
ggguagcugccgcggcc

SEQ ID NO: 1102254 - RNA, 21 nt, Mycobacterium bovis subsp bovis AF2122/97
ggguagcugccgcggccggcg

SEQ ID NO: 1102255 - RNA, 20 nt, Mycobacterium bovis subsp bovis AF2122/97
ggguagauguucacgccgcc

SEQ ID NO: 1102256 - RNA, 23 nt, Mycobacterium bovis subsp bovis AF2122/97
ggguagauguucacgccgccgga

SEQ ID NO: 1102257 - RNA, 13 nt, Mycobacterium bovis subsp bovis AF2122/97
ggguagccgccca

SEQ ID NO: 1102258 - RNA, 13 nt, Mycobacterium bovis subsp bovis AF2122/97
ggggucgcugccg

SEQ ID NO: 1102259 - RNA, 19 nt, Mycobacterium bovis subsp bovis AF2122/97
ggggucuugacggcgccag

SEQ ID NO: 1102260 - RNA, 22 nt, Mycobacterium bovis subsp bovis AF2122/97
ggggugcgcgcgaccauacccg

SEQ ID NO: 1102261 - RNA, 14 nt, Mycobacterium bovis subsp bovis AF2122/97
ggggugcucggucg

SEQ ID NO: 1102262 - RNA, 13 nt, Mycobacterium bovis subsp bovis AF2122/97
ggggugcuuucgc

SEQ ID NO: 1102263 - RNA, 11 nt, Mycobacterium bovis subsp bovis AF2122/97
ggggugccgau

SEQ ID NO: 1102264 - RNA, 14 nt, Mycobacterium bovis subsp bovis AF2122/97
gggguggccaccag

SEQ ID NO: 1102265 - RNA, 22 nt, Mycobacterium bovis subsp bovis AF2122/97
ggggugguaccggcggcgccgg

SEQ ID NO: 1102266 - RNA, 20 nt, Mycobacterium bovis subsp bovis AF2122/97
gggguuuaguuuaucggccg

SEQ ID NO: 1102267 - RNA, 15 nt, Mycobacterium bovis subsp bovis AF2122/97
gggguuucaggcggc

SEQ ID NO: 1102268 - RNA, 14 nt, Mycobacterium bovis subsp bovis AF2122/97
gggggcugcugcuc

SEQ ID NO: 1102269 - RNA, 13 nt, Mycobacterium bovis subsp bovis AF2122/97
gggggcaggucga

SEQ ID NO: 1102270 - RNA, 19 nt, Mycobacterium bovis subsp bovis AF2122/97
gggggcuuaugcgucugcu

SEQ ID NO: 1102271 - RNA, 20 nt, Mycobacterium bovis subsp bovis AF2122/97
gggggcuuaugcgucugcuc

SEQ ID NO: 1102272 - RNA, 20 nt, Mycobacterium bovis subsp bovis AF2122/97
gggggcuuauguguccgcuc

SEQ ID NO: 1102273 - RNA, 21 nt, Mycobacterium bovis subsp bovis AF2122/97
gggggcuuauguguccgcucg

SEQ ID NO: 1102274 - RNA, 19 nt, Mycobacterium bovis subsp bovis AF2122/97
gggggcuuuugcgucugcu

SEQ ID NO: 1102275 - RNA, 20 nt, Mycobacterium bovis subsp bovis AF2122/97
gggggcuuuuacgucugcuc

SEQ ID NO: 1102276 - RNA, 19 nt, Mycobacterium bovis subsp bovis AF2122/97
gggggcuucugcgucugcu

SEQ ID NO: 1102277 - RNA, 20 nt, Mycobacterium bovis subsp bovis AF2122/97
gggggcuucugcgucugcuc

SEQ ID NO: 1102278 - RNA, 21 nt, Mycobacterium bovis subsp bovis AF2122/97
gggggcuucugcgucugcucg

SEQ ID NO: 1102279 - RNA, 19 nt, Mycobacterium bovis subsp bovis AF2122/97
gggggcuuuuacgucugcu

SEQ ID NO: 1102280 - RNA, 18 nt, Mycobacterium bovis subsp bovis AF2122/97
gggguaguugaggccguc

SEQ ID NO: 1102281 - RNA, 17 nt, Mycobacterium bovis subsp bovis AF2122/97
ggggucaaucggguucg

SEQ ID NO: 1102282 - RNA, 13 nt, Mycobacterium bovis subsp bovis AF2122/97
ggggucgaacgcg

SEQ ID NO: 1102283 - RNA, 17 nt, Mycobacterium bovis subsp bovis AF2122/97
ggggucagugcgggcgg

SEQ ID NO: 1102284 - RNA, 14 nt, Mycobacterium bovis subsp bovis AF2122/97
gggguagccgccgg

SEQ ID NO: 1102285 - RNA, 19 nt, Mycobacterium bovis subsp bovis AF2122/97
gggguacugcggcucgcug

SEQ ID NO: 1102286 - RNA, 20 nt, Mycobacterium bovis subsp bovis AF2122/97
gggguaccucccgcgugcgg

SEQ ID NO: 1102287 - RNA, 20 nt, Mycobacterium bovis subsp bovis AF2122/97
gggguaccucccgcuugcgg

SEQ ID NO: 1102288 - RNA, 16 nt, Mycobacterium bovis subsp bovis AF2122/97
ggggguagccgccggc

SEQ ID NO: 1102289 - RNA, 16 nt, Mycobacterium bovis subsp bovis AF2122/97
ggggguggcagcgcgg

SEQ ID NO: 1102290 - RNA, 19 nt, Mycobacterium bovis subsp bovis AF2122/97
ggggcuuuugcgucugcug

SEQ ID NO: 1102291 - RNA, 19 nt, Mycobacterium bovis subsp bovis AF2122/97
ggggcuuuuacgucugcuc

SEQ ID NO: 1102292 - RNA, 19 nt, Mycobacterium bovis subsp bovis AF2122/97
ggggcuucugcgucugcuc

SEQ ID NO: 1102293 - RNA, 20 nt, Mycobacterium bovis subsp bovis AF2122/97
ggggcuuaugcgucugcucg

SEQ ID NO: 1102294 - RNA, 22 nt, Mycobacterium bovis subsp bovis AF2122/97
ggggcuucaucuggcgccguua

SEQ ID NO: 1102295 - RNA, 23 nt, Mycobacterium bovis subsp bovis AF2122/97
ggggcuuuugcgucugcucgcca

SEQ ID NO: 1102296 - RNA, 14 nt, Mycobacterium bovis subsp bovis AF2122/97
gggggacgggucgc

SEQ ID NO: 1102297 - RNA, 18 nt, Mycobacterium bovis subsp bovis AF2122/97
gggggaacccccucgcga

SEQ ID NO: 1102298 - RNA, 19 nt, Mycobacterium bovis subsp bovis AF2122/97
gggggauccagcaggccgg

SEQ ID NO: 1102299 - RNA, 20 nt, Mycobacterium bovis subsp bovis AF2122/97
gggggaucucgagccgcggc

SEQ ID NO: 1102300 - RNA, 23 nt, Mycobacterium bovis subsp bovis AF2122/97
gggggaucucgagccgcggcaac

SEQ ID NO: 1102301 - RNA, 20 nt, Mycobacterium bovis subsp bovis AF2122/97
gggggauuucgcgucugcuc

SEQ ID NO: 1102302 - RNA, 20 nt, Mycobacterium bovis subsp bovis AF2122/97
ggggcguuagggccgccauc

SEQ ID NO: 1102303 - RNA, 23 nt, Mycobacterium bovis subsp bovis AF2122/97
ggggcguaguuaugccaaaccga

SEQ ID NO: 1102304 - RNA, 19 nt, Mycobacterium bovis subsp bovis AF2122/97
ggggcuuaugcgucugcuc

SEQ ID NO: 1102305 - RNA, 14 nt, Mycobacterium bovis subsp bovis AF2122/97
ggggcuguagucga

SEQ ID NO: 1102306 - RNA, 14 nt, Mycobacterium bovis subsp bovis AF2122/97
ggggcuggucgccg

SEQ ID NO: 1102307 - RNA, 13 nt, Mycobacterium bovis subsp bovis AF2122/97
ggggcugccgccg

SEQ ID NO: 1102308 - RNA, 16 nt, Mycobacterium bovis subsp bovis AF2122/97
ggggcugccgccguug

SEQ ID NO: 1102309 - RNA, 23 nt, Mycobacterium bovis subsp bovis AF2122/97
ggggcugccggugagugcgcgau

SEQ ID NO: 1102310 - RNA, 12 nt, Mycobacterium bovis subsp bovis AF2122/97
gggucgaucacc

SEQ ID NO: 1102311 - RNA, 15 nt, Mycobacterium bovis subsp bovis AF2122/97
gggucgaugucggca

SEQ ID NO: 1102312 - RNA, 12 nt, Mycobacterium bovis subsp bovis AF2122/97
gggucgcaaccg

SEQ ID NO: 1102313 - RNA, 13 nt, Mycobacterium bovis subsp bovis AF2122/97
gggucgccgucga

SEQ ID NO: 1102314 - RNA, 19 nt, Mycobacterium bovis subsp bovis AF2122/97
gggucgccuccugccgccg

SEQ ID NO: 1102315 - RNA, 21 nt, Mycobacterium bovis subsp bovis AF2122/97
gggucgccuccugccgccgcu

SEQ ID NO: 1102316 - RNA, 18 nt, Mycobacterium bovis subsp bovis AF2122/97
gggucgcggcuauggcgc

SEQ ID NO: 1102317 - RNA, 15 nt, Mycobacterium bovis subsp bovis AF2122/97
gggucgcugccgccg

SEQ ID NO: 1102318 - RNA, 17 nt, Mycobacterium bovis subsp bovis AF2122/97
gggucgcugccgccguc

SEQ ID NO: 1102319 - RNA, 13 nt, Mycobacterium bovis subsp bovis AF2122/97
gggucgcugccgg

SEQ ID NO: 1102320 - RNA, 14 nt, Mycobacterium bovis subsp bovis AF2122/97
gggucgcugccggc

SEQ ID NO: 1102321 - RNA, 16 nt, Mycobacterium bovis subsp bovis AF2122/97
gggucgcaaccgccgc

SEQ ID NO: 1102322 - RNA, 20 nt, Mycobacterium bovis subsp bovis AF2122/97
gggucgcaaccgccgccauu

SEQ ID NO: 1102323 - RNA, 17 nt, Mycobacterium bovis subsp bovis AF2122/97
gggucgcgcugccaguu

SEQ ID NO: 1102324 - RNA, 12 nt, Mycobacterium bovis subsp bovis AF2122/97
gggucgcgcugg

SEQ ID NO: 1102325 - RNA, 15 nt, Mycobacterium bovis subsp bovis AF2122/97
gggucggcgaccgcg

SEQ ID NO: 1102326 - RNA, 16 nt, Mycobacterium bovis subsp bovis AF2122/97
gggucggcgauggcgg

SEQ ID NO: 1102327 - RNA, 15 nt, Mycobacterium bovis subsp bovis AF2122/97
gggucggcacgaccc

SEQ ID NO: 1102328 - RNA, 16 nt, Mycobacterium bovis subsp bovis AF2122/97
gggucggcacgacccg

SEQ ID NO: 1102329 - RNA, 15 nt, Mycobacterium bovis subsp bovis AF2122/97
gggucggcccgccaa

SEQ ID NO: 1102330 - RNA, 20 nt, Mycobacterium bovis subsp bovis AF2122/97
gggucggcuuccggugccgg

SEQ ID NO: 1102331 - RNA, 12 nt, Mycobacterium bovis subsp bovis AF2122/97
gggucggcgccg

SEQ ID NO: 1102332 - RNA, 16 nt, Mycobacterium bovis subsp bovis AF2122/97
gggucggcgaccaccc

SEQ ID NO: 1102333 - RNA, 17 nt, Mycobacterium bovis subsp bovis AF2122/97
gggucggggaagacgac

SEQ ID NO: 1102334 - RNA, 22 nt, Mycobacterium bovis subsp bovis AF2122/97
gggucgguuuccuccggcagca

SEQ ID NO: 1102335 - RNA, 15 nt, Mycobacterium bovis subsp bovis AF2122/97
gggucguacaacacg

SEQ ID NO: 1102336 - RNA, 17 nt, Mycobacterium bovis subsp bovis AF2122/97
gggucgguugcuccugg

SEQ ID NO: 1102337 - RNA, 18 nt, Mycobacterium bovis subsp bovis AF2122/97
gggucgguuuccuccggc

SEQ ID NO: 1102338 - RNA, 21 nt, Mycobacterium bovis subsp bovis AF2122/97
gggucgguuuccuccggcagc

SEQ ID NO: 1102339 - RNA, 15 nt, Mycobacterium bovis subsp bovis AF2122/97
gggucguccgccugc

SEQ ID NO: 1102340 - RNA, 14 nt, Mycobacterium bovis subsp bovis AF2122/97
gggucucggugcgg

SEQ ID NO: 1102341 - RNA, 13 nt, Mycobacterium bovis subsp bovis AF2122/97
gggucugcgccgc

SEQ ID NO: 1102342 - RNA, 15 nt, Mycobacterium bovis subsp bovis AF2122/97
gggucugcgccgccg

SEQ ID NO: 1102343 - RNA, 17 nt, Mycobacterium bovis subsp bovis AF2122/97
gggucugcgccgccggc

SEQ ID NO: 1102344 - RNA, 22 nt, Mycobacterium bovis subsp bovis AF2122/97
gggucgugccccggcgcgguca

SEQ ID NO: 1102345 - RNA, 22 nt, Mycobacterium bovis subsp bovis AF2122/97
gggucgucguugugauccggug

SEQ ID NO: 1102346 - RNA, 12 nt, Mycobacterium bovis subsp bovis AF2122/97
gggucugcucau

SEQ ID NO: 1102347 - RNA, 23 nt, Mycobacterium bovis subsp bovis AF2122/97
gggucugcggucaucgccucggc

SEQ ID NO: 1102348 - RNA, 18 nt, Mycobacterium bovis subsp bovis AF2122/97
gggucuggcaggccagca

SEQ ID NO: 1102349 - RNA, 15 nt, Mycobacterium bovis subsp bovis AF2122/97
gggucugggugguga

SEQ ID NO: 1102350 - RNA, 23 nt, Mycobacterium bovis subsp bovis AF2122/97
ggguccgacgguguagccgccgg

SEQ ID NO: 1102351 - RNA, 17 nt, Mycobacterium bovis subsp bovis AF2122/97
ggguccagcgucccgau

SEQ ID NO: 1102352 - RNA, 12 nt, Mycobacterium bovis subsp bovis AF2122/97
gggucccgccac

SEQ ID NO: 1102353 - RNA, 12 nt, Mycobacterium bovis subsp bovis AF2122/97
gggucccgccgc

SEQ ID NO: 1102354 - RNA, 17 nt, Mycobacterium bovis subsp bovis AF2122/97
ggguccgccgggccccg

SEQ ID NO: 1102355 - RNA, 13 nt, Mycobacterium bovis subsp bovis AF2122/97
ggguccggcggcc

SEQ ID NO: 1102356 - RNA, 17 nt, Mycobacterium bovis subsp bovis AF2122/97
ggguccggcggccgcca

SEQ ID NO: 1102357 - RNA, 13 nt, Mycobacterium bovis subsp bovis AF2122/97
ggguccgggccaa

SEQ ID NO: 1102358 - RNA, 18 nt, Mycobacterium bovis subsp bovis AF2122/97
gggucgaacaugauccgc

SEQ ID NO: 1102359 - RNA, 22 nt, Mycobacterium bovis subsp bovis AF2122/97
gggucgaacaugauccgccggc

SEQ ID NO: 1102360 - RNA, 16 nt, Mycobacterium bovis subsp bovis AF2122/97
gggucgaagcgauccg

SEQ ID NO: 1102361 - RNA, 19 nt, Mycobacterium bovis subsp bovis AF2122/97
ggguccguuuuaccucggc

SEQ ID NO: 1102362 - RNA, 23 nt, Mycobacterium bovis subsp bovis AF2122/97
ggguccguuuuaccucggccgcc

SEQ ID NO: 1102363 - RNA, 17 nt, Mycobacterium bovis subsp bovis AF2122/97
ggguccggauggccccg

SEQ ID NO: 1102364 - RNA, 17 nt, Mycobacterium bovis subsp bovis AF2122/97
ggguccgggggaagcgc

SEQ ID NO: 1102365 - RNA, 22 nt, Mycobacterium bovis subsp bovis AF2122/97
gggucaugucgaucagcgcgac

SEQ ID NO: 1102366 - RNA, 18 nt, Mycobacterium bovis subsp bovis AF2122/97
ggguccaacccgcgauuc

SEQ ID NO: 1102367 - RNA, 17 nt, Mycobacterium bovis subsp bovis AF2122/97
gggucaucgccagcggc

SEQ ID NO: 1102368 - RNA, 20 nt, Mycobacterium bovis subsp bovis AF2122/97
gggucagguugucggcgauc

SEQ ID NO: 1102369 - RNA, 16 nt, Mycobacterium bovis subsp bovis AF2122/97
gggucagcgccgcgcc

SEQ ID NO: 1102370 - RNA, 19 nt, Mycobacterium bovis subsp bovis AF2122/97
gggucagugcgaugcggug

SEQ ID NO: 1102371 - RNA, 20 nt, Mycobacterium bovis subsp bovis AF2122/97
gggucagugcgggcggcguc

SEQ ID NO: 1102372 - RNA, 23 nt, Mycobacterium bovis subsp bovis AF2122/97
gggucagcgcguauggcucaccc

SEQ ID NO: 1102373 - RNA, 19 nt, Mycobacterium bovis subsp bovis AF2122/97
gggucagcugggacccgag

SEQ ID NO: 1102374 - RNA, 15 nt, Mycobacterium bovis subsp bovis AF2122/97
gggucaggccgacgu

SEQ ID NO: 1102375 - RNA, 16 nt, Mycobacterium bovis subsp bovis AF2122/97
gggucaacgccaucac

SEQ ID NO: 1102376 - RNA, 15 nt, Mycobacterium bovis subsp bovis AF2122/97
gggucacgaccugcu

SEQ ID NO: 1102377 - RNA, 22 nt, Mycobacterium bovis subsp bovis AF2122/97
gggucacgaccugcucauccac

SEQ ID NO: 1102378 - RNA, 16 nt, Mycobacterium bovis subsp bovis AF2122/97
gggucagcccagccaa

SEQ ID NO: 1102379 - RNA, 12 nt, Mycobacterium bovis subsp bovis AF2122/97
gggucagcgccg

SEQ ID NO: 1102380 - RNA, 21 nt, Mycobacterium bovis subsp bovis AF2122/97
ggguaucgacccuccagcacg

SEQ ID NO: 1102381 - RNA, 22 nt, Mycobacterium bovis subsp bovis AF2122/97
ggguaucgacccuccagcacgc

SEQ ID NO: 1102382 - RNA, 14 nt, Mycobacterium bovis subsp bovis AF2122/97
ggguaugcacccag

SEQ ID NO: 1102383 - RNA, 20 nt, Mycobacterium bovis subsp bovis AF2122/97
ggguauugauugacugcuug

SEQ ID NO: 1102384 - RNA, 14 nt, Mycobacterium bovis subsp bovis AF2122/97
ggguagcggcgccg

SEQ ID NO: 1102385 - RNA, 16 nt, Mycobacterium bovis subsp bovis AF2122/97
ggguagcggcgccgcc

SEQ ID NO: 1102386 - RNA, 19 nt, Mycobacterium bovis subsp bovis AF2122/97
ggguaggcaauggcgugcg

SEQ ID NO: 1102387 - RNA, 13 nt, Mycobacterium bovis subsp bovis AF2122/97
ggguaggccgccg

SEQ ID NO: 1102388 - RNA, 20 nt, Mycobacterium bovis subsp bovis AF2122/97
gggucaccagcgcaucggcc

SEQ ID NO: 1102389 - RNA, 21 nt, Mycobacterium bovis subsp bovis AF2122/97
gggucacaaacccagcaucgg

SEQ ID NO: 1102390 - RNA, 20 nt, Mycobacterium bovis subsp bovis AF2122/97
gggccccuugaccgcugccc

SEQ ID NO: 1102391 - RNA, 24 nt, Mycobacterium bovis subsp bovis AF2122/97
gggccgaccagucgacgucucugg

SEQ ID NO: 1102392 - RNA, 22 nt, Mycobacterium bovis subsp bovis AF2122/97
gggccgacgcgaacccauacgc

SEQ ID NO: 1102393 - RNA, 17 nt, Mycobacterium bovis subsp bovis AF2122/97
gggccgacgggacaacc

SEQ ID NO: 1102394 - RNA, 20 nt, Mycobacterium bovis subsp bovis AF2122/97
gggccgagcgcaccacggcg

SEQ ID NO: 1102395 - RNA, 14 nt, Mycobacterium bovis subsp bovis AF2122/97
gggccggucgguga

SEQ ID NO: 1102396 - RNA, 15 nt, Mycobacterium bovis subsp bovis AF2122/97
gggccggucgugccg

SEQ ID NO: 1102397 - RNA, 14 nt, Mycobacterium bovis subsp bovis AF2122/97
gggccggugcagca

SEQ ID NO: 1102398 - RNA, 15 nt, Mycobacterium bovis subsp bovis AF2122/97
gggccgccagcggcg

SEQ ID NO: 1102399 - RNA, 21 nt, Mycobacterium bovis subsp bovis AF2122/97
gggccgguugaugguccgcca

SEQ ID NO: 1102400 - RNA, 24 nt, Mycobacterium bovis subsp bovis AF2122/97
gggccgguccggggcaacgaucag

SEQ ID NO: 1102401 - RNA, 13 nt, Mycobacterium bovis subsp bovis AF2122/97
gggccguacggcg

SEQ ID NO: 1102402 - RNA, 14 nt, Mycobacterium bovis subsp bovis AF2122/97
gggccguacggcgc

SEQ ID NO: 1102403 - RNA, 15 nt, Mycobacterium bovis subsp bovis AF2122/97
gggccgucgccgucc

SEQ ID NO: 1102404 - RNA, 12 nt, Mycobacterium bovis subsp bovis AF2122/97
gggccgucggca

SEQ ID NO: 1102405 - RNA, 20 nt, Mycobacterium bovis subsp bovis AF2122/97
gggccgucggggaguucgcg

SEQ ID NO: 1102406 - RNA, 18 nt, Mycobacterium bovis subsp bovis AF2122/97
gggccgucucgccgugga

SEQ ID NO: 1102407 - RNA, 17 nt, Mycobacterium bovis subsp bovis AF2122/97
gggccgugacccucagc

SEQ ID NO: 1102408 - RNA, 20 nt, Mycobacterium bovis subsp bovis AF2122/97
gggcgaacggcaccgcgccc

SEQ ID NO: 1102409 - RNA, 20 nt, Mycobacterium bovis subsp bovis AF2122/97
gggcgaacgcuucaccucgu

SEQ ID NO: 1102410 - RNA, 21 nt, Mycobacterium bovis subsp bovis AF2122/97
gggccuuccugaggguuucca

SEQ ID NO: 1102411 - RNA, 13 nt, Mycobacterium bovis subsp bovis AF2122/97
gggccuucgccac

SEQ ID NO: 1102412 - RNA, 22 nt, Mycobacterium bovis subsp bovis AF2122/97
gggcgcagguuggcaagcacgg

SEQ ID NO: 1102413 - RNA, 16 nt, Mycobacterium bovis subsp bovis AF2122/97
gggcgccacgggugac

SEQ ID NO: 1102414 - RNA, 12 nt, Mycobacterium bovis subsp bovis AF2122/97
gggcgcccggcc

SEQ ID NO: 1102415 - RNA, 20 nt, Mycobacterium bovis subsp bovis AF2122/97
gggcgccccagggggcgugc

SEQ ID NO: 1102416 - RNA, 23 nt, Mycobacterium bovis subsp bovis AF2122/97
gggcgccccagggggcgugccgc

SEQ ID NO: 1102417 - RNA, 17 nt, Mycobacterium bovis subsp bovis AF2122/97
gggcgcccuuaagccgg

SEQ ID NO: 1102418 - RNA, 20 nt, Mycobacterium bovis subsp bovis AF2122/97
gggcgcccuuaagccggcgc

SEQ ID NO: 1102419 - RNA, 16 nt, Mycobacterium bovis subsp bovis AF2122/97
gggcgccgacaccggc

SEQ ID NO: 1102420 - RNA, 12 nt, Mycobacterium bovis subsp bovis AF2122/97
gggcgccgcagc

SEQ ID NO: 1102421 - RNA, 12 nt, Mycobacterium bovis subsp bovis AF2122/97
gggcgccggcgc

SEQ ID NO: 1102422 - RNA, 17 nt, Mycobacterium bovis subsp bovis AF2122/97
gggcgccgcgcucgacg

SEQ ID NO: 1102423 - RNA, 15 nt, Mycobacterium bovis subsp bovis AF2122/97
gggcgccgcgcucga

SEQ ID NO: 1102424 - RNA, 12 nt, Mycobacterium bovis subsp bovis AF2122/97
gggcgccggugu

SEQ ID NO: 1102425 - RNA, 14 nt, Mycobacterium bovis subsp bovis AF2122/97
gggcgcaacgggac

SEQ ID NO: 1102426 - RNA, 20 nt, Mycobacterium bovis subsp bovis AF2122/97
gggcgauucugcgucugcuc

SEQ ID NO: 1102427 - RNA, 20 nt, Mycobacterium bovis subsp bovis AF2122/97
gggcgauucugugucugcuc

SEQ ID NO: 1102428 - RNA, 22 nt, Mycobacterium bovis subsp bovis AF2122/97
gggcgauuuccaucgcgaccuc

SEQ ID NO: 1102429 - RNA, 16 nt, Mycobacterium bovis subsp bovis AF2122/97
gggcgauuucggcgcc

SEQ ID NO: 1102430 - RNA, 14 nt, Mycobacterium bovis subsp bovis AF2122/97
gggcgcaccaggga

SEQ ID NO: 1102431 - RNA, 20 nt, Mycobacterium bovis subsp bovis AF2122/97
gggcgauuuugcgucugcuc

SEQ ID NO: 1102432 - RNA, 18 nt, Mycobacterium bovis subsp bovis AF2122/97
gggcgaugacgccaucga

SEQ ID NO: 1102433 - RNA, 16 nt, Mycobacterium bovis subsp bovis AF2122/97
gggcgauucugcgucu

SEQ ID NO: 1102434 - RNA, 11 nt, Mycobacterium bovis subsp bovis AF2122/97
gggcgauggca

SEQ ID NO: 1102435 - RNA, 14 nt, Mycobacterium bovis subsp bovis AF2122/97
gggcgauggcaccg

SEQ ID NO: 1102436 - RNA, 18 nt, Mycobacterium bovis subsp bovis AF2122/97
gggcgaauccggcgggug

SEQ ID NO: 1102437 - RNA, 20 nt, Mycobacterium bovis subsp bovis AF2122/97
gggcgaaguggaucuggcgc

SEQ ID NO: 1102438 - RNA, 21 nt, Mycobacterium bovis subsp bovis AF2122/97
gggccagcaaguacgcgucgg

SEQ ID NO: 1102439 - RNA, 15 nt, Mycobacterium bovis subsp bovis AF2122/97
gggccagcaccucga

SEQ ID NO: 1102440 - RNA, 13 nt, Mycobacterium bovis subsp bovis AF2122/97
gggccagccgcuc

SEQ ID NO: 1102441 - RNA, 22 nt, Mycobacterium bovis subsp bovis AF2122/97
gggccaggauccgaccccgcgc

SEQ ID NO: 1102442 - RNA, 13 nt, Mycobacterium bovis subsp bovis AF2122/97
gggccagcggcag

SEQ ID NO: 1102443 - RNA, 21 nt, Mycobacterium bovis subsp bovis AF2122/97
gggccaggcccucgacggcgu

SEQ ID NO: 1102444 - RNA, 18 nt, Mycobacterium bovis subsp bovis AF2122/97
gggccaggucagccgcgc

SEQ ID NO: 1102445 - RNA, 15 nt, Mycobacterium bovis subsp bovis AF2122/97
gggccaggucggcga

SEQ ID NO: 1102446 - RNA, 21 nt, Mycobacterium bovis subsp bovis AF2122/97
gggccagugaaaccaccggcc

SEQ ID NO: 1102447 - RNA, 19 nt, Mycobacterium bovis subsp bovis AF2122/97
gggccauaaaugcgcguuc

SEQ ID NO: 1102448 - RNA, 23 nt, Mycobacterium bovis subsp bovis AF2122/97
gggccaugcuaggaccaccagcg

SEQ ID NO: 1102449 - RNA, 22 nt, Mycobacterium bovis subsp bovis AF2122/97
gggccaucgucaggaaccaccc

SEQ ID NO: 1102450 - RNA, 13 nt, Mycobacterium bovis subsp bovis AF2122/97
gggccaucacggu

SEQ ID NO: 1102451 - RNA, 23 nt, Mycobacterium bovis subsp bovis AF2122/97
gggccauaaaugcgcguucgacc

SEQ ID NO: 1102452 - RNA, 13 nt, Mycobacterium bovis subsp bovis AF2122/97
gggcccagcaggu

SEQ ID NO: 1102453 - RNA, 16 nt, Mycobacterium bovis subsp bovis AF2122/97
gggcccaccgcugcgg

SEQ ID NO: 1102454 - RNA, 15 nt, Mycobacterium bovis subsp bovis AF2122/97
gggccccaccgagcg

SEQ ID NO: 1102455 - RNA, 20 nt, Mycobacterium bovis subsp bovis AF2122/97
gggcccagcaggucgucggc

SEQ ID NO: 1102456 - RNA, 17 nt, Mycobacterium bovis subsp bovis AF2122/97
gggcccagcggccgcga

SEQ ID NO: 1102457 - RNA, 16 nt, Mycobacterium bovis subsp bovis AF2122/97
gggccccaugccgacc

SEQ ID NO: 1102458 - RNA, 23 nt, Mycobacterium bovis subsp bovis AF2122/97
gggcccccagguagugcacacuc

SEQ ID NO: 1102459 - RNA, 20 nt, Mycobacterium bovis subsp bovis AF2122/97
gggcccccgccggacacgau

SEQ ID NO: 1102460 - RNA, 20 nt, Mycobacterium bovis subsp bovis AF2122/97
gggcccccuggaucgcgccc

SEQ ID NO: 1102461 - RNA, 15 nt, Mycobacterium bovis subsp bovis AF2122/97
gggccccgccgaugc

SEQ ID NO: 1102462 - RNA, 15 nt, Mycobacterium bovis subsp bovis AF2122/97
gggccccgcgccggc

SEQ ID NO: 1102463 - RNA, 17 nt, Mycobacterium bovis subsp bovis AF2122/97
gggccccgcgccggccg

SEQ ID NO: 1102464 - RNA, 22 nt, Mycobacterium bovis subsp bovis AF2122/97
gggccccgcgccggccgcacgc

SEQ ID NO: 1102465 - RNA, 12 nt, Mycobacterium bovis subsp bovis AF2122/97
gggccccgcggc

SEQ ID NO: 1102466 - RNA, 16 nt, Mycobacterium bovis subsp bovis AF2122/97
gggccccgcggcgccg

SEQ ID NO: 1102467 - RNA, 19 nt, Mycobacterium bovis subsp bovis AF2122/97
gggccccgcggcgccgcca

SEQ ID NO: 1102468 - RNA, 13 nt, Mycobacterium bovis subsp bovis AF2122/97
gggccccuccggc

SEQ ID NO: 1102469 - RNA, 15 nt, Mycobacterium bovis subsp bovis AF2122/97
gggccccuccggcca

SEQ ID NO: 1102470 - RNA, 16 nt, Mycobacterium bovis subsp bovis AF2122/97
gggccccuccggccac

SEQ ID NO: 1102471 - RNA, 15 nt, Mycobacterium bovis subsp bovis AF2122/97
gggccgaccagucga

SEQ ID NO: 1102472 - RNA, 19 nt, Mycobacterium bovis subsp bovis AF2122/97
gggccccuucgcagcaugu

SEQ ID NO: 1102473 - RNA, 13 nt, Mycobacterium bovis subsp bovis AF2122/97
gggccaccaccac

SEQ ID NO: 1102474 - RNA, 22 nt, Mycobacterium bovis subsp bovis AF2122/97
gggccaaccgggugugcgucga

SEQ ID NO: 1102475 - RNA, 14 nt, Mycobacterium bovis subsp bovis AF2122/97
gggcauugcggcgc

SEQ ID NO: 1102476 - RNA, 16 nt, Mycobacterium bovis subsp bovis AF2122/97
gggccaaugccguuga

SEQ ID NO: 1102477 - RNA, 18 nt, Mycobacterium bovis subsp bovis AF2122/97
gggccaaagcgcgggcgg

SEQ ID NO: 1102478 - RNA, 19 nt, Mycobacterium bovis subsp bovis AF2122/97
gggccaaagcgcgggcggu

SEQ ID NO: 1102479 - RNA, 16 nt, Mycobacterium bovis subsp bovis AF2122/97
gggcauucccgcucgc

SEQ ID NO: 1102480 - RNA, 23 nt, Mycobacterium bovis subsp bovis AF2122/97
gggcauucccgcucgcaggccgg

SEQ ID NO: 1102481 - RNA, 24 nt, Mycobacterium bovis subsp bovis AF2122/97
gggccaccguaaacagcgcgccgg

SEQ ID NO: 1102482 - RNA, 14 nt, Mycobacterium bovis subsp bovis AF2122/97
gggccaccggcgcc

SEQ ID NO: 1102483 - RNA, 22 nt, Mycobacterium bovis subsp bovis AF2122/97
gggccaccgcugucagccgacc

SEQ ID NO: 1102484 - RNA, 13 nt, Mycobacterium bovis subsp bovis AF2122/97
gggccaccgccgc

SEQ ID NO: 1102485 - RNA, 14 nt, Mycobacterium bovis subsp bovis AF2122/97
gggccaccgccgcc

SEQ ID NO: 1102486 - RNA, 15 nt, Mycobacterium bovis subsp bovis AF2122/97
gggccaccgccgccu

SEQ ID NO: 1102487 - RNA, 13 nt, Mycobacterium bovis subsp bovis AF2122/97
gggccaccgcgcc

SEQ ID NO: 1102488 - RNA, 12 nt, Mycobacterium bovis subsp bovis AF2122/97
gggccacgucga

SEQ ID NO: 1102489 - RNA, 17 nt, Mycobacterium bovis subsp bovis AF2122/97
gggccagaucgaagcgc

SEQ ID NO: 1102490 - RNA, 19 nt, Mycobacterium bovis subsp bovis AF2122/97
gggccagaucgaagcgcag

SEQ ID NO: 1102491 - RNA, 15 nt, Mycobacterium bovis subsp bovis AF2122/97
gggccacuggccggu

SEQ ID NO: 1102492 - RNA, 19 nt, Mycobacterium bovis subsp bovis AF2122/97
gggccacuggccgguucgc

SEQ ID NO: 1102493 - RNA, 22 nt, Mycobacterium bovis subsp bovis AF2122/97
gggccacuugaugcucgaugcg

SEQ ID NO: 1102494 - RNA, 14 nt, Mycobacterium bovis subsp bovis AF2122/97
gggcaccacccgau

SEQ ID NO: 1102495 - RNA, 20 nt, Mycobacterium bovis subsp bovis AF2122/97
gggcaucgucgucgcugccg

SEQ ID NO: 1102496 - RNA, 14 nt, Mycobacterium bovis subsp bovis AF2122/97
gggcaucgucgccg

SEQ ID NO: 1102497 - RNA, 21 nt, Mycobacterium bovis subsp bovis AF2122/97
gggcaucucggcuacgccucg

SEQ ID NO: 1102498 - RNA, 18 nt, Mycobacterium bovis subsp bovis AF2122/97
gggcaaccgccccuuccc

SEQ ID NO: 1102499 - RNA, 16 nt, Mycobacterium bovis subsp bovis AF2122/97
gggcaaggacaagccg

SEQ ID NO: 1102500 - RNA, 16 nt, Mycobacterium bovis subsp bovis AF2122/97
gggcaaggccaccggc

SEQ ID NO: 1102501 - RNA, 17 nt, Mycobacterium bovis subsp bovis AF2122/97
gggcaaggccaccggcg

SEQ ID NO: 1102502 - RNA, 18 nt, Mycobacterium bovis subsp bovis AF2122/97
gggcaacuucagcaacgg

SEQ ID NO: 1102503 - RNA, 20 nt, Mycobacterium bovis subsp bovis AF2122/97
gggcaauuaggucgaccacc

SEQ ID NO: 1102504 - RNA, 20 nt, Mycobacterium bovis subsp bovis AF2122/97
gggcaauccggucagcgcgg

SEQ ID NO: 1102505 - RNA, 17 nt, Mycobacterium bovis subsp bovis AF2122/97
gggcacaccgacgccgc

SEQ ID NO: 1102506 - RNA, 21 nt, Mycobacterium bovis subsp bovis AF2122/97
gggcacaccgacgccgccagg

SEQ ID NO: 1102507 - RNA, 15 nt, Mycobacterium bovis subsp bovis AF2122/97
ggcuguccgaccucg

SEQ ID NO: 1102508 - RNA, 16 nt, Mycobacterium bovis subsp bovis AF2122/97
ggcuguccgaccucgc

SEQ ID NO: 1102509 - RNA, 22 nt, Mycobacterium bovis subsp bovis AF2122/97
ggcuguccgaccucgccgcgcg

SEQ ID NO: 1102510 - RNA, 17 nt, Mycobacterium bovis subsp bovis AF2122/97
ggcuguccgcgggccgc

SEQ ID NO: 1102511 - RNA, 13 nt, Mycobacterium bovis subsp bovis AF2122/97
ggcuguccaccga

SEQ ID NO: 1102512 - RNA, 18 nt, Mycobacterium bovis subsp bovis AF2122/97
ggcugucguaugauucac

SEQ ID NO: 1102513 - RNA, 13 nt, Mycobacterium bovis subsp bovis AF2122/97
ggcuguggccgcg

SEQ ID NO: 1102514 - RNA, 18 nt, Mycobacterium bovis subsp bovis AF2122/97
ggcuguggccgcgucgcg

SEQ ID NO: 1102515 - RNA, 13 nt, Mycobacterium bovis subsp bovis AF2122/97
ggcuguggucgcu

SEQ ID NO: 1102516 - RNA, 23 nt, Mycobacterium bovis subsp bovis AF2122/97
ggcuguucgcgccauacuggcgg

SEQ ID NO: 1102517 - RNA, 22 nt, Mycobacterium bovis subsp bovis AF2122/97
ggcuguucggccauggcggcgc

SEQ ID NO: 1102518 - RNA, 21 nt, Mycobacterium bovis subsp bovis AF2122/97
ggcucgucagguuccgcgaca

SEQ ID NO: 1102519 - RNA, 18 nt, Mycobacterium bovis subsp bovis AF2122/97
ggcugugaucgagucgcg

SEQ ID NO: 1102520 - RNA, 15 nt, Mycobacterium bovis subsp bovis AF2122/97
ggcucguguccgccg

SEQ ID NO: 1102521 - RNA, 22 nt, Mycobacterium bovis subsp bovis AF2122/97
ggcuguacucgcggcgcggccg

SEQ ID NO: 1102522 - RNA, 19 nt, Mycobacterium bovis subsp bovis AF2122/97
ggcucguggcgacggcguc

SEQ ID NO: 1102523 - RNA, 16 nt, Mycobacterium bovis subsp bovis AF2122/97
ggcucgucgauccccg

SEQ ID NO: 1102524 - RNA, 18 nt, Mycobacterium bovis subsp bovis AF2122/97
ggcucgucgaugucgacg

SEQ ID NO: 1102525 - RNA, 19 nt, Mycobacterium bovis subsp bovis AF2122/97
ggcucgucgaugucgacgu

SEQ ID NO: 1102526 - RNA, 15 nt, Mycobacterium bovis subsp bovis AF2122/97
ggcuguccagcagcg

SEQ ID NO: 1102527 - RNA, 18 nt, Mycobacterium bovis subsp bovis AF2122/97
ggcugucacgccugccac

SEQ ID NO: 1102528 - RNA, 20 nt, Mycobacterium bovis subsp bovis AF2122/97
ggcugucaguucccgcuuga

SEQ ID NO: 1102529 - RNA, 21 nt, Mycobacterium bovis subsp bovis AF2122/97
ggcuguagucgauguacaccg

SEQ ID NO: 1102530 - RNA, 13 nt, Mycobacterium bovis subsp bovis AF2122/97
ggcucggcgcagc

SEQ ID NO: 1102531 - RNA, 18 nt, Mycobacterium bovis subsp bovis AF2122/97
ggcucggugacccccgag

SEQ ID NO: 1102532 - RNA, 17 nt, Mycobacterium bovis subsp bovis AF2122/97
ggcucgguggcgccggg

SEQ ID NO: 1102533 - RNA, 24 nt, Mycobacterium bovis subsp bovis AF2122/97
ggcucguaggugggcucguagcgc

SEQ ID NO: 1102534 - RNA, 18 nt, Mycobacterium bovis subsp bovis AF2122/97
ggcucggguggccagcgg

SEQ ID NO: 1102535 - RNA, 13 nt, Mycobacterium bovis subsp bovis AF2122/97
ggcucggcgucgc

SEQ ID NO: 1102536 - RNA, 15 nt, Mycobacterium bovis subsp bovis AF2122/97
ggcucggcgucgccg

SEQ ID NO: 1102537 - RNA, 20 nt, Mycobacterium bovis subsp bovis AF2122/97
ggcuuacuugaucucggcga

SEQ ID NO: 1102538 - RNA, 20 nt, Mycobacterium bovis subsp bovis AF2122/97
ggcuguugcguucggucagu

SEQ ID NO: 1102539 - RNA, 16 nt, Mycobacterium bovis subsp bovis AF2122/97
ggcuguucucgccgaa

SEQ ID NO: 1102540 - RNA, 17 nt, Mycobacterium bovis subsp bovis AF2122/97
ggcuuaugcgucugcuc

SEQ ID NO: 1102541 - RNA, 22 nt, Mycobacterium bovis subsp bovis AF2122/97
ggcuuaugcgucugcucgccgg

SEQ ID NO: 1102542 - RNA, 13 nt, Mycobacterium bovis subsp bovis AF2122/97
ggcuuauugcccg

SEQ ID NO: 1102543 - RNA, 20 nt, Mycobacterium bovis subsp bovis AF2122/97
ggcuucaacccgggcagcau

SEQ ID NO: 1102544 - RNA, 23 nt, Mycobacterium bovis subsp bovis AF2122/97
ggcuuacuugaucucggcgagca

SEQ ID NO: 1102545 - RNA, 17 nt, Mycobacterium bovis subsp bovis AF2122/97
ggcuuccggcaagucga

SEQ ID NO: 1102546 - RNA, 18 nt, Mycobacterium bovis subsp bovis AF2122/97
ggcuuccggcgcgaccgg

SEQ ID NO: 1102547 - RNA, 23 nt, Mycobacterium bovis subsp bovis AF2122/97
ggcuuccgacaugaaccggucga

SEQ ID NO: 1102548 - RNA, 21 nt, Mycobacterium bovis subsp bovis AF2122/97
ggcuuccccagcaguucgccg

SEQ ID NO: 1102549 - RNA, 23 nt, Mycobacterium bovis subsp bovis AF2122/97
ggcuuccccagcaguucgccgcg

SEQ ID NO: 1102550 - RNA, 23 nt, Mycobacterium bovis subsp bovis AF2122/97
ggcuuccagcucgggggcgccgg

SEQ ID NO: 1102551 - RNA, 21 nt, Mycobacterium bovis subsp bovis AF2122/97
ggcuucaagauuaccgaagcc

SEQ ID NO: 1102552 - RNA, 21 nt, Mycobacterium bovis subsp bovis AF2122/97
ggcuucacccaaccccgccgg

SEQ ID NO: 1102553 - RNA, 22 nt, Mycobacterium bovis subsp bovis AF2122/97
ggcuucacccaaccccgccggc

SEQ ID NO: 1102554 - RNA, 17 nt, Mycobacterium bovis subsp bovis AF2122/97
ggcuucagcacgcggga

SEQ ID NO: 1102555 - RNA, 17 nt, Mycobacterium bovis subsp bovis AF2122/97
ggcuuccagccacagcc

SEQ ID NO: 1102556 - RNA, 15 nt, Mycobacterium bovis subsp bovis AF2122/97
ggcuugccgcgcacc

SEQ ID NO: 1102557 - RNA, 19 nt, Mycobacterium bovis subsp bovis AF2122/97
ggcuugcccggcucggcag

SEQ ID NO: 1102558 - RNA, 17 nt, Mycobacterium bovis subsp bovis AF2122/97
ggcuugcgcagcagcgu

SEQ ID NO: 1102559 - RNA, 21 nt, Mycobacterium bovis subsp bovis AF2122/97
ggcuugcgccggaugacaccg

SEQ ID NO: 1102560 - RNA, 20 nt, Mycobacterium bovis subsp bovis AF2122/97
ggcuugcgcgacgagacgca

SEQ ID NO: 1102561 - RNA, 15 nt, Mycobacterium bovis subsp bovis AF2122/97
ggcuucggcggccga

SEQ ID NO: 1102562 - RNA, 21 nt, Mycobacterium bovis subsp bovis AF2122/97
ggcuucggcgaacccuccgca

SEQ ID NO: 1102563 - RNA, 22 nt, Mycobacterium bovis subsp bovis AF2122/97
ggcuucgcgguuggcggcgaug

SEQ ID NO: 1102564 - RNA, 19 nt, Mycobacterium bovis subsp bovis AF2122/97
ggcuucgacaaccucgagu

SEQ ID NO: 1102565 - RNA, 17 nt, Mycobacterium bovis subsp bovis AF2122/97
ggcuucgacggcggcca

SEQ ID NO: 1102566 - RNA, 18 nt, Mycobacterium bovis subsp bovis AF2122/97
ggcuucgacggcggccaa

SEQ ID NO: 1102567 - RNA, 18 nt, Mycobacterium bovis subsp bovis AF2122/97
ggcuucgacgucggcgac

SEQ ID NO: 1102568 - RNA, 19 nt, Mycobacterium bovis subsp bovis AF2122/97
ggcuuccuccgacgcgauc

SEQ ID NO: 1102569 - RNA, 22 nt, Mycobacterium bovis subsp bovis AF2122/97
ggcuucgaugucguaccgggcg

SEQ ID NO: 1102570 - RNA, 21 nt, Mycobacterium bovis subsp bovis AF2122/97
ggcuucgauugcgcugcaccg

SEQ ID NO: 1102571 - RNA, 12 nt, Mycobacterium bovis subsp bovis AF2122/97
ggcuucgccgcg

SEQ ID NO: 1102572 - RNA, 20 nt, Mycobacterium bovis subsp bovis AF2122/97
ggcuucgaguuuggcgacga

SEQ ID NO: 1102573 - RNA, 13 nt, Mycobacterium bovis subsp bovis AF2122/97
gggaugcucaccg

SEQ ID NO: 1102574 - RNA, 17 nt, Mycobacterium bovis subsp bovis AF2122/97
gggauggacaccaccuc

SEQ ID NO: 1102575 - RNA, 13 nt, Mycobacterium bovis subsp bovis AF2122/97
gggauggagccgg

SEQ ID NO: 1102576 - RNA, 15 nt, Mycobacterium bovis subsp bovis AF2122/97
gggauggagccggug

SEQ ID NO: 1102577 - RNA, 15 nt, Mycobacterium bovis subsp bovis AF2122/97
gggauggcaccaccc

SEQ ID NO: 1102578 - RNA, 13 nt, Mycobacterium bovis subsp bovis AF2122/97
gggauggccgccg

SEQ ID NO: 1102579 - RNA, 14 nt, Mycobacterium bovis subsp bovis AF2122/97
gggauggccgccga

SEQ ID NO: 1102580 - RNA, 13 nt, Mycobacterium bovis subsp bovis AF2122/97
gggcaacgccucg

SEQ ID NO: 1102581 - RNA, 13 nt, Mycobacterium bovis subsp bovis AF2122/97
gggcaacgcgaac

SEQ ID NO: 1102582 - RNA, 17 nt, Mycobacterium bovis subsp bovis AF2122/97
gggcaacugcagcaugg

SEQ ID NO: 1102583 - RNA, 16 nt, Mycobacterium bovis subsp bovis AF2122/97
gggaugggggagccgg

SEQ ID NO: 1102584 - RNA, 18 nt, Mycobacterium bovis subsp bovis AF2122/97
gggauggucccgcucugg

SEQ ID NO: 1102585 - RNA, 17 nt, Mycobacterium bovis subsp bovis AF2122/97
gggaucguccggccggg

SEQ ID NO: 1102586 - RNA, 18 nt, Mycobacterium bovis subsp bovis AF2122/97
gggaucgugccggcgaac

SEQ ID NO: 1102587 - RNA, 20 nt, Mycobacterium bovis subsp bovis AF2122/97
gggaucugagggcucggugg

SEQ ID NO: 1102588 - RNA, 17 nt, Mycobacterium bovis subsp bovis AF2122/97
gggauauccggucgcuc

SEQ ID NO: 1102589 - RNA, 23 nt, Mycobacterium bovis subsp bovis AF2122/97
gggaugaucaccgggcccgacgc

SEQ ID NO: 1102590 - RNA, 14 nt, Mycobacterium bovis subsp bovis AF2122/97
gggaugcccgcuga

SEQ ID NO: 1102591 - RNA, 18 nt, Mycobacterium bovis subsp bovis AF2122/97
gggaucuauuggaugcga

SEQ ID NO: 1102592 - RNA, 14 nt, Mycobacterium bovis subsp bovis AF2122/97
gggagccaccggcg

SEQ ID NO: 1102593 - RNA, 21 nt, Mycobacterium bovis subsp bovis AF2122/97
gggagccaccggcgucgacgu

SEQ ID NO: 1102594 - RNA, 15 nt, Mycobacterium bovis subsp bovis AF2122/97
gggagcgccgcaggg

SEQ ID NO: 1102595 - RNA, 21 nt, Mycobacterium bovis subsp bovis AF2122/97
gggagcgccgcagggucccgu

SEQ ID NO: 1102596 - RNA, 15 nt, Mycobacterium bovis subsp bovis AF2122/97
gggagcugcggcggc

SEQ ID NO: 1102597 - RNA, 21 nt, Mycobacterium bovis subsp bovis AF2122/97
gggagcguaguucaccaacgc

SEQ ID NO: 1102598 - RNA, 16 nt, Mycobacterium bovis subsp bovis AF2122/97
gggagcggcugcacgc

SEQ ID NO: 1102599 - RNA, 16 nt, Mycobacterium bovis subsp bovis AF2122/97
gggaggccaccgcgaa

SEQ ID NO: 1102600 - RNA, 21 nt, Mycobacterium bovis subsp bovis AF2122/97
gggaguucgcgcagcaccggc

SEQ ID NO: 1102601 - RNA, 21 nt, Mycobacterium bovis subsp bovis AF2122/97
gggaguucggggugcgcccag

SEQ ID NO: 1102602 - RNA, 18 nt, Mycobacterium bovis subsp bovis AF2122/97
gggauacucgucgucggc

SEQ ID NO: 1102603 - RNA, 14 nt, Mycobacterium bovis subsp bovis AF2122/97
gggauagacgaccc

SEQ ID NO: 1102604 - RNA, 13 nt, Mycobacterium bovis subsp bovis AF2122/97
gggagucgucggc

SEQ ID NO: 1102605 - RNA, 12 nt, Mycobacterium bovis subsp bovis AF2122/97
gggagucgucgu

SEQ ID NO: 1102606 - RNA, 16 nt, Mycobacterium bovis subsp bovis AF2122/97
gggagucuucggcgac

SEQ ID NO: 1102607 - RNA, 20 nt, Mycobacterium bovis subsp bovis AF2122/97
gggaguccggccgacccgga

SEQ ID NO: 1102608 - RNA, 15 nt, Mycobacterium bovis subsp bovis AF2122/97
gggagugucagcgcc

SEQ ID NO: 1102609 - RNA, 14 nt, Mycobacterium bovis subsp bovis AF2122/97
gggaguucgcaccc

SEQ ID NO: 1102610 - RNA, 13 nt, Mycobacterium bovis subsp bovis AF2122/97
gggaguucgcgca

SEQ ID NO: 1102611 - RNA, 20 nt, Mycobacterium bovis subsp bovis AF2122/97
gggacgaaucccgcgcccgg

SEQ ID NO: 1102612 - RNA, 20 nt, Mycobacterium bovis subsp bovis AF2122/97
gggaccuugaucgagcaggg

SEQ ID NO: 1102613 - RNA, 20 nt, Mycobacterium bovis subsp bovis AF2122/97
gggaccuauuggucgcucgc

SEQ ID NO: 1102614 - RNA, 20 nt, Mycobacterium bovis subsp bovis AF2122/97
gggaccgaucuuggccaccg

SEQ ID NO: 1102615 - RNA, 13 nt, Mycobacterium bovis subsp bovis AF2122/97
gggaccgcccgag

SEQ ID NO: 1102616 - RNA, 18 nt, Mycobacterium bovis subsp bovis AF2122/97
gggaccgggaacccgagc

SEQ ID NO: 1102617 - RNA, 22 nt, Mycobacterium bovis subsp bovis AF2122/97
gggaccuugaucgagcagggug

SEQ ID NO: 1102618 - RNA, 17 nt, Mycobacterium bovis subsp bovis AF2122/97
gggacuucgugccucgg

SEQ ID NO: 1102619 - RNA, 15 nt, Mycobacterium bovis subsp bovis AF2122/97
gggacgacggcaaga

SEQ ID NO: 1102620 - RNA, 18 nt, Mycobacterium bovis subsp bovis AF2122/97
gggagaaaacggcggcgc

SEQ ID NO: 1102621 - RNA, 17 nt, Mycobacterium bovis subsp bovis AF2122/97
gggacccggaccuucgg

SEQ ID NO: 1102622 - RNA, 18 nt, Mycobacterium bovis subsp bovis AF2122/97
gggaccaggccaacggcg

SEQ ID NO: 1102623 - RNA, 16 nt, Mycobacterium bovis subsp bovis AF2122/97
gggaccauagccugcg

SEQ ID NO: 1102624 - RNA, 14 nt, Mycobacterium bovis subsp bovis AF2122/97
gggacccagcggcg

SEQ ID NO: 1102625 - RNA, 23 nt, Mycobacterium bovis subsp bovis AF2122/97
gggaccaccgggauggcucaccc

SEQ ID NO: 1102626 - RNA, 15 nt, Mycobacterium bovis subsp bovis AF2122/97
gggaccacgccgacg

SEQ ID NO: 1102627 - RNA, 14 nt, Mycobacterium bovis subsp bovis AF2122/97
gggaagccgccggg

SEQ ID NO: 1102628 - RNA, 12 nt, Mycobacterium bovis subsp bovis AF2122/97
gggaagacgacc

SEQ ID NO: 1102629 - RNA, 23 nt, Mycobacterium bovis subsp bovis AF2122/97
ggcuuggaccagcguggggccgc

SEQ ID NO: 1102630 - RNA, 17 nt, Mycobacterium bovis subsp bovis AF2122/97
ggcuugcggcacccagu

SEQ ID NO: 1102631 - RNA, 21 nt, Mycobacterium bovis subsp bovis AF2122/97
ggcuugcgugaugguugcucg

SEQ ID NO: 1102632 - RNA, 15 nt, Mycobacterium bovis subsp bovis AF2122/97
ggcuugcucugcgca

SEQ ID NO: 1102633 - RNA, 22 nt, Mycobacterium bovis subsp bovis AF2122/97
ggcuuggcgccgaugccggcca

SEQ ID NO: 1102634 - RNA, 13 nt, Mycobacterium bovis subsp bovis AF2122/97
ggcuuggcgacga

SEQ ID NO: 1102635 - RNA, 21 nt, Mycobacterium bovis subsp bovis AF2122/97
ggcuuggccuagccgcggcac

SEQ ID NO: 1102636 - RNA, 23 nt, Mycobacterium bovis subsp bovis AF2122/97
ggcuuggccuagccgcggcaccg

SEQ ID NO: 1102637 - RNA, 17 nt, Mycobacterium bovis subsp bovis AF2122/97
gggaaccacggucagca

SEQ ID NO: 1102638 - RNA, 12 nt, Mycobacterium bovis subsp bovis AF2122/97
gggaaccagaug

SEQ ID NO: 1102639 - RNA, 16 nt, Mycobacterium bovis subsp bovis AF2122/97
gggaaccagcggucgg

SEQ ID NO: 1102640 - RNA, 19 nt, Mycobacterium bovis subsp bovis AF2122/97
gggaacgaguacgggcagg

SEQ ID NO: 1102641 - RNA, 19 nt, Mycobacterium bovis subsp bovis AF2122/97
gggaacgaugccgccggcg

SEQ ID NO: 1102642 - RNA, 20 nt, Mycobacterium bovis subsp bovis AF2122/97
gggaacgaugccgccggcgg

SEQ ID NO: 1102643 - RNA, 13 nt, Mycobacterium bovis subsp bovis AF2122/97
gggaacgccgaac

SEQ ID NO: 1102644 - RNA, 15 nt, Mycobacterium bovis subsp bovis AF2122/97
gggaacgcggcggcg

SEQ ID NO: 1102645 - RNA, 22 nt, Mycobacterium bovis subsp bovis AF2122/97
gggaacguccgcgccgagcccg

SEQ ID NO: 1102646 - RNA, 21 nt, Mycobacterium bovis subsp bovis AF2122/97
gggaacgugacccccagcagg

SEQ ID NO: 1102647 - RNA, 23 nt, Mycobacterium bovis subsp bovis AF2122/97
gggaacuggaccacagccgcgcc

SEQ ID NO: 1102648 - RNA, 14 nt, Mycobacterium bovis subsp bovis AF2122/97
gucgagcaccucga

SEQ ID NO: 1102649 - RNA, 19 nt, Mycobacterium bovis subsp bovis AF2122/97
gucgagcaccugccgaucg

SEQ ID NO: 1102650 - RNA, 16 nt, Mycobacterium bovis subsp bovis AF2122/97
gucgagcaccugccga

SEQ ID NO: 1102651 - RNA, 18 nt, Mycobacterium bovis subsp bovis AF2122/97
gucgagcaccugccgauc

SEQ ID NO: 1102652 - RNA, 17 nt, Mycobacterium bovis subsp bovis AF2122/97
gucgagcaccggcugcg

SEQ ID NO: 1102653 - RNA, 22 nt, Mycobacterium bovis subsp bovis AF2122/97
gucgagcaccggcugcggggcg

SEQ ID NO: 1102654 - RNA, 16 nt, Mycobacterium bovis subsp bovis AF2122/97
gucgacgucggcaauc

SEQ ID NO: 1102655 - RNA, 14 nt, Mycobacterium bovis subsp bovis AF2122/97
gucgacgucgacgg

SEQ ID NO: 1102656 - RNA, 22 nt, Mycobacterium bovis subsp bovis AF2122/97
gucgacgucgauuucggcgacc

SEQ ID NO: 1102657 - RNA, 15 nt, Mycobacterium bovis subsp bovis AF2122/97
gucgacgucggcgag

SEQ ID NO: 1102658 - RNA, 19 nt, Mycobacterium bovis subsp bovis AF2122/97
gucgacgucggcgagcucg

SEQ ID NO: 1102659 - RNA, 14 nt, Mycobacterium bovis subsp bovis AF2122/97
gucgacgucgauca

SEQ ID NO: 1102660 - RNA, 15 nt, Mycobacterium bovis subsp bovis AF2122/97
gucgacgucgauggu

SEQ ID NO: 1102661 - RNA, 17 nt, Mycobacterium bovis subsp bovis AF2122/97
gucgagcagccgcgaca

SEQ ID NO: 1102662 - RNA, 12 nt, Mycobacterium bovis subsp bovis AF2122/97
gucgagcagcgc

SEQ ID NO: 1102663 - RNA, 13 nt, Mycobacterium bovis subsp bovis AF2122/97
gucgagcagccga

SEQ ID NO: 1102664 - RNA, 15 nt, Mycobacterium bovis subsp bovis AF2122/97
gucgagcagccgagc

SEQ ID NO: 1102665 - RNA, 16 nt, Mycobacterium bovis subsp bovis AF2122/97
gucgagcacgcugcug

SEQ ID NO: 1102666 - RNA, 19 nt, Mycobacterium bovis subsp bovis AF2122/97
gucgagcacgaugucgaug

SEQ ID NO: 1102667 - RNA, 22 nt, Mycobacterium bovis subsp bovis AF2122/97
gucgagcacgaugucgaugccg

SEQ ID NO: 1102668 - RNA, 15 nt, Mycobacterium bovis subsp bovis AF2122/97
gucgagcagcaccac

SEQ ID NO: 1102669 - RNA, 23 nt, Mycobacterium bovis subsp bovis AF2122/97
gucgagccggacccggugcacgg

SEQ ID NO: 1102670 - RNA, 13 nt, Mycobacterium bovis subsp bovis AF2122/97
gucgagccggauu

SEQ ID NO: 1102671 - RNA, 16 nt, Mycobacterium bovis subsp bovis AF2122/97
gucgagcaucccgguc

SEQ ID NO: 1102672 - RNA, 14 nt, Mycobacterium bovis subsp bovis AF2122/97
gucgagcaugcgau

SEQ ID NO: 1102673 - RNA, 16 nt, Mycobacterium bovis subsp bovis AF2122/97
gucgagccggugccgc

SEQ ID NO: 1102674 - RNA, 22 nt, Mycobacterium bovis subsp bovis AF2122/97
gucgagcgaccccacacgccga

SEQ ID NO: 1102675 - RNA, 13 nt, Mycobacterium bovis subsp bovis AF2122/97
gucgagcgccgcg

SEQ ID NO: 1102676 - RNA, 15 nt, Mycobacterium bovis subsp bovis AF2122/97
gucgagcgccggccg

SEQ ID NO: 1102677 - RNA, 22 nt, Mycobacterium bovis subsp bovis AF2122/97
gucgagcgccuugucgaucucg

SEQ ID NO: 1102678 - RNA, 21 nt, Mycobacterium bovis subsp bovis AF2122/97
gucgagcgcccacuggugauc

SEQ ID NO: 1102679 - RNA, 23 nt, Mycobacterium bovis subsp bovis AF2122/97
gucgagcgcggugccgccaccgg

SEQ ID NO: 1102680 - RNA, 13 nt, Mycobacterium bovis subsp bovis AF2122/97
gucgagcgcgucg

SEQ ID NO: 1102681 - RNA, 22 nt, Mycobacterium bovis subsp bovis AF2122/97
gucgagcgcuucgucgccgaac

SEQ ID NO: 1102682 - RNA, 18 nt, Mycobacterium bovis subsp bovis AF2122/97
gucgagcugauccaagua

SEQ ID NO: 1102683 - RNA, 14 nt, Mycobacterium bovis subsp bovis AF2122/97
gucgacggcugcgc

SEQ ID NO: 1102684 - RNA, 17 nt, Mycobacterium bovis subsp bovis AF2122/97
gucgacgggcacgcggc

SEQ ID NO: 1102685 - RNA, 15 nt, Mycobacterium bovis subsp bovis AF2122/97
gucgacggcggccgc

SEQ ID NO: 1102686 - RNA, 13 nt, Mycobacterium bovis subsp bovis AF2122/97
gucgacggcggcc

SEQ ID NO: 1102687 - RNA, 16 nt, Mycobacterium bovis subsp bovis AF2122/97
gucgacggcgauggcg

SEQ ID NO: 1102688 - RNA, 18 nt, Mycobacterium bovis subsp bovis AF2122/97
gucgacggcgauggcgcg

SEQ ID NO: 1102689 - RNA, 13 nt, Mycobacterium bovis subsp bovis AF2122/97
gucgacgcggccg

SEQ ID NO: 1102690 - RNA, 19 nt, Mycobacterium bovis subsp bovis AF2122/97
gucgacggaaucgucggcg

SEQ ID NO: 1102691 - RNA, 18 nt, Mycobacterium bovis subsp bovis AF2122/97
gucgacgggucggcgccg

SEQ ID NO: 1102692 - RNA, 20 nt, Mycobacterium bovis subsp bovis AF2122/97
gucgacgggucggcgccgag

SEQ ID NO: 1102693 - RNA, 16 nt, Mycobacterium bovis subsp bovis AF2122/97
gucgacgggcucguca

SEQ ID NO: 1102694 - RNA, 23 nt, Mycobacterium bovis subsp bovis AF2122/97
gucgacggggcggucggccggcu

SEQ ID NO: 1102695 - RNA, 18 nt, Mycobacterium bovis subsp bovis AF2122/97
gucgacggcggccgccac

SEQ ID NO: 1102696 - RNA, 13 nt, Mycobacterium bovis subsp bovis AF2122/97
gucgacggucacc

SEQ ID NO: 1102697 - RNA, 17 nt, Mycobacterium bovis subsp bovis AF2122/97
gucgacggucaccggcg

SEQ ID NO: 1102698 - RNA, 18 nt, Mycobacterium bovis subsp bovis AF2122/97
gucgacggucaccggcgc

SEQ ID NO: 1102699 - RNA, 14 nt, Mycobacterium bovis subsp bovis AF2122/97
gucgacggucaucc

SEQ ID NO: 1102700 - RNA, 16 nt, Mycobacterium bovis subsp bovis AF2122/97
gucgacgucagcacca

SEQ ID NO: 1102701 - RNA, 12 nt, Mycobacterium bovis subsp bovis AF2122/97
gucgacggugcc

SEQ ID NO: 1102702 - RNA, 17 nt, Mycobacterium bovis subsp bovis AF2122/97
gucgacggugccgucgg

SEQ ID NO: 1102703 - RNA, 13 nt, Mycobacterium bovis subsp bovis AF2122/97
gucgacgguggcg

SEQ ID NO: 1102704 - RNA, 17 nt, Mycobacterium bovis subsp bovis AF2122/97
gucgacgguggcgccgu

SEQ ID NO: 1102705 - RNA, 20 nt, Mycobacterium bovis subsp bovis AF2122/97
gucgacgguggcgccgucgg

SEQ ID NO: 1102706 - RNA, 22 nt, Mycobacterium bovis subsp bovis AF2122/97
gucgacgguggcgccgucggcc

SEQ ID NO: 1102707 - RNA, 19 nt, Mycobacterium bovis subsp bovis AF2122/97
gucgacggugucuugggcg

SEQ ID NO: 1102708 - RNA, 21 nt, Mycobacterium bovis subsp bovis AF2122/97
guccgaucguuucagcuagac

SEQ ID NO: 1102709 - RNA, 20 nt, Mycobacterium bovis subsp bovis AF2122/97
guccgagggcgucgccgccg

SEQ ID NO: 1102710 - RNA, 16 nt, Mycobacterium bovis subsp bovis AF2122/97
guccgagacgucggcg

SEQ ID NO: 1102711 - RNA, 13 nt, Mycobacterium bovis subsp bovis AF2122/97
guccgaucgccga

SEQ ID NO: 1102712 - RNA, 15 nt, Mycobacterium bovis subsp bovis AF2122/97
guccgaucggcgcgc

SEQ ID NO: 1102713 - RNA, 17 nt, Mycobacterium bovis subsp bovis AF2122/97
guccgaucggcgcgccg

SEQ ID NO: 1102714 - RNA, 15 nt, Mycobacterium bovis subsp bovis AF2122/97
guccgcaaccucgcc

SEQ ID NO: 1102715 - RNA, 16 nt, Mycobacterium bovis subsp bovis AF2122/97
guccgcaaccucgccg

SEQ ID NO: 1102716 - RNA, 20 nt, Mycobacterium bovis subsp bovis AF2122/97
gucgacgcgguccucgagcc

SEQ ID NO: 1102717 - RNA, 22 nt, Mycobacterium bovis subsp bovis AF2122/97
guccgcagcaccgucgggccca

SEQ ID NO: 1102718 - RNA, 13 nt, Mycobacterium bovis subsp bovis AF2122/97
guccgauuggugu

SEQ ID NO: 1102719 - RNA, 19 nt, Mycobacterium bovis subsp bovis AF2122/97
guccgcaaccucgccgucg

SEQ ID NO: 1102720 - RNA, 17 nt, Mycobacterium bovis subsp bovis AF2122/97
guccgcaguucggucgu

SEQ ID NO: 1102721 - RNA, 18 nt, Mycobacterium bovis subsp bovis AF2122/97
guccgcaguucggucguc

SEQ ID NO: 1102722 - RNA, 21 nt, Mycobacterium bovis subsp bovis AF2122/97
guccgcauccgcgacggcgcc

SEQ ID NO: 1102723 - RNA, 15 nt, Mycobacterium bovis subsp bovis AF2122/97
gucgaugaugccgga

SEQ ID NO: 1102724 - RNA, 22 nt, Mycobacterium bovis subsp bovis AF2122/97
gucgaugagguucaucgccggc

SEQ ID NO: 1102725 - RNA, 23 nt, Mycobacterium bovis subsp bovis AF2122/97
gucgaugagguucaucgccggcg

SEQ ID NO: 1102726 - RNA, 18 nt, Mycobacterium bovis subsp bovis AF2122/97
gucgaugacgccgucagc

SEQ ID NO: 1102727 - RNA, 19 nt, Mycobacterium bovis subsp bovis AF2122/97
gucgaugacgccgucagcg

SEQ ID NO: 1102728 - RNA, 20 nt, Mycobacterium bovis subsp bovis AF2122/97
gucgaugaagcgucguugcu

SEQ ID NO: 1102729 - RNA, 22 nt, Mycobacterium bovis subsp bovis AF2122/97
gucgaugaccuugggaccaccg

SEQ ID NO: 1102730 - RNA, 20 nt, Mycobacterium bovis subsp bovis AF2122/97
gucgaugacgacgccgucgg

SEQ ID NO: 1102731 - RNA, 14 nt, Mycobacterium bovis subsp bovis AF2122/97
gucgaugaccagca

SEQ ID NO: 1102732 - RNA, 15 nt, Mycobacterium bovis subsp bovis AF2122/97
gucgaugaccagcac

SEQ ID NO: 1102733 - RNA, 20 nt, Mycobacterium bovis subsp bovis AF2122/97
gucgaugaccagcacaccgc

SEQ ID NO: 1102734 - RNA, 21 nt, Mycobacterium bovis subsp bovis AF2122/97
gucgaugaagcgucguugcuc

SEQ ID NO: 1102735 - RNA, 17 nt, Mycobacterium bovis subsp bovis AF2122/97
gucgauuggcugcgccg

SEQ ID NO: 1102736 - RNA, 19 nt, Mycobacterium bovis subsp bovis AF2122/97
gucgauuggcugcgccgau

SEQ ID NO: 1102737 - RNA, 17 nt, Mycobacterium bovis subsp bovis AF2122/97
gucgauucgucgaaggg

SEQ ID NO: 1102738 - RNA, 21 nt, Mycobacterium bovis subsp bovis AF2122/97
gucgauugcaggucggcccag

SEQ ID NO: 1102739 - RNA, 13 nt, Mycobacterium bovis subsp bovis AF2122/97
gucgaugccggcu

SEQ ID NO: 1102740 - RNA, 18 nt, Mycobacterium bovis subsp bovis AF2122/97
gucgaugccgcgcagcgc

SEQ ID NO: 1102741 - RNA, 14 nt, Mycobacterium bovis subsp bovis AF2122/97
gucgaucgcggccc

SEQ ID NO: 1102742 - RNA, 22 nt, Mycobacterium bovis subsp bovis AF2122/97
gucgaucugcgccaucacaucg

SEQ ID NO: 1102743 - RNA, 19 nt, Mycobacterium bovis subsp bovis AF2122/97
gucgaucgaauugcguucg

SEQ ID NO: 1102744 - RNA, 15 nt, Mycobacterium bovis subsp bovis AF2122/97
gucgauccgucggcg

SEQ ID NO: 1102745 - RNA, 16 nt, Mycobacterium bovis subsp bovis AF2122/97
gucgauccgucggcgg

SEQ ID NO: 1102746 - RNA, 19 nt, Mycobacterium bovis subsp bovis AF2122/97
gucgagggagcgccgcagg

SEQ ID NO: 1102747 - RNA, 16 nt, Mycobacterium bovis subsp bovis AF2122/97
gucgaggcggcagucg

SEQ ID NO: 1102748 - RNA, 23 nt, Mycobacterium bovis subsp bovis AF2122/97
gucgaggcugaccguggcgccgg

SEQ ID NO: 1102749 - RNA, 16 nt, Mycobacterium bovis subsp bovis AF2122/97
gucgaggcaggccucg

SEQ ID NO: 1102750 - RNA, 23 nt, Mycobacterium bovis subsp bovis AF2122/97
gucgaggcaggccucggcgccgc

SEQ ID NO: 1102751 - RNA, 19 nt, Mycobacterium bovis subsp bovis AF2122/97
gucgagcuuuucgaccuuc

SEQ ID NO: 1102752 - RNA, 18 nt, Mycobacterium bovis subsp bovis AF2122/97
gucgcaauggucguaggg

SEQ ID NO: 1102753 - RNA, 14 nt, Mycobacterium bovis subsp bovis AF2122/97
gucgcaccgccggc

SEQ ID NO: 1102754 - RNA, 20 nt, Mycobacterium bovis subsp bovis AF2122/97
gucgcacgcgcgcaggccgc

SEQ ID NO: 1102755 - RNA, 14 nt, Mycobacterium bovis subsp bovis AF2122/97
gucgcacggugccg

SEQ ID NO: 1102756 - RNA, 17 nt, Mycobacterium bovis subsp bovis AF2122/97
gucgcacggugccgccg

SEQ ID NO: 1102757 - RNA, 22 nt, Mycobacterium bovis subsp bovis AF2122/97
gucgcacugcgccggccggcgc

SEQ ID NO: 1102758 - RNA, 21 nt, Mycobacterium bovis subsp bovis AF2122/97
gucgcacauggugggucgacg

SEQ ID NO: 1102759 - RNA, 16 nt, Mycobacterium bovis subsp bovis AF2122/97
gucgcaccacagugcc

SEQ ID NO: 1102760 - RNA, 19 nt, Mycobacterium bovis subsp bovis AF2122/97
gucgcaccacagugccaau

SEQ ID NO: 1102761 - RNA, 12 nt, Mycobacterium bovis subsp bovis AF2122/97
gucgcaccccgg

SEQ ID NO: 1102762 - RNA, 16 nt, Mycobacterium bovis subsp bovis AF2122/97
gucgcaccccggcggc

SEQ ID NO: 1102763 - RNA, 17 nt, Mycobacterium bovis subsp bovis AF2122/97
gucgcaaggcccgcacc

SEQ ID NO: 1102764 - RNA, 22 nt, Mycobacterium bovis subsp bovis AF2122/97
gucgcaaggcccgcaccgcuga

SEQ ID NO: 1102765 - RNA, 20 nt, Mycobacterium bovis subsp bovis AF2122/97
gucgcaauauccggccgagc

SEQ ID NO: 1102766 - RNA, 18 nt, Mycobacterium bovis subsp bovis AF2122/97
gucgcaauaugccacaga

SEQ ID NO: 1102767 - RNA, 17 nt, Mycobacterium bovis subsp bovis AF2122/97
gucgcaaaagcccccau

SEQ ID NO: 1102768 - RNA, 19 nt, Mycobacterium bovis subsp bovis AF2122/97
gucgcaaaagcccccauuu

SEQ ID NO: 1102769 - RNA, 16 nt, Mycobacterium bovis subsp bovis AF2122/97
gucgauuucgccgucg

SEQ ID NO: 1102770 - RNA, 22 nt, Mycobacterium bovis subsp bovis AF2122/97
gucgauuucggcgaccggccgg

SEQ ID NO: 1102771 - RNA, 15 nt, Mycobacterium bovis subsp bovis AF2122/97
gucgcaaccgccgcc

SEQ ID NO: 1102772 - RNA, 16 nt, Mycobacterium bovis subsp bovis AF2122/97
gucgcaaccgccgcca

SEQ ID NO: 1102773 - RNA, 19 nt, Mycobacterium bovis subsp bovis AF2122/97
gucgcaacgcaucgaugcg

SEQ ID NO: 1102774 - RNA, 23 nt, Mycobacterium bovis subsp bovis AF2122/97
gucgcaacgcaucgaugcgugcc

SEQ ID NO: 1102775 - RNA, 14 nt, Mycobacterium bovis subsp bovis AF2122/97
gucgcaacgcgauc

SEQ ID NO: 1102776 - RNA, 20 nt, Mycobacterium bovis subsp bovis AF2122/97
gucgccaugcugcccuuguu

SEQ ID NO: 1102777 - RNA, 16 nt, Mycobacterium bovis subsp bovis AF2122/97
gucgccaugucggcca

SEQ ID NO: 1102778 - RNA, 18 nt, Mycobacterium bovis subsp bovis AF2122/97
gucgccaugucggccagg

SEQ ID NO: 1102779 - RNA, 20 nt, Mycobacterium bovis subsp bovis AF2122/97
gucgcacuuggcccccgacg

SEQ ID NO: 1102780 - RNA, 15 nt, Mycobacterium bovis subsp bovis AF2122/97
gucgcaggaucggcg

SEQ ID NO: 1102781 - RNA, 20 nt, Mycobacterium bovis subsp bovis AF2122/97
gucgcaggaucggcggauag

SEQ ID NO: 1102782 - RNA, 17 nt, Mycobacterium bovis subsp bovis AF2122/97
gucgccagggccgccga

SEQ ID NO: 1102783 - RNA, 15 nt, Mycobacterium bovis subsp bovis AF2122/97
gucgcgcugccggcc

SEQ ID NO: 1102784 - RNA, 14 nt, Mycobacterium bovis subsp bovis AF2122/97
gucgcggacccgcg

SEQ ID NO: 1102785 - RNA, 15 nt, Mycobacterium bovis subsp bovis AF2122/97
gucgcggacccgcgc

SEQ ID NO: 1102786 - RNA, 22 nt, Mycobacterium bovis subsp bovis AF2122/97
gucgcgcugcugucgauuucgc

SEQ ID NO: 1102787 - RNA, 21 nt, Mycobacterium bovis subsp bovis AF2122/97
gucgcgcuggcgccggccagc

SEQ ID NO: 1102788 - RNA, 19 nt, Mycobacterium bovis subsp bovis AF2122/97
gucgcgcaguuggccaugc

SEQ ID NO: 1102789 - RNA, 15 nt, Mycobacterium bovis subsp bovis AF2122/97
gucgccucaccggcg

SEQ ID NO: 1102790 - RNA, 12 nt, Mycobacterium bovis subsp bovis AF2122/97
gucgcgccaccc

SEQ ID NO: 1102791 - RNA, 22 nt, Mycobacterium bovis subsp bovis AF2122/97
gucgcgccaggcgcgaucgcgc

SEQ ID NO: 1102792 - RNA, 23 nt, Mycobacterium bovis subsp bovis AF2122/97
gucgcgccaggcgcgaucgcgcc

SEQ ID NO: 1102793 - RNA, 20 nt, Mycobacterium bovis subsp bovis AF2122/97
gucgcgccaggcuugcggca

SEQ ID NO: 1102794 - RNA, 22 nt, Mycobacterium bovis subsp bovis AF2122/97
gucgcgccaggcuugcggcacc

SEQ ID NO: 1102795 - RNA, 19 nt, Mycobacterium bovis subsp bovis AF2122/97
gucgcgcccucagccgcgg

SEQ ID NO: 1102796 - RNA, 20 nt, Mycobacterium bovis subsp bovis AF2122/97
gucgcgcccucagccgcggc

SEQ ID NO: 1102797 - RNA, 17 nt, Mycobacterium bovis subsp bovis AF2122/97
gucgccguacaaccacc

SEQ ID NO: 1102798 - RNA, 15 nt, Mycobacterium bovis subsp bovis AF2122/97
gucgccguacagcgc

SEQ ID NO: 1102799 - RNA, 17 nt, Mycobacterium bovis subsp bovis AF2122/97
gucgccggaguucugcg

SEQ ID NO: 1102800 - RNA, 15 nt, Mycobacterium bovis subsp bovis AF2122/97
gucgccggauagcgc

SEQ ID NO: 1102801 - RNA, 18 nt, Mycobacterium bovis subsp bovis AF2122/97
gucgccggcaccggaugc

SEQ ID NO: 1102802 - RNA, 20 nt, Mycobacterium bovis subsp bovis AF2122/97
gucgccggugacgaugaccg

SEQ ID NO: 1102803 - RNA, 17 nt, Mycobacterium bovis subsp bovis AF2122/97
gucgccgguggcacccg

SEQ ID NO: 1102804 - RNA, 16 nt, Mycobacterium bovis subsp bovis AF2122/97
gucgccgucgaaccag

SEQ ID NO: 1102805 - RNA, 13 nt, Mycobacterium bovis subsp bovis AF2122/97
gucgccgucgaag

SEQ ID NO: 1102806 - RNA, 21 nt, Mycobacterium bovis subsp bovis AF2122/97
gucgccgucggugccgccgcc

SEQ ID NO: 1102807 - RNA, 18 nt, Mycobacterium bovis subsp bovis AF2122/97
gucgccgucgugccaccg

SEQ ID NO: 1102808 - RNA, 19 nt, Mycobacterium bovis subsp bovis AF2122/97
gucgcgcauuucguggcgc

SEQ ID NO: 1102809 - RNA, 13 nt, Mycobacterium bovis subsp bovis AF2122/97
gucgccgugggcc

SEQ ID NO: 1102810 - RNA, 18 nt, Mycobacterium bovis subsp bovis AF2122/97
gucgccgacggcgaccac

SEQ ID NO: 1102811 - RNA, 15 nt, Mycobacterium bovis subsp bovis AF2122/97
gucgccgagaccggc

SEQ ID NO: 1102812 - RNA, 20 nt, Mycobacterium bovis subsp bovis AF2122/97
gucgccgaucaacagcaccg

SEQ ID NO: 1102813 - RNA, 16 nt, Mycobacterium bovis subsp bovis AF2122/97
gucgccgaucaccgca

SEQ ID NO: 1102814 - RNA, 20 nt, Mycobacterium bovis subsp bovis AF2122/97
gucgccgaggucgaaccgcc

SEQ ID NO: 1102815 - RNA, 22 nt, Mycobacterium bovis subsp bovis AF2122/97
gucgccgaggucgaaccgccgg

SEQ ID NO: 1102816 - RNA, 20 nt, Mycobacterium bovis subsp bovis AF2122/97
gucgccgaguaccggccagc

SEQ ID NO: 1102817 - RNA, 24 nt, Mycobacterium bovis subsp bovis AF2122/97
gucgccgaucaccgcaucggugcc

SEQ ID NO: 1102818 - RNA, 16 nt, Mycobacterium bovis subsp bovis AF2122/97
gucgccgccgucaccg

SEQ ID NO: 1102819 - RNA, 19 nt, Mycobacterium bovis subsp bovis AF2122/97
gucgccgccuuacgcaccg

SEQ ID NO: 1102820 - RNA, 16 nt, Mycobacterium bovis subsp bovis AF2122/97
gucgccgccuucuugg

SEQ ID NO: 1102821 - RNA, 12 nt, Mycobacterium bovis subsp bovis AF2122/97
gucgccgcggca

SEQ ID NO: 1102822 - RNA, 12 nt, Mycobacterium bovis subsp bovis AF2122/97
gucgccgcggcg

SEQ ID NO: 1102823 - RNA, 14 nt, Mycobacterium bovis subsp bovis AF2122/97
gucgccgcggcggc

SEQ ID NO: 1102824 - RNA, 22 nt, Mycobacterium bovis subsp bovis AF2122/97
gucgccgcguccucgcccuggc

SEQ ID NO: 1102825 - RNA, 15 nt, Mycobacterium bovis subsp bovis AF2122/97
gucgccgcgggcagc

SEQ ID NO: 1102826 - RNA, 13 nt, Mycobacterium bovis subsp bovis AF2122/97
gucgccgcgguag

SEQ ID NO: 1102827 - RNA, 13 nt, Mycobacterium bovis subsp bovis AF2122/97
gucgccgcucggu

SEQ ID NO: 1102828 - RNA, 17 nt, Mycobacterium bovis subsp bovis AF2122/97
gucgccgcucggucccc

SEQ ID NO: 1102829 - RNA, 15 nt, Mycobacterium bovis subsp bovis AF2122/97
gucgccggaccagag

SEQ ID NO: 1102830 - RNA, 20 nt, Mycobacterium bovis subsp bovis AF2122/97
gucgccgaggacgccggcgc

SEQ ID NO: 1102831 - RNA, 15 nt, Mycobacterium bovis subsp bovis AF2122/97
gucgccgacgccggu

SEQ ID NO: 1102832 - RNA, 15 nt, Mycobacterium bovis subsp bovis AF2122/97
gucgcccgaucggcg

SEQ ID NO: 1102833 - RNA, 13 nt, Mycobacterium bovis subsp bovis AF2122/97
gucgccgacgccg

SEQ ID NO: 1102834 - RNA, 20 nt, Mycobacterium bovis subsp bovis AF2122/97
gucgcccgguccgccgcaga

SEQ ID NO: 1102835 - RNA, 19 nt, Mycobacterium bovis subsp bovis AF2122/97
gucgcccggguggcgucga

SEQ ID NO: 1102836 - RNA, 22 nt, Mycobacterium bovis subsp bovis AF2122/97
gucgcccaacaccgcgccgacg

SEQ ID NO: 1102837 - RNA, 12 nt, Mycobacterium bovis subsp bovis AF2122/97
gucgccccaagc

SEQ ID NO: 1102838 - RNA, 22 nt, Mycobacterium bovis subsp bovis AF2122/97
gucgccccaagcgccugagcgg

SEQ ID NO: 1102839 - RNA, 13 nt, Mycobacterium bovis subsp bovis AF2122/97
gucgcccagccga

SEQ ID NO: 1102840 - RNA, 16 nt, Mycobacterium bovis subsp bovis AF2122/97
gucgccccgaugaccg

SEQ ID NO: 1102841 - RNA, 20 nt, Mycobacterium bovis subsp bovis AF2122/97
gucgccccguucacgcucgu

SEQ ID NO: 1102842 - RNA, 23 nt, Mycobacterium bovis subsp bovis AF2122/97
gucgcggagcgugagccaugccg

SEQ ID NO: 1102843 - RNA, 23 nt, Mycobacterium bovis subsp bovis AF2122/97
gucgcggacccgcgcgucgccca

SEQ ID NO: 1102844 - RNA, 13 nt, Mycobacterium bovis subsp bovis AF2122/97
gucgcggacgucg

SEQ ID NO: 1102845 - RNA, 14 nt, Mycobacterium bovis subsp bovis AF2122/97
gucgcggacgucgc

SEQ ID NO: 1102846 - RNA, 23 nt, Mycobacterium bovis subsp bovis AF2122/97
gucgcggauugccgcgcgcaagc

SEQ ID NO: 1102847 - RNA, 23 nt, Mycobacterium bovis subsp bovis AF2122/97
gucgcggaucagcccgcgcagca

SEQ ID NO: 1102848 - RNA, 23 nt, Mycobacterium bovis subsp bovis AF2122/97
gucgcggaucuguuccucgguga

SEQ ID NO: 1102849 - RNA, 16 nt, Mycobacterium bovis subsp bovis AF2122/97
gucgcggccacgguca

SEQ ID NO: 1102850 - RNA, 18 nt, Mycobacterium bovis subsp bovis AF2122/97
gucgcggccacggucagc

SEQ ID NO: 1102851 - RNA, 22 nt, Mycobacterium bovis subsp bovis AF2122/97
gucgcgguucaacaccaacgcg

SEQ ID NO: 1102852 - RNA, 15 nt, Mycobacterium bovis subsp bovis AF2122/97
gucgcgguuguggcu

SEQ ID NO: 1102853 - RNA, 12 nt, Mycobacterium bovis subsp bovis AF2122/97
gucgcggccgcg

SEQ ID NO: 1102854 - RNA, 15 nt, Mycobacterium bovis subsp bovis AF2122/97
gucgcggccggcggc

SEQ ID NO: 1102855 - RNA, 14 nt, Mycobacterium bovis subsp bovis AF2122/97
gucgcggccgucgc

SEQ ID NO: 1102856 - RNA, 20 nt, Mycobacterium bovis subsp bovis AF2122/97
gucgcgguggcggcggugcc

SEQ ID NO: 1102857 - RNA, 16 nt, Mycobacterium bovis subsp bovis AF2122/97
gucgcgguggcggcgg

SEQ ID NO: 1102858 - RNA, 18 nt, Mycobacterium bovis subsp bovis AF2122/97
gucgcgguggcggcggug

SEQ ID NO: 1102859 - RNA, 17 nt, Mycobacterium bovis subsp bovis AF2122/97
gucgcugaagccgucgu

SEQ ID NO: 1102860 - RNA, 16 nt, Mycobacterium bovis subsp bovis AF2122/97
gucgcugaacagacgg

SEQ ID NO: 1102861 - RNA, 12 nt, Mycobacterium bovis subsp bovis AF2122/97
gucgcguucggc

SEQ ID NO: 1102862 - RNA, 15 nt, Mycobacterium bovis subsp bovis AF2122/97
gucgcguucggccga

SEQ ID NO: 1102863 - RNA, 14 nt, Mycobacterium bovis subsp bovis AF2122/97
gucgcugaaaucgg

SEQ ID NO: 1102864 - RNA, 15 nt, Mycobacterium bovis subsp bovis AF2122/97
gucgcgucgaccgga

SEQ ID NO: 1102865 - RNA, 23 nt, Mycobacterium bovis subsp bovis AF2122/97
gucgcgucgcaggauucccaguc

SEQ ID NO: 1102866 - RNA, 19 nt, Mycobacterium bovis subsp bovis AF2122/97
gucgcugcccaucacaccc

SEQ ID NO: 1102867 - RNA, 15 nt, Mycobacterium bovis subsp bovis AF2122/97
gucgcugcaaccgcc

SEQ ID NO: 1102868 - RNA, 13 nt, Mycobacterium bovis subsp bovis AF2122/97
gucgcugaccgcg

SEQ ID NO: 1102869 - RNA, 17 nt, Mycobacterium bovis subsp bovis AF2122/97
gucgcugagcacggcgc

SEQ ID NO: 1102870 - RNA, 18 nt, Mycobacterium bovis subsp bovis AF2122/97
gucgcugagcagcgccgc

SEQ ID NO: 1102871 - RNA, 22 nt, Mycobacterium bovis subsp bovis AF2122/97
gucggcaccaccacgccgaccg

SEQ ID NO: 1102872 - RNA, 19 nt, Mycobacterium bovis subsp bovis AF2122/97
gucggcaccagcagccagc

SEQ ID NO: 1102873 - RNA, 13 nt, Mycobacterium bovis subsp bovis AF2122/97
gucggcacccucg

SEQ ID NO: 1102874 - RNA, 13 nt, Mycobacterium bovis subsp bovis AF2122/97
gucggcaccgauc

SEQ ID NO: 1102875 - RNA, 15 nt, Mycobacterium bovis subsp bovis AF2122/97
gucggcaccaccacg

SEQ ID NO: 1102876 - RNA, 18 nt, Mycobacterium bovis subsp bovis AF2122/97
gucggcaccaccacgccg

SEQ ID NO: 1102877 - RNA, 19 nt, Mycobacterium bovis subsp bovis AF2122/97
gucggcaccaccacgccga

SEQ ID NO: 1102878 - RNA, 13 nt, Mycobacterium bovis subsp bovis AF2122/97
gucggcaaucucg

SEQ ID NO: 1102879 - RNA, 17 nt, Mycobacterium bovis subsp bovis AF2122/97
gucggcaacgacccgcc

SEQ ID NO: 1102880 - RNA, 21 nt, Mycobacterium bovis subsp bovis AF2122/97
gucggcaacgacccgccgccc

SEQ ID NO: 1102881 - RNA, 14 nt, Mycobacterium bovis subsp bovis AF2122/97
gucggccaggccgu

SEQ ID NO: 1102882 - RNA, 16 nt, Mycobacterium bovis subsp bovis AF2122/97
gucggaacugaccacg

SEQ ID NO: 1102883 - RNA, 16 nt, Mycobacterium bovis subsp bovis AF2122/97
gucggacauaccgcga

SEQ ID NO: 1102884 - RNA, 17 nt, Mycobacterium bovis subsp bovis AF2122/97
gucggauggaaggcggc

SEQ ID NO: 1102885 - RNA, 15 nt, Mycobacterium bovis subsp bovis AF2122/97
gucggcaaccaaccg

SEQ ID NO: 1102886 - RNA, 18 nt, Mycobacterium bovis subsp bovis AF2122/97
gucggcaaccaaccgcgc

SEQ ID NO: 1102887 - RNA, 19 nt, Mycobacterium bovis subsp bovis AF2122/97
gucggcaaccaaccgcgcg

SEQ ID NO: 1102888 - RNA, 22 nt, Mycobacterium bovis subsp bovis AF2122/97
gucggcaacccacacgcccucg

SEQ ID NO: 1102889 - RNA, 13 nt, Mycobacterium bovis subsp bovis AF2122/97
gucgcugucggca

SEQ ID NO: 1102890 - RNA, 17 nt, Mycobacterium bovis subsp bovis AF2122/97
gucgcugucggcaguag

SEQ ID NO: 1102891 - RNA, 15 nt, Mycobacterium bovis subsp bovis AF2122/97
gucgcuguaggcgau

SEQ ID NO: 1102892 - RNA, 23 nt, Mycobacterium bovis subsp bovis AF2122/97
gucgcuguaggcgauaucgcccg

SEQ ID NO: 1102893 - RNA, 22 nt, Mycobacterium bovis subsp bovis AF2122/97
gucgcuggugggaucgcagcgc

SEQ ID NO: 1102894 - RNA, 21 nt, Mycobacterium bovis subsp bovis AF2122/97
gucgcugccccuugggcucga

SEQ ID NO: 1102895 - RNA, 19 nt, Mycobacterium bovis subsp bovis AF2122/97
gucgcugcccgcgcggcca

SEQ ID NO: 1102896 - RNA, 14 nt, Mycobacterium bovis subsp bovis AF2122/97
gucgcugccgccgc

SEQ ID NO: 1102897 - RNA, 17 nt, Mycobacterium bovis subsp bovis AF2122/97
gucggccggggccaccc

SEQ ID NO: 1102898 - RNA, 16 nt, Mycobacterium bovis subsp bovis AF2122/97
gucggccggggccacc

SEQ ID NO: 1102899 - RNA, 14 nt, Mycobacterium bovis subsp bovis AF2122/97
gucggccggcaccc

SEQ ID NO: 1102900 - RNA, 17 nt, Mycobacterium bovis subsp bovis AF2122/97
gucggccugaccgguca

SEQ ID NO: 1102901 - RNA, 19 nt, Mycobacterium bovis subsp bovis AF2122/97
gucggccugaccggucacc

SEQ ID NO: 1102902 - RNA, 14 nt, Mycobacterium bovis subsp bovis AF2122/97
gucggccugcggca

SEQ ID NO: 1102903 - RNA, 16 nt, Mycobacterium bovis subsp bovis AF2122/97
gucggccugcggcacc

SEQ ID NO: 1102904 - RNA, 17 nt, Mycobacterium bovis subsp bovis AF2122/97
gucggccugcggcaccg

SEQ ID NO: 1102905 - RNA, 20 nt, Mycobacterium bovis subsp bovis AF2122/97
gucggccugcgacacaacgg

SEQ ID NO: 1102906 - RNA, 18 nt, Mycobacterium bovis subsp bovis AF2122/97
gucggccugcgccggcgc

SEQ ID NO: 1102907 - RNA, 20 nt, Mycobacterium bovis subsp bovis AF2122/97
gucggccugaccggucaccc

SEQ ID NO: 1102908 - RNA, 19 nt, Mycobacterium bovis subsp bovis AF2122/97
gucggccuggaucgugccg

SEQ ID NO: 1102909 - RNA, 14 nt, Mycobacterium bovis subsp bovis AF2122/97
gucggcgaaccacg

SEQ ID NO: 1102910 - RNA, 20 nt, Mycobacterium bovis subsp bovis AF2122/97
gucggcgaaccacggcagcc

SEQ ID NO: 1102911 - RNA, 16 nt, Mycobacterium bovis subsp bovis AF2122/97
gucggccaggucggcg

SEQ ID NO: 1102912 - RNA, 16 nt, Mycobacterium bovis subsp bovis AF2122/97
gucggcccgcggucgc

SEQ ID NO: 1102913 - RNA, 16 nt, Mycobacterium bovis subsp bovis AF2122/97
gucggccccggccgcg

SEQ ID NO: 1102914 - RNA, 13 nt, Mycobacterium bovis subsp bovis AF2122/97
gucggccgacacc

SEQ ID NO: 1102915 - RNA, 13 nt, Mycobacterium bovis subsp bovis AF2122/97
gucggccgagucg

SEQ ID NO: 1102916 - RNA, 23 nt, Mycobacterium bovis subsp bovis AF2122/97
gucggccgagucgauugccaccg

SEQ ID NO: 1102917 - RNA, 18 nt, Mycobacterium bovis subsp bovis AF2122/97
gucggcccuccaccggug

SEQ ID NO: 1102918 - RNA, 15 nt, Mycobacterium bovis subsp bovis AF2122/97
gucggccgacaccgc

SEQ ID NO: 1102919 - RNA, 22 nt, Mycobacterium bovis subsp bovis AF2122/97
gucggccgcgggucccggccgg

SEQ ID NO: 1102920 - RNA, 20 nt, Mycobacterium bovis subsp bovis AF2122/97
gucggccaugguguucggca

SEQ ID NO: 1102921 - RNA, 19 nt, Mycobacterium bovis subsp bovis AF2122/97
gucggccauccaccgcaga

SEQ ID NO: 1102922 - RNA, 19 nt, Mycobacterium bovis subsp bovis AF2122/97
gucggccaucgaguccacc

SEQ ID NO: 1102923 - RNA, 16 nt, Mycobacterium bovis subsp bovis AF2122/97
gucggccaggccgucg

SEQ ID NO: 1102924 - RNA, 19 nt, Mycobacterium bovis subsp bovis AF2122/97
gucggccaggccgucggcg

SEQ ID NO: 1102925 - RNA, 22 nt, Mycobacterium bovis subsp bovis AF2122/97
gucggccaggccgucggcgucg

SEQ ID NO: 1102926 - RNA, 16 nt, Mycobacterium bovis subsp bovis AF2122/97
gucggcgaucugcgca

SEQ ID NO: 1102927 - RNA, 16 nt, Mycobacterium bovis subsp bovis AF2122/97
gucggcgaugcgcacc

SEQ ID NO: 1102928 - RNA, 17 nt, Mycobacterium bovis subsp bovis AF2122/97
gucggcgaugaacagcg

SEQ ID NO: 1102929 - RNA, 21 nt, Mycobacterium bovis subsp bovis AF2122/97
gucggcgaugaacagcgacgc

SEQ ID NO: 1102930 - RNA, 17 nt, Mycobacterium bovis subsp bovis AF2122/97
gucggcgccgagcagcc

SEQ ID NO: 1102931 - RNA, 17 nt, Mycobacterium bovis subsp bovis AF2122/97
gucggcgccucggacca

SEQ ID NO: 1102932 - RNA, 19 nt, Mycobacterium bovis subsp bovis AF2122/97
gucggcgccgccguccagc

SEQ ID NO: 1102933 - RNA, 14 nt, Mycobacterium bovis subsp bovis AF2122/97
gucggcgccggcgg

SEQ ID NO: 1102934 - RNA, 13 nt, Mycobacterium bovis subsp bovis AF2122/97
gucggcgccgccg

SEQ ID NO: 1102935 - RNA, 16 nt, Mycobacterium bovis subsp bovis AF2122/97
gucggcgcccagcucg

SEQ ID NO: 1102936 - RNA, 16 nt, Mycobacterium bovis subsp bovis AF2122/97
gucggcgccggcaucg

SEQ ID NO: 1102937 - RNA, 21 nt, Mycobacterium bovis subsp bovis AF2122/97
gucggcgaccgagacggcguc

SEQ ID NO: 1102938 - RNA, 22 nt, Mycobacterium bovis subsp bovis AF2122/97
gucggcgaccgagacggcgucg

SEQ ID NO: 1102939 - RNA, 17 nt, Mycobacterium bovis subsp bovis AF2122/97
gucggcgaauccgccgc

SEQ ID NO: 1102940 - RNA, 22 nt, Mycobacterium bovis subsp bovis AF2122/97
gucggcgaccaggucggcuucg

SEQ ID NO: 1102941 - RNA, 20 nt, Mycobacterium bovis subsp bovis AF2122/97
gucggcgaauccgccgccua

SEQ ID NO: 1102942 - RNA, 17 nt, Mycobacterium bovis subsp bovis AF2122/97
gucggcgaccaccagcg

SEQ ID NO: 1102943 - RNA, 21 nt, Mycobacterium bovis subsp bovis AF2122/97
gucggcgaccaccagcgccga

SEQ ID NO: 1102944 - RNA, 20 nt, Mycobacterium bovis subsp bovis AF2122/97
gucggcgaacgcguccagcg

SEQ ID NO: 1102945 - RNA, 21 nt, Mycobacterium bovis subsp bovis AF2122/97
gucggcgaacgcguccagcgc

SEQ ID NO: 1102946 - RNA, 19 nt, Mycobacterium bovis subsp bovis AF2122/97
gucggcgaacgcggcgucg

SEQ ID NO: 1102947 - RNA, 15 nt, Mycobacterium bovis subsp bovis AF2122/97
gucggcgacuccucu

SEQ ID NO: 1102948 - RNA, 16 nt, Mycobacterium bovis subsp bovis AF2122/97
gucggcgagcucggcc

SEQ ID NO: 1102949 - RNA, 15 nt, Mycobacterium bovis subsp bovis AF2122/97
gucggcgaucaacgc

SEQ ID NO: 1102950 - RNA, 16 nt, Mycobacterium bovis subsp bovis AF2122/97
gucggcgaucaacgcg

SEQ ID NO: 1102951 - RNA, 13 nt, Mycobacterium bovis subsp bovis AF2122/97
gucggcgaccgcg

SEQ ID NO: 1102952 - RNA, 15 nt, Mycobacterium bovis subsp bovis AF2122/97
gucggugggcggcga

SEQ ID NO: 1102953 - RNA, 20 nt, Mycobacterium bovis subsp bovis AF2122/97
gucggugggcggcgagcgcg

SEQ ID NO: 1102954 - RNA, 14 nt, Mycobacterium bovis subsp bovis AF2122/97
gucgguggccgcgg

SEQ ID NO: 1102955 - RNA, 16 nt, Mycobacterium bovis subsp bovis AF2122/97
gucgguggccgcggcg

SEQ ID NO: 1102956 - RNA, 17 nt, Mycobacterium bovis subsp bovis AF2122/97
gucgguggccgcggcgg

SEQ ID NO: 1102957 - RNA, 18 nt, Mycobacterium bovis subsp bovis AF2122/97
gucgguggccgcggcggu

SEQ ID NO: 1102958 - RNA, 22 nt, Mycobacterium bovis subsp bovis AF2122/97
gucggugaccguucggcggucg

SEQ ID NO: 1102959 - RNA, 15 nt, Mycobacterium bovis subsp bovis AF2122/97
gucggugacaccaac

SEQ ID NO: 1102960 - RNA, 19 nt, Mycobacterium bovis subsp bovis AF2122/97
gucggucggaucggcgccg

SEQ ID NO: 1102961 - RNA, 21 nt, Mycobacterium bovis subsp bovis AF2122/97
gucggucggaucggcgccgca

SEQ ID NO: 1102962 - RNA, 22 nt, Mycobacterium bovis subsp bovis AF2122/97
gucggugaaaugacggcugaac

SEQ ID NO: 1102963 - RNA, 21 nt, Mycobacterium bovis subsp bovis AF2122/97
gucggucuuuggcauugccgc

SEQ ID NO: 1102964 - RNA, 20 nt, Mycobacterium bovis subsp bovis AF2122/97
gucggugaaaaaggcgacuc

SEQ ID NO: 1102965 - RNA, 16 nt, Mycobacterium bovis subsp bovis AF2122/97
gucgggcuggguggcc

SEQ ID NO: 1102966 - RNA, 23 nt, Mycobacterium bovis subsp bovis AF2122/97
gucgggcuugacccuugggcacc

SEQ ID NO: 1102967 - RNA, 22 nt, Mycobacterium bovis subsp bovis AF2122/97
gucgguccacccaagcucgguc

SEQ ID NO: 1102968 - RNA, 23 nt, Mycobacterium bovis subsp bovis AF2122/97
gucgguccacuucagaucggcga

SEQ ID NO: 1102969 - RNA, 18 nt, Mycobacterium bovis subsp bovis AF2122/97
gucggucggggauccgac

SEQ ID NO: 1102970 - RNA, 15 nt, Mycobacterium bovis subsp bovis AF2122/97
gucggucgguaacgg

SEQ ID NO: 1102971 - RNA, 14 nt, Mycobacterium bovis subsp bovis AF2122/97
gucggucucggcga

SEQ ID NO: 1102972 - RNA, 17 nt, Mycobacterium bovis subsp bovis AF2122/97
gucggggaugccgaacc

SEQ ID NO: 1102973 - RNA, 12 nt, Mycobacterium bovis subsp bovis AF2122/97
gucgggccgucg

SEQ ID NO: 1102974 - RNA, 18 nt, Mycobacterium bovis subsp bovis AF2122/97
gucgggccgucgggugug

SEQ ID NO: 1102975 - RNA, 18 nt, Mycobacterium bovis subsp bovis AF2122/97
gucgggcgcggggcggcc

SEQ ID NO: 1102976 - RNA, 12 nt, Mycobacterium bovis subsp bovis AF2122/97
gucgggcggcgu

SEQ ID NO: 1102977 - RNA, 14 nt, Mycobacterium bovis subsp bovis AF2122/97
gucgggcggcgucg

SEQ ID NO: 1102978 - RNA, 16 nt, Mycobacterium bovis subsp bovis AF2122/97
gucgggcgugucggga

SEQ ID NO: 1102979 - RNA, 18 nt, Mycobacterium bovis subsp bovis AF2122/97
gucgggcgugucgggaac

SEQ ID NO: 1102980 - RNA, 23 nt, Mycobacterium bovis subsp bovis AF2122/97
gucgggcuaauccagcagcaccg

SEQ ID NO: 1102981 - RNA, 17 nt, Mycobacterium bovis subsp bovis AF2122/97
gucgggcgucccggcgg

SEQ ID NO: 1102982 - RNA, 15 nt, Mycobacterium bovis subsp bovis AF2122/97
gucgggcgugucggg

SEQ ID NO: 1102983 - RNA, 17 nt, Mycobacterium bovis subsp bovis AF2122/97
gucgggcggcgucgaac

SEQ ID NO: 1102984 - RNA, 22 nt, Mycobacterium bovis subsp bovis AF2122/97
gucgggcaaggcggcggccagc

SEQ ID NO: 1102985 - RNA, 21 nt, Mycobacterium bovis subsp bovis AF2122/97
gucgggcacaccgacgccgcc

SEQ ID NO: 1102986 - RNA, 15 nt, Mycobacterium bovis subsp bovis AF2122/97
gucgggcauggcggc

SEQ ID NO: 1102987 - RNA, 21 nt, Mycobacterium bovis subsp bovis AF2122/97
gucgggcccagccggaccgcg

SEQ ID NO: 1102988 - RNA, 23 nt, Mycobacterium bovis subsp bovis AF2122/97
gucgggcccgaugucgucgacga

SEQ ID NO: 1102989 - RNA, 16 nt, Mycobacterium bovis subsp bovis AF2122/97
gucggcgcgccgcaca

SEQ ID NO: 1102990 - RNA, 12 nt, Mycobacterium bovis subsp bovis AF2122/97
gucggcgcggcc

SEQ ID NO: 1102991 - RNA, 13 nt, Mycobacterium bovis subsp bovis AF2122/97
gucggcgcggccg

SEQ ID NO: 1102992 - RNA, 14 nt, Mycobacterium bovis subsp bovis AF2122/97
gucggcgcugacga

SEQ ID NO: 1102993 - RNA, 20 nt, Mycobacterium bovis subsp bovis AF2122/97
gucggcgcugacgacccucc

SEQ ID NO: 1102994 - RNA, 19 nt, Mycobacterium bovis subsp bovis AF2122/97
gucggcgcugcgcgcgauc

SEQ ID NO: 1102995 - RNA, 13 nt, Mycobacterium bovis subsp bovis AF2122/97
gucggcgcuggcc

SEQ ID NO: 1102996 - RNA, 14 nt, Mycobacterium bovis subsp bovis AF2122/97
gucggcggcgaccg

SEQ ID NO: 1102997 - RNA, 16 nt, Mycobacterium bovis subsp bovis AF2122/97
gucggcggcgaccgcc

SEQ ID NO: 1102998 - RNA, 17 nt, Mycobacterium bovis subsp bovis AF2122/97
gucggcggcgaccgcca

SEQ ID NO: 1102999 - RNA, 20 nt, Mycobacterium bovis subsp bovis AF2122/97
gucggcggcgaccgccagcg

SEQ ID NO: 1103000 - RNA, 22 nt, Mycobacterium bovis subsp bovis AF2122/97
gucggcggccgucaccggucgg

SEQ ID NO: 1103001 - RNA, 19 nt, Mycobacterium bovis subsp bovis AF2122/97
gucggcuaccgccgaccgg

SEQ ID NO: 1103002 - RNA, 14 nt, Mycobacterium bovis subsp bovis AF2122/97
gucggcgugucgcg

SEQ ID NO: 1103003 - RNA, 16 nt, Mycobacterium bovis subsp bovis AF2122/97
gucggcgucgagcucg

SEQ ID NO: 1103004 - RNA, 14 nt, Mycobacterium bovis subsp bovis AF2122/97
gucgggaucggcgu

SEQ ID NO: 1103005 - RNA, 19 nt, Mycobacterium bovis subsp bovis AF2122/97
gucgggaucguuggccagu

SEQ ID NO: 1103006 - RNA, 19 nt, Mycobacterium bovis subsp bovis AF2122/97
gucgggaugcccgcugauc

SEQ ID NO: 1103007 - RNA, 20 nt, Mycobacterium bovis subsp bovis AF2122/97
gucgggcaaccugccgggcc

SEQ ID NO: 1103008 - RNA, 22 nt, Mycobacterium bovis subsp bovis AF2122/97
gucggcggcuacuagcgguguc

SEQ ID NO: 1103009 - RNA, 17 nt, Mycobacterium bovis subsp bovis AF2122/97
gucggcgugacgucguc

SEQ ID NO: 1103010 - RNA, 22 nt, Mycobacterium bovis subsp bovis AF2122/97
gucggcgucgaauucagcugca

SEQ ID NO: 1103011 - RNA, 18 nt, Mycobacterium bovis subsp bovis AF2122/97
gucgucgacaaacagcgc

SEQ ID NO: 1103012 - RNA, 16 nt, Mycobacterium bovis subsp bovis AF2122/97
gucgucgaacggcagc

SEQ ID NO: 1103013 - RNA, 16 nt, Mycobacterium bovis subsp bovis AF2122/97
gucguccucgcuggau

SEQ ID NO: 1103014 - RNA, 21 nt, Mycobacterium bovis subsp bovis AF2122/97
gucguccuguccgggcugcau

SEQ ID NO: 1103015 - RNA, 14 nt, Mycobacterium bovis subsp bovis AF2122/97
gucgucgccgccgg

SEQ ID NO: 1103016 - RNA, 17 nt, Mycobacterium bovis subsp bovis AF2122/97
gucgucgccgccgguga

SEQ ID NO: 1103017 - RNA, 13 nt, Mycobacterium bovis subsp bovis AF2122/97
gucgucgccgccg

SEQ ID NO: 1103018 - RNA, 15 nt, Mycobacterium bovis subsp bovis AF2122/97
gucgucgccgccgaa

SEQ ID NO: 1103019 - RNA, 13 nt, Mycobacterium bovis subsp bovis AF2122/97
gucgucgcggccg

SEQ ID NO: 1103020 - RNA, 14 nt, Mycobacterium bovis subsp bovis AF2122/97
gucgucgcggccgg

SEQ ID NO: 1103021 - RNA, 14 nt, Mycobacterium bovis subsp bovis AF2122/97
gucgugcaccucgu

SEQ ID NO: 1103022 - RNA, 15 nt, Mycobacterium bovis subsp bovis AF2122/97
gucgucgcuugcugg

SEQ ID NO: 1103023 - RNA, 13 nt, Mycobacterium bovis subsp bovis AF2122/97
gucgucggccauc

SEQ ID NO: 1103024 - RNA, 15 nt, Mycobacterium bovis subsp bovis AF2122/97
gucgugcacggcggc

SEQ ID NO: 1103025 - RNA, 16 nt, Mycobacterium bovis subsp bovis AF2122/97
gucgugcacggcggcc

SEQ ID NO: 1103026 - RNA, 16 nt, Mycobacterium bovis subsp bovis AF2122/97
gucgugcaggcgacgg

SEQ ID NO: 1103027 - RNA, 17 nt, Mycobacterium bovis subsp bovis AF2122/97
gucgucggcaaccaacc

SEQ ID NO: 1103028 - RNA, 16 nt, Mycobacterium bovis subsp bovis AF2122/97
gucgucggcaggcagc

SEQ ID NO: 1103029 - RNA, 17 nt, Mycobacterium bovis subsp bovis AF2122/97
gucgucgcugagcagcg

SEQ ID NO: 1103030 - RNA, 14 nt, Mycobacterium bovis subsp bovis AF2122/97
gucggugacgaaga

SEQ ID NO: 1103031 - RNA, 11 nt, Mycobacterium bovis subsp bovis AF2122/97
gucggugaccu

SEQ ID NO: 1103032 - RNA, 18 nt, Mycobacterium bovis subsp bovis AF2122/97
gucggugaccucggcgac

SEQ ID NO: 1103033 - RNA, 22 nt, Mycobacterium bovis subsp bovis AF2122/97
gucggugggcuugccgcgcacc

SEQ ID NO: 1103034 - RNA, 19 nt, Mycobacterium bovis subsp bovis AF2122/97
gucgguguaacccuggcgg

SEQ ID NO: 1103035 - RNA, 19 nt, Mycobacterium bovis subsp bovis AF2122/97
gucggugggugccagccgg

SEQ ID NO: 1103036 - RNA, 17 nt, Mycobacterium bovis subsp bovis AF2122/97
gucggugguaccggcgg

SEQ ID NO: 1103037 - RNA, 20 nt, Mycobacterium bovis subsp bovis AF2122/97
gucgguggucucgacggcgc

SEQ ID NO: 1103038 - RNA, 23 nt, Mycobacterium bovis subsp bovis AF2122/97
gucgguggucucgacggcgccgc

SEQ ID NO: 1103039 - RNA, 18 nt, Mycobacterium bovis subsp bovis AF2122/97
gucggugugcaucgccgg

SEQ ID NO: 1103040 - RNA, 15 nt, Mycobacterium bovis subsp bovis AF2122/97
gucggugucggugac

SEQ ID NO: 1103041 - RNA, 22 nt, Mycobacterium bovis subsp bovis AF2122/97
gucggugugcaucgccggcacg

SEQ ID NO: 1103042 - RNA, 16 nt, Mycobacterium bovis subsp bovis AF2122/97
gucggugugcgcgcca

SEQ ID NO: 1103043 - RNA, 18 nt, Mycobacterium bovis subsp bovis AF2122/97
gucgguguuuggccgccg

SEQ ID NO: 1103044 - RNA, 19 nt, Mycobacterium bovis subsp bovis AF2122/97
gucgguguuuggccgccga

SEQ ID NO: 1103045 - RNA, 20 nt, Mycobacterium bovis subsp bovis AF2122/97
gucgguguuuggccgccgaa

SEQ ID NO: 1103046 - RNA, 15 nt, Mycobacterium bovis subsp bovis AF2122/97
gucguccgacgggcc

SEQ ID NO: 1103047 - RNA, 21 nt, Mycobacterium bovis subsp bovis AF2122/97
gucgucccgcccaucccgguu

SEQ ID NO: 1103048 - RNA, 19 nt, Mycobacterium bovis subsp bovis AF2122/97
gucgucccagggcugccgg

SEQ ID NO: 1103049 - RNA, 13 nt, Mycobacterium bovis subsp bovis AF2122/97
gucguccggccac

SEQ ID NO: 1103050 - RNA, 15 nt, Mycobacterium bovis subsp bovis AF2122/97
gucgugcgcggccgg

SEQ ID NO: 1103051 - RNA, 16 nt, Mycobacterium bovis subsp bovis AF2122/97
gucgugccggggcugc

SEQ ID NO: 1103052 - RNA, 22 nt, Mycobacterium bovis subsp bovis AF2122/97
gucgugcgauucacacucgggc

SEQ ID NO: 1103053 - RNA, 19 nt, Mycobacterium bovis subsp bovis AF2122/97
gucgugccacuuccacggc

SEQ ID NO: 1103054 - RNA, 14 nt, Mycobacterium bovis subsp bovis AF2122/97
gucgugccagcagc

SEQ ID NO: 1103055 - RNA, 15 nt, Mycobacterium bovis subsp bovis AF2122/97
gucgugcccgggacc

SEQ ID NO: 1103056 - RNA, 16 nt, Mycobacterium bovis subsp bovis AF2122/97
gucgugcucucggcga

SEQ ID NO: 1103057 - RNA, 15 nt, Mycobacterium bovis subsp bovis AF2122/97
gucgugcgggcgggc

SEQ ID NO: 1103058 - RNA, 19 nt, Mycobacterium bovis subsp bovis AF2122/97
gucguggagcucacgugcu

SEQ ID NO: 1103059 - RNA, 16 nt, Mycobacterium bovis subsp bovis AF2122/97
gucguugccagggcgg

SEQ ID NO: 1103060 - RNA, 20 nt, Mycobacterium bovis subsp bovis AF2122/97
gucguugcccgacccgccga

SEQ ID NO: 1103061 - RNA, 20 nt, Mycobacterium bovis subsp bovis AF2122/97
gucguugggcaugucgccga

SEQ ID NO: 1103062 - RNA, 20 nt, Mycobacterium bovis subsp bovis AF2122/97
gucguuggugcagaccaccg

SEQ ID NO: 1103063 - RNA, 17 nt, Mycobacterium bovis subsp bovis AF2122/97
gucguuggcggcggucg

SEQ ID NO: 1103064 - RNA, 23 nt, Mycobacterium bovis subsp bovis AF2122/97
gucguugccgaucugcucgccga

SEQ ID NO: 1103065 - RNA, 14 nt, Mycobacterium bovis subsp bovis AF2122/97
gucguuggacggca

SEQ ID NO: 1103066 - RNA, 22 nt, Mycobacterium bovis subsp bovis AF2122/97
gucguugucgucgccggcggcg

SEQ ID NO: 1103067 - RNA, 23 nt, Mycobacterium bovis subsp bovis AF2122/97
gucguugucuugggucaggaucg

SEQ ID NO: 1103068 - RNA, 20 nt, Mycobacterium bovis subsp bovis AF2122/97
gucguuguacggggccgucu

SEQ ID NO: 1103069 - RNA, 23 nt, Mycobacterium bovis subsp bovis AF2122/97
gucguugugcagaucgucgccga

SEQ ID NO: 1103070 - RNA, 24 nt, Mycobacterium bovis subsp bovis AF2122/97
gucuaccccgagccuugagcgcgg

SEQ ID NO: 1103071 - RNA, 16 nt, Mycobacterium bovis subsp bovis AF2122/97
gucuacccggucgccg

SEQ ID NO: 1103072 - RNA, 16 nt, Mycobacterium bovis subsp bovis AF2122/97
gucuacgccgggaauu

SEQ ID NO: 1103073 - RNA, 14 nt, Mycobacterium bovis subsp bovis AF2122/97
gucguuucgccagc

SEQ ID NO: 1103074 - RNA, 17 nt, Mycobacterium bovis subsp bovis AF2122/97
gucguuucgccagccgg

SEQ ID NO: 1103075 - RNA, 17 nt, Mycobacterium bovis subsp bovis AF2122/97
gucguugugugccagcg

SEQ ID NO: 1103076 - RNA, 23 nt, Mycobacterium bovis subsp bovis AF2122/97
gucuaucggcgaacccgcagucg

SEQ ID NO: 1103077 - RNA, 15 nt, Mycobacterium bovis subsp bovis AF2122/97
gucucaugcacccgg

SEQ ID NO: 1103078 - RNA, 20 nt, Mycobacterium bovis subsp bovis AF2122/97
gucuacgucguccagcacca

SEQ ID NO: 1103079 - RNA, 14 nt, Mycobacterium bovis subsp bovis AF2122/97
gucugaucggcuuc

SEQ ID NO: 1103080 - RNA, 14 nt, Mycobacterium bovis subsp bovis AF2122/97
gucugauggccucg

SEQ ID NO: 1103081 - RNA, 15 nt, Mycobacterium bovis subsp bovis AF2122/97
gucugauggcggcuc

SEQ ID NO: 1103082 - RNA, 19 nt, Mycobacterium bovis subsp bovis AF2122/97
gucugcagggucgaguucg

SEQ ID NO: 1103083 - RNA, 15 nt, Mycobacterium bovis subsp bovis AF2122/97
gucugccacgaggca

SEQ ID NO: 1103084 - RNA, 18 nt, Mycobacterium bovis subsp bovis AF2122/97
gucugcagugcagcgauc

SEQ ID NO: 1103085 - RNA, 19 nt, Mycobacterium bovis subsp bovis AF2122/97
gucugccaaaagggcggca

SEQ ID NO: 1103086 - RNA, 14 nt, Mycobacterium bovis subsp bovis AF2122/97
gucugcgccgccgg

SEQ ID NO: 1103087 - RNA, 16 nt, Mycobacterium bovis subsp bovis AF2122/97
gucugcgccgccggcg

SEQ ID NO: 1103088 - RNA, 18 nt, Mycobacterium bovis subsp bovis AF2122/97
gucugcgccgccggcggc

SEQ ID NO: 1103089 - RNA, 16 nt, Mycobacterium bovis subsp bovis AF2122/97
gucugcaccggcaggc

SEQ ID NO: 1103090 - RNA, 17 nt, Mycobacterium bovis subsp bovis AF2122/97
gucugccacgucggcga

SEQ ID NO: 1103091 - RNA, 15 nt, Mycobacterium bovis subsp bovis AF2122/97
gucugcccgaggucc

SEQ ID NO: 1103092 - RNA, 16 nt, Mycobacterium bovis subsp bovis AF2122/97
gucugccaggcgcagc

SEQ ID NO: 1103093 - RNA, 14 nt, Mycobacterium bovis subsp bovis AF2122/97
gucuccggcgccac

SEQ ID NO: 1103094 - RNA, 16 nt, Mycobacterium bovis subsp bovis AF2122/97
gucuccggcgccaccg

SEQ ID NO: 1103095 - RNA, 13 nt, Mycobacterium bovis subsp bovis AF2122/97
gucuccggcaagc

SEQ ID NO: 1103096 - RNA, 17 nt, Mycobacterium bovis subsp bovis AF2122/97
gucuccggacgcacgau

SEQ ID NO: 1103097 - RNA, 15 nt, Mycobacterium bovis subsp bovis AF2122/97
gucuccggcaacagc

SEQ ID NO: 1103098 - RNA, 20 nt, Mycobacterium bovis subsp bovis AF2122/97
gucuccgacauuggccguca

SEQ ID NO: 1103099 - RNA, 23 nt, Mycobacterium bovis subsp bovis AF2122/97
gucuccgcccgcgggccccaucg

SEQ ID NO: 1103100 - RNA, 14 nt, Mycobacterium bovis subsp bovis AF2122/97
gucuccgccggcuc

SEQ ID NO: 1103101 - RNA, 17 nt, Mycobacterium bovis subsp bovis AF2122/97
gucuccagcugggugac

SEQ ID NO: 1103102 - RNA, 14 nt, Mycobacterium bovis subsp bovis AF2122/97
gucuccaguagccg

SEQ ID NO: 1103103 - RNA, 20 nt, Mycobacterium bovis subsp bovis AF2122/97
gucuccaguagccggugccg

SEQ ID NO: 1103104 - RNA, 18 nt, Mycobacterium bovis subsp bovis AF2122/97
gucugacaucgucgacga

SEQ ID NO: 1103105 - RNA, 23 nt, Mycobacterium bovis subsp bovis AF2122/97
gucugacccaccgccccggcggc

SEQ ID NO: 1103106 - RNA, 16 nt, Mycobacterium bovis subsp bovis AF2122/97
gucuuggaaggcgcgc

SEQ ID NO: 1103107 - RNA, 15 nt, Mycobacterium bovis subsp bovis AF2122/97
gucuuggacagcagc

SEQ ID NO: 1103108 - RNA, 16 nt, Mycobacterium bovis subsp bovis AF2122/97
gucuuccggugcgccg

SEQ ID NO: 1103109 - RNA, 16 nt, Mycobacterium bovis subsp bovis AF2122/97
gucuucaacgucgaga

SEQ ID NO: 1103110 - RNA, 17 nt, Mycobacterium bovis subsp bovis AF2122/97
gucuuccucggccaccc

SEQ ID NO: 1103111 - RNA, 21 nt, Mycobacterium bovis subsp bovis AF2122/97
gucuuccucggccacccgcag

SEQ ID NO: 1103112 - RNA, 23 nt, Mycobacterium bovis subsp bovis AF2122/97
gucugugauugcgcgggcaucgu

SEQ ID NO: 1103113 - RNA, 13 nt, Mycobacterium bovis subsp bovis AF2122/97
gucugugcucacg

SEQ ID NO: 1103114 - RNA, 13 nt, Mycobacterium bovis subsp bovis AF2122/97
gucugcgccgccg

SEQ ID NO: 1103115 - RNA, 19 nt, Mycobacterium bovis subsp bovis AF2122/97
gucugcgccuucgccagcg

SEQ ID NO: 1103116 - RNA, 23 nt, Mycobacterium bovis subsp bovis AF2122/97
gucugcgccuucgccagcggcgc

SEQ ID NO: 1103117 - RNA, 17 nt, Mycobacterium bovis subsp bovis AF2122/97
gucuguucgccgacgcg

SEQ ID NO: 1103118 - RNA, 20 nt, Mycobacterium bovis subsp bovis AF2122/97
gucugugcucacggcggcga

SEQ ID NO: 1103119 - RNA, 21 nt, Mycobacterium bovis subsp bovis AF2122/97
gucuuggauccggccgccaac

SEQ ID NO: 1103120 - RNA, 16 nt, Mycobacterium bovis subsp bovis AF2122/97
gucuuggcccggcggu

SEQ ID NO: 1103121 - RNA, 14 nt, Mycobacterium bovis subsp bovis AF2122/97
gucuuggccggugc

SEQ ID NO: 1103122 - RNA, 16 nt, Mycobacterium bovis subsp bovis AF2122/97
gucuuggcggcggugc

SEQ ID NO: 1103123 - RNA, 14 nt, Mycobacterium bovis subsp bovis AF2122/97
gucuuggcgguggc

SEQ ID NO: 1103124 - RNA, 12 nt, Mycobacterium bovis subsp bovis AF2122/97
gucuugggcgcg

SEQ ID NO: 1103125 - RNA, 13 nt, Mycobacterium bovis subsp bovis AF2122/97
gucuugggucucg

SEQ ID NO: 1103126 - RNA, 21 nt, Mycobacterium bovis subsp bovis AF2122/97
gucuuggaaagcccgcucgga

SEQ ID NO: 1103127 - RNA, 15 nt, Mycobacterium bovis subsp bovis AF2122/97
gucuugucgccgagu

SEQ ID NO: 1103128 - RNA, 22 nt, Mycobacterium bovis subsp bovis AF2122/97
gugaaagacaacccgcucggcg

SEQ ID NO: 1103129 - RNA, 16 nt, Mycobacterium bovis subsp bovis AF2122/97
gugaaauucgcggcgg

SEQ ID NO: 1103130 - RNA, 19 nt, Mycobacterium bovis subsp bovis AF2122/97
gugaaaucgcacagcgcga

SEQ ID NO: 1103131 - RNA, 15 nt, Mycobacterium bovis subsp bovis AF2122/97
gugaaaccggccuuc

SEQ ID NO: 1103132 - RNA, 19 nt, Mycobacterium bovis subsp bovis AF2122/97
gugaaagacaacccgcucg

SEQ ID NO: 1103133 - RNA, 20 nt, Mycobacterium bovis subsp bovis AF2122/97
gugaaagacaacccgcucgg

SEQ ID NO: 1103134 - RNA, 23 nt, Mycobacterium bovis subsp bovis AF2122/97
guggggcacuuccagcccggcaa

SEQ ID NO: 1103135 - RNA, 13 nt, Mycobacterium bovis subsp bovis AF2122/97
guggggaucgacc

SEQ ID NO: 1103136 - RNA, 20 nt, Mycobacterium bovis subsp bovis AF2122/97
gugggcuuuugcgucugcuc

SEQ ID NO: 1103137 - RNA, 21 nt, Mycobacterium bovis subsp bovis AF2122/97
gugggcuuuugcgucugcucg

SEQ ID NO: 1103138 - RNA, 15 nt, Mycobacterium bovis subsp bovis AF2122/97
gugggguaucgccag

SEQ ID NO: 1103139 - RNA, 16 nt, Mycobacterium bovis subsp bovis AF2122/97
gugggguaucgccagc

SEQ ID NO: 1103140 - RNA, 22 nt, Mycobacterium bovis subsp bovis AF2122/97
gugggguaucgccagccaaccg

SEQ ID NO: 1103141 - RNA, 22 nt, Mycobacterium bovis subsp bovis AF2122/97
guggggucagugcgggcggcgu

SEQ ID NO: 1103142 - RNA, 16 nt, Mycobacterium bovis subsp bovis AF2122/97
guggggucgccgucga

SEQ ID NO: 1103143 - RNA, 13 nt, Mycobacterium bovis subsp bovis AF2122/97
gugggcgcggcgc

SEQ ID NO: 1103144 - RNA, 19 nt, Mycobacterium bovis subsp bovis AF2122/97
gugggcgccgucgccguug

SEQ ID NO: 1103145 - RNA, 17 nt, Mycobacterium bovis subsp bovis AF2122/97
gugggcguggcugguca

SEQ ID NO: 1103146 - RNA, 17 nt, Mycobacterium bovis subsp bovis AF2122/97
gugggcucguagcgcgc

SEQ ID NO: 1103147 - RNA, 21 nt, Mycobacterium bovis subsp bovis AF2122/97
gugggcguucccccggcaccg

SEQ ID NO: 1103148 - RNA, 14 nt, Mycobacterium bovis subsp bovis AF2122/97
gugggccccgccga

SEQ ID NO: 1103149 - RNA, 14 nt, Mycobacterium bovis subsp bovis AF2122/97
gugggccagcagca

SEQ ID NO: 1103150 - RNA, 15 nt, Mycobacterium bovis subsp bovis AF2122/97
gugggccagcagcaa

SEQ ID NO: 1103151 - RNA, 19 nt, Mycobacterium bovis subsp bovis AF2122/97
gugggccgacgugaccagc

SEQ ID NO: 1103152 - RNA, 16 nt, Mycobacterium bovis subsp bovis AF2122/97
gugggcgccgacaccg

SEQ ID NO: 1103153 - RNA, 14 nt, Mycobacterium bovis subsp bovis AF2122/97
gugggcgacggcca

SEQ ID NO: 1103154 - RNA, 19 nt, Mycobacterium bovis subsp bovis AF2122/97
gugggccucgaucagcgcc

SEQ ID NO: 1103155 - RNA, 16 nt, Mycobacterium bovis subsp bovis AF2122/97
gugggccugcccggcg

SEQ ID NO: 1103156 - RNA, 12 nt, Mycobacterium bovis subsp bovis AF2122/97
gugggccugcgc

SEQ ID NO: 1103157 - RNA, 23 nt, Mycobacterium bovis subsp bovis AF2122/97
gugggccuguugcugcccgacac

SEQ ID NO: 1103158 - RNA, 18 nt, Mycobacterium bovis subsp bovis AF2122/97
gugggcagcgcgaucacc

SEQ ID NO: 1103159 - RNA, 20 nt, Mycobacterium bovis subsp bovis AF2122/97
gugggcagcgcgaucaccga

SEQ ID NO: 1103160 - RNA, 14 nt, Mycobacterium bovis subsp bovis AF2122/97
gugggcagcagcug

SEQ ID NO: 1103161 - RNA, 14 nt, Mycobacterium bovis subsp bovis AF2122/97
gugggcagcaggcc

SEQ ID NO: 1103162 - RNA, 20 nt, Mycobacterium bovis subsp bovis AF2122/97
gugggcagcgcgcccgacac

SEQ ID NO: 1103163 - RNA, 12 nt, Mycobacterium bovis subsp bovis AF2122/97
gugggcacaccg

SEQ ID NO: 1103164 - RNA, 18 nt, Mycobacterium bovis subsp bovis AF2122/97
gugggcaccuuggccggc

SEQ ID NO: 1103165 - RNA, 22 nt, Mycobacterium bovis subsp bovis AF2122/97
gugggcacuugcccgucggcgc

SEQ ID NO: 1103166 - RNA, 20 nt, Mycobacterium bovis subsp bovis AF2122/97
gugggauugaagcuggccac

SEQ ID NO: 1103167 - RNA, 22 nt, Mycobacterium bovis subsp bovis AF2122/97
gugggauugaagcuggccaccg

SEQ ID NO: 1103168 - RNA, 18 nt, Mycobacterium bovis subsp bovis AF2122/97
gugggaaccaccagcacg

SEQ ID NO: 1103169 - RNA, 20 nt, Mycobacterium bovis subsp bovis AF2122/97
gugggaagagccgggcucgu

SEQ ID NO: 1103170 - RNA, 16 nt, Mycobacterium bovis subsp bovis AF2122/97
gugggaucgcagcgcc

SEQ ID NO: 1103171 - RNA, 17 nt, Mycobacterium bovis subsp bovis AF2122/97
gugguccaaccgggccg

SEQ ID NO: 1103172 - RNA, 23 nt, Mycobacterium bovis subsp bovis AF2122/97
gugguccaucgcgcugcggccca

SEQ ID NO: 1103173 - RNA, 15 nt, Mycobacterium bovis subsp bovis AF2122/97
guggucaccaggccg

SEQ ID NO: 1103174 - RNA, 14 nt, Mycobacterium bovis subsp bovis AF2122/97
guggucaguccgac

SEQ ID NO: 1103175 - RNA, 18 nt, Mycobacterium bovis subsp bovis AF2122/97
guggucaguccgacaccg

SEQ ID NO: 1103176 - RNA, 18 nt, Mycobacterium bovis subsp bovis AF2122/97
guggucgauuucggcgcg

SEQ ID NO: 1103177 - RNA, 15 nt, Mycobacterium bovis subsp bovis AF2122/97
gugguccucgaucag

SEQ ID NO: 1103178 - RNA, 17 nt, Mycobacterium bovis subsp bovis AF2122/97
guggucgcgcggcaccg

SEQ ID NO: 1103179 - RNA, 14 nt, Mycobacterium bovis subsp bovis AF2122/97
guggucggacagcg

SEQ ID NO: 1103180 - RNA, 16 nt, Mycobacterium bovis subsp bovis AF2122/97
guggucggugccagca

SEQ ID NO: 1103181 - RNA, 22 nt, Mycobacterium bovis subsp bovis AF2122/97
guggucgucccgcccaucccgg

SEQ ID NO: 1103182 - RNA, 23 nt, Mycobacterium bovis subsp bovis AF2122/97
guggucgugggugagcgaccugg

SEQ ID NO: 1103183 - RNA, 15 nt, Mycobacterium bovis subsp bovis AF2122/97
guggucaacggccga

SEQ ID NO: 1103184 - RNA, 15 nt, Mycobacterium bovis subsp bovis AF2122/97
guggucaccaccauc

SEQ ID NO: 1103185 - RNA, 14 nt, Mycobacterium bovis subsp bovis AF2122/97
gugguaucggcgug

SEQ ID NO: 1103186 - RNA, 13 nt, Mycobacterium bovis subsp bovis AF2122/97
gugguaucgccgg

SEQ ID NO: 1103187 - RNA, 15 nt, Mycobacterium bovis subsp bovis AF2122/97
gugguaccggcgcca

SEQ ID NO: 1103188 - RNA, 16 nt, Mycobacterium bovis subsp bovis AF2122/97
gugguaccggcggcgc

SEQ ID NO: 1103189 - RNA, 20 nt, Mycobacterium bovis subsp bovis AF2122/97
gugguacuuucacgcucguu

SEQ ID NO: 1103190 - RNA, 19 nt, Mycobacterium bovis subsp bovis AF2122/97
gugguagcugacgcugcuc

SEQ ID NO: 1103191 - RNA, 13 nt, Mycobacterium bovis subsp bovis AF2122/97
gugguaggccgcc

SEQ ID NO: 1103192 - RNA, 12 nt, Mycobacterium bovis subsp bovis AF2122/97
gugguaggccgg

SEQ ID NO: 1103193 - RNA, 19 nt, Mycobacterium bovis subsp bovis AF2122/97
gugguaggccggggcgucg

SEQ ID NO: 1103194 - RNA, 22 nt, Mycobacterium bovis subsp bovis AF2122/97
gugggugaugguaccgccacug

SEQ ID NO: 1103195 - RNA, 14 nt, Mycobacterium bovis subsp bovis AF2122/97
gugguaccggcgcc

SEQ ID NO: 1103196 - RNA, 16 nt, Mycobacterium bovis subsp bovis AF2122/97
gugguaacaccggcga

SEQ ID NO: 1103197 - RNA, 15 nt, Mycobacterium bovis subsp bovis AF2122/97
gugguaagacgccga

SEQ ID NO: 1103198 - RNA, 17 nt, Mycobacterium bovis subsp bovis AF2122/97
guggguagccagcgcgc

SEQ ID NO: 1103199 - RNA, 23 nt, Mycobacterium bovis subsp bovis AF2122/97
guggguggaggucaaaucaacgg

SEQ ID NO: 1103200 - RNA, 22 nt, Mycobacterium bovis subsp bovis AF2122/97
gugggacaccaucuccgccguc

SEQ ID NO: 1103201 - RNA, 19 nt, Mycobacterium bovis subsp bovis AF2122/97
guggcuuuugcgucugcuc

SEQ ID NO: 1103202 - RNA, 20 nt, Mycobacterium bovis subsp bovis AF2122/97
guggcuuuugcgucugcucg

SEQ ID NO: 1103203 - RNA, 22 nt, Mycobacterium bovis subsp bovis AF2122/97
guggcuuuugcgucugcucgcg

SEQ ID NO: 1103204 - RNA, 13 nt, Mycobacterium bovis subsp bovis AF2122/97
guggcugaucccg

SEQ ID NO: 1103205 - RNA, 16 nt, Mycobacterium bovis subsp bovis AF2122/97
guggcuggcaugccgg

SEQ ID NO: 1103206 - RNA, 19 nt, Mycobacterium bovis subsp bovis AF2122/97
guggcuucgacggcggcca

SEQ ID NO: 1103207 - RNA, 18 nt, Mycobacterium bovis subsp bovis AF2122/97
guggcuugccccgccgua

SEQ ID NO: 1103208 - RNA, 21 nt, Mycobacterium bovis subsp bovis AF2122/97
guggcuugguggucgccaccc

SEQ ID NO: 1103209 - RNA, 23 nt, Mycobacterium bovis subsp bovis AF2122/97
guggcuuguucggacucacucgg

SEQ ID NO: 1103210 - RNA, 18 nt, Mycobacterium bovis subsp bovis AF2122/97
guggcuauuccgacucga

SEQ ID NO: 1103211 - RNA, 20 nt, Mycobacterium bovis subsp bovis AF2122/97
guggcucgacgaugcgguca

SEQ ID NO: 1103212 - RNA, 15 nt, Mycobacterium bovis subsp bovis AF2122/97
guggcguggcccucg

SEQ ID NO: 1103213 - RNA, 17 nt, Mycobacterium bovis subsp bovis AF2122/97
guggcguaauugucgau

SEQ ID NO: 1103214 - RNA, 14 nt, Mycobacterium bovis subsp bovis AF2122/97
guggcgucaccgcc

SEQ ID NO: 1103215 - RNA, 13 nt, Mycobacterium bovis subsp bovis AF2122/97
guggcgucgcucg

SEQ ID NO: 1103216 - RNA, 10 nt, Mycobacterium bovis subsp bovis AF2122/97
guggcgucgu

SEQ ID NO: 1103217 - RNA, 19 nt, Mycobacterium bovis subsp bovis AF2122/97
guggcgugcgcguccagau

SEQ ID NO: 1103218 - RNA, 23 nt, Mycobacterium bovis subsp bovis AF2122/97
guggcgucgugcgcggccggcac

SEQ ID NO: 1103219 - RNA, 18 nt, Mycobacterium bovis subsp bovis AF2122/97
guggcgggagaucgucgc

SEQ ID NO: 1103220 - RNA, 19 nt, Mycobacterium bovis subsp bovis AF2122/97
guggcgggagaucgucgcc

SEQ ID NO: 1103221 - RNA, 19 nt, Mycobacterium bovis subsp bovis AF2122/97
guggcgggguugaucaccg

SEQ ID NO: 1103222 - RNA, 20 nt, Mycobacterium bovis subsp bovis AF2122/97
guggcgggguugaucaccga

SEQ ID NO: 1103223 - RNA, 18 nt, Mycobacterium bovis subsp bovis AF2122/97
guggcgguggccgucggg

SEQ ID NO: 1103224 - RNA, 16 nt, Mycobacterium bovis subsp bovis AF2122/97
guggcgggucagcgcg

SEQ ID NO: 1103225 - RNA, 14 nt, Mycobacterium bovis subsp bovis AF2122/97
guggcgggucagcg

SEQ ID NO: 1103226 - RNA, 17 nt, Mycobacterium bovis subsp bovis AF2122/97
guggcgcgggccggcga

SEQ ID NO: 1103227 - RNA, 15 nt, Mycobacterium bovis subsp bovis AF2122/97
guggcgcggggccgc

SEQ ID NO: 1103228 - RNA, 18 nt, Mycobacterium bovis subsp bovis AF2122/97
guggcgcggggccgccgc

SEQ ID NO: 1103229 - RNA, 17 nt, Mycobacterium bovis subsp bovis AF2122/97
guggcgcggacccgccg

SEQ ID NO: 1103230 - RNA, 14 nt, Mycobacterium bovis subsp bovis AF2122/97
guggcgcugaucgg

SEQ ID NO: 1103231 - RNA, 22 nt, Mycobacterium bovis subsp bovis AF2122/97
guggcgcucggcgagcaacacg

SEQ ID NO: 1103232 - RNA, 19 nt, Mycobacterium bovis subsp bovis AF2122/97
guggcgcugaagccgacga

SEQ ID NO: 1103233 - RNA, 20 nt, Mycobacterium bovis subsp bovis AF2122/97
guggcgcugggguccgcguc

SEQ ID NO: 1103234 - RNA, 13 nt, Mycobacterium bovis subsp bovis AF2122/97
guggcgcugcguc

SEQ ID NO: 1103235 - RNA, 20 nt, Mycobacterium bovis subsp bovis AF2122/97
guggcggccaguucggcggc

SEQ ID NO: 1103236 - RNA, 12 nt, Mycobacterium bovis subsp bovis AF2122/97
guggcggcagca

SEQ ID NO: 1103237 - RNA, 20 nt, Mycobacterium bovis subsp bovis AF2122/97
guggcggcagcagcgccgua

SEQ ID NO: 1103238 - RNA, 15 nt, Mycobacterium bovis subsp bovis AF2122/97
guggcggacggcguc

SEQ ID NO: 1103239 - RNA, 16 nt, Mycobacterium bovis subsp bovis AF2122/97
guggcggacggcgucg

SEQ ID NO: 1103240 - RNA, 17 nt, Mycobacterium bovis subsp bovis AF2122/97
guggcggacggcgucga

SEQ ID NO: 1103241 - RNA, 21 nt, Mycobacterium bovis subsp bovis AF2122/97
guggcggaucgcgagcgccgc

SEQ ID NO: 1103242 - RNA, 23 nt, Mycobacterium bovis subsp bovis AF2122/97
guggcggcggcggcaacggcggc

SEQ ID NO: 1103243 - RNA, 13 nt, Mycobacterium bovis subsp bovis AF2122/97
guggcggcgggcc

SEQ ID NO: 1103244 - RNA, 20 nt, Mycobacterium bovis subsp bovis AF2122/97
guggcggcgggccucggcga

SEQ ID NO: 1103245 - RNA, 12 nt, Mycobacterium bovis subsp bovis AF2122/97
guggcgccguug

SEQ ID NO: 1103246 - RNA, 14 nt, Mycobacterium bovis subsp bovis AF2122/97
guggcgccggucgc

SEQ ID NO: 1103247 - RNA, 13 nt, Mycobacterium bovis subsp bovis AF2122/97
guggcgccgucgg

SEQ ID NO: 1103248 - RNA, 19 nt, Mycobacterium bovis subsp bovis AF2122/97
guggcgccggggccgccga

SEQ ID NO: 1103249 - RNA, 13 nt, Mycobacterium bovis subsp bovis AF2122/97
guggcgccggccg

SEQ ID NO: 1103250 - RNA, 20 nt, Mycobacterium bovis subsp bovis AF2122/97
guggcgccgaacgcaacgcc

SEQ ID NO: 1103251 - RNA, 21 nt, Mycobacterium bovis subsp bovis AF2122/97
guggcgccgccggcaccgccg

SEQ ID NO: 1103252 - RNA, 22 nt, Mycobacterium bovis subsp bovis AF2122/97
guggcgccgccggcaccgccgg

SEQ ID NO: 1103253 - RNA, 16 nt, Mycobacterium bovis subsp bovis AF2122/97
guggcgaggcagcacc

SEQ ID NO: 1103254 - RNA, 21 nt, Mycobacterium bovis subsp bovis AF2122/97
guggcgaggcagcacccgcac

SEQ ID NO: 1103255 - RNA, 17 nt, Mycobacterium bovis subsp bovis AF2122/97
guggcgcaccaccgccc

SEQ ID NO: 1103256 - RNA, 15 nt, Mycobacterium bovis subsp bovis AF2122/97
guggcgccaacgcaa

SEQ ID NO: 1103257 - RNA, 17 nt, Mycobacterium bovis subsp bovis AF2122/97
guggcagcccgucggac

SEQ ID NO: 1103258 - RNA, 21 nt, Mycobacterium bovis subsp bovis AF2122/97
guggcagccugcugcacaucg

SEQ ID NO: 1103259 - RNA, 17 nt, Mycobacterium bovis subsp bovis AF2122/97
guggcagcgcacccggu

SEQ ID NO: 1103260 - RNA, 17 nt, Mycobacterium bovis subsp bovis AF2122/97
guggcacugacgcgccc

SEQ ID NO: 1103261 - RNA, 16 nt, Mycobacterium bovis subsp bovis AF2122/97
guggcagagccgccgu

SEQ ID NO: 1103262 - RNA, 17 nt, Mycobacterium bovis subsp bovis AF2122/97
guggcagagccgccguu

SEQ ID NO: 1103263 - RNA, 18 nt, Mycobacterium bovis subsp bovis AF2122/97
guggcacgcaugagggca

SEQ ID NO: 1103264 - RNA, 18 nt, Mycobacterium bovis subsp bovis AF2122/97
guggcaggugaucccgau

SEQ ID NO: 1103265 - RNA, 20 nt, Mycobacterium bovis subsp bovis AF2122/97
guggccagcaggcggcugaa

SEQ ID NO: 1103266 - RNA, 23 nt, Mycobacterium bovis subsp bovis AF2122/97
guggccagaucgaacgcagccag

SEQ ID NO: 1103267 - RNA, 21 nt, Mycobacterium bovis subsp bovis AF2122/97
guggccaauccggcggcgacg

SEQ ID NO: 1103268 - RNA, 22 nt, Mycobacterium bovis subsp bovis AF2122/97
guggccaauccggcggcgacgu

SEQ ID NO: 1103269 - RNA, 17 nt, Mycobacterium bovis subsp bovis AF2122/97
guggcaguacaccggcg

SEQ ID NO: 1103270 - RNA, 16 nt, Mycobacterium bovis subsp bovis AF2122/97
guggcauccagcagcg

SEQ ID NO: 1103271 - RNA, 13 nt, Mycobacterium bovis subsp bovis AF2122/97
guggcaugcgaca

SEQ ID NO: 1103272 - RNA, 18 nt, Mycobacterium bovis subsp bovis AF2122/97
guggcccgcucccugcac

SEQ ID NO: 1103273 - RNA, 21 nt, Mycobacterium bovis subsp bovis AF2122/97
guggccgaacgggucggcgac

SEQ ID NO: 1103274 - RNA, 21 nt, Mycobacterium bovis subsp bovis AF2122/97
guggccgacgauagcggcccg

SEQ ID NO: 1103275 - RNA, 16 nt, Mycobacterium bovis subsp bovis AF2122/97
guggcccgggccaccg

SEQ ID NO: 1103276 - RNA, 14 nt, Mycobacterium bovis subsp bovis AF2122/97
guggcccucggcga

SEQ ID NO: 1103277 - RNA, 16 nt, Mycobacterium bovis subsp bovis AF2122/97
guggccccaagcgugc

SEQ ID NO: 1103278 - RNA, 15 nt, Mycobacterium bovis subsp bovis AF2122/97
guggccaccaaacgc

SEQ ID NO: 1103279 - RNA, 13 nt, Mycobacterium bovis subsp bovis AF2122/97
guggccaccagcg

SEQ ID NO: 1103280 - RNA, 18 nt, Mycobacterium bovis subsp bovis AF2122/97
guggccgcugccagccgu

SEQ ID NO: 1103281 - RNA, 19 nt, Mycobacterium bovis subsp bovis AF2122/97
guggccggggugccggcga

SEQ ID NO: 1103282 - RNA, 14 nt, Mycobacterium bovis subsp bovis AF2122/97
guggccgucgccga

SEQ ID NO: 1103283 - RNA, 13 nt, Mycobacterium bovis subsp bovis AF2122/97
guggccggucguu

SEQ ID NO: 1103284 - RNA, 16 nt, Mycobacterium bovis subsp bovis AF2122/97
guggccggugggccgc

SEQ ID NO: 1103285 - RNA, 18 nt, Mycobacterium bovis subsp bovis AF2122/97
guggccgggucgaucacc

SEQ ID NO: 1103286 - RNA, 15 nt, Mycobacterium bovis subsp bovis AF2122/97
guggccgcgaucccg

SEQ ID NO: 1103287 - RNA, 17 nt, Mycobacterium bovis subsp bovis AF2122/97
guggccgcgaucccggc

SEQ ID NO: 1103288 - RNA, 14 nt, Mycobacterium bovis subsp bovis AF2122/97
guggccgccgucga

SEQ ID NO: 1103289 - RNA, 15 nt, Mycobacterium bovis subsp bovis AF2122/97
guggccgagccgcgg

SEQ ID NO: 1103290 - RNA, 21 nt, Mycobacterium bovis subsp bovis AF2122/97
guggccgagccgcggucaccc

SEQ ID NO: 1103291 - RNA, 12 nt, Mycobacterium bovis subsp bovis AF2122/97
guggccgccacc

SEQ ID NO: 1103292 - RNA, 13 nt, Mycobacterium bovis subsp bovis AF2122/97
guggccgccaccu

SEQ ID NO: 1103293 - RNA, 20 nt, Mycobacterium bovis subsp bovis AF2122/97
guggcgaaaucgucgaaccg

SEQ ID NO: 1103294 - RNA, 17 nt, Mycobacterium bovis subsp bovis AF2122/97
guggcgaccggcgaccg

SEQ ID NO: 1103295 - RNA, 17 nt, Mycobacterium bovis subsp bovis AF2122/97
guggccuugcgucaucg

SEQ ID NO: 1103296 - RNA, 19 nt, Mycobacterium bovis subsp bovis AF2122/97
guggccucauccaccgaug

SEQ ID NO: 1103297 - RNA, 16 nt, Mycobacterium bovis subsp bovis AF2122/97
guggaccgccgaucgg

SEQ ID NO: 1103298 - RNA, 12 nt, Mycobacterium bovis subsp bovis AF2122/97
guggaccgccga

SEQ ID NO: 1103299 - RNA, 14 nt, Mycobacterium bovis subsp bovis AF2122/97
guggacaggucggg

SEQ ID NO: 1103300 - RNA, 19 nt, Mycobacterium bovis subsp bovis AF2122/97
guggacagaaucgaccgcc

SEQ ID NO: 1103301 - RNA, 13 nt, Mycobacterium bovis subsp bovis AF2122/97
guggacgaccgcg

SEQ ID NO: 1103302 - RNA, 19 nt, Mycobacterium bovis subsp bovis AF2122/97
guggacgauacgcgcaccg

SEQ ID NO: 1103303 - RNA, 16 nt, Mycobacterium bovis subsp bovis AF2122/97
guggacgaucaacccg

SEQ ID NO: 1103304 - RNA, 19 nt, Mycobacterium bovis subsp bovis AF2122/97
guggacgcagagucaacag

SEQ ID NO: 1103305 - RNA, 20 nt, Mycobacterium bovis subsp bovis AF2122/97
guggacgcagagucaacaga

SEQ ID NO: 1103306 - RNA, 22 nt, Mycobacterium bovis subsp bovis AF2122/97
guggacggcaggcggccgccgg

SEQ ID NO: 1103307 - RNA, 19 nt, Mycobacterium bovis subsp bovis AF2122/97
guggaccggucgacagcga

SEQ ID NO: 1103308 - RNA, 15 nt, Mycobacterium bovis subsp bovis AF2122/97
guggagcucgcggcg

SEQ ID NO: 1103309 - RNA, 16 nt, Mycobacterium bovis subsp bovis AF2122/97
guggagcgcgccucgc

SEQ ID NO: 1103310 - RNA, 16 nt, Mycobacterium bovis subsp bovis AF2122/97
guggcacacccgcacc

SEQ ID NO: 1103311 - RNA, 18 nt, Mycobacterium bovis subsp bovis AF2122/97
guggcaagcugucgucgc

SEQ ID NO: 1103312 - RNA, 14 nt, Mycobacterium bovis subsp bovis AF2122/97
guggcacaagcugg

SEQ ID NO: 1103313 - RNA, 17 nt, Mycobacterium bovis subsp bovis AF2122/97
guggaugcgccgcacgg

SEQ ID NO: 1103314 - RNA, 15 nt, Mycobacterium bovis subsp bovis AF2122/97
guggauggccgccag

SEQ ID NO: 1103315 - RNA, 21 nt, Mycobacterium bovis subsp bovis AF2122/97
guggcaagccuaaaaccccga

SEQ ID NO: 1103316 - RNA, 23 nt, Mycobacterium bovis subsp bovis AF2122/97
guggcaacggaggugccggcgcc

SEQ ID NO: 1103317 - RNA, 17 nt, Mycobacterium bovis subsp bovis AF2122/97
guggcaacggguccgac

SEQ ID NO: 1103318 - RNA, 22 nt, Mycobacterium bovis subsp bovis AF2122/97
guggaucaucccgaccagcaga

SEQ ID NO: 1103319 - RNA, 17 nt, Mycobacterium bovis subsp bovis AF2122/97
guggaugcccgguuucu

SEQ ID NO: 1103320 - RNA, 17 nt, Mycobacterium bovis subsp bovis AF2122/97
guggaugccgacggcgg

SEQ ID NO: 1103321 - RNA, 15 nt, Mycobacterium bovis subsp bovis AF2122/97
guggaugagccgguc

SEQ ID NO: 1103322 - RNA, 19 nt, Mycobacterium bovis subsp bovis AF2122/97
guggaggcccgucacaaug

SEQ ID NO: 1103323 - RNA, 18 nt, Mycobacterium bovis subsp bovis AF2122/97
gugcuggucaacagcggc

SEQ ID NO: 1103324 - RNA, 22 nt, Mycobacterium bovis subsp bovis AF2122/97
gugcuguugcgcggucgcgcga

SEQ ID NO: 1103325 - RNA, 19 nt, Mycobacterium bovis subsp bovis AF2122/97
gugcuuccauucgcggucc

SEQ ID NO: 1103326 - RNA, 14 nt, Mycobacterium bovis subsp bovis AF2122/97
gugcuggucgccgc

SEQ ID NO: 1103327 - RNA, 16 nt, Mycobacterium bovis subsp bovis AF2122/97
gugcuggucgccgcgg

SEQ ID NO: 1103328 - RNA, 18 nt, Mycobacterium bovis subsp bovis AF2122/97
gugcuggugaucugcugg

SEQ ID NO: 1103329 - RNA, 18 nt, Mycobacterium bovis subsp bovis AF2122/97
gugcuggugguaucggcg

SEQ ID NO: 1103330 - RNA, 17 nt, Mycobacterium bovis subsp bovis AF2122/97
gugcugugcucacgagc

SEQ ID NO: 1103331 - RNA, 22 nt, Mycobacterium bovis subsp bovis AF2122/97
gugcuggcuuugaucgcccggu

SEQ ID NO: 1103332 - RNA, 19 nt, Mycobacterium bovis subsp bovis AF2122/97
gugcugggcaucaccgacg

SEQ ID NO: 1103333 - RNA, 14 nt, Mycobacterium bovis subsp bovis AF2122/97
gugcugggccgacg

SEQ ID NO: 1103334 - RNA, 24 nt, Mycobacterium bovis subsp bovis AF2122/97
gugcuggcgaucucuaccagccgc

SEQ ID NO: 1103335 - RNA, 15 nt, Mycobacterium bovis subsp bovis AF2122/97
gugcuggcgcaacca

SEQ ID NO: 1103336 - RNA, 15 nt, Mycobacterium bovis subsp bovis AF2122/97
gugcuggcaccagca

SEQ ID NO: 1103337 - RNA, 16 nt, Mycobacterium bovis subsp bovis AF2122/97
gugcuugucgccgcgu

SEQ ID NO: 1103338 - RNA, 23 nt, Mycobacterium bovis subsp bovis AF2122/97
gugcuuguugcgcgacgccgcgg

SEQ ID NO: 1103339 - RNA, 17 nt, Mycobacterium bovis subsp bovis AF2122/97
gugcuugcccgguugug

SEQ ID NO: 1103340 - RNA, 15 nt, Mycobacterium bovis subsp bovis AF2122/97
guggaaacccgccga

SEQ ID NO: 1103341 - RNA, 17 nt, Mycobacterium bovis subsp bovis AF2122/97
guggaaacccgccgaac

SEQ ID NO: 1103342 - RNA, 22 nt, Mycobacterium bovis subsp bovis AF2122/97
guggaaacugaugucgccgauu

SEQ ID NO: 1103343 - RNA, 16 nt, Mycobacterium bovis subsp bovis AF2122/97
guggaaaaaggcggcg

SEQ ID NO: 1103344 - RNA, 18 nt, Mycobacterium bovis subsp bovis AF2122/97
guggaaaaaggcggcguu

SEQ ID NO: 1103345 - RNA, 19 nt, Mycobacterium bovis subsp bovis AF2122/97
guggaaaaaggcggcguug

SEQ ID NO: 1103346 - RNA, 17 nt, Mycobacterium bovis subsp bovis AF2122/97
gugcuuuccuugcgcgc

SEQ ID NO: 1103347 - RNA, 19 nt, Mycobacterium bovis subsp bovis AF2122/97
gugcuuucgcgucugcucg

SEQ ID NO: 1103348 - RNA, 18 nt, Mycobacterium bovis subsp bovis AF2122/97
guggaagcccgucgcggc

SEQ ID NO: 1103349 - RNA, 21 nt, Mycobacterium bovis subsp bovis AF2122/97
guggaagcccgucgcggccgg

SEQ ID NO: 1103350 - RNA, 23 nt, Mycobacterium bovis subsp bovis AF2122/97
guggaagcccgucgcggccggcg

SEQ ID NO: 1103351 - RNA, 20 nt, Mycobacterium bovis subsp bovis AF2122/97
guggaagccgaccaccgccg

SEQ ID NO: 1103352 - RNA, 21 nt, Mycobacterium bovis subsp bovis AF2122/97
guggaagccgaccaccgccgg

SEQ ID NO: 1103353 - RNA, 15 nt, Mycobacterium bovis subsp bovis AF2122/97
guggaaccacggcgc

SEQ ID NO: 1103354 - RNA, 14 nt, Mycobacterium bovis subsp bovis AF2122/97
guggaagacgucga

SEQ ID NO: 1103355 - RNA, 22 nt, Mycobacterium bovis subsp bovis AF2122/97
guggaagauguugccgccgguc

SEQ ID NO: 1103356 - RNA, 15 nt, Mycobacterium bovis subsp bovis AF2122/97
guggaagguguuggu

SEQ ID NO: 1103357 - RNA, 19 nt, Mycobacterium bovis subsp bovis AF2122/97
guggaaccuggcgauagca

SEQ ID NO: 1103358 - RNA, 23 nt, Mycobacterium bovis subsp bovis AF2122/97
guggaaguacuucgcggcgguga

SEQ ID NO: 1103359 - RNA, 13 nt, Mycobacterium bovis subsp bovis AF2122/97
guggaauacgcug

SEQ ID NO: 1103360 - RNA, 18 nt, Mycobacterium bovis subsp bovis AF2122/97
guggaauggcgccggccg

SEQ ID NO: 1103361 - RNA, 15 nt, Mycobacterium bovis subsp bovis AF2122/97
guggacaacgccaua

SEQ ID NO: 1103362 - RNA, 16 nt, Mycobacterium bovis subsp bovis AF2122/97
gugccaaacgccgccc

SEQ ID NO: 1103363 - RNA, 22 nt, Mycobacterium bovis subsp bovis AF2122/97
gugccaaacgccgcccgccggu

SEQ ID NO: 1103364 - RNA, 17 nt, Mycobacterium bovis subsp bovis AF2122/97
gugccaaaggacgacac

SEQ ID NO: 1103365 - RNA, 20 nt, Mycobacterium bovis subsp bovis AF2122/97
gugccaaaggacgacaccgc

SEQ ID NO: 1103366 - RNA, 14 nt, Mycobacterium bovis subsp bovis AF2122/97
gugccaggaucgcg

SEQ ID NO: 1103367 - RNA, 19 nt, Mycobacterium bovis subsp bovis AF2122/97
gugccaggaucgcggcgcc

SEQ ID NO: 1103368 - RNA, 12 nt, Mycobacterium bovis subsp bovis AF2122/97
gugccaucgcca

SEQ ID NO: 1103369 - RNA, 20 nt, Mycobacterium bovis subsp bovis AF2122/97
gugccauccuuaugcgcggu

SEQ ID NO: 1103370 - RNA, 21 nt, Mycobacterium bovis subsp bovis AF2122/97
gugcccaauauugcguucggg

SEQ ID NO: 1103371 - RNA, 17 nt, Mycobacterium bovis subsp bovis AF2122/97
gugcccaacccacucgc

SEQ ID NO: 1103372 - RNA, 17 nt, Mycobacterium bovis subsp bovis AF2122/97
gugccagugccagcguc

SEQ ID NO: 1103373 - RNA, 21 nt, Mycobacterium bovis subsp bovis AF2122/97
gugccccgccgagcggugccg

SEQ ID NO: 1103374 - RNA, 17 nt, Mycobacterium bovis subsp bovis AF2122/97
gugcccgacccgccgau

SEQ ID NO: 1103375 - RNA, 13 nt, Mycobacterium bovis subsp bovis AF2122/97
gugcccgccaccg

SEQ ID NO: 1103376 - RNA, 16 nt, Mycobacterium bovis subsp bovis AF2122/97
gugcccgccaccggcg

SEQ ID NO: 1103377 - RNA, 17 nt, Mycobacterium bovis subsp bovis AF2122/97
gugcccgcaccacaccg

SEQ ID NO: 1103378 - RNA, 20 nt, Mycobacterium bovis subsp bovis AF2122/97
gugcccgcacugccgccggu

SEQ ID NO: 1103379 - RNA, 15 nt, Mycobacterium bovis subsp bovis AF2122/97
gugccccacucgggu

SEQ ID NO: 1103380 - RNA, 18 nt, Mycobacterium bovis subsp bovis AF2122/97
gugcccauagccgguggu

SEQ ID NO: 1103381 - RNA, 19 nt, Mycobacterium bovis subsp bovis AF2122/97
gugcccauagccggugguc

SEQ ID NO: 1103382 - RNA, 18 nt, Mycobacterium bovis subsp bovis AF2122/97
gugcccaggaaggcgacg

SEQ ID NO: 1103383 - RNA, 17 nt, Mycobacterium bovis subsp bovis AF2122/97
gugcaucgccaccaccg

SEQ ID NO: 1103384 - RNA, 16 nt, Mycobacterium bovis subsp bovis AF2122/97
gugcaucgccggcacg

SEQ ID NO: 1103385 - RNA, 14 nt, Mycobacterium bovis subsp bovis AF2122/97
gugcagcgugcagc

SEQ ID NO: 1103386 - RNA, 17 nt, Mycobacterium bovis subsp bovis AF2122/97
gugcagcgugcagcggc

SEQ ID NO: 1103387 - RNA, 13 nt, Mycobacterium bovis subsp bovis AF2122/97
gugcagcgcagga

SEQ ID NO: 1103388 - RNA, 17 nt, Mycobacterium bovis subsp bovis AF2122/97
gugcagcggcgccgcca

SEQ ID NO: 1103389 - RNA, 19 nt, Mycobacterium bovis subsp bovis AF2122/97
gugcagcggcgccgccaag

SEQ ID NO: 1103390 - RNA, 16 nt, Mycobacterium bovis subsp bovis AF2122/97
gugcaggaucacgccg

SEQ ID NO: 1103391 - RNA, 20 nt, Mycobacterium bovis subsp bovis AF2122/97
gugcaggaucacgccgccgg

SEQ ID NO: 1103392 - RNA, 15 nt, Mycobacterium bovis subsp bovis AF2122/97
gugcaguuccgcggg

SEQ ID NO: 1103393 - RNA, 16 nt, Mycobacterium bovis subsp bovis AF2122/97
gugcagcuccccgccg

SEQ ID NO: 1103394 - RNA, 16 nt, Mycobacterium bovis subsp bovis AF2122/97
gugcaggaccagcacc

SEQ ID NO: 1103395 - RNA, 22 nt, Mycobacterium bovis subsp bovis AF2122/97
gugcaggacguuugagacccca

SEQ ID NO: 1103396 - RNA, 23 nt, Mycobacterium bovis subsp bovis AF2122/97
gugcauagcaauccgcacagcga

SEQ ID NO: 1103397 - RNA, 12 nt, Mycobacterium bovis subsp bovis AF2122/97
gugcaccgcgac

SEQ ID NO: 1103398 - RNA, 16 nt, Mycobacterium bovis subsp bovis AF2122/97
gugcaccgcgaccgcg

SEQ ID NO: 1103399 - RNA, 14 nt, Mycobacterium bovis subsp bovis AF2122/97
gugcagcagcgcgc

SEQ ID NO: 1103400 - RNA, 19 nt, Mycobacterium bovis subsp bovis AF2122/97
gugcagcagcgcgcggaug

SEQ ID NO: 1103401 - RNA, 19 nt, Mycobacterium bovis subsp bovis AF2122/97
gugcacccgguugugcgcg

SEQ ID NO: 1103402 - RNA, 17 nt, Mycobacterium bovis subsp bovis AF2122/97
gugcagcccgccgcuga

SEQ ID NO: 1103403 - RNA, 23 nt, Mycobacterium bovis subsp bovis AF2122/97
gugcagccgcaggugggcguugg

SEQ ID NO: 1103404 - RNA, 12 nt, Mycobacterium bovis subsp bovis AF2122/97
gugcagcgccga

SEQ ID NO: 1103405 - RNA, 14 nt, Mycobacterium bovis subsp bovis AF2122/97
gugcaccagcgacc

SEQ ID NO: 1103406 - RNA, 19 nt, Mycobacterium bovis subsp bovis AF2122/97
gugcaccagcgaccagguc

SEQ ID NO: 1103407 - RNA, 23 nt, Mycobacterium bovis subsp bovis AF2122/97
gugcaccagcgaccaggucgcca

SEQ ID NO: 1103408 - RNA, 16 nt, Mycobacterium bovis subsp bovis AF2122/97
gugcaccagcucaccc

SEQ ID NO: 1103409 - RNA, 23 nt, Mycobacterium bovis subsp bovis AF2122/97
gugcaccauuguuccguccccga

SEQ ID NO: 1103410 - RNA, 21 nt, Mycobacterium bovis subsp bovis AF2122/97
gugcaccgaagauggccagcg

SEQ ID NO: 1103411 - RNA, 15 nt, Mycobacterium bovis subsp bovis AF2122/97
gugaaccuggcgacg

SEQ ID NO: 1103412 - RNA, 20 nt, Mycobacterium bovis subsp bovis AF2122/97
gugaaccuggcgacgcgaca

SEQ ID NO: 1103413 - RNA, 23 nt, Mycobacterium bovis subsp bovis AF2122/97
gugaacgaagggaaggacgcgca

SEQ ID NO: 1103414 - RNA, 12 nt, Mycobacterium bovis subsp bovis AF2122/97
gugaaccgcgcg

SEQ ID NO: 1103415 - RNA, 19 nt, Mycobacterium bovis subsp bovis AF2122/97
gugaaccgcgcggcgaucg

SEQ ID NO: 1103416 - RNA, 15 nt, Mycobacterium bovis subsp bovis AF2122/97
gugaacauuggguac

SEQ ID NO: 1103417 - RNA, 16 nt, Mycobacterium bovis subsp bovis AF2122/97
gugaacagcgcgucgg

SEQ ID NO: 1103418 - RNA, 21 nt, Mycobacterium bovis subsp bovis AF2122/97
gugaacaggccgaggcgaguu

SEQ ID NO: 1103419 - RNA, 17 nt, Mycobacterium bovis subsp bovis AF2122/97
gugaacacgucgcggua

SEQ ID NO: 1103420 - RNA, 19 nt, Mycobacterium bovis subsp bovis AF2122/97
gugaaccaccacuucggcg

SEQ ID NO: 1103421 - RNA, 16 nt, Mycobacterium bovis subsp bovis AF2122/97
gugaaccacucgguga

SEQ ID NO: 1103422 - RNA, 20 nt, Mycobacterium bovis subsp bovis AF2122/97
gugaacgcgcgugcagccau

SEQ ID NO: 1103423 - RNA, 18 nt, Mycobacterium bovis subsp bovis AF2122/97
gugaacgcggacaccgcg

SEQ ID NO: 1103424 - RNA, 19 nt, Mycobacterium bovis subsp bovis AF2122/97
gugaacgcggacaccgcgg

SEQ ID NO: 1103425 - RNA, 20 nt, Mycobacterium bovis subsp bovis AF2122/97
gugaacggcaaggucgcggc

SEQ ID NO: 1103426 - RNA, 12 nt, Mycobacterium bovis subsp bovis AF2122/97
gugaacggugcc

SEQ ID NO: 1103427 - RNA, 22 nt, Mycobacterium bovis subsp bovis AF2122/97
gugaacggcgcgggccaccacg

SEQ ID NO: 1103428 - RNA, 16 nt, Mycobacterium bovis subsp bovis AF2122/97
gugaacggcucgggca

SEQ ID NO: 1103429 - RNA, 22 nt, Mycobacterium bovis subsp bovis AF2122/97
gugaacggcucgggcagcguca

SEQ ID NO: 1103430 - RNA, 14 nt, Mycobacterium bovis subsp bovis AF2122/97
gugaacucacggcg

SEQ ID NO: 1103431 - RNA, 16 nt, Mycobacterium bovis subsp bovis AF2122/97
gugaacucacggcggu

SEQ ID NO: 1103432 - RNA, 12 nt, Mycobacterium bovis subsp bovis AF2122/97
gugagccgggcg

SEQ ID NO: 1103433 - RNA, 15 nt, Mycobacterium bovis subsp bovis AF2122/97
gugagcaccugggcg

SEQ ID NO: 1103434 - RNA, 15 nt, Mycobacterium bovis subsp bovis AF2122/97
gugagcagcaagacc

SEQ ID NO: 1103435 - RNA, 21 nt, Mycobacterium bovis subsp bovis AF2122/97
gugagcagcaagaccgcgcca

SEQ ID NO: 1103436 - RNA, 22 nt, Mycobacterium bovis subsp bovis AF2122/97
gugaacugguugacgucgaugu

SEQ ID NO: 1103437 - RNA, 15 nt, Mycobacterium bovis subsp bovis AF2122/97
gugagcccguugacc

SEQ ID NO: 1103438 - RNA, 18 nt, Mycobacterium bovis subsp bovis AF2122/97
gugagccgugccgccagc

SEQ ID NO: 1103439 - RNA, 14 nt, Mycobacterium bovis subsp bovis AF2122/97
gugagcgagcgcgc

SEQ ID NO: 1103440 - RNA, 15 nt, Mycobacterium bovis subsp bovis AF2122/97
gugagcuacucacgg

SEQ ID NO: 1103441 - RNA, 20 nt, Mycobacterium bovis subsp bovis AF2122/97
gugagcuacucacggugauc

SEQ ID NO: 1103442 - RNA, 14 nt, Mycobacterium bovis subsp bovis AF2122/97
gugagcggcaugcg

SEQ ID NO: 1103443 - RNA, 22 nt, Mycobacterium bovis subsp bovis AF2122/97
gugagcucagcaaguucgucgg

SEQ ID NO: 1103444 - RNA, 20 nt, Mycobacterium bovis subsp bovis AF2122/97
gugauagcgcgugugcgucg

SEQ ID NO: 1103445 - RNA, 17 nt, Mycobacterium bovis subsp bovis AF2122/97
gugauagcuugcgucgc

SEQ ID NO: 1103446 - RNA, 20 nt, Mycobacterium bovis subsp bovis AF2122/97
gugauaucagagggccgcgg

SEQ ID NO: 1103447 - RNA, 16 nt, Mycobacterium bovis subsp bovis AF2122/97
gugauccagccgucgg

SEQ ID NO: 1103448 - RNA, 18 nt, Mycobacterium bovis subsp bovis AF2122/97
gugaucagcgcaucgccg

SEQ ID NO: 1103449 - RNA, 24 nt, Mycobacterium bovis subsp bovis AF2122/97
gugaucacgucggauccgcccgcc

SEQ ID NO: 1103450 - RNA, 16 nt, Mycobacterium bovis subsp bovis AF2122/97
gugaucacgucggcgu

SEQ ID NO: 1103451 - RNA, 16 nt, Mycobacterium bovis subsp bovis AF2122/97
gugaucaccacgaaug

SEQ ID NO: 1103452 - RNA, 19 nt, Mycobacterium bovis subsp bovis AF2122/97
gugaucaccaugaucagcg

SEQ ID NO: 1103453 - RNA, 20 nt, Mycobacterium bovis subsp bovis AF2122/97
gugaucaacuuccgcagcgc

SEQ ID NO: 1103454 - RNA, 19 nt, Mycobacterium bovis subsp bovis AF2122/97
gugauauccuuugccgccg

SEQ ID NO: 1103455 - RNA, 16 nt, Mycobacterium bovis subsp bovis AF2122/97
gugaucaaaccggcgg

SEQ ID NO: 1103456 - RNA, 13 nt, Mycobacterium bovis subsp bovis AF2122/97
gugauccgacagu

SEQ ID NO: 1103457 - RNA, 14 nt, Mycobacterium bovis subsp bovis AF2122/97
gugaucgaggcggc

SEQ ID NO: 1103458 - RNA, 15 nt, Mycobacterium bovis subsp bovis AF2122/97
gugaucgaggcggcg

SEQ ID NO: 1103459 - RNA, 16 nt, Mycobacterium bovis subsp bovis AF2122/97
gugaucgaggcggcgg

SEQ ID NO: 1103460 - RNA, 21 nt, Mycobacterium bovis subsp bovis AF2122/97
gugaucgagguugacgucagg

SEQ ID NO: 1103461 - RNA, 21 nt, Mycobacterium bovis subsp bovis AF2122/97
gugaucgaucgcggcgcccag

SEQ ID NO: 1103462 - RNA, 12 nt, Mycobacterium bovis subsp bovis AF2122/97
gugaucgcacag

SEQ ID NO: 1103463 - RNA, 15 nt, Mycobacterium bovis subsp bovis AF2122/97
gugaucccgcccaag

SEQ ID NO: 1103464 - RNA, 14 nt, Mycobacterium bovis subsp bovis AF2122/97
gugauccacgcucg

SEQ ID NO: 1103465 - RNA, 18 nt, Mycobacterium bovis subsp bovis AF2122/97
gugauccaacuggccgcg

SEQ ID NO: 1103466 - RNA, 22 nt, Mycobacterium bovis subsp bovis AF2122/97
gugauccaacuggccgcgucgc

SEQ ID NO: 1103467 - RNA, 20 nt, Mycobacterium bovis subsp bovis AF2122/97
gugaucgccaccgguaccgg

SEQ ID NO: 1103468 - RNA, 22 nt, Mycobacterium bovis subsp bovis AF2122/97
gugaucgccaccgguaccggcg

SEQ ID NO: 1103469 - RNA, 15 nt, Mycobacterium bovis subsp bovis AF2122/97
gugaucgagucgcga

SEQ ID NO: 1103470 - RNA, 15 nt, Mycobacterium bovis subsp bovis AF2122/97
gugaugaagcgcggu

SEQ ID NO: 1103471 - RNA, 16 nt, Mycobacterium bovis subsp bovis AF2122/97
gugaugacgccgucgg

SEQ ID NO: 1103472 - RNA, 19 nt, Mycobacterium bovis subsp bovis AF2122/97
gugaugacgccgucggcgc

SEQ ID NO: 1103473 - RNA, 12 nt, Mycobacterium bovis subsp bovis AF2122/97
gugaugccacgg

SEQ ID NO: 1103474 - RNA, 16 nt, Mycobacterium bovis subsp bovis AF2122/97
gugaugccaucaacga

SEQ ID NO: 1103475 - RNA, 14 nt, Mycobacterium bovis subsp bovis AF2122/97
gugaugcgggcucg

SEQ ID NO: 1103476 - RNA, 18 nt, Mycobacterium bovis subsp bovis AF2122/97
gugaugcccugggggugg

SEQ ID NO: 1103477 - RNA, 19 nt, Mycobacterium bovis subsp bovis AF2122/97
gugcacaggcaucguccgc

SEQ ID NO: 1103478 - RNA, 19 nt, Mycobacterium bovis subsp bovis AF2122/97
gugcacacucaacccgccg

SEQ ID NO: 1103479 - RNA, 12 nt, Mycobacterium bovis subsp bovis AF2122/97
gugaugcgcccc

SEQ ID NO: 1103480 - RNA, 18 nt, Mycobacterium bovis subsp bovis AF2122/97
gugcggucucacucaucg

SEQ ID NO: 1103481 - RNA, 24 nt, Mycobacterium bovis subsp bovis AF2122/97
gugcggugaccgugaacggcucgg

SEQ ID NO: 1103482 - RNA, 16 nt, Mycobacterium bovis subsp bovis AF2122/97
gugcggugagauggcg

SEQ ID NO: 1103483 - RNA, 16 nt, Mycobacterium bovis subsp bovis AF2122/97
gugcgguucgcugcgg

SEQ ID NO: 1103484 - RNA, 15 nt, Mycobacterium bovis subsp bovis AF2122/97
gugcgguugcgcgga

SEQ ID NO: 1103485 - RNA, 12 nt, Mycobacterium bovis subsp bovis AF2122/97
gugcggucaucg

SEQ ID NO: 1103486 - RNA, 14 nt, Mycobacterium bovis subsp bovis AF2122/97
gugcggugucacaa

SEQ ID NO: 1103487 - RNA, 22 nt, Mycobacterium bovis subsp bovis AF2122/97
gugcgggucguccgccugcacc

SEQ ID NO: 1103488 - RNA, 18 nt, Mycobacterium bovis subsp bovis AF2122/97
gugcggguaauacggcgc

SEQ ID NO: 1103489 - RNA, 19 nt, Mycobacterium bovis subsp bovis AF2122/97
gugcgggugggcacaccgg

SEQ ID NO: 1103490 - RNA, 18 nt, Mycobacterium bovis subsp bovis AF2122/97
gugcggguggugccggcg

SEQ ID NO: 1103491 - RNA, 15 nt, Mycobacterium bovis subsp bovis AF2122/97
gugcgguaucgguca

SEQ ID NO: 1103492 - RNA, 19 nt, Mycobacterium bovis subsp bovis AF2122/97
gugcgguaucggucagcca

SEQ ID NO: 1103493 - RNA, 20 nt, Mycobacterium bovis subsp bovis AF2122/97
gugcgguauuugaacgcccg

SEQ ID NO: 1103494 - RNA, 18 nt, Mycobacterium bovis subsp bovis AF2122/97
gugcggcucgccggcggc

SEQ ID NO: 1103495 - RNA, 16 nt, Mycobacterium bovis subsp bovis AF2122/97
gugcgccgucagccca

SEQ ID NO: 1103496 - RNA, 18 nt, Mycobacterium bovis subsp bovis AF2122/97
gugcgggcaugccggcga

SEQ ID NO: 1103497 - RNA, 19 nt, Mycobacterium bovis subsp bovis AF2122/97
gugcgggcggcgucugcgc

SEQ ID NO: 1103498 - RNA, 15 nt, Mycobacterium bovis subsp bovis AF2122/97
gugcgggcgggcguc

SEQ ID NO: 1103499 - RNA, 16 nt, Mycobacterium bovis subsp bovis AF2122/97
gugcgggcuaggcggc

SEQ ID NO: 1103500 - RNA, 14 nt, Mycobacterium bovis subsp bovis AF2122/97
gugcgggccggucg

SEQ ID NO: 1103501 - RNA, 18 nt, Mycobacterium bovis subsp bovis AF2122/97
gugcgggccggucgugcc

SEQ ID NO: 1103502 - RNA, 22 nt, Mycobacterium bovis subsp bovis AF2122/97
gugcgggaagaacaucaccucg

SEQ ID NO: 1103503 - RNA, 23 nt, Mycobacterium bovis subsp bovis AF2122/97
gugcgggagacguaaccgcuggc

SEQ ID NO: 1103504 - RNA, 12 nt, Mycobacterium bovis subsp bovis AF2122/97
gugcgccgacgg

SEQ ID NO: 1103505 - RNA, 17 nt, Mycobacterium bovis subsp bovis AF2122/97
gugcgccgaucccgccc

SEQ ID NO: 1103506 - RNA, 15 nt, Mycobacterium bovis subsp bovis AF2122/97
gugcgccgcagccug

SEQ ID NO: 1103507 - RNA, 13 nt, Mycobacterium bovis subsp bovis AF2122/97
gugcgcccgacgg

SEQ ID NO: 1103508 - RNA, 14 nt, Mycobacterium bovis subsp bovis AF2122/97
gugcgcccgccggc

SEQ ID NO: 1103509 - RNA, 21 nt, Mycobacterium bovis subsp bovis AF2122/97
gugcucguagacuugcugcuc

SEQ ID NO: 1103510 - RNA, 22 nt, Mycobacterium bovis subsp bovis AF2122/97
gugcucgccguaagcaccagcc

SEQ ID NO: 1103511 - RNA, 13 nt, Mycobacterium bovis subsp bovis AF2122/97
gugcucgccgggu

SEQ ID NO: 1103512 - RNA, 20 nt, Mycobacterium bovis subsp bovis AF2122/97
gugcucgccguaagcaccag

SEQ ID NO: 1103513 - RNA, 19 nt, Mycobacterium bovis subsp bovis AF2122/97
gugcugccaccggccggcg

SEQ ID NO: 1103514 - RNA, 20 nt, Mycobacterium bovis subsp bovis AF2122/97
gugcugccaccggccggcgc

SEQ ID NO: 1103515 - RNA, 15 nt, Mycobacterium bovis subsp bovis AF2122/97
gugcugcccaucccg

SEQ ID NO: 1103516 - RNA, 17 nt, Mycobacterium bovis subsp bovis AF2122/97
gugcugaccgcgccgga

SEQ ID NO: 1103517 - RNA, 22 nt, Mycobacterium bovis subsp bovis AF2122/97
gugcucucguggauggccgcca

SEQ ID NO: 1103518 - RNA, 22 nt, Mycobacterium bovis subsp bovis AF2122/97
gugcucuucggcaccaccgcga

SEQ ID NO: 1103519 - RNA, 23 nt, Mycobacterium bovis subsp bovis AF2122/97
gugcugaugggucaggccgacgu

SEQ ID NO: 1103520 - RNA, 14 nt, Mycobacterium bovis subsp bovis AF2122/97
gugcugcaccgauu

SEQ ID NO: 1103521 - RNA, 15 nt, Mycobacterium bovis subsp bovis AF2122/97
gugcuagcgccgcca

SEQ ID NO: 1103522 - RNA, 17 nt, Mycobacterium bovis subsp bovis AF2122/97
gugcuaugcaacaccgc

SEQ ID NO: 1103523 - RNA, 22 nt, Mycobacterium bovis subsp bovis AF2122/97
gugcuaugcaacaccgcaccgg

SEQ ID NO: 1103524 - RNA, 19 nt, Mycobacterium bovis subsp bovis AF2122/97
gugcuaugcguccaggcga

SEQ ID NO: 1103525 - RNA, 22 nt, Mycobacterium bovis subsp bovis AF2122/97
gugcguacugguccgcacgguu

SEQ ID NO: 1103526 - RNA, 21 nt, Mycobacterium bovis subsp bovis AF2122/97
gugcuacccauucggcggcgg

SEQ ID NO: 1103527 - RNA, 16 nt, Mycobacterium bovis subsp bovis AF2122/97
gugcucaaggcuucgg

SEQ ID NO: 1103528 - RNA, 13 nt, Mycobacterium bovis subsp bovis AF2122/97
gugcucaccggcg

SEQ ID NO: 1103529 - RNA, 21 nt, Mycobacterium bovis subsp bovis AF2122/97
gugcucaccuccacggucggg

SEQ ID NO: 1103530 - RNA, 20 nt, Mycobacterium bovis subsp bovis AF2122/97
gugcucacggcaggcgguga

SEQ ID NO: 1103531 - RNA, 13 nt, Mycobacterium bovis subsp bovis AF2122/97
gugcucacggcgg

SEQ ID NO: 1103532 - RNA, 20 nt, Mycobacterium bovis subsp bovis AF2122/97
gugcucagcgcgcgccgcug

SEQ ID NO: 1103533 - RNA, 12 nt, Mycobacterium bovis subsp bovis AF2122/97
gugcucgccgau

SEQ ID NO: 1103534 - RNA, 20 nt, Mycobacterium bovis subsp bovis AF2122/97
gugcucgaugcgaucgacga

SEQ ID NO: 1103535 - RNA, 22 nt, Mycobacterium bovis subsp bovis AF2122/97
gugcuccugcccgaacuucugg

SEQ ID NO: 1103536 - RNA, 22 nt, Mycobacterium bovis subsp bovis AF2122/97
gugcucgagcaccucggccucg

SEQ ID NO: 1103537 - RNA, 14 nt, Mycobacterium bovis subsp bovis AF2122/97
gugcucgacgaaga

SEQ ID NO: 1103538 - RNA, 13 nt, Mycobacterium bovis subsp bovis AF2122/97
gugcuccagcgac

SEQ ID NO: 1103539 - RNA, 23 nt, Mycobacterium bovis subsp bovis AF2122/97
gugcucaucgacaaucgcacgcu

SEQ ID NO: 1103540 - RNA, 23 nt, Mycobacterium bovis subsp bovis AF2122/97
gugcucccacgugaaggcgaugg

SEQ ID NO: 1103541 - RNA, 13 nt, Mycobacterium bovis subsp bovis AF2122/97
gugccugcgucuc

SEQ ID NO: 1103542 - RNA, 22 nt, Mycobacterium bovis subsp bovis AF2122/97
gugccugccgcacguucggcga

SEQ ID NO: 1103543 - RNA, 17 nt, Mycobacterium bovis subsp bovis AF2122/97
gugccugcaguucggcg

SEQ ID NO: 1103544 - RNA, 19 nt, Mycobacterium bovis subsp bovis AF2122/97
gugccuucaccgaggauca

SEQ ID NO: 1103545 - RNA, 21 nt, Mycobacterium bovis subsp bovis AF2122/97
gugccuugaucugagcgcggg

SEQ ID NO: 1103546 - RNA, 18 nt, Mycobacterium bovis subsp bovis AF2122/97
gugccuuccucggcaagu

SEQ ID NO: 1103547 - RNA, 14 nt, Mycobacterium bovis subsp bovis AF2122/97
gugcgacgcgaccg

SEQ ID NO: 1103548 - RNA, 13 nt, Mycobacterium bovis subsp bovis AF2122/97
gugcgacgacggc

SEQ ID NO: 1103549 - RNA, 20 nt, Mycobacterium bovis subsp bovis AF2122/97
gugcgacgacggcgccgucg

SEQ ID NO: 1103550 - RNA, 19 nt, Mycobacterium bovis subsp bovis AF2122/97
gugcgacucugcgucugcu

SEQ ID NO: 1103551 - RNA, 20 nt, Mycobacterium bovis subsp bovis AF2122/97
gugcgacucugcgucugcuc

SEQ ID NO: 1103552 - RNA, 19 nt, Mycobacterium bovis subsp bovis AF2122/97
gugcgaacaaguggccagc

SEQ ID NO: 1103553 - RNA, 16 nt, Mycobacterium bovis subsp bovis AF2122/97
gugcgaaaaucgcgcg

SEQ ID NO: 1103554 - RNA, 23 nt, Mycobacterium bovis subsp bovis AF2122/97
gugcgccagcgauaucggcggcu

SEQ ID NO: 1103555 - RNA, 20 nt, Mycobacterium bovis subsp bovis AF2122/97
gugcgcccaauccaccgauu

SEQ ID NO: 1103556 - RNA, 18 nt, Mycobacterium bovis subsp bovis AF2122/97
gugcgagggcacggcggu

SEQ ID NO: 1103557 - RNA, 19 nt, Mycobacterium bovis subsp bovis AF2122/97
gugcgcagguacgccucga

SEQ ID NO: 1103558 - RNA, 17 nt, Mycobacterium bovis subsp bovis AF2122/97
gugccgccgucgccgcc

SEQ ID NO: 1103559 - RNA, 18 nt, Mycobacterium bovis subsp bovis AF2122/97
gugccgccgucgccgcca

SEQ ID NO: 1103560 - RNA, 12 nt, Mycobacterium bovis subsp bovis AF2122/97
gugccgccgggu

SEQ ID NO: 1103561 - RNA, 22 nt, Mycobacterium bovis subsp bovis AF2122/97
gugccgccguucccaccaccac

SEQ ID NO: 1103562 - RNA, 18 nt, Mycobacterium bovis subsp bovis AF2122/97
gugccgccugcgccgcca

SEQ ID NO: 1103563 - RNA, 23 nt, Mycobacterium bovis subsp bovis AF2122/97
gugccgcgucaaccgaucggucg

SEQ ID NO: 1103564 - RNA, 19 nt, Mycobacterium bovis subsp bovis AF2122/97
gugccgccugcgccgccag

SEQ ID NO: 1103565 - RNA, 23 nt, Mycobacterium bovis subsp bovis AF2122/97
gugcccgcguugccaaagcccac

SEQ ID NO: 1103566 - RNA, 15 nt, Mycobacterium bovis subsp bovis AF2122/97
gugccgccggcgcca

SEQ ID NO: 1103567 - RNA, 13 nt, Mycobacterium bovis subsp bovis AF2122/97
gugcccggcgcga

SEQ ID NO: 1103568 - RNA, 13 nt, Mycobacterium bovis subsp bovis AF2122/97
gugcccggcgccc

SEQ ID NO: 1103569 - RNA, 15 nt, Mycobacterium bovis subsp bovis AF2122/97
gugccggccagacuc

SEQ ID NO: 1103570 - RNA, 21 nt, Mycobacterium bovis subsp bovis AF2122/97
gugccggccagacucgcgguc

SEQ ID NO: 1103571 - RNA, 22 nt, Mycobacterium bovis subsp bovis AF2122/97
gugccggcagcgguggcaagcc

SEQ ID NO: 1103572 - RNA, 20 nt, Mycobacterium bovis subsp bovis AF2122/97
gugccggacuuggccugcgg

SEQ ID NO: 1103573 - RNA, 16 nt, Mycobacterium bovis subsp bovis AF2122/97
gugccgcggccaccgc

SEQ ID NO: 1103574 - RNA, 16 nt, Mycobacterium bovis subsp bovis AF2122/97
gugccgcuagcggauu

SEQ ID NO: 1103575 - RNA, 15 nt, Mycobacterium bovis subsp bovis AF2122/97
gugccggcgacgcua

SEQ ID NO: 1103576 - RNA, 23 nt, Mycobacterium bovis subsp bovis AF2122/97
gugccggcgacgcuaccgccgga

SEQ ID NO: 1103577 - RNA, 21 nt, Mycobacterium bovis subsp bovis AF2122/97
gugccggcccugcucggccaa

SEQ ID NO: 1103578 - RNA, 19 nt, Mycobacterium bovis subsp bovis AF2122/97
gugccugaguuuaugcccg

SEQ ID NO: 1103579 - RNA, 21 nt, Mycobacterium bovis subsp bovis AF2122/97
gugccucucuccgcgcucguc

SEQ ID NO: 1103580 - RNA, 18 nt, Mycobacterium bovis subsp bovis AF2122/97
gugccguugcgucugcuc

SEQ ID NO: 1103581 - RNA, 19 nt, Mycobacterium bovis subsp bovis AF2122/97
gugccuacaccggcaagcc

SEQ ID NO: 1103582 - RNA, 15 nt, Mycobacterium bovis subsp bovis AF2122/97
gucagcggcucggcg

SEQ ID NO: 1103583 - RNA, 16 nt, Mycobacterium bovis subsp bovis AF2122/97
gucagcggcucggcgg

SEQ ID NO: 1103584 - RNA, 20 nt, Mycobacterium bovis subsp bovis AF2122/97
gucagcgggcagcaggcgau

SEQ ID NO: 1103585 - RNA, 15 nt, Mycobacterium bovis subsp bovis AF2122/97
gucagcggccgcgac

SEQ ID NO: 1103586 - RNA, 18 nt, Mycobacterium bovis subsp bovis AF2122/97
gucagcggccugcucggg

SEQ ID NO: 1103587 - RNA, 17 nt, Mycobacterium bovis subsp bovis AF2122/97
gucagcggcggccacgg

SEQ ID NO: 1103588 - RNA, 19 nt, Mycobacterium bovis subsp bovis AF2122/97
gucagcgggucgaccccgg

SEQ ID NO: 1103589 - RNA, 18 nt, Mycobacterium bovis subsp bovis AF2122/97
gucagcgcugagccgcuc

SEQ ID NO: 1103590 - RNA, 20 nt, Mycobacterium bovis subsp bovis AF2122/97
gucagcggauccaggccucg

SEQ ID NO: 1103591 - RNA, 17 nt, Mycobacterium bovis subsp bovis AF2122/97
gucagcgcgucguccag

SEQ ID NO: 1103592 - RNA, 14 nt, Mycobacterium bovis subsp bovis AF2122/97
gucagcgcggcgcg

SEQ ID NO: 1103593 - RNA, 14 nt, Mycobacterium bovis subsp bovis AF2122/97
gucagcgccgccgg

SEQ ID NO: 1103594 - RNA, 13 nt, Mycobacterium bovis subsp bovis AF2122/97
gucagcgccgaga

SEQ ID NO: 1103595 - RNA, 21 nt, Mycobacterium bovis subsp bovis AF2122/97
gucagcguugaccgcaucguc

SEQ ID NO: 1103596 - RNA, 23 nt, Mycobacterium bovis subsp bovis AF2122/97
gucagcguugaccgcaucgucga

SEQ ID NO: 1103597 - RNA, 21 nt, Mycobacterium bovis subsp bovis AF2122/97
gucagcucgaccugaggcacc

SEQ ID NO: 1103598 - RNA, 21 nt, Mycobacterium bovis subsp bovis AF2122/97
gucagcuaauaccugcggauu

SEQ ID NO: 1103599 - RNA, 16 nt, Mycobacterium bovis subsp bovis AF2122/97
gucagcucaccaccca

SEQ ID NO: 1103600 - RNA, 21 nt, Mycobacterium bovis subsp bovis AF2122/97
gucagcugauuaccgacaccg

SEQ ID NO: 1103601 - RNA, 18 nt, Mycobacterium bovis subsp bovis AF2122/97
gucaggcaguccaccgcg

SEQ ID NO: 1103602 - RNA, 19 nt, Mycobacterium bovis subsp bovis AF2122/97
gucaggcaguccaccgcgc

SEQ ID NO: 1103603 - RNA, 20 nt, Mycobacterium bovis subsp bovis AF2122/97
gucagcugggacccgagcag

SEQ ID NO: 1103604 - RNA, 20 nt, Mycobacterium bovis subsp bovis AF2122/97
gucagcuuggacccugcgcc

SEQ ID NO: 1103605 - RNA, 21 nt, Mycobacterium bovis subsp bovis AF2122/97
gucaggguguugcggcugacc

SEQ ID NO: 1103606 - RNA, 21 nt, Mycobacterium bovis subsp bovis AF2122/97
gucaggcggccgucgucggcc

SEQ ID NO: 1103607 - RNA, 12 nt, Mycobacterium bovis subsp bovis AF2122/97
gucaggcggcgg

SEQ ID NO: 1103608 - RNA, 14 nt, Mycobacterium bovis subsp bovis AF2122/97
gucaggcgggagcg

SEQ ID NO: 1103609 - RNA, 14 nt, Mycobacterium bovis subsp bovis AF2122/97
gucaggcccauggc

SEQ ID NO: 1103610 - RNA, 17 nt, Mycobacterium bovis subsp bovis AF2122/97
gucaggcccauggcagc

SEQ ID NO: 1103611 - RNA, 19 nt, Mycobacterium bovis subsp bovis AF2122/97
gucaggcccauggcagccc

SEQ ID NO: 1103612 - RNA, 18 nt, Mycobacterium bovis subsp bovis AF2122/97
gucaggccagggugacca

SEQ ID NO: 1103613 - RNA, 16 nt, Mycobacterium bovis subsp bovis AF2122/97
gucaggccagagucgc

SEQ ID NO: 1103614 - RNA, 19 nt, Mycobacterium bovis subsp bovis AF2122/97
gucaggccagagucgcccg

SEQ ID NO: 1103615 - RNA, 18 nt, Mycobacterium bovis subsp bovis AF2122/97
gucaggccuagcgcggcg

SEQ ID NO: 1103616 - RNA, 21 nt, Mycobacterium bovis subsp bovis AF2122/97
gucaggccuagcgcggcgacg

SEQ ID NO: 1103617 - RNA, 15 nt, Mycobacterium bovis subsp bovis AF2122/97
gucaggcggccgucg

SEQ ID NO: 1103618 - RNA, 20 nt, Mycobacterium bovis subsp bovis AF2122/97
gucaggcggccgucgucggc

SEQ ID NO: 1103619 - RNA, 20 nt, Mycobacterium bovis subsp bovis AF2122/97
gucaggugauucgcgcagcg

SEQ ID NO: 1103620 - RNA, 15 nt, Mycobacterium bovis subsp bovis AF2122/97
gucaggugcgcgacc

SEQ ID NO: 1103621 - RNA, 16 nt, Mycobacterium bovis subsp bovis AF2122/97
gucaggugcgcgacca

SEQ ID NO: 1103622 - RNA, 17 nt, Mycobacterium bovis subsp bovis AF2122/97
gucagguaauucgucca

SEQ ID NO: 1103623 - RNA, 15 nt, Mycobacterium bovis subsp bovis AF2122/97
gucagguacaucccg

SEQ ID NO: 1103624 - RNA, 17 nt, Mycobacterium bovis subsp bovis AF2122/97
gucagugaucaccaacc

SEQ ID NO: 1103625 - RNA, 15 nt, Mycobacterium bovis subsp bovis AF2122/97
gucaguccgucggcc

SEQ ID NO: 1103626 - RNA, 21 nt, Mycobacterium bovis subsp bovis AF2122/97
gucaguccucaucgagcgcgc

SEQ ID NO: 1103627 - RNA, 14 nt, Mycobacterium bovis subsp bovis AF2122/97
gucaguccucaucg

SEQ ID NO: 1103628 - RNA, 13 nt, Mycobacterium bovis subsp bovis AF2122/97
gucaguaccgcac

SEQ ID NO: 1103629 - RNA, 14 nt, Mycobacterium bovis subsp bovis AF2122/97
gucaguaggcggau

SEQ ID NO: 1103630 - RNA, 19 nt, Mycobacterium bovis subsp bovis AF2122/97
gucaguccgacaccacgga

SEQ ID NO: 1103631 - RNA, 19 nt, Mycobacterium bovis subsp bovis AF2122/97
gucaguccgacaccggcgg

SEQ ID NO: 1103632 - RNA, 19 nt, Mycobacterium bovis subsp bovis AF2122/97
gucaucgccggguagcugu

SEQ ID NO: 1103633 - RNA, 16 nt, Mycobacterium bovis subsp bovis AF2122/97
gucaucgcgggugauc

SEQ ID NO: 1103634 - RNA, 15 nt, Mycobacterium bovis subsp bovis AF2122/97
gucaucgcguaguga

SEQ ID NO: 1103635 - RNA, 14 nt, Mycobacterium bovis subsp bovis AF2122/97
gucaucgacgagcg

SEQ ID NO: 1103636 - RNA, 22 nt, Mycobacterium bovis subsp bovis AF2122/97
gucaucgacuugccgccgcaca

SEQ ID NO: 1103637 - RNA, 13 nt, Mycobacterium bovis subsp bovis AF2122/97
gucauccccgacu

SEQ ID NO: 1103638 - RNA, 16 nt, Mycobacterium bovis subsp bovis AF2122/97
gucauccccggccagc

SEQ ID NO: 1103639 - RNA, 16 nt, Mycobacterium bovis subsp bovis AF2122/97
gucauccggccgucgg

SEQ ID NO: 1103640 - RNA, 15 nt, Mycobacterium bovis subsp bovis AF2122/97
gucaucccgagcucu

SEQ ID NO: 1103641 - RNA, 18 nt, Mycobacterium bovis subsp bovis AF2122/97
gucaucauggccggaucc

SEQ ID NO: 1103642 - RNA, 18 nt, Mycobacterium bovis subsp bovis AF2122/97
gucauccauccgggccgc

SEQ ID NO: 1103643 - RNA, 20 nt, Mycobacterium bovis subsp bovis AF2122/97
gucauccauccgggccgcgg

SEQ ID NO: 1103644 - RNA, 22 nt, Mycobacterium bovis subsp bovis AF2122/97
gucauccauccgggccgcggcc

SEQ ID NO: 1103645 - RNA, 17 nt, Mycobacterium bovis subsp bovis AF2122/97
gucauagcgcaccaccg

SEQ ID NO: 1103646 - RNA, 20 nt, Mycobacterium bovis subsp bovis AF2122/97
gucauauugugggugcgacg

SEQ ID NO: 1103647 - RNA, 15 nt, Mycobacterium bovis subsp bovis AF2122/97
gucaguucccagacc

SEQ ID NO: 1103648 - RNA, 23 nt, Mycobacterium bovis subsp bovis AF2122/97
gucaguucccagaccaccgugac

SEQ ID NO: 1103649 - RNA, 13 nt, Mycobacterium bovis subsp bovis AF2122/97
gucaugcaagcgc

SEQ ID NO: 1103650 - RNA, 18 nt, Mycobacterium bovis subsp bovis AF2122/97
gucaucuggcgcugcugg

SEQ ID NO: 1103651 - RNA, 16 nt, Mycobacterium bovis subsp bovis AF2122/97
gucaucuugccaccgc

SEQ ID NO: 1103652 - RNA, 15 nt, Mycobacterium bovis subsp bovis AF2122/97
gucaugaacgaccgg

SEQ ID NO: 1103653 - RNA, 17 nt, Mycobacterium bovis subsp bovis AF2122/97
gucaugaacgaucggac

SEQ ID NO: 1103654 - RNA, 19 nt, Mycobacterium bovis subsp bovis AF2122/97
gucaugaacgaucggacca

SEQ ID NO: 1103655 - RNA, 16 nt, Mycobacterium bovis subsp bovis AF2122/97
gucaugaagccguugc

SEQ ID NO: 1103656 - RNA, 13 nt, Mycobacterium bovis subsp bovis AF2122/97
gucaucgugcccg

SEQ ID NO: 1103657 - RNA, 16 nt, Mycobacterium bovis subsp bovis AF2122/97
gucaucgccucggcgu

SEQ ID NO: 1103658 - RNA, 20 nt, Mycobacterium bovis subsp bovis AF2122/97
gucaucgguugaccggucga

SEQ ID NO: 1103659 - RNA, 14 nt, Mycobacterium bovis subsp bovis AF2122/97
gucaugcccaccgc

SEQ ID NO: 1103660 - RNA, 21 nt, Mycobacterium bovis subsp bovis AF2122/97
gucauggcgaguacggccugc

SEQ ID NO: 1103661 - RNA, 20 nt, Mycobacterium bovis subsp bovis AF2122/97
gucauggcgaaccgucagcg

SEQ ID NO: 1103662 - RNA, 21 nt, Mycobacterium bovis subsp bovis AF2122/97
gucauggcccgaucgaccgcu

SEQ ID NO: 1103663 - RNA, 17 nt, Mycobacterium bovis subsp bovis AF2122/97
gucauggccggccaucg

SEQ ID NO: 1103664 - RNA, 15 nt, Mycobacterium bovis subsp bovis AF2122/97
gucauggcccgaucg

SEQ ID NO: 1103665 - RNA, 20 nt, Mycobacterium bovis subsp bovis AF2122/97
gucauggcgggugcggcgau

SEQ ID NO: 1103666 - RNA, 15 nt, Mycobacterium bovis subsp bovis AF2122/97
gucaugggcggcuuc

SEQ ID NO: 1103667 - RNA, 20 nt, Mycobacterium bovis subsp bovis AF2122/97
gucauguucggggcgcacca

SEQ ID NO: 1103668 - RNA, 17 nt, Mycobacterium bovis subsp bovis AF2122/97
gucauguccguccgcga

SEQ ID NO: 1103669 - RNA, 14 nt, Mycobacterium bovis subsp bovis AF2122/97
gucaugucgaucag

SEQ ID NO: 1103670 - RNA, 16 nt, Mycobacterium bovis subsp bovis AF2122/97
gucaugucgaucagcg

SEQ ID NO: 1103671 - RNA, 18 nt, Mycobacterium bovis subsp bovis AF2122/97
gucauguccauagccggc

SEQ ID NO: 1103672 - RNA, 16 nt, Mycobacterium bovis subsp bovis AF2122/97
gucauugccggcgacg

SEQ ID NO: 1103673 - RNA, 22 nt, Mycobacterium bovis subsp bovis AF2122/97
guccagcgccgcggcccgcucg

SEQ ID NO: 1103674 - RNA, 16 nt, Mycobacterium bovis subsp bovis AF2122/97
guccagcgcggccuug

SEQ ID NO: 1103675 - RNA, 15 nt, Mycobacterium bovis subsp bovis AF2122/97
guccagcgcgacguc

SEQ ID NO: 1103676 - RNA, 23 nt, Mycobacterium bovis subsp bovis AF2122/97
guccagcgggcauaacccgcacc

SEQ ID NO: 1103677 - RNA, 15 nt, Mycobacterium bovis subsp bovis AF2122/97
guccagcggccgccg

SEQ ID NO: 1103678 - RNA, 18 nt, Mycobacterium bovis subsp bovis AF2122/97
guccagcggccgccgcgg

SEQ ID NO: 1103679 - RNA, 13 nt, Mycobacterium bovis subsp bovis AF2122/97
guccagcgucgcc

SEQ ID NO: 1103680 - RNA, 14 nt, Mycobacterium bovis subsp bovis AF2122/97
guccagcgucgccg

SEQ ID NO: 1103681 - RNA, 17 nt, Mycobacterium bovis subsp bovis AF2122/97
guccagcguccuggcgu

SEQ ID NO: 1103682 - RNA, 16 nt, Mycobacterium bovis subsp bovis AF2122/97
guccaggcgcgcacca

SEQ ID NO: 1103683 - RNA, 20 nt, Mycobacterium bovis subsp bovis AF2122/97
guccaggugcgccguggcau

SEQ ID NO: 1103684 - RNA, 22 nt, Mycobacterium bovis subsp bovis AF2122/97
guccagguucuucuccaccacc

SEQ ID NO: 1103685 - RNA, 21 nt, Mycobacterium bovis subsp bovis AF2122/97
guccaggugcgccguggcauc

SEQ ID NO: 1103686 - RNA, 15 nt, Mycobacterium bovis subsp bovis AF2122/97
guccaucucggacca

SEQ ID NO: 1103687 - RNA, 22 nt, Mycobacterium bovis subsp bovis AF2122/97
guccaggguggucaguccgucg

SEQ ID NO: 1103688 - RNA, 22 nt, Mycobacterium bovis subsp bovis AF2122/97
guccauguggggucagugcggg

SEQ ID NO: 1103689 - RNA, 12 nt, Mycobacterium bovis subsp bovis AF2122/97
gucccaccagcc

SEQ ID NO: 1103690 - RNA, 14 nt, Mycobacterium bovis subsp bovis AF2122/97
gucccaccagccga

SEQ ID NO: 1103691 - RNA, 15 nt, Mycobacterium bovis subsp bovis AF2122/97
gucccacggccggcc

SEQ ID NO: 1103692 - RNA, 23 nt, Mycobacterium bovis subsp bovis AF2122/97
gucccacggcgguugccccgacc

SEQ ID NO: 1103693 - RNA, 15 nt, Mycobacterium bovis subsp bovis AF2122/97
gucccacgugugcgg

SEQ ID NO: 1103694 - RNA, 13 nt, Mycobacterium bovis subsp bovis AF2122/97
gucccaaucggga

SEQ ID NO: 1103695 - RNA, 22 nt, Mycobacterium bovis subsp bovis AF2122/97
gucccaacgccacugcgccgug

SEQ ID NO: 1103696 - RNA, 15 nt, Mycobacterium bovis subsp bovis AF2122/97
gucccaaucgggauc

SEQ ID NO: 1103697 - RNA, 20 nt, Mycobacterium bovis subsp bovis AF2122/97
gucccaaucgucggccagca

SEQ ID NO: 1103698 - RNA, 22 nt, Mycobacterium bovis subsp bovis AF2122/97
gucccaaucgucggccagcaga

SEQ ID NO: 1103699 - RNA, 17 nt, Mycobacterium bovis subsp bovis AF2122/97
guccgaccagcggccga

SEQ ID NO: 1103700 - RNA, 19 nt, Mycobacterium bovis subsp bovis AF2122/97
guccgaccagcggccgacc

SEQ ID NO: 1103701 - RNA, 18 nt, Mycobacterium bovis subsp bovis AF2122/97
guccgacaguccgcgccg

SEQ ID NO: 1103702 - RNA, 21 nt, Mycobacterium bovis subsp bovis AF2122/97
guccgacaccacggaccagcg

SEQ ID NO: 1103703 - RNA, 22 nt, Mycobacterium bovis subsp bovis AF2122/97
guccgacaccacggaccagcgc

SEQ ID NO: 1103704 - RNA, 14 nt, Mycobacterium bovis subsp bovis AF2122/97
guccgacaccggcg

SEQ ID NO: 1103705 - RNA, 23 nt, Mycobacterium bovis subsp bovis AF2122/97
guccgacgguguagccgccggca

SEQ ID NO: 1103706 - RNA, 14 nt, Mycobacterium bovis subsp bovis AF2122/97
guccgaccgguacc

SEQ ID NO: 1103707 - RNA, 19 nt, Mycobacterium bovis subsp bovis AF2122/97
guccgagcuuggccgccgc

SEQ ID NO: 1103708 - RNA, 18 nt, Mycobacterium bovis subsp bovis AF2122/97
gucccggucgccaaaucc

SEQ ID NO: 1103709 - RNA, 20 nt, Mycobacterium bovis subsp bovis AF2122/97
gucccggugggcggcucguc

SEQ ID NO: 1103710 - RNA, 21 nt, Mycobacterium bovis subsp bovis AF2122/97
gucccggugggcggcucgucg

SEQ ID NO: 1103711 - RNA, 22 nt, Mycobacterium bovis subsp bovis AF2122/97
gucccggcggucagcggcucgg

SEQ ID NO: 1103712 - RNA, 13 nt, Mycobacterium bovis subsp bovis AF2122/97
gucccgucacuca

SEQ ID NO: 1103713 - RNA, 14 nt, Mycobacterium bovis subsp bovis AF2122/97
gucccacugcgcgu

SEQ ID NO: 1103714 - RNA, 16 nt, Mycobacterium bovis subsp bovis AF2122/97
gucccagcccggccca

SEQ ID NO: 1103715 - RNA, 20 nt, Mycobacterium bovis subsp bovis AF2122/97
gucccagcgguagccgagcu

SEQ ID NO: 1103716 - RNA, 17 nt, Mycobacterium bovis subsp bovis AF2122/97
gucccagcugaccagcg

SEQ ID NO: 1103717 - RNA, 18 nt, Mycobacterium bovis subsp bovis AF2122/97
gucccagcgccgcacaga

SEQ ID NO: 1103718 - RNA, 20 nt, Mycobacterium bovis subsp bovis AF2122/97
gucccaggacuccggccgca

SEQ ID NO: 1103719 - RNA, 13 nt, Mycobacterium bovis subsp bovis AF2122/97
gucccagggcugc

SEQ ID NO: 1103720 - RNA, 16 nt, Mycobacterium bovis subsp bovis AF2122/97
gucccagggcugccgg

SEQ ID NO: 1103721 - RNA, 19 nt, Mycobacterium bovis subsp bovis AF2122/97
gucccagguuggagcccga

SEQ ID NO: 1103722 - RNA, 16 nt, Mycobacterium bovis subsp bovis AF2122/97
gucccaguacgaucgu

SEQ ID NO: 1103723 - RNA, 14 nt, Mycobacterium bovis subsp bovis AF2122/97
guccccccguugcc

SEQ ID NO: 1103724 - RNA, 16 nt, Mycobacterium bovis subsp bovis AF2122/97
gucccagucccgcguc

SEQ ID NO: 1103725 - RNA, 19 nt, Mycobacterium bovis subsp bovis AF2122/97
gucccagucccgcgucgga

SEQ ID NO: 1103726 - RNA, 17 nt, Mycobacterium bovis subsp bovis AF2122/97
gucccggcgaccggguc

SEQ ID NO: 1103727 - RNA, 19 nt, Mycobacterium bovis subsp bovis AF2122/97
gucccggccgagcguggcc

SEQ ID NO: 1103728 - RNA, 16 nt, Mycobacterium bovis subsp bovis AF2122/97
guccagcagcucggcc

SEQ ID NO: 1103729 - RNA, 19 nt, Mycobacterium bovis subsp bovis AF2122/97
guccagcagcucggccgag

SEQ ID NO: 1103730 - RNA, 12 nt, Mycobacterium bovis subsp bovis AF2122/97
guccagcagcga

SEQ ID NO: 1103731 - RNA, 22 nt, Mycobacterium bovis subsp bovis AF2122/97
guccagcagcgaaaaccgucgc

SEQ ID NO: 1103732 - RNA, 17 nt, Mycobacterium bovis subsp bovis AF2122/97
guccagccaacgggaac

SEQ ID NO: 1103733 - RNA, 14 nt, Mycobacterium bovis subsp bovis AF2122/97
guccagccggcgcg

SEQ ID NO: 1103734 - RNA, 17 nt, Mycobacterium bovis subsp bovis AF2122/97
guccagccgggugccgg

SEQ ID NO: 1103735 - RNA, 19 nt, Mycobacterium bovis subsp bovis AF2122/97
guccagccgggugccggca

SEQ ID NO: 1103736 - RNA, 18 nt, Mycobacterium bovis subsp bovis AF2122/97
guccagccgguccagacc

SEQ ID NO: 1103737 - RNA, 22 nt, Mycobacterium bovis subsp bovis AF2122/97
guccagccaacgggaacaacgg

SEQ ID NO: 1103738 - RNA, 13 nt, Mycobacterium bovis subsp bovis AF2122/97
guccagccaccga

SEQ ID NO: 1103739 - RNA, 15 nt, Mycobacterium bovis subsp bovis AF2122/97
guccagccggugacg

SEQ ID NO: 1103740 - RNA, 18 nt, Mycobacterium bovis subsp bovis AF2122/97
guccagccguggcggcgg

SEQ ID NO: 1103741 - RNA, 19 nt, Mycobacterium bovis subsp bovis AF2122/97
guccagccguggcggcggg

SEQ ID NO: 1103742 - RNA, 20 nt, Mycobacterium bovis subsp bovis AF2122/97
guccagcagcgacgcugccg

SEQ ID NO: 1103743 - RNA, 20 nt, Mycobacterium bovis subsp bovis AF2122/97
guccagccuuuuucggcgag

SEQ ID NO: 1103744 - RNA, 17 nt, Mycobacterium bovis subsp bovis AF2122/97
guccagcgaucccggug

SEQ ID NO: 1103745 - RNA, 18 nt, Mycobacterium bovis subsp bovis AF2122/97
guccagcgaucccgguga

SEQ ID NO: 1103746 - RNA, 19 nt, Mycobacterium bovis subsp bovis AF2122/97
guccagaccguagcggccg

SEQ ID NO: 1103747 - RNA, 15 nt, Mycobacterium bovis subsp bovis AF2122/97
guccagauaucgaag

SEQ ID NO: 1103748 - RNA, 16 nt, Mycobacterium bovis subsp bovis AF2122/97
guccagaaugucgcgg

SEQ ID NO: 1103749 - RNA, 18 nt, Mycobacterium bovis subsp bovis AF2122/97
guccacuucagaucggcg

SEQ ID NO: 1103750 - RNA, 15 nt, Mycobacterium bovis subsp bovis AF2122/97
guccagaacggcgau

SEQ ID NO: 1103751 - RNA, 15 nt, Mycobacterium bovis subsp bovis AF2122/97
guccagaacgguggc

SEQ ID NO: 1103752 - RNA, 20 nt, Mycobacterium bovis subsp bovis AF2122/97
guccagaacgguggcgcggu

SEQ ID NO: 1103753 - RNA, 22 nt, Mycobacterium bovis subsp bovis AF2122/97
guccagaauccagguggucauc

SEQ ID NO: 1103754 - RNA, 13 nt, Mycobacterium bovis subsp bovis AF2122/97
guccagcacaucg

SEQ ID NO: 1103755 - RNA, 18 nt, Mycobacterium bovis subsp bovis AF2122/97
guccagcacaucggcgag

SEQ ID NO: 1103756 - RNA, 22 nt, Mycobacterium bovis subsp bovis AF2122/97
guccacggcguuacguggugga

SEQ ID NO: 1103757 - RNA, 18 nt, Mycobacterium bovis subsp bovis AF2122/97
guccacugccaccgcgag

SEQ ID NO: 1103758 - RNA, 16 nt, Mycobacterium bovis subsp bovis AF2122/97
guccaccgcugccggc

SEQ ID NO: 1103759 - RNA, 13 nt, Mycobacterium bovis subsp bovis AF2122/97
guccaccggaccg

SEQ ID NO: 1103760 - RNA, 19 nt, Mycobacterium bovis subsp bovis AF2122/97
guccaccgaugccacaucg

SEQ ID NO: 1103761 - RNA, 17 nt, Mycobacterium bovis subsp bovis AF2122/97
guccaccaccggcaccc

SEQ ID NO: 1103762 - RNA, 19 nt, Mycobacterium bovis subsp bovis AF2122/97
guccaccaccggcacccgc

SEQ ID NO: 1103763 - RNA, 14 nt, Mycobacterium bovis subsp bovis AF2122/97
guccaccaccuggc

SEQ ID NO: 1103764 - RNA, 21 nt, Mycobacterium bovis subsp bovis AF2122/97
guccacccacgaucagcagcg

SEQ ID NO: 1103765 - RNA, 21 nt, Mycobacterium bovis subsp bovis AF2122/97
guccaccgaccuaccgucgac

SEQ ID NO: 1103766 - RNA, 14 nt, Mycobacterium bovis subsp bovis AF2122/97
guccaccggccagu

SEQ ID NO: 1103767 - RNA, 22 nt, Mycobacterium bovis subsp bovis AF2122/97
guccaccggaccgaccaccgcg

SEQ ID NO: 1103768 - RNA, 20 nt, Mycobacterium bovis subsp bovis AF2122/97
guccaccgucacggucgcgg

SEQ ID NO: 1103769 - RNA, 17 nt, Mycobacterium bovis subsp bovis AF2122/97
guccacgaugacgucga

SEQ ID NO: 1103770 - RNA, 23 nt, Mycobacterium bovis subsp bovis AF2122/97
guccacgcagaggcggcuggcgg

SEQ ID NO: 1103771 - RNA, 15 nt, Mycobacterium bovis subsp bovis AF2122/97
guccaccaccggcac

SEQ ID NO: 1103772 - RNA, 23 nt, Mycobacterium bovis subsp bovis AF2122/97
guccaccacccugcacugcgcgu

SEQ ID NO: 1103773 - RNA, 16 nt, Mycobacterium bovis subsp bovis AF2122/97
guccacaacgcccgca

SEQ ID NO: 1103774 - RNA, 19 nt, Mycobacterium bovis subsp bovis AF2122/97
guccacaccaugguuggcg

SEQ ID NO: 1103775 - RNA, 23 nt, Mycobacterium bovis subsp bovis AF2122/97
guccaacucggcccgggugacgg

SEQ ID NO: 1103776 - RNA, 16 nt, Mycobacterium bovis subsp bovis AF2122/97
guccaauuguucggcc

SEQ ID NO: 1103777 - RNA, 15 nt, Mycobacterium bovis subsp bovis AF2122/97
guccaaucgccgggu

SEQ ID NO: 1103778 - RNA, 13 nt, Mycobacterium bovis subsp bovis AF2122/97
guccaaucuucuc

SEQ ID NO: 1103779 - RNA, 23 nt, Mycobacterium bovis subsp bovis AF2122/97
guccaaucuucucgagccgccgg

SEQ ID NO: 1103780 - RNA, 15 nt, Mycobacterium bovis subsp bovis AF2122/97
guccaaugcaccguu

SEQ ID NO: 1103781 - RNA, 20 nt, Mycobacterium bovis subsp bovis AF2122/97
guccaagacagccugcgcca

SEQ ID NO: 1103782 - RNA, 18 nt, Mycobacterium bovis subsp bovis AF2122/97
guccaagaaccacgacgu

SEQ ID NO: 1103783 - RNA, 18 nt, Mycobacterium bovis subsp bovis AF2122/97
guccaagugggccggcgg

SEQ ID NO: 1103784 - RNA, 21 nt, Mycobacterium bovis subsp bovis AF2122/97
guccaauacucgccaucgcgg

SEQ ID NO: 1103785 - RNA, 19 nt, Mycobacterium bovis subsp bovis AF2122/97
guccaauagcugacaccga

SEQ ID NO: 1103786 - RNA, 16 nt, Mycobacterium bovis subsp bovis AF2122/97
guaucgccggccgcgg

SEQ ID NO: 1103787 - RNA, 22 nt, Mycobacterium bovis subsp bovis AF2122/97
guaucgccaguggugcaccgau

SEQ ID NO: 1103788 - RNA, 15 nt, Mycobacterium bovis subsp bovis AF2122/97
guagguuuucggcgg

SEQ ID NO: 1103789 - RNA, 19 nt, Mycobacterium bovis subsp bovis AF2122/97
guaucgauugaugcguggu

SEQ ID NO: 1103790 - RNA, 13 nt, Mycobacterium bovis subsp bovis AF2122/97
guagguggccggc

SEQ ID NO: 1103791 - RNA, 14 nt, Mycobacterium bovis subsp bovis AF2122/97
guaggugacgaagg

SEQ ID NO: 1103792 - RNA, 21 nt, Mycobacterium bovis subsp bovis AF2122/97
guagggcuguccgaccucgcc

SEQ ID NO: 1103793 - RNA, 23 nt, Mycobacterium bovis subsp bovis AF2122/97
guagggcuguccgaccucgccgc

SEQ ID NO: 1103794 - RNA, 13 nt, Mycobacterium bovis subsp bovis AF2122/97
guaggucagcgcg

SEQ ID NO: 1103795 - RNA, 17 nt, Mycobacterium bovis subsp bovis AF2122/97
guaggucgccgccgcca

SEQ ID NO: 1103796 - RNA, 13 nt, Mycobacterium bovis subsp bovis AF2122/97
guaucggccggca

SEQ ID NO: 1103797 - RNA, 23 nt, Mycobacterium bovis subsp bovis AF2122/97
guaucggugcuggucgccgcggc

SEQ ID NO: 1103798 - RNA, 15 nt, Mycobacterium bovis subsp bovis AF2122/97
guaucggcagauggu

SEQ ID NO: 1103799 - RNA, 13 nt, Mycobacterium bovis subsp bovis AF2122/97
guauguucggcgg

SEQ ID NO: 1103800 - RNA, 16 nt, Mycobacterium bovis subsp bovis AF2122/97
guauguucggcggugu

SEQ ID NO: 1103801 - RNA, 20 nt, Mycobacterium bovis subsp bovis AF2122/97
guauuagggccggcguuggc

SEQ ID NO: 1103802 - RNA, 21 nt, Mycobacterium bovis subsp bovis AF2122/97
gucaacgggaugccggcgaag

SEQ ID NO: 1103803 - RNA, 21 nt, Mycobacterium bovis subsp bovis AF2122/97
gucaacgugaugcguucggcc

SEQ ID NO: 1103804 - RNA, 16 nt, Mycobacterium bovis subsp bovis AF2122/97
gucaacucaccgucgg

SEQ ID NO: 1103805 - RNA, 18 nt, Mycobacterium bovis subsp bovis AF2122/97
gucaacgggaugccggcg

SEQ ID NO: 1103806 - RNA, 19 nt, Mycobacterium bovis subsp bovis AF2122/97
gucaacgggaugccggcga

SEQ ID NO: 1103807 - RNA, 20 nt, Mycobacterium bovis subsp bovis AF2122/97
gucaacgggaugccggcgaa

SEQ ID NO: 1103808 - RNA, 21 nt, Mycobacterium bovis subsp bovis AF2122/97
gucaacggucucaacgcaucg

SEQ ID NO: 1103809 - RNA, 13 nt, Mycobacterium bovis subsp bovis AF2122/97
gucaacggccgac

SEQ ID NO: 1103810 - RNA, 17 nt, Mycobacterium bovis subsp bovis AF2122/97
gucaacgcuucggcacg

SEQ ID NO: 1103811 - RNA, 16 nt, Mycobacterium bovis subsp bovis AF2122/97
gucaacggcacccgaa

SEQ ID NO: 1103812 - RNA, 13 nt, Mycobacterium bovis subsp bovis AF2122/97
gucaacgccgcgg

SEQ ID NO: 1103813 - RNA, 12 nt, Mycobacterium bovis subsp bovis AF2122/97
gucaagccggcg

SEQ ID NO: 1103814 - RNA, 14 nt, Mycobacterium bovis subsp bovis AF2122/97
gucaagccgggcac

SEQ ID NO: 1103815 - RNA, 19 nt, Mycobacterium bovis subsp bovis AF2122/97
gucaagccacacccggcgu

SEQ ID NO: 1103816 - RNA, 18 nt, Mycobacterium bovis subsp bovis AF2122/97
gucaagcacacuggccac

SEQ ID NO: 1103817 - RNA, 22 nt, Mycobacterium bovis subsp bovis AF2122/97
gucaaggugucaacgcgcggcu

SEQ ID NO: 1103818 - RNA, 20 nt, Mycobacterium bovis subsp bovis AF2122/97
gucaaguccuucacugcgac

SEQ ID NO: 1103819 - RNA, 20 nt, Mycobacterium bovis subsp bovis AF2122/97
gucaagucugugcucacggc

SEQ ID NO: 1103820 - RNA, 19 nt, Mycobacterium bovis subsp bovis AF2122/97
gucaaguggcaaccgcacc

SEQ ID NO: 1103821 - RNA, 17 nt, Mycobacterium bovis subsp bovis AF2122/97
gucaaguucgccagcaa

SEQ ID NO: 1103822 - RNA, 22 nt, Mycobacterium bovis subsp bovis AF2122/97
gucaacuccacgcggaccucga

SEQ ID NO: 1103823 - RNA, 18 nt, Mycobacterium bovis subsp bovis AF2122/97
gucaagauugaccgcggc

SEQ ID NO: 1103824 - RNA, 20 nt, Mycobacterium bovis subsp bovis AF2122/97
gucaagauugaccgcggccg

SEQ ID NO: 1103825 - RNA, 22 nt, Mycobacterium bovis subsp bovis AF2122/97
gucaagcaaguccaccggaucg

SEQ ID NO: 1103826 - RNA, 20 nt, Mycobacterium bovis subsp bovis AF2122/97
guauugccaaagcccgacau

SEQ ID NO: 1103827 - RNA, 19 nt, Mycobacterium bovis subsp bovis AF2122/97
guauugauacugcccgcgu

SEQ ID NO: 1103828 - RNA, 14 nt, Mycobacterium bovis subsp bovis AF2122/97
guauugcaccgcca

SEQ ID NO: 1103829 - RNA, 19 nt, Mycobacterium bovis subsp bovis AF2122/97
guauucguggucggccucg

SEQ ID NO: 1103830 - RNA, 22 nt, Mycobacterium bovis subsp bovis AF2122/97
guauucguggucggccucgaga

SEQ ID NO: 1103831 - RNA, 17 nt, Mycobacterium bovis subsp bovis AF2122/97
guauucguuggggcugc

SEQ ID NO: 1103832 - RNA, 13 nt, Mycobacterium bovis subsp bovis AF2122/97
guauucguggucg

SEQ ID NO: 1103833 - RNA, 19 nt, Mycobacterium bovis subsp bovis AF2122/97
guauucgguggagcgcggg

SEQ ID NO: 1103834 - RNA, 17 nt, Mycobacterium bovis subsp bovis AF2122/97
guauucggcaucgccga

SEQ ID NO: 1103835 - RNA, 14 nt, Mycobacterium bovis subsp bovis AF2122/97
guauuuuucgacca

SEQ ID NO: 1103836 - RNA, 12 nt, Mycobacterium bovis subsp bovis AF2122/97
guauuggggugg

SEQ ID NO: 1103837 - RNA, 13 nt, Mycobacterium bovis subsp bovis AF2122/97
guauugggguggc

SEQ ID NO: 1103838 - RNA, 16 nt, Mycobacterium bovis subsp bovis AF2122/97
guauuggacgcugccg

SEQ ID NO: 1103839 - RNA, 15 nt, Mycobacterium bovis subsp bovis AF2122/97
gucagccguacgccg

SEQ ID NO: 1103840 - RNA, 15 nt, Mycobacterium bovis subsp bovis AF2122/97
gucagccgcggggcg

SEQ ID NO: 1103841 - RNA, 15 nt, Mycobacterium bovis subsp bovis AF2122/97
gucagccgcggcggc

SEQ ID NO: 1103842 - RNA, 13 nt, Mycobacterium bovis subsp bovis AF2122/97
gucagccgcggcg

SEQ ID NO: 1103843 - RNA, 23 nt, Mycobacterium bovis subsp bovis AF2122/97
gucagccgcgcgggucacgaccu

SEQ ID NO: 1103844 - RNA, 15 nt, Mycobacterium bovis subsp bovis AF2122/97
gucagccguucggcu

SEQ ID NO: 1103845 - RNA, 23 nt, Mycobacterium bovis subsp bovis AF2122/97
gucagcaguucggcgaugcgcgg

SEQ ID NO: 1103846 - RNA, 18 nt, Mycobacterium bovis subsp bovis AF2122/97
gucagcaugggguagauc

SEQ ID NO: 1103847 - RNA, 17 nt, Mycobacterium bovis subsp bovis AF2122/97
gucagccaccggugagc

SEQ ID NO: 1103848 - RNA, 19 nt, Mycobacterium bovis subsp bovis AF2122/97
gucagccaggugcccaagc

SEQ ID NO: 1103849 - RNA, 13 nt, Mycobacterium bovis subsp bovis AF2122/97
gucagcccggcgc

SEQ ID NO: 1103850 - RNA, 19 nt, Mycobacterium bovis subsp bovis AF2122/97
gucagccgaccgaccuggu

SEQ ID NO: 1103851 - RNA, 12 nt, Mycobacterium bovis subsp bovis AF2122/97
gucagccgcacc

SEQ ID NO: 1103852 - RNA, 19 nt, Mycobacterium bovis subsp bovis AF2122/97
gucagcagaugggcgucgg

SEQ ID NO: 1103853 - RNA, 15 nt, Mycobacterium bovis subsp bovis AF2122/97
gucagcacgcugacc

SEQ ID NO: 1103854 - RNA, 23 nt, Mycobacterium bovis subsp bovis AF2122/97
gucagaacaccggccaggccggc

SEQ ID NO: 1103855 - RNA, 19 nt, Mycobacterium bovis subsp bovis AF2122/97
gucagaaaaagccgcguag

SEQ ID NO: 1103856 - RNA, 19 nt, Mycobacterium bovis subsp bovis AF2122/97
gucagaaggaucagcgcac

SEQ ID NO: 1103857 - RNA, 20 nt, Mycobacterium bovis subsp bovis AF2122/97
gucagaauugugugcagcag

SEQ ID NO: 1103858 - RNA, 15 nt, Mycobacterium bovis subsp bovis AF2122/97
gucagaacggcggca

SEQ ID NO: 1103859 - RNA, 18 nt, Mycobacterium bovis subsp bovis AF2122/97
gucagaacggcggcagcg

SEQ ID NO: 1103860 - RNA, 19 nt, Mycobacterium bovis subsp bovis AF2122/97
gucagaacggcggcagcgg

SEQ ID NO: 1103861 - RNA, 21 nt, Mycobacterium bovis subsp bovis AF2122/97
gucagaacggcggcagcggcg

SEQ ID NO: 1103862 - RNA, 22 nt, Mycobacterium bovis subsp bovis AF2122/97
gucacguucaguuccgcggcga

SEQ ID NO: 1103863 - RNA, 12 nt, Mycobacterium bovis subsp bovis AF2122/97
gucacuccggcg

SEQ ID NO: 1103864 - RNA, 21 nt, Mycobacterium bovis subsp bovis AF2122/97
gucacucgcaagaaccggcau

SEQ ID NO: 1103865 - RNA, 20 nt, Mycobacterium bovis subsp bovis AF2122/97
gucaccguguugcacgcggg

SEQ ID NO: 1103866 - RNA, 16 nt, Mycobacterium bovis subsp bovis AF2122/97
gucaccguuggccgcg

SEQ ID NO: 1103867 - RNA, 23 nt, Mycobacterium bovis subsp bovis AF2122/97
gucacccaucaacgccggcgacg

SEQ ID NO: 1103868 - RNA, 13 nt, Mycobacterium bovis subsp bovis AF2122/97
gucacccccggcc

SEQ ID NO: 1103869 - RNA, 14 nt, Mycobacterium bovis subsp bovis AF2122/97
gucaccccggcucg

SEQ ID NO: 1103870 - RNA, 16 nt, Mycobacterium bovis subsp bovis AF2122/97
gucaccugcgggccca

SEQ ID NO: 1103871 - RNA, 14 nt, Mycobacterium bovis subsp bovis AF2122/97
gucaccccgcccag

SEQ ID NO: 1103872 - RNA, 14 nt, Mycobacterium bovis subsp bovis AF2122/97
gucaccucgucgcc

SEQ ID NO: 1103873 - RNA, 14 nt, Mycobacterium bovis subsp bovis AF2122/97
gucacgacguccga

SEQ ID NO: 1103874 - RNA, 16 nt, Mycobacterium bovis subsp bovis AF2122/97
gucacgaucacgaugu

SEQ ID NO: 1103875 - RNA, 15 nt, Mycobacterium bovis subsp bovis AF2122/97
gucacgacguccgau

SEQ ID NO: 1103876 - RNA, 14 nt, Mycobacterium bovis subsp bovis AF2122/97
gucaaugacaccgg

SEQ ID NO: 1103877 - RNA, 18 nt, Mycobacterium bovis subsp bovis AF2122/97
gucaaugcuggcagcggc

SEQ ID NO: 1103878 - RNA, 13 nt, Mycobacterium bovis subsp bovis AF2122/97
gucaauucggugc

SEQ ID NO: 1103879 - RNA, 20 nt, Mycobacterium bovis subsp bovis AF2122/97
gucaauucggugcgcuggcg

SEQ ID NO: 1103880 - RNA, 18 nt, Mycobacterium bovis subsp bovis AF2122/97
gucacaaaaccugggaug

SEQ ID NO: 1103881 - RNA, 14 nt, Mycobacterium bovis subsp bovis AF2122/97
gucacaaacccagc

SEQ ID NO: 1103882 - RNA, 16 nt, Mycobacterium bovis subsp bovis AF2122/97
gucacaaacccagcau

SEQ ID NO: 1103883 - RNA, 17 nt, Mycobacterium bovis subsp bovis AF2122/97
gucaccaggcugcaguc

SEQ ID NO: 1103884 - RNA, 20 nt, Mycobacterium bovis subsp bovis AF2122/97
gucaccauggcgccgcgccg

SEQ ID NO: 1103885 - RNA, 22 nt, Mycobacterium bovis subsp bovis AF2122/97
gucaccauggcgccgcgccgau

SEQ ID NO: 1103886 - RNA, 20 nt, Mycobacterium bovis subsp bovis AF2122/97
gucacccaauggagccgcga

SEQ ID NO: 1103887 - RNA, 23 nt, Mycobacterium bovis subsp bovis AF2122/97
gucacccaauucacgacgccgag

SEQ ID NO: 1103888 - RNA, 18 nt, Mycobacterium bovis subsp bovis AF2122/97
gucacaacgcgugaccag

SEQ ID NO: 1103889 - RNA, 16 nt, Mycobacterium bovis subsp bovis AF2122/97
gucacaagucgacacg

SEQ ID NO: 1103890 - RNA, 19 nt, Mycobacterium bovis subsp bovis AF2122/97
gucaccagcgcaucggcca

SEQ ID NO: 1103891 - RNA, 13 nt, Mycobacterium bovis subsp bovis AF2122/97
gucaccaggccga

SEQ ID NO: 1103892 - RNA, 15 nt, Mycobacterium bovis subsp bovis AF2122/97
guaggcggaucuugg

SEQ ID NO: 1103893 - RNA, 14 nt, Mycobacterium bovis subsp bovis AF2122/97
guaggcggcgaccc

SEQ ID NO: 1103894 - RNA, 20 nt, Mycobacterium bovis subsp bovis AF2122/97
guagggcaucgucgccgagc

SEQ ID NO: 1103895 - RNA, 22 nt, Mycobacterium bovis subsp bovis AF2122/97
guagggcaucgucgccgagcgg

SEQ ID NO: 1103896 - RNA, 20 nt, Mycobacterium bovis subsp bovis AF2122/97
guaggcgccgcgacaaaucg

SEQ ID NO: 1103897 - RNA, 17 nt, Mycobacterium bovis subsp bovis AF2122/97
guaggcgguguccagaa

SEQ ID NO: 1103898 - RNA, 17 nt, Mycobacterium bovis subsp bovis AF2122/97
guaggcuuccagcucgu

SEQ ID NO: 1103899 - RNA, 20 nt, Mycobacterium bovis subsp bovis AF2122/97
guaggcuuccagcucgucgu

SEQ ID NO: 1103900 - RNA, 12 nt, Mycobacterium bovis subsp bovis AF2122/97
guaggccggugc

SEQ ID NO: 1103901 - RNA, 16 nt, Mycobacterium bovis subsp bovis AF2122/97
guaggccucggcagca

SEQ ID NO: 1103902 - RNA, 15 nt, Mycobacterium bovis subsp bovis AF2122/97
guaggcaggccggcu

SEQ ID NO: 1103903 - RNA, 19 nt, Mycobacterium bovis subsp bovis AF2122/97
guaggccugcccccggcgc

SEQ ID NO: 1103904 - RNA, 21 nt, Mycobacterium bovis subsp bovis AF2122/97
guaggccugcccccggcgcgg

SEQ ID NO: 1103905 - RNA, 14 nt, Mycobacterium bovis subsp bovis AF2122/97
guaggcgaccgcca

SEQ ID NO: 1103906 - RNA, 17 nt, Mycobacterium bovis subsp bovis AF2122/97
guaggcgauaucgcccg

SEQ ID NO: 1103907 - RNA, 18 nt, Mycobacterium bovis subsp bovis AF2122/97
guaggcgaucucacgcau

SEQ ID NO: 1103908 - RNA, 14 nt, Mycobacterium bovis subsp bovis AF2122/97
guagccgacgacac

SEQ ID NO: 1103909 - RNA, 17 nt, Mycobacterium bovis subsp bovis AF2122/97
guagccgacuaucggcc

SEQ ID NO: 1103910 - RNA, 21 nt, Mycobacterium bovis subsp bovis AF2122/97
guagccgacuaucggccgccg

SEQ ID NO: 1103911 - RNA, 13 nt, Mycobacterium bovis subsp bovis AF2122/97
guagccgagcucg

SEQ ID NO: 1103912 - RNA, 14 nt, Mycobacterium bovis subsp bovis AF2122/97
guagccgagcucgu

SEQ ID NO: 1103913 - RNA, 17 nt, Mycobacterium bovis subsp bovis AF2122/97
guagccgccgucgccgg

SEQ ID NO: 1103914 - RNA, 22 nt, Mycobacterium bovis subsp bovis AF2122/97
guagcccgcgaucucggagcgc

SEQ ID NO: 1103915 - RNA, 17 nt, Mycobacterium bovis subsp bovis AF2122/97
guagauguugccgcccg

SEQ ID NO: 1103916 - RNA, 18 nt, Mycobacterium bovis subsp bovis AF2122/97
guagaucugggcuggcag

SEQ ID NO: 1103917 - RNA, 18 nt, Mycobacterium bovis subsp bovis AF2122/97
guagaucgccucgacgcg

SEQ ID NO: 1103918 - RNA, 14 nt, Mycobacterium bovis subsp bovis AF2122/97
guagaucggaucga

SEQ ID NO: 1103919 - RNA, 15 nt, Mycobacterium bovis subsp bovis AF2122/97
guagaucaucagcga

SEQ ID NO: 1103920 - RNA, 21 nt, Mycobacterium bovis subsp bovis AF2122/97
guagcgguuagaucacccgca

SEQ ID NO: 1103921 - RNA, 20 nt, Mycobacterium bovis subsp bovis AF2122/97
guagcgucgaucacgucguc

SEQ ID NO: 1103922 - RNA, 13 nt, Mycobacterium bovis subsp bovis AF2122/97
guagcgucgcacc

SEQ ID NO: 1103923 - RNA, 14 nt, Mycobacterium bovis subsp bovis AF2122/97
guagccgccggcag

SEQ ID NO: 1103924 - RNA, 23 nt, Mycobacterium bovis subsp bovis AF2122/97
guagcuaaugcacgcccaggcga

SEQ ID NO: 1103925 - RNA, 14 nt, Mycobacterium bovis subsp bovis AF2122/97
guagcggucgauga

SEQ ID NO: 1103926 - RNA, 12 nt, Mycobacterium bovis subsp bovis AF2122/97
guagcgugcgac

SEQ ID NO: 1103927 - RNA, 14 nt, Mycobacterium bovis subsp bovis AF2122/97
guagcugaccaucg

SEQ ID NO: 1103928 - RNA, 12 nt, Mycobacterium bovis subsp bovis AF2122/97
guaggcaccgau

SEQ ID NO: 1103929 - RNA, 13 nt, Mycobacterium bovis subsp bovis AF2122/97
guaggcaccccgg

SEQ ID NO: 1103930 - RNA, 22 nt, Mycobacterium bovis subsp bovis AF2122/97
guagcucccugggcgucgacca

SEQ ID NO: 1103931 - RNA, 19 nt, Mycobacterium bovis subsp bovis AF2122/97
guagaccacgccggugacg

SEQ ID NO: 1103932 - RNA, 15 nt, Mycobacterium bovis subsp bovis AF2122/97
guacugucgucgccc

SEQ ID NO: 1103933 - RNA, 16 nt, Mycobacterium bovis subsp bovis AF2122/97
guagaccagcaggccc

SEQ ID NO: 1103934 - RNA, 14 nt, Mycobacterium bovis subsp bovis AF2122/97
guagaccaggccca

SEQ ID NO: 1103935 - RNA, 20 nt, Mycobacterium bovis subsp bovis AF2122/97
guacgggcaggccgcugggc

SEQ ID NO: 1103936 - RNA, 19 nt, Mycobacterium bovis subsp bovis AF2122/97
guacuggcguugccaccgg

SEQ ID NO: 1103937 - RNA, 17 nt, Mycobacterium bovis subsp bovis AF2122/97
guacucggcggccacca

SEQ ID NO: 1103938 - RNA, 15 nt, Mycobacterium bovis subsp bovis AF2122/97
guacgguacggaccg

SEQ ID NO: 1103939 - RNA, 17 nt, Mycobacterium bovis subsp bovis AF2122/97
guacggucucacggcgc

SEQ ID NO: 1103940 - RNA, 23 nt, Mycobacterium bovis subsp bovis AF2122/97
guacggugguaagacgccgaacg

SEQ ID NO: 1103941 - RNA, 16 nt, Mycobacterium bovis subsp bovis AF2122/97
guagacgacgucggcc

SEQ ID NO: 1103942 - RNA, 20 nt, Mycobacterium bovis subsp bovis AF2122/97
guagaccuggccgucgcugg

SEQ ID NO: 1103943 - RNA, 19 nt, Mycobacterium bovis subsp bovis AF2122/97
guagacccacagucgccgg

SEQ ID NO: 1103944 - RNA, 18 nt, Mycobacterium bovis subsp bovis AF2122/97
guagaccccaaucgaccg

SEQ ID NO: 1103945 - RNA, 15 nt, Mycobacterium bovis subsp bovis AF2122/97
guagacuugcugcuc

SEQ ID NO: 1103946 - RNA, 18 nt, Mycobacterium bovis subsp bovis AF2122/97
guagacgguuaccgcgaa

SEQ ID NO: 1103947 - RNA, 18 nt, Mycobacterium bovis subsp bovis AF2122/97
guagacguccgcggucgc

SEQ ID NO: 1103948 - RNA, 14 nt, Mycobacterium bovis subsp bovis AF2122/97
guagacgucgaccg

SEQ ID NO: 1103949 - RNA, 14 nt, Mycobacterium bovis subsp bovis AF2122/97
guagacgugcguca

SEQ ID NO: 1103950 - RNA, 14 nt, Mycobacterium bovis subsp bovis AF2122/97
guagacggcacccc

SEQ ID NO: 1103951 - RNA, 22 nt, Mycobacterium bovis subsp bovis AF2122/97
guagacggcacugugcguccgc

SEQ ID NO: 1103952 - RNA, 17 nt, Mycobacterium bovis subsp bovis AF2122/97
guagacgguccggucgc

SEQ ID NO: 1103953 - RNA, 12 nt, Mycobacterium bovis subsp bovis AF2122/97
guagacgguccg

SEQ ID NO: 1103954 - RNA, 21 nt, Mycobacterium bovis subsp bovis AF2122/97
guaaucgagcgcggcaaccgu

SEQ ID NO: 1103955 - RNA, 15 nt, Mycobacterium bovis subsp bovis AF2122/97
guacggggucgccgg

SEQ ID NO: 1103956 - RNA, 20 nt, Mycobacterium bovis subsp bovis AF2122/97
guacggggucgccggcaccg

SEQ ID NO: 1103957 - RNA, 14 nt, Mycobacterium bovis subsp bovis AF2122/97
guacgggucgccgg

SEQ ID NO: 1103958 - RNA, 17 nt, Mycobacterium bovis subsp bovis AF2122/97
guacggcguacgccgga

SEQ ID NO: 1103959 - RNA, 18 nt, Mycobacterium bovis subsp bovis AF2122/97
guacgggagccggcuguu

SEQ ID NO: 1103960 - RNA, 21 nt, Mycobacterium bovis subsp bovis AF2122/97
guacggaucaggcccgggcgg

SEQ ID NO: 1103961 - RNA, 20 nt, Mycobacterium bovis subsp bovis AF2122/97
guaaucaauaaucacaucgg

SEQ ID NO: 1103962 - RNA, 21 nt, Mycobacterium bovis subsp bovis AF2122/97
guaaucaccgaauaccgccgc

SEQ ID NO: 1103963 - RNA, 15 nt, Mycobacterium bovis subsp bovis AF2122/97
guaaguuuucggccg

SEQ ID NO: 1103964 - RNA, 14 nt, Mycobacterium bovis subsp bovis AF2122/97
guaagcgaccgacg

SEQ ID NO: 1103965 - RNA, 16 nt, Mycobacterium bovis subsp bovis AF2122/97
guaagcgagucgacga

SEQ ID NO: 1103966 - RNA, 21 nt, Mycobacterium bovis subsp bovis AF2122/97
guaagcgauucccaaccggug

SEQ ID NO: 1103967 - RNA, 21 nt, Mycobacterium bovis subsp bovis AF2122/97
guaagcgccaaggcgaugguc

SEQ ID NO: 1103968 - RNA, 17 nt, Mycobacterium bovis subsp bovis AF2122/97
gguccggcccaccagcg

SEQ ID NO: 1103969 - RNA, 19 nt, Mycobacterium bovis subsp bovis AF2122/97
ggucccgccgaccgacacc

SEQ ID NO: 1103970 - RNA, 17 nt, Mycobacterium bovis subsp bovis AF2122/97
gguccggauggccccgc

SEQ ID NO: 1103971 - RNA, 23 nt, Mycobacterium bovis subsp bovis AF2122/97
ggucccggacgugccgggucacc

SEQ ID NO: 1103972 - RNA, 19 nt, Mycobacterium bovis subsp bovis AF2122/97
gguccgcugccaucggcac

SEQ ID NO: 1103973 - RNA, 21 nt, Mycobacterium bovis subsp bovis AF2122/97
gguccggaaauuccggcgcgg

SEQ ID NO: 1103974 - RNA, 22 nt, Mycobacterium bovis subsp bovis AF2122/97
gguccggaaauuccggcgcggc

SEQ ID NO: 1103975 - RNA, 14 nt, Mycobacterium bovis subsp bovis AF2122/97
gguccggcggccgc

SEQ ID NO: 1103976 - RNA, 22 nt, Mycobacterium bovis subsp bovis AF2122/97
gguccggcgaaaagacugcgcc

SEQ ID NO: 1103977 - RNA, 13 nt, Mycobacterium bovis subsp bovis AF2122/97
gguccggggcaac

SEQ ID NO: 1103978 - RNA, 17 nt, Mycobacterium bovis subsp bovis AF2122/97
gguccgugccgaugccg

SEQ ID NO: 1103979 - RNA, 12 nt, Mycobacterium bovis subsp bovis AF2122/97
ggucgacagcgc

SEQ ID NO: 1103980 - RNA, 14 nt, Mycobacterium bovis subsp bovis AF2122/97
ggucgacagcgcag

SEQ ID NO: 1103981 - RNA, 17 nt, Mycobacterium bovis subsp bovis AF2122/97
gguccgucgagucgccg

SEQ ID NO: 1103982 - RNA, 19 nt, Mycobacterium bovis subsp bovis AF2122/97
gguccgucgagucgccgag

SEQ ID NO: 1103983 - RNA, 16 nt, Mycobacterium bovis subsp bovis AF2122/97
gguccguucgaugcca

SEQ ID NO: 1103984 - RNA, 19 nt, Mycobacterium bovis subsp bovis AF2122/97
ggucgacaggugccagacc

SEQ ID NO: 1103985 - RNA, 18 nt, Mycobacterium bovis subsp bovis AF2122/97
ggucgacauaggccaccu

SEQ ID NO: 1103986 - RNA, 15 nt, Mycobacterium bovis subsp bovis AF2122/97
ggucgaccaucgguu

SEQ ID NO: 1103987 - RNA, 13 nt, Mycobacterium bovis subsp bovis AF2122/97
ggucgaccaucgg

SEQ ID NO: 1103988 - RNA, 13 nt, Mycobacterium bovis subsp bovis AF2122/97
ggucgaccacccg

SEQ ID NO: 1103989 - RNA, 18 nt, Mycobacterium bovis subsp bovis AF2122/97
ggucgaccacccgcaggg

SEQ ID NO: 1103990 - RNA, 14 nt, Mycobacterium bovis subsp bovis AF2122/97
ggucgacccggcca

SEQ ID NO: 1103991 - RNA, 13 nt, Mycobacterium bovis subsp bovis AF2122/97
ggucgaccgugcg

SEQ ID NO: 1103992 - RNA, 14 nt, Mycobacterium bovis subsp bovis AF2122/97
ggucgacgccgacc

SEQ ID NO: 1103993 - RNA, 18 nt, Mycobacterium bovis subsp bovis AF2122/97
ggucgacgccgaccaccc

SEQ ID NO: 1103994 - RNA, 22 nt, Mycobacterium bovis subsp bovis AF2122/97
ggucgacgccgaccacccggau

SEQ ID NO: 1103995 - RNA, 18 nt, Mycobacterium bovis subsp bovis AF2122/97
ggucgacgaugacggugg

SEQ ID NO: 1103996 - RNA, 23 nt, Mycobacterium bovis subsp bovis AF2122/97
ggucgacggaaucgucggcgcgg

SEQ ID NO: 1103997 - RNA, 17 nt, Mycobacterium bovis subsp bovis AF2122/97
ggucgacugggacgacg

SEQ ID NO: 1103998 - RNA, 14 nt, Mycobacterium bovis subsp bovis AF2122/97
ggucgacgugaucg

SEQ ID NO: 1103999 - RNA, 15 nt, Mycobacterium bovis subsp bovis AF2122/97
ggucgacguguugga

SEQ ID NO: 1104000 - RNA, 20 nt, Mycobacterium bovis subsp bovis AF2122/97
ggucgacuccagcaccagca

SEQ ID NO: 1104001 - RNA, 14 nt, Mycobacterium bovis subsp bovis AF2122/97
ggucgacggguucu

SEQ ID NO: 1104002 - RNA, 23 nt, Mycobacterium bovis subsp bovis AF2122/97
ggucgacuccagcaccagcacgg

SEQ ID NO: 1104003 - RNA, 18 nt, Mycobacterium bovis subsp bovis AF2122/97
ggucgacgaacaccccgg

SEQ ID NO: 1104004 - RNA, 15 nt, Mycobacterium bovis subsp bovis AF2122/97
ggucgacgggcucgu

SEQ ID NO: 1104005 - RNA, 18 nt, Mycobacterium bovis subsp bovis AF2122/97
ggucgacggggcggucgg

SEQ ID NO: 1104006 - RNA, 20 nt, Mycobacterium bovis subsp bovis AF2122/97
ggucgacgggucggcgccga

SEQ ID NO: 1104007 - RNA, 14 nt, Mycobacterium bovis subsp bovis AF2122/97
ggucgccgaugacg

SEQ ID NO: 1104008 - RNA, 13 nt, Mycobacterium bovis subsp bovis AF2122/97
ggucgccgccuuc

SEQ ID NO: 1104009 - RNA, 22 nt, Mycobacterium bovis subsp bovis AF2122/97
ggucgccgccuuccuggcgggc

SEQ ID NO: 1104010 - RNA, 19 nt, Mycobacterium bovis subsp bovis AF2122/97
ggucgcgcccucagccgcg

SEQ ID NO: 1104011 - RNA, 22 nt, Mycobacterium bovis subsp bovis AF2122/97
ggucgcgcauuucguggcgcgc

SEQ ID NO: 1104012 - RNA, 14 nt, Mycobacterium bovis subsp bovis AF2122/97
ggucgcccgcuacc

SEQ ID NO: 1104013 - RNA, 21 nt, Mycobacterium bovis subsp bovis AF2122/97
ggucgcccgugucguaccagc

SEQ ID NO: 1104014 - RNA, 11 nt, Mycobacterium bovis subsp bovis AF2122/97
ggucgccgaga

SEQ ID NO: 1104015 - RNA, 20 nt, Mycobacterium bovis subsp bovis AF2122/97
ggucgcccaacaccgcgccg

SEQ ID NO: 1104016 - RNA, 15 nt, Mycobacterium bovis subsp bovis AF2122/97
ggucgccgacggcga

SEQ ID NO: 1104017 - RNA, 13 nt, Mycobacterium bovis subsp bovis AF2122/97
ggucgccgacggc

SEQ ID NO: 1104018 - RNA, 17 nt, Mycobacterium bovis subsp bovis AF2122/97
ggucgccgaccacucga

SEQ ID NO: 1104019 - RNA, 15 nt, Mycobacterium bovis subsp bovis AF2122/97
ggucgagcaccggcu

SEQ ID NO: 1104020 - RNA, 17 nt, Mycobacterium bovis subsp bovis AF2122/97
ggucgaucauggcggca

SEQ ID NO: 1104021 - RNA, 19 nt, Mycobacterium bovis subsp bovis AF2122/97
ggucgacgaacaccccggg

SEQ ID NO: 1104022 - RNA, 13 nt, Mycobacterium bovis subsp bovis AF2122/97
ggucgaucugcgc

SEQ ID NO: 1104023 - RNA, 12 nt, Mycobacterium bovis subsp bovis AF2122/97
ggucgaucaguu

SEQ ID NO: 1104024 - RNA, 17 nt, Mycobacterium bovis subsp bovis AF2122/97
ggucgccccgaugaccg

SEQ ID NO: 1104025 - RNA, 19 nt, Mycobacterium bovis subsp bovis AF2122/97
ggucgauguccgcagcacc

SEQ ID NO: 1104026 - RNA, 18 nt, Mycobacterium bovis subsp bovis AF2122/97
ggucgcaauauccggccg

SEQ ID NO: 1104027 - RNA, 17 nt, Mycobacterium bovis subsp bovis AF2122/97
ggucgaugucggggccg

SEQ ID NO: 1104028 - RNA, 15 nt, Mycobacterium bovis subsp bovis AF2122/97
ggucgaugucgucga

SEQ ID NO: 1104029 - RNA, 15 nt, Mycobacterium bovis subsp bovis AF2122/97
ggucgauuucggcgc

SEQ ID NO: 1104030 - RNA, 16 nt, Mycobacterium bovis subsp bovis AF2122/97
ggucgcaaccgccgcc

SEQ ID NO: 1104031 - RNA, 20 nt, Mycobacterium bovis subsp bovis AF2122/97
ggucgaugcgggcgacgaag

SEQ ID NO: 1104032 - RNA, 14 nt, Mycobacterium bovis subsp bovis AF2122/97
ggucgaugccgaug

SEQ ID NO: 1104033 - RNA, 22 nt, Mycobacterium bovis subsp bovis AF2122/97
gggugaaacgauggcgaugagg

SEQ ID NO: 1104034 - RNA, 13 nt, Mycobacterium bovis subsp bovis AF2122/97
gggugaaccaauu

SEQ ID NO: 1104035 - RNA, 19 nt, Mycobacterium bovis subsp bovis AF2122/97
gggucuucuaccccgguga

SEQ ID NO: 1104036 - RNA, 14 nt, Mycobacterium bovis subsp bovis AF2122/97
gggucuuggcgauc

SEQ ID NO: 1104037 - RNA, 14 nt, Mycobacterium bovis subsp bovis AF2122/97
gggugaacgcggac

SEQ ID NO: 1104038 - RNA, 15 nt, Mycobacterium bovis subsp bovis AF2122/97
gggugaccaacaccc

SEQ ID NO: 1104039 - RNA, 12 nt, Mycobacterium bovis subsp bovis AF2122/97
gggugacccgcu

SEQ ID NO: 1104040 - RNA, 18 nt, Mycobacterium bovis subsp bovis AF2122/97
gggugaccaggccgagcu

SEQ ID NO: 1104041 - RNA, 22 nt, Mycobacterium bovis subsp bovis AF2122/97
gggucugucgaacugguuucgc

SEQ ID NO: 1104042 - RNA, 15 nt, Mycobacterium bovis subsp bovis AF2122/97
gggugaccucgucga

SEQ ID NO: 1104043 - RNA, 11 nt, Mycobacterium bovis subsp bovis AF2122/97
gggugacgaug

SEQ ID NO: 1104044 - RNA, 15 nt, Mycobacterium bovis subsp bovis AF2122/97
gggugacgaugacga

SEQ ID NO: 1104045 - RNA, 16 nt, Mycobacterium bovis subsp bovis AF2122/97
ggucagcgcugccacc

SEQ ID NO: 1104046 - RNA, 22 nt, Mycobacterium bovis subsp bovis AF2122/97
ggucagcgcgucguccagggcg

SEQ ID NO: 1104047 - RNA, 17 nt, Mycobacterium bovis subsp bovis AF2122/97
gggugacuucgcugcgg

SEQ ID NO: 1104048 - RNA, 14 nt, Mycobacterium bovis subsp bovis AF2122/97
ggucagcgcggcgc

SEQ ID NO: 1104049 - RNA, 21 nt, Mycobacterium bovis subsp bovis AF2122/97
ggucagcgcguauggcucacc

SEQ ID NO: 1104050 - RNA, 14 nt, Mycobacterium bovis subsp bovis AF2122/97
ggucagcgugcagg

SEQ ID NO: 1104051 - RNA, 18 nt, Mycobacterium bovis subsp bovis AF2122/97
ggucagcgugcagguagg

SEQ ID NO: 1104052 - RNA, 17 nt, Mycobacterium bovis subsp bovis AF2122/97
ggucagcgcugccaccg

SEQ ID NO: 1104053 - RNA, 17 nt, Mycobacterium bovis subsp bovis AF2122/97
ggucagcgggucgaccc

SEQ ID NO: 1104054 - RNA, 19 nt, Mycobacterium bovis subsp bovis AF2122/97
ggucagcggcucggcgggg

SEQ ID NO: 1104055 - RNA, 20 nt, Mycobacterium bovis subsp bovis AF2122/97
ggucagcgggcacgccgccg

SEQ ID NO: 1104056 - RNA, 17 nt, Mycobacterium bovis subsp bovis AF2122/97
ggucagcggggugcugc

SEQ ID NO: 1104057 - RNA, 17 nt, Mycobacterium bovis subsp bovis AF2122/97
ggucagcucggcagcau

SEQ ID NO: 1104058 - RNA, 18 nt, Mycobacterium bovis subsp bovis AF2122/97
ggucagcucgucggcgau

SEQ ID NO: 1104059 - RNA, 20 nt, Mycobacterium bovis subsp bovis AF2122/97
ggucagcucgucggcgaugg

SEQ ID NO: 1104060 - RNA, 18 nt, Mycobacterium bovis subsp bovis AF2122/97
ggucagcuggccgcggcg

SEQ ID NO: 1104061 - RNA, 17 nt, Mycobacterium bovis subsp bovis AF2122/97
ggucagcugggacccga

SEQ ID NO: 1104062 - RNA, 14 nt, Mycobacterium bovis subsp bovis AF2122/97
ggucaggaugggga

SEQ ID NO: 1104063 - RNA, 23 nt, Mycobacterium bovis subsp bovis AF2122/97
ggucaggcaguccaccgcgcggc

SEQ ID NO: 1104064 - RNA, 13 nt, Mycobacterium bovis subsp bovis AF2122/97
ggucaggccgccg

SEQ ID NO: 1104065 - RNA, 18 nt, Mycobacterium bovis subsp bovis AF2122/97
ggucaggccgccgcggcg

SEQ ID NO: 1104066 - RNA, 20 nt, Mycobacterium bovis subsp bovis AF2122/97
ggucagcgggucgaccccgg

SEQ ID NO: 1104067 - RNA, 14 nt, Mycobacterium bovis subsp bovis AF2122/97
ggucaggccgacgu

SEQ ID NO: 1104068 - RNA, 14 nt, Mycobacterium bovis subsp bovis AF2122/97
ggucccgccgugcc

SEQ ID NO: 1104069 - RNA, 15 nt, Mycobacterium bovis subsp bovis AF2122/97
ggucccgccgugccg

SEQ ID NO: 1104070 - RNA, 21 nt, Mycobacterium bovis subsp bovis AF2122/97
ggucccgccgugccgcggcga

SEQ ID NO: 1104071 - RNA, 16 nt, Mycobacterium bovis subsp bovis AF2122/97
ggucccgagggcggca

SEQ ID NO: 1104072 - RNA, 19 nt, Mycobacterium bovis subsp bovis AF2122/97
ggucccgaucaccccgguc

SEQ ID NO: 1104073 - RNA, 18 nt, Mycobacterium bovis subsp bovis AF2122/97
gguccccucccaccagcg

SEQ ID NO: 1104074 - RNA, 14 nt, Mycobacterium bovis subsp bovis AF2122/97
gguccccgccggcg

SEQ ID NO: 1104075 - RNA, 16 nt, Mycobacterium bovis subsp bovis AF2122/97
gguccccgccggcggg

SEQ ID NO: 1104076 - RNA, 20 nt, Mycobacterium bovis subsp bovis AF2122/97
gguccccgacaacggcggca

SEQ ID NO: 1104077 - RNA, 19 nt, Mycobacterium bovis subsp bovis AF2122/97
gguccccacauggcccgga

SEQ ID NO: 1104078 - RNA, 20 nt, Mycobacterium bovis subsp bovis AF2122/97
ggucccccgaaguggugacc

SEQ ID NO: 1104079 - RNA, 16 nt, Mycobacterium bovis subsp bovis AF2122/97
gguccaucuggcgcgc

SEQ ID NO: 1104080 - RNA, 18 nt, Mycobacterium bovis subsp bovis AF2122/97
gguccaucuggcgcgccg

SEQ ID NO: 1104081 - RNA, 15 nt, Mycobacterium bovis subsp bovis AF2122/97
gguccauucguccgc

SEQ ID NO: 1104082 - RNA, 17 nt, Mycobacterium bovis subsp bovis AF2122/97
ggucccagccuggcaac

SEQ ID NO: 1104083 - RNA, 20 nt, Mycobacterium bovis subsp bovis AF2122/97
gguccagccuuuuucggcga

SEQ ID NO: 1104084 - RNA, 20 nt, Mycobacterium bovis subsp bovis AF2122/97
gguccagccgguccagaccc

SEQ ID NO: 1104085 - RNA, 17 nt, Mycobacterium bovis subsp bovis AF2122/97
gguccagcggccgccgc

SEQ ID NO: 1104086 - RNA, 14 nt, Mycobacterium bovis subsp bovis AF2122/97
gguccaggccggca

SEQ ID NO: 1104087 - RNA, 22 nt, Mycobacterium bovis subsp bovis AF2122/97
gguccagguucuucuccaccac

SEQ ID NO: 1104088 - RNA, 15 nt, Mycobacterium bovis subsp bovis AF2122/97
gguccaucagcacgg

SEQ ID NO: 1104089 - RNA, 18 nt, Mycobacterium bovis subsp bovis AF2122/97
ggucauugccggcgacga

SEQ ID NO: 1104090 - RNA, 17 nt, Mycobacterium bovis subsp bovis AF2122/97
ggucauugggguggcau

SEQ ID NO: 1104091 - RNA, 14 nt, Mycobacterium bovis subsp bovis AF2122/97
ggucaugggcgcgu

SEQ ID NO: 1104092 - RNA, 20 nt, Mycobacterium bovis subsp bovis AF2122/97
ggucaugucggccaccggcg

SEQ ID NO: 1104093 - RNA, 17 nt, Mycobacterium bovis subsp bovis AF2122/97
ggucauguucggggcgc

SEQ ID NO: 1104094 - RNA, 15 nt, Mycobacterium bovis subsp bovis AF2122/97
gguccagcagcucgg

SEQ ID NO: 1104095 - RNA, 18 nt, Mycobacterium bovis subsp bovis AF2122/97
gguccagcacaucggcga

SEQ ID NO: 1104096 - RNA, 15 nt, Mycobacterium bovis subsp bovis AF2122/97
gguccagccaccgac

SEQ ID NO: 1104097 - RNA, 21 nt, Mycobacterium bovis subsp bovis AF2122/97
gguccagccaccgaccccgga

SEQ ID NO: 1104098 - RNA, 12 nt, Mycobacterium bovis subsp bovis AF2122/97
ggucaucgccac

SEQ ID NO: 1104099 - RNA, 19 nt, Mycobacterium bovis subsp bovis AF2122/97
ggucaucgccacgccugcu

SEQ ID NO: 1104100 - RNA, 14 nt, Mycobacterium bovis subsp bovis AF2122/97
ggucaucggcgcca

SEQ ID NO: 1104101 - RNA, 15 nt, Mycobacterium bovis subsp bovis AF2122/97
ggucaucgguugacc

SEQ ID NO: 1104102 - RNA, 21 nt, Mycobacterium bovis subsp bovis AF2122/97
ggucaucgguugaccggucga

SEQ ID NO: 1104103 - RNA, 20 nt, Mycobacterium bovis subsp bovis AF2122/97
ggugcacaggauuggccgcu

SEQ ID NO: 1104104 - RNA, 15 nt, Mycobacterium bovis subsp bovis AF2122/97
ggugcacaacccgug

SEQ ID NO: 1104105 - RNA, 12 nt, Mycobacterium bovis subsp bovis AF2122/97
ggugcacaccgu

SEQ ID NO: 1104106 - RNA, 14 nt, Mycobacterium bovis subsp bovis AF2122/97
ggugcacaccgucg

SEQ ID NO: 1104107 - RNA, 24 nt, Mycobacterium bovis subsp bovis AF2122/97
ggugcacaccgucgcgcucgcacc

SEQ ID NO: 1104108 - RNA, 22 nt, Mycobacterium bovis subsp bovis AF2122/97
ggugaucugguauucaugcccg

SEQ ID NO: 1104109 - RNA, 16 nt, Mycobacterium bovis subsp bovis AF2122/97
ggugcaacggcguugg

SEQ ID NO: 1104110 - RNA, 16 nt, Mycobacterium bovis subsp bovis AF2122/97
ggugccagccggucga

SEQ ID NO: 1104111 - RNA, 22 nt, Mycobacterium bovis subsp bovis AF2122/97
ggugccagcaccacgucgacga

SEQ ID NO: 1104112 - RNA, 21 nt, Mycobacterium bovis subsp bovis AF2122/97
ggugccagccggauguugguc

SEQ ID NO: 1104113 - RNA, 16 nt, Mycobacterium bovis subsp bovis AF2122/97
ggugccagcaccacgu

SEQ ID NO: 1104114 - RNA, 16 nt, Mycobacterium bovis subsp bovis AF2122/97
ggugccacccuugccg

SEQ ID NO: 1104115 - RNA, 20 nt, Mycobacterium bovis subsp bovis AF2122/97
ggugccacccuugccgccgg

SEQ ID NO: 1104116 - RNA, 13 nt, Mycobacterium bovis subsp bovis AF2122/97
ggugccaccgacg

SEQ ID NO: 1104117 - RNA, 13 nt, Mycobacterium bovis subsp bovis AF2122/97
ggugccaccggcu

SEQ ID NO: 1104118 - RNA, 17 nt, Mycobacterium bovis subsp bovis AF2122/97
ggugccacgaucggcgg

SEQ ID NO: 1104119 - RNA, 11 nt, Mycobacterium bovis subsp bovis AF2122/97
ggugcagguga

SEQ ID NO: 1104120 - RNA, 18 nt, Mycobacterium bovis subsp bovis AF2122/97
ggugcaucgccacagucg

SEQ ID NO: 1104121 - RNA, 18 nt, Mycobacterium bovis subsp bovis AF2122/97
ggugcaucgccaccaccg

SEQ ID NO: 1104122 - RNA, 13 nt, Mycobacterium bovis subsp bovis AF2122/97
ggugcaugucgau

SEQ ID NO: 1104123 - RNA, 19 nt, Mycobacterium bovis subsp bovis AF2122/97
ggugcauucugcggcaagu

SEQ ID NO: 1104124 - RNA, 22 nt, Mycobacterium bovis subsp bovis AF2122/97
ggugccaaaggacgacaccgcg

SEQ ID NO: 1104125 - RNA, 16 nt, Mycobacterium bovis subsp bovis AF2122/97
ggugaugccaucaacg

SEQ ID NO: 1104126 - RNA, 17 nt, Mycobacterium bovis subsp bovis AF2122/97
ggugaugcaacgcggcg

SEQ ID NO: 1104127 - RNA, 15 nt, Mycobacterium bovis subsp bovis AF2122/97
ggugcaacgcgccuu

SEQ ID NO: 1104128 - RNA, 15 nt, Mycobacterium bovis subsp bovis AF2122/97
ggugcaacaggcgcg

SEQ ID NO: 1104129 - RNA, 15 nt, Mycobacterium bovis subsp bovis AF2122/97
ggugcaaccgugccg

SEQ ID NO: 1104130 - RNA, 20 nt, Mycobacterium bovis subsp bovis AF2122/97
ggugaucuuggcgcccgccg

SEQ ID NO: 1104131 - RNA, 14 nt, Mycobacterium bovis subsp bovis AF2122/97
ggugaucuuguccg

SEQ ID NO: 1104132 - RNA, 18 nt, Mycobacterium bovis subsp bovis AF2122/97
ggugaucgccggcuucgc

SEQ ID NO: 1104133 - RNA, 15 nt, Mycobacterium bovis subsp bovis AF2122/97
ggugaugagugcgga

SEQ ID NO: 1104134 - RNA, 22 nt, Mycobacterium bovis subsp bovis AF2122/97
ggugagggguugcggucgacgu

SEQ ID NO: 1104135 - RNA, 20 nt, Mycobacterium bovis subsp bovis AF2122/97
ggugagggaacccacagugg

SEQ ID NO: 1104136 - RNA, 12 nt, Mycobacterium bovis subsp bovis AF2122/97
ggugaucggcga

SEQ ID NO: 1104137 - RNA, 19 nt, Mycobacterium bovis subsp bovis AF2122/97
ggugaucgggcagcacgcc

SEQ ID NO: 1104138 - RNA, 22 nt, Mycobacterium bovis subsp bovis AF2122/97
ggugaacaccgccucugcaucg

SEQ ID NO: 1104139 - RNA, 15 nt, Mycobacterium bovis subsp bovis AF2122/97
ggugaaaugacggcu

SEQ ID NO: 1104140 - RNA, 13 nt, Mycobacterium bovis subsp bovis AF2122/97
ggugaaacgaugg

SEQ ID NO: 1104141 - RNA, 16 nt, Mycobacterium bovis subsp bovis AF2122/97
ggucuuuguccacgag

SEQ ID NO: 1104142 - RNA, 23 nt, Mycobacterium bovis subsp bovis AF2122/97
ggucuuuguccacgaggcaacca

SEQ ID NO: 1104143 - RNA, 15 nt, Mycobacterium bovis subsp bovis AF2122/97
ggugaaaaucgccau

SEQ ID NO: 1104144 - RNA, 18 nt, Mycobacterium bovis subsp bovis AF2122/97
ggugaaaaucgccaucgg

SEQ ID NO: 1104145 - RNA, 14 nt, Mycobacterium bovis subsp bovis AF2122/97
ggucuuugcccgcc

SEQ ID NO: 1104146 - RNA, 16 nt, Mycobacterium bovis subsp bovis AF2122/97
ggugaaccgcgcggcg

SEQ ID NO: 1104147 - RNA, 18 nt, Mycobacterium bovis subsp bovis AF2122/97
ggugaaauucgcggcggu

SEQ ID NO: 1104148 - RNA, 14 nt, Mycobacterium bovis subsp bovis AF2122/97
ggugaacaccagca

SEQ ID NO: 1104149 - RNA, 19 nt, Mycobacterium bovis subsp bovis AF2122/97
ggugaacaugugaccggcg

SEQ ID NO: 1104150 - RNA, 23 nt, Mycobacterium bovis subsp bovis AF2122/97
ggugaaccaccacuucggcgccg

SEQ ID NO: 1104151 - RNA, 16 nt, Mycobacterium bovis subsp bovis AF2122/97
ggugaaccccgccggc

SEQ ID NO: 1104152 - RNA, 19 nt, Mycobacterium bovis subsp bovis AF2122/97
ggugaacgagaugccgcga

SEQ ID NO: 1104153 - RNA, 13 nt, Mycobacterium bovis subsp bovis AF2122/97
ggugacaccaaca

SEQ ID NO: 1104154 - RNA, 19 nt, Mycobacterium bovis subsp bovis AF2122/97
ggugaacgcggacaccgcg

SEQ ID NO: 1104155 - RNA, 22 nt, Mycobacterium bovis subsp bovis AF2122/97
ggugaacgcggacaccgcggcg

SEQ ID NO: 1104156 - RNA, 13 nt, Mycobacterium bovis subsp bovis AF2122/97
ggugaccacgccg

SEQ ID NO: 1104157 - RNA, 16 nt, Mycobacterium bovis subsp bovis AF2122/97
ggugaccacggcaagc

SEQ ID NO: 1104158 - RNA, 14 nt, Mycobacterium bovis subsp bovis AF2122/97
ggugaccagcaacc

SEQ ID NO: 1104159 - RNA, 17 nt, Mycobacterium bovis subsp bovis AF2122/97
ggugaccagcaggccgg

SEQ ID NO: 1104160 - RNA, 21 nt, Mycobacterium bovis subsp bovis AF2122/97
ggugacauguugccgcugacg

SEQ ID NO: 1104161 - RNA, 21 nt, Mycobacterium bovis subsp bovis AF2122/97
ggugacaucgcgaggcgucac

SEQ ID NO: 1104162 - RNA, 13 nt, Mycobacterium bovis subsp bovis AF2122/97
ggugacacgacgu

SEQ ID NO: 1104163 - RNA, 18 nt, Mycobacterium bovis subsp bovis AF2122/97
ggugaccgagaucgucgc

SEQ ID NO: 1104164 - RNA, 23 nt, Mycobacterium bovis subsp bovis AF2122/97
ggugacccacucggggacggcga

SEQ ID NO: 1104165 - RNA, 16 nt, Mycobacterium bovis subsp bovis AF2122/97
ggugacccgcuauucg

SEQ ID NO: 1104166 - RNA, 15 nt, Mycobacterium bovis subsp bovis AF2122/97
ggugacccgcugggc

SEQ ID NO: 1104167 - RNA, 18 nt, Mycobacterium bovis subsp bovis AF2122/97
ggugaccaccccggccaa

SEQ ID NO: 1104168 - RNA, 23 nt, Mycobacterium bovis subsp bovis AF2122/97
ggugaccaccccggccaacccgu

SEQ ID NO: 1104169 - RNA, 18 nt, Mycobacterium bovis subsp bovis AF2122/97
ggugaccagggugacgga

SEQ ID NO: 1104170 - RNA, 17 nt, Mycobacterium bovis subsp bovis AF2122/97
ggugagcaccugggcgc

SEQ ID NO: 1104171 - RNA, 19 nt, Mycobacterium bovis subsp bovis AF2122/97
ggugagcaccugggcgcgc

SEQ ID NO: 1104172 - RNA, 22 nt, Mycobacterium bovis subsp bovis AF2122/97
ggugagcaccugggcgcgcugg

SEQ ID NO: 1104173 - RNA, 12 nt, Mycobacterium bovis subsp bovis AF2122/97
ggugagcucgcg

SEQ ID NO: 1104174 - RNA, 15 nt, Mycobacterium bovis subsp bovis AF2122/97
ggugaggaagcggcc

SEQ ID NO: 1104175 - RNA, 23 nt, Mycobacterium bovis subsp bovis AF2122/97
ggugagcgggcaagucgcccagc

SEQ ID NO: 1104176 - RNA, 20 nt, Mycobacterium bovis subsp bovis AF2122/97
ggugagccgguggcccgccg

SEQ ID NO: 1104177 - RNA, 16 nt, Mycobacterium bovis subsp bovis AF2122/97
ggugagcgagcgcgcg

SEQ ID NO: 1104178 - RNA, 19 nt, Mycobacterium bovis subsp bovis AF2122/97
ggugagccaguuggccagu

SEQ ID NO: 1104179 - RNA, 17 nt, Mycobacterium bovis subsp bovis AF2122/97
ggugagcagggcggcga

SEQ ID NO: 1104180 - RNA, 22 nt, Mycobacterium bovis subsp bovis AF2122/97
ggugagcagcucggugacaagc

SEQ ID NO: 1104181 - RNA, 13 nt, Mycobacterium bovis subsp bovis AF2122/97
ggugagcagcucg

SEQ ID NO: 1104182 - RNA, 13 nt, Mycobacterium bovis subsp bovis AF2122/97
ggucgcggcugcc

SEQ ID NO: 1104183 - RNA, 23 nt, Mycobacterium bovis subsp bovis AF2122/97
ggucgcgcgaauggucagcgucg

SEQ ID NO: 1104184 - RNA, 20 nt, Mycobacterium bovis subsp bovis AF2122/97
ggucgcgcuggcgccggcca

SEQ ID NO: 1104185 - RNA, 14 nt, Mycobacterium bovis subsp bovis AF2122/97
ggucgcgcugaagg

SEQ ID NO: 1104186 - RNA, 17 nt, Mycobacterium bovis subsp bovis AF2122/97
ggucgcgcggcaccgau

SEQ ID NO: 1104187 - RNA, 17 nt, Mycobacterium bovis subsp bovis AF2122/97
ggucggcagcuccagca

SEQ ID NO: 1104188 - RNA, 21 nt, Mycobacterium bovis subsp bovis AF2122/97
ggucggcagcuucucgccgac

SEQ ID NO: 1104189 - RNA, 23 nt, Mycobacterium bovis subsp bovis AF2122/97
ggucggcagcuucucgccgacga

SEQ ID NO: 1104190 - RNA, 21 nt, Mycobacterium bovis subsp bovis AF2122/97
ggucggcaccagguugccgag

SEQ ID NO: 1104191 - RNA, 18 nt, Mycobacterium bovis subsp bovis AF2122/97
ggucggcauugaucggug

SEQ ID NO: 1104192 - RNA, 22 nt, Mycobacterium bovis subsp bovis AF2122/97
ggucggcauugaucggugccca

SEQ ID NO: 1104193 - RNA, 13 nt, Mycobacterium bovis subsp bovis AF2122/97
ggucggccaccaa

SEQ ID NO: 1104194 - RNA, 14 nt, Mycobacterium bovis subsp bovis AF2122/97
ggucggccaccgug

SEQ ID NO: 1104195 - RNA, 16 nt, Mycobacterium bovis subsp bovis AF2122/97
ggucggccaccgugga

SEQ ID NO: 1104196 - RNA, 18 nt, Mycobacterium bovis subsp bovis AF2122/97
ggucggcuuccggugccg

SEQ ID NO: 1104197 - RNA, 17 nt, Mycobacterium bovis subsp bovis AF2122/97
ggucggcuucgacaacc

SEQ ID NO: 1104198 - RNA, 19 nt, Mycobacterium bovis subsp bovis AF2122/97
ggucggcccuccaccggug

SEQ ID NO: 1104199 - RNA, 20 nt, Mycobacterium bovis subsp bovis AF2122/97
ggucggcccuccaccggugu

SEQ ID NO: 1104200 - RNA, 12 nt, Mycobacterium bovis subsp bovis AF2122/97
ggucggccgccu

SEQ ID NO: 1104201 - RNA, 13 nt, Mycobacterium bovis subsp bovis AF2122/97
ggucggccgccuc

SEQ ID NO: 1104202 - RNA, 22 nt, Mycobacterium bovis subsp bovis AF2122/97
ggucggccgcuggaggcggcgc

SEQ ID NO: 1104203 - RNA, 16 nt, Mycobacterium bovis subsp bovis AF2122/97
ggucgggcccggcgag

SEQ ID NO: 1104204 - RNA, 21 nt, Mycobacterium bovis subsp bovis AF2122/97
ggucggcuucgacaaccucga

SEQ ID NO: 1104205 - RNA, 23 nt, Mycobacterium bovis subsp bovis AF2122/97
ggucgggcagcacuuggacccgg

SEQ ID NO: 1104206 - RNA, 17 nt, Mycobacterium bovis subsp bovis AF2122/97
ggucgggcaaccugccg

SEQ ID NO: 1104207 - RNA, 23 nt, Mycobacterium bovis subsp bovis AF2122/97
ggucggugggcuugccgcgcacc

SEQ ID NO: 1104208 - RNA, 16 nt, Mycobacterium bovis subsp bovis AF2122/97
ggucgggcggcgucga

SEQ ID NO: 1104209 - RNA, 22 nt, Mycobacterium bovis subsp bovis AF2122/97
ggucggugcugaccccgccggc

SEQ ID NO: 1104210 - RNA, 13 nt, Mycobacterium bovis subsp bovis AF2122/97
ggucggugcgguc

SEQ ID NO: 1104211 - RNA, 17 nt, Mycobacterium bovis subsp bovis AF2122/97
ggucucgguaggcggug

SEQ ID NO: 1104212 - RNA, 16 nt, Mycobacterium bovis subsp bovis AF2122/97
ggucucgcaccagucg

SEQ ID NO: 1104213 - RNA, 13 nt, Mycobacterium bovis subsp bovis AF2122/97
ggucucgaccgcg

SEQ ID NO: 1104214 - RNA, 19 nt, Mycobacterium bovis subsp bovis AF2122/97
ggucucgaacuccaugccg

SEQ ID NO: 1104215 - RNA, 21 nt, Mycobacterium bovis subsp bovis AF2122/97
ggucucuagcaaagccagcgc

SEQ ID NO: 1104216 - RNA, 19 nt, Mycobacterium bovis subsp bovis AF2122/97
ggucugcgccgccggcggc

SEQ ID NO: 1104217 - RNA, 20 nt, Mycobacterium bovis subsp bovis AF2122/97
ggucugcgccgccggcggcg

SEQ ID NO: 1104218 - RNA, 23 nt, Mycobacterium bovis subsp bovis AF2122/97
ggucugcgccuucgccagcggcg

SEQ ID NO: 1104219 - RNA, 23 nt, Mycobacterium bovis subsp bovis AF2122/97
ggucugcagaucguagugcgcgc

SEQ ID NO: 1104220 - RNA, 19 nt, Mycobacterium bovis subsp bovis AF2122/97
ggucugcagugcagcgauc

SEQ ID NO: 1104221 - RNA, 21 nt, Mycobacterium bovis subsp bovis AF2122/97
ggucugacagaccgggcacca

SEQ ID NO: 1104222 - RNA, 15 nt, Mycobacterium bovis subsp bovis AF2122/97
ggucgguuccggugu

SEQ ID NO: 1104223 - RNA, 16 nt, Mycobacterium bovis subsp bovis AF2122/97
ggucgguucggccgga

SEQ ID NO: 1104224 - RNA, 17 nt, Mycobacterium bovis subsp bovis AF2122/97
ggucguacgcauggcgg

SEQ ID NO: 1104225 - RNA, 20 nt, Mycobacterium bovis subsp bovis AF2122/97
ggucguaggacaccaccgug

SEQ ID NO: 1104226 - RNA, 15 nt, Mycobacterium bovis subsp bovis AF2122/97
ggucguaggacacca

SEQ ID NO: 1104227 - RNA, 16 nt, Mycobacterium bovis subsp bovis AF2122/97
ggucguaggacaccac

SEQ ID NO: 1104228 - RNA, 18 nt, Mycobacterium bovis subsp bovis AF2122/97
ggucguaggacaccaccg

SEQ ID NO: 1104229 - RNA, 15 nt, Mycobacterium bovis subsp bovis AF2122/97
ggucucccggcugau

SEQ ID NO: 1104230 - RNA, 23 nt, Mycobacterium bovis subsp bovis AF2122/97
ggucuccgaacggguagacccac

SEQ ID NO: 1104231 - RNA, 21 nt, Mycobacterium bovis subsp bovis AF2122/97
ggucgucaugccagucgccga

SEQ ID NO: 1104232 - RNA, 18 nt, Mycobacterium bovis subsp bovis AF2122/97
ggucuccggaucgccgaa

SEQ ID NO: 1104233 - RNA, 15 nt, Mycobacterium bovis subsp bovis AF2122/97
ggucuccggcgcacc

SEQ ID NO: 1104234 - RNA, 20 nt, Mycobacterium bovis subsp bovis AF2122/97
ggucucaugcacccgguacc

SEQ ID NO: 1104235 - RNA, 14 nt, Mycobacterium bovis subsp bovis AF2122/97
ggucucacggcgcg

SEQ ID NO: 1104236 - RNA, 17 nt, Mycobacterium bovis subsp bovis AF2122/97
ggucucagugcucgccc

SEQ ID NO: 1104237 - RNA, 20 nt, Mycobacterium bovis subsp bovis AF2122/97
ggucucauagugcaggucga

SEQ ID NO: 1104238 - RNA, 18 nt, Mycobacterium bovis subsp bovis AF2122/97
ggucgucacggaccgcca

SEQ ID NO: 1104239 - RNA, 15 nt, Mycobacterium bovis subsp bovis AF2122/97
ggugcgagcgacacc

SEQ ID NO: 1104240 - RNA, 17 nt, Mycobacterium bovis subsp bovis AF2122/97
ggugcgacgcgaccgcg

SEQ ID NO: 1104241 - RNA, 19 nt, Mycobacterium bovis subsp bovis AF2122/97
ggugcgaauggugcaacgc

SEQ ID NO: 1104242 - RNA, 18 nt, Mycobacterium bovis subsp bovis AF2122/97
ggugcgaucccacccucg

SEQ ID NO: 1104243 - RNA, 15 nt, Mycobacterium bovis subsp bovis AF2122/97
ggugcgauccggcgc

SEQ ID NO: 1104244 - RNA, 16 nt, Mycobacterium bovis subsp bovis AF2122/97
ggugcgauccggcgca

SEQ ID NO: 1104245 - RNA, 13 nt, Mycobacterium bovis subsp bovis AF2122/97
ggugcgccgaucc

SEQ ID NO: 1104246 - RNA, 15 nt, Mycobacterium bovis subsp bovis AF2122/97
ggugcgccgaucccg

SEQ ID NO: 1104247 - RNA, 19 nt, Mycobacterium bovis subsp bovis AF2122/97
ggugcgccgcgggcugacc

SEQ ID NO: 1104248 - RNA, 16 nt, Mycobacterium bovis subsp bovis AF2122/97
ggugcgccauucccgg

SEQ ID NO: 1104249 - RNA, 18 nt, Mycobacterium bovis subsp bovis AF2122/97
ggugcgcccgccggcgcg

SEQ ID NO: 1104250 - RNA, 14 nt, Mycobacterium bovis subsp bovis AF2122/97
ggugcgcccggcca

SEQ ID NO: 1104251 - RNA, 20 nt, Mycobacterium bovis subsp bovis AF2122/97
ggugcgccagaucaccgucg

SEQ ID NO: 1104252 - RNA, 12 nt, Mycobacterium bovis subsp bovis AF2122/97
ggugcgcaccag

SEQ ID NO: 1104253 - RNA, 23 nt, Mycobacterium bovis subsp bovis AF2122/97
ggugcgccacgccaccgcgguca

SEQ ID NO: 1104254 - RNA, 24 nt, Mycobacterium bovis subsp bovis AF2122/97
ggugccggccagacucgcggucga

SEQ ID NO: 1104255 - RNA, 12 nt, Mycobacterium bovis subsp bovis AF2122/97
ggugccggcggu

SEQ ID NO: 1104256 - RNA, 14 nt, Mycobacterium bovis subsp bovis AF2122/97
ggugccggcgguga

SEQ ID NO: 1104257 - RNA, 15 nt, Mycobacterium bovis subsp bovis AF2122/97
ggugccggcgucgcu

SEQ ID NO: 1104258 - RNA, 16 nt, Mycobacterium bovis subsp bovis AF2122/97
ggugccggcguugccg

SEQ ID NO: 1104259 - RNA, 20 nt, Mycobacterium bovis subsp bovis AF2122/97
ggugccggcgacgcuaccgc

SEQ ID NO: 1104260 - RNA, 14 nt, Mycobacterium bovis subsp bovis AF2122/97
ggugccggcgccgc

SEQ ID NO: 1104261 - RNA, 22 nt, Mycobacterium bovis subsp bovis AF2122/97
ggugccggcgccgcccuugccg

SEQ ID NO: 1104262 - RNA, 23 nt, Mycobacterium bovis subsp bovis AF2122/97
ggugccggcggaaauggcgucgc

SEQ ID NO: 1104263 - RNA, 16 nt, Mycobacterium bovis subsp bovis AF2122/97
ggugccgccuccgccu

SEQ ID NO: 1104264 - RNA, 14 nt, Mycobacterium bovis subsp bovis AF2122/97
ggugccggucgagu

SEQ ID NO: 1104265 - RNA, 18 nt, Mycobacterium bovis subsp bovis AF2122/97
ggugccggugcuccucgg

SEQ ID NO: 1104266 - RNA, 17 nt, Mycobacterium bovis subsp bovis AF2122/97
ggugccgggcaccacca

SEQ ID NO: 1104267 - RNA, 20 nt, Mycobacterium bovis subsp bovis AF2122/97
ggugccggggccccaugccg

SEQ ID NO: 1104268 - RNA, 21 nt, Mycobacterium bovis subsp bovis AF2122/97
ggugccggggccccaugccga

SEQ ID NO: 1104269 - RNA, 17 nt, Mycobacterium bovis subsp bovis AF2122/97
ggugccggggcugccgc

SEQ ID NO: 1104270 - RNA, 18 nt, Mycobacterium bovis subsp bovis AF2122/97
ggugccggggcugccgcc

SEQ ID NO: 1104271 - RNA, 18 nt, Mycobacterium bovis subsp bovis AF2122/97
ggugccgggguggcgcgc

SEQ ID NO: 1104272 - RNA, 19 nt, Mycobacterium bovis subsp bovis AF2122/97
ggugccgggguggcgcgcc

SEQ ID NO: 1104273 - RNA, 14 nt, Mycobacterium bovis subsp bovis AF2122/97
ggugccggucacgu

SEQ ID NO: 1104274 - RNA, 15 nt, Mycobacterium bovis subsp bovis AF2122/97
ggugccguccggcgc

SEQ ID NO: 1104275 - RNA, 17 nt, Mycobacterium bovis subsp bovis AF2122/97
ggugccgugaucggcgc

SEQ ID NO: 1104276 - RNA, 13 nt, Mycobacterium bovis subsp bovis AF2122/97
ggugccgucgccg

SEQ ID NO: 1104277 - RNA, 16 nt, Mycobacterium bovis subsp bovis AF2122/97
ggugccgucagcggcg

SEQ ID NO: 1104278 - RNA, 19 nt, Mycobacterium bovis subsp bovis AF2122/97
ggugccguugcgucugcuc

SEQ ID NO: 1104279 - RNA, 20 nt, Mycobacterium bovis subsp bovis AF2122/97
ggugccguugcgucugcucg

SEQ ID NO: 1104280 - RNA, 19 nt, Mycobacterium bovis subsp bovis AF2122/97
ggugccucgcagccaacgc

SEQ ID NO: 1104281 - RNA, 21 nt, Mycobacterium bovis subsp bovis AF2122/97
ggugccuguugcgaccauccg

SEQ ID NO: 1104282 - RNA, 13 nt, Mycobacterium bovis subsp bovis AF2122/97
ggugccgccguug

SEQ ID NO: 1104283 - RNA, 21 nt, Mycobacterium bovis subsp bovis AF2122/97
ggugccgcgcagcugccgcac

SEQ ID NO: 1104284 - RNA, 19 nt, Mycobacterium bovis subsp bovis AF2122/97
ggugccgcggccaccgccg

SEQ ID NO: 1104285 - RNA, 23 nt, Mycobacterium bovis subsp bovis AF2122/97
ggugccgcggccaccgccgccgc

SEQ ID NO: 1104286 - RNA, 22 nt, Mycobacterium bovis subsp bovis AF2122/97
ggugccgcgguaggugcauguc

SEQ ID NO: 1104287 - RNA, 15 nt, Mycobacterium bovis subsp bovis AF2122/97
ggugccggcagcggc

SEQ ID NO: 1104288 - RNA, 19 nt, Mycobacterium bovis subsp bovis AF2122/97
ggugccggcagcggcgcgc

SEQ ID NO: 1104289 - RNA, 14 nt, Mycobacterium bovis subsp bovis AF2122/97
ggugccgccggugc

SEQ ID NO: 1104290 - RNA, 12 nt, Mycobacterium bovis subsp bovis AF2122/97
ggugccgccauc

SEQ ID NO: 1104291 - RNA, 17 nt, Mycobacterium bovis subsp bovis AF2122/97
ggugccgccaucgccgc

SEQ ID NO: 1104292 - RNA, 14 nt, Mycobacterium bovis subsp bovis AF2122/97
ggugccgccgucgc

SEQ ID NO: 1104293 - RNA, 16 nt, Mycobacterium bovis subsp bovis AF2122/97
ggugccgagcuggcga

SEQ ID NO: 1104294 - RNA, 13 nt, Mycobacterium bovis subsp bovis AF2122/97
ggugccgcagcuu

SEQ ID NO: 1104295 - RNA, 16 nt, Mycobacterium bovis subsp bovis AF2122/97
ggugccgccaccaccg

SEQ ID NO: 1104296 - RNA, 19 nt, Mycobacterium bovis subsp bovis AF2122/97
ggugccgccaccaccggcg

SEQ ID NO: 1104297 - RNA, 20 nt, Mycobacterium bovis subsp bovis AF2122/97
ggugccgccaccaccggcgc

SEQ ID NO: 1104298 - RNA, 23 nt, Mycobacterium bovis subsp bovis AF2122/97
ggugccgccaccaccggcgccuc

SEQ ID NO: 1104299 - RNA, 16 nt, Mycobacterium bovis subsp bovis AF2122/97
ggugccgccaccggcg

SEQ ID NO: 1104300 - RNA, 23 nt, Mycobacterium bovis subsp bovis AF2122/97
ggugccgagcgcaaggucgacgg

SEQ ID NO: 1104301 - RNA, 11 nt, Mycobacterium bovis subsp bovis AF2122/97
ggugccgcccg

SEQ ID NO: 1104302 - RNA, 14 nt, Mycobacterium bovis subsp bovis AF2122/97
ggugccgcccgcgc

SEQ ID NO: 1104303 - RNA, 17 nt, Mycobacterium bovis subsp bovis AF2122/97
ggugccgcccgcgccgc

SEQ ID NO: 1104304 - RNA, 20 nt, Mycobacterium bovis subsp bovis AF2122/97
ggugccgcccgcgccgccgc

SEQ ID NO: 1104305 - RNA, 14 nt, Mycobacterium bovis subsp bovis AF2122/97
ggugcccgacccgc

SEQ ID NO: 1104306 - RNA, 17 nt, Mycobacterium bovis subsp bovis AF2122/97
ggugccgccgauaccgc

SEQ ID NO: 1104307 - RNA, 14 nt, Mycobacterium bovis subsp bovis AF2122/97
ggugccgccgccgg

SEQ ID NO: 1104308 - RNA, 17 nt, Mycobacterium bovis subsp bovis AF2122/97
ggugccgccgccggcgc

SEQ ID NO: 1104309 - RNA, 20 nt, Mycobacterium bovis subsp bovis AF2122/97
ggugccgccgccggcgccgg

SEQ ID NO: 1104310 - RNA, 12 nt, Mycobacterium bovis subsp bovis AF2122/97
ggugccgccgcg

SEQ ID NO: 1104311 - RNA, 16 nt, Mycobacterium bovis subsp bovis AF2122/97
ggugccgccgcggcca

SEQ ID NO: 1104312 - RNA, 18 nt, Mycobacterium bovis subsp bovis AF2122/97
ggugccgccgcggccacc

SEQ ID NO: 1104313 - RNA, 22 nt, Mycobacterium bovis subsp bovis AF2122/97
ggugccgccgcggccaccaccg

SEQ ID NO: 1104314 - RNA, 15 nt, Mycobacterium bovis subsp bovis AF2122/97
ggugcccagcagcgc

SEQ ID NO: 1104315 - RNA, 19 nt, Mycobacterium bovis subsp bovis AF2122/97
ggugccaucggugguggcg

SEQ ID NO: 1104316 - RNA, 16 nt, Mycobacterium bovis subsp bovis AF2122/97
ggugcccaugaugguc

SEQ ID NO: 1104317 - RNA, 21 nt, Mycobacterium bovis subsp bovis AF2122/97
ggugcccaacccacucgcagc

SEQ ID NO: 1104318 - RNA, 16 nt, Mycobacterium bovis subsp bovis AF2122/97
ggugcccgaguucgca

SEQ ID NO: 1104319 - RNA, 16 nt, Mycobacterium bovis subsp bovis AF2122/97
ggugccgacgaugacg

SEQ ID NO: 1104320 - RNA, 13 nt, Mycobacterium bovis subsp bovis AF2122/97
ggugccgaccgcg

SEQ ID NO: 1104321 - RNA, 16 nt, Mycobacterium bovis subsp bovis AF2122/97
ggugccgacccgccgc

SEQ ID NO: 1104322 - RNA, 18 nt, Mycobacterium bovis subsp bovis AF2122/97
ggugccgacccgccgcgc

SEQ ID NO: 1104323 - RNA, 16 nt, Mycobacterium bovis subsp bovis AF2122/97
ggugccgacggcgccg

SEQ ID NO: 1104324 - RNA, 17 nt, Mycobacterium bovis subsp bovis AF2122/97
ggugccgacggcgccga

SEQ ID NO: 1104325 - RNA, 16 nt, Mycobacterium bovis subsp bovis AF2122/97
ggugccgaccuguccg

SEQ ID NO: 1104326 - RNA, 15 nt, Mycobacterium bovis subsp bovis AF2122/97
ggugcccgcaccaca

SEQ ID NO: 1104327 - RNA, 15 nt, Mycobacterium bovis subsp bovis AF2122/97
ggugcccucggccgc

SEQ ID NO: 1104328 - RNA, 15 nt, Mycobacterium bovis subsp bovis AF2122/97
ggugcccugccggca

SEQ ID NO: 1104329 - RNA, 17 nt, Mycobacterium bovis subsp bovis AF2122/97
ggugcccugccggcagc

SEQ ID NO: 1104330 - RNA, 22 nt, Mycobacterium bovis subsp bovis AF2122/97
gguggccagaucgaacgcagcc

SEQ ID NO: 1104331 - RNA, 15 nt, Mycobacterium bovis subsp bovis AF2122/97
gguggccacgcccag

SEQ ID NO: 1104332 - RNA, 18 nt, Mycobacterium bovis subsp bovis AF2122/97
gguggccccgauggcgau

SEQ ID NO: 1104333 - RNA, 15 nt, Mycobacterium bovis subsp bovis AF2122/97
gguggccagcgcggc

SEQ ID NO: 1104334 - RNA, 16 nt, Mycobacterium bovis subsp bovis AF2122/97
gguggccagcgucgcg

SEQ ID NO: 1104335 - RNA, 13 nt, Mycobacterium bovis subsp bovis AF2122/97
gguggcccggcug

SEQ ID NO: 1104336 - RNA, 19 nt, Mycobacterium bovis subsp bovis AF2122/97
gguggcccgggccaccgga

SEQ ID NO: 1104337 - RNA, 18 nt, Mycobacterium bovis subsp bovis AF2122/97
gguggcccgaccgggaac

SEQ ID NO: 1104338 - RNA, 14 nt, Mycobacterium bovis subsp bovis AF2122/97
gguggccagcgcgg

SEQ ID NO: 1104339 - RNA, 14 nt, Mycobacterium bovis subsp bovis AF2122/97
gguggcccguagcg

SEQ ID NO: 1104340 - RNA, 13 nt, Mycobacterium bovis subsp bovis AF2122/97
ggugggcuugccg

SEQ ID NO: 1104341 - RNA, 18 nt, Mycobacterium bovis subsp bovis AF2122/97
gguggccggcgaggguga

SEQ ID NO: 1104342 - RNA, 12 nt, Mycobacterium bovis subsp bovis AF2122/97
gguggccgucgg

SEQ ID NO: 1104343 - RNA, 23 nt, Mycobacterium bovis subsp bovis AF2122/97
gguggugucagccaccggugagc

SEQ ID NO: 1104344 - RNA, 17 nt, Mycobacterium bovis subsp bovis AF2122/97
ggugguuccgcccggug

SEQ ID NO: 1104345 - RNA, 20 nt, Mycobacterium bovis subsp bovis AF2122/97
ggugguuagguggcuggcug

SEQ ID NO: 1104346 - RNA, 23 nt, Mycobacterium bovis subsp bovis AF2122/97
ggugguucaaccggacgaccgga

SEQ ID NO: 1104347 - RNA, 16 nt, Mycobacterium bovis subsp bovis AF2122/97
ggugguucaccucggc

SEQ ID NO: 1104348 - RNA, 18 nt, Mycobacterium bovis subsp bovis AF2122/97
ggugguucaccucggcga

SEQ ID NO: 1104349 - RNA, 13 nt, Mycobacterium bovis subsp bovis AF2122/97
gguggucagcacc

SEQ ID NO: 1104350 - RNA, 12 nt, Mycobacterium bovis subsp bovis AF2122/97
ggugguggcggu

SEQ ID NO: 1104351 - RNA, 22 nt, Mycobacterium bovis subsp bovis AF2122/97
ggugguggcgguguugcucccg

SEQ ID NO: 1104352 - RNA, 14 nt, Mycobacterium bovis subsp bovis AF2122/97
ggugguggcgucga

SEQ ID NO: 1104353 - RNA, 17 nt, Mycobacterium bovis subsp bovis AF2122/97
gguggucagcaccggcg

SEQ ID NO: 1104354 - RNA, 14 nt, Mycobacterium bovis subsp bovis AF2122/97
gguggugcucgucg

SEQ ID NO: 1104355 - RNA, 20 nt, Mycobacterium bovis subsp bovis AF2122/97
ggugguaucggcgugcuggc

SEQ ID NO: 1104356 - RNA, 14 nt, Mycobacterium bovis subsp bovis AF2122/97
gguggucaccacca

SEQ ID NO: 1104357 - RNA, 19 nt, Mycobacterium bovis subsp bovis AF2122/97
gguggucaccaccaucacg

SEQ ID NO: 1104358 - RNA, 21 nt, Mycobacterium bovis subsp bovis AF2122/97
gguggggauagccgcgucgcg

SEQ ID NO: 1104359 - RNA, 16 nt, Mycobacterium bovis subsp bovis AF2122/97
ggugggcuugccgcgc

SEQ ID NO: 1104360 - RNA, 14 nt, Mycobacterium bovis subsp bovis AF2122/97
gguggggucgacgc

SEQ ID NO: 1104361 - RNA, 17 nt, Mycobacterium bovis subsp bovis AF2122/97
gguggggccggcggugu

SEQ ID NO: 1104362 - RNA, 14 nt, Mycobacterium bovis subsp bovis AF2122/97
gguggggcgcgccg

SEQ ID NO: 1104363 - RNA, 13 nt, Mycobacterium bovis subsp bovis AF2122/97
gguggggucgccg

SEQ ID NO: 1104364 - RNA, 23 nt, Mycobacterium bovis subsp bovis AF2122/97
gguggggucgcugccgccgucgc

SEQ ID NO: 1104365 - RNA, 13 nt, Mycobacterium bovis subsp bovis AF2122/97
ggugggguggugg

SEQ ID NO: 1104366 - RNA, 18 nt, Mycobacterium bovis subsp bovis AF2122/97
ggugggugccggcgucgc

SEQ ID NO: 1104367 - RNA, 22 nt, Mycobacterium bovis subsp bovis AF2122/97
ggugggugccggcgucgcuggc

SEQ ID NO: 1104368 - RNA, 15 nt, Mycobacterium bovis subsp bovis AF2122/97
ggugguaacggcggc

SEQ ID NO: 1104369 - RNA, 20 nt, Mycobacterium bovis subsp bovis AF2122/97
ggugcgcgaggucggcggcg

SEQ ID NO: 1104370 - RNA, 13 nt, Mycobacterium bovis subsp bovis AF2122/97
ggugcgcgcggcg

SEQ ID NO: 1104371 - RNA, 16 nt, Mycobacterium bovis subsp bovis AF2122/97
ggugcgcggagagcgc

SEQ ID NO: 1104372 - RNA, 18 nt, Mycobacterium bovis subsp bovis AF2122/97
ggugcgcuggaggcuccu

SEQ ID NO: 1104373 - RNA, 12 nt, Mycobacterium bovis subsp bovis AF2122/97
ggugcgcuggcc

SEQ ID NO: 1104374 - RNA, 16 nt, Mycobacterium bovis subsp bovis AF2122/97
ggugcgcuggcccaau

SEQ ID NO: 1104375 - RNA, 19 nt, Mycobacterium bovis subsp bovis AF2122/97
ggugcgcuugcggccgcgc

SEQ ID NO: 1104376 - RNA, 19 nt, Mycobacterium bovis subsp bovis AF2122/97
ggugcggacuucgaugucg

SEQ ID NO: 1104377 - RNA, 23 nt, Mycobacterium bovis subsp bovis AF2122/97
ggugcggacuucgaugucgaggu

SEQ ID NO: 1104378 - RNA, 14 nt, Mycobacterium bovis subsp bovis AF2122/97
ggugcggcggcauc

SEQ ID NO: 1104379 - RNA, 16 nt, Mycobacterium bovis subsp bovis AF2122/97
ggugcggcgggcucgc

SEQ ID NO: 1104380 - RNA, 16 nt, Mycobacterium bovis subsp bovis AF2122/97
ggugcggccgcggcga

SEQ ID NO: 1104381 - RNA, 17 nt, Mycobacterium bovis subsp bovis AF2122/97
ggugcggccgcggcgau

SEQ ID NO: 1104382 - RNA, 17 nt, Mycobacterium bovis subsp bovis AF2122/97
ggugcggggccggucgg

SEQ ID NO: 1104383 - RNA, 19 nt, Mycobacterium bovis subsp bovis AF2122/97
ggugcgggguuggccgugg

SEQ ID NO: 1104384 - RNA, 17 nt, Mycobacterium bovis subsp bovis AF2122/97
gguggaauccaccagcc

SEQ ID NO: 1104385 - RNA, 13 nt, Mycobacterium bovis subsp bovis AF2122/97
gguggaccaccgg

SEQ ID NO: 1104386 - RNA, 17 nt, Mycobacterium bovis subsp bovis AF2122/97
gguggacccggcggugc

SEQ ID NO: 1104387 - RNA, 18 nt, Mycobacterium bovis subsp bovis AF2122/97
gguggaccgccgaucggc

SEQ ID NO: 1104388 - RNA, 18 nt, Mycobacterium bovis subsp bovis AF2122/97
gguggacgaccgcgcggc

SEQ ID NO: 1104389 - RNA, 18 nt, Mycobacterium bovis subsp bovis AF2122/97
gguggacgaggcggucga

SEQ ID NO: 1104390 - RNA, 18 nt, Mycobacterium bovis subsp bovis AF2122/97
gguggccaacaccgccag

SEQ ID NO: 1104391 - RNA, 14 nt, Mycobacterium bovis subsp bovis AF2122/97
gguggccaccaccg

SEQ ID NO: 1104392 - RNA, 21 nt, Mycobacterium bovis subsp bovis AF2122/97
gguggcaugcgacagaugccg

SEQ ID NO: 1104393 - RNA, 14 nt, Mycobacterium bovis subsp bovis AF2122/97
gguggccagcaggc

SEQ ID NO: 1104394 - RNA, 17 nt, Mycobacterium bovis subsp bovis AF2122/97
gguggccagcaggcggc

SEQ ID NO: 1104395 - RNA, 19 nt, Mycobacterium bovis subsp bovis AF2122/97
ggugcugucgacgucggca

SEQ ID NO: 1104396 - RNA, 18 nt, Mycobacterium bovis subsp bovis AF2122/97
ggugcuuccucgcgagcu

SEQ ID NO: 1104397 - RNA, 17 nt, Mycobacterium bovis subsp bovis AF2122/97
ggugcggauuuguguac

SEQ ID NO: 1104398 - RNA, 16 nt, Mycobacterium bovis subsp bovis AF2122/97
ggugcuugucgccgcg

SEQ ID NO: 1104399 - RNA, 20 nt, Mycobacterium bovis subsp bovis AF2122/97
ggugcuuucgcgucugcucg

SEQ ID NO: 1104400 - RNA, 12 nt, Mycobacterium bovis subsp bovis AF2122/97
gguugccggcgg

SEQ ID NO: 1104401 - RNA, 14 nt, Mycobacterium bovis subsp bovis AF2122/97
gguugcgacggcgu

SEQ ID NO: 1104402 - RNA, 16 nt, Mycobacterium bovis subsp bovis AF2122/97
gguugccgucugcggu

SEQ ID NO: 1104403 - RNA, 14 nt, Mycobacterium bovis subsp bovis AF2122/97
gguugccgccgacu

SEQ ID NO: 1104404 - RNA, 23 nt, Mycobacterium bovis subsp bovis AF2122/97
gguugccaccugugcgaacagcg

SEQ ID NO: 1104405 - RNA, 14 nt, Mycobacterium bovis subsp bovis AF2122/97
gguugccgaagccg

SEQ ID NO: 1104406 - RNA, 13 nt, Mycobacterium bovis subsp bovis AF2122/97
gguugccagcgac

SEQ ID NO: 1104407 - RNA, 14 nt, Mycobacterium bovis subsp bovis AF2122/97
gguugccagcgacg

SEQ ID NO: 1104408 - RNA, 23 nt, Mycobacterium bovis subsp bovis AF2122/97
gguugccccgaagcgggcggaaa

SEQ ID NO: 1104409 - RNA, 13 nt, Mycobacterium bovis subsp bovis AF2122/97
gguugccccgacc

SEQ ID NO: 1104410 - RNA, 15 nt, Mycobacterium bovis subsp bovis AF2122/97
gguugcaucaugccg

SEQ ID NO: 1104411 - RNA, 17 nt, Mycobacterium bovis subsp bovis AF2122/97
gguugcggcagcuggcg

SEQ ID NO: 1104412 - RNA, 15 nt, Mycobacterium bovis subsp bovis AF2122/97
gguugcggccgucga

SEQ ID NO: 1104413 - RNA, 17 nt, Mycobacterium bovis subsp bovis AF2122/97
gguugcggucaucggcg

SEQ ID NO: 1104414 - RNA, 21 nt, Mycobacterium bovis subsp bovis AF2122/97
gguuucaaagcgacagcgcgg

SEQ ID NO: 1104415 - RNA, 16 nt, Mycobacterium bovis subsp bovis AF2122/97
gguuucaccgacgacg

SEQ ID NO: 1104416 - RNA, 20 nt, Mycobacterium bovis subsp bovis AF2122/97
gguuuccggccugcacggcg

SEQ ID NO: 1104417 - RNA, 13 nt, Mycobacterium bovis subsp bovis AF2122/97
gguuucuuucggc

SEQ ID NO: 1104418 - RNA, 23 nt, Mycobacterium bovis subsp bovis AF2122/97
guaacccagucccaacacggcga

SEQ ID NO: 1104419 - RNA, 13 nt, Mycobacterium bovis subsp bovis AF2122/97
guaaccagcgcca

SEQ ID NO: 1104420 - RNA, 12 nt, Mycobacterium bovis subsp bovis AF2122/97
guaaccuccucg

SEQ ID NO: 1104421 - RNA, 13 nt, Mycobacterium bovis subsp bovis AF2122/97
guaaccgucgccu

SEQ ID NO: 1104422 - RNA, 21 nt, Mycobacterium bovis subsp bovis AF2122/97
guaaccgucgccugccgacga

SEQ ID NO: 1104423 - RNA, 13 nt, Mycobacterium bovis subsp bovis AF2122/97
guaagcaccagcc

SEQ ID NO: 1104424 - RNA, 21 nt, Mycobacterium bovis subsp bovis AF2122/97
guaaacagcgcgccggcgucg

SEQ ID NO: 1104425 - RNA, 19 nt, Mycobacterium bovis subsp bovis AF2122/97
guaaacgucggucggggau

SEQ ID NO: 1104426 - RNA, 16 nt, Mycobacterium bovis subsp bovis AF2122/97
gguucuucgacgcggc

SEQ ID NO: 1104427 - RNA, 17 nt, Mycobacterium bovis subsp bovis AF2122/97
gguugaaaacgcccggc

SEQ ID NO: 1104428 - RNA, 23 nt, Mycobacterium bovis subsp bovis AF2122/97
gguugaaaacgcccggcacacgg

SEQ ID NO: 1104429 - RNA, 15 nt, Mycobacterium bovis subsp bovis AF2122/97
gguugaccaccagcg

SEQ ID NO: 1104430 - RNA, 17 nt, Mycobacterium bovis subsp bovis AF2122/97
gguucuccccgcuagcc

SEQ ID NO: 1104431 - RNA, 21 nt, Mycobacterium bovis subsp bovis AF2122/97
gguugaacauguccagugccg

SEQ ID NO: 1104432 - RNA, 14 nt, Mycobacterium bovis subsp bovis AF2122/97
gguugaacgaccuc

SEQ ID NO: 1104433 - RNA, 20 nt, Mycobacterium bovis subsp bovis AF2122/97
gguugacccccggguagacc

SEQ ID NO: 1104434 - RNA, 14 nt, Mycobacterium bovis subsp bovis AF2122/97
gguugaccgccacc

SEQ ID NO: 1104435 - RNA, 18 nt, Mycobacterium bovis subsp bovis AF2122/97
gguugacguaggcggcgg

SEQ ID NO: 1104436 - RNA, 12 nt, Mycobacterium bovis subsp bovis AF2122/97
gguugaucagcc

SEQ ID NO: 1104437 - RNA, 15 nt, Mycobacterium bovis subsp bovis AF2122/97
gguugagccgccgcg

SEQ ID NO: 1104438 - RNA, 20 nt, Mycobacterium bovis subsp bovis AF2122/97
gguugaggaucccggccggg

SEQ ID NO: 1104439 - RNA, 21 nt, Mycobacterium bovis subsp bovis AF2122/97
gguugaguugcagaccgggug

SEQ ID NO: 1104440 - RNA, 17 nt, Mycobacterium bovis subsp bovis AF2122/97
gguugcaaaccgcugcg

SEQ ID NO: 1104441 - RNA, 14 nt, Mycobacterium bovis subsp bovis AF2122/97
gguugaucgcgcug

SEQ ID NO: 1104442 - RNA, 20 nt, Mycobacterium bovis subsp bovis AF2122/97
gguugaugaaggucaacagc

SEQ ID NO: 1104443 - RNA, 22 nt, Mycobacterium bovis subsp bovis AF2122/97
gguucggcgaucuccggcggau

SEQ ID NO: 1104444 - RNA, 14 nt, Mycobacterium bovis subsp bovis AF2122/97
gguucuucgaauag

SEQ ID NO: 1104445 - RNA, 18 nt, Mycobacterium bovis subsp bovis AF2122/97
gguucuucuccaccaccg

SEQ ID NO: 1104446 - RNA, 17 nt, Mycobacterium bovis subsp bovis AF2122/97
gguucuugaccagcagc

SEQ ID NO: 1104447 - RNA, 18 nt, Mycobacterium bovis subsp bovis AF2122/97
gguucugggccugcggca

SEQ ID NO: 1104448 - RNA, 16 nt, Mycobacterium bovis subsp bovis AF2122/97
gguucgucgucgucgg

SEQ ID NO: 1104449 - RNA, 19 nt, Mycobacterium bovis subsp bovis AF2122/97
gguucgggcagcacccgcg

SEQ ID NO: 1104450 - RNA, 20 nt, Mycobacterium bovis subsp bovis AF2122/97
gguucggaugucucggcacc

SEQ ID NO: 1104451 - RNA, 15 nt, Mycobacterium bovis subsp bovis AF2122/97
gguucgaucgcggug

SEQ ID NO: 1104452 - RNA, 16 nt, Mycobacterium bovis subsp bovis AF2122/97
gguucgcucugguguc

SEQ ID NO: 1104453 - RNA, 23 nt, Mycobacterium bovis subsp bovis AF2122/97
gguucgcgucugacaucgucgac

SEQ ID NO: 1104454 - RNA, 16 nt, Mycobacterium bovis subsp bovis AF2122/97
gguucggacacacagg

SEQ ID NO: 1104455 - RNA, 23 nt, Mycobacterium bovis subsp bovis AF2122/97
gguucaucaagguguugcggugg

SEQ ID NO: 1104456 - RNA, 20 nt, Mycobacterium bovis subsp bovis AF2122/97
gguucagggguggcgcgggc

SEQ ID NO: 1104457 - RNA, 20 nt, Mycobacterium bovis subsp bovis AF2122/97
gguucagccacgcagcacgg

SEQ ID NO: 1104458 - RNA, 22 nt, Mycobacterium bovis subsp bovis AF2122/97
gguucagccacgcagcacggca

SEQ ID NO: 1104459 - RNA, 18 nt, Mycobacterium bovis subsp bovis AF2122/97
gguucacggggaccagau

SEQ ID NO: 1104460 - RNA, 16 nt, Mycobacterium bovis subsp bovis AF2122/97
gguucaucgccggcgc

SEQ ID NO: 1104461 - RNA, 20 nt, Mycobacterium bovis subsp bovis AF2122/97
gguucaucgccggcgcgccg

SEQ ID NO: 1104462 - RNA, 23 nt, Mycobacterium bovis subsp bovis AF2122/97
gguucaugcaaaagccgcgaucg

SEQ ID NO: 1104463 - RNA, 19 nt, Mycobacterium bovis subsp bovis AF2122/97
gguucgcacaccuccucga

SEQ ID NO: 1104464 - RNA, 20 nt, Mycobacterium bovis subsp bovis AF2122/97
gguucgcacaccuccucgac

SEQ ID NO: 1104465 - RNA, 19 nt, Mycobacterium bovis subsp bovis AF2122/97
gguucaccaugucggccac

SEQ ID NO: 1104466 - RNA, 14 nt, Mycobacterium bovis subsp bovis AF2122/97
gguucaacgcgcgc

SEQ ID NO: 1104467 - RNA, 15 nt, Mycobacterium bovis subsp bovis AF2122/97
gguucaccacgucgu

SEQ ID NO: 1104468 - RNA, 16 nt, Mycobacterium bovis subsp bovis AF2122/97
gguucaccucggcgac

SEQ ID NO: 1104469 - RNA, 18 nt, Mycobacterium bovis subsp bovis AF2122/97
gguucaccucggcgacga

SEQ ID NO: 1104470 - RNA, 16 nt, Mycobacterium bovis subsp bovis AF2122/97
gguucacucucggcgc

SEQ ID NO: 1104471 - RNA, 22 nt, Mycobacterium bovis subsp bovis AF2122/97
gguucacuuccgggcagcuggg

SEQ ID NO: 1104472 - RNA, 19 nt, Mycobacterium bovis subsp bovis AF2122/97
gguguuggacacucccggg

SEQ ID NO: 1104473 - RNA, 13 nt, Mycobacterium bovis subsp bovis AF2122/97
gguguugcacgag

SEQ ID NO: 1104474 - RNA, 18 nt, Mycobacterium bovis subsp bovis AF2122/97
gguuauguauccgcgccg

SEQ ID NO: 1104475 - RNA, 19 nt, Mycobacterium bovis subsp bovis AF2122/97
gguguuccggucgcccgag

SEQ ID NO: 1104476 - RNA, 20 nt, Mycobacterium bovis subsp bovis AF2122/97
gguguuccggucgcccgagu

SEQ ID NO: 1104477 - RNA, 20 nt, Mycobacterium bovis subsp bovis AF2122/97
gguguuagugaggcccgagu

SEQ ID NO: 1104478 - RNA, 15 nt, Mycobacterium bovis subsp bovis AF2122/97
gguguguggcgccgg

SEQ ID NO: 1104479 - RNA, 19 nt, Mycobacterium bovis subsp bovis AF2122/97
gguguucaucacgccgccg

SEQ ID NO: 1104480 - RNA, 13 nt, Mycobacterium bovis subsp bovis AF2122/97
gguguugcggugg

SEQ ID NO: 1104481 - RNA, 20 nt, Mycobacterium bovis subsp bovis AF2122/97
gguguugagaucgcccgagu

SEQ ID NO: 1104482 - RNA, 16 nt, Mycobacterium bovis subsp bovis AF2122/97
gguguugagcgaaccc

SEQ ID NO: 1104483 - RNA, 17 nt, Mycobacterium bovis subsp bovis AF2122/97
gguguugaggccgguga

SEQ ID NO: 1104484 - RNA, 18 nt, Mycobacterium bovis subsp bovis AF2122/97
gguguugaggccggugaa

SEQ ID NO: 1104485 - RNA, 15 nt, Mycobacterium bovis subsp bovis AF2122/97
gguguggucgagcgg

SEQ ID NO: 1104486 - RNA, 17 nt, Mycobacterium bovis subsp bovis AF2122/97
gguguggucggcugugg

SEQ ID NO: 1104487 - RNA, 17 nt, Mycobacterium bovis subsp bovis AF2122/97
ggugugucccgggguga

SEQ ID NO: 1104488 - RNA, 20 nt, Mycobacterium bovis subsp bovis AF2122/97
gguguacccgccucgggccg

SEQ ID NO: 1104489 - RNA, 13 nt, Mycobacterium bovis subsp bovis AF2122/97
gguguagccgccg

SEQ ID NO: 1104490 - RNA, 20 nt, Mycobacterium bovis subsp bovis AF2122/97
gguguagccgccggcagugg

SEQ ID NO: 1104491 - RNA, 17 nt, Mycobacterium bovis subsp bovis AF2122/97
gguguagccggcgccgc

SEQ ID NO: 1104492 - RNA, 19 nt, Mycobacterium bovis subsp bovis AF2122/97
gguguagccggcgccgccg

SEQ ID NO: 1104493 - RNA, 16 nt, Mycobacterium bovis subsp bovis AF2122/97
ggugguuccgcgcggc

SEQ ID NO: 1104494 - RNA, 22 nt, Mycobacterium bovis subsp bovis AF2122/97
gguguagaugaacuucccaccc

SEQ ID NO: 1104495 - RNA, 19 nt, Mycobacterium bovis subsp bovis AF2122/97
gguguagcaagucgccgag

SEQ ID NO: 1104496 - RNA, 16 nt, Mycobacterium bovis subsp bovis AF2122/97
gguguacaggucgccg

SEQ ID NO: 1104497 - RNA, 17 nt, Mycobacterium bovis subsp bovis AF2122/97
gguguacagucgcgcgc

SEQ ID NO: 1104498 - RNA, 15 nt, Mycobacterium bovis subsp bovis AF2122/97
cgaaugcggccccga

SEQ ID NO: 1104499 - RNA, 20 nt, Mycobacterium bovis subsp bovis AF2122/97
cgaaugcugggcccgccagc

SEQ ID NO: 1104500 - RNA, 22 nt, Mycobacterium bovis subsp bovis AF2122/97
cgaaugcugggcccgccagccc

SEQ ID NO: 1104501 - RNA, 23 nt, Mycobacterium bovis subsp bovis AF2122/97
cgaaugcugggcccgccagccca

SEQ ID NO: 1104502 - RNA, 19 nt, Mycobacterium bovis subsp bovis AF2122/97
cgaaugccauaaccggugg

SEQ ID NO: 1104503 - RNA, 23 nt, Mycobacterium bovis subsp bovis AF2122/97
cgaauggccgaaccguucggcga

SEQ ID NO: 1104504 - RNA, 19 nt, Mycobacterium bovis subsp bovis AF2122/97
cgaauggcggacagggcgg

SEQ ID NO: 1104505 - RNA, 23 nt, Mycobacterium bovis subsp bovis AF2122/97
cgaauggcggugggcuuggcgcc

SEQ ID NO: 1104506 - RNA, 22 nt, Mycobacterium bovis subsp bovis AF2122/97
cgaaugggggcuggucgccgua

SEQ ID NO: 1104507 - RNA, 17 nt, Mycobacterium bovis subsp bovis AF2122/97
cgaaugguaucgagugg

SEQ ID NO: 1104508 - RNA, 21 nt, Mycobacterium bovis subsp bovis AF2122/97
cgaaugggucuuugcccgcca

SEQ ID NO: 1104509 - RNA, 14 nt, Mycobacterium bovis subsp bovis AF2122/97
cgacacccgcacga

SEQ ID NO: 1104510 - RNA, 21 nt, Mycobacterium bovis subsp bovis AF2122/97
cgacacccgcauggcagcggc

SEQ ID NO: 1104511 - RNA, 23 nt, Mycobacterium bovis subsp bovis AF2122/97
cgacacccgcauggcagcggcgg

SEQ ID NO: 1104512 - RNA, 14 nt, Mycobacterium bovis subsp bovis AF2122/97
cgacacccgcucgg

SEQ ID NO: 1104513 - RNA, 18 nt, Mycobacterium bovis subsp bovis AF2122/97
cgacaccauaggccgacg

SEQ ID NO: 1104514 - RNA, 22 nt, Mycobacterium bovis subsp bovis AF2122/97
cgacaccccgaugccgugccgg

SEQ ID NO: 1104515 - RNA, 13 nt, Mycobacterium bovis subsp bovis AF2122/97
cgacaccgcccga

SEQ ID NO: 1104516 - RNA, 17 nt, Mycobacterium bovis subsp bovis AF2122/97
cgacaccgcccgaccca

SEQ ID NO: 1104517 - RNA, 22 nt, Mycobacterium bovis subsp bovis AF2122/97
cgacaccgccccgccgcgacgg

SEQ ID NO: 1104518 - RNA, 18 nt, Mycobacterium bovis subsp bovis AF2122/97
cgacaccgcggacccgca

SEQ ID NO: 1104519 - RNA, 14 nt, Mycobacterium bovis subsp bovis AF2122/97
cgacaccgcggugc

SEQ ID NO: 1104520 - RNA, 19 nt, Mycobacterium bovis subsp bovis AF2122/97
cgacacccgcucggccguc

SEQ ID NO: 1104521 - RNA, 19 nt, Mycobacterium bovis subsp bovis AF2122/97
cgacacccugggugccggc

SEQ ID NO: 1104522 - RNA, 14 nt, Mycobacterium bovis subsp bovis AF2122/97
cgacaccgacgcgg

SEQ ID NO: 1104523 - RNA, 18 nt, Mycobacterium bovis subsp bovis AF2122/97
cgacaccgacgcggucgg

SEQ ID NO: 1104524 - RNA, 14 nt, Mycobacterium bovis subsp bovis AF2122/97
cgacaccgccacca

SEQ ID NO: 1104525 - RNA, 18 nt, Mycobacterium bovis subsp bovis AF2122/97
cgacaccgcagcgggcgg

SEQ ID NO: 1104526 - RNA, 15 nt, Mycobacterium bovis subsp bovis AF2122/97
cgacaccgcaggugc

SEQ ID NO: 1104527 - RNA, 21 nt, Mycobacterium bovis subsp bovis AF2122/97
cgacaccgcaggugccguggc

SEQ ID NO: 1104528 - RNA, 23 nt, Mycobacterium bovis subsp bovis AF2122/97
cgacaccgcggacccgcagcugc

SEQ ID NO: 1104529 - RNA, 17 nt, Mycobacterium bovis subsp bovis AF2122/97
cgacaccguguugcugu

SEQ ID NO: 1104530 - RNA, 15 nt, Mycobacterium bovis subsp bovis AF2122/97
cgacaccgugucgcc

SEQ ID NO: 1104531 - RNA, 20 nt, Mycobacterium bovis subsp bovis AF2122/97
cgacaccgugaccgccgcgc

SEQ ID NO: 1104532 - RNA, 21 nt, Mycobacterium bovis subsp bovis AF2122/97
cgacaccgugaccgccgcgcc

SEQ ID NO: 1104533 - RNA, 22 nt, Mycobacterium bovis subsp bovis AF2122/97
cgacaccgugaccgccgcgccg

SEQ ID NO: 1104534 - RNA, 15 nt, Mycobacterium bovis subsp bovis AF2122/97
cgacaccguaggcga

SEQ ID NO: 1104535 - RNA, 19 nt, Mycobacterium bovis subsp bovis AF2122/97
cgacaccguccagcagcuc

SEQ ID NO: 1104536 - RNA, 21 nt, Mycobacterium bovis subsp bovis AF2122/97
cgacaccggcugaccgacccg

SEQ ID NO: 1104537 - RNA, 12 nt, Mycobacterium bovis subsp bovis AF2122/97
cgacaccggcgc

SEQ ID NO: 1104538 - RNA, 17 nt, Mycobacterium bovis subsp bovis AF2122/97
cgacaccggcgcccuca

SEQ ID NO: 1104539 - RNA, 17 nt, Mycobacterium bovis subsp bovis AF2122/97
cgacaccggccgcgacg

SEQ ID NO: 1104540 - RNA, 18 nt, Mycobacterium bovis subsp bovis AF2122/97
cgacaccuccgucagcgc

SEQ ID NO: 1104541 - RNA, 19 nt, Mycobacterium bovis subsp bovis AF2122/97
cgacaccuccgucagcgcc

SEQ ID NO: 1104542 - RNA, 20 nt, Mycobacterium bovis subsp bovis AF2122/97
cgacaccucgaaggcacugc

SEQ ID NO: 1104543 - RNA, 14 nt, Mycobacterium bovis subsp bovis AF2122/97
cgacacgccagccg

SEQ ID NO: 1104544 - RNA, 14 nt, Mycobacterium bovis subsp bovis AF2122/97
cgacacgccaggug

SEQ ID NO: 1104545 - RNA, 17 nt, Mycobacterium bovis subsp bovis AF2122/97
cgacacgccauccacga

SEQ ID NO: 1104546 - RNA, 13 nt, Mycobacterium bovis subsp bovis AF2122/97
cgacacgccgaac

SEQ ID NO: 1104547 - RNA, 14 nt, Mycobacterium bovis subsp bovis AF2122/97
cgacacgccgaugc

SEQ ID NO: 1104548 - RNA, 15 nt, Mycobacterium bovis subsp bovis AF2122/97
cgacacgccgaugcc

SEQ ID NO: 1104549 - RNA, 16 nt, Mycobacterium bovis subsp bovis AF2122/97
cgacacgccgcaucgg

SEQ ID NO: 1104550 - RNA, 22 nt, Mycobacterium bovis subsp bovis AF2122/97
cgacacgccgaacgugcggugg

SEQ ID NO: 1104551 - RNA, 13 nt, Mycobacterium bovis subsp bovis AF2122/97
cgacacgccgugc

SEQ ID NO: 1104552 - RNA, 16 nt, Mycobacterium bovis subsp bovis AF2122/97
cgacacgccugggcga

SEQ ID NO: 1104553 - RNA, 20 nt, Mycobacterium bovis subsp bovis AF2122/97
cgacagccgauccgaucgca

SEQ ID NO: 1104554 - RNA, 22 nt, Mycobacterium bovis subsp bovis AF2122/97
cgacagccgauccgaucgcaga

SEQ ID NO: 1104555 - RNA, 14 nt, Mycobacterium bovis subsp bovis AF2122/97
cgacagccguggcg

SEQ ID NO: 1104556 - RNA, 14 nt, Mycobacterium bovis subsp bovis AF2122/97
cgacagcccgccgg

SEQ ID NO: 1104557 - RNA, 17 nt, Mycobacterium bovis subsp bovis AF2122/97
cgacagccgauccgauc

SEQ ID NO: 1104558 - RNA, 22 nt, Mycobacterium bovis subsp bovis AF2122/97
cgacacggcggcugcggcgucg

SEQ ID NO: 1104559 - RNA, 23 nt, Mycobacterium bovis subsp bovis AF2122/97
cgacagccccgcggccagcagca

SEQ ID NO: 1104560 - RNA, 13 nt, Mycobacterium bovis subsp bovis AF2122/97
cgacagcgcggcg

SEQ ID NO: 1104561 - RNA, 15 nt, Mycobacterium bovis subsp bovis AF2122/97
cgacagcgcggcgcg

SEQ ID NO: 1104562 - RNA, 14 nt, Mycobacterium bovis subsp bovis AF2122/97
cgacagcggacccc

SEQ ID NO: 1104563 - RNA, 14 nt, Mycobacterium bovis subsp bovis AF2122/97
cgacagcggcaccg

SEQ ID NO: 1104564 - RNA, 18 nt, Mycobacterium bovis subsp bovis AF2122/97
cgacagcuuggccgguuc

SEQ ID NO: 1104565 - RNA, 14 nt, Mycobacterium bovis subsp bovis AF2122/97
cgacaggccaccgc

SEQ ID NO: 1104566 - RNA, 16 nt, Mycobacterium bovis subsp bovis AF2122/97
cgacagcuuggccggu

SEQ ID NO: 1104567 - RNA, 17 nt, Mycobacterium bovis subsp bovis AF2122/97
cgaaggggugcccggcg

SEQ ID NO: 1104568 - RNA, 18 nt, Mycobacterium bovis subsp bovis AF2122/97
cgaagguccgugccgaug

SEQ ID NO: 1104569 - RNA, 20 nt, Mycobacterium bovis subsp bovis AF2122/97
cgaagguccgugccgaugcc

SEQ ID NO: 1104570 - RNA, 21 nt, Mycobacterium bovis subsp bovis AF2122/97
cgaaggucgguaccccagcgc

SEQ ID NO: 1104571 - RNA, 22 nt, Mycobacterium bovis subsp bovis AF2122/97
cgaaggucucgaaagccgcggc

SEQ ID NO: 1104572 - RNA, 18 nt, Mycobacterium bovis subsp bovis AF2122/97
cgaaggugacaaaucggc

SEQ ID NO: 1104573 - RNA, 20 nt, Mycobacterium bovis subsp bovis AF2122/97
cgaaggugaugaacaccggc

SEQ ID NO: 1104574 - RNA, 21 nt, Mycobacterium bovis subsp bovis AF2122/97
cgaaggugaugaacaccggcg

SEQ ID NO: 1104575 - RNA, 23 nt, Mycobacterium bovis subsp bovis AF2122/97
cgaagguggcgaaaucgucgaac

SEQ ID NO: 1104576 - RNA, 23 nt, Mycobacterium bovis subsp bovis AF2122/97
cgaaguaauagcuguuggccagc

SEQ ID NO: 1104577 - RNA, 20 nt, Mycobacterium bovis subsp bovis AF2122/97
cgaaguagaagcccaggacg

SEQ ID NO: 1104578 - RNA, 15 nt, Mycobacterium bovis subsp bovis AF2122/97
cgaaguagccgaccg

SEQ ID NO: 1104579 - RNA, 15 nt, Mycobacterium bovis subsp bovis AF2122/97
cgaaguacuggccgc

SEQ ID NO: 1104580 - RNA, 16 nt, Mycobacterium bovis subsp bovis AF2122/97
cgaaguacuggccgcc

SEQ ID NO: 1104581 - RNA, 17 nt, Mycobacterium bovis subsp bovis AF2122/97
cgaagucacgcacccgg

SEQ ID NO: 1104582 - RNA, 18 nt, Mycobacterium bovis subsp bovis AF2122/97
cgaagucacgcacccggc

SEQ ID NO: 1104583 - RNA, 18 nt, Mycobacterium bovis subsp bovis AF2122/97
cgaaguccacgcaccacg

SEQ ID NO: 1104584 - RNA, 21 nt, Mycobacterium bovis subsp bovis AF2122/97
cgaaguccaccacgacgucgg

SEQ ID NO: 1104585 - RNA, 22 nt, Mycobacterium bovis subsp bovis AF2122/97
cgaaguccaccacgacgucggu

SEQ ID NO: 1104586 - RNA, 20 nt, Mycobacterium bovis subsp bovis AF2122/97
cgaaguccacgcaccacgag

SEQ ID NO: 1104587 - RNA, 18 nt, Mycobacterium bovis subsp bovis AF2122/97
cgaaguccgcuugggcgg

SEQ ID NO: 1104588 - RNA, 14 nt, Mycobacterium bovis subsp bovis AF2122/97
cgaagauaucggca

SEQ ID NO: 1104589 - RNA, 14 nt, Mycobacterium bovis subsp bovis AF2122/97
cgaagaucagcgga

SEQ ID NO: 1104590 - RNA, 17 nt, Mycobacterium bovis subsp bovis AF2122/97
cgaagaugaccucggcg

SEQ ID NO: 1104591 - RNA, 19 nt, Mycobacterium bovis subsp bovis AF2122/97
cgaagaugccuggaaucgc

SEQ ID NO: 1104592 - RNA, 19 nt, Mycobacterium bovis subsp bovis AF2122/97
cgaagaucuucaccggccg

SEQ ID NO: 1104593 - RNA, 15 nt, Mycobacterium bovis subsp bovis AF2122/97
cgaagaugaccucgg

SEQ ID NO: 1104594 - RNA, 18 nt, Mycobacterium bovis subsp bovis AF2122/97
cgaagauggccagcgcgg

SEQ ID NO: 1104595 - RNA, 17 nt, Mycobacterium bovis subsp bovis AF2122/97
cgaagauggccagcgcg

SEQ ID NO: 1104596 - RNA, 13 nt, Mycobacterium bovis subsp bovis AF2122/97
cgaagauggccag

SEQ ID NO: 1104597 - RNA, 13 nt, Mycobacterium bovis subsp bovis AF2122/97
cgaagcacaccgu

SEQ ID NO: 1104598 - RNA, 14 nt, Mycobacterium bovis subsp bovis AF2122/97
cgaagcacaccguc

SEQ ID NO: 1104599 - RNA, 20 nt, Mycobacterium bovis subsp bovis AF2122/97
cgaagcacaccguccgucgg

SEQ ID NO: 1104600 - RNA, 23 nt, Mycobacterium bovis subsp bovis AF2122/97
cgaagcacaccguccgucggcgc

SEQ ID NO: 1104601 - RNA, 14 nt, Mycobacterium bovis subsp bovis AF2122/97
cgaagccagaucgc

SEQ ID NO: 1104602 - RNA, 14 nt, Mycobacterium bovis subsp bovis AF2122/97
cgaagccaccaggu

SEQ ID NO: 1104603 - RNA, 17 nt, Mycobacterium bovis subsp bovis AF2122/97
cgaagccaccaggucga

SEQ ID NO: 1104604 - RNA, 19 nt, Mycobacterium bovis subsp bovis AF2122/97
cgaagccagaucgcuagga

SEQ ID NO: 1104605 - RNA, 12 nt, Mycobacterium bovis subsp bovis AF2122/97
cgaagcccagca

SEQ ID NO: 1104606 - RNA, 20 nt, Mycobacterium bovis subsp bovis AF2122/97
cgaagggaucacgaccgcgc

SEQ ID NO: 1104607 - RNA, 15 nt, Mycobacterium bovis subsp bovis AF2122/97
cgaagggcaccggcg

SEQ ID NO: 1104608 - RNA, 15 nt, Mycobacterium bovis subsp bovis AF2122/97
cgaaugacggccagu

SEQ ID NO: 1104609 - RNA, 22 nt, Mycobacterium bovis subsp bovis AF2122/97
cgaaugaucgucccgcggcgcg

SEQ ID NO: 1104610 - RNA, 18 nt, Mycobacterium bovis subsp bovis AF2122/97
cgaaugccaccucgacgc

SEQ ID NO: 1104611 - RNA, 19 nt, Mycobacterium bovis subsp bovis AF2122/97
cgaaucugccggccggcgg

SEQ ID NO: 1104612 - RNA, 20 nt, Mycobacterium bovis subsp bovis AF2122/97
cgaaucgggucggccgcugg

SEQ ID NO: 1104613 - RNA, 14 nt, Mycobacterium bovis subsp bovis AF2122/97
cgaaucgugucgcc

SEQ ID NO: 1104614 - RNA, 17 nt, Mycobacterium bovis subsp bovis AF2122/97
cgaaucgcugccgccga

SEQ ID NO: 1104615 - RNA, 13 nt, Mycobacterium bovis subsp bovis AF2122/97
cgaaucucaccgu

SEQ ID NO: 1104616 - RNA, 14 nt, Mycobacterium bovis subsp bovis AF2122/97
cgaaucuccgcgcg

SEQ ID NO: 1104617 - RNA, 17 nt, Mycobacterium bovis subsp bovis AF2122/97
cgaaucgcgacgcgacg

SEQ ID NO: 1104618 - RNA, 15 nt, Mycobacterium bovis subsp bovis AF2122/97
cgaaucgcgucgagc

SEQ ID NO: 1104619 - RNA, 16 nt, Mycobacterium bovis subsp bovis AF2122/97
cgaaucgcugaccgcg

SEQ ID NO: 1104620 - RNA, 21 nt, Mycobacterium bovis subsp bovis AF2122/97
cgaaucgcugaccgcguagac

SEQ ID NO: 1104621 - RNA, 15 nt, Mycobacterium bovis subsp bovis AF2122/97
cgaaucgcugccgcc

SEQ ID NO: 1104622 - RNA, 14 nt, Mycobacterium bovis subsp bovis AF2122/97
cgaaucgcccaucg

SEQ ID NO: 1104623 - RNA, 12 nt, Mycobacterium bovis subsp bovis AF2122/97
cgaagucgacga

SEQ ID NO: 1104624 - RNA, 17 nt, Mycobacterium bovis subsp bovis AF2122/97
cgaagucgucgagguca

SEQ ID NO: 1104625 - RNA, 20 nt, Mycobacterium bovis subsp bovis AF2122/97
cgaagucgucgaggucacgc

SEQ ID NO: 1104626 - RNA, 15 nt, Mycobacterium bovis subsp bovis AF2122/97
cgaagugacccgaac

SEQ ID NO: 1104627 - RNA, 22 nt, Mycobacterium bovis subsp bovis AF2122/97
cgaagugggucaagaucggugc

SEQ ID NO: 1104628 - RNA, 16 nt, Mycobacterium bovis subsp bovis AF2122/97
cgaagugcaggugcgg

SEQ ID NO: 1104629 - RNA, 21 nt, Mycobacterium bovis subsp bovis AF2122/97
cgaagugcaggugcgggccgg

SEQ ID NO: 1104630 - RNA, 14 nt, Mycobacterium bovis subsp bovis AF2122/97
cgaaguuccagccg

SEQ ID NO: 1104631 - RNA, 16 nt, Mycobacterium bovis subsp bovis AF2122/97
cgaaguggugaccgac

SEQ ID NO: 1104632 - RNA, 20 nt, Mycobacterium bovis subsp bovis AF2122/97
cgaaguggugaccgacgcgg

SEQ ID NO: 1104633 - RNA, 16 nt, Mycobacterium bovis subsp bovis AF2122/97
cgaagugucgcugcaa

SEQ ID NO: 1104634 - RNA, 23 nt, Mycobacterium bovis subsp bovis AF2122/97
cgaaguucucggugcgcagcugc

SEQ ID NO: 1104635 - RNA, 17 nt, Mycobacterium bovis subsp bovis AF2122/97
cgaaguugaugucgcgu

SEQ ID NO: 1104636 - RNA, 16 nt, Mycobacterium bovis subsp bovis AF2122/97
cgaccagcucagcugc

SEQ ID NO: 1104637 - RNA, 18 nt, Mycobacterium bovis subsp bovis AF2122/97
cgaccagcuggccguacu

SEQ ID NO: 1104638 - RNA, 21 nt, Mycobacterium bovis subsp bovis AF2122/97
cgaccaggaacggcucggccg

SEQ ID NO: 1104639 - RNA, 22 nt, Mycobacterium bovis subsp bovis AF2122/97
cgaccaggaacggcucggccgg

SEQ ID NO: 1104640 - RNA, 16 nt, Mycobacterium bovis subsp bovis AF2122/97
cgaccagcugagcugg

SEQ ID NO: 1104641 - RNA, 16 nt, Mycobacterium bovis subsp bovis AF2122/97
cgaccaggaccaccgc

SEQ ID NO: 1104642 - RNA, 17 nt, Mycobacterium bovis subsp bovis AF2122/97
cgaccaggaccaccgca

SEQ ID NO: 1104643 - RNA, 19 nt, Mycobacterium bovis subsp bovis AF2122/97
cgaccaggccacugccgac

SEQ ID NO: 1104644 - RNA, 20 nt, Mycobacterium bovis subsp bovis AF2122/97
cgaccaggagccuccagcgc

SEQ ID NO: 1104645 - RNA, 13 nt, Mycobacterium bovis subsp bovis AF2122/97
cgaccagcgccga

SEQ ID NO: 1104646 - RNA, 19 nt, Mycobacterium bovis subsp bovis AF2122/97
cgaccagcggccgaccgcg

SEQ ID NO: 1104647 - RNA, 15 nt, Mycobacterium bovis subsp bovis AF2122/97
cgaccagcgcuagcg

SEQ ID NO: 1104648 - RNA, 18 nt, Mycobacterium bovis subsp bovis AF2122/97
cgaccagcggccgaccgc

SEQ ID NO: 1104649 - RNA, 19 nt, Mycobacterium bovis subsp bovis AF2122/97
cgaccagcgccgcacccgc

SEQ ID NO: 1104650 - RNA, 14 nt, Mycobacterium bovis subsp bovis AF2122/97
cgaccacgaugauc

SEQ ID NO: 1104651 - RNA, 23 nt, Mycobacterium bovis subsp bovis AF2122/97
cgaccagcacccgcucggccgcc

SEQ ID NO: 1104652 - RNA, 13 nt, Mycobacterium bovis subsp bovis AF2122/97
cgaccagccccgc

SEQ ID NO: 1104653 - RNA, 14 nt, Mycobacterium bovis subsp bovis AF2122/97
cgaccagcacccgc

SEQ ID NO: 1104654 - RNA, 19 nt, Mycobacterium bovis subsp bovis AF2122/97
cgaccagagccgcgagcac

SEQ ID NO: 1104655 - RNA, 21 nt, Mycobacterium bovis subsp bovis AF2122/97
cgaccagagcuucgccgcgca

SEQ ID NO: 1104656 - RNA, 21 nt, Mycobacterium bovis subsp bovis AF2122/97
cgaccagaggcgugucgacuc

SEQ ID NO: 1104657 - RNA, 17 nt, Mycobacterium bovis subsp bovis AF2122/97
cgaccagaaucgggccg

SEQ ID NO: 1104658 - RNA, 20 nt, Mycobacterium bovis subsp bovis AF2122/97
cgaccagaaucucgccgggc

SEQ ID NO: 1104659 - RNA, 19 nt, Mycobacterium bovis subsp bovis AF2122/97
cgaccagauagaacaacgu

SEQ ID NO: 1104660 - RNA, 22 nt, Mycobacterium bovis subsp bovis AF2122/97
cgaccacugcccgggguccauc

SEQ ID NO: 1104661 - RNA, 19 nt, Mycobacterium bovis subsp bovis AF2122/97
cgaccagguagaccaggug

SEQ ID NO: 1104662 - RNA, 15 nt, Mycobacterium bovis subsp bovis AF2122/97
cgaccagggccgccg

SEQ ID NO: 1104663 - RNA, 16 nt, Mycobacterium bovis subsp bovis AF2122/97
cgaccagggccgccgc

SEQ ID NO: 1104664 - RNA, 17 nt, Mycobacterium bovis subsp bovis AF2122/97
cgaccagggccgccgcu

SEQ ID NO: 1104665 - RNA, 22 nt, Mycobacterium bovis subsp bovis AF2122/97
cgaccaggucggcuucgacaac

SEQ ID NO: 1104666 - RNA, 24 nt, Mycobacterium bovis subsp bovis AF2122/97
cgaccaguucggaaucggagccgu

SEQ ID NO: 1104667 - RNA, 18 nt, Mycobacterium bovis subsp bovis AF2122/97
cgaccauacccgcgcgca

SEQ ID NO: 1104668 - RNA, 22 nt, Mycobacterium bovis subsp bovis AF2122/97
cgaccagucgacgucucuggug

SEQ ID NO: 1104669 - RNA, 20 nt, Mycobacterium bovis subsp bovis AF2122/97
cgaccaggucgccagcucgg

SEQ ID NO: 1104670 - RNA, 17 nt, Mycobacterium bovis subsp bovis AF2122/97
cgaccaugagccggcgc

SEQ ID NO: 1104671 - RNA, 18 nt, Mycobacterium bovis subsp bovis AF2122/97
cgaccaugagccggcgcc

SEQ ID NO: 1104672 - RNA, 22 nt, Mycobacterium bovis subsp bovis AF2122/97
cgaccaugagccggcgccgccg

SEQ ID NO: 1104673 - RNA, 22 nt, Mycobacterium bovis subsp bovis AF2122/97
cgaccaugaugccuaccgggcc

SEQ ID NO: 1104674 - RNA, 14 nt, Mycobacterium bovis subsp bovis AF2122/97
cgaccaucgcgacg

SEQ ID NO: 1104675 - RNA, 18 nt, Mycobacterium bovis subsp bovis AF2122/97
cgaccaucucgacgucgg

SEQ ID NO: 1104676 - RNA, 20 nt, Mycobacterium bovis subsp bovis AF2122/97
cgaccaucucgacgucggug

SEQ ID NO: 1104677 - RNA, 21 nt, Mycobacterium bovis subsp bovis AF2122/97
cgaccaucugaucgggcccgu

SEQ ID NO: 1104678 - RNA, 21 nt, Mycobacterium bovis subsp bovis AF2122/97
cgaccaugguagcgccccgau

SEQ ID NO: 1104679 - RNA, 22 nt, Mycobacterium bovis subsp bovis AF2122/97
cgaccaugguagcgccccgaug

SEQ ID NO: 1104680 - RNA, 19 nt, Mycobacterium bovis subsp bovis AF2122/97
cgaccaucaccacggccgc

SEQ ID NO: 1104681 - RNA, 20 nt, Mycobacterium bovis subsp bovis AF2122/97
cgaccaucaccacggccgcc

SEQ ID NO: 1104682 - RNA, 21 nt, Mycobacterium bovis subsp bovis AF2122/97
cgaccaucaccacggccgccg

SEQ ID NO: 1104683 - RNA, 20 nt, Mycobacterium bovis subsp bovis AF2122/97
cgaccauaagcucguagagc

SEQ ID NO: 1104684 - RNA, 13 nt, Mycobacterium bovis subsp bovis AF2122/97
cgaccauacccgc

SEQ ID NO: 1104685 - RNA, 16 nt, Mycobacterium bovis subsp bovis AF2122/97
cgacccaacgaccacc

SEQ ID NO: 1104686 - RNA, 16 nt, Mycobacterium bovis subsp bovis AF2122/97
cgacccaagucgccga

SEQ ID NO: 1104687 - RNA, 15 nt, Mycobacterium bovis subsp bovis AF2122/97
cgacauggcggugcg

SEQ ID NO: 1104688 - RNA, 22 nt, Mycobacterium bovis subsp bovis AF2122/97
cgacauggcggugcgcagcuug

SEQ ID NO: 1104689 - RNA, 17 nt, Mycobacterium bovis subsp bovis AF2122/97
cgacaugggcaggccgc

SEQ ID NO: 1104690 - RNA, 19 nt, Mycobacterium bovis subsp bovis AF2122/97
cgacaugguccgaccagcg

SEQ ID NO: 1104691 - RNA, 20 nt, Mycobacterium bovis subsp bovis AF2122/97
cgacaugguccgaccagcgg

SEQ ID NO: 1104692 - RNA, 21 nt, Mycobacterium bovis subsp bovis AF2122/97
cgacaugguccgaccagcggc

SEQ ID NO: 1104693 - RNA, 13 nt, Mycobacterium bovis subsp bovis AF2122/97
cgacaugcgccga

SEQ ID NO: 1104694 - RNA, 17 nt, Mycobacterium bovis subsp bovis AF2122/97
cgacaugcgccgagauc

SEQ ID NO: 1104695 - RNA, 19 nt, Mycobacterium bovis subsp bovis AF2122/97
cgaccaaaccgacgcgggc

SEQ ID NO: 1104696 - RNA, 23 nt, Mycobacterium bovis subsp bovis AF2122/97
cgaccaaaccgacgcgggccgcg

SEQ ID NO: 1104697 - RNA, 22 nt, Mycobacterium bovis subsp bovis AF2122/97
cgaccaaaccgcuguaaccggu

SEQ ID NO: 1104698 - RNA, 15 nt, Mycobacterium bovis subsp bovis AF2122/97
cgaccaacacgucga

SEQ ID NO: 1104699 - RNA, 18 nt, Mycobacterium bovis subsp bovis AF2122/97
cgaccaagucaugcccac

SEQ ID NO: 1104700 - RNA, 18 nt, Mycobacterium bovis subsp bovis AF2122/97
cgacauugccacggcgcc

SEQ ID NO: 1104701 - RNA, 15 nt, Mycobacterium bovis subsp bovis AF2122/97
cgacaguggcucacc

SEQ ID NO: 1104702 - RNA, 17 nt, Mycobacterium bovis subsp bovis AF2122/97
cgacaguggucccggug

SEQ ID NO: 1104703 - RNA, 17 nt, Mycobacterium bovis subsp bovis AF2122/97
cgacaguccgcgccggc

SEQ ID NO: 1104704 - RNA, 18 nt, Mycobacterium bovis subsp bovis AF2122/97
cgacagucaacagggcca

SEQ ID NO: 1104705 - RNA, 21 nt, Mycobacterium bovis subsp bovis AF2122/97
cgacagucaacagggccagga

SEQ ID NO: 1104706 - RNA, 15 nt, Mycobacterium bovis subsp bovis AF2122/97
cgacagucaacaggg

SEQ ID NO: 1104707 - RNA, 17 nt, Mycobacterium bovis subsp bovis AF2122/97
cgacaguugcgccagcg

SEQ ID NO: 1104708 - RNA, 20 nt, Mycobacterium bovis subsp bovis AF2122/97
cgacauacgucggggccgca

SEQ ID NO: 1104709 - RNA, 20 nt, Mycobacterium bovis subsp bovis AF2122/97
cgacaguuuaccgugccgcc

SEQ ID NO: 1104710 - RNA, 21 nt, Mycobacterium bovis subsp bovis AF2122/97
cgacaguuuaccgugccgccc

SEQ ID NO: 1104711 - RNA, 16 nt, Mycobacterium bovis subsp bovis AF2122/97
cgacaguuuucaccgc

SEQ ID NO: 1104712 - RNA, 22 nt, Mycobacterium bovis subsp bovis AF2122/97
cgaccaccggguagccggcgug

SEQ ID NO: 1104713 - RNA, 12 nt, Mycobacterium bovis subsp bovis AF2122/97
cgaccaccgcgg

SEQ ID NO: 1104714 - RNA, 20 nt, Mycobacterium bovis subsp bovis AF2122/97
cgaccaccgcggcugcuccg

SEQ ID NO: 1104715 - RNA, 22 nt, Mycobacterium bovis subsp bovis AF2122/97
cgaccaccgcgucgggccgcaa

SEQ ID NO: 1104716 - RNA, 14 nt, Mycobacterium bovis subsp bovis AF2122/97
cgaccaccgucacg

SEQ ID NO: 1104717 - RNA, 22 nt, Mycobacterium bovis subsp bovis AF2122/97
cgaccaccgccggcccgcgggc

SEQ ID NO: 1104718 - RNA, 13 nt, Mycobacterium bovis subsp bovis AF2122/97
cgaccaccgccgg

SEQ ID NO: 1104719 - RNA, 16 nt, Mycobacterium bovis subsp bovis AF2122/97
cgaccaccgccggccc

SEQ ID NO: 1104720 - RNA, 15 nt, Mycobacterium bovis subsp bovis AF2122/97
cgaccaccgccgagc

SEQ ID NO: 1104721 - RNA, 19 nt, Mycobacterium bovis subsp bovis AF2122/97
cgaccaccgccgagccugc

SEQ ID NO: 1104722 - RNA, 18 nt, Mycobacterium bovis subsp bovis AF2122/97
cgaccaccuucugacgcg

SEQ ID NO: 1104723 - RNA, 14 nt, Mycobacterium bovis subsp bovis AF2122/97
cgaccacgcaccgc

SEQ ID NO: 1104724 - RNA, 18 nt, Mycobacterium bovis subsp bovis AF2122/97
cgaccacgccgccggcgc

SEQ ID NO: 1104725 - RNA, 18 nt, Mycobacterium bovis subsp bovis AF2122/97
cgaccacggucugccacg

SEQ ID NO: 1104726 - RNA, 14 nt, Mycobacterium bovis subsp bovis AF2122/97
cgaccacuagccca

SEQ ID NO: 1104727 - RNA, 14 nt, Mycobacterium bovis subsp bovis AF2122/97
cgaccacuccacgc

SEQ ID NO: 1104728 - RNA, 20 nt, Mycobacterium bovis subsp bovis AF2122/97
cgaccacaucaugccagccg

SEQ ID NO: 1104729 - RNA, 17 nt, Mycobacterium bovis subsp bovis AF2122/97
cgaccaccaccgccgcc

SEQ ID NO: 1104730 - RNA, 19 nt, Mycobacterium bovis subsp bovis AF2122/97
cgaccaccaccgccgccga

SEQ ID NO: 1104731 - RNA, 21 nt, Mycobacterium bovis subsp bovis AF2122/97
cgaccaccaccgccgccgaag

SEQ ID NO: 1104732 - RNA, 15 nt, Mycobacterium bovis subsp bovis AF2122/97
cgaccaauuggucga

SEQ ID NO: 1104733 - RNA, 22 nt, Mycobacterium bovis subsp bovis AF2122/97
cgaccaaugcguugacgucgag

SEQ ID NO: 1104734 - RNA, 15 nt, Mycobacterium bovis subsp bovis AF2122/97
cgaccaauucgcaau

SEQ ID NO: 1104735 - RNA, 18 nt, Mycobacterium bovis subsp bovis AF2122/97
cgaccaauucgcaaucgg

SEQ ID NO: 1104736 - RNA, 17 nt, Mycobacterium bovis subsp bovis AF2122/97
cgaccaauaggucccca

SEQ ID NO: 1104737 - RNA, 21 nt, Mycobacterium bovis subsp bovis AF2122/97
cgaccaauaccaguccguuca

SEQ ID NO: 1104738 - RNA, 15 nt, Mycobacterium bovis subsp bovis AF2122/97
cgaccaauagcacgg

SEQ ID NO: 1104739 - RNA, 18 nt, Mycobacterium bovis subsp bovis AF2122/97
cgaccaccagagcgucga

SEQ ID NO: 1104740 - RNA, 13 nt, Mycobacterium bovis subsp bovis AF2122/97
cgaccaccagcgc

SEQ ID NO: 1104741 - RNA, 14 nt, Mycobacterium bovis subsp bovis AF2122/97
cgaccaccagcgcc

SEQ ID NO: 1104742 - RNA, 19 nt, Mycobacterium bovis subsp bovis AF2122/97
cgaccaccagagcgucgaa

SEQ ID NO: 1104743 - RNA, 20 nt, Mycobacterium bovis subsp bovis AF2122/97
cgaccaccagagcgucgaac

SEQ ID NO: 1104744 - RNA, 15 nt, Mycobacterium bovis subsp bovis AF2122/97
ccugucgcgcaccgg

SEQ ID NO: 1104745 - RNA, 13 nt, Mycobacterium bovis subsp bovis AF2122/97
ccuguccggcgcc

SEQ ID NO: 1104746 - RNA, 20 nt, Mycobacterium bovis subsp bovis AF2122/97
ccuguccggguagcggcgcc

SEQ ID NO: 1104747 - RNA, 14 nt, Mycobacterium bovis subsp bovis AF2122/97
ccugugccgccggc

SEQ ID NO: 1104748 - RNA, 17 nt, Mycobacterium bovis subsp bovis AF2122/97
ccugugccgccggcgcc

SEQ ID NO: 1104749 - RNA, 23 nt, Mycobacterium bovis subsp bovis AF2122/97
ccugucgggucgaguccgacggg

SEQ ID NO: 1104750 - RNA, 19 nt, Mycobacterium bovis subsp bovis AF2122/97
ccugugccagcagcagcgc

SEQ ID NO: 1104751 - RNA, 19 nt, Mycobacterium bovis subsp bovis AF2122/97
ccuguucgagaucgccgag

SEQ ID NO: 1104752 - RNA, 14 nt, Mycobacterium bovis subsp bovis AF2122/97
ccuguucgccgucg

SEQ ID NO: 1104753 - RNA, 23 nt, Mycobacterium bovis subsp bovis AF2122/97
ccuguggggauuccgcacccccg

SEQ ID NO: 1104754 - RNA, 17 nt, Mycobacterium bovis subsp bovis AF2122/97
ccugugcgcggugacga

SEQ ID NO: 1104755 - RNA, 15 nt, Mycobacterium bovis subsp bovis AF2122/97
ccugugcugccaacg

SEQ ID NO: 1104756 - RNA, 16 nt, Mycobacterium bovis subsp bovis AF2122/97
ccugugcugccaacgg

SEQ ID NO: 1104757 - RNA, 22 nt, Mycobacterium bovis subsp bovis AF2122/97
ccuggccagcagagcggcacgc

SEQ ID NO: 1104758 - RNA, 22 nt, Mycobacterium bovis subsp bovis AF2122/97
ccuggccaucgagggcaucggg

SEQ ID NO: 1104759 - RNA, 21 nt, Mycobacterium bovis subsp bovis AF2122/97
ccuguccuuggcgaacgccac

SEQ ID NO: 1104760 - RNA, 23 nt, Mycobacterium bovis subsp bovis AF2122/97
ccuggcacccggggugcccggcc

SEQ ID NO: 1104761 - RNA, 19 nt, Mycobacterium bovis subsp bovis AF2122/97
ccuggcaacgacacgccgc

SEQ ID NO: 1104762 - RNA, 17 nt, Mycobacterium bovis subsp bovis AF2122/97
ccuggaugggcucgacg

SEQ ID NO: 1104763 - RNA, 16 nt, Mycobacterium bovis subsp bovis AF2122/97
ccuggauggguugacg

SEQ ID NO: 1104764 - RNA, 14 nt, Mycobacterium bovis subsp bovis AF2122/97
ccuuaagccggcgc

SEQ ID NO: 1104765 - RNA, 21 nt, Mycobacterium bovis subsp bovis AF2122/97
ccuuaugcgcggugaccgggu

SEQ ID NO: 1104766 - RNA, 19 nt, Mycobacterium bovis subsp bovis AF2122/97
ccuuaucgcucucggucag

SEQ ID NO: 1104767 - RNA, 20 nt, Mycobacterium bovis subsp bovis AF2122/97
ccuguuugacugcgaccggu

SEQ ID NO: 1104768 - RNA, 14 nt, Mycobacterium bovis subsp bovis AF2122/97
ccuguuguugucgg

SEQ ID NO: 1104769 - RNA, 19 nt, Mycobacterium bovis subsp bovis AF2122/97
ccuguucggcccgaggugc

SEQ ID NO: 1104770 - RNA, 22 nt, Mycobacterium bovis subsp bovis AF2122/97
ccuucgaugaaauccuccuccg

SEQ ID NO: 1104771 - RNA, 21 nt, Mycobacterium bovis subsp bovis AF2122/97
ccuucgaaacgguaaucgcga

SEQ ID NO: 1104772 - RNA, 16 nt, Mycobacterium bovis subsp bovis AF2122/97
ccuuccuggcgggcgc

SEQ ID NO: 1104773 - RNA, 18 nt, Mycobacterium bovis subsp bovis AF2122/97
ccuucaacuuacgcgacg

SEQ ID NO: 1104774 - RNA, 20 nt, Mycobacterium bovis subsp bovis AF2122/97
ccuuggucgcgucggcugcc

SEQ ID NO: 1104775 - RNA, 17 nt, Mycobacterium bovis subsp bovis AF2122/97
ccuuggcgggaucgaga

SEQ ID NO: 1104776 - RNA, 14 nt, Mycobacterium bovis subsp bovis AF2122/97
ccuuggucgccggc

SEQ ID NO: 1104777 - RNA, 14 nt, Mycobacterium bovis subsp bovis AF2122/97
ccuugguagccggc

SEQ ID NO: 1104778 - RNA, 16 nt, Mycobacterium bovis subsp bovis AF2122/97
ccuugguggccagcca

SEQ ID NO: 1104779 - RNA, 15 nt, Mycobacterium bovis subsp bovis AF2122/97
ccuugguuagccgcg

SEQ ID NO: 1104780 - RNA, 22 nt, Mycobacterium bovis subsp bovis AF2122/97
ccuugguuagccgcggcccgcg

SEQ ID NO: 1104781 - RNA, 19 nt, Mycobacterium bovis subsp bovis AF2122/97
ccuuguagcacaccgacau

SEQ ID NO: 1104782 - RNA, 17 nt, Mycobacterium bovis subsp bovis AF2122/97
ccuuguggcacacccgc

SEQ ID NO: 1104783 - RNA, 16 nt, Mycobacterium bovis subsp bovis AF2122/97
ccuuugagcccgcgau

SEQ ID NO: 1104784 - RNA, 14 nt, Mycobacterium bovis subsp bovis AF2122/97
ccuuguucgcccac

SEQ ID NO: 1104785 - RNA, 18 nt, Mycobacterium bovis subsp bovis AF2122/97
cgaaacucaccagcaccc

SEQ ID NO: 1104786 - RNA, 20 nt, Mycobacterium bovis subsp bovis AF2122/97
cgaaacucaccagcaccccg

SEQ ID NO: 1104787 - RNA, 22 nt, Mycobacterium bovis subsp bovis AF2122/97
cgaaacucaccagcaccccgag

SEQ ID NO: 1104788 - RNA, 12 nt, Mycobacterium bovis subsp bovis AF2122/97
cgaaaaaaucgu

SEQ ID NO: 1104789 - RNA, 15 nt, Mycobacterium bovis subsp bovis AF2122/97
cgaaaaacaccagcg

SEQ ID NO: 1104790 - RNA, 16 nt, Mycobacterium bovis subsp bovis AF2122/97
cgaaaaacaccagcga

SEQ ID NO: 1104791 - RNA, 23 nt, Mycobacterium bovis subsp bovis AF2122/97
cgaaaaacaccagcgaggccagc

SEQ ID NO: 1104792 - RNA, 19 nt, Mycobacterium bovis subsp bovis AF2122/97
cgaaacgguacgccgccgc

SEQ ID NO: 1104793 - RNA, 16 nt, Mycobacterium bovis subsp bovis AF2122/97
ccuuugccgccgaacg

SEQ ID NO: 1104794 - RNA, 20 nt, Mycobacterium bovis subsp bovis AF2122/97
ccuuugccgccgaacgccuc

SEQ ID NO: 1104795 - RNA, 19 nt, Mycobacterium bovis subsp bovis AF2122/97
ccuuugccaccucggcgcg

SEQ ID NO: 1104796 - RNA, 15 nt, Mycobacterium bovis subsp bovis AF2122/97
ccuuugcccgccgcg

SEQ ID NO: 1104797 - RNA, 20 nt, Mycobacterium bovis subsp bovis AF2122/97
ccuuggcgacugucuggucg

SEQ ID NO: 1104798 - RNA, 22 nt, Mycobacterium bovis subsp bovis AF2122/97
ccuuggcgacugucuggucggc

SEQ ID NO: 1104799 - RNA, 17 nt, Mycobacterium bovis subsp bovis AF2122/97
ccuuggccgccggccgc

SEQ ID NO: 1104800 - RNA, 15 nt, Mycobacterium bovis subsp bovis AF2122/97
ccuuggcgccaccgg

SEQ ID NO: 1104801 - RNA, 16 nt, Mycobacterium bovis subsp bovis AF2122/97
ccuuggcgccaccggc

SEQ ID NO: 1104802 - RNA, 16 nt, Mycobacterium bovis subsp bovis AF2122/97
ccuuggcgcccgcgaa

SEQ ID NO: 1104803 - RNA, 15 nt, Mycobacterium bovis subsp bovis AF2122/97
ccuuggcgcggcacc

SEQ ID NO: 1104804 - RNA, 23 nt, Mycobacterium bovis subsp bovis AF2122/97
ccuuggcgcggcacccggucggc

SEQ ID NO: 1104805 - RNA, 13 nt, Mycobacterium bovis subsp bovis AF2122/97
ccuuggcggccgc

SEQ ID NO: 1104806 - RNA, 15 nt, Mycobacterium bovis subsp bovis AF2122/97
ccuugggaccgcgcc

SEQ ID NO: 1104807 - RNA, 16 nt, Mycobacterium bovis subsp bovis AF2122/97
ccuugcgccagcgggc

SEQ ID NO: 1104808 - RNA, 22 nt, Mycobacterium bovis subsp bovis AF2122/97
ccuugcgcgcgcagaucgucca

SEQ ID NO: 1104809 - RNA, 15 nt, Mycobacterium bovis subsp bovis AF2122/97
ccuuggccagcaggg

SEQ ID NO: 1104810 - RNA, 21 nt, Mycobacterium bovis subsp bovis AF2122/97
ccuugccgccggccccgccgg

SEQ ID NO: 1104811 - RNA, 23 nt, Mycobacterium bovis subsp bovis AF2122/97
ccuugccgccggccccgccgucg

SEQ ID NO: 1104812 - RNA, 16 nt, Mycobacterium bovis subsp bovis AF2122/97
ccuugccgccggcgcc

SEQ ID NO: 1104813 - RNA, 22 nt, Mycobacterium bovis subsp bovis AF2122/97
ccuugccgccgguggugccggc

SEQ ID NO: 1104814 - RNA, 23 nt, Mycobacterium bovis subsp bovis AF2122/97
ccuugccgcccgcuccgccgucg

SEQ ID NO: 1104815 - RNA, 14 nt, Mycobacterium bovis subsp bovis AF2122/97
ccuugccgcuggug

SEQ ID NO: 1104816 - RNA, 17 nt, Mycobacterium bovis subsp bovis AF2122/97
ccuugccgggccgcgcg

SEQ ID NO: 1104817 - RNA, 18 nt, Mycobacterium bovis subsp bovis AF2122/97
ccuugccgggccgcgcgg

SEQ ID NO: 1104818 - RNA, 18 nt, Mycobacterium bovis subsp bovis AF2122/97
ccuugcgcagcaccaggg

SEQ ID NO: 1104819 - RNA, 14 nt, Mycobacterium bovis subsp bovis AF2122/97
ccuucuccaucguc

SEQ ID NO: 1104820 - RNA, 23 nt, Mycobacterium bovis subsp bovis AF2122/97
ccuucugccgggagacgcugcgc

SEQ ID NO: 1104821 - RNA, 14 nt, Mycobacterium bovis subsp bovis AF2122/97
ccuucugguucggg

SEQ ID NO: 1104822 - RNA, 15 nt, Mycobacterium bovis subsp bovis AF2122/97
ccuucuuggcaggug

SEQ ID NO: 1104823 - RNA, 13 nt, Mycobacterium bovis subsp bovis AF2122/97
cgaaccgccggcu

SEQ ID NO: 1104824 - RNA, 21 nt, Mycobacterium bovis subsp bovis AF2122/97
cgaaccgccgcugccgcgcgg

SEQ ID NO: 1104825 - RNA, 21 nt, Mycobacterium bovis subsp bovis AF2122/97
cgaaccgccggcaccgccgcc

SEQ ID NO: 1104826 - RNA, 19 nt, Mycobacterium bovis subsp bovis AF2122/97
cgaaccgccgccgccgcgu

SEQ ID NO: 1104827 - RNA, 13 nt, Mycobacterium bovis subsp bovis AF2122/97
cgaaccgccgacg

SEQ ID NO: 1104828 - RNA, 14 nt, Mycobacterium bovis subsp bovis AF2122/97
cgaaccgccgacgg

SEQ ID NO: 1104829 - RNA, 13 nt, Mycobacterium bovis subsp bovis AF2122/97
cgaacccucagcc

SEQ ID NO: 1104830 - RNA, 22 nt, Mycobacterium bovis subsp bovis AF2122/97
cgaacccucagccgcgccgggu

SEQ ID NO: 1104831 - RNA, 14 nt, Mycobacterium bovis subsp bovis AF2122/97
cgaacccuccgcag

SEQ ID NO: 1104832 - RNA, 23 nt, Mycobacterium bovis subsp bovis AF2122/97
cgaaccgacaccugucguccucg

SEQ ID NO: 1104833 - RNA, 12 nt, Mycobacterium bovis subsp bovis AF2122/97
cgaaccgacccg

SEQ ID NO: 1104834 - RNA, 14 nt, Mycobacterium bovis subsp bovis AF2122/97
cgaaccgcaaggcc

SEQ ID NO: 1104835 - RNA, 19 nt, Mycobacterium bovis subsp bovis AF2122/97
cgaaccgaggugccgugga

SEQ ID NO: 1104836 - RNA, 21 nt, Mycobacterium bovis subsp bovis AF2122/97
cgaacccuucgcggugugcgg

SEQ ID NO: 1104837 - RNA, 22 nt, Mycobacterium bovis subsp bovis AF2122/97
cgaacccuucgcggugugcggc

SEQ ID NO: 1104838 - RNA, 21 nt, Mycobacterium bovis subsp bovis AF2122/97
cgaacgacgcuuucccgauga

SEQ ID NO: 1104839 - RNA, 19 nt, Mycobacterium bovis subsp bovis AF2122/97
cgaacgacggguccgggcc

SEQ ID NO: 1104840 - RNA, 16 nt, Mycobacterium bovis subsp bovis AF2122/97
cgaacgaucccgccga

SEQ ID NO: 1104841 - RNA, 21 nt, Mycobacterium bovis subsp bovis AF2122/97
cgaacgcaccgaaacgccgac

SEQ ID NO: 1104842 - RNA, 22 nt, Mycobacterium bovis subsp bovis AF2122/97
cgaaccgcguuaugccaggcgc

SEQ ID NO: 1104843 - RNA, 12 nt, Mycobacterium bovis subsp bovis AF2122/97
cgaaccgcucca

SEQ ID NO: 1104844 - RNA, 18 nt, Mycobacterium bovis subsp bovis AF2122/97
cgaacgacgcuuucccga

SEQ ID NO: 1104845 - RNA, 17 nt, Mycobacterium bovis subsp bovis AF2122/97
cgaacgaauccgcucga

SEQ ID NO: 1104846 - RNA, 16 nt, Mycobacterium bovis subsp bovis AF2122/97
cgaacgcgaucgaccu

SEQ ID NO: 1104847 - RNA, 23 nt, Mycobacterium bovis subsp bovis AF2122/97
cgaacgccugcucgucggccacc

SEQ ID NO: 1104848 - RNA, 16 nt, Mycobacterium bovis subsp bovis AF2122/97
cgaacgccugcuggua

SEQ ID NO: 1104849 - RNA, 13 nt, Mycobacterium bovis subsp bovis AF2122/97
cgaacgcgccggu

SEQ ID NO: 1104850 - RNA, 15 nt, Mycobacterium bovis subsp bovis AF2122/97
cgaacgcggccaccg

SEQ ID NO: 1104851 - RNA, 13 nt, Mycobacterium bovis subsp bovis AF2122/97
cgaacgcgcgcgu

SEQ ID NO: 1104852 - RNA, 13 nt, Mycobacterium bovis subsp bovis AF2122/97
cgaacggccagga

SEQ ID NO: 1104853 - RNA, 16 nt, Mycobacterium bovis subsp bovis AF2122/97
cgaacggccaggacaa

SEQ ID NO: 1104854 - RNA, 18 nt, Mycobacterium bovis subsp bovis AF2122/97
cgaacgccgucgacgcgg

SEQ ID NO: 1104855 - RNA, 19 nt, Mycobacterium bovis subsp bovis AF2122/97
cgaacgccgucgacgcggc

SEQ ID NO: 1104856 - RNA, 20 nt, Mycobacterium bovis subsp bovis AF2122/97
cgaacgccucgccggccacc

SEQ ID NO: 1104857 - RNA, 23 nt, Mycobacterium bovis subsp bovis AF2122/97
cgaacgccucgccggccaccagc

SEQ ID NO: 1104858 - RNA, 15 nt, Mycobacterium bovis subsp bovis AF2122/97
cgaacgccugcucgu

SEQ ID NO: 1104859 - RNA, 17 nt, Mycobacterium bovis subsp bovis AF2122/97
cgaacgccugcucgucg

SEQ ID NO: 1104860 - RNA, 14 nt, Mycobacterium bovis subsp bovis AF2122/97
cgaacgccgcccgc

SEQ ID NO: 1104861 - RNA, 17 nt, Mycobacterium bovis subsp bovis AF2122/97
cgaacgcgacagccacc

SEQ ID NO: 1104862 - RNA, 18 nt, Mycobacterium bovis subsp bovis AF2122/97
cgaacggcgaggugccca

SEQ ID NO: 1104863 - RNA, 22 nt, Mycobacterium bovis subsp bovis AF2122/97
cgaacggcuuggcgucggccgg

SEQ ID NO: 1104864 - RNA, 23 nt, Mycobacterium bovis subsp bovis AF2122/97
cgaacggcuuggcgucggccggc

SEQ ID NO: 1104865 - RNA, 18 nt, Mycobacterium bovis subsp bovis AF2122/97
cgaacggguagucgggca

SEQ ID NO: 1104866 - RNA, 20 nt, Mycobacterium bovis subsp bovis AF2122/97
cgaacggguagucgggcaag

SEQ ID NO: 1104867 - RNA, 18 nt, Mycobacterium bovis subsp bovis AF2122/97
cgaacgggucggcgacca

SEQ ID NO: 1104868 - RNA, 14 nt, Mycobacterium bovis subsp bovis AF2122/97
cgaacgggucggga

SEQ ID NO: 1104869 - RNA, 17 nt, Mycobacterium bovis subsp bovis AF2122/97
cgaacugggugcggucu

SEQ ID NO: 1104870 - RNA, 17 nt, Mycobacterium bovis subsp bovis AF2122/97
cgaacugguagcccgga

SEQ ID NO: 1104871 - RNA, 20 nt, Mycobacterium bovis subsp bovis AF2122/97
cgaacuggucgacgccgaga

SEQ ID NO: 1104872 - RNA, 20 nt, Mycobacterium bovis subsp bovis AF2122/97
cgaacugcagccauucuucg

SEQ ID NO: 1104873 - RNA, 19 nt, Mycobacterium bovis subsp bovis AF2122/97
cgaacugcagccauucuuc

SEQ ID NO: 1104874 - RNA, 20 nt, Mycobacterium bovis subsp bovis AF2122/97
cgaacugccggacuaccgcc

SEQ ID NO: 1104875 - RNA, 21 nt, Mycobacterium bovis subsp bovis AF2122/97
cgaagaacaguugcccgacgc

SEQ ID NO: 1104876 - RNA, 24 nt, Mycobacterium bovis subsp bovis AF2122/97
cgaagaacaguugcccgacgccgg

SEQ ID NO: 1104877 - RNA, 23 nt, Mycobacterium bovis subsp bovis AF2122/97
cgaagaacaccuugggcagcuug

SEQ ID NO: 1104878 - RNA, 20 nt, Mycobacterium bovis subsp bovis AF2122/97
cgaagaacaacaucgccaua

SEQ ID NO: 1104879 - RNA, 18 nt, Mycobacterium bovis subsp bovis AF2122/97
cgaacuggcugguggcgu

SEQ ID NO: 1104880 - RNA, 23 nt, Mycobacterium bovis subsp bovis AF2122/97
cgaacuuccauucauggccgcga

SEQ ID NO: 1104881 - RNA, 21 nt, Mycobacterium bovis subsp bovis AF2122/97
cgaacuucgauucuggccgga

SEQ ID NO: 1104882 - RNA, 21 nt, Mycobacterium bovis subsp bovis AF2122/97
cgaacuucugguaggcggcca

SEQ ID NO: 1104883 - RNA, 19 nt, Mycobacterium bovis subsp bovis AF2122/97
cgaacuugaucaccgcgua

SEQ ID NO: 1104884 - RNA, 19 nt, Mycobacterium bovis subsp bovis AF2122/97
cgaagagugugacggcggc

SEQ ID NO: 1104885 - RNA, 18 nt, Mycobacterium bovis subsp bovis AF2122/97
cgaagagggcgccgcgcg

SEQ ID NO: 1104886 - RNA, 17 nt, Mycobacterium bovis subsp bovis AF2122/97
cgaagagccagcaacgg

SEQ ID NO: 1104887 - RNA, 14 nt, Mycobacterium bovis subsp bovis AF2122/97
cgaagagcaccgcg

SEQ ID NO: 1104888 - RNA, 16 nt, Mycobacterium bovis subsp bovis AF2122/97
cgaagagcaccgcgcc

SEQ ID NO: 1104889 - RNA, 14 nt, Mycobacterium bovis subsp bovis AF2122/97
cgaagagccagcaa

SEQ ID NO: 1104890 - RNA, 15 nt, Mycobacterium bovis subsp bovis AF2122/97
cgaacaucgccagcg

SEQ ID NO: 1104891 - RNA, 19 nt, Mycobacterium bovis subsp bovis AF2122/97
cgaacauggcacgcgggaa

SEQ ID NO: 1104892 - RNA, 20 nt, Mycobacterium bovis subsp bovis AF2122/97
cgaacauggcacgcgggaag

SEQ ID NO: 1104893 - RNA, 21 nt, Mycobacterium bovis subsp bovis AF2122/97
cgaacaugauccgccggcaac

SEQ ID NO: 1104894 - RNA, 18 nt, Mycobacterium bovis subsp bovis AF2122/97
cgaacauugcgcccagcg

SEQ ID NO: 1104895 - RNA, 20 nt, Mycobacterium bovis subsp bovis AF2122/97
cgaacauugcgcccagcgac

SEQ ID NO: 1104896 - RNA, 13 nt, Mycobacterium bovis subsp bovis AF2122/97
cgaacaucgccag

SEQ ID NO: 1104897 - RNA, 15 nt, Mycobacterium bovis subsp bovis AF2122/97
cgaacauccgccgcc

SEQ ID NO: 1104898 - RNA, 14 nt, Mycobacterium bovis subsp bovis AF2122/97
cgaacaucaccguc

SEQ ID NO: 1104899 - RNA, 20 nt, Mycobacterium bovis subsp bovis AF2122/97
cgaacaguugcggcuggcgc

SEQ ID NO: 1104900 - RNA, 19 nt, Mycobacterium bovis subsp bovis AF2122/97
cgaacagggaggucgccgc

SEQ ID NO: 1104901 - RNA, 20 nt, Mycobacterium bovis subsp bovis AF2122/97
cgaacagguuggccccggcc

SEQ ID NO: 1104902 - RNA, 22 nt, Mycobacterium bovis subsp bovis AF2122/97
cgaacagucgagugaagccgac

SEQ ID NO: 1104903 - RNA, 15 nt, Mycobacterium bovis subsp bovis AF2122/97
cgaacagugacgcca

SEQ ID NO: 1104904 - RNA, 13 nt, Mycobacterium bovis subsp bovis AF2122/97
cgaacagucgcag

SEQ ID NO: 1104905 - RNA, 21 nt, Mycobacterium bovis subsp bovis AF2122/97
cgaacaguggggguccggcgg

SEQ ID NO: 1104906 - RNA, 22 nt, Mycobacterium bovis subsp bovis AF2122/97
cgaacaguggggguccggcggc

SEQ ID NO: 1104907 - RNA, 20 nt, Mycobacterium bovis subsp bovis AF2122/97
cgaaccagaguucggccagc

SEQ ID NO: 1104908 - RNA, 20 nt, Mycobacterium bovis subsp bovis AF2122/97
cgaaccaccggcgccgccgg

SEQ ID NO: 1104909 - RNA, 20 nt, Mycobacterium bovis subsp bovis AF2122/97
cgaaccagucgaagaagacc

SEQ ID NO: 1104910 - RNA, 18 nt, Mycobacterium bovis subsp bovis AF2122/97
cgaaccagcuugcgccgc

SEQ ID NO: 1104911 - RNA, 15 nt, Mycobacterium bovis subsp bovis AF2122/97
cgaacccgagccgcc

SEQ ID NO: 1104912 - RNA, 20 nt, Mycobacterium bovis subsp bovis AF2122/97
cgaacccgagccgccgugga

SEQ ID NO: 1104913 - RNA, 14 nt, Mycobacterium bovis subsp bovis AF2122/97
cgaacccgaucguc

SEQ ID NO: 1104914 - RNA, 18 nt, Mycobacterium bovis subsp bovis AF2122/97
cgaacccgaucgucgagc

SEQ ID NO: 1104915 - RNA, 15 nt, Mycobacterium bovis subsp bovis AF2122/97
cgaacccgcagucgg

SEQ ID NO: 1104916 - RNA, 21 nt, Mycobacterium bovis subsp bovis AF2122/97
cgaacccgcagucggucacgc

SEQ ID NO: 1104917 - RNA, 15 nt, Mycobacterium bovis subsp bovis AF2122/97
cgaacccgccaccgc

SEQ ID NO: 1104918 - RNA, 14 nt, Mycobacterium bovis subsp bovis AF2122/97
cgaacccgguguug

SEQ ID NO: 1104919 - RNA, 15 nt, Mycobacterium bovis subsp bovis AF2122/97
cgaacccgccgaugc

SEQ ID NO: 1104920 - RNA, 22 nt, Mycobacterium bovis subsp bovis AF2122/97
cgaacccgccgaugcugccgcc

SEQ ID NO: 1104921 - RNA, 21 nt, Mycobacterium bovis subsp bovis AF2122/97
cgaacccaccgugccgggcga

SEQ ID NO: 1104922 - RNA, 18 nt, Mycobacterium bovis subsp bovis AF2122/97
cgaacccacugcccgccg

SEQ ID NO: 1104923 - RNA, 22 nt, Mycobacterium bovis subsp bovis AF2122/97
cgaaccaugguugaugacggcg

SEQ ID NO: 1104924 - RNA, 23 nt, Mycobacterium bovis subsp bovis AF2122/97
cgaaccaugguugaugacggcgu

SEQ ID NO: 1104925 - RNA, 11 nt, Mycobacterium bovis subsp bovis AF2122/97
cgaaccccgac

SEQ ID NO: 1104926 - RNA, 13 nt, Mycobacterium bovis subsp bovis AF2122/97
cgaacccaggcac

SEQ ID NO: 1104927 - RNA, 15 nt, Mycobacterium bovis subsp bovis AF2122/97
cgaacagcaccgccg

SEQ ID NO: 1104928 - RNA, 15 nt, Mycobacterium bovis subsp bovis AF2122/97
cgaacagccgagcca

SEQ ID NO: 1104929 - RNA, 18 nt, Mycobacterium bovis subsp bovis AF2122/97
cgaacagcgaaccgccgg

SEQ ID NO: 1104930 - RNA, 21 nt, Mycobacterium bovis subsp bovis AF2122/97
cgaacagcaugauccgcuggg

SEQ ID NO: 1104931 - RNA, 15 nt, Mycobacterium bovis subsp bovis AF2122/97
cgaacagggcugcga

SEQ ID NO: 1104932 - RNA, 16 nt, Mycobacterium bovis subsp bovis AF2122/97
cgaacaggccggccgc

SEQ ID NO: 1104933 - RNA, 22 nt, Mycobacterium bovis subsp bovis AF2122/97
cgaacagcugcccgccagcgcc

SEQ ID NO: 1104934 - RNA, 17 nt, Mycobacterium bovis subsp bovis AF2122/97
cgaacagacaugcgcac

SEQ ID NO: 1104935 - RNA, 15 nt, Mycobacterium bovis subsp bovis AF2122/97
cgaacacguucgggu

SEQ ID NO: 1104936 - RNA, 16 nt, Mycobacterium bovis subsp bovis AF2122/97
cgaacacgucggccag

SEQ ID NO: 1104937 - RNA, 20 nt, Mycobacterium bovis subsp bovis AF2122/97
cgaacaccgguaacgcgaca

SEQ ID NO: 1104938 - RNA, 19 nt, Mycobacterium bovis subsp bovis AF2122/97
cgaacagacaugcgcacca

SEQ ID NO: 1104939 - RNA, 23 nt, Mycobacterium bovis subsp bovis AF2122/97
cgaacagcacauaugugcccggc

SEQ ID NO: 1104940 - RNA, 12 nt, Mycobacterium bovis subsp bovis AF2122/97
cgaacagcaccg

SEQ ID NO: 1104941 - RNA, 17 nt, Mycobacterium bovis subsp bovis AF2122/97
cgaacagcaccgaaccc

SEQ ID NO: 1104942 - RNA, 13 nt, Mycobacterium bovis subsp bovis AF2122/97
cgaacacgcgaug

SEQ ID NO: 1104943 - RNA, 15 nt, Mycobacterium bovis subsp bovis AF2122/97
cgaaagccgcggccg

SEQ ID NO: 1104944 - RNA, 14 nt, Mycobacterium bovis subsp bovis AF2122/97
cgaaagccgccgag

SEQ ID NO: 1104945 - RNA, 20 nt, Mycobacterium bovis subsp bovis AF2122/97
cgaaagcacgugcacggcga

SEQ ID NO: 1104946 - RNA, 14 nt, Mycobacterium bovis subsp bovis AF2122/97
cgaaagccaggcgg

SEQ ID NO: 1104947 - RNA, 20 nt, Mycobacterium bovis subsp bovis AF2122/97
cgaaagccaacucgaccgac

SEQ ID NO: 1104948 - RNA, 19 nt, Mycobacterium bovis subsp bovis AF2122/97
cgaaagagccagcggcacu

SEQ ID NO: 1104949 - RNA, 15 nt, Mycobacterium bovis subsp bovis AF2122/97
cgaaacuucgcccgg

SEQ ID NO: 1104950 - RNA, 15 nt, Mycobacterium bovis subsp bovis AF2122/97
cgaaacucaccagca

SEQ ID NO: 1104951 - RNA, 19 nt, Mycobacterium bovis subsp bovis AF2122/97
cgacccccagcgcccgccg

SEQ ID NO: 1104952 - RNA, 20 nt, Mycobacterium bovis subsp bovis AF2122/97
cgacccccagcgcccgccgg

SEQ ID NO: 1104953 - RNA, 21 nt, Mycobacterium bovis subsp bovis AF2122/97
cgacccccagcgcccgccggc

SEQ ID NO: 1104954 - RNA, 18 nt, Mycobacterium bovis subsp bovis AF2122/97
cgacccccgaucaggccg

SEQ ID NO: 1104955 - RNA, 22 nt, Mycobacterium bovis subsp bovis AF2122/97
cgacccccgaucaggccgacgu

SEQ ID NO: 1104956 - RNA, 15 nt, Mycobacterium bovis subsp bovis AF2122/97
cgacccccgcaucgg

SEQ ID NO: 1104957 - RNA, 15 nt, Mycobacterium bovis subsp bovis AF2122/97
cgacccaucaccagc

SEQ ID NO: 1104958 - RNA, 16 nt, Mycobacterium bovis subsp bovis AF2122/97
cgacccaucaccagcg

SEQ ID NO: 1104959 - RNA, 21 nt, Mycobacterium bovis subsp bovis AF2122/97
cgacccaucaccagcggcugc

SEQ ID NO: 1104960 - RNA, 14 nt, Mycobacterium bovis subsp bovis AF2122/97
cgaccccgccgagc

SEQ ID NO: 1104961 - RNA, 22 nt, Mycobacterium bovis subsp bovis AF2122/97
cgaccccgccgagcgcgccgaa

SEQ ID NO: 1104962 - RNA, 19 nt, Mycobacterium bovis subsp bovis AF2122/97
cgaccccgccgagcgguug

SEQ ID NO: 1104963 - RNA, 13 nt, Mycobacterium bovis subsp bovis AF2122/97
cgaccccaggcgc

SEQ ID NO: 1104964 - RNA, 17 nt, Mycobacterium bovis subsp bovis AF2122/97
cgaccccaggcgcucau

SEQ ID NO: 1104965 - RNA, 22 nt, Mycobacterium bovis subsp bovis AF2122/97
cgaccucaucggcaccgucucg

SEQ ID NO: 1104966 - RNA, 18 nt, Mycobacterium bovis subsp bovis AF2122/97
cgaccucacugcggcgcc

SEQ ID NO: 1104967 - RNA, 19 nt, Mycobacterium bovis subsp bovis AF2122/97
cgaccguuucuccgccgcc

SEQ ID NO: 1104968 - RNA, 22 nt, Mycobacterium bovis subsp bovis AF2122/97
cgaccuaaagaucguugccucg

SEQ ID NO: 1104969 - RNA, 17 nt, Mycobacterium bovis subsp bovis AF2122/97
cgaccuaccgucgacca

SEQ ID NO: 1104970 - RNA, 17 nt, Mycobacterium bovis subsp bovis AF2122/97
cgaccuacugcggucgc

SEQ ID NO: 1104971 - RNA, 18 nt, Mycobacterium bovis subsp bovis AF2122/97
cgaccuacugcggucgcc

SEQ ID NO: 1104972 - RNA, 22 nt, Mycobacterium bovis subsp bovis AF2122/97
cgaccucacggcauccgcucaa

SEQ ID NO: 1104973 - RNA, 22 nt, Mycobacterium bovis subsp bovis AF2122/97
cgaccgugguggucgggcgcaa

SEQ ID NO: 1104974 - RNA, 18 nt, Mycobacterium bovis subsp bovis AF2122/97
cgaccgugucaccgccgg

SEQ ID NO: 1104975 - RNA, 19 nt, Mycobacterium bovis subsp bovis AF2122/97
cgaccgugucaccgccggg

SEQ ID NO: 1104976 - RNA, 20 nt, Mycobacterium bovis subsp bovis AF2122/97
cgaccgugucaccgccggga

SEQ ID NO: 1104977 - RNA, 14 nt, Mycobacterium bovis subsp bovis AF2122/97
cgaccccggccagg

SEQ ID NO: 1104978 - RNA, 13 nt, Mycobacterium bovis subsp bovis AF2122/97
cgaccguggcggc

SEQ ID NO: 1104979 - RNA, 15 nt, Mycobacterium bovis subsp bovis AF2122/97
cgaccguggcggccu

SEQ ID NO: 1104980 - RNA, 16 nt, Mycobacterium bovis subsp bovis AF2122/97
cgaccguggcggccuc

SEQ ID NO: 1104981 - RNA, 17 nt, Mycobacterium bovis subsp bovis AF2122/97
cgaccguggcggccucc

SEQ ID NO: 1104982 - RNA, 15 nt, Mycobacterium bovis subsp bovis AF2122/97
cgaccguggcugcgc

SEQ ID NO: 1104983 - RNA, 16 nt, Mycobacterium bovis subsp bovis AF2122/97
cgaccgugguggucgg

SEQ ID NO: 1104984 - RNA, 18 nt, Mycobacterium bovis subsp bovis AF2122/97
cgaccgugguggucgggc

SEQ ID NO: 1104985 - RNA, 15 nt, Mycobacterium bovis subsp bovis AF2122/97
cgaccucgcuggccg

SEQ ID NO: 1104986 - RNA, 14 nt, Mycobacterium bovis subsp bovis AF2122/97
cgaccucgccgcgg

SEQ ID NO: 1104987 - RNA, 18 nt, Mycobacterium bovis subsp bovis AF2122/97
cgaccucgucggccgaca

SEQ ID NO: 1104988 - RNA, 18 nt, Mycobacterium bovis subsp bovis AF2122/97
cgaccugagucggcauug

SEQ ID NO: 1104989 - RNA, 21 nt, Mycobacterium bovis subsp bovis AF2122/97
cgaccucgggaucggcggggu

SEQ ID NO: 1104990 - RNA, 14 nt, Mycobacterium bovis subsp bovis AF2122/97
cgaccugcgcgagg

SEQ ID NO: 1104991 - RNA, 13 nt, Mycobacterium bovis subsp bovis AF2122/97
cgaccugcgcgac

SEQ ID NO: 1104992 - RNA, 20 nt, Mycobacterium bovis subsp bovis AF2122/97
cgaccugccggaccgcggau

SEQ ID NO: 1104993 - RNA, 13 nt, Mycobacterium bovis subsp bovis AF2122/97
cgaccugcucgcu

SEQ ID NO: 1104994 - RNA, 12 nt, Mycobacterium bovis subsp bovis AF2122/97
cgaccugcucgc

SEQ ID NO: 1104995 - RNA, 17 nt, Mycobacterium bovis subsp bovis AF2122/97
cgacgaacuccgcguug

SEQ ID NO: 1104996 - RNA, 14 nt, Mycobacterium bovis subsp bovis AF2122/97
cgacgaacgccguc

SEQ ID NO: 1104997 - RNA, 23 nt, Mycobacterium bovis subsp bovis AF2122/97
cgaccuggacaaccucgucgauc

SEQ ID NO: 1104998 - RNA, 12 nt, Mycobacterium bovis subsp bovis AF2122/97
cgacgaaccgga

SEQ ID NO: 1104999 - RNA, 15 nt, Mycobacterium bovis subsp bovis AF2122/97
cgacgaaccggauca

SEQ ID NO: 1105000 - RNA, 14 nt, Mycobacterium bovis subsp bovis AF2122/97
cgacgaacagcggu

SEQ ID NO: 1105001 - RNA, 16 nt, Mycobacterium bovis subsp bovis AF2122/97
cgacgaacagcggugg

SEQ ID NO: 1105002 - RNA, 20 nt, Mycobacterium bovis subsp bovis AF2122/97
cgacgaacaccagcgcgccg

SEQ ID NO: 1105003 - RNA, 21 nt, Mycobacterium bovis subsp bovis AF2122/97
cgacgaacaccagcgcgccgu

SEQ ID NO: 1105004 - RNA, 19 nt, Mycobacterium bovis subsp bovis AF2122/97
cgacgaacaccccgggcgc

SEQ ID NO: 1105005 - RNA, 20 nt, Mycobacterium bovis subsp bovis AF2122/97
cgacgaacaccccgggcgcc

SEQ ID NO: 1105006 - RNA, 19 nt, Mycobacterium bovis subsp bovis AF2122/97
cgaccuggacgcggccaau

SEQ ID NO: 1105007 - RNA, 18 nt, Mycobacterium bovis subsp bovis AF2122/97
cgaccuggauugccacca

SEQ ID NO: 1105008 - RNA, 21 nt, Mycobacterium bovis subsp bovis AF2122/97
cgaccuggacaaccucgucga

SEQ ID NO: 1105009 - RNA, 16 nt, Mycobacterium bovis subsp bovis AF2122/97
cgacgaacucgcccag

SEQ ID NO: 1105010 - RNA, 19 nt, Mycobacterium bovis subsp bovis AF2122/97
cgacgaagaucgcgugcca

SEQ ID NO: 1105011 - RNA, 18 nt, Mycobacterium bovis subsp bovis AF2122/97
cgacgacacguugacgau

SEQ ID NO: 1105012 - RNA, 19 nt, Mycobacterium bovis subsp bovis AF2122/97
cgacgacacguugacgaug

SEQ ID NO: 1105013 - RNA, 14 nt, Mycobacterium bovis subsp bovis AF2122/97
cgacgacagcaccg

SEQ ID NO: 1105014 - RNA, 19 nt, Mycobacterium bovis subsp bovis AF2122/97
cgacgaacgaaccgccgcc

SEQ ID NO: 1105015 - RNA, 21 nt, Mycobacterium bovis subsp bovis AF2122/97
cgacgaacgaaccgccgccgc

SEQ ID NO: 1105016 - RNA, 13 nt, Mycobacterium bovis subsp bovis AF2122/97
cgacgaacucgcc

SEQ ID NO: 1105017 - RNA, 21 nt, Mycobacterium bovis subsp bovis AF2122/97
cgacgaacuagguucagcgac

SEQ ID NO: 1105018 - RNA, 22 nt, Mycobacterium bovis subsp bovis AF2122/97
cgacgaacuagguucagcgacu

SEQ ID NO: 1105019 - RNA, 13 nt, Mycobacterium bovis subsp bovis AF2122/97
cgacgacaucugc

SEQ ID NO: 1105020 - RNA, 20 nt, Mycobacterium bovis subsp bovis AF2122/97
cgacgacauuggugcugaca

SEQ ID NO: 1105021 - RNA, 19 nt, Mycobacterium bovis subsp bovis AF2122/97
cgacgaccacaccacgaug

SEQ ID NO: 1105022 - RNA, 18 nt, Mycobacterium bovis subsp bovis AF2122/97
cgacgaacgccucaccga

SEQ ID NO: 1105023 - RNA, 23 nt, Mycobacterium bovis subsp bovis AF2122/97
cgacgaccacaccacgauggcgg

SEQ ID NO: 1105024 - RNA, 15 nt, Mycobacterium bovis subsp bovis AF2122/97
cgacgacaucgagcc

SEQ ID NO: 1105025 - RNA, 20 nt, Mycobacterium bovis subsp bovis AF2122/97
cgacgacaucgagccaacgc

SEQ ID NO: 1105026 - RNA, 16 nt, Mycobacterium bovis subsp bovis AF2122/97
cgacgacaucgguggc

SEQ ID NO: 1105027 - RNA, 23 nt, Mycobacterium bovis subsp bovis AF2122/97
cgacgacaucgguggcccggugc

SEQ ID NO: 1105028 - RNA, 20 nt, Mycobacterium bovis subsp bovis AF2122/97
cgacgacccgggucggcacg

SEQ ID NO: 1105029 - RNA, 23 nt, Mycobacterium bovis subsp bovis AF2122/97
cgacgacccgggucggcacgacc

SEQ ID NO: 1105030 - RNA, 12 nt, Mycobacterium bovis subsp bovis AF2122/97
cgacgaccagca

SEQ ID NO: 1105031 - RNA, 14 nt, Mycobacterium bovis subsp bovis AF2122/97
cgacgaccagcaga

SEQ ID NO: 1105032 - RNA, 13 nt, Mycobacterium bovis subsp bovis AF2122/97
cgacgaccgucgg

SEQ ID NO: 1105033 - RNA, 23 nt, Mycobacterium bovis subsp bovis AF2122/97
cgacgaccaccuucugacgcggc

SEQ ID NO: 1105034 - RNA, 13 nt, Mycobacterium bovis subsp bovis AF2122/97
cgacgacccgggu

SEQ ID NO: 1105035 - RNA, 18 nt, Mycobacterium bovis subsp bovis AF2122/97
cgacgacccgggucggca

SEQ ID NO: 1105036 - RNA, 17 nt, Mycobacterium bovis subsp bovis AF2122/97
cgacgacguccucgacg

SEQ ID NO: 1105037 - RNA, 23 nt, Mycobacterium bovis subsp bovis AF2122/97
cgacgacguccucgacgaucagc

SEQ ID NO: 1105038 - RNA, 15 nt, Mycobacterium bovis subsp bovis AF2122/97
cgacgacggcaccga

SEQ ID NO: 1105039 - RNA, 14 nt, Mycobacterium bovis subsp bovis AF2122/97
cgacgaccucgacg

SEQ ID NO: 1105040 - RNA, 12 nt, Mycobacterium bovis subsp bovis AF2122/97
cgacgacgcccu

SEQ ID NO: 1105041 - RNA, 15 nt, Mycobacterium bovis subsp bovis AF2122/97
cgacgagccgcgguc

SEQ ID NO: 1105042 - RNA, 14 nt, Mycobacterium bovis subsp bovis AF2122/97
cgacgagcgcagcg

SEQ ID NO: 1105043 - RNA, 14 nt, Mycobacterium bovis subsp bovis AF2122/97
cgacgacggccugc

SEQ ID NO: 1105044 - RNA, 16 nt, Mycobacterium bovis subsp bovis AF2122/97
cgacgagcgcagcgug

SEQ ID NO: 1105045 - RNA, 23 nt, Mycobacterium bovis subsp bovis AF2122/97
cgacgagcgccucaagcucgccg

SEQ ID NO: 1105046 - RNA, 17 nt, Mycobacterium bovis subsp bovis AF2122/97
cgacgaggacgucaccg

SEQ ID NO: 1105047 - RNA, 17 nt, Mycobacterium bovis subsp bovis AF2122/97
cgacgagcggccguggc

SEQ ID NO: 1105048 - RNA, 19 nt, Mycobacterium bovis subsp bovis AF2122/97
cgacgaggagccucgaccg

SEQ ID NO: 1105049 - RNA, 16 nt, Mycobacterium bovis subsp bovis AF2122/97
cgacgaggcaaugcga

SEQ ID NO: 1105050 - RNA, 17 nt, Mycobacterium bovis subsp bovis AF2122/97
cgacgaggggcgcgggu

SEQ ID NO: 1105051 - RNA, 18 nt, Mycobacterium bovis subsp bovis AF2122/97
cgacgagucggcgggcga

SEQ ID NO: 1105052 - RNA, 19 nt, Mycobacterium bovis subsp bovis AF2122/97
cgacgagucggcgggcgac

SEQ ID NO: 1105053 - RNA, 22 nt, Mycobacterium bovis subsp bovis AF2122/97
cgacgagugguccggcggccgg

SEQ ID NO: 1105054 - RNA, 20 nt, Mycobacterium bovis subsp bovis AF2122/97
cgacgaguuccucguggguc

SEQ ID NO: 1105055 - RNA, 17 nt, Mycobacterium bovis subsp bovis AF2122/97
cgacgaguugcgaacca

SEQ ID NO: 1105056 - RNA, 17 nt, Mycobacterium bovis subsp bovis AF2122/97
cgacgagggcgggaccc

SEQ ID NO: 1105057 - RNA, 21 nt, Mycobacterium bovis subsp bovis AF2122/97
cgacgagggcgggacccguga

SEQ ID NO: 1105058 - RNA, 16 nt, Mycobacterium bovis subsp bovis AF2122/97
cgacgagggccagcag

SEQ ID NO: 1105059 - RNA, 18 nt, Mycobacterium bovis subsp bovis AF2122/97
cgacgagggccagcagcc

SEQ ID NO: 1105060 - RNA, 14 nt, Mycobacterium bovis subsp bovis AF2122/97
cgacgagggcggga

SEQ ID NO: 1105061 - RNA, 14 nt, Mycobacterium bovis subsp bovis AF2122/97
cgacgaugugcacg

SEQ ID NO: 1105062 - RNA, 20 nt, Mycobacterium bovis subsp bovis AF2122/97
cgacgaugugcacggugugc

SEQ ID NO: 1105063 - RNA, 15 nt, Mycobacterium bovis subsp bovis AF2122/97
cgacgauguggucca

SEQ ID NO: 1105064 - RNA, 18 nt, Mycobacterium bovis subsp bovis AF2122/97
cgacgaugugguccaucg

SEQ ID NO: 1105065 - RNA, 15 nt, Mycobacterium bovis subsp bovis AF2122/97
cgacgaugucgagcg

SEQ ID NO: 1105066 - RNA, 21 nt, Mycobacterium bovis subsp bovis AF2122/97
cgacgauagcggcccgaucac

SEQ ID NO: 1105067 - RNA, 18 nt, Mycobacterium bovis subsp bovis AF2122/97
cgacgcaccucgguggcu

SEQ ID NO: 1105068 - RNA, 22 nt, Mycobacterium bovis subsp bovis AF2122/97
cgacgcaccucgguggcugcca

SEQ ID NO: 1105069 - RNA, 16 nt, Mycobacterium bovis subsp bovis AF2122/97
cgacgcaaagcagcgc

SEQ ID NO: 1105070 - RNA, 15 nt, Mycobacterium bovis subsp bovis AF2122/97
cgacgcacacccggu

SEQ ID NO: 1105071 - RNA, 18 nt, Mycobacterium bovis subsp bovis AF2122/97
cgacgcagaacggcguug

SEQ ID NO: 1105072 - RNA, 19 nt, Mycobacterium bovis subsp bovis AF2122/97
cgacgcagaccguccagca

SEQ ID NO: 1105073 - RNA, 21 nt, Mycobacterium bovis subsp bovis AF2122/97
cgacgcagaccguccagcaac

SEQ ID NO: 1105074 - RNA, 16 nt, Mycobacterium bovis subsp bovis AF2122/97
cgacgccgaaaaugcc

SEQ ID NO: 1105075 - RNA, 18 nt, Mycobacterium bovis subsp bovis AF2122/97
cgacgcccucacaacgau

SEQ ID NO: 1105076 - RNA, 21 nt, Mycobacterium bovis subsp bovis AF2122/97
cgacgcccucacaacgauugc

SEQ ID NO: 1105077 - RNA, 14 nt, Mycobacterium bovis subsp bovis AF2122/97
cgacgccggccagc

SEQ ID NO: 1105078 - RNA, 17 nt, Mycobacterium bovis subsp bovis AF2122/97
cgacgccggccagcggc

SEQ ID NO: 1105079 - RNA, 19 nt, Mycobacterium bovis subsp bovis AF2122/97
cgacgccggccagcggcca

SEQ ID NO: 1105080 - RNA, 20 nt, Mycobacterium bovis subsp bovis AF2122/97
cgacgccggccagcggccau

SEQ ID NO: 1105081 - RNA, 16 nt, Mycobacterium bovis subsp bovis AF2122/97
cgacgccggcccgacg

SEQ ID NO: 1105082 - RNA, 12 nt, Mycobacterium bovis subsp bovis AF2122/97
cgacgccggccu

SEQ ID NO: 1105083 - RNA, 18 nt, Mycobacterium bovis subsp bovis AF2122/97
cgacgccggccuggccgc

SEQ ID NO: 1105084 - RNA, 19 nt, Mycobacterium bovis subsp bovis AF2122/97
cgacgccggccuggccgcc

SEQ ID NO: 1105085 - RNA, 14 nt, Mycobacterium bovis subsp bovis AF2122/97
cgacgccggccuug

SEQ ID NO: 1105086 - RNA, 12 nt, Mycobacterium bovis subsp bovis AF2122/97
cgacgccgucgg

SEQ ID NO: 1105087 - RNA, 19 nt, Mycobacterium bovis subsp bovis AF2122/97
cgacgcccaggcauggccu

SEQ ID NO: 1105088 - RNA, 13 nt, Mycobacterium bovis subsp bovis AF2122/97
cgacgcccauggc

SEQ ID NO: 1105089 - RNA, 16 nt, Mycobacterium bovis subsp bovis AF2122/97
cgacgcccgccaccgg

SEQ ID NO: 1105090 - RNA, 18 nt, Mycobacterium bovis subsp bovis AF2122/97
cgacgcccauggcgucga

SEQ ID NO: 1105091 - RNA, 21 nt, Mycobacterium bovis subsp bovis AF2122/97
cgacgcccgcccuggcaacga

SEQ ID NO: 1105092 - RNA, 17 nt, Mycobacterium bovis subsp bovis AF2122/97
cgacgcccgccaccggg

SEQ ID NO: 1105093 - RNA, 12 nt, Mycobacterium bovis subsp bovis AF2122/97
cgacgcccgccc

SEQ ID NO: 1105094 - RNA, 14 nt, Mycobacterium bovis subsp bovis AF2122/97
cgacgcccucacaa

SEQ ID NO: 1105095 - RNA, 14 nt, Mycobacterium bovis subsp bovis AF2122/97
cgacgccaccgcga

SEQ ID NO: 1105096 - RNA, 14 nt, Mycobacterium bovis subsp bovis AF2122/97
cgacgccacgcguc

SEQ ID NO: 1105097 - RNA, 13 nt, Mycobacterium bovis subsp bovis AF2122/97
cgacgccaccgcg

SEQ ID NO: 1105098 - RNA, 17 nt, Mycobacterium bovis subsp bovis AF2122/97
cgacgccaccgccacca

SEQ ID NO: 1105099 - RNA, 17 nt, Mycobacterium bovis subsp bovis AF2122/97
cgacgcaaagcagcgca

SEQ ID NO: 1105100 - RNA, 21 nt, Mycobacterium bovis subsp bovis AF2122/97
cgacgcaugggucauggcgcu

SEQ ID NO: 1105101 - RNA, 17 nt, Mycobacterium bovis subsp bovis AF2122/97
cgacgccaacgccagcg

SEQ ID NO: 1105102 - RNA, 17 nt, Mycobacterium bovis subsp bovis AF2122/97
cgacgcauuccucgacg

SEQ ID NO: 1105103 - RNA, 15 nt, Mycobacterium bovis subsp bovis AF2122/97
cgacgcagugcccga

SEQ ID NO: 1105104 - RNA, 16 nt, Mycobacterium bovis subsp bovis AF2122/97
cgacgcauaaccggcg

SEQ ID NO: 1105105 - RNA, 18 nt, Mycobacterium bovis subsp bovis AF2122/97
cgacgcagcuugcccgac

SEQ ID NO: 1105106 - RNA, 22 nt, Mycobacterium bovis subsp bovis AF2122/97
cgacggcacgaucaucggggug

SEQ ID NO: 1105107 - RNA, 22 nt, Mycobacterium bovis subsp bovis AF2122/97
cgacggcaggcucgggcaaggc

SEQ ID NO: 1105108 - RNA, 15 nt, Mycobacterium bovis subsp bovis AF2122/97
cgacggccacggugg

SEQ ID NO: 1105109 - RNA, 19 nt, Mycobacterium bovis subsp bovis AF2122/97
cgacggcauuucagcgcgc

SEQ ID NO: 1105110 - RNA, 20 nt, Mycobacterium bovis subsp bovis AF2122/97
cgacggcauuucagcgcgcc

SEQ ID NO: 1105111 - RNA, 16 nt, Mycobacterium bovis subsp bovis AF2122/97
cgacggccagcaagac

SEQ ID NO: 1105112 - RNA, 17 nt, Mycobacterium bovis subsp bovis AF2122/97
cgacggcauguaccgac

SEQ ID NO: 1105113 - RNA, 19 nt, Mycobacterium bovis subsp bovis AF2122/97
cgacggcaucaacgcgggc

SEQ ID NO: 1105114 - RNA, 21 nt, Mycobacterium bovis subsp bovis AF2122/97
cgacggcauguaccgaccgcg

SEQ ID NO: 1105115 - RNA, 15 nt, Mycobacterium bovis subsp bovis AF2122/97
cgacggccgcggcgu

SEQ ID NO: 1105116 - RNA, 15 nt, Mycobacterium bovis subsp bovis AF2122/97
cgacggccggcaagc

SEQ ID NO: 1105117 - RNA, 18 nt, Mycobacterium bovis subsp bovis AF2122/97
cgacggcccgccguccgg

SEQ ID NO: 1105118 - RNA, 20 nt, Mycobacterium bovis subsp bovis AF2122/97
cgacggcccgccguccggcg

SEQ ID NO: 1105119 - RNA, 13 nt, Mycobacterium bovis subsp bovis AF2122/97
cgacggcccgccg

SEQ ID NO: 1105120 - RNA, 14 nt, Mycobacterium bovis subsp bovis AF2122/97
cgacggccagccca

SEQ ID NO: 1105121 - RNA, 21 nt, Mycobacterium bovis subsp bovis AF2122/97
cgacggccagcaagacgauga

SEQ ID NO: 1105122 - RNA, 14 nt, Mycobacterium bovis subsp bovis AF2122/97
cgacggccagcgcg

SEQ ID NO: 1105123 - RNA, 12 nt, Mycobacterium bovis subsp bovis AF2122/97
cgacggccagcg

SEQ ID NO: 1105124 - RNA, 13 nt, Mycobacterium bovis subsp bovis AF2122/97
cgacggccagcgc

SEQ ID NO: 1105125 - RNA, 16 nt, Mycobacterium bovis subsp bovis AF2122/97
cgacggcccgaucccg

SEQ ID NO: 1105126 - RNA, 17 nt, Mycobacterium bovis subsp bovis AF2122/97
cgacggcgaccaccgcg

SEQ ID NO: 1105127 - RNA, 19 nt, Mycobacterium bovis subsp bovis AF2122/97
cgacggcgaccaccgcggc

SEQ ID NO: 1105128 - RNA, 12 nt, Mycobacterium bovis subsp bovis AF2122/97
cgacggcgacca

SEQ ID NO: 1105129 - RNA, 14 nt, Mycobacterium bovis subsp bovis AF2122/97
cgacggccgacaac

SEQ ID NO: 1105130 - RNA, 19 nt, Mycobacterium bovis subsp bovis AF2122/97
cgacggccucgucgauguu

SEQ ID NO: 1105131 - RNA, 20 nt, Mycobacterium bovis subsp bovis AF2122/97
cgacggccgccagcagcuuc

SEQ ID NO: 1105132 - RNA, 15 nt, Mycobacterium bovis subsp bovis AF2122/97
cgacggccucgucga

SEQ ID NO: 1105133 - RNA, 13 nt, Mycobacterium bovis subsp bovis AF2122/97
cgacggcgcaugc

SEQ ID NO: 1105134 - RNA, 13 nt, Mycobacterium bovis subsp bovis AF2122/97
cgacggcgccauu

SEQ ID NO: 1105135 - RNA, 20 nt, Mycobacterium bovis subsp bovis AF2122/97
cgacggccuuggcgacgucg

SEQ ID NO: 1105136 - RNA, 17 nt, Mycobacterium bovis subsp bovis AF2122/97
cgacggcgcccagcgcu

SEQ ID NO: 1105137 - RNA, 18 nt, Mycobacterium bovis subsp bovis AF2122/97
cgacggcgauggcgcgca

SEQ ID NO: 1105138 - RNA, 12 nt, Mycobacterium bovis subsp bovis AF2122/97
cgacgcggcgcc

SEQ ID NO: 1105139 - RNA, 18 nt, Mycobacterium bovis subsp bovis AF2122/97
cgacgcuguggcucgacg

SEQ ID NO: 1105140 - RNA, 14 nt, Mycobacterium bovis subsp bovis AF2122/97
cgacgcuggucggc

SEQ ID NO: 1105141 - RNA, 16 nt, Mycobacterium bovis subsp bovis AF2122/97
cgacgcuggucggcgg

SEQ ID NO: 1105142 - RNA, 19 nt, Mycobacterium bovis subsp bovis AF2122/97
cgacgcuguggcucgacga

SEQ ID NO: 1105143 - RNA, 23 nt, Mycobacterium bovis subsp bovis AF2122/97
cgacgcuguggcucgacgaugcg

SEQ ID NO: 1105144 - RNA, 17 nt, Mycobacterium bovis subsp bovis AF2122/97
cgacggaaugucagccg

SEQ ID NO: 1105145 - RNA, 19 nt, Mycobacterium bovis subsp bovis AF2122/97
cgacgcuuccuggguuggc

SEQ ID NO: 1105146 - RNA, 17 nt, Mycobacterium bovis subsp bovis AF2122/97
cgacgcuuucccgauga

SEQ ID NO: 1105147 - RNA, 19 nt, Mycobacterium bovis subsp bovis AF2122/97
cgacgcuuucccgaugacg

SEQ ID NO: 1105148 - RNA, 19 nt, Mycobacterium bovis subsp bovis AF2122/97
cgacggcaagcacgguggc

SEQ ID NO: 1105149 - RNA, 21 nt, Mycobacterium bovis subsp bovis AF2122/97
cgacggcaagcacgguggccg

SEQ ID NO: 1105150 - RNA, 13 nt, Mycobacterium bovis subsp bovis AF2122/97
cgacggcaacagc

SEQ ID NO: 1105151 - RNA, 18 nt, Mycobacterium bovis subsp bovis AF2122/97
cgacggaguucgacgucg

SEQ ID NO: 1105152 - RNA, 19 nt, Mycobacterium bovis subsp bovis AF2122/97
cgacggaguucgacgucgg

SEQ ID NO: 1105153 - RNA, 16 nt, Mycobacterium bovis subsp bovis AF2122/97
cgacggaguucgacgu

SEQ ID NO: 1105154 - RNA, 23 nt, Mycobacterium bovis subsp bovis AF2122/97
cgacggacuucccgcgcgagccg

SEQ ID NO: 1105155 - RNA, 19 nt, Mycobacterium bovis subsp bovis AF2122/97
cgacggacuucccgcgcga

SEQ ID NO: 1105156 - RNA, 19 nt, Mycobacterium bovis subsp bovis AF2122/97
cgacggacucccucgauca

SEQ ID NO: 1105157 - RNA, 17 nt, Mycobacterium bovis subsp bovis AF2122/97
cgacgcggccggccgcc

SEQ ID NO: 1105158 - RNA, 17 nt, Mycobacterium bovis subsp bovis AF2122/97
cgacgcgcgcgauggac

SEQ ID NO: 1105159 - RNA, 14 nt, Mycobacterium bovis subsp bovis AF2122/97
cgacgcgcggccag

SEQ ID NO: 1105160 - RNA, 18 nt, Mycobacterium bovis subsp bovis AF2122/97
cgacgcgcggccagccca

SEQ ID NO: 1105161 - RNA, 20 nt, Mycobacterium bovis subsp bovis AF2122/97
cgacgcgcucggcgaucugc

SEQ ID NO: 1105162 - RNA, 13 nt, Mycobacterium bovis subsp bovis AF2122/97
cgacgcgcccgcg

SEQ ID NO: 1105163 - RNA, 15 nt, Mycobacterium bovis subsp bovis AF2122/97
cgacgcgcucgggcg

SEQ ID NO: 1105164 - RNA, 13 nt, Mycobacterium bovis subsp bovis AF2122/97
cgacgccgcgguc

SEQ ID NO: 1105165 - RNA, 14 nt, Mycobacterium bovis subsp bovis AF2122/97
cgacggugccaccg

SEQ ID NO: 1105166 - RNA, 19 nt, Mycobacterium bovis subsp bovis AF2122/97
cgacggugccaccgcgacg

SEQ ID NO: 1105167 - RNA, 14 nt, Mycobacterium bovis subsp bovis AF2122/97
cgacggugccgucg

SEQ ID NO: 1105168 - RNA, 16 nt, Mycobacterium bovis subsp bovis AF2122/97
cgacggucuggcccgc

SEQ ID NO: 1105169 - RNA, 22 nt, Mycobacterium bovis subsp bovis AF2122/97
cgacggucggcggaaacaaccc

SEQ ID NO: 1105170 - RNA, 15 nt, Mycobacterium bovis subsp bovis AF2122/97
cgacggugcgcugga

SEQ ID NO: 1105171 - RNA, 22 nt, Mycobacterium bovis subsp bovis AF2122/97
cgacggugccgucggugccgcg

SEQ ID NO: 1105172 - RNA, 13 nt, Mycobacterium bovis subsp bovis AF2122/97
cgacggugggcga

SEQ ID NO: 1105173 - RNA, 21 nt, Mycobacterium bovis subsp bovis AF2122/97
cgacgguguaacugcguuggc

SEQ ID NO: 1105174 - RNA, 17 nt, Mycobacterium bovis subsp bovis AF2122/97
cgacgguguagccgccg

SEQ ID NO: 1105175 - RNA, 13 nt, Mycobacterium bovis subsp bovis AF2122/97
cgacgguguccgg

SEQ ID NO: 1105176 - RNA, 16 nt, Mycobacterium bovis subsp bovis AF2122/97
cgacgucaucgccgac

SEQ ID NO: 1105177 - RNA, 19 nt, Mycobacterium bovis subsp bovis AF2122/97
cgacgucaucgccgacccg

SEQ ID NO: 1105178 - RNA, 16 nt, Mycobacterium bovis subsp bovis AF2122/97
cgacgucagcaccauc

SEQ ID NO: 1105179 - RNA, 23 nt, Mycobacterium bovis subsp bovis AF2122/97
cgacgucaggcagcuccgccgcc

SEQ ID NO: 1105180 - RNA, 16 nt, Mycobacterium bovis subsp bovis AF2122/97
cgacgucaggcucacg

SEQ ID NO: 1105181 - RNA, 14 nt, Mycobacterium bovis subsp bovis AF2122/97
cgacguccaccagc

SEQ ID NO: 1105182 - RNA, 16 nt, Mycobacterium bovis subsp bovis AF2122/97
cgacguccaccagccg

SEQ ID NO: 1105183 - RNA, 16 nt, Mycobacterium bovis subsp bovis AF2122/97
cgacguccaucccggc

SEQ ID NO: 1105184 - RNA, 18 nt, Mycobacterium bovis subsp bovis AF2122/97
cgacguccaucccggcgc

SEQ ID NO: 1105185 - RNA, 21 nt, Mycobacterium bovis subsp bovis AF2122/97
cgacguccaucccggcgccgc

SEQ ID NO: 1105186 - RNA, 12 nt, Mycobacterium bovis subsp bovis AF2122/97
cgacggcggccg

SEQ ID NO: 1105187 - RNA, 16 nt, Mycobacterium bovis subsp bovis AF2122/97
cgacggcgccgaaccc

SEQ ID NO: 1105188 - RNA, 17 nt, Mycobacterium bovis subsp bovis AF2122/97
cgacggcgcuguggcgg

SEQ ID NO: 1105189 - RNA, 18 nt, Mycobacterium bovis subsp bovis AF2122/97
cgacggcggauaaccggc

SEQ ID NO: 1105190 - RNA, 13 nt, Mycobacterium bovis subsp bovis AF2122/97
cgacggcggcacg

SEQ ID NO: 1105191 - RNA, 21 nt, Mycobacterium bovis subsp bovis AF2122/97
cgacggcggcacgggcggcca

SEQ ID NO: 1105192 - RNA, 14 nt, Mycobacterium bovis subsp bovis AF2122/97
cgacggcgcggugc

SEQ ID NO: 1105193 - RNA, 17 nt, Mycobacterium bovis subsp bovis AF2122/97
cgacggcgcggugcgcu

SEQ ID NO: 1105194 - RNA, 19 nt, Mycobacterium bovis subsp bovis AF2122/97
cgacggcgcggugcgcuca

SEQ ID NO: 1105195 - RNA, 13 nt, Mycobacterium bovis subsp bovis AF2122/97
cgacggcgucgac

SEQ ID NO: 1105196 - RNA, 13 nt, Mycobacterium bovis subsp bovis AF2122/97
cgacggcgucgau

SEQ ID NO: 1105197 - RNA, 13 nt, Mycobacterium bovis subsp bovis AF2122/97
cgacggcgucacc

SEQ ID NO: 1105198 - RNA, 21 nt, Mycobacterium bovis subsp bovis AF2122/97
cgacggugagggcgucgucga

SEQ ID NO: 1105199 - RNA, 14 nt, Mycobacterium bovis subsp bovis AF2122/97
cgacggugaugggg

SEQ ID NO: 1105200 - RNA, 17 nt, Mycobacterium bovis subsp bovis AF2122/97
cgacggucccggcacgu

SEQ ID NO: 1105201 - RNA, 20 nt, Mycobacterium bovis subsp bovis AF2122/97
cgacggucccggcacgucga

SEQ ID NO: 1105202 - RNA, 14 nt, Mycobacterium bovis subsp bovis AF2122/97
cgacggcgucaccc

SEQ ID NO: 1105203 - RNA, 18 nt, Mycobacterium bovis subsp bovis AF2122/97
cgacgucggcaucggcgg

SEQ ID NO: 1105204 - RNA, 22 nt, Mycobacterium bovis subsp bovis AF2122/97
cgacgucggcaucggcggcguc

SEQ ID NO: 1105205 - RNA, 13 nt, Mycobacterium bovis subsp bovis AF2122/97
cgacgucggccgc

SEQ ID NO: 1105206 - RNA, 15 nt, Mycobacterium bovis subsp bovis AF2122/97
cgacgucggccgcau

SEQ ID NO: 1105207 - RNA, 22 nt, Mycobacterium bovis subsp bovis AF2122/97
cgacgucggccgcaucgcccaa

SEQ ID NO: 1105208 - RNA, 13 nt, Mycobacterium bovis subsp bovis AF2122/97
cgacgucgcgggu

SEQ ID NO: 1105209 - RNA, 13 nt, Mycobacterium bovis subsp bovis AF2122/97
cgacgucggccuu

SEQ ID NO: 1105210 - RNA, 15 nt, Mycobacterium bovis subsp bovis AF2122/97
cgacgucggcgacca

SEQ ID NO: 1105211 - RNA, 23 nt, Mycobacterium bovis subsp bovis AF2122/97
cgacguccgcgacuuccuguaca

SEQ ID NO: 1105212 - RNA, 23 nt, Mycobacterium bovis subsp bovis AF2122/97
cgacgucggccgcaucgcccaac

SEQ ID NO: 1105213 - RNA, 15 nt, Mycobacterium bovis subsp bovis AF2122/97
cgacguggauggugg

SEQ ID NO: 1105214 - RNA, 15 nt, Mycobacterium bovis subsp bovis AF2122/97
cgacgucgucgucga

SEQ ID NO: 1105215 - RNA, 18 nt, Mycobacterium bovis subsp bovis AF2122/97
cgacgucgucgucgacgg

SEQ ID NO: 1105216 - RNA, 21 nt, Mycobacterium bovis subsp bovis AF2122/97
cgacguguugcacguacgggc

SEQ ID NO: 1105217 - RNA, 16 nt, Mycobacterium bovis subsp bovis AF2122/97
cgacgucggcggugac

SEQ ID NO: 1105218 - RNA, 21 nt, Mycobacterium bovis subsp bovis AF2122/97
cgacgucggcggugacggugc

SEQ ID NO: 1105219 - RNA, 15 nt, Mycobacterium bovis subsp bovis AF2122/97
cgacguggccagccc

SEQ ID NO: 1105220 - RNA, 15 nt, Mycobacterium bovis subsp bovis AF2122/97
cgacucggcggcgcg

SEQ ID NO: 1105221 - RNA, 12 nt, Mycobacterium bovis subsp bovis AF2122/97
cgacucggccag

SEQ ID NO: 1105222 - RNA, 16 nt, Mycobacterium bovis subsp bovis AF2122/97
cgacucggcaccgcgg

SEQ ID NO: 1105223 - RNA, 14 nt, Mycobacterium bovis subsp bovis AF2122/97
cgacucgcgguggc

SEQ ID NO: 1105224 - RNA, 16 nt, Mycobacterium bovis subsp bovis AF2122/97
cgacguucgggucgag

SEQ ID NO: 1105225 - RNA, 19 nt, Mycobacterium bovis subsp bovis AF2122/97
cgacuccggcaggcccgac

SEQ ID NO: 1105226 - RNA, 20 nt, Mycobacterium bovis subsp bovis AF2122/97
cgacucgauauaacccggcu

SEQ ID NO: 1105227 - RNA, 17 nt, Mycobacterium bovis subsp bovis AF2122/97
cgacguuccgcucgagg

SEQ ID NO: 1105228 - RNA, 16 nt, Mycobacterium bovis subsp bovis AF2122/97
cgacguucgacgacag

SEQ ID NO: 1105229 - RNA, 19 nt, Mycobacterium bovis subsp bovis AF2122/97
cgacguuaaugacgccauu

SEQ ID NO: 1105230 - RNA, 23 nt, Mycobacterium bovis subsp bovis AF2122/97
cgacguucgacgacagcaccgaa

SEQ ID NO: 1105231 - RNA, 15 nt, Mycobacterium bovis subsp bovis AF2122/97
cgacguucgggucga

SEQ ID NO: 1105232 - RNA, 13 nt, Mycobacterium bovis subsp bovis AF2122/97
cgacguggcugcg

SEQ ID NO: 1105233 - RNA, 21 nt, Mycobacterium bovis subsp bovis AF2122/97
cgacguuccccuucagcacga

SEQ ID NO: 1105234 - RNA, 15 nt, Mycobacterium bovis subsp bovis AF2122/97
cgacguuccgcucga

SEQ ID NO: 1105235 - RNA, 15 nt, Mycobacterium bovis subsp bovis AF2122/97
cgaggccgcacgucg

SEQ ID NO: 1105236 - RNA, 16 nt, Mycobacterium bovis subsp bovis AF2122/97
cgaggccgcacgucga

SEQ ID NO: 1105237 - RNA, 22 nt, Mycobacterium bovis subsp bovis AF2122/97
cgaggccgcacgucgaccucgg

SEQ ID NO: 1105238 - RNA, 11 nt, Mycobacterium bovis subsp bovis AF2122/97
cgaggccgacc

SEQ ID NO: 1105239 - RNA, 20 nt, Mycobacterium bovis subsp bovis AF2122/97
cgaggccgccgagaugaugc

SEQ ID NO: 1105240 - RNA, 14 nt, Mycobacterium bovis subsp bovis AF2122/97
cgaggccgccguug

SEQ ID NO: 1105241 - RNA, 17 nt, Mycobacterium bovis subsp bovis AF2122/97
cgaggccucggccagcg

SEQ ID NO: 1105242 - RNA, 17 nt, Mycobacterium bovis subsp bovis AF2122/97
cgaggccucggcggccg

SEQ ID NO: 1105243 - RNA, 19 nt, Mycobacterium bovis subsp bovis AF2122/97
cgaggccucggcggccgug

SEQ ID NO: 1105244 - RNA, 21 nt, Mycobacterium bovis subsp bovis AF2122/97
cgaggccucggcggccguggc

SEQ ID NO: 1105245 - RNA, 18 nt, Mycobacterium bovis subsp bovis AF2122/97
cgaggccucgucccacaa

SEQ ID NO: 1105246 - RNA, 17 nt, Mycobacterium bovis subsp bovis AF2122/97
cgaggccuaccaggcgc

SEQ ID NO: 1105247 - RNA, 18 nt, Mycobacterium bovis subsp bovis AF2122/97
cgaggccuaccaggcgcg

SEQ ID NO: 1105248 - RNA, 16 nt, Mycobacterium bovis subsp bovis AF2122/97
cgaggcgaccggaccg

SEQ ID NO: 1105249 - RNA, 21 nt, Mycobacterium bovis subsp bovis AF2122/97
cgaggcgagcggccaguccgg

SEQ ID NO: 1105250 - RNA, 17 nt, Mycobacterium bovis subsp bovis AF2122/97
cgaggcgagucaccggg

SEQ ID NO: 1105251 - RNA, 22 nt, Mycobacterium bovis subsp bovis AF2122/97
cgaggcgaguucgcgcacgucg

SEQ ID NO: 1105252 - RNA, 14 nt, Mycobacterium bovis subsp bovis AF2122/97
cgaggcgcagguca

SEQ ID NO: 1105253 - RNA, 13 nt, Mycobacterium bovis subsp bovis AF2122/97
cgaggcgcccaac

SEQ ID NO: 1105254 - RNA, 16 nt, Mycobacterium bovis subsp bovis AF2122/97
cgaggccaugcucgcc

SEQ ID NO: 1105255 - RNA, 20 nt, Mycobacterium bovis subsp bovis AF2122/97
cgaggccauguugccgugga

SEQ ID NO: 1105256 - RNA, 17 nt, Mycobacterium bovis subsp bovis AF2122/97
cgaggcaccgacaucgu

SEQ ID NO: 1105257 - RNA, 18 nt, Mycobacterium bovis subsp bovis AF2122/97
cgaggcaccgacaucguc

SEQ ID NO: 1105258 - RNA, 16 nt, Mycobacterium bovis subsp bovis AF2122/97
cgaggcaaccgacacu

SEQ ID NO: 1105259 - RNA, 13 nt, Mycobacterium bovis subsp bovis AF2122/97
cgaggcaaugcga

SEQ ID NO: 1105260 - RNA, 18 nt, Mycobacterium bovis subsp bovis AF2122/97
cgaggcacaaucaccgcc

SEQ ID NO: 1105261 - RNA, 19 nt, Mycobacterium bovis subsp bovis AF2122/97
cgaggcacaaucaccgccg

SEQ ID NO: 1105262 - RNA, 22 nt, Mycobacterium bovis subsp bovis AF2122/97
cgaggcacaaucaccgccgcga

SEQ ID NO: 1105263 - RNA, 22 nt, Mycobacterium bovis subsp bovis AF2122/97
cgaggcagacacgagucgccag

SEQ ID NO: 1105264 - RNA, 16 nt, Mycobacterium bovis subsp bovis AF2122/97
cgaggcagcacccgca

SEQ ID NO: 1105265 - RNA, 19 nt, Mycobacterium bovis subsp bovis AF2122/97
cgaggcagcacccgcacgg

SEQ ID NO: 1105266 - RNA, 14 nt, Mycobacterium bovis subsp bovis AF2122/97
cgaggcagcgucgu

SEQ ID NO: 1105267 - RNA, 23 nt, Mycobacterium bovis subsp bovis AF2122/97
cgaggcaggccucggcgccgccc

SEQ ID NO: 1105268 - RNA, 13 nt, Mycobacterium bovis subsp bovis AF2122/97
cgaggccacgcca

SEQ ID NO: 1105269 - RNA, 18 nt, Mycobacterium bovis subsp bovis AF2122/97
cgaggccacgccagcucg

SEQ ID NO: 1105270 - RNA, 21 nt, Mycobacterium bovis subsp bovis AF2122/97
cgaggccacgccagcucgccg

SEQ ID NO: 1105271 - RNA, 14 nt, Mycobacterium bovis subsp bovis AF2122/97
cgaggaugucgaug

SEQ ID NO: 1105272 - RNA, 17 nt, Mycobacterium bovis subsp bovis AF2122/97
cgaggaugucgaugacc

SEQ ID NO: 1105273 - RNA, 21 nt, Mycobacterium bovis subsp bovis AF2122/97
cgaggauguaguuggugaugc

SEQ ID NO: 1105274 - RNA, 23 nt, Mycobacterium bovis subsp bovis AF2122/97
cgaggauguugugccgaucggcc

SEQ ID NO: 1105275 - RNA, 15 nt, Mycobacterium bovis subsp bovis AF2122/97
cgaggauucauggcg

SEQ ID NO: 1105276 - RNA, 14 nt, Mycobacterium bovis subsp bovis AF2122/97
cgaggaugccgaac

SEQ ID NO: 1105277 - RNA, 20 nt, Mycobacterium bovis subsp bovis AF2122/97
cgaggaucccgcugcacgac

SEQ ID NO: 1105278 - RNA, 14 nt, Mycobacterium bovis subsp bovis AF2122/97
cgaggacgucaccg

SEQ ID NO: 1105279 - RNA, 16 nt, Mycobacterium bovis subsp bovis AF2122/97
cgaggaccagaggcgc

SEQ ID NO: 1105280 - RNA, 16 nt, Mycobacterium bovis subsp bovis AF2122/97
cgaggacggcguagac

SEQ ID NO: 1105281 - RNA, 19 nt, Mycobacterium bovis subsp bovis AF2122/97
cgaggagaugccgacgaac

SEQ ID NO: 1105282 - RNA, 18 nt, Mycobacterium bovis subsp bovis AF2122/97
cgaggaguuggugcagcg

SEQ ID NO: 1105283 - RNA, 14 nt, Mycobacterium bovis subsp bovis AF2122/97
cgaggagggccgcg

SEQ ID NO: 1105284 - RNA, 20 nt, Mycobacterium bovis subsp bovis AF2122/97
cgaggaccugcucgggcgug

SEQ ID NO: 1105285 - RNA, 20 nt, Mycobacterium bovis subsp bovis AF2122/97
cgaggacgccggcgccgcca

SEQ ID NO: 1105286 - RNA, 14 nt, Mycobacterium bovis subsp bovis AF2122/97
cgaggacggcguag

SEQ ID NO: 1105287 - RNA, 20 nt, Mycobacterium bovis subsp bovis AF2122/97
cgaggacacauugaccaggu

SEQ ID NO: 1105288 - RNA, 21 nt, Mycobacterium bovis subsp bovis AF2122/97
cgaggacacauugaccaggug

SEQ ID NO: 1105289 - RNA, 22 nt, Mycobacterium bovis subsp bovis AF2122/97
cgaggaccaccacuaggucgcc

SEQ ID NO: 1105290 - RNA, 19 nt, Mycobacterium bovis subsp bovis AF2122/97
cgaggaacuggaccggugc

SEQ ID NO: 1105291 - RNA, 19 nt, Mycobacterium bovis subsp bovis AF2122/97
cgagcgucagauccggccg

SEQ ID NO: 1105292 - RNA, 20 nt, Mycobacterium bovis subsp bovis AF2122/97
cgagcgucagauccggccgu

SEQ ID NO: 1105293 - RNA, 21 nt, Mycobacterium bovis subsp bovis AF2122/97
cgagcgcggugccgccaccgg

SEQ ID NO: 1105294 - RNA, 18 nt, Mycobacterium bovis subsp bovis AF2122/97
cgagcguaaugcugcugc

SEQ ID NO: 1105295 - RNA, 16 nt, Mycobacterium bovis subsp bovis AF2122/97
cgagcguagcgaccuc

SEQ ID NO: 1105296 - RNA, 18 nt, Mycobacterium bovis subsp bovis AF2122/97
cgagcguagcgaccucgc

SEQ ID NO: 1105297 - RNA, 13 nt, Mycobacterium bovis subsp bovis AF2122/97
cgagcgcggcgau

SEQ ID NO: 1105298 - RNA, 15 nt, Mycobacterium bovis subsp bovis AF2122/97
cgagcgcggcgaucg

SEQ ID NO: 1105299 - RNA, 17 nt, Mycobacterium bovis subsp bovis AF2122/97
cgagcgcuaucaccgcc

SEQ ID NO: 1105300 - RNA, 15 nt, Mycobacterium bovis subsp bovis AF2122/97
cgagcucaccugcgg

SEQ ID NO: 1105301 - RNA, 21 nt, Mycobacterium bovis subsp bovis AF2122/97
cgagcucacuucacgccgccc

SEQ ID NO: 1105302 - RNA, 19 nt, Mycobacterium bovis subsp bovis AF2122/97
cgagcguuuggacgggcgu

SEQ ID NO: 1105303 - RNA, 18 nt, Mycobacterium bovis subsp bovis AF2122/97
cgagcguuuggacgggcg

SEQ ID NO: 1105304 - RNA, 18 nt, Mycobacterium bovis subsp bovis AF2122/97
cgagcgugcgcacggcgc

SEQ ID NO: 1105305 - RNA, 19 nt, Mycobacterium bovis subsp bovis AF2122/97
cgagcgugaaccuggcgac

SEQ ID NO: 1105306 - RNA, 14 nt, Mycobacterium bovis subsp bovis AF2122/97
cgagcguccggugg

SEQ ID NO: 1105307 - RNA, 14 nt, Mycobacterium bovis subsp bovis AF2122/97
cgagcgcggcaacc

SEQ ID NO: 1105308 - RNA, 16 nt, Mycobacterium bovis subsp bovis AF2122/97
cgagcgcgcgcuguug

SEQ ID NO: 1105309 - RNA, 15 nt, Mycobacterium bovis subsp bovis AF2122/97
cgagcgcgucgguca

SEQ ID NO: 1105310 - RNA, 16 nt, Mycobacterium bovis subsp bovis AF2122/97
cgagcgcuaucaccgc

SEQ ID NO: 1105311 - RNA, 13 nt, Mycobacterium bovis subsp bovis AF2122/97
cgagcgcaccgcu

SEQ ID NO: 1105312 - RNA, 19 nt, Mycobacterium bovis subsp bovis AF2122/97
cgagcgcaccgcugaccgc

SEQ ID NO: 1105313 - RNA, 12 nt, Mycobacterium bovis subsp bovis AF2122/97
cgagcgcacugg

SEQ ID NO: 1105314 - RNA, 13 nt, Mycobacterium bovis subsp bovis AF2122/97
cgagcgcagcgca

SEQ ID NO: 1105315 - RNA, 13 nt, Mycobacterium bovis subsp bovis AF2122/97
cgagcgcacuggg

SEQ ID NO: 1105316 - RNA, 16 nt, Mycobacterium bovis subsp bovis AF2122/97
cgagcgcacuggggag

SEQ ID NO: 1105317 - RNA, 12 nt, Mycobacterium bovis subsp bovis AF2122/97
cgagcgcaccgc

SEQ ID NO: 1105318 - RNA, 19 nt, Mycobacterium bovis subsp bovis AF2122/97
cgagcgcaagagccguccg

SEQ ID NO: 1105319 - RNA, 15 nt, Mycobacterium bovis subsp bovis AF2122/97
cgagcgcacaccggc

SEQ ID NO: 1105320 - RNA, 13 nt, Mycobacterium bovis subsp bovis AF2122/97
cgagcgcaccacg

SEQ ID NO: 1105321 - RNA, 14 nt, Mycobacterium bovis subsp bovis AF2122/97
cgagcgcgccgcgc

SEQ ID NO: 1105322 - RNA, 17 nt, Mycobacterium bovis subsp bovis AF2122/97
cgagcgcgccguugccg

SEQ ID NO: 1105323 - RNA, 20 nt, Mycobacterium bovis subsp bovis AF2122/97
cgagcgcgccguugccgccc

SEQ ID NO: 1105324 - RNA, 13 nt, Mycobacterium bovis subsp bovis AF2122/97
cgagcgcgcgacg

SEQ ID NO: 1105325 - RNA, 18 nt, Mycobacterium bovis subsp bovis AF2122/97
cgagcgcaucgauggccg

SEQ ID NO: 1105326 - RNA, 21 nt, Mycobacterium bovis subsp bovis AF2122/97
cgagcgcaucgauggccgcga

SEQ ID NO: 1105327 - RNA, 20 nt, Mycobacterium bovis subsp bovis AF2122/97
cgagcgcaucggccaacacc

SEQ ID NO: 1105328 - RNA, 23 nt, Mycobacterium bovis subsp bovis AF2122/97
cgagcgcauguugcaggcgcagc

SEQ ID NO: 1105329 - RNA, 15 nt, Mycobacterium bovis subsp bovis AF2122/97
cgagcgccagcgcca

SEQ ID NO: 1105330 - RNA, 23 nt, Mycobacterium bovis subsp bovis AF2122/97
cgagcuccgcggcgagcuccgau

SEQ ID NO: 1105331 - RNA, 16 nt, Mycobacterium bovis subsp bovis AF2122/97
cgagcucgccgcagcg

SEQ ID NO: 1105332 - RNA, 17 nt, Mycobacterium bovis subsp bovis AF2122/97
cgagcucgaagcccgga

SEQ ID NO: 1105333 - RNA, 15 nt, Mycobacterium bovis subsp bovis AF2122/97
cgagcucgaggcccg

SEQ ID NO: 1105334 - RNA, 20 nt, Mycobacterium bovis subsp bovis AF2122/97
cgagcucgaggcccgggugc

SEQ ID NO: 1105335 - RNA, 14 nt, Mycobacterium bovis subsp bovis AF2122/97
cgagcuccgaugcc

SEQ ID NO: 1105336 - RNA, 17 nt, Mycobacterium bovis subsp bovis AF2122/97
cgagcuccgaugccgac

SEQ ID NO: 1105337 - RNA, 18 nt, Mycobacterium bovis subsp bovis AF2122/97
cgagcuccgaugccgacg

SEQ ID NO: 1105338 - RNA, 15 nt, Mycobacterium bovis subsp bovis AF2122/97
cgagcucgggugcga

SEQ ID NO: 1105339 - RNA, 13 nt, Mycobacterium bovis subsp bovis AF2122/97
cgagcucggucac

SEQ ID NO: 1105340 - RNA, 14 nt, Mycobacterium bovis subsp bovis AF2122/97
cgagcucguccucg

SEQ ID NO: 1105341 - RNA, 19 nt, Mycobacterium bovis subsp bovis AF2122/97
cgagcucggccccgccgcc

SEQ ID NO: 1105342 - RNA, 20 nt, Mycobacterium bovis subsp bovis AF2122/97
cgagcucggccccgccgccg

SEQ ID NO: 1105343 - RNA, 13 nt, Mycobacterium bovis subsp bovis AF2122/97
cgagcucggcgcc

SEQ ID NO: 1105344 - RNA, 17 nt, Mycobacterium bovis subsp bovis AF2122/97
cgagcucggcgcccagc

SEQ ID NO: 1105345 - RNA, 20 nt, Mycobacterium bovis subsp bovis AF2122/97
cgagcucguccucgucuucg

SEQ ID NO: 1105346 - RNA, 14 nt, Mycobacterium bovis subsp bovis AF2122/97
cgagcucgucgagc

SEQ ID NO: 1105347 - RNA, 14 nt, Mycobacterium bovis subsp bovis AF2122/97
cgagcugacgaugg

SEQ ID NO: 1105348 - RNA, 13 nt, Mycobacterium bovis subsp bovis AF2122/97
cgagcugacgccg

SEQ ID NO: 1105349 - RNA, 14 nt, Mycobacterium bovis subsp bovis AF2122/97
cgagcugacgccga

SEQ ID NO: 1105350 - RNA, 13 nt, Mycobacterium bovis subsp bovis AF2122/97
cgagcugagcggc

SEQ ID NO: 1105351 - RNA, 21 nt, Mycobacterium bovis subsp bovis AF2122/97
cgagcugagcggccagcaucg

SEQ ID NO: 1105352 - RNA, 17 nt, Mycobacterium bovis subsp bovis AF2122/97
cgagcugauacgcaugc

SEQ ID NO: 1105353 - RNA, 14 nt, Mycobacterium bovis subsp bovis AF2122/97
cgagcugaccuggu

SEQ ID NO: 1105354 - RNA, 18 nt, Mycobacterium bovis subsp bovis AF2122/97
cgagcugauccggguggc

SEQ ID NO: 1105355 - RNA, 19 nt, Mycobacterium bovis subsp bovis AF2122/97
cgagcugcgacgaugccgc

SEQ ID NO: 1105356 - RNA, 16 nt, Mycobacterium bovis subsp bovis AF2122/97
cgagcuggcaacgccg

SEQ ID NO: 1105357 - RNA, 20 nt, Mycobacterium bovis subsp bovis AF2122/97
cgagcuggcaacgccgcgcc

SEQ ID NO: 1105358 - RNA, 21 nt, Mycobacterium bovis subsp bovis AF2122/97
cgagcugcgggucgcguuucg

SEQ ID NO: 1105359 - RNA, 16 nt, Mycobacterium bovis subsp bovis AF2122/97
cgagcuggcgaccugg

SEQ ID NO: 1105360 - RNA, 17 nt, Mycobacterium bovis subsp bovis AF2122/97
cgagcuugggccggugc

SEQ ID NO: 1105361 - RNA, 15 nt, Mycobacterium bovis subsp bovis AF2122/97
cgagcuuggccgccg

SEQ ID NO: 1105362 - RNA, 16 nt, Mycobacterium bovis subsp bovis AF2122/97
cgagcuuggccgccgc

SEQ ID NO: 1105363 - RNA, 18 nt, Mycobacterium bovis subsp bovis AF2122/97
cgagcuuggccgccgcca

SEQ ID NO: 1105364 - RNA, 14 nt, Mycobacterium bovis subsp bovis AF2122/97
cgagcuuggccggc

SEQ ID NO: 1105365 - RNA, 16 nt, Mycobacterium bovis subsp bovis AF2122/97
cgagcuuggccggcag

SEQ ID NO: 1105366 - RNA, 17 nt, Mycobacterium bovis subsp bovis AF2122/97
cgagcuuggcuuggccg

SEQ ID NO: 1105367 - RNA, 15 nt, Mycobacterium bovis subsp bovis AF2122/97
cgagcuucagcgcgc

SEQ ID NO: 1105368 - RNA, 21 nt, Mycobacterium bovis subsp bovis AF2122/97
cgagcuugagcgugagcgccg

SEQ ID NO: 1105369 - RNA, 16 nt, Mycobacterium bovis subsp bovis AF2122/97
cgagcuuccacgccgg

SEQ ID NO: 1105370 - RNA, 21 nt, Mycobacterium bovis subsp bovis AF2122/97
cgagcuggcgcgcgggguggc

SEQ ID NO: 1105371 - RNA, 20 nt, Mycobacterium bovis subsp bovis AF2122/97
cgagcuguaggucagcgcgu

SEQ ID NO: 1105372 - RNA, 15 nt, Mycobacterium bovis subsp bovis AF2122/97
cgagcccuccagggc

SEQ ID NO: 1105373 - RNA, 22 nt, Mycobacterium bovis subsp bovis AF2122/97
cgagcccucguuaucgaccgcc

SEQ ID NO: 1105374 - RNA, 23 nt, Mycobacterium bovis subsp bovis AF2122/97
cgagcccucguuaucgaccgccg

SEQ ID NO: 1105375 - RNA, 16 nt, Mycobacterium bovis subsp bovis AF2122/97
cgagcccggugcuacc

SEQ ID NO: 1105376 - RNA, 18 nt, Mycobacterium bovis subsp bovis AF2122/97
cgagcccguccucgucgg

SEQ ID NO: 1105377 - RNA, 18 nt, Mycobacterium bovis subsp bovis AF2122/97
cgagcccgggccguacgg

SEQ ID NO: 1105378 - RNA, 21 nt, Mycobacterium bovis subsp bovis AF2122/97
cgagcccgggccugaaccacg

SEQ ID NO: 1105379 - RNA, 13 nt, Mycobacterium bovis subsp bovis AF2122/97
cgagcccggagcg

SEQ ID NO: 1105380 - RNA, 18 nt, Mycobacterium bovis subsp bovis AF2122/97
cgagcccggccucggcga

SEQ ID NO: 1105381 - RNA, 13 nt, Mycobacterium bovis subsp bovis AF2122/97
cgagccgacaucg

SEQ ID NO: 1105382 - RNA, 19 nt, Mycobacterium bovis subsp bovis AF2122/97
cgagccgagccucgcucuc

SEQ ID NO: 1105383 - RNA, 23 nt, Mycobacterium bovis subsp bovis AF2122/97
cgagcccgucgaguagguaacgc

SEQ ID NO: 1105384 - RNA, 24 nt, Mycobacterium bovis subsp bovis AF2122/97
cgagccgacccgacgcuggucggc

SEQ ID NO: 1105385 - RNA, 20 nt, Mycobacterium bovis subsp bovis AF2122/97
cgagccgcaaaaucgaugac

SEQ ID NO: 1105386 - RNA, 12 nt, Mycobacterium bovis subsp bovis AF2122/97
cgagccgcacaa

SEQ ID NO: 1105387 - RNA, 20 nt, Mycobacterium bovis subsp bovis AF2122/97
cgagccgcacaaacgggcgu

SEQ ID NO: 1105388 - RNA, 20 nt, Mycobacterium bovis subsp bovis AF2122/97
cgagccgauauaccagggca

SEQ ID NO: 1105389 - RNA, 12 nt, Mycobacterium bovis subsp bovis AF2122/97
cgagccgaccgg

SEQ ID NO: 1105390 - RNA, 15 nt, Mycobacterium bovis subsp bovis AF2122/97
cgagccgaccggcgg

SEQ ID NO: 1105391 - RNA, 13 nt, Mycobacterium bovis subsp bovis AF2122/97
cgagccgcagcuc

SEQ ID NO: 1105392 - RNA, 15 nt, Mycobacterium bovis subsp bovis AF2122/97
cgagccgcagcucgc

SEQ ID NO: 1105393 - RNA, 21 nt, Mycobacterium bovis subsp bovis AF2122/97
cgagccucgcucuccauggcc

SEQ ID NO: 1105394 - RNA, 20 nt, Mycobacterium bovis subsp bovis AF2122/97
cgagccugauaaagcccggc

SEQ ID NO: 1105395 - RNA, 20 nt, Mycobacterium bovis subsp bovis AF2122/97
cgagccucgcucuccauggc

SEQ ID NO: 1105396 - RNA, 15 nt, Mycobacterium bovis subsp bovis AF2122/97
cgagccgugccagca

SEQ ID NO: 1105397 - RNA, 15 nt, Mycobacterium bovis subsp bovis AF2122/97
cgagccggugcgcgc

SEQ ID NO: 1105398 - RNA, 20 nt, Mycobacterium bovis subsp bovis AF2122/97
cgagccggugcgcgcggucg

SEQ ID NO: 1105399 - RNA, 19 nt, Mycobacterium bovis subsp bovis AF2122/97
cgagcgcaaucgaccacga

SEQ ID NO: 1105400 - RNA, 12 nt, Mycobacterium bovis subsp bovis AF2122/97
cgagcgcaccac

SEQ ID NO: 1105401 - RNA, 20 nt, Mycobacterium bovis subsp bovis AF2122/97
cgagcgauacgucgucagcc

SEQ ID NO: 1105402 - RNA, 15 nt, Mycobacterium bovis subsp bovis AF2122/97
cgagcgagaaucacg

SEQ ID NO: 1105403 - RNA, 17 nt, Mycobacterium bovis subsp bovis AF2122/97
cgagcgauacgucguca

SEQ ID NO: 1105404 - RNA, 18 nt, Mycobacterium bovis subsp bovis AF2122/97
cgagcgauacgucgucag

SEQ ID NO: 1105405 - RNA, 16 nt, Mycobacterium bovis subsp bovis AF2122/97
cgagcgaaggugaacg

SEQ ID NO: 1105406 - RNA, 19 nt, Mycobacterium bovis subsp bovis AF2122/97
cgagccgauauuggcaucg

SEQ ID NO: 1105407 - RNA, 19 nt, Mycobacterium bovis subsp bovis AF2122/97
cgagccuugagcgcggcua

SEQ ID NO: 1105408 - RNA, 22 nt, Mycobacterium bovis subsp bovis AF2122/97
cgagcgacguuaaugacgccau

SEQ ID NO: 1105409 - RNA, 14 nt, Mycobacterium bovis subsp bovis AF2122/97
cgagcgacguuguu

SEQ ID NO: 1105410 - RNA, 23 nt, Mycobacterium bovis subsp bovis AF2122/97
cgagcgacccccagcgcccgccg

SEQ ID NO: 1105411 - RNA, 23 nt, Mycobacterium bovis subsp bovis AF2122/97
cgagcauccacccauagacccgg

SEQ ID NO: 1105412 - RNA, 18 nt, Mycobacterium bovis subsp bovis AF2122/97
cgagcagggccggcaccg

SEQ ID NO: 1105413 - RNA, 19 nt, Mycobacterium bovis subsp bovis AF2122/97
cgagcagggccggcaccgc

SEQ ID NO: 1105414 - RNA, 17 nt, Mycobacterium bovis subsp bovis AF2122/97
cgagcauaccgccgcug

SEQ ID NO: 1105415 - RNA, 18 nt, Mycobacterium bovis subsp bovis AF2122/97
cgagcauaccgccgcugc

SEQ ID NO: 1105416 - RNA, 19 nt, Mycobacterium bovis subsp bovis AF2122/97
cgagcaucaacgaaccagc

SEQ ID NO: 1105417 - RNA, 23 nt, Mycobacterium bovis subsp bovis AF2122/97
cgagcaucagauucgcgcuggcc

SEQ ID NO: 1105418 - RNA, 17 nt, Mycobacterium bovis subsp bovis AF2122/97
cgagcaucucgacaucg

SEQ ID NO: 1105419 - RNA, 22 nt, Mycobacterium bovis subsp bovis AF2122/97
cgagcaucucgacaucggccag

SEQ ID NO: 1105420 - RNA, 17 nt, Mycobacterium bovis subsp bovis AF2122/97
cgagcaucuucgcgcag

SEQ ID NO: 1105421 - RNA, 14 nt, Mycobacterium bovis subsp bovis AF2122/97
cgagcaugccguug

SEQ ID NO: 1105422 - RNA, 19 nt, Mycobacterium bovis subsp bovis AF2122/97
cgagcaugccguugacaac

SEQ ID NO: 1105423 - RNA, 16 nt, Mycobacterium bovis subsp bovis AF2122/97
cgagcccgccggguug

SEQ ID NO: 1105424 - RNA, 14 nt, Mycobacterium bovis subsp bovis AF2122/97
cgagcccgcaucgc

SEQ ID NO: 1105425 - RNA, 19 nt, Mycobacterium bovis subsp bovis AF2122/97
cgagcauuucggaugccgc

SEQ ID NO: 1105426 - RNA, 22 nt, Mycobacterium bovis subsp bovis AF2122/97
cgagcauuucggaugccgcggc

SEQ ID NO: 1105427 - RNA, 17 nt, Mycobacterium bovis subsp bovis AF2122/97
cgagccaacaagucgau

SEQ ID NO: 1105428 - RNA, 21 nt, Mycobacterium bovis subsp bovis AF2122/97
cgagcccgaaccaccgcguug

SEQ ID NO: 1105429 - RNA, 18 nt, Mycobacterium bovis subsp bovis AF2122/97
cgagcaggcccaacgcga

SEQ ID NO: 1105430 - RNA, 21 nt, Mycobacterium bovis subsp bovis AF2122/97
cgagcaggauaaacccggcga

SEQ ID NO: 1105431 - RNA, 22 nt, Mycobacterium bovis subsp bovis AF2122/97
cgagcaggauaaacccggcgag

SEQ ID NO: 1105432 - RNA, 23 nt, Mycobacterium bovis subsp bovis AF2122/97
cgagcaggaugcgaucgucacgc

SEQ ID NO: 1105433 - RNA, 18 nt, Mycobacterium bovis subsp bovis AF2122/97
cgagcagcuucucggcga

SEQ ID NO: 1105434 - RNA, 17 nt, Mycobacterium bovis subsp bovis AF2122/97
cgagcaggccgcccagc

SEQ ID NO: 1105435 - RNA, 19 nt, Mycobacterium bovis subsp bovis AF2122/97
cgagcaggcccaacgcgau

SEQ ID NO: 1105436 - RNA, 23 nt, Mycobacterium bovis subsp bovis AF2122/97
cgagcaggcccaacgcgaugucc

SEQ ID NO: 1105437 - RNA, 20 nt, Mycobacterium bovis subsp bovis AF2122/97
cgagcaggcgcaccaggcgg

SEQ ID NO: 1105438 - RNA, 23 nt, Mycobacterium bovis subsp bovis AF2122/97
cgagcaggcgcaccaggcggccg

SEQ ID NO: 1105439 - RNA, 23 nt, Mycobacterium bovis subsp bovis AF2122/97
cgagcagacgcgaaagcacccca

SEQ ID NO: 1105440 - RNA, 19 nt, Mycobacterium bovis subsp bovis AF2122/97
cgagcagacgcgaaauccc

SEQ ID NO: 1105441 - RNA, 23 nt, Mycobacterium bovis subsp bovis AF2122/97
cgagcagacgcagaaucgcccaa

SEQ ID NO: 1105442 - RNA, 19 nt, Mycobacterium bovis subsp bovis AF2122/97
cgagcagacgcagagucgc

SEQ ID NO: 1105443 - RNA, 13 nt, Mycobacterium bovis subsp bovis AF2122/97
cgagcagacgcga

SEQ ID NO: 1105444 - RNA, 19 nt, Mycobacterium bovis subsp bovis AF2122/97
cgagcagacacuaaagccc

SEQ ID NO: 1105445 - RNA, 19 nt, Mycobacterium bovis subsp bovis AF2122/97
cgagcagacgcgaaagcac

SEQ ID NO: 1105446 - RNA, 14 nt, Mycobacterium bovis subsp bovis AF2122/97
cgagcagacgcgga

SEQ ID NO: 1105447 - RNA, 15 nt, Mycobacterium bovis subsp bovis AF2122/97
cgagcagacgcggaa

SEQ ID NO: 1105448 - RNA, 18 nt, Mycobacterium bovis subsp bovis AF2122/97
cgagcagacgcggaaucg

SEQ ID NO: 1105449 - RNA, 19 nt, Mycobacterium bovis subsp bovis AF2122/97
cgagcagacgcggaaucgc

SEQ ID NO: 1105450 - RNA, 19 nt, Mycobacterium bovis subsp bovis AF2122/97
cgagcagcucaaugucgaa

SEQ ID NO: 1105451 - RNA, 20 nt, Mycobacterium bovis subsp bovis AF2122/97
cgagcagacgcggaaucgca

SEQ ID NO: 1105452 - RNA, 20 nt, Mycobacterium bovis subsp bovis AF2122/97
cgagcagacgcuaaagcccc

SEQ ID NO: 1105453 - RNA, 22 nt, Mycobacterium bovis subsp bovis AF2122/97
cgagcagagaacuccgccacca

SEQ ID NO: 1105454 - RNA, 17 nt, Mycobacterium bovis subsp bovis AF2122/97
cgagcacgccgaccaau

SEQ ID NO: 1105455 - RNA, 15 nt, Mycobacterium bovis subsp bovis AF2122/97
cgagcacgaugucga

SEQ ID NO: 1105456 - RNA, 22 nt, Mycobacterium bovis subsp bovis AF2122/97
cgagcaccuuggggugggcgac

SEQ ID NO: 1105457 - RNA, 23 nt, Mycobacterium bovis subsp bovis AF2122/97
cgagcaauagcuccuauggcaag

SEQ ID NO: 1105458 - RNA, 12 nt, Mycobacterium bovis subsp bovis AF2122/97
cgagcacgucgg

SEQ ID NO: 1105459 - RNA, 22 nt, Mycobacterium bovis subsp bovis AF2122/97
cgagcacgucggggugccggcu

SEQ ID NO: 1105460 - RNA, 18 nt, Mycobacterium bovis subsp bovis AF2122/97
cgagcacgacgacgucgg

SEQ ID NO: 1105461 - RNA, 14 nt, Mycobacterium bovis subsp bovis AF2122/97
cgagcacgcgggca

SEQ ID NO: 1105462 - RNA, 16 nt, Mycobacterium bovis subsp bovis AF2122/97
cgagcacggugagccg

SEQ ID NO: 1105463 - RNA, 22 nt, Mycobacterium bovis subsp bovis AF2122/97
cgagcacggugagccgguggcc

SEQ ID NO: 1105464 - RNA, 19 nt, Mycobacterium bovis subsp bovis AF2122/97
cgagcagacgcaaaagccc

SEQ ID NO: 1105465 - RNA, 19 nt, Mycobacterium bovis subsp bovis AF2122/97
cgagcagacacagaaucgc

SEQ ID NO: 1105466 - RNA, 20 nt, Mycobacterium bovis subsp bovis AF2122/97
cgagcagacgcaaaaucgca

SEQ ID NO: 1105467 - RNA, 23 nt, Mycobacterium bovis subsp bovis AF2122/97
cgagcagacgcaaaaucgcccaa

SEQ ID NO: 1105468 - RNA, 16 nt, Mycobacterium bovis subsp bovis AF2122/97
cgagcagacgcagaau

SEQ ID NO: 1105469 - RNA, 19 nt, Mycobacterium bovis subsp bovis AF2122/97
cgagcagacgcagaaucgc

SEQ ID NO: 1105470 - RNA, 21 nt, Mycobacterium bovis subsp bovis AF2122/97
cgagcagacgcauaagccccc

SEQ ID NO: 1105471 - RNA, 22 nt, Mycobacterium bovis subsp bovis AF2122/97
cgagcagacgcauaagcccccg

SEQ ID NO: 1105472 - RNA, 16 nt, Mycobacterium bovis subsp bovis AF2122/97
cgagcagacgccgcgu

SEQ ID NO: 1105473 - RNA, 15 nt, Mycobacterium bovis subsp bovis AF2122/97
cgagcacucggccac

SEQ ID NO: 1105474 - RNA, 24 nt, Mycobacterium bovis subsp bovis AF2122/97
cgagcacugaggagaugagcacca

SEQ ID NO: 1105475 - RNA, 16 nt, Mycobacterium bovis subsp bovis AF2122/97
cgagcagaaacaacgu

SEQ ID NO: 1105476 - RNA, 21 nt, Mycobacterium bovis subsp bovis AF2122/97
cgagcagacgcaaaagccacc

SEQ ID NO: 1105477 - RNA, 18 nt, Mycobacterium bovis subsp bovis AF2122/97
cgagcagacacagaaucg

SEQ ID NO: 1105478 - RNA, 16 nt, Mycobacterium bovis subsp bovis AF2122/97
cgagcaacaccagggc

SEQ ID NO: 1105479 - RNA, 20 nt, Mycobacterium bovis subsp bovis AF2122/97
cgagcaaacacgccucgccg

SEQ ID NO: 1105480 - RNA, 23 nt, Mycobacterium bovis subsp bovis AF2122/97
cgagcaaacacgccucgccgaag

SEQ ID NO: 1105481 - RNA, 17 nt, Mycobacterium bovis subsp bovis AF2122/97
cgagcaaacauccaccc

SEQ ID NO: 1105482 - RNA, 21 nt, Mycobacterium bovis subsp bovis AF2122/97
cgagcaaacauccacccgcgg

SEQ ID NO: 1105483 - RNA, 22 nt, Mycobacterium bovis subsp bovis AF2122/97
cgagcaaaccagauugccgagc

SEQ ID NO: 1105484 - RNA, 23 nt, Mycobacterium bovis subsp bovis AF2122/97
cgagcaaaccagauugccgagcc

SEQ ID NO: 1105485 - RNA, 15 nt, Mycobacterium bovis subsp bovis AF2122/97
cgagcaacggcggca

SEQ ID NO: 1105486 - RNA, 20 nt, Mycobacterium bovis subsp bovis AF2122/97
cgagcaacaccagggccucc

SEQ ID NO: 1105487 - RNA, 15 nt, Mycobacterium bovis subsp bovis AF2122/97
cgagcaacaccccug

SEQ ID NO: 1105488 - RNA, 13 nt, Mycobacterium bovis subsp bovis AF2122/97
cgagcaacaccgu

SEQ ID NO: 1105489 - RNA, 20 nt, Mycobacterium bovis subsp bovis AF2122/97
cgagaucgcgugcgacgaua

SEQ ID NO: 1105490 - RNA, 15 nt, Mycobacterium bovis subsp bovis AF2122/97
cgagaugaugcugcc

SEQ ID NO: 1105491 - RNA, 23 nt, Mycobacterium bovis subsp bovis AF2122/97
cgagaugcgcaauagaccgcagu

SEQ ID NO: 1105492 - RNA, 18 nt, Mycobacterium bovis subsp bovis AF2122/97
cgagaugcggaccacacc

SEQ ID NO: 1105493 - RNA, 22 nt, Mycobacterium bovis subsp bovis AF2122/97
cgagauucggagucaccagcaa

SEQ ID NO: 1105494 - RNA, 16 nt, Mycobacterium bovis subsp bovis AF2122/97
cgagauggcgaucaug

SEQ ID NO: 1105495 - RNA, 23 nt, Mycobacterium bovis subsp bovis AF2122/97
cgagauggcgaucaugagcagca

SEQ ID NO: 1105496 - RNA, 19 nt, Mycobacterium bovis subsp bovis AF2122/97
cgagauugccgggccgccg

SEQ ID NO: 1105497 - RNA, 20 nt, Mycobacterium bovis subsp bovis AF2122/97
cgagauugccgggccgccga

SEQ ID NO: 1105498 - RNA, 20 nt, Mycobacterium bovis subsp bovis AF2122/97
cgacugccguucagcggcgg

SEQ ID NO: 1105499 - RNA, 17 nt, Mycobacterium bovis subsp bovis AF2122/97
cgacugcgaaugcuggg

SEQ ID NO: 1105500 - RNA, 14 nt, Mycobacterium bovis subsp bovis AF2122/97
cgacugccagcgcc

SEQ ID NO: 1105501 - RNA, 13 nt, Mycobacterium bovis subsp bovis AF2122/97
cgagacgucggcg

SEQ ID NO: 1105502 - RNA, 22 nt, Mycobacterium bovis subsp bovis AF2122/97
cgagacggcguugucgacgaag

SEQ ID NO: 1105503 - RNA, 13 nt, Mycobacterium bovis subsp bovis AF2122/97
cgagacggcguug

SEQ ID NO: 1105504 - RNA, 22 nt, Mycobacterium bovis subsp bovis AF2122/97
cgacugcgcccauagcugccgg

SEQ ID NO: 1105505 - RNA, 19 nt, Mycobacterium bovis subsp bovis AF2122/97
cgacucugcgucugcucac

SEQ ID NO: 1105506 - RNA, 22 nt, Mycobacterium bovis subsp bovis AF2122/97
cgacucguggcgccacggcagc

SEQ ID NO: 1105507 - RNA, 15 nt, Mycobacterium bovis subsp bovis AF2122/97
cgacucgugucugcc

SEQ ID NO: 1105508 - RNA, 18 nt, Mycobacterium bovis subsp bovis AF2122/97
cgacucgguugaggacga

SEQ ID NO: 1105509 - RNA, 20 nt, Mycobacterium bovis subsp bovis AF2122/97
cgacucugugacgggcacaa

SEQ ID NO: 1105510 - RNA, 20 nt, Mycobacterium bovis subsp bovis AF2122/97
cgacucugcgucugcucacc

SEQ ID NO: 1105511 - RNA, 17 nt, Mycobacterium bovis subsp bovis AF2122/97
cgacugcaccuggccgc

SEQ ID NO: 1105512 - RNA, 13 nt, Mycobacterium bovis subsp bovis AF2122/97
cgacugcagcggc

SEQ ID NO: 1105513 - RNA, 21 nt, Mycobacterium bovis subsp bovis AF2122/97
cgagagcgucaaccacggccg

SEQ ID NO: 1105514 - RNA, 17 nt, Mycobacterium bovis subsp bovis AF2122/97
cgagauccagcgccuug

SEQ ID NO: 1105515 - RNA, 17 nt, Mycobacterium bovis subsp bovis AF2122/97
cgagagguucgccgucg

SEQ ID NO: 1105516 - RNA, 15 nt, Mycobacterium bovis subsp bovis AF2122/97
cgagauccucgucga

SEQ ID NO: 1105517 - RNA, 18 nt, Mycobacterium bovis subsp bovis AF2122/97
cgagauccucgucgaggu

SEQ ID NO: 1105518 - RNA, 18 nt, Mycobacterium bovis subsp bovis AF2122/97
cgagaucgcgugcgacga

SEQ ID NO: 1105519 - RNA, 23 nt, Mycobacterium bovis subsp bovis AF2122/97
cgagauccugguaaggccggccg

SEQ ID NO: 1105520 - RNA, 17 nt, Mycobacterium bovis subsp bovis AF2122/97
cgagauccuucgcguug

SEQ ID NO: 1105521 - RNA, 13 nt, Mycobacterium bovis subsp bovis AF2122/97
cgagaucgggccg

SEQ ID NO: 1105522 - RNA, 17 nt, Mycobacterium bovis subsp bovis AF2122/97
cgagaucgggccggccg

SEQ ID NO: 1105523 - RNA, 14 nt, Mycobacterium bovis subsp bovis AF2122/97
cgagaucgccguug

SEQ ID NO: 1105524 - RNA, 24 nt, Mycobacterium bovis subsp bovis AF2122/97
cgagaucgccguugccggcgacca

SEQ ID NO: 1105525 - RNA, 20 nt, Mycobacterium bovis subsp bovis AF2122/97
cgagaucgcggcgacccggu

SEQ ID NO: 1105526 - RNA, 14 nt, Mycobacterium bovis subsp bovis AF2122/97
cgagagcaccgacu

SEQ ID NO: 1105527 - RNA, 23 nt, Mycobacterium bovis subsp bovis AF2122/97
cgagagcaccgacuucagcaacg

SEQ ID NO: 1105528 - RNA, 16 nt, Mycobacterium bovis subsp bovis AF2122/97
cgagagcagccagcca

SEQ ID NO: 1105529 - RNA, 18 nt, Mycobacterium bovis subsp bovis AF2122/97
cgagagcaugguccagca

SEQ ID NO: 1105530 - RNA, 14 nt, Mycobacterium bovis subsp bovis AF2122/97
cgagagccgaccgg

SEQ ID NO: 1105531 - RNA, 19 nt, Mycobacterium bovis subsp bovis AF2122/97
cgagagcgcugucccgaac

SEQ ID NO: 1105532 - RNA, 18 nt, Mycobacterium bovis subsp bovis AF2122/97
cgagagaguucgcaugcu

SEQ ID NO: 1105533 - RNA, 22 nt, Mycobacterium bovis subsp bovis AF2122/97
cgagagaguuagugacguagac

SEQ ID NO: 1105534 - RNA, 14 nt, Mycobacterium bovis subsp bovis AF2122/97
cgagagaguucgca

SEQ ID NO: 1105535 - RNA, 19 nt, Mycobacterium bovis subsp bovis AF2122/97
cgagacuugcuggcccgca

SEQ ID NO: 1105536 - RNA, 19 nt, Mycobacterium bovis subsp bovis AF2122/97
cgagacuuggugauccgag

SEQ ID NO: 1105537 - RNA, 23 nt, Mycobacterium bovis subsp bovis AF2122/97
cgagacuccgccuugcagcgcgu

SEQ ID NO: 1105538 - RNA, 16 nt, Mycobacterium bovis subsp bovis AF2122/97
cgagacuucgguguag

SEQ ID NO: 1105539 - RNA, 23 nt, Mycobacterium bovis subsp bovis AF2122/97
cgccaccucggaggugccggugc

SEQ ID NO: 1105540 - RNA, 19 nt, Mycobacterium bovis subsp bovis AF2122/97
cgccaccugacgugcggcg

SEQ ID NO: 1105541 - RNA, 22 nt, Mycobacterium bovis subsp bovis AF2122/97
cgccaccugacgugcggcgcgg

SEQ ID NO: 1105542 - RNA, 19 nt, Mycobacterium bovis subsp bovis AF2122/97
cgccaccuuggcugggccc

SEQ ID NO: 1105543 - RNA, 22 nt, Mycobacterium bovis subsp bovis AF2122/97
cgccaccuuggcugggcccgcc

SEQ ID NO: 1105544 - RNA, 15 nt, Mycobacterium bovis subsp bovis AF2122/97
cgccacgcgucuucg

SEQ ID NO: 1105545 - RNA, 22 nt, Mycobacterium bovis subsp bovis AF2122/97
cgccacgcgucuucggucgcgg

SEQ ID NO: 1105546 - RNA, 16 nt, Mycobacterium bovis subsp bovis AF2122/97
cgccacggcaucggcc

SEQ ID NO: 1105547 - RNA, 16 nt, Mycobacterium bovis subsp bovis AF2122/97
cgccacggaucgcggc

SEQ ID NO: 1105548 - RNA, 20 nt, Mycobacterium bovis subsp bovis AF2122/97
cgccacggaucgcggcggcg

SEQ ID NO: 1105549 - RNA, 22 nt, Mycobacterium bovis subsp bovis AF2122/97
cgccacggaucgcggcggcgug

SEQ ID NO: 1105550 - RNA, 18 nt, Mycobacterium bovis subsp bovis AF2122/97
cgccaacguugcgccagc

SEQ ID NO: 1105551 - RNA, 16 nt, Mycobacterium bovis subsp bovis AF2122/97
cgccaaggcgaugguc

SEQ ID NO: 1105552 - RNA, 18 nt, Mycobacterium bovis subsp bovis AF2122/97
cgccaaguacgcgaccgc

SEQ ID NO: 1105553 - RNA, 19 nt, Mycobacterium bovis subsp bovis AF2122/97
cgccaaguacgcgaccgcg

SEQ ID NO: 1105554 - RNA, 16 nt, Mycobacterium bovis subsp bovis AF2122/97
cgccaauccaccggug

SEQ ID NO: 1105555 - RNA, 17 nt, Mycobacterium bovis subsp bovis AF2122/97
cgccaauccaccggugc

SEQ ID NO: 1105556 - RNA, 18 nt, Mycobacterium bovis subsp bovis AF2122/97
cgccaauccaccggugcc

SEQ ID NO: 1105557 - RNA, 20 nt, Mycobacterium bovis subsp bovis AF2122/97
cgccaaucauggugcguagc

SEQ ID NO: 1105558 - RNA, 17 nt, Mycobacterium bovis subsp bovis AF2122/97
cgccaccucgccggccg

SEQ ID NO: 1105559 - RNA, 18 nt, Mycobacterium bovis subsp bovis AF2122/97
cgccaccucgccggccgu

SEQ ID NO: 1105560 - RNA, 23 nt, Mycobacterium bovis subsp bovis AF2122/97
cgccaccgugguggacgaccgcg

SEQ ID NO: 1105561 - RNA, 16 nt, Mycobacterium bovis subsp bovis AF2122/97
cgccaccgugucacgc

SEQ ID NO: 1105562 - RNA, 22 nt, Mycobacterium bovis subsp bovis AF2122/97
cgccaccguuaccgccguuugc

SEQ ID NO: 1105563 - RNA, 14 nt, Mycobacterium bovis subsp bovis AF2122/97
cgccaccguuugcg

SEQ ID NO: 1105564 - RNA, 22 nt, Mycobacterium bovis subsp bovis AF2122/97
cgccaccguuugcgcaccgguc

SEQ ID NO: 1105565 - RNA, 17 nt, Mycobacterium bovis subsp bovis AF2122/97
cgccaccucccacgccg

SEQ ID NO: 1105566 - RNA, 19 nt, Mycobacterium bovis subsp bovis AF2122/97
cgccaccucccacgccgcc

SEQ ID NO: 1105567 - RNA, 14 nt, Mycobacterium bovis subsp bovis AF2122/97
cgccaccuccgacg

SEQ ID NO: 1105568 - RNA, 22 nt, Mycobacterium bovis subsp bovis AF2122/97
cgccacguccaucaccggcggc

SEQ ID NO: 1105569 - RNA, 15 nt, Mycobacterium bovis subsp bovis AF2122/97
cgccacgucgacggu

SEQ ID NO: 1105570 - RNA, 14 nt, Mycobacterium bovis subsp bovis AF2122/97
cgccacgucgacgg

SEQ ID NO: 1105571 - RNA, 20 nt, Mycobacterium bovis subsp bovis AF2122/97
cgccacguggucgagcaggc

SEQ ID NO: 1105572 - RNA, 14 nt, Mycobacterium bovis subsp bovis AF2122/97
cgccacucagcccg

SEQ ID NO: 1105573 - RNA, 16 nt, Mycobacterium bovis subsp bovis AF2122/97
cgccacugccggcagc

SEQ ID NO: 1105574 - RNA, 20 nt, Mycobacterium bovis subsp bovis AF2122/97
cgccacugaccgcgaucgcc

SEQ ID NO: 1105575 - RNA, 21 nt, Mycobacterium bovis subsp bovis AF2122/97
cgccacugaccgcgaucgccg

SEQ ID NO: 1105576 - RNA, 17 nt, Mycobacterium bovis subsp bovis AF2122/97
cgccagaacgacaccgc

SEQ ID NO: 1105577 - RNA, 18 nt, Mycobacterium bovis subsp bovis AF2122/97
cgccagaauugccggcga

SEQ ID NO: 1105578 - RNA, 14 nt, Mycobacterium bovis subsp bovis AF2122/97
cgccagcaaugccc

SEQ ID NO: 1105579 - RNA, 15 nt, Mycobacterium bovis subsp bovis AF2122/97
cgccagcaacgucgg

SEQ ID NO: 1105580 - RNA, 20 nt, Mycobacterium bovis subsp bovis AF2122/97
cgccagcaacccugcggugc

SEQ ID NO: 1105581 - RNA, 15 nt, Mycobacterium bovis subsp bovis AF2122/97
cgccagcaccaccgg

SEQ ID NO: 1105582 - RNA, 16 nt, Mycobacterium bovis subsp bovis AF2122/97
cgccagcaccaccggc

SEQ ID NO: 1105583 - RNA, 17 nt, Mycobacterium bovis subsp bovis AF2122/97
cgccagcaccaccggcu

SEQ ID NO: 1105584 - RNA, 19 nt, Mycobacterium bovis subsp bovis AF2122/97
cgccagcaccaccggcucc

SEQ ID NO: 1105585 - RNA, 17 nt, Mycobacterium bovis subsp bovis AF2122/97
cgccagcaaugcccgca

SEQ ID NO: 1105586 - RNA, 18 nt, Mycobacterium bovis subsp bovis AF2122/97
cgccagcaaugcccgcac

SEQ ID NO: 1105587 - RNA, 19 nt, Mycobacterium bovis subsp bovis AF2122/97
cgccagcaaugcccgcacc

SEQ ID NO: 1105588 - RNA, 21 nt, Mycobacterium bovis subsp bovis AF2122/97
cgccagcaaugcccgcaccgc

SEQ ID NO: 1105589 - RNA, 15 nt, Mycobacterium bovis subsp bovis AF2122/97
cgccagaccgcggcg

SEQ ID NO: 1105590 - RNA, 16 nt, Mycobacterium bovis subsp bovis AF2122/97
cgccagaccgcggcgg

SEQ ID NO: 1105591 - RNA, 12 nt, Mycobacterium bovis subsp bovis AF2122/97
cgccagaccgcc

SEQ ID NO: 1105592 - RNA, 14 nt, Mycobacterium bovis subsp bovis AF2122/97
cgccagccgguugg

SEQ ID NO: 1105593 - RNA, 13 nt, Mycobacterium bovis subsp bovis AF2122/97
cgccagccggccg

SEQ ID NO: 1105594 - RNA, 15 nt, Mycobacterium bovis subsp bovis AF2122/97
cgccagccggccgcg

SEQ ID NO: 1105595 - RNA, 20 nt, Mycobacterium bovis subsp bovis AF2122/97
cgccagccggccgcgaccgc

SEQ ID NO: 1105596 - RNA, 16 nt, Mycobacterium bovis subsp bovis AF2122/97
cgccagccgugccggu

SEQ ID NO: 1105597 - RNA, 16 nt, Mycobacterium bovis subsp bovis AF2122/97
cgccagccuccaccag

SEQ ID NO: 1105598 - RNA, 11 nt, Mycobacterium bovis subsp bovis AF2122/97
cgccagcgcga

SEQ ID NO: 1105599 - RNA, 21 nt, Mycobacterium bovis subsp bovis AF2122/97
cgccagcgcucacauaagcga

SEQ ID NO: 1105600 - RNA, 13 nt, Mycobacterium bovis subsp bovis AF2122/97
cgccagcgcggug

SEQ ID NO: 1105601 - RNA, 23 nt, Mycobacterium bovis subsp bovis AF2122/97
cgccagcgcgaaccugcucggcg

SEQ ID NO: 1105602 - RNA, 18 nt, Mycobacterium bovis subsp bovis AF2122/97
cgccaggcccccucggcg

SEQ ID NO: 1105603 - RNA, 23 nt, Mycobacterium bovis subsp bovis AF2122/97
cgccagcguuaggucgccggcug

SEQ ID NO: 1105604 - RNA, 15 nt, Mycobacterium bovis subsp bovis AF2122/97
cgccagcucaaccac

SEQ ID NO: 1105605 - RNA, 20 nt, Mycobacterium bovis subsp bovis AF2122/97
cgccagccgcgagccgguga

SEQ ID NO: 1105606 - RNA, 17 nt, Mycobacterium bovis subsp bovis AF2122/97
cgccagccaggcgaagu

SEQ ID NO: 1105607 - RNA, 22 nt, Mycobacterium bovis subsp bovis AF2122/97
cgccagccgcgcuagcucggcc

SEQ ID NO: 1105608 - RNA, 17 nt, Mycobacterium bovis subsp bovis AF2122/97
cgccagcaucagcccgg

SEQ ID NO: 1105609 - RNA, 18 nt, Mycobacterium bovis subsp bovis AF2122/97
cgccagcaucagcccggc

SEQ ID NO: 1105610 - RNA, 19 nt, Mycobacterium bovis subsp bovis AF2122/97
cgccagcaucagcccggcg

SEQ ID NO: 1105611 - RNA, 13 nt, Mycobacterium bovis subsp bovis AF2122/97
cgccagccaccac

SEQ ID NO: 1105612 - RNA, 14 nt, Mycobacterium bovis subsp bovis AF2122/97
cgccagcaccagcg

SEQ ID NO: 1105613 - RNA, 20 nt, Mycobacterium bovis subsp bovis AF2122/97
cgccagcaccagcgucgcgg

SEQ ID NO: 1105614 - RNA, 23 nt, Mycobacterium bovis subsp bovis AF2122/97
cgccagcaccagcgucgcggcca

SEQ ID NO: 1105615 - RNA, 16 nt, Mycobacterium bovis subsp bovis AF2122/97
cgccaguuccggugac

SEQ ID NO: 1105616 - RNA, 15 nt, Mycobacterium bovis subsp bovis AF2122/97
cgccagugcccgcac

SEQ ID NO: 1105617 - RNA, 21 nt, Mycobacterium bovis subsp bovis AF2122/97
cgccagugcccgcacugccgc

SEQ ID NO: 1105618 - RNA, 14 nt, Mycobacterium bovis subsp bovis AF2122/97
cgccaguucgcggc

SEQ ID NO: 1105619 - RNA, 21 nt, Mycobacterium bovis subsp bovis AF2122/97
cgccaguccggacggcagccg

SEQ ID NO: 1105620 - RNA, 21 nt, Mycobacterium bovis subsp bovis AF2122/97
cgccagucgcaggaucggcgg

SEQ ID NO: 1105621 - RNA, 22 nt, Mycobacterium bovis subsp bovis AF2122/97
cgccagucgcaggaucggcgga

SEQ ID NO: 1105622 - RNA, 23 nt, Mycobacterium bovis subsp bovis AF2122/97
cgccagugcccgcacugccgccg

SEQ ID NO: 1105623 - RNA, 20 nt, Mycobacterium bovis subsp bovis AF2122/97
cgccaguguggugcggcgcg

SEQ ID NO: 1105624 - RNA, 18 nt, Mycobacterium bovis subsp bovis AF2122/97
cgccaguguugcgcugcg

SEQ ID NO: 1105625 - RNA, 21 nt, Mycobacterium bovis subsp bovis AF2122/97
cgccaggugaugccgccgugg

SEQ ID NO: 1105626 - RNA, 22 nt, Mycobacterium bovis subsp bovis AF2122/97
cgccagguuaggcaauagccgg

SEQ ID NO: 1105627 - RNA, 16 nt, Mycobacterium bovis subsp bovis AF2122/97
cgccaguauggccgcc

SEQ ID NO: 1105628 - RNA, 16 nt, Mycobacterium bovis subsp bovis AF2122/97
cgccagucccggcgca

SEQ ID NO: 1105629 - RNA, 17 nt, Mycobacterium bovis subsp bovis AF2122/97
cgccaguccgaucgccg

SEQ ID NO: 1105630 - RNA, 18 nt, Mycobacterium bovis subsp bovis AF2122/97
cgccagucccacugggcc

SEQ ID NO: 1105631 - RNA, 19 nt, Mycobacterium bovis subsp bovis AF2122/97
cgccagucccacugggccg

SEQ ID NO: 1105632 - RNA, 17 nt, Mycobacterium bovis subsp bovis AF2122/97
cgccaguauggccgcca

SEQ ID NO: 1105633 - RNA, 19 nt, Mycobacterium bovis subsp bovis AF2122/97
cgccaguauggccgccacc

SEQ ID NO: 1105634 - RNA, 20 nt, Mycobacterium bovis subsp bovis AF2122/97
cgccaguauggccgccaccg

SEQ ID NO: 1105635 - RNA, 17 nt, Mycobacterium bovis subsp bovis AF2122/97
cgccaguaacgcccaca

SEQ ID NO: 1105636 - RNA, 21 nt, Mycobacterium bovis subsp bovis AF2122/97
cgccagggcccuagccggcgc

SEQ ID NO: 1105637 - RNA, 20 nt, Mycobacterium bovis subsp bovis AF2122/97
cgccaggggugugccguggu

SEQ ID NO: 1105638 - RNA, 22 nt, Mycobacterium bovis subsp bovis AF2122/97
cgccaggggugugccguggucg

SEQ ID NO: 1105639 - RNA, 16 nt, Mycobacterium bovis subsp bovis AF2122/97
cgccaggggacccggg

SEQ ID NO: 1105640 - RNA, 18 nt, Mycobacterium bovis subsp bovis AF2122/97
cgccagguacucggugca

SEQ ID NO: 1105641 - RNA, 16 nt, Mycobacterium bovis subsp bovis AF2122/97
cgccaggucagcucga

SEQ ID NO: 1105642 - RNA, 19 nt, Mycobacterium bovis subsp bovis AF2122/97
cgccaggucagcucgagcg

SEQ ID NO: 1105643 - RNA, 22 nt, Mycobacterium bovis subsp bovis AF2122/97
cgccagguccgccggugccgcc

SEQ ID NO: 1105644 - RNA, 23 nt, Mycobacterium bovis subsp bovis AF2122/97
cgccagguccgccggugccgccg

SEQ ID NO: 1105645 - RNA, 23 nt, Mycobacterium bovis subsp bovis AF2122/97
cgccagggaucuagaggcggccc

SEQ ID NO: 1105646 - RNA, 21 nt, Mycobacterium bovis subsp bovis AF2122/97
cgccagggcacguggcgguac

SEQ ID NO: 1105647 - RNA, 17 nt, Mycobacterium bovis subsp bovis AF2122/97
cgccaggcuugcggcac

SEQ ID NO: 1105648 - RNA, 15 nt, Mycobacterium bovis subsp bovis AF2122/97
cgccaggccgcgcga

SEQ ID NO: 1105649 - RNA, 23 nt, Mycobacterium bovis subsp bovis AF2122/97
cgccaggccgcgcgacaacccgg

SEQ ID NO: 1105650 - RNA, 18 nt, Mycobacterium bovis subsp bovis AF2122/97
cgccaggccgaccgcgca

SEQ ID NO: 1105651 - RNA, 15 nt, Mycobacterium bovis subsp bovis AF2122/97
cgccaggccgagccc

SEQ ID NO: 1105652 - RNA, 20 nt, Mycobacterium bovis subsp bovis AF2122/97
cgccaggccgagcccggugc

SEQ ID NO: 1105653 - RNA, 19 nt, Mycobacterium bovis subsp bovis AF2122/97
cgccaggccuaggccgagg

SEQ ID NO: 1105654 - RNA, 14 nt, Mycobacterium bovis subsp bovis AF2122/97
cgccaggccgucgg

SEQ ID NO: 1105655 - RNA, 14 nt, Mycobacterium bovis subsp bovis AF2122/97
cgccaggccguggc

SEQ ID NO: 1105656 - RNA, 14 nt, Mycobacterium bovis subsp bovis AF2122/97
cgccaggccguugc

SEQ ID NO: 1105657 - RNA, 18 nt, Mycobacterium bovis subsp bovis AF2122/97
cgccagcucgccggccgg

SEQ ID NO: 1105658 - RNA, 17 nt, Mycobacterium bovis subsp bovis AF2122/97
cgccaggcggcaauucg

SEQ ID NO: 1105659 - RNA, 20 nt, Mycobacterium bovis subsp bovis AF2122/97
cgccaggcggcaauucgggc

SEQ ID NO: 1105660 - RNA, 19 nt, Mycobacterium bovis subsp bovis AF2122/97
cgccaggcgcgaucgcgcc

SEQ ID NO: 1105661 - RNA, 20 nt, Mycobacterium bovis subsp bovis AF2122/97
cgccaggcgcgaucgcgccc

SEQ ID NO: 1105662 - RNA, 18 nt, Mycobacterium bovis subsp bovis AF2122/97
cgccaggcgcuuggccgg

SEQ ID NO: 1105663 - RNA, 16 nt, Mycobacterium bovis subsp bovis AF2122/97
cgccaucgggucaccc

SEQ ID NO: 1105664 - RNA, 14 nt, Mycobacterium bovis subsp bovis AF2122/97
cgccaucgucgcgc

SEQ ID NO: 1105665 - RNA, 18 nt, Mycobacterium bovis subsp bovis AF2122/97
cgccaucguuucacccgg

SEQ ID NO: 1105666 - RNA, 18 nt, Mycobacterium bovis subsp bovis AF2122/97
cgccaucucgacggugac

SEQ ID NO: 1105667 - RNA, 14 nt, Mycobacterium bovis subsp bovis AF2122/97
cgccaugaagccgg

SEQ ID NO: 1105668 - RNA, 17 nt, Mycobacterium bovis subsp bovis AF2122/97
cgccaugaagccgggcg

SEQ ID NO: 1105669 - RNA, 17 nt, Mycobacterium bovis subsp bovis AF2122/97
cgccaugagcgcgccca

SEQ ID NO: 1105670 - RNA, 23 nt, Mycobacterium bovis subsp bovis AF2122/97
cgccaucucgacggugaccggau

SEQ ID NO: 1105671 - RNA, 16 nt, Mycobacterium bovis subsp bovis AF2122/97
cgccaugaaaucaccc

SEQ ID NO: 1105672 - RNA, 18 nt, Mycobacterium bovis subsp bovis AF2122/97
cgccaucugcuggcuggg

SEQ ID NO: 1105673 - RNA, 23 nt, Mycobacterium bovis subsp bovis AF2122/97
cgccaucgccgccggugccgccc

SEQ ID NO: 1105674 - RNA, 20 nt, Mycobacterium bovis subsp bovis AF2122/97
cgccaucgccuccagccggc

SEQ ID NO: 1105675 - RNA, 15 nt, Mycobacterium bovis subsp bovis AF2122/97
cgccaucgccgccgg

SEQ ID NO: 1105676 - RNA, 14 nt, Mycobacterium bovis subsp bovis AF2122/97
cgccaucgccgccg

SEQ ID NO: 1105677 - RNA, 18 nt, Mycobacterium bovis subsp bovis AF2122/97
cgccaucgccaacaccaa

SEQ ID NO: 1105678 - RNA, 18 nt, Mycobacterium bovis subsp bovis AF2122/97
cgccauccccgccggcgc

SEQ ID NO: 1105679 - RNA, 20 nt, Mycobacterium bovis subsp bovis AF2122/97
cgccauccccgccggcgcca

SEQ ID NO: 1105680 - RNA, 18 nt, Mycobacterium bovis subsp bovis AF2122/97
cgccauccccuggccagc

SEQ ID NO: 1105681 - RNA, 19 nt, Mycobacterium bovis subsp bovis AF2122/97
cgccauccccuggccagca

SEQ ID NO: 1105682 - RNA, 20 nt, Mycobacterium bovis subsp bovis AF2122/97
cgccauccccuggccagcag

SEQ ID NO: 1105683 - RNA, 17 nt, Mycobacterium bovis subsp bovis AF2122/97
cgccaucccgccgcccg

SEQ ID NO: 1105684 - RNA, 19 nt, Mycobacterium bovis subsp bovis AF2122/97
cgccaucccgccgcccgca

SEQ ID NO: 1105685 - RNA, 14 nt, Mycobacterium bovis subsp bovis AF2122/97
cgccauccaugaug

SEQ ID NO: 1105686 - RNA, 16 nt, Mycobacterium bovis subsp bovis AF2122/97
cgccaucagccgcugc

SEQ ID NO: 1105687 - RNA, 22 nt, Mycobacterium bovis subsp bovis AF2122/97
cgccaucagaccaaugaccgcc

SEQ ID NO: 1105688 - RNA, 13 nt, Mycobacterium bovis subsp bovis AF2122/97
cgccaucaccccg

SEQ ID NO: 1105689 - RNA, 18 nt, Mycobacterium bovis subsp bovis AF2122/97
cgccaucaccgccguuac

SEQ ID NO: 1105690 - RNA, 21 nt, Mycobacterium bovis subsp bovis AF2122/97
cgccaucaacaaggggcagca

SEQ ID NO: 1105691 - RNA, 15 nt, Mycobacterium bovis subsp bovis AF2122/97
cgccaguucggcguc

SEQ ID NO: 1105692 - RNA, 20 nt, Mycobacterium bovis subsp bovis AF2122/97
cgccaguugcguuguccacc

SEQ ID NO: 1105693 - RNA, 21 nt, Mycobacterium bovis subsp bovis AF2122/97
cgccauaaagagauggguagc

SEQ ID NO: 1105694 - RNA, 14 nt, Mycobacterium bovis subsp bovis AF2122/97
cgccauaacaccgg

SEQ ID NO: 1105695 - RNA, 21 nt, Mycobacterium bovis subsp bovis AF2122/97
cgccauacgucgccucgagau

SEQ ID NO: 1105696 - RNA, 14 nt, Mycobacterium bovis subsp bovis AF2122/97
cgccauacacaacg

SEQ ID NO: 1105697 - RNA, 17 nt, Mycobacterium bovis subsp bovis AF2122/97
cgccauaccggccgcca

SEQ ID NO: 1105698 - RNA, 14 nt, Mycobacterium bovis subsp bovis AF2122/97
cgccauagccgcga

SEQ ID NO: 1105699 - RNA, 13 nt, Mycobacterium bovis subsp bovis AF2122/97
cgccauagcgggc

SEQ ID NO: 1105700 - RNA, 19 nt, Mycobacterium bovis subsp bovis AF2122/97
cgcaccgccacccugacca

SEQ ID NO: 1105701 - RNA, 13 nt, Mycobacterium bovis subsp bovis AF2122/97
cgcaccgccaccc

SEQ ID NO: 1105702 - RNA, 17 nt, Mycobacterium bovis subsp bovis AF2122/97
cgcaccgccacccugac

SEQ ID NO: 1105703 - RNA, 14 nt, Mycobacterium bovis subsp bovis AF2122/97
cgcaccgccggccu

SEQ ID NO: 1105704 - RNA, 19 nt, Mycobacterium bovis subsp bovis AF2122/97
cgcaccgccugcucggcga

SEQ ID NO: 1105705 - RNA, 15 nt, Mycobacterium bovis subsp bovis AF2122/97
cgcaccgcccgccga

SEQ ID NO: 1105706 - RNA, 18 nt, Mycobacterium bovis subsp bovis AF2122/97
cgcaccgccaguuccggu

SEQ ID NO: 1105707 - RNA, 15 nt, Mycobacterium bovis subsp bovis AF2122/97
cgcagaaucgcacgc

SEQ ID NO: 1105708 - RNA, 15 nt, Mycobacterium bovis subsp bovis AF2122/97
cgcagaaucgcauga

SEQ ID NO: 1105709 - RNA, 18 nt, Mycobacterium bovis subsp bovis AF2122/97
cgcagacacugcugcggc

SEQ ID NO: 1105710 - RNA, 21 nt, Mycobacterium bovis subsp bovis AF2122/97
cgcagacacugcugcggcagc

SEQ ID NO: 1105711 - RNA, 18 nt, Mycobacterium bovis subsp bovis AF2122/97
cgcagaccguccagcaac

SEQ ID NO: 1105712 - RNA, 15 nt, Mycobacterium bovis subsp bovis AF2122/97
cgcagaccugcauca

SEQ ID NO: 1105713 - RNA, 15 nt, Mycobacterium bovis subsp bovis AF2122/97
cgcagacgccgacuc

SEQ ID NO: 1105714 - RNA, 16 nt, Mycobacterium bovis subsp bovis AF2122/97
cgcagaaucgcaugau

SEQ ID NO: 1105715 - RNA, 16 nt, Mycobacterium bovis subsp bovis AF2122/97
cgcagacacugcugcg

SEQ ID NO: 1105716 - RNA, 19 nt, Mycobacterium bovis subsp bovis AF2122/97
cgcagaccagacugcagug

SEQ ID NO: 1105717 - RNA, 15 nt, Mycobacterium bovis subsp bovis AF2122/97
cgcagacggcugcca

SEQ ID NO: 1105718 - RNA, 17 nt, Mycobacterium bovis subsp bovis AF2122/97
cgcagacggcugccacg

SEQ ID NO: 1105719 - RNA, 19 nt, Mycobacterium bovis subsp bovis AF2122/97
cgcagacggcugccacgcg

SEQ ID NO: 1105720 - RNA, 22 nt, Mycobacterium bovis subsp bovis AF2122/97
cgcagacggcugccacgcgucg

SEQ ID NO: 1105721 - RNA, 15 nt, Mycobacterium bovis subsp bovis AF2122/97
cgcagacgacaaccg

SEQ ID NO: 1105722 - RNA, 15 nt, Mycobacterium bovis subsp bovis AF2122/97
cgcagacgugguagc

SEQ ID NO: 1105723 - RNA, 19 nt, Mycobacterium bovis subsp bovis AF2122/97
cgcagacucgccaccgcgg

SEQ ID NO: 1105724 - RNA, 23 nt, Mycobacterium bovis subsp bovis AF2122/97
cgcagacucgccaccgcggcgau

SEQ ID NO: 1105725 - RNA, 14 nt, Mycobacterium bovis subsp bovis AF2122/97
cgcagagucaacag

SEQ ID NO: 1105726 - RNA, 19 nt, Mycobacterium bovis subsp bovis AF2122/97
cgcagaucgugcacaaucg

SEQ ID NO: 1105727 - RNA, 17 nt, Mycobacterium bovis subsp bovis AF2122/97
cgcagaucaggacgcga

SEQ ID NO: 1105728 - RNA, 19 nt, Mycobacterium bovis subsp bovis AF2122/97
cgcagagucaacgucguga

SEQ ID NO: 1105729 - RNA, 20 nt, Mycobacterium bovis subsp bovis AF2122/97
cgcagagucgcacugcgccg

SEQ ID NO: 1105730 - RNA, 19 nt, Mycobacterium bovis subsp bovis AF2122/97
cgcagauccccgccaccga

SEQ ID NO: 1105731 - RNA, 18 nt, Mycobacterium bovis subsp bovis AF2122/97
cgcagauauuccucgucg

SEQ ID NO: 1105732 - RNA, 19 nt, Mycobacterium bovis subsp bovis AF2122/97
cgcagauauuccucgucgg

SEQ ID NO: 1105733 - RNA, 16 nt, Mycobacterium bovis subsp bovis AF2122/97
cgcagaucaccgccag

SEQ ID NO: 1105734 - RNA, 13 nt, Mycobacterium bovis subsp bovis AF2122/97
cgcagcccgcgag

SEQ ID NO: 1105735 - RNA, 16 nt, Mycobacterium bovis subsp bovis AF2122/97
cgcagcccgucggugg

SEQ ID NO: 1105736 - RNA, 15 nt, Mycobacterium bovis subsp bovis AF2122/97
cgcagccccucgucg

SEQ ID NO: 1105737 - RNA, 17 nt, Mycobacterium bovis subsp bovis AF2122/97
cgcagccgaucgucucg

SEQ ID NO: 1105738 - RNA, 22 nt, Mycobacterium bovis subsp bovis AF2122/97
cgcagccgaucgucucggccac

SEQ ID NO: 1105739 - RNA, 20 nt, Mycobacterium bovis subsp bovis AF2122/97
cgcagcauggugcggcggcg

SEQ ID NO: 1105740 - RNA, 18 nt, Mycobacterium bovis subsp bovis AF2122/97
cgcagcauguccgcagcg

SEQ ID NO: 1105741 - RNA, 22 nt, Mycobacterium bovis subsp bovis AF2122/97
cgcagcauguccgcagcggugc

SEQ ID NO: 1105742 - RNA, 17 nt, Mycobacterium bovis subsp bovis AF2122/97
cgcagcaggugagccag

SEQ ID NO: 1105743 - RNA, 18 nt, Mycobacterium bovis subsp bovis AF2122/97
cgcagcauccccgcagcg

SEQ ID NO: 1105744 - RNA, 13 nt, Mycobacterium bovis subsp bovis AF2122/97
cgcagcaucggcg

SEQ ID NO: 1105745 - RNA, 14 nt, Mycobacterium bovis subsp bovis AF2122/97
cgcagcaucggcga

SEQ ID NO: 1105746 - RNA, 15 nt, Mycobacterium bovis subsp bovis AF2122/97
cgcagcaucgucgcc

SEQ ID NO: 1105747 - RNA, 15 nt, Mycobacterium bovis subsp bovis AF2122/97
cgcagcaucucgucg

SEQ ID NO: 1105748 - RNA, 19 nt, Mycobacterium bovis subsp bovis AF2122/97
cgcagcaucucgucgaucu

SEQ ID NO: 1105749 - RNA, 16 nt, Mycobacterium bovis subsp bovis AF2122/97
cgcagcagugccgugc

SEQ ID NO: 1105750 - RNA, 14 nt, Mycobacterium bovis subsp bovis AF2122/97
cgcagcaggugagc

SEQ ID NO: 1105751 - RNA, 20 nt, Mycobacterium bovis subsp bovis AF2122/97
cgcagaucgaaaucagcccg

SEQ ID NO: 1105752 - RNA, 15 nt, Mycobacterium bovis subsp bovis AF2122/97
cgcagauuccugaug

SEQ ID NO: 1105753 - RNA, 17 nt, Mycobacterium bovis subsp bovis AF2122/97
cgcagcaacugggcggc

SEQ ID NO: 1105754 - RNA, 22 nt, Mycobacterium bovis subsp bovis AF2122/97
cgcagaucguccaccgccgaca

SEQ ID NO: 1105755 - RNA, 16 nt, Mycobacterium bovis subsp bovis AF2122/97
cgcagcaacggcggcg

SEQ ID NO: 1105756 - RNA, 18 nt, Mycobacterium bovis subsp bovis AF2122/97
cgcagcaacggcggcguc

SEQ ID NO: 1105757 - RNA, 23 nt, Mycobacterium bovis subsp bovis AF2122/97
cgcagccgccucaaugaccaccg

SEQ ID NO: 1105758 - RNA, 23 nt, Mycobacterium bovis subsp bovis AF2122/97
cgcagccggcccgucgcgucgac

SEQ ID NO: 1105759 - RNA, 12 nt, Mycobacterium bovis subsp bovis AF2122/97
cgcagccgcgcg

SEQ ID NO: 1105760 - RNA, 15 nt, Mycobacterium bovis subsp bovis AF2122/97
cgcagccgcucgacg

SEQ ID NO: 1105761 - RNA, 23 nt, Mycobacterium bovis subsp bovis AF2122/97
cgcagccgcucgacggcccgccg

SEQ ID NO: 1105762 - RNA, 17 nt, Mycobacterium bovis subsp bovis AF2122/97
cgcagcgcggcggcauc

SEQ ID NO: 1105763 - RNA, 19 nt, Mycobacterium bovis subsp bovis AF2122/97
cgcagcggcaaggucaacg

SEQ ID NO: 1105764 - RNA, 20 nt, Mycobacterium bovis subsp bovis AF2122/97
cgcagcggaacugggccccc

SEQ ID NO: 1105765 - RNA, 21 nt, Mycobacterium bovis subsp bovis AF2122/97
cgcagcggaacugggccccca

SEQ ID NO: 1105766 - RNA, 13 nt, Mycobacterium bovis subsp bovis AF2122/97
cgcagcggccagc

SEQ ID NO: 1105767 - RNA, 15 nt, Mycobacterium bovis subsp bovis AF2122/97
cgcagcggccagccc

SEQ ID NO: 1105768 - RNA, 16 nt, Mycobacterium bovis subsp bovis AF2122/97
cgcagcggccagccca

SEQ ID NO: 1105769 - RNA, 15 nt, Mycobacterium bovis subsp bovis AF2122/97
cgcagcggcggcaac

SEQ ID NO: 1105770 - RNA, 15 nt, Mycobacterium bovis subsp bovis AF2122/97
cgcagccgcaccggg

SEQ ID NO: 1105771 - RNA, 16 nt, Mycobacterium bovis subsp bovis AF2122/97
cgcagcggugcgcggu

SEQ ID NO: 1105772 - RNA, 15 nt, Mycobacterium bovis subsp bovis AF2122/97
cgcagcgguggucgg

SEQ ID NO: 1105773 - RNA, 21 nt, Mycobacterium bovis subsp bovis AF2122/97
cgcagcgguggucggcgcgcc

SEQ ID NO: 1105774 - RNA, 22 nt, Mycobacterium bovis subsp bovis AF2122/97
cgcagcgguggucggcgcgccg

SEQ ID NO: 1105775 - RNA, 16 nt, Mycobacterium bovis subsp bovis AF2122/97
cgcagcgguccgccgc

SEQ ID NO: 1105776 - RNA, 20 nt, Mycobacterium bovis subsp bovis AF2122/97
cgcagcggugaggugaccaa

SEQ ID NO: 1105777 - RNA, 22 nt, Mycobacterium bovis subsp bovis AF2122/97
cgcagcggugaggugaccaacg

SEQ ID NO: 1105778 - RNA, 17 nt, Mycobacterium bovis subsp bovis AF2122/97
cgcagcgugagugcagc

SEQ ID NO: 1105779 - RNA, 24 nt, Mycobacterium bovis subsp bovis AF2122/97
cgcagcgggcggugucgucaucgg

SEQ ID NO: 1105780 - RNA, 22 nt, Mycobacterium bovis subsp bovis AF2122/97
cgcagcgugaucuggccacggc

SEQ ID NO: 1105781 - RNA, 20 nt, Mycobacterium bovis subsp bovis AF2122/97
cgcaggaccugcgucaucgc

SEQ ID NO: 1105782 - RNA, 22 nt, Mycobacterium bovis subsp bovis AF2122/97
cgcaggaauguugagggugagc

SEQ ID NO: 1105783 - RNA, 16 nt, Mycobacterium bovis subsp bovis AF2122/97
cgcaggaaaaccccgg

SEQ ID NO: 1105784 - RNA, 15 nt, Mycobacterium bovis subsp bovis AF2122/97
cgcagcuuggccagc

SEQ ID NO: 1105785 - RNA, 16 nt, Mycobacterium bovis subsp bovis AF2122/97
cgcagcuuggccagcc

SEQ ID NO: 1105786 - RNA, 13 nt, Mycobacterium bovis subsp bovis AF2122/97
cgcagcugagccg

SEQ ID NO: 1105787 - RNA, 19 nt, Mycobacterium bovis subsp bovis AF2122/97
cgcagcuuguccggugagu

SEQ ID NO: 1105788 - RNA, 24 nt, Mycobacterium bovis subsp bovis AF2122/97
cgcagcugcgggucgugccccggc

SEQ ID NO: 1105789 - RNA, 14 nt, Mycobacterium bovis subsp bovis AF2122/97
cgcagcugacguca

SEQ ID NO: 1105790 - RNA, 19 nt, Mycobacterium bovis subsp bovis AF2122/97
cgcagcugguuugcggugc

SEQ ID NO: 1105791 - RNA, 20 nt, Mycobacterium bovis subsp bovis AF2122/97
cgcagcugguuugcggugcc

SEQ ID NO: 1105792 - RNA, 17 nt, Mycobacterium bovis subsp bovis AF2122/97
cgcagcuccucgcccag

SEQ ID NO: 1105793 - RNA, 16 nt, Mycobacterium bovis subsp bovis AF2122/97
cgcagcucgaccagga

SEQ ID NO: 1105794 - RNA, 15 nt, Mycobacterium bovis subsp bovis AF2122/97
cgcagcucgucguga

SEQ ID NO: 1105795 - RNA, 16 nt, Mycobacterium bovis subsp bovis AF2122/97
cgcagcucgugaccgc

SEQ ID NO: 1105796 - RNA, 18 nt, Mycobacterium bovis subsp bovis AF2122/97
cgcagcguguugcguucg

SEQ ID NO: 1105797 - RNA, 16 nt, Mycobacterium bovis subsp bovis AF2122/97
cgcagcuauuucgcga

SEQ ID NO: 1105798 - RNA, 17 nt, Mycobacterium bovis subsp bovis AF2122/97
cgcagcuccaccgugac

SEQ ID NO: 1105799 - RNA, 23 nt, Mycobacterium bovis subsp bovis AF2122/97
cgcaguacuugaccguccaccga

SEQ ID NO: 1105800 - RNA, 16 nt, Mycobacterium bovis subsp bovis AF2122/97
cgcagggcgucggcga

SEQ ID NO: 1105801 - RNA, 16 nt, Mycobacterium bovis subsp bovis AF2122/97
cgcaggguccacacca

SEQ ID NO: 1105802 - RNA, 15 nt, Mycobacterium bovis subsp bovis AF2122/97
cgcagugacguuccg

SEQ ID NO: 1105803 - RNA, 17 nt, Mycobacterium bovis subsp bovis AF2122/97
cgcagugagcagccgga

SEQ ID NO: 1105804 - RNA, 20 nt, Mycobacterium bovis subsp bovis AF2122/97
cgcagugacguuccgcucgc

SEQ ID NO: 1105805 - RNA, 19 nt, Mycobacterium bovis subsp bovis AF2122/97
cgcaguggcguuacgcucg

SEQ ID NO: 1105806 - RNA, 15 nt, Mycobacterium bovis subsp bovis AF2122/97
cgcaguagccgacca

SEQ ID NO: 1105807 - RNA, 16 nt, Mycobacterium bovis subsp bovis AF2122/97
cgcaguccggggcgca

SEQ ID NO: 1105808 - RNA, 18 nt, Mycobacterium bovis subsp bovis AF2122/97
cgcaguccggggcgcagg

SEQ ID NO: 1105809 - RNA, 18 nt, Mycobacterium bovis subsp bovis AF2122/97
cgcagucaacgcaaucga

SEQ ID NO: 1105810 - RNA, 15 nt, Mycobacterium bovis subsp bovis AF2122/97
cgcagucgggcagcg

SEQ ID NO: 1105811 - RNA, 17 nt, Mycobacterium bovis subsp bovis AF2122/97
cgcagucgcggcagacg

SEQ ID NO: 1105812 - RNA, 13 nt, Mycobacterium bovis subsp bovis AF2122/97
cgcagucugacga

SEQ ID NO: 1105813 - RNA, 19 nt, Mycobacterium bovis subsp bovis AF2122/97
cgcagucggucacgcgggg

SEQ ID NO: 1105814 - RNA, 19 nt, Mycobacterium bovis subsp bovis AF2122/97
cgcaguccgguuacgcucg

SEQ ID NO: 1105815 - RNA, 23 nt, Mycobacterium bovis subsp bovis AF2122/97
cgcauacacgagguagccgacga

SEQ ID NO: 1105816 - RNA, 19 nt, Mycobacterium bovis subsp bovis AF2122/97
cgcauaacgccagucccgg

SEQ ID NO: 1105817 - RNA, 14 nt, Mycobacterium bovis subsp bovis AF2122/97
cgcauaaaucgggg

SEQ ID NO: 1105818 - RNA, 16 nt, Mycobacterium bovis subsp bovis AF2122/97
cgcaguucggucagcg

SEQ ID NO: 1105819 - RNA, 13 nt, Mycobacterium bovis subsp bovis AF2122/97
cgcaguuggcacc

SEQ ID NO: 1105820 - RNA, 18 nt, Mycobacterium bovis subsp bovis AF2122/97
cgcaguuggcaccagccg

SEQ ID NO: 1105821 - RNA, 17 nt, Mycobacterium bovis subsp bovis AF2122/97
cgcaguuuggcggcgcg

SEQ ID NO: 1105822 - RNA, 19 nt, Mycobacterium bovis subsp bovis AF2122/97
cgcaguuuggcggcgcgca

SEQ ID NO: 1105823 - RNA, 20 nt, Mycobacterium bovis subsp bovis AF2122/97
cgcaguugagggugugaggu

SEQ ID NO: 1105824 - RNA, 14 nt, Mycobacterium bovis subsp bovis AF2122/97
cgcauaggcggcca

SEQ ID NO: 1105825 - RNA, 15 nt, Mycobacterium bovis subsp bovis AF2122/97
cgcauaggccccgcc

SEQ ID NO: 1105826 - RNA, 18 nt, Mycobacterium bovis subsp bovis AF2122/97
cgcauaggccccgccagc

SEQ ID NO: 1105827 - RNA, 15 nt, Mycobacterium bovis subsp bovis AF2122/97
cgcauagugcggcug

SEQ ID NO: 1105828 - RNA, 16 nt, Mycobacterium bovis subsp bovis AF2122/97
cgcauagggccaccgc

SEQ ID NO: 1105829 - RNA, 15 nt, Mycobacterium bovis subsp bovis AF2122/97
cgcauacagcgcccg

SEQ ID NO: 1105830 - RNA, 17 nt, Mycobacterium bovis subsp bovis AF2122/97
cgcauagggccaccgcc

SEQ ID NO: 1105831 - RNA, 13 nt, Mycobacterium bovis subsp bovis AF2122/97
cgcaucaccacug

SEQ ID NO: 1105832 - RNA, 19 nt, Mycobacterium bovis subsp bovis AF2122/97
cgcauauugcggcgccgug

SEQ ID NO: 1105833 - RNA, 21 nt, Mycobacterium bovis subsp bovis AF2122/97
cgcaugccccgaccgcguaca

SEQ ID NO: 1105834 - RNA, 18 nt, Mycobacterium bovis subsp bovis AF2122/97
cgcaugcgagaacgucga

SEQ ID NO: 1105835 - RNA, 17 nt, Mycobacterium bovis subsp bovis AF2122/97
cgcaugcgugacccgac

SEQ ID NO: 1105836 - RNA, 13 nt, Mycobacterium bovis subsp bovis AF2122/97
cgcaugucgaucc

SEQ ID NO: 1105837 - RNA, 21 nt, Mycobacterium bovis subsp bovis AF2122/97
cgcaugucggacacguggcgu

SEQ ID NO: 1105838 - RNA, 20 nt, Mycobacterium bovis subsp bovis AF2122/97
cgcaugcucagcaucgucga

SEQ ID NO: 1105839 - RNA, 14 nt, Mycobacterium bovis subsp bovis AF2122/97
cgcaugcucgaucg

SEQ ID NO: 1105840 - RNA, 17 nt, Mycobacterium bovis subsp bovis AF2122/97
cgcaugccacggcaagc

SEQ ID NO: 1105841 - RNA, 16 nt, Mycobacterium bovis subsp bovis AF2122/97
cgcaugccccgaccgc

SEQ ID NO: 1105842 - RNA, 17 nt, Mycobacterium bovis subsp bovis AF2122/97
cgcauccgcgacggcgc

SEQ ID NO: 1105843 - RNA, 15 nt, Mycobacterium bovis subsp bovis AF2122/97
cgcauccgcgacggc

SEQ ID NO: 1105844 - RNA, 20 nt, Mycobacterium bovis subsp bovis AF2122/97
cgcaucccgaauggccgauc

SEQ ID NO: 1105845 - RNA, 23 nt, Mycobacterium bovis subsp bovis AF2122/97
cgcauccagccgugcggcggcug

SEQ ID NO: 1105846 - RNA, 22 nt, Mycobacterium bovis subsp bovis AF2122/97
cgcaucaugucgaagaaccggc

SEQ ID NO: 1105847 - RNA, 21 nt, Mycobacterium bovis subsp bovis AF2122/97
cgcaucauagacagggccgcu

SEQ ID NO: 1105848 - RNA, 19 nt, Mycobacterium bovis subsp bovis AF2122/97
cgcauccacgucgcccagg

SEQ ID NO: 1105849 - RNA, 18 nt, Mycobacterium bovis subsp bovis AF2122/97
cgcauccacuuccgggcg

SEQ ID NO: 1105850 - RNA, 15 nt, Mycobacterium bovis subsp bovis AF2122/97
cgcauccaauaucgc

SEQ ID NO: 1105851 - RNA, 21 nt, Mycobacterium bovis subsp bovis AF2122/97
cgcauccaauccacgguugcc

SEQ ID NO: 1105852 - RNA, 17 nt, Mycobacterium bovis subsp bovis AF2122/97
cgccaaccgugcgcacu

SEQ ID NO: 1105853 - RNA, 18 nt, Mycobacterium bovis subsp bovis AF2122/97
cgccaacaucuccgcguc

SEQ ID NO: 1105854 - RNA, 15 nt, Mycobacterium bovis subsp bovis AF2122/97
cgccaaccgcaggcc

SEQ ID NO: 1105855 - RNA, 16 nt, Mycobacterium bovis subsp bovis AF2122/97
cgccaacgccagcggg

SEQ ID NO: 1105856 - RNA, 14 nt, Mycobacterium bovis subsp bovis AF2122/97
cgccaacgccagca

SEQ ID NO: 1105857 - RNA, 15 nt, Mycobacterium bovis subsp bovis AF2122/97
cgccaacgccagcac

SEQ ID NO: 1105858 - RNA, 17 nt, Mycobacterium bovis subsp bovis AF2122/97
cgccaacgccagcacca

SEQ ID NO: 1105859 - RNA, 15 nt, Mycobacterium bovis subsp bovis AF2122/97
cgccaaauccggugc

SEQ ID NO: 1105860 - RNA, 21 nt, Mycobacterium bovis subsp bovis AF2122/97
cgccaaauccggugcccgcac

SEQ ID NO: 1105861 - RNA, 22 nt, Mycobacterium bovis subsp bovis AF2122/97
cgccaaagccgggauugccgcc

SEQ ID NO: 1105862 - RNA, 15 nt, Mycobacterium bovis subsp bovis AF2122/97
cgccaaccccaacau

SEQ ID NO: 1105863 - RNA, 17 nt, Mycobacterium bovis subsp bovis AF2122/97
cgccaaccccaacaucc

SEQ ID NO: 1105864 - RNA, 20 nt, Mycobacterium bovis subsp bovis AF2122/97
cgccaaccacuuuccggccg

SEQ ID NO: 1105865 - RNA, 18 nt, Mycobacterium bovis subsp bovis AF2122/97
cgcauuccggcgccagga

SEQ ID NO: 1105866 - RNA, 18 nt, Mycobacterium bovis subsp bovis AF2122/97
cgcauucggcgagccgcg

SEQ ID NO: 1105867 - RNA, 15 nt, Mycobacterium bovis subsp bovis AF2122/97
cgcauucgccgggcg

SEQ ID NO: 1105868 - RNA, 15 nt, Mycobacterium bovis subsp bovis AF2122/97
cgcauguucuccacg

SEQ ID NO: 1105869 - RNA, 17 nt, Mycobacterium bovis subsp bovis AF2122/97
cgcauguucuccacgcc

SEQ ID NO: 1105870 - RNA, 17 nt, Mycobacterium bovis subsp bovis AF2122/97
cgcaugccggcgcacca

SEQ ID NO: 1105871 - RNA, 19 nt, Mycobacterium bovis subsp bovis AF2122/97
cgcaugugaaagacaaccc

SEQ ID NO: 1105872 - RNA, 15 nt, Mycobacterium bovis subsp bovis AF2122/97
cgccaaacccggcgg

SEQ ID NO: 1105873 - RNA, 16 nt, Mycobacterium bovis subsp bovis AF2122/97
cgccaaacgcugcgcc

SEQ ID NO: 1105874 - RNA, 20 nt, Mycobacterium bovis subsp bovis AF2122/97
cgccaaacgcugcgcccgga

SEQ ID NO: 1105875 - RNA, 19 nt, Mycobacterium bovis subsp bovis AF2122/97
cgccaaaacggucgaccgu

SEQ ID NO: 1105876 - RNA, 22 nt, Mycobacterium bovis subsp bovis AF2122/97
cgccaaaauccgcccaccgguc

SEQ ID NO: 1105877 - RNA, 23 nt, Mycobacterium bovis subsp bovis AF2122/97
cgccaaaauccgcccaccggucg

SEQ ID NO: 1105878 - RNA, 21 nt, Mycobacterium bovis subsp bovis AF2122/97
cgccaaacaccccggccuugc

SEQ ID NO: 1105879 - RNA, 15 nt, Mycobacterium bovis subsp bovis AF2122/97
cgccaaaacggucga

SEQ ID NO: 1105880 - RNA, 16 nt, Mycobacterium bovis subsp bovis AF2122/97
cgcauucguggagccg

SEQ ID NO: 1105881 - RNA, 20 nt, Mycobacterium bovis subsp bovis AF2122/97
cgcauucguggagccggccg

SEQ ID NO: 1105882 - RNA, 22 nt, Mycobacterium bovis subsp bovis AF2122/97
cgcauucguggagccggccgug

SEQ ID NO: 1105883 - RNA, 17 nt, Mycobacterium bovis subsp bovis AF2122/97
cgcacagccgcuuggcg

SEQ ID NO: 1105884 - RNA, 22 nt, Mycobacterium bovis subsp bovis AF2122/97
cgcacaggaagcccauccccgc

SEQ ID NO: 1105885 - RNA, 19 nt, Mycobacterium bovis subsp bovis AF2122/97
cgcacauugguguccacca

SEQ ID NO: 1105886 - RNA, 18 nt, Mycobacterium bovis subsp bovis AF2122/97
cgcaccaagacgccaccc

SEQ ID NO: 1105887 - RNA, 16 nt, Mycobacterium bovis subsp bovis AF2122/97
cgcaccaagcagcgac

SEQ ID NO: 1105888 - RNA, 13 nt, Mycobacterium bovis subsp bovis AF2122/97
cgcaccaaggccg

SEQ ID NO: 1105889 - RNA, 15 nt, Mycobacterium bovis subsp bovis AF2122/97
cgcaccaaggccgcc

SEQ ID NO: 1105890 - RNA, 20 nt, Mycobacterium bovis subsp bovis AF2122/97
cgcaccaacguugugccgcu

SEQ ID NO: 1105891 - RNA, 15 nt, Mycobacterium bovis subsp bovis AF2122/97
cgcaccacaccacgg

SEQ ID NO: 1105892 - RNA, 14 nt, Mycobacterium bovis subsp bovis AF2122/97
cgcaccacaccgug

SEQ ID NO: 1105893 - RNA, 22 nt, Mycobacterium bovis subsp bovis AF2122/97
cgcaccacaccgugggcgacgg

SEQ ID NO: 1105894 - RNA, 14 nt, Mycobacterium bovis subsp bovis AF2122/97
cgcaccacagugcc

SEQ ID NO: 1105895 - RNA, 16 nt, Mycobacterium bovis subsp bovis AF2122/97
cgcaccaggcggccgu

SEQ ID NO: 1105896 - RNA, 15 nt, Mycobacterium bovis subsp bovis AF2122/97
cgcaccaccgccccg

SEQ ID NO: 1105897 - RNA, 20 nt, Mycobacterium bovis subsp bovis AF2122/97
cgcaccaccgccccgcgccc

SEQ ID NO: 1105898 - RNA, 22 nt, Mycobacterium bovis subsp bovis AF2122/97
cgcaccaccgccccgcgcccaa

SEQ ID NO: 1105899 - RNA, 16 nt, Mycobacterium bovis subsp bovis AF2122/97
cgcaccaccggcccca

SEQ ID NO: 1105900 - RNA, 22 nt, Mycobacterium bovis subsp bovis AF2122/97
cgcaccaccggccccaccggca

SEQ ID NO: 1105901 - RNA, 15 nt, Mycobacterium bovis subsp bovis AF2122/97
cgcaccaccgucucg

SEQ ID NO: 1105902 - RNA, 17 nt, Mycobacterium bovis subsp bovis AF2122/97
cgcaccacgagcagccg

SEQ ID NO: 1105903 - RNA, 13 nt, Mycobacterium bovis subsp bovis AF2122/97
cgcaccaccgcgg

SEQ ID NO: 1105904 - RNA, 15 nt, Mycobacterium bovis subsp bovis AF2122/97
cgcaccaccgcggcg

SEQ ID NO: 1105905 - RNA, 22 nt, Mycobacterium bovis subsp bovis AF2122/97
cgcaccaccgcggcggcggcca

SEQ ID NO: 1105906 - RNA, 16 nt, Mycobacterium bovis subsp bovis AF2122/97
cgcaccacgcccgacg

SEQ ID NO: 1105907 - RNA, 15 nt, Mycobacterium bovis subsp bovis AF2122/97
cgcaccaugucggug

SEQ ID NO: 1105908 - RNA, 16 nt, Mycobacterium bovis subsp bovis AF2122/97
cgcaccaugucgguga

SEQ ID NO: 1105909 - RNA, 14 nt, Mycobacterium bovis subsp bovis AF2122/97
cgcaccaucggcga

SEQ ID NO: 1105910 - RNA, 16 nt, Mycobacterium bovis subsp bovis AF2122/97
cgcaccaucggcgagg

SEQ ID NO: 1105911 - RNA, 17 nt, Mycobacterium bovis subsp bovis AF2122/97
cgcacccagaccgccga

SEQ ID NO: 1105912 - RNA, 22 nt, Mycobacterium bovis subsp bovis AF2122/97
cgcacccaacuccaucagcgcg

SEQ ID NO: 1105913 - RNA, 20 nt, Mycobacterium bovis subsp bovis AF2122/97
cgcacccaugaucccgcuga

SEQ ID NO: 1105914 - RNA, 14 nt, Mycobacterium bovis subsp bovis AF2122/97
cgcacccagggcgu

SEQ ID NO: 1105915 - RNA, 21 nt, Mycobacterium bovis subsp bovis AF2122/97
cgcacccagggcguuggcggc

SEQ ID NO: 1105916 - RNA, 19 nt, Mycobacterium bovis subsp bovis AF2122/97
cgcaccccgcuugcgcggc

SEQ ID NO: 1105917 - RNA, 12 nt, Mycobacterium bovis subsp bovis AF2122/97
cgcaccccggca

SEQ ID NO: 1105918 - RNA, 19 nt, Mycobacterium bovis subsp bovis AF2122/97
cgcacccgaaacaccgucu

SEQ ID NO: 1105919 - RNA, 14 nt, Mycobacterium bovis subsp bovis AF2122/97
cgcaccccggccgc

SEQ ID NO: 1105920 - RNA, 17 nt, Mycobacterium bovis subsp bovis AF2122/97
cgcaccccggccgcgcg

SEQ ID NO: 1105921 - RNA, 19 nt, Mycobacterium bovis subsp bovis AF2122/97
cgcaccccggccgcgcgca

SEQ ID NO: 1105922 - RNA, 18 nt, Mycobacterium bovis subsp bovis AF2122/97
cgcaccgagcgagaccac

SEQ ID NO: 1105923 - RNA, 14 nt, Mycobacterium bovis subsp bovis AF2122/97
cgcaccgaggccgc

SEQ ID NO: 1105924 - RNA, 20 nt, Mycobacterium bovis subsp bovis AF2122/97
cgcaccgaugccuugaccgc

SEQ ID NO: 1105925 - RNA, 22 nt, Mycobacterium bovis subsp bovis AF2122/97
cgcaccgaaaccaugccgccga

SEQ ID NO: 1105926 - RNA, 17 nt, Mycobacterium bovis subsp bovis AF2122/97
cgcacccugcgugcggc

SEQ ID NO: 1105927 - RNA, 16 nt, Mycobacterium bovis subsp bovis AF2122/97
cgcacccggucggcgg

SEQ ID NO: 1105928 - RNA, 19 nt, Mycobacterium bovis subsp bovis AF2122/97
cgcaccgaaacgccgaccu

SEQ ID NO: 1105929 - RNA, 15 nt, Mycobacterium bovis subsp bovis AF2122/97
cgcacccggucgagc

SEQ ID NO: 1105930 - RNA, 15 nt, Mycobacterium bovis subsp bovis AF2122/97
cgcacccgcucggcg

SEQ ID NO: 1105931 - RNA, 15 nt, Mycobacterium bovis subsp bovis AF2122/97
cgcacccgcucgucg

SEQ ID NO: 1105932 - RNA, 13 nt, Mycobacterium bovis subsp bovis AF2122/97
cgcacccggcgca

SEQ ID NO: 1105933 - RNA, 15 nt, Mycobacterium bovis subsp bovis AF2122/97
cgcacccguucguga

SEQ ID NO: 1105934 - RNA, 21 nt, Mycobacterium bovis subsp bovis AF2122/97
cgcacccguugcgacaccucc

SEQ ID NO: 1105935 - RNA, 14 nt, Mycobacterium bovis subsp bovis AF2122/97
cgcacccguccggc

SEQ ID NO: 1105936 - RNA, 13 nt, Mycobacterium bovis subsp bovis AF2122/97
cgcacccgcucgg

SEQ ID NO: 1105937 - RNA, 13 nt, Mycobacterium bovis subsp bovis AF2122/97
cgcacccgcgggu

SEQ ID NO: 1105938 - RNA, 22 nt, Mycobacterium bovis subsp bovis AF2122/97
cgcaccaguggcgcccauggcc

SEQ ID NO: 1105939 - RNA, 19 nt, Mycobacterium bovis subsp bovis AF2122/97
cgcaccccggcggcgucca

SEQ ID NO: 1105940 - RNA, 22 nt, Mycobacterium bovis subsp bovis AF2122/97
cgcaccccggcggcguccaucg

SEQ ID NO: 1105941 - RNA, 20 nt, Mycobacterium bovis subsp bovis AF2122/97
cgcacaaacauacgccaccc

SEQ ID NO: 1105942 - RNA, 18 nt, Mycobacterium bovis subsp bovis AF2122/97
cgcacaaacgacucgcgg

SEQ ID NO: 1105943 - RNA, 21 nt, Mycobacterium bovis subsp bovis AF2122/97
cgcacaaacgacucgcggugg

SEQ ID NO: 1105944 - RNA, 23 nt, Mycobacterium bovis subsp bovis AF2122/97
cgcaauuccggugaucgcggugg

SEQ ID NO: 1105945 - RNA, 16 nt, Mycobacterium bovis subsp bovis AF2122/97
cgcaaugucggcaggg

SEQ ID NO: 1105946 - RNA, 14 nt, Mycobacterium bovis subsp bovis AF2122/97
cgcaauggcggccu

SEQ ID NO: 1105947 - RNA, 15 nt, Mycobacterium bovis subsp bovis AF2122/97
cgcaaugccgugcgc

SEQ ID NO: 1105948 - RNA, 19 nt, Mycobacterium bovis subsp bovis AF2122/97
cgcaaugccgugcgccacg

SEQ ID NO: 1105949 - RNA, 16 nt, Mycobacterium bovis subsp bovis AF2122/97
cgcaaugcgagcgcgc

SEQ ID NO: 1105950 - RNA, 13 nt, Mycobacterium bovis subsp bovis AF2122/97
cgcaaugcggccc

SEQ ID NO: 1105951 - RNA, 21 nt, Mycobacterium bovis subsp bovis AF2122/97
cgcaaugcggcccggguggcc

SEQ ID NO: 1105952 - RNA, 12 nt, Mycobacterium bovis subsp bovis AF2122/97
cgcaaugaccgc

SEQ ID NO: 1105953 - RNA, 20 nt, Mycobacterium bovis subsp bovis AF2122/97
cgcaaugcaucgcggcggcg

SEQ ID NO: 1105954 - RNA, 12 nt, Mycobacterium bovis subsp bovis AF2122/97
cgcacagcacca

SEQ ID NO: 1105955 - RNA, 22 nt, Mycobacterium bovis subsp bovis AF2122/97
cgcacagcaacgcccaacgucg

SEQ ID NO: 1105956 - RNA, 15 nt, Mycobacterium bovis subsp bovis AF2122/97
cgcacaccugcgcgg

SEQ ID NO: 1105957 - RNA, 15 nt, Mycobacterium bovis subsp bovis AF2122/97
cgcacaccggcuuug

SEQ ID NO: 1105958 - RNA, 22 nt, Mycobacterium bovis subsp bovis AF2122/97
cgcacacuaccgccgcgaccgc

SEQ ID NO: 1105959 - RNA, 15 nt, Mycobacterium bovis subsp bovis AF2122/97
cgcacacgaucgcgg

SEQ ID NO: 1105960 - RNA, 19 nt, Mycobacterium bovis subsp bovis AF2122/97
cgcacagcccgaugccgug

SEQ ID NO: 1105961 - RNA, 15 nt, Mycobacterium bovis subsp bovis AF2122/97
cgcacacccgguugg

SEQ ID NO: 1105962 - RNA, 15 nt, Mycobacterium bovis subsp bovis AF2122/97
cgcacaauggcggcg

SEQ ID NO: 1105963 - RNA, 16 nt, Mycobacterium bovis subsp bovis AF2122/97
cgcacaauggcggcgc

SEQ ID NO: 1105964 - RNA, 17 nt, Mycobacterium bovis subsp bovis AF2122/97
cgcacaauggcggcgcc

SEQ ID NO: 1105965 - RNA, 17 nt, Mycobacterium bovis subsp bovis AF2122/97
cgcacacagaccgugac

SEQ ID NO: 1105966 - RNA, 21 nt, Mycobacterium bovis subsp bovis AF2122/97
cgcacaaguucuucgacagcg

SEQ ID NO: 1105967 - RNA, 14 nt, Mycobacterium bovis subsp bovis AF2122/97
cgcacaaacgggcg

SEQ ID NO: 1105968 - RNA, 18 nt, Mycobacterium bovis subsp bovis AF2122/97
cgcaagguugccaacgcc

SEQ ID NO: 1105969 - RNA, 23 nt, Mycobacterium bovis subsp bovis AF2122/97
cgcaaggucgacggaaucgucgg

SEQ ID NO: 1105970 - RNA, 14 nt, Mycobacterium bovis subsp bovis AF2122/97
cgcaaggggcgucg

SEQ ID NO: 1105971 - RNA, 21 nt, Mycobacterium bovis subsp bovis AF2122/97
cgcaagucauccaggucgccu

SEQ ID NO: 1105972 - RNA, 15 nt, Mycobacterium bovis subsp bovis AF2122/97
cgcaagaaugccgcc

SEQ ID NO: 1105973 - RNA, 16 nt, Mycobacterium bovis subsp bovis AF2122/97
cgcaagaaugccgccg

SEQ ID NO: 1105974 - RNA, 21 nt, Mycobacterium bovis subsp bovis AF2122/97
cgcaacuucuucagcagcggc

SEQ ID NO: 1105975 - RNA, 13 nt, Mycobacterium bovis subsp bovis AF2122/97
cgcaaggccgcgu

SEQ ID NO: 1105976 - RNA, 12 nt, Mycobacterium bovis subsp bovis AF2122/97
cgcaaggcgccg

SEQ ID NO: 1105977 - RNA, 20 nt, Mycobacterium bovis subsp bovis AF2122/97
cgcaacgggacgucaccguu

SEQ ID NO: 1105978 - RNA, 15 nt, Mycobacterium bovis subsp bovis AF2122/97
cgcaacucgccgaaa

SEQ ID NO: 1105979 - RNA, 14 nt, Mycobacterium bovis subsp bovis AF2122/97
cgcaaucgcgacgg

SEQ ID NO: 1105980 - RNA, 23 nt, Mycobacterium bovis subsp bovis AF2122/97
cgcaaucggcguuaucgaaggcg

SEQ ID NO: 1105981 - RNA, 13 nt, Mycobacterium bovis subsp bovis AF2122/97
cgcaaucgaccac

SEQ ID NO: 1105982 - RNA, 18 nt, Mycobacterium bovis subsp bovis AF2122/97
cgcaaucgacugaucgaa

SEQ ID NO: 1105983 - RNA, 21 nt, Mycobacterium bovis subsp bovis AF2122/97
cgcaauaugccacagaccgaa

SEQ ID NO: 1105984 - RNA, 20 nt, Mycobacterium bovis subsp bovis AF2122/97
cgcaauccagcugucguuga

SEQ ID NO: 1105985 - RNA, 14 nt, Mycobacterium bovis subsp bovis AF2122/97
cgcaagugcuggcc

SEQ ID NO: 1105986 - RNA, 23 nt, Mycobacterium bovis subsp bovis AF2122/97
cgcaauacccgagcguccggugg

SEQ ID NO: 1105987 - RNA, 21 nt, Mycobacterium bovis subsp bovis AF2122/97
cgcaauagaccgcagucgcug

SEQ ID NO: 1105988 - RNA, 23 nt, Mycobacterium bovis subsp bovis AF2122/97
cgcaauagaccgcagucgcuggg

SEQ ID NO: 1105989 - RNA, 19 nt, Mycobacterium bovis subsp bovis AF2122/97
cgcaauauccggccgagcc

SEQ ID NO: 1105990 - RNA, 15 nt, Mycobacterium bovis subsp bovis AF2122/97
cgaugcccgacaccg

SEQ ID NO: 1105991 - RNA, 16 nt, Mycobacterium bovis subsp bovis AF2122/97
cgaugcccggcaucgc

SEQ ID NO: 1105992 - RNA, 19 nt, Mycobacterium bovis subsp bovis AF2122/97
cgaugccccacggugcggu

SEQ ID NO: 1105993 - RNA, 22 nt, Mycobacterium bovis subsp bovis AF2122/97
cgaugcccuccucgaccgcggc

SEQ ID NO: 1105994 - RNA, 21 nt, Mycobacterium bovis subsp bovis AF2122/97
cgaugcguccgcccagccgca

SEQ ID NO: 1105995 - RNA, 20 nt, Mycobacterium bovis subsp bovis AF2122/97
cgaugcucaaugugccgccg

SEQ ID NO: 1105996 - RNA, 18 nt, Mycobacterium bovis subsp bovis AF2122/97
cgaugcucacuacccgca

SEQ ID NO: 1105997 - RNA, 19 nt, Mycobacterium bovis subsp bovis AF2122/97
cgauggcccuuccggccga

SEQ ID NO: 1105998 - RNA, 17 nt, Mycobacterium bovis subsp bovis AF2122/97
cgauggccaguucuuca

SEQ ID NO: 1105999 - RNA, 19 nt, Mycobacterium bovis subsp bovis AF2122/97
cgauggcccggcucacagc

SEQ ID NO: 1106000 - RNA, 14 nt, Mycobacterium bovis subsp bovis AF2122/97
cgauggccgacgcu

SEQ ID NO: 1106001 - RNA, 13 nt, Mycobacterium bovis subsp bovis AF2122/97
cgauggccgccgc

SEQ ID NO: 1106002 - RNA, 19 nt, Mycobacterium bovis subsp bovis AF2122/97
cgaugcucagcuggucggc

SEQ ID NO: 1106003 - RNA, 20 nt, Mycobacterium bovis subsp bovis AF2122/97
cgauggccacccgguggcgu

SEQ ID NO: 1106004 - RNA, 23 nt, Mycobacterium bovis subsp bovis AF2122/97
cgaugcugggcgagacggcguug

SEQ ID NO: 1106005 - RNA, 20 nt, Mycobacterium bovis subsp bovis AF2122/97
cgaugcuggcaaaguaucgc

SEQ ID NO: 1106006 - RNA, 22 nt, Mycobacterium bovis subsp bovis AF2122/97
cgaugcucgucccagaaccggc

SEQ ID NO: 1106007 - RNA, 14 nt, Mycobacterium bovis subsp bovis AF2122/97
cgaugcugaacacg

SEQ ID NO: 1106008 - RNA, 24 nt, Mycobacterium bovis subsp bovis AF2122/97
cgaugcugaucaccgucguacucg

SEQ ID NO: 1106009 - RNA, 12 nt, Mycobacterium bovis subsp bovis AF2122/97
cgaugcugccgc

SEQ ID NO: 1106010 - RNA, 17 nt, Mycobacterium bovis subsp bovis AF2122/97
cgauggugccgacccgc

SEQ ID NO: 1106011 - RNA, 14 nt, Mycobacterium bovis subsp bovis AF2122/97
cgauggugaugggg

SEQ ID NO: 1106012 - RNA, 23 nt, Mycobacterium bovis subsp bovis AF2122/97
cgauggucacugugacgccgggc

SEQ ID NO: 1106013 - RNA, 22 nt, Mycobacterium bovis subsp bovis AF2122/97
cgauggucuccucggucaccga

SEQ ID NO: 1106014 - RNA, 19 nt, Mycobacterium bovis subsp bovis AF2122/97
cgaugucccaucgcgucgg

SEQ ID NO: 1106015 - RNA, 17 nt, Mycobacterium bovis subsp bovis AF2122/97
cgauggugcgcccgccg

SEQ ID NO: 1106016 - RNA, 16 nt, Mycobacterium bovis subsp bovis AF2122/97
cgauggugcgccgggc

SEQ ID NO: 1106017 - RNA, 15 nt, Mycobacterium bovis subsp bovis AF2122/97
cgauggugcggccca

SEQ ID NO: 1106018 - RNA, 14 nt, Mycobacterium bovis subsp bovis AF2122/97
cgauguccgcgcga

SEQ ID NO: 1106019 - RNA, 19 nt, Mycobacterium bovis subsp bovis AF2122/97
cgauguccuuguuggccag

SEQ ID NO: 1106020 - RNA, 21 nt, Mycobacterium bovis subsp bovis AF2122/97
cgauguccuauuugcagccuu

SEQ ID NO: 1106021 - RNA, 16 nt, Mycobacterium bovis subsp bovis AF2122/97
cgauguccucgaugcg

SEQ ID NO: 1106022 - RNA, 19 nt, Mycobacterium bovis subsp bovis AF2122/97
cgauguccucgaugcgggc

SEQ ID NO: 1106023 - RNA, 15 nt, Mycobacterium bovis subsp bovis AF2122/97
cgauguccgacgcca

SEQ ID NO: 1106024 - RNA, 19 nt, Mycobacterium bovis subsp bovis AF2122/97
cgauguccgacgccaccgc

SEQ ID NO: 1106025 - RNA, 14 nt, Mycobacterium bovis subsp bovis AF2122/97
cgaugucccgagcc

SEQ ID NO: 1106026 - RNA, 19 nt, Mycobacterium bovis subsp bovis AF2122/97
cgaugucccgagcccgcug

SEQ ID NO: 1106027 - RNA, 23 nt, Mycobacterium bovis subsp bovis AF2122/97
cgaugucgacucguggcgccacg

SEQ ID NO: 1106028 - RNA, 15 nt, Mycobacterium bovis subsp bovis AF2122/97
cgaugucgagcgcga

SEQ ID NO: 1106029 - RNA, 18 nt, Mycobacterium bovis subsp bovis AF2122/97
cgaugucgagcgcgaucg

SEQ ID NO: 1106030 - RNA, 19 nt, Mycobacterium bovis subsp bovis AF2122/97
cgaugucgagcgcgaucgg

SEQ ID NO: 1106031 - RNA, 14 nt, Mycobacterium bovis subsp bovis AF2122/97
cgaugucgaugccg

SEQ ID NO: 1106032 - RNA, 22 nt, Mycobacterium bovis subsp bovis AF2122/97
cgaugguccagcccugcgcuuc

SEQ ID NO: 1106033 - RNA, 22 nt, Mycobacterium bovis subsp bovis AF2122/97
cgauggcuaccuuggacucggc

SEQ ID NO: 1106034 - RNA, 23 nt, Mycobacterium bovis subsp bovis AF2122/97
cgauggucaaugcgcuggcgccg

SEQ ID NO: 1106035 - RNA, 17 nt, Mycobacterium bovis subsp bovis AF2122/97
cgauggucuccggacgc

SEQ ID NO: 1106036 - RNA, 21 nt, Mycobacterium bovis subsp bovis AF2122/97
cgauggucuccucggucaccg

SEQ ID NO: 1106037 - RNA, 16 nt, Mycobacterium bovis subsp bovis AF2122/97
cgauggcgucggccag

SEQ ID NO: 1106038 - RNA, 22 nt, Mycobacterium bovis subsp bovis AF2122/97
cgauggcgguggugccgcggcc

SEQ ID NO: 1106039 - RNA, 23 nt, Mycobacterium bovis subsp bovis AF2122/97
cgauggcguagcccaugccgaug

SEQ ID NO: 1106040 - RNA, 23 nt, Mycobacterium bovis subsp bovis AF2122/97
cgauggcuaccccagggagugcc

SEQ ID NO: 1106041 - RNA, 23 nt, Mycobacterium bovis subsp bovis AF2122/97
cgauggcgucggugaaugccguc

SEQ ID NO: 1106042 - RNA, 18 nt, Mycobacterium bovis subsp bovis AF2122/97
cgauggcgguccaccggc

SEQ ID NO: 1106043 - RNA, 13 nt, Mycobacterium bovis subsp bovis AF2122/97
cgauggcgguggc

SEQ ID NO: 1106044 - RNA, 18 nt, Mycobacterium bovis subsp bovis AF2122/97
cgauggcgguggggcugu

SEQ ID NO: 1106045 - RNA, 15 nt, Mycobacterium bovis subsp bovis AF2122/97
cgauggcgucgccgg

SEQ ID NO: 1106046 - RNA, 16 nt, Mycobacterium bovis subsp bovis AF2122/97
cgauggcgucgccggc

SEQ ID NO: 1106047 - RNA, 23 nt, Mycobacterium bovis subsp bovis AF2122/97
cgauggcgucgccggccccgccg

SEQ ID NO: 1106048 - RNA, 12 nt, Mycobacterium bovis subsp bovis AF2122/97
cgauggcgucgg

SEQ ID NO: 1106049 - RNA, 16 nt, Mycobacterium bovis subsp bovis AF2122/97
cgaugucgcggucgcc

SEQ ID NO: 1106050 - RNA, 23 nt, Mycobacterium bovis subsp bovis AF2122/97
cgaugucgcgcauugccgacgcg

SEQ ID NO: 1106051 - RNA, 16 nt, Mycobacterium bovis subsp bovis AF2122/97
cgaugucgcgcauugc

SEQ ID NO: 1106052 - RNA, 14 nt, Mycobacterium bovis subsp bovis AF2122/97
cgaugucgucguug

SEQ ID NO: 1106053 - RNA, 14 nt, Mycobacterium bovis subsp bovis AF2122/97
cgaugucggcacca

SEQ ID NO: 1106054 - RNA, 18 nt, Mycobacterium bovis subsp bovis AF2122/97
cgaugucguaccgggcga

SEQ ID NO: 1106055 - RNA, 18 nt, Mycobacterium bovis subsp bovis AF2122/97
cgaugucggcucggcccc

SEQ ID NO: 1106056 - RNA, 23 nt, Mycobacterium bovis subsp bovis AF2122/97
cgauuccgaacuggucgacgccg

SEQ ID NO: 1106057 - RNA, 19 nt, Mycobacterium bovis subsp bovis AF2122/97
cgauuccgaacuggucgac

SEQ ID NO: 1106058 - RNA, 14 nt, Mycobacterium bovis subsp bovis AF2122/97
cgauuccggcggcc

SEQ ID NO: 1106059 - RNA, 19 nt, Mycobacterium bovis subsp bovis AF2122/97
cgauuccggcggccacgcc

SEQ ID NO: 1106060 - RNA, 18 nt, Mycobacterium bovis subsp bovis AF2122/97
cgauuccgggugcgaucg

SEQ ID NO: 1106061 - RNA, 19 nt, Mycobacterium bovis subsp bovis AF2122/97
cgauuccgggugcgaucgc

SEQ ID NO: 1106062 - RNA, 21 nt, Mycobacterium bovis subsp bovis AF2122/97
cgauuccgggugcgaucgcaa

SEQ ID NO: 1106063 - RNA, 19 nt, Mycobacterium bovis subsp bovis AF2122/97
cgauuccgcgucugcucgc

SEQ ID NO: 1106064 - RNA, 19 nt, Mycobacterium bovis subsp bovis AF2122/97
cgaugugaaccgggcacca

SEQ ID NO: 1106065 - RNA, 24 nt, Mycobacterium bovis subsp bovis AF2122/97
cgaugucguucgcgucacaccagc

SEQ ID NO: 1106066 - RNA, 21 nt, Mycobacterium bovis subsp bovis AF2122/97
cgaugucguuggccaccucgg

SEQ ID NO: 1106067 - RNA, 19 nt, Mycobacterium bovis subsp bovis AF2122/97
cgaugucguaccgggcgag

SEQ ID NO: 1106068 - RNA, 18 nt, Mycobacterium bovis subsp bovis AF2122/97
cgauugcccgcgcucgca

SEQ ID NO: 1106069 - RNA, 12 nt, Mycobacterium bovis subsp bovis AF2122/97
cgauugccacca

SEQ ID NO: 1106070 - RNA, 14 nt, Mycobacterium bovis subsp bovis AF2122/97
cgauucggcggccg

SEQ ID NO: 1106071 - RNA, 20 nt, Mycobacterium bovis subsp bovis AF2122/97
cgauucgccuagcgagcgca

SEQ ID NO: 1106072 - RNA, 19 nt, Mycobacterium bovis subsp bovis AF2122/97
cgauucgcggcagccggcg

SEQ ID NO: 1106073 - RNA, 20 nt, Mycobacterium bovis subsp bovis AF2122/97
cgauucggccagcgcccgca

SEQ ID NO: 1106074 - RNA, 21 nt, Mycobacterium bovis subsp bovis AF2122/97
cgauucggccagcgcccgcag

SEQ ID NO: 1106075 - RNA, 16 nt, Mycobacterium bovis subsp bovis AF2122/97
cgauucggcgacgaac

SEQ ID NO: 1106076 - RNA, 18 nt, Mycobacterium bovis subsp bovis AF2122/97
cgauucgcggcagccggc

SEQ ID NO: 1106077 - RNA, 15 nt, Mycobacterium bovis subsp bovis AF2122/97
cgauucgaccgguga

SEQ ID NO: 1106078 - RNA, 22 nt, Mycobacterium bovis subsp bovis AF2122/97
cgauuccgcgucugcucggcgg

SEQ ID NO: 1106079 - RNA, 20 nt, Mycobacterium bovis subsp bovis AF2122/97
cgauugcgaagggcaccggc

SEQ ID NO: 1106080 - RNA, 19 nt, Mycobacterium bovis subsp bovis AF2122/97
cgauugccaccaaugguga

SEQ ID NO: 1106081 - RNA, 18 nt, Mycobacterium bovis subsp bovis AF2122/97
cgauugcccgugcgaugc

SEQ ID NO: 1106082 - RNA, 21 nt, Mycobacterium bovis subsp bovis AF2122/97
cgauugucggggccgcaggcc

SEQ ID NO: 1106083 - RNA, 22 nt, Mycobacterium bovis subsp bovis AF2122/97
cgauugucggggccgcaggcca

SEQ ID NO: 1106084 - RNA, 15 nt, Mycobacterium bovis subsp bovis AF2122/97
cgauuggaccgccaa

SEQ ID NO: 1106085 - RNA, 15 nt, Mycobacterium bovis subsp bovis AF2122/97
cgauugcugcggcuu

SEQ ID NO: 1106086 - RNA, 22 nt, Mycobacterium bovis subsp bovis AF2122/97
cgauuggccaaccccauggcca

SEQ ID NO: 1106087 - RNA, 15 nt, Mycobacterium bovis subsp bovis AF2122/97
cgauuggcucgagca

SEQ ID NO: 1106088 - RNA, 19 nt, Mycobacterium bovis subsp bovis AF2122/97
cgcaaccgggccucaugcu

SEQ ID NO: 1106089 - RNA, 17 nt, Mycobacterium bovis subsp bovis AF2122/97
cgcaacccugccgcgau

SEQ ID NO: 1106090 - RNA, 14 nt, Mycobacterium bovis subsp bovis AF2122/97
cgcaacccggacga

SEQ ID NO: 1106091 - RNA, 13 nt, Mycobacterium bovis subsp bovis AF2122/97
cgcaaccagccca

SEQ ID NO: 1106092 - RNA, 24 nt, Mycobacterium bovis subsp bovis AF2122/97
cgcaaccccuggggugcucgggcg

SEQ ID NO: 1106093 - RNA, 12 nt, Mycobacterium bovis subsp bovis AF2122/97
cgcaaccggugg

SEQ ID NO: 1106094 - RNA, 21 nt, Mycobacterium bovis subsp bovis AF2122/97
cgcaaccuaaauugccgggcc

SEQ ID NO: 1106095 - RNA, 22 nt, Mycobacterium bovis subsp bovis AF2122/97
cgcaaccuaaauugccgggccc

SEQ ID NO: 1106096 - RNA, 18 nt, Mycobacterium bovis subsp bovis AF2122/97
cgcaacgggacgucaccg

SEQ ID NO: 1106097 - RNA, 23 nt, Mycobacterium bovis subsp bovis AF2122/97
cgcaacuaucgcaccuccggcgu

SEQ ID NO: 1106098 - RNA, 15 nt, Mycobacterium bovis subsp bovis AF2122/97
cgauugucgccgcgc

SEQ ID NO: 1106099 - RNA, 14 nt, Mycobacterium bovis subsp bovis AF2122/97
cgauuguggccagc

SEQ ID NO: 1106100 - RNA, 16 nt, Mycobacterium bovis subsp bovis AF2122/97
cgauuguggccagcgc

SEQ ID NO: 1106101 - RNA, 15 nt, Mycobacterium bovis subsp bovis AF2122/97
cgcaaaaucaccggu

SEQ ID NO: 1106102 - RNA, 15 nt, Mycobacterium bovis subsp bovis AF2122/97
cgcaaaagccaccgc

SEQ ID NO: 1106103 - RNA, 16 nt, Mycobacterium bovis subsp bovis AF2122/97
cgcaaagacagcgcgg

SEQ ID NO: 1106104 - RNA, 17 nt, Mycobacterium bovis subsp bovis AF2122/97
cgcaacaucggaugacc

SEQ ID NO: 1106105 - RNA, 14 nt, Mycobacterium bovis subsp bovis AF2122/97
cgcaaacccgccga

SEQ ID NO: 1106106 - RNA, 16 nt, Mycobacterium bovis subsp bovis AF2122/97
cgcaaacccgccgaca

SEQ ID NO: 1106107 - RNA, 15 nt, Mycobacterium bovis subsp bovis AF2122/97
cgcaaaaucgcccau

SEQ ID NO: 1106108 - RNA, 19 nt, Mycobacterium bovis subsp bovis AF2122/97
cgcaaacaagaucagaccc

SEQ ID NO: 1106109 - RNA, 18 nt, Mycobacterium bovis subsp bovis AF2122/97
cgaucaccuucggccgac

SEQ ID NO: 1106110 - RNA, 14 nt, Mycobacterium bovis subsp bovis AF2122/97
cgaucacggcaccg

SEQ ID NO: 1106111 - RNA, 14 nt, Mycobacterium bovis subsp bovis AF2122/97
cgaucacgacguug

SEQ ID NO: 1106112 - RNA, 15 nt, Mycobacterium bovis subsp bovis AF2122/97
cgaucacgccggccu

SEQ ID NO: 1106113 - RNA, 16 nt, Mycobacterium bovis subsp bovis AF2122/97
cgaucaccugccagug

SEQ ID NO: 1106114 - RNA, 15 nt, Mycobacterium bovis subsp bovis AF2122/97
cgaucaccugcagca

SEQ ID NO: 1106115 - RNA, 18 nt, Mycobacterium bovis subsp bovis AF2122/97
cgaucaccucggcgacgu

SEQ ID NO: 1106116 - RNA, 21 nt, Mycobacterium bovis subsp bovis AF2122/97
cgaucaccucggcgacgucgg

SEQ ID NO: 1106117 - RNA, 22 nt, Mycobacterium bovis subsp bovis AF2122/97
cgaucaccacggcguugccgcc

SEQ ID NO: 1106118 - RNA, 12 nt, Mycobacterium bovis subsp bovis AF2122/97
cgaucaccagcc

SEQ ID NO: 1106119 - RNA, 17 nt, Mycobacterium bovis subsp bovis AF2122/97
cgaucaauugcccggca

SEQ ID NO: 1106120 - RNA, 19 nt, Mycobacterium bovis subsp bovis AF2122/97
cgaucaauugcccggcacg

SEQ ID NO: 1106121 - RNA, 22 nt, Mycobacterium bovis subsp bovis AF2122/97
cgaucacaccacgguuggccac

SEQ ID NO: 1106122 - RNA, 17 nt, Mycobacterium bovis subsp bovis AF2122/97
cgaucacacgguccgcc

SEQ ID NO: 1106123 - RNA, 18 nt, Mycobacterium bovis subsp bovis AF2122/97
cgaucacacgguccgcca

SEQ ID NO: 1106124 - RNA, 14 nt, Mycobacterium bovis subsp bovis AF2122/97
cgaucacggcggcc

SEQ ID NO: 1106125 - RNA, 16 nt, Mycobacterium bovis subsp bovis AF2122/97
cgaucacggcggcccc

SEQ ID NO: 1106126 - RNA, 23 nt, Mycobacterium bovis subsp bovis AF2122/97
cgaucacggcgggaugcagcugc

SEQ ID NO: 1106127 - RNA, 16 nt, Mycobacterium bovis subsp bovis AF2122/97
cgaucagcagccgccg

SEQ ID NO: 1106128 - RNA, 17 nt, Mycobacterium bovis subsp bovis AF2122/97
cgaucagcagccgccga

SEQ ID NO: 1106129 - RNA, 20 nt, Mycobacterium bovis subsp bovis AF2122/97
cgaucagcagggcggcguua

SEQ ID NO: 1106130 - RNA, 14 nt, Mycobacterium bovis subsp bovis AF2122/97
cgaucagcccggcc

SEQ ID NO: 1106131 - RNA, 17 nt, Mycobacterium bovis subsp bovis AF2122/97
cgaucagcccggccuug

SEQ ID NO: 1106132 - RNA, 23 nt, Mycobacterium bovis subsp bovis AF2122/97
cgaucagcccggccuugccgccg

SEQ ID NO: 1106133 - RNA, 13 nt, Mycobacterium bovis subsp bovis AF2122/97
cgaucagccgggu

SEQ ID NO: 1106134 - RNA, 20 nt, Mycobacterium bovis subsp bovis AF2122/97
cgaucagccgggugcgcacc

SEQ ID NO: 1106135 - RNA, 19 nt, Mycobacterium bovis subsp bovis AF2122/97
cgaucagcgaaccaccggc

SEQ ID NO: 1106136 - RNA, 22 nt, Mycobacterium bovis subsp bovis AF2122/97
cgaucagcgaaccaccggcgcc

SEQ ID NO: 1106137 - RNA, 21 nt, Mycobacterium bovis subsp bovis AF2122/97
cgaucagguuggugcucagcg

SEQ ID NO: 1106138 - RNA, 15 nt, Mycobacterium bovis subsp bovis AF2122/97
cgaucaucaccggca

SEQ ID NO: 1106139 - RNA, 18 nt, Mycobacterium bovis subsp bovis AF2122/97
cgaucaguucgugacgug

SEQ ID NO: 1106140 - RNA, 18 nt, Mycobacterium bovis subsp bovis AF2122/97
cgaucagugcaagaccgc

SEQ ID NO: 1106141 - RNA, 19 nt, Mycobacterium bovis subsp bovis AF2122/97
cgaucagugcaagaccgca

SEQ ID NO: 1106142 - RNA, 19 nt, Mycobacterium bovis subsp bovis AF2122/97
cgaucaucauauccgcccc

SEQ ID NO: 1106143 - RNA, 22 nt, Mycobacterium bovis subsp bovis AF2122/97
cgaucaucauauccgccccagc

SEQ ID NO: 1106144 - RNA, 23 nt, Mycobacterium bovis subsp bovis AF2122/97
cgaucaucgggguggccaccagc

SEQ ID NO: 1106145 - RNA, 15 nt, Mycobacterium bovis subsp bovis AF2122/97
cgauccagcaggccg

SEQ ID NO: 1106146 - RNA, 16 nt, Mycobacterium bovis subsp bovis AF2122/97
cgaucaucggccccga

SEQ ID NO: 1106147 - RNA, 13 nt, Mycobacterium bovis subsp bovis AF2122/97
cgauccagggccg

SEQ ID NO: 1106148 - RNA, 14 nt, Mycobacterium bovis subsp bovis AF2122/97
cgauccagcgggua

SEQ ID NO: 1106149 - RNA, 14 nt, Mycobacterium bovis subsp bovis AF2122/97
cgauccccagcacc

SEQ ID NO: 1106150 - RNA, 16 nt, Mycobacterium bovis subsp bovis AF2122/97
cgauccccagcaccac

SEQ ID NO: 1106151 - RNA, 21 nt, Mycobacterium bovis subsp bovis AF2122/97
cgauccccagcaccacgguga

SEQ ID NO: 1106152 - RNA, 14 nt, Mycobacterium bovis subsp bovis AF2122/97
cgauccccaggccg

SEQ ID NO: 1106153 - RNA, 15 nt, Mycobacterium bovis subsp bovis AF2122/97
cgaucccaccggcua

SEQ ID NO: 1106154 - RNA, 22 nt, Mycobacterium bovis subsp bovis AF2122/97
cgaucccaccggcuaugcuggc

SEQ ID NO: 1106155 - RNA, 19 nt, Mycobacterium bovis subsp bovis AF2122/97
cgaucccaacgcccgggcg

SEQ ID NO: 1106156 - RNA, 20 nt, Mycobacterium bovis subsp bovis AF2122/97
cgaucccaacgcccgggcga

SEQ ID NO: 1106157 - RNA, 22 nt, Mycobacterium bovis subsp bovis AF2122/97
cgauccagggucaccucgucgc

SEQ ID NO: 1106158 - RNA, 16 nt, Mycobacterium bovis subsp bovis AF2122/97
cgauccggucggccag

SEQ ID NO: 1106159 - RNA, 17 nt, Mycobacterium bovis subsp bovis AF2122/97
cgauccggucggccagg

SEQ ID NO: 1106160 - RNA, 19 nt, Mycobacterium bovis subsp bovis AF2122/97
cgauccggucggccaggcc

SEQ ID NO: 1106161 - RNA, 15 nt, Mycobacterium bovis subsp bovis AF2122/97
cgauccccgcgcuga

SEQ ID NO: 1106162 - RNA, 15 nt, Mycobacterium bovis subsp bovis AF2122/97
cgauccucgcccgca

SEQ ID NO: 1106163 - RNA, 20 nt, Mycobacterium bovis subsp bovis AF2122/97
cgauccucgcccgcaccagc

SEQ ID NO: 1106164 - RNA, 12 nt, Mycobacterium bovis subsp bovis AF2122/97
cgauccgucggc

SEQ ID NO: 1106165 - RNA, 15 nt, Mycobacterium bovis subsp bovis AF2122/97
cgaucaacgcgcacg

SEQ ID NO: 1106166 - RNA, 16 nt, Mycobacterium bovis subsp bovis AF2122/97
cgauaucggcggcuug

SEQ ID NO: 1106167 - RNA, 22 nt, Mycobacterium bovis subsp bovis AF2122/97
cgauaucgggcucagcggcgac

SEQ ID NO: 1106168 - RNA, 20 nt, Mycobacterium bovis subsp bovis AF2122/97
cgaucaagugcgguccggcu

SEQ ID NO: 1106169 - RNA, 15 nt, Mycobacterium bovis subsp bovis AF2122/97
cgaucaacggaucga

SEQ ID NO: 1106170 - RNA, 16 nt, Mycobacterium bovis subsp bovis AF2122/97
cgaucaauggcaacga

SEQ ID NO: 1106171 - RNA, 19 nt, Mycobacterium bovis subsp bovis AF2122/97
cgauaucggugaccguggc

SEQ ID NO: 1106172 - RNA, 14 nt, Mycobacterium bovis subsp bovis AF2122/97
cgaucaacgcguug

SEQ ID NO: 1106173 - RNA, 18 nt, Mycobacterium bovis subsp bovis AF2122/97
cgaucaacucgugcgggc

SEQ ID NO: 1106174 - RNA, 13 nt, Mycobacterium bovis subsp bovis AF2122/97
cgaucaagccuuc

SEQ ID NO: 1106175 - RNA, 14 nt, Mycobacterium bovis subsp bovis AF2122/97
cgauauagccgccg

SEQ ID NO: 1106176 - RNA, 23 nt, Mycobacterium bovis subsp bovis AF2122/97
cgauauaacccggcuccagcacc

SEQ ID NO: 1106177 - RNA, 20 nt, Mycobacterium bovis subsp bovis AF2122/97
cgauauccacaauccgcucg

SEQ ID NO: 1106178 - RNA, 22 nt, Mycobacterium bovis subsp bovis AF2122/97
cgauauaggacgccgcgccgca

SEQ ID NO: 1106179 - RNA, 14 nt, Mycobacterium bovis subsp bovis AF2122/97
cgauaucgaugcgg

SEQ ID NO: 1106180 - RNA, 13 nt, Mycobacterium bovis subsp bovis AF2122/97
cgauaggcccggu

SEQ ID NO: 1106181 - RNA, 14 nt, Mycobacterium bovis subsp bovis AF2122/97
cgauagcgcggcac

SEQ ID NO: 1106182 - RNA, 19 nt, Mycobacterium bovis subsp bovis AF2122/97
cgauagcgcggcaccagca

SEQ ID NO: 1106183 - RNA, 12 nt, Mycobacterium bovis subsp bovis AF2122/97
cgauagccaccg

SEQ ID NO: 1106184 - RNA, 15 nt, Mycobacterium bovis subsp bovis AF2122/97
cgauagccaccgacg

SEQ ID NO: 1106185 - RNA, 18 nt, Mycobacterium bovis subsp bovis AF2122/97
cgauagccaccgacgaca

SEQ ID NO: 1106186 - RNA, 22 nt, Mycobacterium bovis subsp bovis AF2122/97
cgauagaucgcguggaucgcgc

SEQ ID NO: 1106187 - RNA, 19 nt, Mycobacterium bovis subsp bovis AF2122/97
cgauagaugcgugcggcag

SEQ ID NO: 1106188 - RNA, 13 nt, Mycobacterium bovis subsp bovis AF2122/97
cgauacaccgacg

SEQ ID NO: 1106189 - RNA, 16 nt, Mycobacterium bovis subsp bovis AF2122/97
cgaggcgcucacccgc

SEQ ID NO: 1106190 - RNA, 21 nt, Mycobacterium bovis subsp bovis AF2122/97
cgaggcguucaccacgaucgc

SEQ ID NO: 1106191 - RNA, 16 nt, Mycobacterium bovis subsp bovis AF2122/97
cgauaacccgcaucgg

SEQ ID NO: 1106192 - RNA, 15 nt, Mycobacterium bovis subsp bovis AF2122/97
cgauaaccgacgauc

SEQ ID NO: 1106193 - RNA, 16 nt, Mycobacterium bovis subsp bovis AF2122/97
cgauaacaaggccgcc

SEQ ID NO: 1106194 - RNA, 18 nt, Mycobacterium bovis subsp bovis AF2122/97
cgauaacaaggccgccgc

SEQ ID NO: 1106195 - RNA, 17 nt, Mycobacterium bovis subsp bovis AF2122/97
cgauaaauggccgauga

SEQ ID NO: 1106196 - RNA, 20 nt, Mycobacterium bovis subsp bovis AF2122/97
cgaggcgcucgaucgcguug

SEQ ID NO: 1106197 - RNA, 16 nt, Mycobacterium bovis subsp bovis AF2122/97
cgauaacuccgcggcg

SEQ ID NO: 1106198 - RNA, 16 nt, Mycobacterium bovis subsp bovis AF2122/97
cgauaaggaccgcgcc

SEQ ID NO: 1106199 - RNA, 18 nt, Mycobacterium bovis subsp bovis AF2122/97
cgauaaggaccgcgccca

SEQ ID NO: 1106200 - RNA, 13 nt, Mycobacterium bovis subsp bovis AF2122/97
cgaugacgccguc

SEQ ID NO: 1106201 - RNA, 18 nt, Mycobacterium bovis subsp bovis AF2122/97
cgaugacgccgucagcgg

SEQ ID NO: 1106202 - RNA, 22 nt, Mycobacterium bovis subsp bovis AF2122/97
cgaugacgccgucagcggccaa

SEQ ID NO: 1106203 - RNA, 13 nt, Mycobacterium bovis subsp bovis AF2122/97
cgaugacgauguc

SEQ ID NO: 1106204 - RNA, 19 nt, Mycobacterium bovis subsp bovis AF2122/97
cgaugacugaaucgaccgg

SEQ ID NO: 1106205 - RNA, 17 nt, Mycobacterium bovis subsp bovis AF2122/97
cgaugagcaugcccagc

SEQ ID NO: 1106206 - RNA, 20 nt, Mycobacterium bovis subsp bovis AF2122/97
cgaugagcaugcccagcgca

SEQ ID NO: 1106207 - RNA, 16 nt, Mycobacterium bovis subsp bovis AF2122/97
cgaugaggcgcagcgc

SEQ ID NO: 1106208 - RNA, 17 nt, Mycobacterium bovis subsp bovis AF2122/97
cgaugaggcgcagcgcc

SEQ ID NO: 1106209 - RNA, 21 nt, Mycobacterium bovis subsp bovis AF2122/97
cgaugagucgggaagcgagca

SEQ ID NO: 1106210 - RNA, 23 nt, Mycobacterium bovis subsp bovis AF2122/97
cgaugagguggccgcgcaggggc

SEQ ID NO: 1106211 - RNA, 19 nt, Mycobacterium bovis subsp bovis AF2122/97
cgaugacgguggggucgcc

SEQ ID NO: 1106212 - RNA, 19 nt, Mycobacterium bovis subsp bovis AF2122/97
cgaugaggacauccggcgc

SEQ ID NO: 1106213 - RNA, 15 nt, Mycobacterium bovis subsp bovis AF2122/97
cgaugagcccagccg

SEQ ID NO: 1106214 - RNA, 19 nt, Mycobacterium bovis subsp bovis AF2122/97
cgaugagcgugccgcagcg

SEQ ID NO: 1106215 - RNA, 23 nt, Mycobacterium bovis subsp bovis AF2122/97
cgaugagcgugccgcagcggcgg

SEQ ID NO: 1106216 - RNA, 15 nt, Mycobacterium bovis subsp bovis AF2122/97
cgaugaugacggcgg

SEQ ID NO: 1106217 - RNA, 23 nt, Mycobacterium bovis subsp bovis AF2122/97
cgaugaucugcuugccaccgccg

SEQ ID NO: 1106218 - RNA, 16 nt, Mycobacterium bovis subsp bovis AF2122/97
cgaugaucuugccgcg

SEQ ID NO: 1106219 - RNA, 20 nt, Mycobacterium bovis subsp bovis AF2122/97
cgaugaucuugccgcggcgc

SEQ ID NO: 1106220 - RNA, 19 nt, Mycobacterium bovis subsp bovis AF2122/97
cgaugaugcgcucggccug

SEQ ID NO: 1106221 - RNA, 20 nt, Mycobacterium bovis subsp bovis AF2122/97
cgaugaucccgccaccgaac

SEQ ID NO: 1106222 - RNA, 19 nt, Mycobacterium bovis subsp bovis AF2122/97
cgaugauggcuccggccgc

SEQ ID NO: 1106223 - RNA, 13 nt, Mycobacterium bovis subsp bovis AF2122/97
cgaugauggcggu

SEQ ID NO: 1106224 - RNA, 19 nt, Mycobacterium bovis subsp bovis AF2122/97
cgaugaugcggcgcagcga

SEQ ID NO: 1106225 - RNA, 20 nt, Mycobacterium bovis subsp bovis AF2122/97
cgaugaugcucgacaaccac

SEQ ID NO: 1106226 - RNA, 17 nt, Mycobacterium bovis subsp bovis AF2122/97
cgaugauggacaccagc

SEQ ID NO: 1106227 - RNA, 18 nt, Mycobacterium bovis subsp bovis AF2122/97
cgaugauggacaccagcc

SEQ ID NO: 1106228 - RNA, 16 nt, Mycobacterium bovis subsp bovis AF2122/97
cgaugaugugcgacca

SEQ ID NO: 1106229 - RNA, 18 nt, Mycobacterium bovis subsp bovis AF2122/97
cgaugaugugcgaccaca

SEQ ID NO: 1106230 - RNA, 15 nt, Mycobacterium bovis subsp bovis AF2122/97
cgaugaugucggccg

SEQ ID NO: 1106231 - RNA, 17 nt, Mycobacterium bovis subsp bovis AF2122/97
cgaugaugugcggugac

SEQ ID NO: 1106232 - RNA, 13 nt, Mycobacterium bovis subsp bovis AF2122/97
cgaugaacagcga

SEQ ID NO: 1106233 - RNA, 20 nt, Mycobacterium bovis subsp bovis AF2122/97
cgaugaaccaaucgcacgcc

SEQ ID NO: 1106234 - RNA, 17 nt, Mycobacterium bovis subsp bovis AF2122/97
cgaucuuggaucgguug

SEQ ID NO: 1106235 - RNA, 15 nt, Mycobacterium bovis subsp bovis AF2122/97
cgaucuuggccaccg

SEQ ID NO: 1106236 - RNA, 14 nt, Mycobacterium bovis subsp bovis AF2122/97
cgaucuuggcgaca

SEQ ID NO: 1106237 - RNA, 22 nt, Mycobacterium bovis subsp bovis AF2122/97
cgaucucgucgcggucgaucac

SEQ ID NO: 1106238 - RNA, 23 nt, Mycobacterium bovis subsp bovis AF2122/97
cgaucucgucgcggucgaucaca

SEQ ID NO: 1106239 - RNA, 16 nt, Mycobacterium bovis subsp bovis AF2122/97
cgaucucuaccagccg

SEQ ID NO: 1106240 - RNA, 19 nt, Mycobacterium bovis subsp bovis AF2122/97
cgaucucuccggcggcgaa

SEQ ID NO: 1106241 - RNA, 14 nt, Mycobacterium bovis subsp bovis AF2122/97
cgaucucugcggcg

SEQ ID NO: 1106242 - RNA, 13 nt, Mycobacterium bovis subsp bovis AF2122/97
cgaucuucucgcg

SEQ ID NO: 1106243 - RNA, 23 nt, Mycobacterium bovis subsp bovis AF2122/97
cgaugacgaucgcguccgcgcuc

SEQ ID NO: 1106244 - RNA, 14 nt, Mycobacterium bovis subsp bovis AF2122/97
cgaugacgaucggc

SEQ ID NO: 1106245 - RNA, 22 nt, Mycobacterium bovis subsp bovis AF2122/97
cgaugacgaucggcggcgcgcc

SEQ ID NO: 1106246 - RNA, 14 nt, Mycobacterium bovis subsp bovis AF2122/97
cgaugacgaugccg

SEQ ID NO: 1106247 - RNA, 13 nt, Mycobacterium bovis subsp bovis AF2122/97
cgaugacgauggc

SEQ ID NO: 1106248 - RNA, 21 nt, Mycobacterium bovis subsp bovis AF2122/97
cgaugacgauggccgccgcga

SEQ ID NO: 1106249 - RNA, 22 nt, Mycobacterium bovis subsp bovis AF2122/97
cgaugaccuugggaccaccggg

SEQ ID NO: 1106250 - RNA, 18 nt, Mycobacterium bovis subsp bovis AF2122/97
cgaugaccagcacaccgc

SEQ ID NO: 1106251 - RNA, 19 nt, Mycobacterium bovis subsp bovis AF2122/97
cgaugaccagcacaccgcc

SEQ ID NO: 1106252 - RNA, 16 nt, Mycobacterium bovis subsp bovis AF2122/97
cgaugacgaagugcag

SEQ ID NO: 1106253 - RNA, 16 nt, Mycobacterium bovis subsp bovis AF2122/97
cgaugaccacgccgac

SEQ ID NO: 1106254 - RNA, 18 nt, Mycobacterium bovis subsp bovis AF2122/97
cgaugaccacgccgacga

SEQ ID NO: 1106255 - RNA, 23 nt, Mycobacterium bovis subsp bovis AF2122/97
cgaugaccagauguaccucaucg

SEQ ID NO: 1106256 - RNA, 16 nt, Mycobacterium bovis subsp bovis AF2122/97
cgaugaacgggaucga

SEQ ID NO: 1106257 - RNA, 14 nt, Mycobacterium bovis subsp bovis AF2122/97
cgaugaaccgggca

SEQ ID NO: 1106258 - RNA, 20 nt, Mycobacterium bovis subsp bovis AF2122/97
cgaugaaggccggcgaccgg

SEQ ID NO: 1106259 - RNA, 18 nt, Mycobacterium bovis subsp bovis AF2122/97
cgaugacagacaucgcga

SEQ ID NO: 1106260 - RNA, 22 nt, Mycobacterium bovis subsp bovis AF2122/97
cgaugacaaagaaguggucggc

SEQ ID NO: 1106261 - RNA, 16 nt, Mycobacterium bovis subsp bovis AF2122/97
cgaucggugaaucguc

SEQ ID NO: 1106262 - RNA, 14 nt, Mycobacterium bovis subsp bovis AF2122/97
cgaucggugacgcg

SEQ ID NO: 1106263 - RNA, 21 nt, Mycobacterium bovis subsp bovis AF2122/97
cgaucggugacgcgccguaac

SEQ ID NO: 1106264 - RNA, 16 nt, Mycobacterium bovis subsp bovis AF2122/97
cgaucggugcgaucag

SEQ ID NO: 1106265 - RNA, 17 nt, Mycobacterium bovis subsp bovis AF2122/97
cgaucggugcgggcgcc

SEQ ID NO: 1106266 - RNA, 18 nt, Mycobacterium bovis subsp bovis AF2122/97
cgaucggugcgggcgccg

SEQ ID NO: 1106267 - RNA, 16 nt, Mycobacterium bovis subsp bovis AF2122/97
cgaucggucguccgga

SEQ ID NO: 1106268 - RNA, 15 nt, Mycobacterium bovis subsp bovis AF2122/97
cgaucggggcgacga

SEQ ID NO: 1106269 - RNA, 16 nt, Mycobacterium bovis subsp bovis AF2122/97
cgaucggcucacgacu

SEQ ID NO: 1106270 - RNA, 18 nt, Mycobacterium bovis subsp bovis AF2122/97
cgaucggcucacgacugc

SEQ ID NO: 1106271 - RNA, 22 nt, Mycobacterium bovis subsp bovis AF2122/97
cgaucggcuugccugcgccgag

SEQ ID NO: 1106272 - RNA, 14 nt, Mycobacterium bovis subsp bovis AF2122/97
cgaucgggcccacc

SEQ ID NO: 1106273 - RNA, 21 nt, Mycobacterium bovis subsp bovis AF2122/97
cgaucgggcccaccgcugcgg

SEQ ID NO: 1106274 - RNA, 16 nt, Mycobacterium bovis subsp bovis AF2122/97
cgaucgggccggcgcg

SEQ ID NO: 1106275 - RNA, 18 nt, Mycobacterium bovis subsp bovis AF2122/97
cgaucgggcuucggccag

SEQ ID NO: 1106276 - RNA, 18 nt, Mycobacterium bovis subsp bovis AF2122/97
cgaucggaugcgugagaa

SEQ ID NO: 1106277 - RNA, 23 nt, Mycobacterium bovis subsp bovis AF2122/97
cgaucggggaagccugcgggccg

SEQ ID NO: 1106278 - RNA, 12 nt, Mycobacterium bovis subsp bovis AF2122/97
cgaucguagccg

SEQ ID NO: 1106279 - RNA, 19 nt, Mycobacterium bovis subsp bovis AF2122/97
cgaucguaggacucggcgg

SEQ ID NO: 1106280 - RNA, 15 nt, Mycobacterium bovis subsp bovis AF2122/97
cgaucgucaacgacg

SEQ ID NO: 1106281 - RNA, 18 nt, Mycobacterium bovis subsp bovis AF2122/97
cgaucgucacgcggguug

SEQ ID NO: 1106282 - RNA, 23 nt, Mycobacterium bovis subsp bovis AF2122/97
cgaucgucacgcggguugcgcgg

SEQ ID NO: 1106283 - RNA, 18 nt, Mycobacterium bovis subsp bovis AF2122/97
cgaucgucaacgacgacg

SEQ ID NO: 1106284 - RNA, 19 nt, Mycobacterium bovis subsp bovis AF2122/97
cgaucgucaacgacgacga

SEQ ID NO: 1106285 - RNA, 14 nt, Mycobacterium bovis subsp bovis AF2122/97
cgaucucggccagg

SEQ ID NO: 1106286 - RNA, 15 nt, Mycobacterium bovis subsp bovis AF2122/97
cgaucgucaagccgg

SEQ ID NO: 1106287 - RNA, 19 nt, Mycobacterium bovis subsp bovis AF2122/97
cgaucucggagcgcacgaa

SEQ ID NO: 1106288 - RNA, 13 nt, Mycobacterium bovis subsp bovis AF2122/97
cgaucucggccag

SEQ ID NO: 1106289 - RNA, 14 nt, Mycobacterium bovis subsp bovis AF2122/97
cgaucggcaggccg

SEQ ID NO: 1106290 - RNA, 14 nt, Mycobacterium bovis subsp bovis AF2122/97
cgaucggccaccau

SEQ ID NO: 1106291 - RNA, 14 nt, Mycobacterium bovis subsp bovis AF2122/97
cgaucggccgccga

SEQ ID NO: 1106292 - RNA, 14 nt, Mycobacterium bovis subsp bovis AF2122/97
cgaucggcggcgcg

SEQ ID NO: 1106293 - RNA, 16 nt, Mycobacterium bovis subsp bovis AF2122/97
cgaucggcggcgcgcc

SEQ ID NO: 1106294 - RNA, 17 nt, Mycobacterium bovis subsp bovis AF2122/97
cgaucggcggcggcgcc

SEQ ID NO: 1106295 - RNA, 21 nt, Mycobacterium bovis subsp bovis AF2122/97
cgaucggcagucccagcgccg

SEQ ID NO: 1106296 - RNA, 23 nt, Mycobacterium bovis subsp bovis AF2122/97
cgaucggcagucccagcgccgca

SEQ ID NO: 1106297 - RNA, 20 nt, Mycobacterium bovis subsp bovis AF2122/97
cgaucggcauguucagcccg

SEQ ID NO: 1106298 - RNA, 21 nt, Mycobacterium bovis subsp bovis AF2122/97
cgaucggcauguucagcccga

SEQ ID NO: 1106299 - RNA, 13 nt, Mycobacterium bovis subsp bovis AF2122/97
cgaucggccacca

SEQ ID NO: 1106300 - RNA, 16 nt, Mycobacterium bovis subsp bovis AF2122/97
cgaucggcacuagcga

SEQ ID NO: 1106301 - RNA, 19 nt, Mycobacterium bovis subsp bovis AF2122/97
cgaucggcacuagcgagcc

SEQ ID NO: 1106302 - RNA, 15 nt, Mycobacterium bovis subsp bovis AF2122/97
cgaucggcagccagg

SEQ ID NO: 1106303 - RNA, 19 nt, Mycobacterium bovis subsp bovis AF2122/97
cgaucggcagccagggcgc

SEQ ID NO: 1106304 - RNA, 14 nt, Mycobacterium bovis subsp bovis AF2122/97
cgaucggcaaucga

SEQ ID NO: 1106305 - RNA, 23 nt, Mycobacterium bovis subsp bovis AF2122/97
cgaucggaccaccaggguaucga

SEQ ID NO: 1106306 - RNA, 13 nt, Mycobacterium bovis subsp bovis AF2122/97
cgaucggacgucg

SEQ ID NO: 1106307 - RNA, 16 nt, Mycobacterium bovis subsp bovis AF2122/97
cgaucggaucgaugcc

SEQ ID NO: 1106308 - RNA, 22 nt, Mycobacterium bovis subsp bovis AF2122/97
cgaucgcuccggcccugccgcc

SEQ ID NO: 1106309 - RNA, 16 nt, Mycobacterium bovis subsp bovis AF2122/97
cgaucgcucauucgug

SEQ ID NO: 1106310 - RNA, 23 nt, Mycobacterium bovis subsp bovis AF2122/97
cgaucgcuccggcccugccgccg

SEQ ID NO: 1106311 - RNA, 22 nt, Mycobacterium bovis subsp bovis AF2122/97
cgaucgcucauucgugcccggg

SEQ ID NO: 1106312 - RNA, 16 nt, Mycobacterium bovis subsp bovis AF2122/97
cgaucgcggcccggcc

SEQ ID NO: 1106313 - RNA, 20 nt, Mycobacterium bovis subsp bovis AF2122/97
cgaucgcgccgucggcgaug

SEQ ID NO: 1106314 - RNA, 13 nt, Mycobacterium bovis subsp bovis AF2122/97
cgaucgcggcauc

SEQ ID NO: 1106315 - RNA, 21 nt, Mycobacterium bovis subsp bovis AF2122/97
cgaucgcggcgagcaccaccc

SEQ ID NO: 1106316 - RNA, 16 nt, Mycobacterium bovis subsp bovis AF2122/97
cgaucgcgccgucggc

SEQ ID NO: 1106317 - RNA, 17 nt, Mycobacterium bovis subsp bovis AF2122/97
cgaucgcgccugugcgc

SEQ ID NO: 1106318 - RNA, 15 nt, Mycobacterium bovis subsp bovis AF2122/97
cgaucgcgcgagcga

SEQ ID NO: 1106319 - RNA, 15 nt, Mycobacterium bovis subsp bovis AF2122/97
cgaucgcgcuggcgc

SEQ ID NO: 1106320 - RNA, 18 nt, Mycobacterium bovis subsp bovis AF2122/97
cgaucgcgcuggcgcccu

SEQ ID NO: 1106321 - RNA, 12 nt, Mycobacterium bovis subsp bovis AF2122/97
cgaucgcggcgg

SEQ ID NO: 1106322 - RNA, 14 nt, Mycobacterium bovis subsp bovis AF2122/97
cgaucgcggcggcc

SEQ ID NO: 1106323 - RNA, 17 nt, Mycobacterium bovis subsp bovis AF2122/97
cgaucgcggcggccucc

SEQ ID NO: 1106324 - RNA, 24 nt, Mycobacterium bovis subsp bovis AF2122/97
cgaucgcggucaaauccagcagcc

SEQ ID NO: 1106325 - RNA, 15 nt, Mycobacterium bovis subsp bovis AF2122/97
cgaucgcguccgcgc

SEQ ID NO: 1106326 - RNA, 12 nt, Mycobacterium bovis subsp bovis AF2122/97
cgaucgcgucgg

SEQ ID NO: 1106327 - RNA, 22 nt, Mycobacterium bovis subsp bovis AF2122/97
cgaucgcgucgggcucggcgaa

SEQ ID NO: 1106328 - RNA, 22 nt, Mycobacterium bovis subsp bovis AF2122/97
cgaucgcgugcggugccguggu

SEQ ID NO: 1106329 - RNA, 17 nt, Mycobacterium bovis subsp bovis AF2122/97
cgaucgcgagcgagcca

SEQ ID NO: 1106330 - RNA, 14 nt, Mycobacterium bovis subsp bovis AF2122/97
cgaucgcgagccca

SEQ ID NO: 1106331 - RNA, 15 nt, Mycobacterium bovis subsp bovis AF2122/97
cgaucgcgacccgau

SEQ ID NO: 1106332 - RNA, 13 nt, Mycobacterium bovis subsp bovis AF2122/97
cgaucgccggccg

SEQ ID NO: 1106333 - RNA, 16 nt, Mycobacterium bovis subsp bovis AF2122/97
cgaucgccggccgcgu

SEQ ID NO: 1106334 - RNA, 20 nt, Mycobacterium bovis subsp bovis AF2122/97
cgaucgccgcuaacgcaccu

SEQ ID NO: 1106335 - RNA, 15 nt, Mycobacterium bovis subsp bovis AF2122/97
cgaucgccgcgaugg

SEQ ID NO: 1106336 - RNA, 18 nt, Mycobacterium bovis subsp bovis AF2122/97
cgaucgccgcgcuggucg

SEQ ID NO: 1106337 - RNA, 23 nt, Mycobacterium bovis subsp bovis AF2122/97
cgaucgccgcgaagcgcucggca

SEQ ID NO: 1106338 - RNA, 15 nt, Mycobacterium bovis subsp bovis AF2122/97
cgaucgcccggcccc

SEQ ID NO: 1106339 - RNA, 18 nt, Mycobacterium bovis subsp bovis AF2122/97
cgaucgcccggccccgca

SEQ ID NO: 1106340 - RNA, 15 nt, Mycobacterium bovis subsp bovis AF2122/97
cgaucgccaggccga

SEQ ID NO: 1106341 - RNA, 23 nt, Mycobacterium bovis subsp bovis AF2122/97
cgaucgacaccgugaccgccgcg

SEQ ID NO: 1106342 - RNA, 21 nt, Mycobacterium bovis subsp bovis AF2122/97
cgaucgaauugcguucgccgc

SEQ ID NO: 1106343 - RNA, 13 nt, Mycobacterium bovis subsp bovis AF2122/97
cgaucgacccggu

SEQ ID NO: 1106344 - RNA, 18 nt, Mycobacterium bovis subsp bovis AF2122/97
cgaucgacaccagggcgu

SEQ ID NO: 1106345 - RNA, 16 nt, Mycobacterium bovis subsp bovis AF2122/97
ccggaucgaagaccag

SEQ ID NO: 1106346 - RNA, 21 nt, Mycobacterium bovis subsp bovis AF2122/97
ccggaucgaagaccagcaacg

SEQ ID NO: 1106347 - RNA, 20 nt, Mycobacterium bovis subsp bovis AF2122/97
ccggauccgccagaccgcgg

SEQ ID NO: 1106348 - RNA, 17 nt, Mycobacterium bovis subsp bovis AF2122/97
ccggauccgccagaccg

SEQ ID NO: 1106349 - RNA, 13 nt, Mycobacterium bovis subsp bovis AF2122/97
ccggaucggccug

SEQ ID NO: 1106350 - RNA, 15 nt, Mycobacterium bovis subsp bovis AF2122/97
ccggaucgccgucgc

SEQ ID NO: 1106351 - RNA, 16 nt, Mycobacterium bovis subsp bovis AF2122/97
ccggaucgccgucggc

SEQ ID NO: 1106352 - RNA, 18 nt, Mycobacterium bovis subsp bovis AF2122/97
ccggaucgccgucggcgg

SEQ ID NO: 1106353 - RNA, 21 nt, Mycobacterium bovis subsp bovis AF2122/97
ccggaucgccuuggcgcccgc

SEQ ID NO: 1106354 - RNA, 14 nt, Mycobacterium bovis subsp bovis AF2122/97
ccggaucgccgaau

SEQ ID NO: 1106355 - RNA, 20 nt, Mycobacterium bovis subsp bovis AF2122/97
ccggaucgccgaaucggcag

SEQ ID NO: 1106356 - RNA, 13 nt, Mycobacterium bovis subsp bovis AF2122/97
ccggaucaccgcg

SEQ ID NO: 1106357 - RNA, 23 nt, Mycobacterium bovis subsp bovis AF2122/97
ccggaucaccgcgcccgccgcgg

SEQ ID NO: 1106358 - RNA, 15 nt, Mycobacterium bovis subsp bovis AF2122/97
ccggauccgauccgc

SEQ ID NO: 1106359 - RNA, 14 nt, Mycobacterium bovis subsp bovis AF2122/97
ccggaucccaccac

SEQ ID NO: 1106360 - RNA, 21 nt, Mycobacterium bovis subsp bovis AF2122/97
ccggaucccaccaccgcucgu

SEQ ID NO: 1106361 - RNA, 22 nt, Mycobacterium bovis subsp bovis AF2122/97
ccggaucccaccaccgcucguc

SEQ ID NO: 1106362 - RNA, 20 nt, Mycobacterium bovis subsp bovis AF2122/97
ccggauagcgcagcucgcug

SEQ ID NO: 1106363 - RNA, 15 nt, Mycobacterium bovis subsp bovis AF2122/97
ccggauagcaccggc

SEQ ID NO: 1106364 - RNA, 17 nt, Mycobacterium bovis subsp bovis AF2122/97
ccggauagcaccggcac

SEQ ID NO: 1106365 - RNA, 19 nt, Mycobacterium bovis subsp bovis AF2122/97
ccggauagcgucuggcgac

SEQ ID NO: 1106366 - RNA, 20 nt, Mycobacterium bovis subsp bovis AF2122/97
ccggauagcgucuggcgaca

SEQ ID NO: 1106367 - RNA, 18 nt, Mycobacterium bovis subsp bovis AF2122/97
ccggauaucgaccaccgg

SEQ ID NO: 1106368 - RNA, 21 nt, Mycobacterium bovis subsp bovis AF2122/97
ccggaguucuguaccggcugg

SEQ ID NO: 1106369 - RNA, 20 nt, Mycobacterium bovis subsp bovis AF2122/97
ccggaguugucgacggccac

SEQ ID NO: 1106370 - RNA, 18 nt, Mycobacterium bovis subsp bovis AF2122/97
ccggaggugacaaauggg

SEQ ID NO: 1106371 - RNA, 22 nt, Mycobacterium bovis subsp bovis AF2122/97
ccggagucgcccgguccgccgc

SEQ ID NO: 1106372 - RNA, 14 nt, Mycobacterium bovis subsp bovis AF2122/97
ccggagucggcguc

SEQ ID NO: 1106373 - RNA, 14 nt, Mycobacterium bovis subsp bovis AF2122/97
ccggagucgacgac

SEQ ID NO: 1106374 - RNA, 15 nt, Mycobacterium bovis subsp bovis AF2122/97
ccggaggugcgccgc

SEQ ID NO: 1106375 - RNA, 21 nt, Mycobacterium bovis subsp bovis AF2122/97
ccggaggcuugcaacaccccg

SEQ ID NO: 1106376 - RNA, 20 nt, Mycobacterium bovis subsp bovis AF2122/97
ccggauaaucauccgagcgg

SEQ ID NO: 1106377 - RNA, 18 nt, Mycobacterium bovis subsp bovis AF2122/97
ccggauagacgugcacca

SEQ ID NO: 1106378 - RNA, 13 nt, Mycobacterium bovis subsp bovis AF2122/97
ccggauagacggc

SEQ ID NO: 1106379 - RNA, 16 nt, Mycobacterium bovis subsp bovis AF2122/97
ccggauagacggcgac

SEQ ID NO: 1106380 - RNA, 16 nt, Mycobacterium bovis subsp bovis AF2122/97
ccggagcccacacgcu

SEQ ID NO: 1106381 - RNA, 19 nt, Mycobacterium bovis subsp bovis AF2122/97
ccggaguuuaagacgcccg

SEQ ID NO: 1106382 - RNA, 14 nt, Mycobacterium bovis subsp bovis AF2122/97
ccggauucggcugc

SEQ ID NO: 1106383 - RNA, 17 nt, Mycobacterium bovis subsp bovis AF2122/97
ccggauucuucggugaa

SEQ ID NO: 1106384 - RNA, 18 nt, Mycobacterium bovis subsp bovis AF2122/97
ccggauugaagucgucgg

SEQ ID NO: 1106385 - RNA, 19 nt, Mycobacterium bovis subsp bovis AF2122/97
ccggauugaagucgucggc

SEQ ID NO: 1106386 - RNA, 20 nt, Mycobacterium bovis subsp bovis AF2122/97
ccggauugcuguacugcggu

SEQ ID NO: 1106387 - RNA, 18 nt, Mycobacterium bovis subsp bovis AF2122/97
ccggauggguggccagca

SEQ ID NO: 1106388 - RNA, 21 nt, Mycobacterium bovis subsp bovis AF2122/97
ccggauuccucgucaccgcga

SEQ ID NO: 1106389 - RNA, 13 nt, Mycobacterium bovis subsp bovis AF2122/97
ccggauguccgcc

SEQ ID NO: 1106390 - RNA, 15 nt, Mycobacterium bovis subsp bovis AF2122/97
ccggauguccgccga

SEQ ID NO: 1106391 - RNA, 18 nt, Mycobacterium bovis subsp bovis AF2122/97
ccggaugcugucagcagc

SEQ ID NO: 1106392 - RNA, 19 nt, Mycobacterium bovis subsp bovis AF2122/97
ccggaugcugucagcagcc

SEQ ID NO: 1106393 - RNA, 15 nt, Mycobacterium bovis subsp bovis AF2122/97
ccggaugcgcaaccg

SEQ ID NO: 1106394 - RNA, 23 nt, Mycobacterium bovis subsp bovis AF2122/97
ccggaugacaccgaccgggucgc

SEQ ID NO: 1106395 - RNA, 20 nt, Mycobacterium bovis subsp bovis AF2122/97
ccggaucggccuguccaccg

SEQ ID NO: 1106396 - RNA, 14 nt, Mycobacterium bovis subsp bovis AF2122/97
ccggaucggucggc

SEQ ID NO: 1106397 - RNA, 14 nt, Mycobacterium bovis subsp bovis AF2122/97
ccggaucgucgaac

SEQ ID NO: 1106398 - RNA, 17 nt, Mycobacterium bovis subsp bovis AF2122/97
ccggaugacaccgaccg

SEQ ID NO: 1106399 - RNA, 20 nt, Mycobacterium bovis subsp bovis AF2122/97
ccggaugacaccgaccgggu

SEQ ID NO: 1106400 - RNA, 16 nt, Mycobacterium bovis subsp bovis AF2122/97
ccggaucguucgcgug

SEQ ID NO: 1106401 - RNA, 19 nt, Mycobacterium bovis subsp bovis AF2122/97
ccggaucgucgaacagcac

SEQ ID NO: 1106402 - RNA, 22 nt, Mycobacterium bovis subsp bovis AF2122/97
ccggaucgucgaacagcaccgc

SEQ ID NO: 1106403 - RNA, 12 nt, Mycobacterium bovis subsp bovis AF2122/97
ccggagagccgg

SEQ ID NO: 1106404 - RNA, 16 nt, Mycobacterium bovis subsp bovis AF2122/97
ccggagacgucgccgc

SEQ ID NO: 1106405 - RNA, 14 nt, Mycobacterium bovis subsp bovis AF2122/97
ccggacugcggccc

SEQ ID NO: 1106406 - RNA, 18 nt, Mycobacterium bovis subsp bovis AF2122/97
ccggacuuggccugcggu

SEQ ID NO: 1106407 - RNA, 12 nt, Mycobacterium bovis subsp bovis AF2122/97
ccggagccgcca

SEQ ID NO: 1106408 - RNA, 13 nt, Mycobacterium bovis subsp bovis AF2122/97
ccggagccgccca

SEQ ID NO: 1106409 - RNA, 19 nt, Mycobacterium bovis subsp bovis AF2122/97
ccggagccccugucaacgc

SEQ ID NO: 1106410 - RNA, 21 nt, Mycobacterium bovis subsp bovis AF2122/97
ccggagccccugucaacgccg

SEQ ID NO: 1106411 - RNA, 22 nt, Mycobacterium bovis subsp bovis AF2122/97
ccggagaucuugcgcaaugccg

SEQ ID NO: 1106412 - RNA, 20 nt, Mycobacterium bovis subsp bovis AF2122/97
ccggagcgccgagcucggcg

SEQ ID NO: 1106413 - RNA, 14 nt, Mycobacterium bovis subsp bovis AF2122/97
ccggaggccgccgc

SEQ ID NO: 1106414 - RNA, 18 nt, Mycobacterium bovis subsp bovis AF2122/97
ccggaggccgccgcgccg

SEQ ID NO: 1106415 - RNA, 13 nt, Mycobacterium bovis subsp bovis AF2122/97
ccggaggcaaucc

SEQ ID NO: 1106416 - RNA, 21 nt, Mycobacterium bovis subsp bovis AF2122/97
ccggacuccaaagccgugcca

SEQ ID NO: 1106417 - RNA, 14 nt, Mycobacterium bovis subsp bovis AF2122/97
ccggacuaccgccg

SEQ ID NO: 1106418 - RNA, 16 nt, Mycobacterium bovis subsp bovis AF2122/97
ccggacuaccgccggc

SEQ ID NO: 1106419 - RNA, 21 nt, Mycobacterium bovis subsp bovis AF2122/97
ccggacuaccgccggcggcgg

SEQ ID NO: 1106420 - RNA, 13 nt, Mycobacterium bovis subsp bovis AF2122/97
ccggacuugacca

SEQ ID NO: 1106421 - RNA, 22 nt, Mycobacterium bovis subsp bovis AF2122/97
ccggagaauagaucagggcucg

SEQ ID NO: 1106422 - RNA, 14 nt, Mycobacterium bovis subsp bovis AF2122/97
ccggagacacccgc

SEQ ID NO: 1106423 - RNA, 21 nt, Mycobacterium bovis subsp bovis AF2122/97
ccggagacacccgccaggccg

SEQ ID NO: 1106424 - RNA, 17 nt, Mycobacterium bovis subsp bovis AF2122/97
ccggagacaccgcaacg

SEQ ID NO: 1106425 - RNA, 19 nt, Mycobacterium bovis subsp bovis AF2122/97
ccggacggcagccgggcgg

SEQ ID NO: 1106426 - RNA, 20 nt, Mycobacterium bovis subsp bovis AF2122/97
ccggacggcagccgggcggc

SEQ ID NO: 1106427 - RNA, 23 nt, Mycobacterium bovis subsp bovis AF2122/97
ccggacggcagccgggcggcagc

SEQ ID NO: 1106428 - RNA, 18 nt, Mycobacterium bovis subsp bovis AF2122/97
ccggacggcaggcuggcg

SEQ ID NO: 1106429 - RNA, 17 nt, Mycobacterium bovis subsp bovis AF2122/97
ccggacgggugcagcgc

SEQ ID NO: 1106430 - RNA, 18 nt, Mycobacterium bovis subsp bovis AF2122/97
ccggacgggugcagcgca

SEQ ID NO: 1106431 - RNA, 19 nt, Mycobacterium bovis subsp bovis AF2122/97
ccggacguaggcaccccgg

SEQ ID NO: 1106432 - RNA, 20 nt, Mycobacterium bovis subsp bovis AF2122/97
ccggacguaggcaccccggu

SEQ ID NO: 1106433 - RNA, 22 nt, Mycobacterium bovis subsp bovis AF2122/97
ccggacguaggcaccccggugc

SEQ ID NO: 1106434 - RNA, 12 nt, Mycobacterium bovis subsp bovis AF2122/97
ccggacgucggc

SEQ ID NO: 1106435 - RNA, 17 nt, Mycobacterium bovis subsp bovis AF2122/97
ccggacgucggcggccg

SEQ ID NO: 1106436 - RNA, 19 nt, Mycobacterium bovis subsp bovis AF2122/97
ccggacguucuggaucgug

SEQ ID NO: 1106437 - RNA, 15 nt, Mycobacterium bovis subsp bovis AF2122/97
ccggacccgccgggu

SEQ ID NO: 1106438 - RNA, 16 nt, Mycobacterium bovis subsp bovis AF2122/97
ccggaccgucguggcg

SEQ ID NO: 1106439 - RNA, 14 nt, Mycobacterium bovis subsp bovis AF2122/97
ccggaccgccgcaa

SEQ ID NO: 1106440 - RNA, 13 nt, Mycobacterium bovis subsp bovis AF2122/97
ccggaccgcgacg

SEQ ID NO: 1106441 - RNA, 15 nt, Mycobacterium bovis subsp bovis AF2122/97
ccggaccgcgacggc

SEQ ID NO: 1106442 - RNA, 22 nt, Mycobacterium bovis subsp bovis AF2122/97
ccggacccgcccuugccgccga

SEQ ID NO: 1106443 - RNA, 16 nt, Mycobacterium bovis subsp bovis AF2122/97
ccggacccggucgccg

SEQ ID NO: 1106444 - RNA, 12 nt, Mycobacterium bovis subsp bovis AF2122/97
ccggacgauggc

SEQ ID NO: 1106445 - RNA, 15 nt, Mycobacterium bovis subsp bovis AF2122/97
ccggaccuucggcgg

SEQ ID NO: 1106446 - RNA, 23 nt, Mycobacterium bovis subsp bovis AF2122/97
ccggacgaaacgaucgcgccauc

SEQ ID NO: 1106447 - RNA, 19 nt, Mycobacterium bovis subsp bovis AF2122/97
ccggacgagcgucagaucc

SEQ ID NO: 1106448 - RNA, 16 nt, Mycobacterium bovis subsp bovis AF2122/97
ccggacgagugcacac

SEQ ID NO: 1106449 - RNA, 17 nt, Mycobacterium bovis subsp bovis AF2122/97
ccggacgaucagggugu

SEQ ID NO: 1106450 - RNA, 14 nt, Mycobacterium bovis subsp bovis AF2122/97
ccggaccugaccgg

SEQ ID NO: 1106451 - RNA, 17 nt, Mycobacterium bovis subsp bovis AF2122/97
ccggacgccaugcccgc

SEQ ID NO: 1106452 - RNA, 20 nt, Mycobacterium bovis subsp bovis AF2122/97
ccggacgcccucacgccaag

SEQ ID NO: 1106453 - RNA, 17 nt, Mycobacterium bovis subsp bovis AF2122/97
ccggacgcaacacccgg

SEQ ID NO: 1106454 - RNA, 19 nt, Mycobacterium bovis subsp bovis AF2122/97
ccggacgaaaucggcggcg

SEQ ID NO: 1106455 - RNA, 19 nt, Mycobacterium bovis subsp bovis AF2122/97
ccggacgauggcgucggcc

SEQ ID NO: 1106456 - RNA, 20 nt, Mycobacterium bovis subsp bovis AF2122/97
ccggaccaucgacaacgccu

SEQ ID NO: 1106457 - RNA, 13 nt, Mycobacterium bovis subsp bovis AF2122/97
ccggacccaccaa

SEQ ID NO: 1106458 - RNA, 19 nt, Mycobacterium bovis subsp bovis AF2122/97
ccggacccacccgcaccgc

SEQ ID NO: 1106459 - RNA, 16 nt, Mycobacterium bovis subsp bovis AF2122/97
ccggacccaccgucac

SEQ ID NO: 1106460 - RNA, 15 nt, Mycobacterium bovis subsp bovis AF2122/97
ccggacagcgcaucc

SEQ ID NO: 1106461 - RNA, 14 nt, Mycobacterium bovis subsp bovis AF2122/97
ccggacauagccgc

SEQ ID NO: 1106462 - RNA, 22 nt, Mycobacterium bovis subsp bovis AF2122/97
ccggacauagccgcgcucgaac

SEQ ID NO: 1106463 - RNA, 17 nt, Mycobacterium bovis subsp bovis AF2122/97
ccggacaugcgggcagc

SEQ ID NO: 1106464 - RNA, 18 nt, Mycobacterium bovis subsp bovis AF2122/97
ccggacaugcgggcagca

SEQ ID NO: 1106465 - RNA, 12 nt, Mycobacterium bovis subsp bovis AF2122/97
ccggaccaccgc

SEQ ID NO: 1106466 - RNA, 15 nt, Mycobacterium bovis subsp bovis AF2122/97
ccggaccaccgccga

SEQ ID NO: 1106467 - RNA, 16 nt, Mycobacterium bovis subsp bovis AF2122/97
ccggacagggcggcga

SEQ ID NO: 1106468 - RNA, 14 nt, Mycobacterium bovis subsp bovis AF2122/97
ccggacaggcuuga

SEQ ID NO: 1106469 - RNA, 15 nt, Mycobacterium bovis subsp bovis AF2122/97
ccggacagcucgcgc

SEQ ID NO: 1106470 - RNA, 14 nt, Mycobacterium bovis subsp bovis AF2122/97
ccggacagcgcauc

SEQ ID NO: 1106471 - RNA, 14 nt, Mycobacterium bovis subsp bovis AF2122/97
ccggacacgaucag

SEQ ID NO: 1106472 - RNA, 13 nt, Mycobacterium bovis subsp bovis AF2122/97
ccggacacuccug

SEQ ID NO: 1106473 - RNA, 21 nt, Mycobacterium bovis subsp bovis AF2122/97
ccggacaaagcugcucgucgg

SEQ ID NO: 1106474 - RNA, 23 nt, Mycobacterium bovis subsp bovis AF2122/97
ccggacaaagcugcucgucggcg

SEQ ID NO: 1106475 - RNA, 23 nt, Mycobacterium bovis subsp bovis AF2122/97
ccggacaacagagucaccgcgcu

SEQ ID NO: 1106476 - RNA, 21 nt, Mycobacterium bovis subsp bovis AF2122/97
ccggaacuguggugccugcgg

SEQ ID NO: 1106477 - RNA, 22 nt, Mycobacterium bovis subsp bovis AF2122/97
ccggcaccaacgccaccgucgc

SEQ ID NO: 1106478 - RNA, 14 nt, Mycobacterium bovis subsp bovis AF2122/97
ccggcaccggccgu

SEQ ID NO: 1106479 - RNA, 17 nt, Mycobacterium bovis subsp bovis AF2122/97
ccggcaccggccgugcc

SEQ ID NO: 1106480 - RNA, 18 nt, Mycobacterium bovis subsp bovis AF2122/97
ccggcaccggccgugccg

SEQ ID NO: 1106481 - RNA, 16 nt, Mycobacterium bovis subsp bovis AF2122/97
ccggcaccuccagcac

SEQ ID NO: 1106482 - RNA, 19 nt, Mycobacterium bovis subsp bovis AF2122/97
ccggcaccuccagcaccac

SEQ ID NO: 1106483 - RNA, 14 nt, Mycobacterium bovis subsp bovis AF2122/97
ccggcacgccggcg

SEQ ID NO: 1106484 - RNA, 18 nt, Mycobacterium bovis subsp bovis AF2122/97
ccggcacgccggcggcgg

SEQ ID NO: 1106485 - RNA, 20 nt, Mycobacterium bovis subsp bovis AF2122/97
ccggcacgccggcggcggag

SEQ ID NO: 1106486 - RNA, 17 nt, Mycobacterium bovis subsp bovis AF2122/97
ccggcacgccgaccggu

SEQ ID NO: 1106487 - RNA, 13 nt, Mycobacterium bovis subsp bovis AF2122/97
ccggcaccgacac

SEQ ID NO: 1106488 - RNA, 12 nt, Mycobacterium bovis subsp bovis AF2122/97
ccggcacccggu

SEQ ID NO: 1106489 - RNA, 16 nt, Mycobacterium bovis subsp bovis AF2122/97
ccggcacccggugaga

SEQ ID NO: 1106490 - RNA, 12 nt, Mycobacterium bovis subsp bovis AF2122/97
ccggcacccguc

SEQ ID NO: 1106491 - RNA, 14 nt, Mycobacterium bovis subsp bovis AF2122/97
ccggcacccgucgg

SEQ ID NO: 1106492 - RNA, 17 nt, Mycobacterium bovis subsp bovis AF2122/97
ccggcacccgucgggug

SEQ ID NO: 1106493 - RNA, 22 nt, Mycobacterium bovis subsp bovis AF2122/97
ccggcacccgucgggugcugau

SEQ ID NO: 1106494 - RNA, 12 nt, Mycobacterium bovis subsp bovis AF2122/97
ccggcaccgcgu

SEQ ID NO: 1106495 - RNA, 16 nt, Mycobacterium bovis subsp bovis AF2122/97
ccggcaccgcugccgc

SEQ ID NO: 1106496 - RNA, 19 nt, Mycobacterium bovis subsp bovis AF2122/97
ccggcaccgcugccgcugc

SEQ ID NO: 1106497 - RNA, 22 nt, Mycobacterium bovis subsp bovis AF2122/97
ccggcaccgcugccgcugccga

SEQ ID NO: 1106498 - RNA, 13 nt, Mycobacterium bovis subsp bovis AF2122/97
ccggcaccggaug

SEQ ID NO: 1106499 - RNA, 13 nt, Mycobacterium bovis subsp bovis AF2122/97
ccggcaccgccgc

SEQ ID NO: 1106500 - RNA, 15 nt, Mycobacterium bovis subsp bovis AF2122/97
ccggcaccgccggca

SEQ ID NO: 1106501 - RNA, 15 nt, Mycobacterium bovis subsp bovis AF2122/97
ccggcaccgccggcu

SEQ ID NO: 1106502 - RNA, 14 nt, Mycobacterium bovis subsp bovis AF2122/97
ccggcaccgccggu

SEQ ID NO: 1106503 - RNA, 12 nt, Mycobacterium bovis subsp bovis AF2122/97
ccggcaccgccu

SEQ ID NO: 1106504 - RNA, 14 nt, Mycobacterium bovis subsp bovis AF2122/97
ccggcagagcacgc

SEQ ID NO: 1106505 - RNA, 24 nt, Mycobacterium bovis subsp bovis AF2122/97
ccggcagagcacgcgcggcgucgu

SEQ ID NO: 1106506 - RNA, 21 nt, Mycobacterium bovis subsp bovis AF2122/97
ccggcagaugcagcgggucgc

SEQ ID NO: 1106507 - RNA, 18 nt, Mycobacterium bovis subsp bovis AF2122/97
ccggcagauguguccggc

SEQ ID NO: 1106508 - RNA, 19 nt, Mycobacterium bovis subsp bovis AF2122/97
ccggcagauguguccggca

SEQ ID NO: 1106509 - RNA, 16 nt, Mycobacterium bovis subsp bovis AF2122/97
ccggcagcagccggcg

SEQ ID NO: 1106510 - RNA, 21 nt, Mycobacterium bovis subsp bovis AF2122/97
ccggcacugcccagcagacca

SEQ ID NO: 1106511 - RNA, 14 nt, Mycobacterium bovis subsp bovis AF2122/97
ccggcacugcggcc

SEQ ID NO: 1106512 - RNA, 19 nt, Mycobacterium bovis subsp bovis AF2122/97
ccggcacugcggccaguca

SEQ ID NO: 1106513 - RNA, 12 nt, Mycobacterium bovis subsp bovis AF2122/97
ccggcacgcguc

SEQ ID NO: 1106514 - RNA, 14 nt, Mycobacterium bovis subsp bovis AF2122/97
ccggcacgcgcgcu

SEQ ID NO: 1106515 - RNA, 19 nt, Mycobacterium bovis subsp bovis AF2122/97
ccggcacggugucgcgcga

SEQ ID NO: 1106516 - RNA, 19 nt, Mycobacterium bovis subsp bovis AF2122/97
ccggcacggugaacaaucc

SEQ ID NO: 1106517 - RNA, 14 nt, Mycobacterium bovis subsp bovis AF2122/97
ccggcacgucgacc

SEQ ID NO: 1106518 - RNA, 17 nt, Mycobacterium bovis subsp bovis AF2122/97
ccggcacccgcggcgaa

SEQ ID NO: 1106519 - RNA, 15 nt, Mycobacterium bovis subsp bovis AF2122/97
ccggcacccgcacgg

SEQ ID NO: 1106520 - RNA, 20 nt, Mycobacterium bovis subsp bovis AF2122/97
ccggcacccgcacggccucc

SEQ ID NO: 1106521 - RNA, 16 nt, Mycobacterium bovis subsp bovis AF2122/97
ccggcacccccgucgc

SEQ ID NO: 1106522 - RNA, 13 nt, Mycobacterium bovis subsp bovis AF2122/97
ccggcacccaguu

SEQ ID NO: 1106523 - RNA, 17 nt, Mycobacterium bovis subsp bovis AF2122/97
ccggcaccagcggcacc

SEQ ID NO: 1106524 - RNA, 16 nt, Mycobacterium bovis subsp bovis AF2122/97
ccggcaccaaccaccg

SEQ ID NO: 1106525 - RNA, 16 nt, Mycobacterium bovis subsp bovis AF2122/97
ccggcaccaacgccac

SEQ ID NO: 1106526 - RNA, 19 nt, Mycobacterium bovis subsp bovis AF2122/97
ccggcaccaacgccaccgu

SEQ ID NO: 1106527 - RNA, 14 nt, Mycobacterium bovis subsp bovis AF2122/97
ccggcaccagcggc

SEQ ID NO: 1106528 - RNA, 16 nt, Mycobacterium bovis subsp bovis AF2122/97
ccggcaccagcggcac

SEQ ID NO: 1106529 - RNA, 17 nt, Mycobacterium bovis subsp bovis AF2122/97
ccggcaagccgauugcu

SEQ ID NO: 1106530 - RNA, 15 nt, Mycobacterium bovis subsp bovis AF2122/97
ccggcaaucggcggc

SEQ ID NO: 1106531 - RNA, 17 nt, Mycobacterium bovis subsp bovis AF2122/97
ccggcaaucggcggcac

SEQ ID NO: 1106532 - RNA, 23 nt, Mycobacterium bovis subsp bovis AF2122/97
ccggcaaucggcggcacccgggu

SEQ ID NO: 1106533 - RNA, 18 nt, Mycobacterium bovis subsp bovis AF2122/97
ccggcaagcacaccgcca

SEQ ID NO: 1106534 - RNA, 23 nt, Mycobacterium bovis subsp bovis AF2122/97
ccggcaagcacaccgccagcggc

SEQ ID NO: 1106535 - RNA, 22 nt, Mycobacterium bovis subsp bovis AF2122/97
ccggcaagaccgaacagcggca

SEQ ID NO: 1106536 - RNA, 16 nt, Mycobacterium bovis subsp bovis AF2122/97
ccggcaagcacaccgc

SEQ ID NO: 1106537 - RNA, 19 nt, Mycobacterium bovis subsp bovis AF2122/97
ccggcaagccacgccgguc

SEQ ID NO: 1106538 - RNA, 13 nt, Mycobacterium bovis subsp bovis AF2122/97
ccggcaaccgccg

SEQ ID NO: 1106539 - RNA, 16 nt, Mycobacterium bovis subsp bovis AF2122/97
ccggcaaccgggaucu

SEQ ID NO: 1106540 - RNA, 15 nt, Mycobacterium bovis subsp bovis AF2122/97
ccggcaaccuggacu

SEQ ID NO: 1106541 - RNA, 15 nt, Mycobacterium bovis subsp bovis AF2122/97
ccggcaaccgacucg

SEQ ID NO: 1106542 - RNA, 15 nt, Mycobacterium bovis subsp bovis AF2122/97
ccggcaacgcggcuc

SEQ ID NO: 1106543 - RNA, 13 nt, Mycobacterium bovis subsp bovis AF2122/97
ccggcaacggcgc

SEQ ID NO: 1106544 - RNA, 19 nt, Mycobacterium bovis subsp bovis AF2122/97
ccggcaacggcgcgccgac

SEQ ID NO: 1106545 - RNA, 20 nt, Mycobacterium bovis subsp bovis AF2122/97
ccggcaacggcgcgccgacc

SEQ ID NO: 1106546 - RNA, 16 nt, Mycobacterium bovis subsp bovis AF2122/97
ccggcaacaucggguu

SEQ ID NO: 1106547 - RNA, 14 nt, Mycobacterium bovis subsp bovis AF2122/97
ccggcaaccaccgg

SEQ ID NO: 1106548 - RNA, 15 nt, Mycobacterium bovis subsp bovis AF2122/97
ccggcaaccaccggc

SEQ ID NO: 1106549 - RNA, 17 nt, Mycobacterium bovis subsp bovis AF2122/97
ccggcaaccaccggccg

SEQ ID NO: 1106550 - RNA, 18 nt, Mycobacterium bovis subsp bovis AF2122/97
ccggcaaccaccggccgc

SEQ ID NO: 1106551 - RNA, 22 nt, Mycobacterium bovis subsp bovis AF2122/97
ccggcaaccaccggccgcgcag

SEQ ID NO: 1106552 - RNA, 20 nt, Mycobacterium bovis subsp bovis AF2122/97
ccggcagcagcgggcgcgcu

SEQ ID NO: 1106553 - RNA, 20 nt, Mycobacterium bovis subsp bovis AF2122/97
ccggcagcacguggaccggc

SEQ ID NO: 1106554 - RNA, 14 nt, Mycobacterium bovis subsp bovis AF2122/97
ccggcagcggcgag

SEQ ID NO: 1106555 - RNA, 13 nt, Mycobacterium bovis subsp bovis AF2122/97
ccggcagcggcgc

SEQ ID NO: 1106556 - RNA, 18 nt, Mycobacterium bovis subsp bovis AF2122/97
ccggcagcggcgcgcugc

SEQ ID NO: 1106557 - RNA, 21 nt, Mycobacterium bovis subsp bovis AF2122/97
ccggcagcggcgcgcugcacg

SEQ ID NO: 1106558 - RNA, 18 nt, Mycobacterium bovis subsp bovis AF2122/97
ccggcagcgagacuucga

SEQ ID NO: 1106559 - RNA, 24 nt, Mycobacterium bovis subsp bovis AF2122/97
ccggcagcgagacuucgacgcggc

SEQ ID NO: 1106560 - RNA, 15 nt, Mycobacterium bovis subsp bovis AF2122/97
ccggcagcgaugcgg

SEQ ID NO: 1106561 - RNA, 19 nt, Mycobacterium bovis subsp bovis AF2122/97
ccggcagcgaugcgguguc

SEQ ID NO: 1106562 - RNA, 13 nt, Mycobacterium bovis subsp bovis AF2122/97
ccggcagcgcccu

SEQ ID NO: 1106563 - RNA, 21 nt, Mycobacterium bovis subsp bovis AF2122/97
ccggcagcugcucggucaggc

SEQ ID NO: 1106564 - RNA, 18 nt, Mycobacterium bovis subsp bovis AF2122/97
ccggcagcuuugacgccc

SEQ ID NO: 1106565 - RNA, 21 nt, Mycobacterium bovis subsp bovis AF2122/97
ccggcaggaaacucagguccg

SEQ ID NO: 1106566 - RNA, 17 nt, Mycobacterium bovis subsp bovis AF2122/97
ccggcaguucgcggcca

SEQ ID NO: 1106567 - RNA, 23 nt, Mycobacterium bovis subsp bovis AF2122/97
ccggcagguccaucuggcgcgcc

SEQ ID NO: 1106568 - RNA, 19 nt, Mycobacterium bovis subsp bovis AF2122/97
ccggcaggcuaaucagcca

SEQ ID NO: 1106569 - RNA, 21 nt, Mycobacterium bovis subsp bovis AF2122/97
ccggcaggcuaaucagccagg

SEQ ID NO: 1106570 - RNA, 13 nt, Mycobacterium bovis subsp bovis AF2122/97
ccggcaggccggc

SEQ ID NO: 1106571 - RNA, 14 nt, Mycobacterium bovis subsp bovis AF2122/97
ccggcaggccggcg

SEQ ID NO: 1106572 - RNA, 12 nt, Mycobacterium bovis subsp bovis AF2122/97
ccggcaggcccg

SEQ ID NO: 1106573 - RNA, 16 nt, Mycobacterium bovis subsp bovis AF2122/97
ccggcaggcccgacgg

SEQ ID NO: 1106574 - RNA, 20 nt, Mycobacterium bovis subsp bovis AF2122/97
ccggcagcgguaagcgcauc

SEQ ID NO: 1106575 - RNA, 13 nt, Mycobacterium bovis subsp bovis AF2122/97
ccggcagcguccg

SEQ ID NO: 1106576 - RNA, 18 nt, Mycobacterium bovis subsp bovis AF2122/97
ccggccaccucggugcgg

SEQ ID NO: 1106577 - RNA, 22 nt, Mycobacterium bovis subsp bovis AF2122/97
ccggccacccacauggcggccc

SEQ ID NO: 1106578 - RNA, 13 nt, Mycobacterium bovis subsp bovis AF2122/97
ccggccacccgcg

SEQ ID NO: 1106579 - RNA, 14 nt, Mycobacterium bovis subsp bovis AF2122/97
ccggccacccgcgc

SEQ ID NO: 1106580 - RNA, 18 nt, Mycobacterium bovis subsp bovis AF2122/97
ccggccaccgagucgauc

SEQ ID NO: 1106581 - RNA, 13 nt, Mycobacterium bovis subsp bovis AF2122/97
ccggccacgaccu

SEQ ID NO: 1106582 - RNA, 17 nt, Mycobacterium bovis subsp bovis AF2122/97
ccggccacgaccucggg

SEQ ID NO: 1106583 - RNA, 22 nt, Mycobacterium bovis subsp bovis AF2122/97
ccggccacgcauuccagcaggc

SEQ ID NO: 1106584 - RNA, 20 nt, Mycobacterium bovis subsp bovis AF2122/97
ccggccacuacggccuggcc

SEQ ID NO: 1106585 - RNA, 13 nt, Mycobacterium bovis subsp bovis AF2122/97
ccggccacggucc

SEQ ID NO: 1106586 - RNA, 21 nt, Mycobacterium bovis subsp bovis AF2122/97
ccggccacgguccggcccacc

SEQ ID NO: 1106587 - RNA, 15 nt, Mycobacterium bovis subsp bovis AF2122/97
ccggccagccauggc

SEQ ID NO: 1106588 - RNA, 23 nt, Mycobacterium bovis subsp bovis AF2122/97
ccggccagccauggcagcgccgc

SEQ ID NO: 1106589 - RNA, 15 nt, Mycobacterium bovis subsp bovis AF2122/97
ccggccagccgacgc

SEQ ID NO: 1106590 - RNA, 13 nt, Mycobacterium bovis subsp bovis AF2122/97
ccggccagauggu

SEQ ID NO: 1106591 - RNA, 14 nt, Mycobacterium bovis subsp bovis AF2122/97
ccggccagcacccg

SEQ ID NO: 1106592 - RNA, 18 nt, Mycobacterium bovis subsp bovis AF2122/97
ccggccagcacuccgcgg

SEQ ID NO: 1106593 - RNA, 15 nt, Mycobacterium bovis subsp bovis AF2122/97
ccggccaccaccgcg

SEQ ID NO: 1106594 - RNA, 22 nt, Mycobacterium bovis subsp bovis AF2122/97
ccggccaccaccgcgccgucgu

SEQ ID NO: 1106595 - RNA, 23 nt, Mycobacterium bovis subsp bovis AF2122/97
ccggccaccaccgcgccgucguc

SEQ ID NO: 1106596 - RNA, 14 nt, Mycobacterium bovis subsp bovis AF2122/97
ccggccaccacgug

SEQ ID NO: 1106597 - RNA, 14 nt, Mycobacterium bovis subsp bovis AF2122/97
ccggccaccagccg

SEQ ID NO: 1106598 - RNA, 15 nt, Mycobacterium bovis subsp bovis AF2122/97
ccggccaccagccgg

SEQ ID NO: 1106599 - RNA, 20 nt, Mycobacterium bovis subsp bovis AF2122/97
ccggccacaggaagcgaccg

SEQ ID NO: 1106600 - RNA, 22 nt, Mycobacterium bovis subsp bovis AF2122/97
ccggccacaggaagcgaccguc

SEQ ID NO: 1106601 - RNA, 20 nt, Mycobacterium bovis subsp bovis AF2122/97
ccggccaccagggccaccgc

SEQ ID NO: 1106602 - RNA, 21 nt, Mycobacterium bovis subsp bovis AF2122/97
ccggccaccagggccaccgcg

SEQ ID NO: 1106603 - RNA, 22 nt, Mycobacterium bovis subsp bovis AF2122/97
ccggccaccagggccaccgcgc

SEQ ID NO: 1106604 - RNA, 16 nt, Mycobacterium bovis subsp bovis AF2122/97
ccggcauggcggcaua

SEQ ID NO: 1106605 - RNA, 22 nt, Mycobacterium bovis subsp bovis AF2122/97
ccggcaugccgccaugcgcacc

SEQ ID NO: 1106606 - RNA, 20 nt, Mycobacterium bovis subsp bovis AF2122/97
ccggcaugcgugccggcagc

SEQ ID NO: 1106607 - RNA, 18 nt, Mycobacterium bovis subsp bovis AF2122/97
ccggcaucuccaccgucg

SEQ ID NO: 1106608 - RNA, 19 nt, Mycobacterium bovis subsp bovis AF2122/97
ccggcaucuccaccgucgc

SEQ ID NO: 1106609 - RNA, 20 nt, Mycobacterium bovis subsp bovis AF2122/97
ccggcaucuccaccgucgcc

SEQ ID NO: 1106610 - RNA, 12 nt, Mycobacterium bovis subsp bovis AF2122/97
ccggcaugccag

SEQ ID NO: 1106611 - RNA, 17 nt, Mycobacterium bovis subsp bovis AF2122/97
ccggcaugccagccacg

SEQ ID NO: 1106612 - RNA, 16 nt, Mycobacterium bovis subsp bovis AF2122/97
ccggcaugcccgcggu

SEQ ID NO: 1106613 - RNA, 19 nt, Mycobacterium bovis subsp bovis AF2122/97
ccggcaugcccgcggugac

SEQ ID NO: 1106614 - RNA, 21 nt, Mycobacterium bovis subsp bovis AF2122/97
ccggcaugcccgcggugacca

SEQ ID NO: 1106615 - RNA, 19 nt, Mycobacterium bovis subsp bovis AF2122/97
ccggcaucggucagcgcgg

SEQ ID NO: 1106616 - RNA, 22 nt, Mycobacterium bovis subsp bovis AF2122/97
ccggcaucggugaucaaaccgg

SEQ ID NO: 1106617 - RNA, 14 nt, Mycobacterium bovis subsp bovis AF2122/97
ccggcaucgcgcgc

SEQ ID NO: 1106618 - RNA, 22 nt, Mycobacterium bovis subsp bovis AF2122/97
ccggcaucgcgcaaccgggcgg

SEQ ID NO: 1106619 - RNA, 15 nt, Mycobacterium bovis subsp bovis AF2122/97
ccgcgcccaacgcgg

SEQ ID NO: 1106620 - RNA, 18 nt, Mycobacterium bovis subsp bovis AF2122/97
ccgcgccccgcggcagac

SEQ ID NO: 1106621 - RNA, 15 nt, Mycobacterium bovis subsp bovis AF2122/97
ccgcgccccaugggg

SEQ ID NO: 1106622 - RNA, 16 nt, Mycobacterium bovis subsp bovis AF2122/97
ccgcgcccgccgcggc

SEQ ID NO: 1106623 - RNA, 13 nt, Mycobacterium bovis subsp bovis AF2122/97
ccgcgcccggccg

SEQ ID NO: 1106624 - RNA, 14 nt, Mycobacterium bovis subsp bovis AF2122/97
ccgcgcccggcgca

SEQ ID NO: 1106625 - RNA, 22 nt, Mycobacterium bovis subsp bovis AF2122/97
ccgcgcccggcgcaagcgccgc

SEQ ID NO: 1106626 - RNA, 22 nt, Mycobacterium bovis subsp bovis AF2122/97
ccgcgcccggcgcuagcgccgc

SEQ ID NO: 1106627 - RNA, 18 nt, Mycobacterium bovis subsp bovis AF2122/97
ccgcgcccuucagcacgg

SEQ ID NO: 1106628 - RNA, 14 nt, Mycobacterium bovis subsp bovis AF2122/97
ccgcgccgaacacg

SEQ ID NO: 1106629 - RNA, 17 nt, Mycobacterium bovis subsp bovis AF2122/97
ccgcgccgaacacgcac

SEQ ID NO: 1106630 - RNA, 22 nt, Mycobacterium bovis subsp bovis AF2122/97
ccgcgcuacgucaagccgugcu

SEQ ID NO: 1106631 - RNA, 23 nt, Mycobacterium bovis subsp bovis AF2122/97
ccgcgcuacgucaagccgugcug

SEQ ID NO: 1106632 - RNA, 15 nt, Mycobacterium bovis subsp bovis AF2122/97
ccgcgcguucggcgc

SEQ ID NO: 1106633 - RNA, 21 nt, Mycobacterium bovis subsp bovis AF2122/97
ccgcgcguugcuggucgccgu

SEQ ID NO: 1106634 - RNA, 20 nt, Mycobacterium bovis subsp bovis AF2122/97
ccgcgcuaaugucgauuucg

SEQ ID NO: 1106635 - RNA, 13 nt, Mycobacterium bovis subsp bovis AF2122/97
ccgcgcugcgacg

SEQ ID NO: 1106636 - RNA, 13 nt, Mycobacterium bovis subsp bovis AF2122/97
ccgcgcugcagca

SEQ ID NO: 1106637 - RNA, 17 nt, Mycobacterium bovis subsp bovis AF2122/97
ccgcgcugcagcacggc

SEQ ID NO: 1106638 - RNA, 18 nt, Mycobacterium bovis subsp bovis AF2122/97
ccgcgcugcagcacggcu

SEQ ID NO: 1106639 - RNA, 13 nt, Mycobacterium bovis subsp bovis AF2122/97
ccgcgcguucggc

SEQ ID NO: 1106640 - RNA, 15 nt, Mycobacterium bovis subsp bovis AF2122/97
ccgcgcguccgggca

SEQ ID NO: 1106641 - RNA, 20 nt, Mycobacterium bovis subsp bovis AF2122/97
ccgcgcguccgggcagccgc

SEQ ID NO: 1106642 - RNA, 18 nt, Mycobacterium bovis subsp bovis AF2122/97
ccgcgcgggucacgaccu

SEQ ID NO: 1106643 - RNA, 14 nt, Mycobacterium bovis subsp bovis AF2122/97
ccgcgcggugcccu

SEQ ID NO: 1106644 - RNA, 18 nt, Mycobacterium bovis subsp bovis AF2122/97
ccgcgcggugcccugccg

SEQ ID NO: 1106645 - RNA, 21 nt, Mycobacterium bovis subsp bovis AF2122/97
ccgcgcggugcccugccggca

SEQ ID NO: 1106646 - RNA, 17 nt, Mycobacterium bovis subsp bovis AF2122/97
ccgcgcgguggcggucg

SEQ ID NO: 1106647 - RNA, 21 nt, Mycobacterium bovis subsp bovis AF2122/97
ccgcgcgguggcggucgccac

SEQ ID NO: 1106648 - RNA, 17 nt, Mycobacterium bovis subsp bovis AF2122/97
ccgcggccaccaccgcc

SEQ ID NO: 1106649 - RNA, 18 nt, Mycobacterium bovis subsp bovis AF2122/97
ccgcggccaccaccgccg

SEQ ID NO: 1106650 - RNA, 19 nt, Mycobacterium bovis subsp bovis AF2122/97
ccgcggccaccaccgccgc

SEQ ID NO: 1106651 - RNA, 15 nt, Mycobacterium bovis subsp bovis AF2122/97
ccgcggccaccaccg

SEQ ID NO: 1106652 - RNA, 14 nt, Mycobacterium bovis subsp bovis AF2122/97
ccgcggcagggcgg

SEQ ID NO: 1106653 - RNA, 21 nt, Mycobacterium bovis subsp bovis AF2122/97
ccgcggcauuggcgucgucgc

SEQ ID NO: 1106654 - RNA, 11 nt, Mycobacterium bovis subsp bovis AF2122/97
ccgcggccacc

SEQ ID NO: 1106655 - RNA, 13 nt, Mycobacterium bovis subsp bovis AF2122/97
ccgcggcagcacg

SEQ ID NO: 1106656 - RNA, 22 nt, Mycobacterium bovis subsp bovis AF2122/97
ccgcggcagcguugacggucag

SEQ ID NO: 1106657 - RNA, 13 nt, Mycobacterium bovis subsp bovis AF2122/97
ccgcggcaccgcc

SEQ ID NO: 1106658 - RNA, 14 nt, Mycobacterium bovis subsp bovis AF2122/97
ccgcggcaccgccc

SEQ ID NO: 1106659 - RNA, 16 nt, Mycobacterium bovis subsp bovis AF2122/97
ccgcggcaccgccccg

SEQ ID NO: 1106660 - RNA, 17 nt, Mycobacterium bovis subsp bovis AF2122/97
ccgcggcaccgccccgc

SEQ ID NO: 1106661 - RNA, 22 nt, Mycobacterium bovis subsp bovis AF2122/97
ccgcggcagcggauacauuucg

SEQ ID NO: 1106662 - RNA, 12 nt, Mycobacterium bovis subsp bovis AF2122/97
ccgcggccagca

SEQ ID NO: 1106663 - RNA, 16 nt, Mycobacterium bovis subsp bovis AF2122/97
ccgcggccagcaccgg

SEQ ID NO: 1106664 - RNA, 13 nt, Mycobacterium bovis subsp bovis AF2122/97
ccgcggccgcggu

SEQ ID NO: 1106665 - RNA, 18 nt, Mycobacterium bovis subsp bovis AF2122/97
ccgcggccgcggugacgg

SEQ ID NO: 1106666 - RNA, 14 nt, Mycobacterium bovis subsp bovis AF2122/97
ccgcggccaccgcc

SEQ ID NO: 1106667 - RNA, 12 nt, Mycobacterium bovis subsp bovis AF2122/97
ccgcggccggcc

SEQ ID NO: 1106668 - RNA, 13 nt, Mycobacterium bovis subsp bovis AF2122/97
ccgcggccggccg

SEQ ID NO: 1106669 - RNA, 23 nt, Mycobacterium bovis subsp bovis AF2122/97
ccgcgcuggucaacuccacgcgg

SEQ ID NO: 1106670 - RNA, 21 nt, Mycobacterium bovis subsp bovis AF2122/97
ccgcgcuggucagccgugccg

SEQ ID NO: 1106671 - RNA, 18 nt, Mycobacterium bovis subsp bovis AF2122/97
ccgcgcuggugauucgca

SEQ ID NO: 1106672 - RNA, 23 nt, Mycobacterium bovis subsp bovis AF2122/97
ccgcgcugguugaacauguccag

SEQ ID NO: 1106673 - RNA, 19 nt, Mycobacterium bovis subsp bovis AF2122/97
ccgcgcuugcgaucggcac

SEQ ID NO: 1106674 - RNA, 15 nt, Mycobacterium bovis subsp bovis AF2122/97
ccgcggacaccagga

SEQ ID NO: 1106675 - RNA, 17 nt, Mycobacterium bovis subsp bovis AF2122/97
ccgcggacagcccggac

SEQ ID NO: 1106676 - RNA, 18 nt, Mycobacterium bovis subsp bovis AF2122/97
ccgcggacagcccggacg

SEQ ID NO: 1106677 - RNA, 15 nt, Mycobacterium bovis subsp bovis AF2122/97
ccgcggacgugccgg

SEQ ID NO: 1106678 - RNA, 19 nt, Mycobacterium bovis subsp bovis AF2122/97
ccgcggacguggucggagc

SEQ ID NO: 1106679 - RNA, 16 nt, Mycobacterium bovis subsp bovis AF2122/97
ccgcggacucgggcag

SEQ ID NO: 1106680 - RNA, 18 nt, Mycobacterium bovis subsp bovis AF2122/97
ccgcggacccgcagcugc

SEQ ID NO: 1106681 - RNA, 19 nt, Mycobacterium bovis subsp bovis AF2122/97
ccgcggacccgcagcugcg

SEQ ID NO: 1106682 - RNA, 13 nt, Mycobacterium bovis subsp bovis AF2122/97
ccgcggaccgcga

SEQ ID NO: 1106683 - RNA, 15 nt, Mycobacterium bovis subsp bovis AF2122/97
ccgcggaacccagca

SEQ ID NO: 1106684 - RNA, 16 nt, Mycobacterium bovis subsp bovis AF2122/97
ccgcggaacccagcac

SEQ ID NO: 1106685 - RNA, 16 nt, Mycobacterium bovis subsp bovis AF2122/97
ccgcggaauaugggug

SEQ ID NO: 1106686 - RNA, 20 nt, Mycobacterium bovis subsp bovis AF2122/97
ccgcggaauaugggugugcu

SEQ ID NO: 1106687 - RNA, 21 nt, Mycobacterium bovis subsp bovis AF2122/97
ccgcgcuugauccacccgacg

SEQ ID NO: 1106688 - RNA, 22 nt, Mycobacterium bovis subsp bovis AF2122/97
ccgcgcuucacagccaccagcc

SEQ ID NO: 1106689 - RNA, 20 nt, Mycobacterium bovis subsp bovis AF2122/97
ccgcggcgaaccagcgcguc

SEQ ID NO: 1106690 - RNA, 18 nt, Mycobacterium bovis subsp bovis AF2122/97
ccgcgcuugguccugcgg

SEQ ID NO: 1106691 - RNA, 19 nt, Mycobacterium bovis subsp bovis AF2122/97
ccgcggccggguggcccgg

SEQ ID NO: 1106692 - RNA, 13 nt, Mycobacterium bovis subsp bovis AF2122/97
ccgcggccggcgu

SEQ ID NO: 1106693 - RNA, 15 nt, Mycobacterium bovis subsp bovis AF2122/97
ccgcggccgggccgc

SEQ ID NO: 1106694 - RNA, 16 nt, Mycobacterium bovis subsp bovis AF2122/97
ccgcggccgggccgcu

SEQ ID NO: 1106695 - RNA, 21 nt, Mycobacterium bovis subsp bovis AF2122/97
ccgcggcgagcuccgaugccg

SEQ ID NO: 1106696 - RNA, 14 nt, Mycobacterium bovis subsp bovis AF2122/97
ccgcggcgcagcac

SEQ ID NO: 1106697 - RNA, 19 nt, Mycobacterium bovis subsp bovis AF2122/97
ccgcggcgcccggcggauc

SEQ ID NO: 1106698 - RNA, 12 nt, Mycobacterium bovis subsp bovis AF2122/97
ccgcggcgcgga

SEQ ID NO: 1106699 - RNA, 12 nt, Mycobacterium bovis subsp bovis AF2122/97
ccgcggcggaug

SEQ ID NO: 1106700 - RNA, 14 nt, Mycobacterium bovis subsp bovis AF2122/97
ccgcgggcaagccg

SEQ ID NO: 1106701 - RNA, 11 nt, Mycobacterium bovis subsp bovis AF2122/97
ccgcgggccgc

SEQ ID NO: 1106702 - RNA, 12 nt, Mycobacterium bovis subsp bovis AF2122/97
ccgcgggccgcg

SEQ ID NO: 1106703 - RNA, 14 nt, Mycobacterium bovis subsp bovis AF2122/97
ccgcgggccgcguc

SEQ ID NO: 1106704 - RNA, 13 nt, Mycobacterium bovis subsp bovis AF2122/97
ccgcgggcaguag

SEQ ID NO: 1106705 - RNA, 21 nt, Mycobacterium bovis subsp bovis AF2122/97
ccgcgggcaguggcagcccgu

SEQ ID NO: 1106706 - RNA, 19 nt, Mycobacterium bovis subsp bovis AF2122/97
ccgcgggcggcaucgccga

SEQ ID NO: 1106707 - RNA, 21 nt, Mycobacterium bovis subsp bovis AF2122/97
ccgcgggcgccuuccaggcgg

SEQ ID NO: 1106708 - RNA, 19 nt, Mycobacterium bovis subsp bovis AF2122/97
ccgcgggucgugccagcag

SEQ ID NO: 1106709 - RNA, 19 nt, Mycobacterium bovis subsp bovis AF2122/97
ccgcgggucguccggcggc

SEQ ID NO: 1106710 - RNA, 16 nt, Mycobacterium bovis subsp bovis AF2122/97
ccgcggggaaucaccc

SEQ ID NO: 1106711 - RNA, 16 nt, Mycobacterium bovis subsp bovis AF2122/97
ccgcgggggaccgccc

SEQ ID NO: 1106712 - RNA, 19 nt, Mycobacterium bovis subsp bovis AF2122/97
ccgcggggcagcgggccgc

SEQ ID NO: 1106713 - RNA, 19 nt, Mycobacterium bovis subsp bovis AF2122/97
ccgcggggcaucggugcgg

SEQ ID NO: 1106714 - RNA, 13 nt, Mycobacterium bovis subsp bovis AF2122/97
ccgcguccgcgcg

SEQ ID NO: 1106715 - RNA, 18 nt, Mycobacterium bovis subsp bovis AF2122/97
ccgcguaauucgacuucg

SEQ ID NO: 1106716 - RNA, 22 nt, Mycobacterium bovis subsp bovis AF2122/97
ccgcgucgacuacacauucauc

SEQ ID NO: 1106717 - RNA, 22 nt, Mycobacterium bovis subsp bovis AF2122/97
ccgcgucgaacugggcgcccgc

SEQ ID NO: 1106718 - RNA, 18 nt, Mycobacterium bovis subsp bovis AF2122/97
ccgcgucgaagccggggu

SEQ ID NO: 1106719 - RNA, 21 nt, Mycobacterium bovis subsp bovis AF2122/97
ccgcguccucgcccuggccgc

SEQ ID NO: 1106720 - RNA, 13 nt, Mycobacterium bovis subsp bovis AF2122/97
ccgcguaaaccgg

SEQ ID NO: 1106721 - RNA, 20 nt, Mycobacterium bovis subsp bovis AF2122/97
ccgcguaaaggccuugggcg

SEQ ID NO: 1106722 - RNA, 21 nt, Mycobacterium bovis subsp bovis AF2122/97
ccgcguaccaauucccgcgcg

SEQ ID NO: 1106723 - RNA, 16 nt, Mycobacterium bovis subsp bovis AF2122/97
ccgcguaccacggugg

SEQ ID NO: 1106724 - RNA, 20 nt, Mycobacterium bovis subsp bovis AF2122/97
ccgcgguuugcacgucacgc

SEQ ID NO: 1106725 - RNA, 21 nt, Mycobacterium bovis subsp bovis AF2122/97
ccgcgguuugcacgucacgcg

SEQ ID NO: 1106726 - RNA, 16 nt, Mycobacterium bovis subsp bovis AF2122/97
ccgcgguuuggcgacg

SEQ ID NO: 1106727 - RNA, 17 nt, Mycobacterium bovis subsp bovis AF2122/97
ccgcggugaccaccccg

SEQ ID NO: 1106728 - RNA, 22 nt, Mycobacterium bovis subsp bovis AF2122/97
ccgcggugaccaccccggccaa

SEQ ID NO: 1106729 - RNA, 14 nt, Mycobacterium bovis subsp bovis AF2122/97
ccgcggucggccac

SEQ ID NO: 1106730 - RNA, 24 nt, Mycobacterium bovis subsp bovis AF2122/97
ccgcggucgcgacuaccaucgccg

SEQ ID NO: 1106731 - RNA, 22 nt, Mycobacterium bovis subsp bovis AF2122/97
ccgcggucgccaagaucgggug

SEQ ID NO: 1106732 - RNA, 23 nt, Mycobacterium bovis subsp bovis AF2122/97
ccgcggucgaucaggccguguac

SEQ ID NO: 1106733 - RNA, 21 nt, Mycobacterium bovis subsp bovis AF2122/97
ccgcggucugcgccuucgcca

SEQ ID NO: 1106734 - RNA, 22 nt, Mycobacterium bovis subsp bovis AF2122/97
ccgcggucugcgccuucgccag

SEQ ID NO: 1106735 - RNA, 20 nt, Mycobacterium bovis subsp bovis AF2122/97
ccgcggucuucuucaccgcc

SEQ ID NO: 1106736 - RNA, 23 nt, Mycobacterium bovis subsp bovis AF2122/97
ccgcgguguuggacgcgggccga

SEQ ID NO: 1106737 - RNA, 23 nt, Mycobacterium bovis subsp bovis AF2122/97
ccgcgguugugcugggugccgca

SEQ ID NO: 1106738 - RNA, 18 nt, Mycobacterium bovis subsp bovis AF2122/97
ccgcgguaauggcgugca

SEQ ID NO: 1106739 - RNA, 15 nt, Mycobacterium bovis subsp bovis AF2122/97
ccgcgguacgccggu

SEQ ID NO: 1106740 - RNA, 17 nt, Mycobacterium bovis subsp bovis AF2122/97
ccgcgguacgccggucg

SEQ ID NO: 1106741 - RNA, 16 nt, Mycobacterium bovis subsp bovis AF2122/97
ccgcgggugcggcaug

SEQ ID NO: 1106742 - RNA, 18 nt, Mycobacterium bovis subsp bovis AF2122/97
ccgcgggugaucugggcg

SEQ ID NO: 1106743 - RNA, 17 nt, Mycobacterium bovis subsp bovis AF2122/97
ccgcggucauggcgacg

SEQ ID NO: 1106744 - RNA, 15 nt, Mycobacterium bovis subsp bovis AF2122/97
ccgcgguagacggca

SEQ ID NO: 1106745 - RNA, 15 nt, Mycobacterium bovis subsp bovis AF2122/97
ccgcgguagccgacc

SEQ ID NO: 1106746 - RNA, 15 nt, Mycobacterium bovis subsp bovis AF2122/97
ccgcugcauccgcag

SEQ ID NO: 1106747 - RNA, 21 nt, Mycobacterium bovis subsp bovis AF2122/97
ccgcugcagguccaggguggu

SEQ ID NO: 1106748 - RNA, 14 nt, Mycobacterium bovis subsp bovis AF2122/97
ccgcugagcgggca

SEQ ID NO: 1106749 - RNA, 15 nt, Mycobacterium bovis subsp bovis AF2122/97
ccgcugcacgccguc

SEQ ID NO: 1106750 - RNA, 23 nt, Mycobacterium bovis subsp bovis AF2122/97
ccgcugccaucggcaccagcgcg

SEQ ID NO: 1106751 - RNA, 17 nt, Mycobacterium bovis subsp bovis AF2122/97
ccgcugccaugcgggug

SEQ ID NO: 1106752 - RNA, 14 nt, Mycobacterium bovis subsp bovis AF2122/97
ccgcugccauugcc

SEQ ID NO: 1106753 - RNA, 15 nt, Mycobacterium bovis subsp bovis AF2122/97
ccgcugccgaagcgg

SEQ ID NO: 1106754 - RNA, 15 nt, Mycobacterium bovis subsp bovis AF2122/97
ccgcugccggcacgc

SEQ ID NO: 1106755 - RNA, 20 nt, Mycobacterium bovis subsp bovis AF2122/97
ccgcugccauugccugggcg

SEQ ID NO: 1106756 - RNA, 21 nt, Mycobacterium bovis subsp bovis AF2122/97
ccgcugccggcacgcaugccg

SEQ ID NO: 1106757 - RNA, 17 nt, Mycobacterium bovis subsp bovis AF2122/97
ccgcugccgccugcagg

SEQ ID NO: 1106758 - RNA, 13 nt, Mycobacterium bovis subsp bovis AF2122/97
ccgcugccgcgcg

SEQ ID NO: 1106759 - RNA, 14 nt, Mycobacterium bovis subsp bovis AF2122/97
ccgcugccgcgcgg

SEQ ID NO: 1106760 - RNA, 15 nt, Mycobacterium bovis subsp bovis AF2122/97
ccgcugccgcgcggc

SEQ ID NO: 1106761 - RNA, 14 nt, Mycobacterium bovis subsp bovis AF2122/97
ccgcugccgcccgc

SEQ ID NO: 1106762 - RNA, 21 nt, Mycobacterium bovis subsp bovis AF2122/97
ccgcugccacccaucgcacgg

SEQ ID NO: 1106763 - RNA, 22 nt, Mycobacterium bovis subsp bovis AF2122/97
ccgcugccgaagcggccaccgc

SEQ ID NO: 1106764 - RNA, 12 nt, Mycobacterium bovis subsp bovis AF2122/97
ccgcugccgacg

SEQ ID NO: 1106765 - RNA, 17 nt, Mycobacterium bovis subsp bovis AF2122/97
ccgcugccgacgcguuc

SEQ ID NO: 1106766 - RNA, 14 nt, Mycobacterium bovis subsp bovis AF2122/97
ccgcugccugccgc

SEQ ID NO: 1106767 - RNA, 14 nt, Mycobacterium bovis subsp bovis AF2122/97
ccgcugccuggccg

SEQ ID NO: 1106768 - RNA, 21 nt, Mycobacterium bovis subsp bovis AF2122/97
ccgcucgccgguaggcggcca

SEQ ID NO: 1106769 - RNA, 21 nt, Mycobacterium bovis subsp bovis AF2122/97
ccgcucggcaaccugcgacca

SEQ ID NO: 1106770 - RNA, 12 nt, Mycobacterium bovis subsp bovis AF2122/97
ccgcucggccgc

SEQ ID NO: 1106771 - RNA, 15 nt, Mycobacterium bovis subsp bovis AF2122/97
ccgcucggccgccgg

SEQ ID NO: 1106772 - RNA, 13 nt, Mycobacterium bovis subsp bovis AF2122/97
ccgcugagcccug

SEQ ID NO: 1106773 - RNA, 15 nt, Mycobacterium bovis subsp bovis AF2122/97
ccgcucggcgcgcgg

SEQ ID NO: 1106774 - RNA, 23 nt, Mycobacterium bovis subsp bovis AF2122/97
ccgcucggcgcgcggguugucgg

SEQ ID NO: 1106775 - RNA, 14 nt, Mycobacterium bovis subsp bovis AF2122/97
ccgcucggcggucg

SEQ ID NO: 1106776 - RNA, 22 nt, Mycobacterium bovis subsp bovis AF2122/97
ccgcugauagcggucggucacc

SEQ ID NO: 1106777 - RNA, 15 nt, Mycobacterium bovis subsp bovis AF2122/97
ccgcugaucaacaga

SEQ ID NO: 1106778 - RNA, 18 nt, Mycobacterium bovis subsp bovis AF2122/97
ccgcugaucugccgccgc

SEQ ID NO: 1106779 - RNA, 20 nt, Mycobacterium bovis subsp bovis AF2122/97
ccgcugaucugccgccgcgg

SEQ ID NO: 1106780 - RNA, 21 nt, Mycobacterium bovis subsp bovis AF2122/97
ccgcugaucugccgccgcggc

SEQ ID NO: 1106781 - RNA, 16 nt, Mycobacterium bovis subsp bovis AF2122/97
ccgcugaugagccgca

SEQ ID NO: 1106782 - RNA, 22 nt, Mycobacterium bovis subsp bovis AF2122/97
ccgcucauuagcccccgcgggg

SEQ ID NO: 1106783 - RNA, 17 nt, Mycobacterium bovis subsp bovis AF2122/97
ccgcuccaccacgaccg

SEQ ID NO: 1106784 - RNA, 17 nt, Mycobacterium bovis subsp bovis AF2122/97
ccgcuccaugacaaacc

SEQ ID NO: 1106785 - RNA, 14 nt, Mycobacterium bovis subsp bovis AF2122/97
ccgcucaucgauca

SEQ ID NO: 1106786 - RNA, 18 nt, Mycobacterium bovis subsp bovis AF2122/97
ccgcucggaugaguagca

SEQ ID NO: 1106787 - RNA, 18 nt, Mycobacterium bovis subsp bovis AF2122/97
ccgcucggcaaccugcga

SEQ ID NO: 1106788 - RNA, 12 nt, Mycobacterium bovis subsp bovis AF2122/97
ccgcucgccgcc

SEQ ID NO: 1106789 - RNA, 19 nt, Mycobacterium bovis subsp bovis AF2122/97
ccgcucccccgccaacccc

SEQ ID NO: 1106790 - RNA, 20 nt, Mycobacterium bovis subsp bovis AF2122/97
ccgcucgcaggccggcggcg

SEQ ID NO: 1106791 - RNA, 12 nt, Mycobacterium bovis subsp bovis AF2122/97
ccgcucgcccgc

SEQ ID NO: 1106792 - RNA, 14 nt, Mycobacterium bovis subsp bovis AF2122/97
ccgcucgcccgccg

SEQ ID NO: 1106793 - RNA, 17 nt, Mycobacterium bovis subsp bovis AF2122/97
ccgcuccgccgucgccg

SEQ ID NO: 1106794 - RNA, 14 nt, Mycobacterium bovis subsp bovis AF2122/97
ccgcuccgcgccgc

SEQ ID NO: 1106795 - RNA, 18 nt, Mycobacterium bovis subsp bovis AF2122/97
ccgcucacaagccgugca

SEQ ID NO: 1106796 - RNA, 16 nt, Mycobacterium bovis subsp bovis AF2122/97
ccgcucaacgggccgc

SEQ ID NO: 1106797 - RNA, 21 nt, Mycobacterium bovis subsp bovis AF2122/97
ccgcucaacgggccgcaucgu

SEQ ID NO: 1106798 - RNA, 22 nt, Mycobacterium bovis subsp bovis AF2122/97
ccgcucacccgcccggaacggg

SEQ ID NO: 1106799 - RNA, 18 nt, Mycobacterium bovis subsp bovis AF2122/97
ccgcucagggugcgccgc

SEQ ID NO: 1106800 - RNA, 16 nt, Mycobacterium bovis subsp bovis AF2122/97
ccgcucagcgcagcau

SEQ ID NO: 1106801 - RNA, 16 nt, Mycobacterium bovis subsp bovis AF2122/97
ccgcgucgagugccgc

SEQ ID NO: 1106802 - RNA, 17 nt, Mycobacterium bovis subsp bovis AF2122/97
ccgcgucgagugccgcc

SEQ ID NO: 1106803 - RNA, 21 nt, Mycobacterium bovis subsp bovis AF2122/97
ccgcuauccaggccgucaggc

SEQ ID NO: 1106804 - RNA, 20 nt, Mycobacterium bovis subsp bovis AF2122/97
ccgcuaucgaggaggcgguc

SEQ ID NO: 1106805 - RNA, 13 nt, Mycobacterium bovis subsp bovis AF2122/97
ccgcgucgcgggu

SEQ ID NO: 1106806 - RNA, 19 nt, Mycobacterium bovis subsp bovis AF2122/97
ccggaaauuccggcgcggc

SEQ ID NO: 1106807 - RNA, 21 nt, Mycobacterium bovis subsp bovis AF2122/97
ccggaaccagcguaucggccg

SEQ ID NO: 1106808 - RNA, 14 nt, Mycobacterium bovis subsp bovis AF2122/97
ccggaaccgguauc

SEQ ID NO: 1106809 - RNA, 19 nt, Mycobacterium bovis subsp bovis AF2122/97
ccggaacccgagccgguaa

SEQ ID NO: 1106810 - RNA, 18 nt, Mycobacterium bovis subsp bovis AF2122/97
ccggaacgagcggccgcg

SEQ ID NO: 1106811 - RNA, 20 nt, Mycobacterium bovis subsp bovis AF2122/97
ccggaacgagcggccgcgcg

SEQ ID NO: 1106812 - RNA, 23 nt, Mycobacterium bovis subsp bovis AF2122/97
ccggaacgccgucgagcauccac

SEQ ID NO: 1106813 - RNA, 17 nt, Mycobacterium bovis subsp bovis AF2122/97
ccggaaagcucuugcac

SEQ ID NO: 1106814 - RNA, 22 nt, Mycobacterium bovis subsp bovis AF2122/97
ccggaaagcucuugcacucggc

SEQ ID NO: 1106815 - RNA, 15 nt, Mycobacterium bovis subsp bovis AF2122/97
ccggaaaccacagcg

SEQ ID NO: 1106816 - RNA, 19 nt, Mycobacterium bovis subsp bovis AF2122/97
ccgcuuggcgagccacggc

SEQ ID NO: 1106817 - RNA, 14 nt, Mycobacterium bovis subsp bovis AF2122/97
ccgcuugcgcggcu

SEQ ID NO: 1106818 - RNA, 18 nt, Mycobacterium bovis subsp bovis AF2122/97
ccgcuuuuucccggcggc

SEQ ID NO: 1106819 - RNA, 19 nt, Mycobacterium bovis subsp bovis AF2122/97
ccgcuuuuucccggcggcg

SEQ ID NO: 1106820 - RNA, 21 nt, Mycobacterium bovis subsp bovis AF2122/97
ccgcuugaccccuggccgccg

SEQ ID NO: 1106821 - RNA, 14 nt, Mycobacterium bovis subsp bovis AF2122/97
ccgcuugcccgcgc

SEQ ID NO: 1106822 - RNA, 21 nt, Mycobacterium bovis subsp bovis AF2122/97
ccgcuuggaccguugccgaug

SEQ ID NO: 1106823 - RNA, 15 nt, Mycobacterium bovis subsp bovis AF2122/97
ccgcuugcggggccg

SEQ ID NO: 1106824 - RNA, 19 nt, Mycobacterium bovis subsp bovis AF2122/97
ccgcuugaccccuggccgc

SEQ ID NO: 1106825 - RNA, 22 nt, Mycobacterium bovis subsp bovis AF2122/97
ccgcuuccaaaaucaucugcac

SEQ ID NO: 1106826 - RNA, 13 nt, Mycobacterium bovis subsp bovis AF2122/97
ccgcugguggugc

SEQ ID NO: 1106827 - RNA, 18 nt, Mycobacterium bovis subsp bovis AF2122/97
ccgcuggugguucccgac

SEQ ID NO: 1106828 - RNA, 23 nt, Mycobacterium bovis subsp bovis AF2122/97
ccgcuggugguucccgacaucgu

SEQ ID NO: 1106829 - RNA, 16 nt, Mycobacterium bovis subsp bovis AF2122/97
ccgcugguggucagca

SEQ ID NO: 1106830 - RNA, 15 nt, Mycobacterium bovis subsp bovis AF2122/97
ccgcugcgccagguc

SEQ ID NO: 1106831 - RNA, 17 nt, Mycobacterium bovis subsp bovis AF2122/97
ccgcuggucgucgaguu

SEQ ID NO: 1106832 - RNA, 17 nt, Mycobacterium bovis subsp bovis AF2122/97
ccgcuggucgagcagug

SEQ ID NO: 1106833 - RNA, 16 nt, Mycobacterium bovis subsp bovis AF2122/97
ccgcuggucgaccggc

SEQ ID NO: 1106834 - RNA, 16 nt, Mycobacterium bovis subsp bovis AF2122/97
ccgcugggggcggucg

SEQ ID NO: 1106835 - RNA, 15 nt, Mycobacterium bovis subsp bovis AF2122/97
ccgcugggucgaccg

SEQ ID NO: 1106836 - RNA, 14 nt, Mycobacterium bovis subsp bovis AF2122/97
ccgcuggguggccg

SEQ ID NO: 1106837 - RNA, 23 nt, Mycobacterium bovis subsp bovis AF2122/97
ccgcugcgaaagcacgugcacgg

SEQ ID NO: 1106838 - RNA, 15 nt, Mycobacterium bovis subsp bovis AF2122/97
ccgcugucagccgac

SEQ ID NO: 1106839 - RNA, 18 nt, Mycobacterium bovis subsp bovis AF2122/97
ccgcuguguucagcgcau

SEQ ID NO: 1106840 - RNA, 16 nt, Mycobacterium bovis subsp bovis AF2122/97
ccgcuucaggcgccac

SEQ ID NO: 1106841 - RNA, 18 nt, Mycobacterium bovis subsp bovis AF2122/97
ccgcuuagcaaucggcag

SEQ ID NO: 1106842 - RNA, 15 nt, Mycobacterium bovis subsp bovis AF2122/97
ccgccuuggcuucga

SEQ ID NO: 1106843 - RNA, 21 nt, Mycobacterium bovis subsp bovis AF2122/97
ccgccuuggcuucgacgcuuc

SEQ ID NO: 1106844 - RNA, 17 nt, Mycobacterium bovis subsp bovis AF2122/97
ccgcgaccucgcggcgc

SEQ ID NO: 1106845 - RNA, 18 nt, Mycobacterium bovis subsp bovis AF2122/97
ccgcgaccucgcggcgcu

SEQ ID NO: 1106846 - RNA, 15 nt, Mycobacterium bovis subsp bovis AF2122/97
ccgcgacgacgaggu

SEQ ID NO: 1106847 - RNA, 16 nt, Mycobacterium bovis subsp bovis AF2122/97
ccgcgacgagcggccg

SEQ ID NO: 1106848 - RNA, 15 nt, Mycobacterium bovis subsp bovis AF2122/97
ccgcgacgcucgcug

SEQ ID NO: 1106849 - RNA, 18 nt, Mycobacterium bovis subsp bovis AF2122/97
ccgcgagcagacgugggc

SEQ ID NO: 1106850 - RNA, 13 nt, Mycobacterium bovis subsp bovis AF2122/97
ccgcgagcagcac

SEQ ID NO: 1106851 - RNA, 16 nt, Mycobacterium bovis subsp bovis AF2122/97
ccgcgagaucgggccg

SEQ ID NO: 1106852 - RNA, 20 nt, Mycobacterium bovis subsp bovis AF2122/97
ccgcgagaucgggccggccg

SEQ ID NO: 1106853 - RNA, 21 nt, Mycobacterium bovis subsp bovis AF2122/97
ccgcgagaucgggccggccgc

SEQ ID NO: 1106854 - RNA, 17 nt, Mycobacterium bovis subsp bovis AF2122/97
ccgcgagccggugaucc

SEQ ID NO: 1106855 - RNA, 12 nt, Mycobacterium bovis subsp bovis AF2122/97
ccgcgaccgcga

SEQ ID NO: 1106856 - RNA, 14 nt, Mycobacterium bovis subsp bovis AF2122/97
ccgcgaccgcgcac

SEQ ID NO: 1106857 - RNA, 17 nt, Mycobacterium bovis subsp bovis AF2122/97
ccgcgaccgcgcacggc

SEQ ID NO: 1106858 - RNA, 22 nt, Mycobacterium bovis subsp bovis AF2122/97
ccgcgaccgcgcacggcuggcg

SEQ ID NO: 1106859 - RNA, 19 nt, Mycobacterium bovis subsp bovis AF2122/97
ccgcgaccggcguaaccgg

SEQ ID NO: 1106860 - RNA, 17 nt, Mycobacterium bovis subsp bovis AF2122/97
ccgcgaccgccucgccg

SEQ ID NO: 1106861 - RNA, 13 nt, Mycobacterium bovis subsp bovis AF2122/97
ccgccuuggcccc

SEQ ID NO: 1106862 - RNA, 12 nt, Mycobacterium bovis subsp bovis AF2122/97
ccgccuuggcca

SEQ ID NO: 1106863 - RNA, 16 nt, Mycobacterium bovis subsp bovis AF2122/97
ccgccugugccgccgg

SEQ ID NO: 1106864 - RNA, 20 nt, Mycobacterium bovis subsp bovis AF2122/97
ccgccugugccgccggcgcc

SEQ ID NO: 1106865 - RNA, 20 nt, Mycobacterium bovis subsp bovis AF2122/97
ccgccuucgaucaucgaccu

SEQ ID NO: 1106866 - RNA, 19 nt, Mycobacterium bovis subsp bovis AF2122/97
ccgccuucucccgcacggc

SEQ ID NO: 1106867 - RNA, 22 nt, Mycobacterium bovis subsp bovis AF2122/97
ccgccuucucccgcacggccgg

SEQ ID NO: 1106868 - RNA, 16 nt, Mycobacterium bovis subsp bovis AF2122/97
ccgccuucuuggcggc

SEQ ID NO: 1106869 - RNA, 18 nt, Mycobacterium bovis subsp bovis AF2122/97
ccgccuucuuggcggccu

SEQ ID NO: 1106870 - RNA, 21 nt, Mycobacterium bovis subsp bovis AF2122/97
ccgccuucuuggcggccuuug

SEQ ID NO: 1106871 - RNA, 21 nt, Mycobacterium bovis subsp bovis AF2122/97
ccgcgcaccaacaccagcgcg

SEQ ID NO: 1106872 - RNA, 19 nt, Mycobacterium bovis subsp bovis AF2122/97
ccgcgcacccguccgccgc

SEQ ID NO: 1106873 - RNA, 15 nt, Mycobacterium bovis subsp bovis AF2122/97
ccgcgcaccgaccgc

SEQ ID NO: 1106874 - RNA, 16 nt, Mycobacterium bovis subsp bovis AF2122/97
ccgcgcaccgcagggu

SEQ ID NO: 1106875 - RNA, 19 nt, Mycobacterium bovis subsp bovis AF2122/97
ccgcgcagauacgcgugug

SEQ ID NO: 1106876 - RNA, 20 nt, Mycobacterium bovis subsp bovis AF2122/97
ccgcgccaguaacgcccaca

SEQ ID NO: 1106877 - RNA, 19 nt, Mycobacterium bovis subsp bovis AF2122/97
ccgcgccauagcagagccg

SEQ ID NO: 1106878 - RNA, 21 nt, Mycobacterium bovis subsp bovis AF2122/97
ccgcgccauagcagagccggg

SEQ ID NO: 1106879 - RNA, 13 nt, Mycobacterium bovis subsp bovis AF2122/97
ccgcgaucugcag

SEQ ID NO: 1106880 - RNA, 13 nt, Mycobacterium bovis subsp bovis AF2122/97
ccgcgaugagcgg

SEQ ID NO: 1106881 - RNA, 15 nt, Mycobacterium bovis subsp bovis AF2122/97
ccgcgaugacgaccg

SEQ ID NO: 1106882 - RNA, 20 nt, Mycobacterium bovis subsp bovis AF2122/97
ccgcgaugacggugccgacc

SEQ ID NO: 1106883 - RNA, 21 nt, Mycobacterium bovis subsp bovis AF2122/97
ccgcgaucggugcgggcgccg

SEQ ID NO: 1106884 - RNA, 18 nt, Mycobacterium bovis subsp bovis AF2122/97
ccgcgaucgcgacacggc

SEQ ID NO: 1106885 - RNA, 17 nt, Mycobacterium bovis subsp bovis AF2122/97
ccgcgaucgggccgauc

SEQ ID NO: 1106886 - RNA, 17 nt, Mycobacterium bovis subsp bovis AF2122/97
ccgcgaugagcggcgcg

SEQ ID NO: 1106887 - RNA, 20 nt, Mycobacterium bovis subsp bovis AF2122/97
ccgcgaugaucgcaucgacg

SEQ ID NO: 1106888 - RNA, 16 nt, Mycobacterium bovis subsp bovis AF2122/97
ccgcgaucgcgacacg

SEQ ID NO: 1106889 - RNA, 16 nt, Mycobacterium bovis subsp bovis AF2122/97
ccgcgaucgccgacgc

SEQ ID NO: 1106890 - RNA, 15 nt, Mycobacterium bovis subsp bovis AF2122/97
ccgcgaucccggccg

SEQ ID NO: 1106891 - RNA, 17 nt, Mycobacterium bovis subsp bovis AF2122/97
ccgcgaucccggccguc

SEQ ID NO: 1106892 - RNA, 20 nt, Mycobacterium bovis subsp bovis AF2122/97
ccgcgaucccggccgucgcc

SEQ ID NO: 1106893 - RNA, 20 nt, Mycobacterium bovis subsp bovis AF2122/97
ccgcgauccagcgcugaccg

SEQ ID NO: 1106894 - RNA, 12 nt, Mycobacterium bovis subsp bovis AF2122/97
ccgccuccgccg

SEQ ID NO: 1106895 - RNA, 19 nt, Mycobacterium bovis subsp bovis AF2122/97
ccgccuccgccgaggccgc

SEQ ID NO: 1106896 - RNA, 14 nt, Mycobacterium bovis subsp bovis AF2122/97
ccgccguugccgcc

SEQ ID NO: 1106897 - RNA, 19 nt, Mycobacterium bovis subsp bovis AF2122/97
ccgccguugccgccgacgc

SEQ ID NO: 1106898 - RNA, 18 nt, Mycobacterium bovis subsp bovis AF2122/97
ccgccguugccgccguca

SEQ ID NO: 1106899 - RNA, 18 nt, Mycobacterium bovis subsp bovis AF2122/97
ccgccguugccgaucagc

SEQ ID NO: 1106900 - RNA, 16 nt, Mycobacterium bovis subsp bovis AF2122/97
ccgccguugccgccgg

SEQ ID NO: 1106901 - RNA, 20 nt, Mycobacterium bovis subsp bovis AF2122/97
ccgccguugccgccggcgcc

SEQ ID NO: 1106902 - RNA, 21 nt, Mycobacterium bovis subsp bovis AF2122/97
ccgccguugccgccggcgccg

SEQ ID NO: 1106903 - RNA, 15 nt, Mycobacterium bovis subsp bovis AF2122/97
ccgccguugccaccg

SEQ ID NO: 1106904 - RNA, 16 nt, Mycobacterium bovis subsp bovis AF2122/97
ccgccguugccaccgg

SEQ ID NO: 1106905 - RNA, 17 nt, Mycobacterium bovis subsp bovis AF2122/97
ccgccguucccaccacc

SEQ ID NO: 1106906 - RNA, 21 nt, Mycobacterium bovis subsp bovis AF2122/97
ccgccguucccacccacgccg

SEQ ID NO: 1106907 - RNA, 13 nt, Mycobacterium bovis subsp bovis AF2122/97
ccgccguucccgc

SEQ ID NO: 1106908 - RNA, 18 nt, Mycobacterium bovis subsp bovis AF2122/97
ccgccguugccgaucaac

SEQ ID NO: 1106909 - RNA, 23 nt, Mycobacterium bovis subsp bovis AF2122/97
ccgccguugccgaucaccacggc

SEQ ID NO: 1106910 - RNA, 14 nt, Mycobacterium bovis subsp bovis AF2122/97
ccgccuccucgaua

SEQ ID NO: 1106911 - RNA, 19 nt, Mycobacterium bovis subsp bovis AF2122/97
ccgccguugccgccgucac

SEQ ID NO: 1106912 - RNA, 15 nt, Mycobacterium bovis subsp bovis AF2122/97
ccgccuccugcgggu

SEQ ID NO: 1106913 - RNA, 20 nt, Mycobacterium bovis subsp bovis AF2122/97
ccgccguugccgccgucacc

SEQ ID NO: 1106914 - RNA, 22 nt, Mycobacterium bovis subsp bovis AF2122/97
ccgccucgaccgccagcccggu

SEQ ID NO: 1106915 - RNA, 15 nt, Mycobacterium bovis subsp bovis AF2122/97
ccgccugucccgccg

SEQ ID NO: 1106916 - RNA, 19 nt, Mycobacterium bovis subsp bovis AF2122/97
ccgccugucccgccggccc

SEQ ID NO: 1106917 - RNA, 20 nt, Mycobacterium bovis subsp bovis AF2122/97
ccgccugucccgccggcccc

SEQ ID NO: 1106918 - RNA, 16 nt, Mycobacterium bovis subsp bovis AF2122/97
ccgccugggcggccag

SEQ ID NO: 1106919 - RNA, 19 nt, Mycobacterium bovis subsp bovis AF2122/97
ccgccugggcggccagcac

SEQ ID NO: 1106920 - RNA, 20 nt, Mycobacterium bovis subsp bovis AF2122/97
ccgccugggcggccagcacg

SEQ ID NO: 1106921 - RNA, 16 nt, Mycobacterium bovis subsp bovis AF2122/97
ccgccuggguugaccg

SEQ ID NO: 1106922 - RNA, 17 nt, Mycobacterium bovis subsp bovis AF2122/97
ccgccuggguugaccgc

SEQ ID NO: 1106923 - RNA, 19 nt, Mycobacterium bovis subsp bovis AF2122/97
ccgccuggguugaccgcca

SEQ ID NO: 1106924 - RNA, 19 nt, Mycobacterium bovis subsp bovis AF2122/97
ccgccugcuggccgcggcu

SEQ ID NO: 1106925 - RNA, 17 nt, Mycobacterium bovis subsp bovis AF2122/97
ccgccuggaucagcgcg

SEQ ID NO: 1106926 - RNA, 16 nt, Mycobacterium bovis subsp bovis AF2122/97
ccgccuggacgccgcc

SEQ ID NO: 1106927 - RNA, 22 nt, Mycobacterium bovis subsp bovis AF2122/97
ccgccuggaaauuucaguucgg

SEQ ID NO: 1106928 - RNA, 22 nt, Mycobacterium bovis subsp bovis AF2122/97
ccgccucgggcaccuggucggc

SEQ ID NO: 1106929 - RNA, 17 nt, Mycobacterium bovis subsp bovis AF2122/97
ccgccgucgccgccguc

SEQ ID NO: 1106930 - RNA, 23 nt, Mycobacterium bovis subsp bovis AF2122/97
ccgccgucggcgagcagacgccg

SEQ ID NO: 1106931 - RNA, 13 nt, Mycobacterium bovis subsp bovis AF2122/97
ccgccgucgccgc

SEQ ID NO: 1106932 - RNA, 15 nt, Mycobacterium bovis subsp bovis AF2122/97
ccgccgucgccgccg

SEQ ID NO: 1106933 - RNA, 19 nt, Mycobacterium bovis subsp bovis AF2122/97
ccgccgucgccgccgcuac

SEQ ID NO: 1106934 - RNA, 17 nt, Mycobacterium bovis subsp bovis AF2122/97
ccgccgugccgcggcga

SEQ ID NO: 1106935 - RNA, 21 nt, Mycobacterium bovis subsp bovis AF2122/97
ccgccgugccgcggcgacggu

SEQ ID NO: 1106936 - RNA, 21 nt, Mycobacterium bovis subsp bovis AF2122/97
ccgccgucggguugcgacgaa

SEQ ID NO: 1106937 - RNA, 19 nt, Mycobacterium bovis subsp bovis AF2122/97
ccgccgucuuggcccgguc

SEQ ID NO: 1106938 - RNA, 16 nt, Mycobacterium bovis subsp bovis AF2122/97
ccgccguuaccgccgc

SEQ ID NO: 1106939 - RNA, 21 nt, Mycobacterium bovis subsp bovis AF2122/97
ccgccguuaccgccgcugccg

SEQ ID NO: 1106940 - RNA, 20 nt, Mycobacterium bovis subsp bovis AF2122/97
ccgccguuaccgccguuacc

SEQ ID NO: 1106941 - RNA, 18 nt, Mycobacterium bovis subsp bovis AF2122/97
ccgccguuaccgacgccg

SEQ ID NO: 1106942 - RNA, 20 nt, Mycobacterium bovis subsp bovis AF2122/97
ccgccguuaccgacgccggu

SEQ ID NO: 1106943 - RNA, 22 nt, Mycobacterium bovis subsp bovis AF2122/97
ccgccguuaccgacgccggugg

SEQ ID NO: 1106944 - RNA, 17 nt, Mycobacterium bovis subsp bovis AF2122/97
ccgccguuaccgagccc

SEQ ID NO: 1106945 - RNA, 15 nt, Mycobacterium bovis subsp bovis AF2122/97
ccgccguuaccgccg

SEQ ID NO: 1106946 - RNA, 23 nt, Mycobacterium bovis subsp bovis AF2122/97
ccgccgugguugcacguucggcg

SEQ ID NO: 1106947 - RNA, 16 nt, Mycobacterium bovis subsp bovis AF2122/97
ccgccgggccaggccg

SEQ ID NO: 1106948 - RNA, 21 nt, Mycobacterium bovis subsp bovis AF2122/97
ccgccgggauaacccagcacc

SEQ ID NO: 1106949 - RNA, 20 nt, Mycobacterium bovis subsp bovis AF2122/97
ccgccgggauaacccagcac

SEQ ID NO: 1106950 - RNA, 20 nt, Mycobacterium bovis subsp bovis AF2122/97
ccgccgggcccccgccuacg

SEQ ID NO: 1106951 - RNA, 20 nt, Mycobacterium bovis subsp bovis AF2122/97
ccgccgucaccgccguugcc

SEQ ID NO: 1106952 - RNA, 19 nt, Mycobacterium bovis subsp bovis AF2122/97
ccgccgggcccccgccuac

SEQ ID NO: 1106953 - RNA, 18 nt, Mycobacterium bovis subsp bovis AF2122/97
ccgccguccccgccgacg

SEQ ID NO: 1106954 - RNA, 20 nt, Mycobacterium bovis subsp bovis AF2122/97
ccgccguccccgccgucgcc

SEQ ID NO: 1106955 - RNA, 13 nt, Mycobacterium bovis subsp bovis AF2122/97
ccgccgucgacgu

SEQ ID NO: 1106956 - RNA, 17 nt, Mycobacterium bovis subsp bovis AF2122/97
ccgccguccagcgccgc

SEQ ID NO: 1106957 - RNA, 21 nt, Mycobacterium bovis subsp bovis AF2122/97
ccgccguccccgccgucgcca

SEQ ID NO: 1106958 - RNA, 13 nt, Mycobacterium bovis subsp bovis AF2122/97
ccgccgucgccac

SEQ ID NO: 1106959 - RNA, 15 nt, Mycobacterium bovis subsp bovis AF2122/97
ccgccgucgccaccg

SEQ ID NO: 1106960 - RNA, 16 nt, Mycobacterium bovis subsp bovis AF2122/97
ccgccgucgccaccgg

SEQ ID NO: 1106961 - RNA, 21 nt, Mycobacterium bovis subsp bovis AF2122/97
ccgccgucgacguugaugacc

SEQ ID NO: 1106962 - RNA, 13 nt, Mycobacterium bovis subsp bovis AF2122/97
ccgccgucgccga

SEQ ID NO: 1106963 - RNA, 14 nt, Mycobacterium bovis subsp bovis AF2122/97
ccgccggccgcgca

SEQ ID NO: 1106964 - RNA, 12 nt, Mycobacterium bovis subsp bovis AF2122/97
ccgccggccgcc

SEQ ID NO: 1106965 - RNA, 22 nt, Mycobacterium bovis subsp bovis AF2122/97
ccgccggccccgccggcgccgc

SEQ ID NO: 1106966 - RNA, 22 nt, Mycobacterium bovis subsp bovis AF2122/97
ccgccggccccgccgucaccgc

SEQ ID NO: 1106967 - RNA, 22 nt, Mycobacterium bovis subsp bovis AF2122/97
ccgccggccccgccgucgccgc

SEQ ID NO: 1106968 - RNA, 20 nt, Mycobacterium bovis subsp bovis AF2122/97
ccgccggccccgccguuacc

SEQ ID NO: 1106969 - RNA, 19 nt, Mycobacterium bovis subsp bovis AF2122/97
ccgccggauucgcccgggc

SEQ ID NO: 1106970 - RNA, 23 nt, Mycobacterium bovis subsp bovis AF2122/97
ccgccggcaaaggacgucgaccu

SEQ ID NO: 1106971 - RNA, 18 nt, Mycobacterium bovis subsp bovis AF2122/97
ccgccggccccgccagcg

SEQ ID NO: 1106972 - RNA, 21 nt, Mycobacterium bovis subsp bovis AF2122/97
ccgccggccccgccagcgccg

SEQ ID NO: 1106973 - RNA, 22 nt, Mycobacterium bovis subsp bovis AF2122/97
ccgccggccccgccagcgccgc

SEQ ID NO: 1106974 - RNA, 15 nt, Mycobacterium bovis subsp bovis AF2122/97
ccgccggccccgccg

SEQ ID NO: 1106975 - RNA, 21 nt, Mycobacterium bovis subsp bovis AF2122/97
ccgccggccccgccgaugccg

SEQ ID NO: 1106976 - RNA, 24 nt, Mycobacterium bovis subsp bovis AF2122/97
ccgccggccggaacgcccggcuga

SEQ ID NO: 1106977 - RNA, 18 nt, Mycobacterium bovis subsp bovis AF2122/97
ccgccggccgucgaucuu

SEQ ID NO: 1106978 - RNA, 20 nt, Mycobacterium bovis subsp bovis AF2122/97
ccgccggccuugugcucgau

SEQ ID NO: 1106979 - RNA, 16 nt, Mycobacterium bovis subsp bovis AF2122/97
ccgccggcgccacccg

SEQ ID NO: 1106980 - RNA, 21 nt, Mycobacterium bovis subsp bovis AF2122/97
ccgccggcgccacccgcgccg

SEQ ID NO: 1106981 - RNA, 21 nt, Mycobacterium bovis subsp bovis AF2122/97
ccgccggcgugucgcgucgug

SEQ ID NO: 1106982 - RNA, 21 nt, Mycobacterium bovis subsp bovis AF2122/97
ccgccgcgggcuccccggcaa

SEQ ID NO: 1106983 - RNA, 14 nt, Mycobacterium bovis subsp bovis AF2122/97
ccgccgcgggucgc

SEQ ID NO: 1106984 - RNA, 16 nt, Mycobacterium bovis subsp bovis AF2122/97
ccgccgcgggucgcgc

SEQ ID NO: 1106985 - RNA, 17 nt, Mycobacterium bovis subsp bovis AF2122/97
ccgccgcugccaugcgg

SEQ ID NO: 1106986 - RNA, 23 nt, Mycobacterium bovis subsp bovis AF2122/97
ccgccgcugccgaucaguccggc

SEQ ID NO: 1106987 - RNA, 14 nt, Mycobacterium bovis subsp bovis AF2122/97
ccgccgcugccgcc

SEQ ID NO: 1106988 - RNA, 15 nt, Mycobacterium bovis subsp bovis AF2122/97
ccgccgcugccgccg

SEQ ID NO: 1106989 - RNA, 16 nt, Mycobacterium bovis subsp bovis AF2122/97
ccgccgcugccgccgg

SEQ ID NO: 1106990 - RNA, 13 nt, Mycobacterium bovis subsp bovis AF2122/97
ccgccgcgggcgc

SEQ ID NO: 1106991 - RNA, 22 nt, Mycobacterium bovis subsp bovis AF2122/97
ccgccgcugccgguagcacagc

SEQ ID NO: 1106992 - RNA, 15 nt, Mycobacterium bovis subsp bovis AF2122/97
ccgccgcugccggug

SEQ ID NO: 1106993 - RNA, 19 nt, Mycobacterium bovis subsp bovis AF2122/97
ccgccggacccgucgagca

SEQ ID NO: 1106994 - RNA, 23 nt, Mycobacterium bovis subsp bovis AF2122/97
ccgccggacccgucgagcagcau

SEQ ID NO: 1106995 - RNA, 21 nt, Mycobacterium bovis subsp bovis AF2122/97
ccgccggaucaggaucgacag

SEQ ID NO: 1106996 - RNA, 20 nt, Mycobacterium bovis subsp bovis AF2122/97
ccgccggaucgccacggugg

SEQ ID NO: 1106997 - RNA, 22 nt, Mycobacterium bovis subsp bovis AF2122/97
ccgccggaucgccacgguggug

SEQ ID NO: 1106998 - RNA, 22 nt, Mycobacterium bovis subsp bovis AF2122/97
ccgccgcugccgccggugccgc

SEQ ID NO: 1106999 - RNA, 17 nt, Mycobacterium bovis subsp bovis AF2122/97
ccgccgcugccgcgcgg

SEQ ID NO: 1107000 - RNA, 20 nt, Mycobacterium bovis subsp bovis AF2122/97
ccgccggacccaccgucacc

SEQ ID NO: 1107001 - RNA, 14 nt, Mycobacterium bovis subsp bovis AF2122/97
ccgccggacccguc

SEQ ID NO: 1107002 - RNA, 13 nt, Mycobacterium bovis subsp bovis AF2122/97
ccgccgcuggucu

SEQ ID NO: 1107003 - RNA, 22 nt, Mycobacterium bovis subsp bovis AF2122/97
ccgccgcuguugaucgacaccg

SEQ ID NO: 1107004 - RNA, 12 nt, Mycobacterium bovis subsp bovis AF2122/97
ccgccgcgccgg

SEQ ID NO: 1107005 - RNA, 14 nt, Mycobacterium bovis subsp bovis AF2122/97
ccgccgcgccggug

SEQ ID NO: 1107006 - RNA, 20 nt, Mycobacterium bovis subsp bovis AF2122/97
ccgccgcgccggcacgggcg

SEQ ID NO: 1107007 - RNA, 13 nt, Mycobacterium bovis subsp bovis AF2122/97
ccgccgcgcguuc

SEQ ID NO: 1107008 - RNA, 16 nt, Mycobacterium bovis subsp bovis AF2122/97
ccgccgcgcgacaggc

SEQ ID NO: 1107009 - RNA, 24 nt, Mycobacterium bovis subsp bovis AF2122/97
ccgccgcgcguucggcgcugaucg

SEQ ID NO: 1107010 - RNA, 15 nt, Mycobacterium bovis subsp bovis AF2122/97
ccgccgcggcagcau

SEQ ID NO: 1107011 - RNA, 13 nt, Mycobacterium bovis subsp bovis AF2122/97
ccgccgcggccac

SEQ ID NO: 1107012 - RNA, 13 nt, Mycobacterium bovis subsp bovis AF2122/97
ccgccgcggcagg

SEQ ID NO: 1107013 - RNA, 14 nt, Mycobacterium bovis subsp bovis AF2122/97
ccgccgcggccacc

SEQ ID NO: 1107014 - RNA, 16 nt, Mycobacterium bovis subsp bovis AF2122/97
ccgccgcggccaccac

SEQ ID NO: 1107015 - RNA, 17 nt, Mycobacterium bovis subsp bovis AF2122/97
ccgccgcggccaccacc

SEQ ID NO: 1107016 - RNA, 14 nt, Mycobacterium bovis subsp bovis AF2122/97
ccgccgcggccggc

SEQ ID NO: 1107017 - RNA, 17 nt, Mycobacterium bovis subsp bovis AF2122/97
ccgccgcggccgccguc

SEQ ID NO: 1107018 - RNA, 13 nt, Mycobacterium bovis subsp bovis AF2122/97
ccgccgcggcgcc

SEQ ID NO: 1107019 - RNA, 16 nt, Mycobacterium bovis subsp bovis AF2122/97
ccgccgcccccgcccg

SEQ ID NO: 1107020 - RNA, 18 nt, Mycobacterium bovis subsp bovis AF2122/97
ccgccgccccggcgcugg

SEQ ID NO: 1107021 - RNA, 15 nt, Mycobacterium bovis subsp bovis AF2122/97
ccgccgccaguccgg

SEQ ID NO: 1107022 - RNA, 18 nt, Mycobacterium bovis subsp bovis AF2122/97
ccgccgccaguccggacg

SEQ ID NO: 1107023 - RNA, 21 nt, Mycobacterium bovis subsp bovis AF2122/97
ccgccgaugcugccgccgccg

SEQ ID NO: 1107024 - RNA, 13 nt, Mycobacterium bovis subsp bovis AF2122/97
ccgccgaugccgc

SEQ ID NO: 1107025 - RNA, 21 nt, Mycobacterium bovis subsp bovis AF2122/97
ccgccgaugcgauuccgcguc

SEQ ID NO: 1107026 - RNA, 21 nt, Mycobacterium bovis subsp bovis AF2122/97
ccgccgauguggucggcuguc

SEQ ID NO: 1107027 - RNA, 19 nt, Mycobacterium bovis subsp bovis AF2122/97
ccgccgccaccggcgccgc

SEQ ID NO: 1107028 - RNA, 14 nt, Mycobacterium bovis subsp bovis AF2122/97
ccgccgccaccacc

SEQ ID NO: 1107029 - RNA, 21 nt, Mycobacterium bovis subsp bovis AF2122/97
ccgccgccaccacccaacagc

SEQ ID NO: 1107030 - RNA, 21 nt, Mycobacterium bovis subsp bovis AF2122/97
ccgccgccaccaccgcugccg

SEQ ID NO: 1107031 - RNA, 15 nt, Mycobacterium bovis subsp bovis AF2122/97
ccgccgccaccaggg

SEQ ID NO: 1107032 - RNA, 15 nt, Mycobacterium bovis subsp bovis AF2122/97
ccgcccggguugacc

SEQ ID NO: 1107033 - RNA, 22 nt, Mycobacterium bovis subsp bovis AF2122/97
ccgcccuggcaacgacacgccg

SEQ ID NO: 1107034 - RNA, 13 nt, Mycobacterium bovis subsp bovis AF2122/97
ccgcccuggccgc

SEQ ID NO: 1107035 - RNA, 15 nt, Mycobacterium bovis subsp bovis AF2122/97
ccgcccuggccgccc

SEQ ID NO: 1107036 - RNA, 16 nt, Mycobacterium bovis subsp bovis AF2122/97
ccgcccuggccgccgg

SEQ ID NO: 1107037 - RNA, 20 nt, Mycobacterium bovis subsp bovis AF2122/97
ccgcccuggccgccggcccc

SEQ ID NO: 1107038 - RNA, 12 nt, Mycobacterium bovis subsp bovis AF2122/97
ccgcccuugccg

SEQ ID NO: 1107039 - RNA, 20 nt, Mycobacterium bovis subsp bovis AF2122/97
ccgcccuugccgccggcccc

SEQ ID NO: 1107040 - RNA, 21 nt, Mycobacterium bovis subsp bovis AF2122/97
ccgccgaaacucaccagcacc

SEQ ID NO: 1107041 - RNA, 16 nt, Mycobacterium bovis subsp bovis AF2122/97
ccgcccuucaucuugc

SEQ ID NO: 1107042 - RNA, 16 nt, Mycobacterium bovis subsp bovis AF2122/97
ccgcccuugcggcgug

SEQ ID NO: 1107043 - RNA, 22 nt, Mycobacterium bovis subsp bovis AF2122/97
ccgccgaacgccucugcgauca

SEQ ID NO: 1107044 - RNA, 15 nt, Mycobacterium bovis subsp bovis AF2122/97
ccgccgaacggcaau

SEQ ID NO: 1107045 - RNA, 21 nt, Mycobacterium bovis subsp bovis AF2122/97
ccgccgaucgacacccgcucg

SEQ ID NO: 1107046 - RNA, 16 nt, Mycobacterium bovis subsp bovis AF2122/97
ccgccgaucaccgcug

SEQ ID NO: 1107047 - RNA, 15 nt, Mycobacterium bovis subsp bovis AF2122/97
ccgccgaucugcugc

SEQ ID NO: 1107048 - RNA, 15 nt, Mycobacterium bovis subsp bovis AF2122/97
ccgccgaucgggcuu

SEQ ID NO: 1107049 - RNA, 16 nt, Mycobacterium bovis subsp bovis AF2122/97
ccgccgaugccaccgc

SEQ ID NO: 1107050 - RNA, 15 nt, Mycobacterium bovis subsp bovis AF2122/97
ccgccgaugccgccg

SEQ ID NO: 1107051 - RNA, 14 nt, Mycobacterium bovis subsp bovis AF2122/97
ccgccgaagccgac

SEQ ID NO: 1107052 - RNA, 23 nt, Mycobacterium bovis subsp bovis AF2122/97
ccgccgaacgugaacucacggcg

SEQ ID NO: 1107053 - RNA, 13 nt, Mycobacterium bovis subsp bovis AF2122/97
ccgccgacaaccc

SEQ ID NO: 1107054 - RNA, 19 nt, Mycobacterium bovis subsp bovis AF2122/97
ccgccgaagcucaucgccg

SEQ ID NO: 1107055 - RNA, 16 nt, Mycobacterium bovis subsp bovis AF2122/97
ccgccgaagccgcgca

SEQ ID NO: 1107056 - RNA, 22 nt, Mycobacterium bovis subsp bovis AF2122/97
ccgccgaagcgaugccgugcug

SEQ ID NO: 1107057 - RNA, 15 nt, Mycobacterium bovis subsp bovis AF2122/97
ccgccgacaggccgg

SEQ ID NO: 1107058 - RNA, 16 nt, Mycobacterium bovis subsp bovis AF2122/97
ccgccgacaccaccgg

SEQ ID NO: 1107059 - RNA, 22 nt, Mycobacterium bovis subsp bovis AF2122/97
ccgccgacaccaccggcgccgc

SEQ ID NO: 1107060 - RNA, 13 nt, Mycobacterium bovis subsp bovis AF2122/97
ccgccgaccgaca

SEQ ID NO: 1107061 - RNA, 13 nt, Mycobacterium bovis subsp bovis AF2122/97
ccgcccgccggug

SEQ ID NO: 1107062 - RNA, 14 nt, Mycobacterium bovis subsp bovis AF2122/97
ccgcccgccgguga

SEQ ID NO: 1107063 - RNA, 16 nt, Mycobacterium bovis subsp bovis AF2122/97
ccgcccgcgccgccgg

SEQ ID NO: 1107064 - RNA, 16 nt, Mycobacterium bovis subsp bovis AF2122/97
ccgcccgcgccaccga

SEQ ID NO: 1107065 - RNA, 12 nt, Mycobacterium bovis subsp bovis AF2122/97
ccgcccgcgccg

SEQ ID NO: 1107066 - RNA, 13 nt, Mycobacterium bovis subsp bovis AF2122/97
ccgcccgcgccgc

SEQ ID NO: 1107067 - RNA, 14 nt, Mycobacterium bovis subsp bovis AF2122/97
ccgcccgcgccgcc

SEQ ID NO: 1107068 - RNA, 15 nt, Mycobacterium bovis subsp bovis AF2122/97
ccgcccgcgccgccg

SEQ ID NO: 1107069 - RNA, 19 nt, Mycobacterium bovis subsp bovis AF2122/97
ccgcccgcgccgccgcuac

SEQ ID NO: 1107070 - RNA, 15 nt, Mycobacterium bovis subsp bovis AF2122/97
ccgcccgcuccgccg

SEQ ID NO: 1107071 - RNA, 21 nt, Mycobacterium bovis subsp bovis AF2122/97
ccgcccggaacggguuggcga

SEQ ID NO: 1107072 - RNA, 13 nt, Mycobacterium bovis subsp bovis AF2122/97
ccgcccggcccgg

SEQ ID NO: 1107073 - RNA, 23 nt, Mycobacterium bovis subsp bovis AF2122/97
ccgccccguugugucaccggcgu

SEQ ID NO: 1107074 - RNA, 20 nt, Mycobacterium bovis subsp bovis AF2122/97
ccgccccguaaucgguggug

SEQ ID NO: 1107075 - RNA, 14 nt, Mycobacterium bovis subsp bovis AF2122/97
ccgccccgggccac

SEQ ID NO: 1107076 - RNA, 17 nt, Mycobacterium bovis subsp bovis AF2122/97
ccgcccgacccaucacc

SEQ ID NO: 1107077 - RNA, 17 nt, Mycobacterium bovis subsp bovis AF2122/97
ccgcccgagccgcugcg

SEQ ID NO: 1107078 - RNA, 19 nt, Mycobacterium bovis subsp bovis AF2122/97
ccgcccgcacguucacgcg

SEQ ID NO: 1107079 - RNA, 20 nt, Mycobacterium bovis subsp bovis AF2122/97
ccgcccgcacguucacgcgc

SEQ ID NO: 1107080 - RNA, 19 nt, Mycobacterium bovis subsp bovis AF2122/97
ccgcccgcagggccgccgc

SEQ ID NO: 1107081 - RNA, 21 nt, Mycobacterium bovis subsp bovis AF2122/97
ccgcccccgccggccgcgccg

SEQ ID NO: 1107082 - RNA, 15 nt, Mycobacterium bovis subsp bovis AF2122/97
ccgccccgccguuga

SEQ ID NO: 1107083 - RNA, 14 nt, Mycobacterium bovis subsp bovis AF2122/97
ccgccccgccaacc

SEQ ID NO: 1107084 - RNA, 13 nt, Mycobacterium bovis subsp bovis AF2122/97
ccgccccgcccgc

SEQ ID NO: 1107085 - RNA, 13 nt, Mycobacterium bovis subsp bovis AF2122/97
ccgccccgcucgg

SEQ ID NO: 1107086 - RNA, 18 nt, Mycobacterium bovis subsp bovis AF2122/97
ccgccccggccgcuggcg

SEQ ID NO: 1107087 - RNA, 20 nt, Mycobacterium bovis subsp bovis AF2122/97
ccgcccagcaucucggcggc

SEQ ID NO: 1107088 - RNA, 14 nt, Mycobacterium bovis subsp bovis AF2122/97
ccgcccagcaucuc

SEQ ID NO: 1107089 - RNA, 12 nt, Mycobacterium bovis subsp bovis AF2122/97
ccgcccagcccg

SEQ ID NO: 1107090 - RNA, 14 nt, Mycobacterium bovis subsp bovis AF2122/97
ccgcccagcccggc

SEQ ID NO: 1107091 - RNA, 12 nt, Mycobacterium bovis subsp bovis AF2122/97
ccgcccagccgc

SEQ ID NO: 1107092 - RNA, 17 nt, Mycobacterium bovis subsp bovis AF2122/97
ccgcccaggagcaccuc

SEQ ID NO: 1107093 - RNA, 14 nt, Mycobacterium bovis subsp bovis AF2122/97
ccgcccaugccggg

SEQ ID NO: 1107094 - RNA, 12 nt, Mycobacterium bovis subsp bovis AF2122/97
ccgcccaccggu

SEQ ID NO: 1107095 - RNA, 16 nt, Mycobacterium bovis subsp bovis AF2122/97
ccgcccaccggucgcc

SEQ ID NO: 1107096 - RNA, 17 nt, Mycobacterium bovis subsp bovis AF2122/97
ccgcccacggcaccacc

SEQ ID NO: 1107097 - RNA, 18 nt, Mycobacterium bovis subsp bovis AF2122/97
ccgcccacggcaccacca

SEQ ID NO: 1107098 - RNA, 20 nt, Mycobacterium bovis subsp bovis AF2122/97
ccgcccagagugaauccggc

SEQ ID NO: 1107099 - RNA, 13 nt, Mycobacterium bovis subsp bovis AF2122/97
ccgcccagcagca

SEQ ID NO: 1107100 - RNA, 17 nt, Mycobacterium bovis subsp bovis AF2122/97
ccgcccagcagcaccug

SEQ ID NO: 1107101 - RNA, 20 nt, Mycobacterium bovis subsp bovis AF2122/97
ccgcccagcagcaccugcac

SEQ ID NO: 1107102 - RNA, 13 nt, Mycobacterium bovis subsp bovis AF2122/97
ccgcccagaccgc

SEQ ID NO: 1107103 - RNA, 14 nt, Mycobacterium bovis subsp bovis AF2122/97
ccgcccagaccgcc

SEQ ID NO: 1107104 - RNA, 15 nt, Mycobacterium bovis subsp bovis AF2122/97
ccgcccagaccgccg

SEQ ID NO: 1107105 - RNA, 17 nt, Mycobacterium bovis subsp bovis AF2122/97
ccgcccagaccgccgac

SEQ ID NO: 1107106 - RNA, 16 nt, Mycobacterium bovis subsp bovis AF2122/97
ccgcccaagccgccgg

SEQ ID NO: 1107107 - RNA, 19 nt, Mycobacterium bovis subsp bovis AF2122/97
ccgcccaagguggcggcca

SEQ ID NO: 1107108 - RNA, 15 nt, Mycobacterium bovis subsp bovis AF2122/97
ccgccauuggcaggc

SEQ ID NO: 1107109 - RNA, 15 nt, Mycobacterium bovis subsp bovis AF2122/97
ccgccauuggcgccg

SEQ ID NO: 1107110 - RNA, 16 nt, Mycobacterium bovis subsp bovis AF2122/97
ccgccauugucgaucu

SEQ ID NO: 1107111 - RNA, 16 nt, Mycobacterium bovis subsp bovis AF2122/97
ccgcccaccacacagc

SEQ ID NO: 1107112 - RNA, 17 nt, Mycobacterium bovis subsp bovis AF2122/97
ccgcccaccacacagcc

SEQ ID NO: 1107113 - RNA, 20 nt, Mycobacterium bovis subsp bovis AF2122/97
ccgccauugacgccguugcc

SEQ ID NO: 1107114 - RNA, 17 nt, Mycobacterium bovis subsp bovis AF2122/97
ccgccauugagcucccg

SEQ ID NO: 1107115 - RNA, 22 nt, Mycobacterium bovis subsp bovis AF2122/97
ccgccauugccgccggugccgc

SEQ ID NO: 1107116 - RNA, 15 nt, Mycobacterium bovis subsp bovis AF2122/97
ccgccauugccgccg

SEQ ID NO: 1107117 - RNA, 16 nt, Mycobacterium bovis subsp bovis AF2122/97
ccgccauugccgccgg

SEQ ID NO: 1107118 - RNA, 19 nt, Mycobacterium bovis subsp bovis AF2122/97
ccgccauugccgccggcgc

SEQ ID NO: 1107119 - RNA, 15 nt, Mycobacterium bovis subsp bovis AF2122/97
ccgccaugcggcgcg

SEQ ID NO: 1107120 - RNA, 13 nt, Mycobacterium bovis subsp bovis AF2122/97
ccgccaugcggcg

SEQ ID NO: 1107121 - RNA, 19 nt, Mycobacterium bovis subsp bovis AF2122/97
ccgccauuccagccggugc

SEQ ID NO: 1107122 - RNA, 18 nt, Mycobacterium bovis subsp bovis AF2122/97
ccgccaucgccgccaacc

SEQ ID NO: 1107123 - RNA, 13 nt, Mycobacterium bovis subsp bovis AF2122/97
ccgccaucgccga

SEQ ID NO: 1107124 - RNA, 17 nt, Mycobacterium bovis subsp bovis AF2122/97
ccgccaguccggacggc

SEQ ID NO: 1107125 - RNA, 15 nt, Mycobacterium bovis subsp bovis AF2122/97
ccgccaucgccgccg

SEQ ID NO: 1107126 - RNA, 17 nt, Mycobacterium bovis subsp bovis AF2122/97
ccgccagggcggcaucc

SEQ ID NO: 1107127 - RNA, 22 nt, Mycobacterium bovis subsp bovis AF2122/97
ccgccacgucgccggcuaccgc

SEQ ID NO: 1107128 - RNA, 16 nt, Mycobacterium bovis subsp bovis AF2122/97
ccgccaggugcucguc

SEQ ID NO: 1107129 - RNA, 22 nt, Mycobacterium bovis subsp bovis AF2122/97
ccgccaggucgaggcaggccuc

SEQ ID NO: 1107130 - RNA, 18 nt, Mycobacterium bovis subsp bovis AF2122/97
ccgccagcaugacaccgg

SEQ ID NO: 1107131 - RNA, 13 nt, Mycobacterium bovis subsp bovis AF2122/97
ccgccagcagggc

SEQ ID NO: 1107132 - RNA, 13 nt, Mycobacterium bovis subsp bovis AF2122/97
ccgccagccacca

SEQ ID NO: 1107133 - RNA, 15 nt, Mycobacterium bovis subsp bovis AF2122/97
ccgccagccaccaca

SEQ ID NO: 1107134 - RNA, 13 nt, Mycobacterium bovis subsp bovis AF2122/97
ccgccagcagcuu

SEQ ID NO: 1107135 - RNA, 16 nt, Mycobacterium bovis subsp bovis AF2122/97
ccgcagcggccagccc

SEQ ID NO: 1107136 - RNA, 22 nt, Mycobacterium bovis subsp bovis AF2122/97
ccgcagcggccagcccagccgg

SEQ ID NO: 1107137 - RNA, 23 nt, Mycobacterium bovis subsp bovis AF2122/97
ccgcagcggccagcccagccggg

SEQ ID NO: 1107138 - RNA, 21 nt, Mycobacterium bovis subsp bovis AF2122/97
ccgcagcgcgaaggucagcga

SEQ ID NO: 1107139 - RNA, 19 nt, Mycobacterium bovis subsp bovis AF2122/97
ccgcagcuauuucgcgacg

SEQ ID NO: 1107140 - RNA, 21 nt, Mycobacterium bovis subsp bovis AF2122/97
ccgcagcuauuucgcgacgcg

SEQ ID NO: 1107141 - RNA, 20 nt, Mycobacterium bovis subsp bovis AF2122/97
ccgcagcggccugaccggcu

SEQ ID NO: 1107142 - RNA, 19 nt, Mycobacterium bovis subsp bovis AF2122/97
ccgcagcgccuaccagcac

SEQ ID NO: 1107143 - RNA, 13 nt, Mycobacterium bovis subsp bovis AF2122/97
ccgcagccgcgcg

SEQ ID NO: 1107144 - RNA, 14 nt, Mycobacterium bovis subsp bovis AF2122/97
ccgcagccgcgcgg

SEQ ID NO: 1107145 - RNA, 15 nt, Mycobacterium bovis subsp bovis AF2122/97
ccgcaugccggcgca

SEQ ID NO: 1107146 - RNA, 14 nt, Mycobacterium bovis subsp bovis AF2122/97
ccgcaugcgcuccg

SEQ ID NO: 1107147 - RNA, 18 nt, Mycobacterium bovis subsp bovis AF2122/97
ccgcaugcgcuccggcgc

SEQ ID NO: 1107148 - RNA, 23 nt, Mycobacterium bovis subsp bovis AF2122/97
ccgcaugcgcuccggcgcgacgc

SEQ ID NO: 1107149 - RNA, 12 nt, Mycobacterium bovis subsp bovis AF2122/97
ccgcaugccacg

SEQ ID NO: 1107150 - RNA, 17 nt, Mycobacterium bovis subsp bovis AF2122/97
ccgcaugacgccggcgg

SEQ ID NO: 1107151 - RNA, 18 nt, Mycobacterium bovis subsp bovis AF2122/97
ccgcaugacgccggcggg

SEQ ID NO: 1107152 - RNA, 22 nt, Mycobacterium bovis subsp bovis AF2122/97
ccgcaucguuuucgccgauccc

SEQ ID NO: 1107153 - RNA, 18 nt, Mycobacterium bovis subsp bovis AF2122/97
ccgcaucgucgagccaca

SEQ ID NO: 1107154 - RNA, 17 nt, Mycobacterium bovis subsp bovis AF2122/97
ccgcaucgucgccgcgc

SEQ ID NO: 1107155 - RNA, 14 nt, Mycobacterium bovis subsp bovis AF2122/97
ccgcaucguuuucg

SEQ ID NO: 1107156 - RNA, 18 nt, Mycobacterium bovis subsp bovis AF2122/97
ccgcaucguuuucgccga

SEQ ID NO: 1107157 - RNA, 19 nt, Mycobacterium bovis subsp bovis AF2122/97
ccgcaucgguggggcgccg

SEQ ID NO: 1107158 - RNA, 14 nt, Mycobacterium bovis subsp bovis AF2122/97
ccgcaucggcacgc

SEQ ID NO: 1107159 - RNA, 15 nt, Mycobacterium bovis subsp bovis AF2122/97
ccgcaucggccccca

SEQ ID NO: 1107160 - RNA, 16 nt, Mycobacterium bovis subsp bovis AF2122/97
ccgcaucggcccccaa

SEQ ID NO: 1107161 - RNA, 15 nt, Mycobacterium bovis subsp bovis AF2122/97
ccgccaaccgcaggc

SEQ ID NO: 1107162 - RNA, 13 nt, Mycobacterium bovis subsp bovis AF2122/97
ccgccaaccgcgu

SEQ ID NO: 1107163 - RNA, 12 nt, Mycobacterium bovis subsp bovis AF2122/97
ccgccaacuccu

SEQ ID NO: 1107164 - RNA, 19 nt, Mycobacterium bovis subsp bovis AF2122/97
ccgccaacuccucagccgc

SEQ ID NO: 1107165 - RNA, 11 nt, Mycobacterium bovis subsp bovis AF2122/97
ccgccaacucg

SEQ ID NO: 1107166 - RNA, 15 nt, Mycobacterium bovis subsp bovis AF2122/97
ccgcaugcucagcau

SEQ ID NO: 1107167 - RNA, 15 nt, Mycobacterium bovis subsp bovis AF2122/97
ccgcauggacgcgau

SEQ ID NO: 1107168 - RNA, 22 nt, Mycobacterium bovis subsp bovis AF2122/97
ccgcauggacgcgaugaccgca

SEQ ID NO: 1107169 - RNA, 20 nt, Mycobacterium bovis subsp bovis AF2122/97
ccgccaaacgcugcgcccgg

SEQ ID NO: 1107170 - RNA, 20 nt, Mycobacterium bovis subsp bovis AF2122/97
ccgccaccagggcacguucg

SEQ ID NO: 1107171 - RNA, 18 nt, Mycobacterium bovis subsp bovis AF2122/97
ccgccaccagggcggccu

SEQ ID NO: 1107172 - RNA, 14 nt, Mycobacterium bovis subsp bovis AF2122/97
ccgccacgaugucg

SEQ ID NO: 1107173 - RNA, 18 nt, Mycobacterium bovis subsp bovis AF2122/97
ccgccacgcucaacccgu

SEQ ID NO: 1107174 - RNA, 20 nt, Mycobacterium bovis subsp bovis AF2122/97
ccgccacgggcggccaccgc

SEQ ID NO: 1107175 - RNA, 13 nt, Mycobacterium bovis subsp bovis AF2122/97
ccgccacggcggc

SEQ ID NO: 1107176 - RNA, 15 nt, Mycobacterium bovis subsp bovis AF2122/97
ccgccacggcgggcg

SEQ ID NO: 1107177 - RNA, 18 nt, Mycobacterium bovis subsp bovis AF2122/97
ccgccacguacuuggacg

SEQ ID NO: 1107178 - RNA, 19 nt, Mycobacterium bovis subsp bovis AF2122/97
ccgccacgguucgggcagc

SEQ ID NO: 1107179 - RNA, 15 nt, Mycobacterium bovis subsp bovis AF2122/97
ccgccacgucgccgg

SEQ ID NO: 1107180 - RNA, 15 nt, Mycobacterium bovis subsp bovis AF2122/97
ccgccaccaccaggg

SEQ ID NO: 1107181 - RNA, 16 nt, Mycobacterium bovis subsp bovis AF2122/97
ccgccaccaccggcgc

SEQ ID NO: 1107182 - RNA, 14 nt, Mycobacterium bovis subsp bovis AF2122/97
ccgccaccacgccg

SEQ ID NO: 1107183 - RNA, 22 nt, Mycobacterium bovis subsp bovis AF2122/97
ccgccaccacgccgucgacaac

SEQ ID NO: 1107184 - RNA, 13 nt, Mycobacterium bovis subsp bovis AF2122/97
ccgccaccagcgc

SEQ ID NO: 1107185 - RNA, 15 nt, Mycobacterium bovis subsp bovis AF2122/97
ccgccaccagcgcga

SEQ ID NO: 1107186 - RNA, 21 nt, Mycobacterium bovis subsp bovis AF2122/97
ccgccaauccaccggugccgc

SEQ ID NO: 1107187 - RNA, 16 nt, Mycobacterium bovis subsp bovis AF2122/97
ccgccaauggcgcgaa

SEQ ID NO: 1107188 - RNA, 16 nt, Mycobacterium bovis subsp bovis AF2122/97
ccgccacaaacccgau

SEQ ID NO: 1107189 - RNA, 16 nt, Mycobacterium bovis subsp bovis AF2122/97
ccgccacaacggcggc

SEQ ID NO: 1107190 - RNA, 14 nt, Mycobacterium bovis subsp bovis AF2122/97
ccgccacaccgccg

SEQ ID NO: 1107191 - RNA, 15 nt, Mycobacterium bovis subsp bovis AF2122/97
ccgccacaccgccgc

SEQ ID NO: 1107192 - RNA, 15 nt, Mycobacterium bovis subsp bovis AF2122/97
ccgacgacggcgacg

SEQ ID NO: 1107193 - RNA, 20 nt, Mycobacterium bovis subsp bovis AF2122/97
ccgacgacggguuggcgucg

SEQ ID NO: 1107194 - RNA, 22 nt, Mycobacterium bovis subsp bovis AF2122/97
ccgacgacggguuggcgucgcu

SEQ ID NO: 1107195 - RNA, 20 nt, Mycobacterium bovis subsp bovis AF2122/97
ccgacgacguauucguuggg

SEQ ID NO: 1107196 - RNA, 13 nt, Mycobacterium bovis subsp bovis AF2122/97
ccgacgacgcgcg

SEQ ID NO: 1107197 - RNA, 14 nt, Mycobacterium bovis subsp bovis AF2122/97
ccgacgacgcgcgc

SEQ ID NO: 1107198 - RNA, 15 nt, Mycobacterium bovis subsp bovis AF2122/97
ccgacgacgacguuc

SEQ ID NO: 1107199 - RNA, 11 nt, Mycobacterium bovis subsp bovis AF2122/97
ccgacgaccau

SEQ ID NO: 1107200 - RNA, 23 nt, Mycobacterium bovis subsp bovis AF2122/97
ccgacgagauugccgggccgccg

SEQ ID NO: 1107201 - RNA, 21 nt, Mycobacterium bovis subsp bovis AF2122/97
ccgacgaggacgucaccguca

SEQ ID NO: 1107202 - RNA, 23 nt, Mycobacterium bovis subsp bovis AF2122/97
ccgacgagauacggccaccaggu

SEQ ID NO: 1107203 - RNA, 20 nt, Mycobacterium bovis subsp bovis AF2122/97
ccgacgagauacggccacca

SEQ ID NO: 1107204 - RNA, 18 nt, Mycobacterium bovis subsp bovis AF2122/97
ccgacgaggggcgcgggu

SEQ ID NO: 1107205 - RNA, 22 nt, Mycobacterium bovis subsp bovis AF2122/97
ccgacgagucgccgcgggcagc

SEQ ID NO: 1107206 - RNA, 15 nt, Mycobacterium bovis subsp bovis AF2122/97
ccgacgaucaacgga

SEQ ID NO: 1107207 - RNA, 20 nt, Mycobacterium bovis subsp bovis AF2122/97
ccgaugcacuccaugaaucg

SEQ ID NO: 1107208 - RNA, 14 nt, Mycobacterium bovis subsp bovis AF2122/97
ccgaugcugacgau

SEQ ID NO: 1107209 - RNA, 15 nt, Mycobacterium bovis subsp bovis AF2122/97
ccgaugcugccgccg

SEQ ID NO: 1107210 - RNA, 23 nt, Mycobacterium bovis subsp bovis AF2122/97
ccgaugcugccgccgccgccggc

SEQ ID NO: 1107211 - RNA, 16 nt, Mycobacterium bovis subsp bovis AF2122/97
ccgaugcgccaccggc

SEQ ID NO: 1107212 - RNA, 14 nt, Mycobacterium bovis subsp bovis AF2122/97
ccgaugccgacggc

SEQ ID NO: 1107213 - RNA, 17 nt, Mycobacterium bovis subsp bovis AF2122/97
ccgaugccgaugcccag

SEQ ID NO: 1107214 - RNA, 13 nt, Mycobacterium bovis subsp bovis AF2122/97
ccgaugccggcga

SEQ ID NO: 1107215 - RNA, 21 nt, Mycobacterium bovis subsp bovis AF2122/97
ccgaugcgcagugcaccgcgu

SEQ ID NO: 1107216 - RNA, 22 nt, Mycobacterium bovis subsp bovis AF2122/97
ccgaugcgcagugcaccgcguc

SEQ ID NO: 1107217 - RNA, 21 nt, Mycobacterium bovis subsp bovis AF2122/97
ccgaugccgugcccggugcgg

SEQ ID NO: 1107218 - RNA, 18 nt, Mycobacterium bovis subsp bovis AF2122/97
ccgaugcccgacaccgcc

SEQ ID NO: 1107219 - RNA, 19 nt, Mycobacterium bovis subsp bovis AF2122/97
ccgaugcgauaacccgcau

SEQ ID NO: 1107220 - RNA, 16 nt, Mycobacterium bovis subsp bovis AF2122/97
ccgauggcgucgccgg

SEQ ID NO: 1107221 - RNA, 17 nt, Mycobacterium bovis subsp bovis AF2122/97
ccgauggcgucgccggc

SEQ ID NO: 1107222 - RNA, 20 nt, Mycobacterium bovis subsp bovis AF2122/97
ccgauggcucacaugcccgc

SEQ ID NO: 1107223 - RNA, 21 nt, Mycobacterium bovis subsp bovis AF2122/97
ccgauggcucacaugcccgca

SEQ ID NO: 1107224 - RNA, 22 nt, Mycobacterium bovis subsp bovis AF2122/97
ccgauggugaugggggagccgg

SEQ ID NO: 1107225 - RNA, 14 nt, Mycobacterium bovis subsp bovis AF2122/97
ccgauggugccgac

SEQ ID NO: 1107226 - RNA, 15 nt, Mycobacterium bovis subsp bovis AF2122/97
ccgauggugccgacc

SEQ ID NO: 1107227 - RNA, 20 nt, Mycobacterium bovis subsp bovis AF2122/97
ccgauggugccgacccgccg

SEQ ID NO: 1107228 - RNA, 22 nt, Mycobacterium bovis subsp bovis AF2122/97
ccgauggugccgacccgccgcg

SEQ ID NO: 1107229 - RNA, 14 nt, Mycobacterium bovis subsp bovis AF2122/97
ccgaugguggccgc

SEQ ID NO: 1107230 - RNA, 18 nt, Mycobacterium bovis subsp bovis AF2122/97
ccgaugguacccgcgccg

SEQ ID NO: 1107231 - RNA, 22 nt, Mycobacterium bovis subsp bovis AF2122/97
ccgaugguacccgcgccgcgca

SEQ ID NO: 1107232 - RNA, 15 nt, Mycobacterium bovis subsp bovis AF2122/97
ccgauggcgcaccgg

SEQ ID NO: 1107233 - RNA, 16 nt, Mycobacterium bovis subsp bovis AF2122/97
ccgauggcgcaccggc

SEQ ID NO: 1107234 - RNA, 17 nt, Mycobacterium bovis subsp bovis AF2122/97
ccgaugcgcgcggcgcg

SEQ ID NO: 1107235 - RNA, 19 nt, Mycobacterium bovis subsp bovis AF2122/97
ccgcaaaguagacgugcca

SEQ ID NO: 1107236 - RNA, 21 nt, Mycobacterium bovis subsp bovis AF2122/97
ccgcaaaacgagcuuccacgc

SEQ ID NO: 1107237 - RNA, 15 nt, Mycobacterium bovis subsp bovis AF2122/97
ccgauggugugcacg

SEQ ID NO: 1107238 - RNA, 19 nt, Mycobacterium bovis subsp bovis AF2122/97
ccgauguagcgcugcgggu

SEQ ID NO: 1107239 - RNA, 21 nt, Mycobacterium bovis subsp bovis AF2122/97
ccgauguccgacgccaccgcc

SEQ ID NO: 1107240 - RNA, 19 nt, Mycobacterium bovis subsp bovis AF2122/97
ccgaugucgaugccgcgca

SEQ ID NO: 1107241 - RNA, 14 nt, Mycobacterium bovis subsp bovis AF2122/97
ccgauucucgaucu

SEQ ID NO: 1107242 - RNA, 15 nt, Mycobacterium bovis subsp bovis AF2122/97
ccgauugucggcaac

SEQ ID NO: 1107243 - RNA, 15 nt, Mycobacterium bovis subsp bovis AF2122/97
ccgauugaguucggc

SEQ ID NO: 1107244 - RNA, 17 nt, Mycobacterium bovis subsp bovis AF2122/97
ccgauugaguucggcgg

SEQ ID NO: 1107245 - RNA, 20 nt, Mycobacterium bovis subsp bovis AF2122/97
ccgauugaguucggcggcca

SEQ ID NO: 1107246 - RNA, 19 nt, Mycobacterium bovis subsp bovis AF2122/97
ccgauucugauaucgucgg

SEQ ID NO: 1107247 - RNA, 14 nt, Mycobacterium bovis subsp bovis AF2122/97
ccgcaagccgcgag

SEQ ID NO: 1107248 - RNA, 17 nt, Mycobacterium bovis subsp bovis AF2122/97
ccgcaagccucguggug

SEQ ID NO: 1107249 - RNA, 18 nt, Mycobacterium bovis subsp bovis AF2122/97
ccgcaagaaucagcagca

SEQ ID NO: 1107250 - RNA, 14 nt, Mycobacterium bovis subsp bovis AF2122/97
ccgcaacucgccga

SEQ ID NO: 1107251 - RNA, 13 nt, Mycobacterium bovis subsp bovis AF2122/97
ccgcaaggcgccg

SEQ ID NO: 1107252 - RNA, 23 nt, Mycobacterium bovis subsp bovis AF2122/97
ccgcaacggauaacccguggcgg

SEQ ID NO: 1107253 - RNA, 22 nt, Mycobacterium bovis subsp bovis AF2122/97
ccgcaaggcguguagccugcgg

SEQ ID NO: 1107254 - RNA, 21 nt, Mycobacterium bovis subsp bovis AF2122/97
ccgcaaggaccugugcggccg

SEQ ID NO: 1107255 - RNA, 21 nt, Mycobacterium bovis subsp bovis AF2122/97
ccgcaccccauacucggcggc

SEQ ID NO: 1107256 - RNA, 17 nt, Mycobacterium bovis subsp bovis AF2122/97
ccgcaccccgcccgacg

SEQ ID NO: 1107257 - RNA, 21 nt, Mycobacterium bovis subsp bovis AF2122/97
ccgcaccccgcccgacgugaa

SEQ ID NO: 1107258 - RNA, 18 nt, Mycobacterium bovis subsp bovis AF2122/97
ccgcaccccggccgcgcg

SEQ ID NO: 1107259 - RNA, 19 nt, Mycobacterium bovis subsp bovis AF2122/97
ccgcaccccggccgcgcgc

SEQ ID NO: 1107260 - RNA, 22 nt, Mycobacterium bovis subsp bovis AF2122/97
ccgcacccgcucccgugcuggc

SEQ ID NO: 1107261 - RNA, 14 nt, Mycobacterium bovis subsp bovis AF2122/97
ccgcacccggccgc

SEQ ID NO: 1107262 - RNA, 22 nt, Mycobacterium bovis subsp bovis AF2122/97
ccgcaccgaccugagucggcau

SEQ ID NO: 1107263 - RNA, 15 nt, Mycobacterium bovis subsp bovis AF2122/97
ccgcacccgggacgu

SEQ ID NO: 1107264 - RNA, 14 nt, Mycobacterium bovis subsp bovis AF2122/97
ccgcacccggucga

SEQ ID NO: 1107265 - RNA, 14 nt, Mycobacterium bovis subsp bovis AF2122/97
ccgcacccguccgg

SEQ ID NO: 1107266 - RNA, 14 nt, Mycobacterium bovis subsp bovis AF2122/97
ccgcacccguugcg

SEQ ID NO: 1107267 - RNA, 16 nt, Mycobacterium bovis subsp bovis AF2122/97
ccgcaccgcugacccc

SEQ ID NO: 1107268 - RNA, 22 nt, Mycobacterium bovis subsp bovis AF2122/97
ccgcaccgcugaccccggcagc

SEQ ID NO: 1107269 - RNA, 22 nt, Mycobacterium bovis subsp bovis AF2122/97
ccgcaccgcuguugcaucgccg

SEQ ID NO: 1107270 - RNA, 17 nt, Mycobacterium bovis subsp bovis AF2122/97
ccgcaccgccugcucgg

SEQ ID NO: 1107271 - RNA, 13 nt, Mycobacterium bovis subsp bovis AF2122/97
ccgcaccgccggc

SEQ ID NO: 1107272 - RNA, 15 nt, Mycobacterium bovis subsp bovis AF2122/97
ccgcaccggaucggc

SEQ ID NO: 1107273 - RNA, 18 nt, Mycobacterium bovis subsp bovis AF2122/97
ccgcaccggggugugcgg

SEQ ID NO: 1107274 - RNA, 19 nt, Mycobacterium bovis subsp bovis AF2122/97
ccgcaccggugacgcacag

SEQ ID NO: 1107275 - RNA, 20 nt, Mycobacterium bovis subsp bovis AF2122/97
ccgcaccggugacgcacagc

SEQ ID NO: 1107276 - RNA, 15 nt, Mycobacterium bovis subsp bovis AF2122/97
ccgcaccugcgauga

SEQ ID NO: 1107277 - RNA, 13 nt, Mycobacterium bovis subsp bovis AF2122/97
ccgcaccgugccg

SEQ ID NO: 1107278 - RNA, 19 nt, Mycobacterium bovis subsp bovis AF2122/97
ccgcaccgugccgacgccc

SEQ ID NO: 1107279 - RNA, 21 nt, Mycobacterium bovis subsp bovis AF2122/97
ccgcaccguagccgcugcacg

SEQ ID NO: 1107280 - RNA, 15 nt, Mycobacterium bovis subsp bovis AF2122/97
ccgcaccgucccagu

SEQ ID NO: 1107281 - RNA, 16 nt, Mycobacterium bovis subsp bovis AF2122/97
ccgcaccgucccagug

SEQ ID NO: 1107282 - RNA, 14 nt, Mycobacterium bovis subsp bovis AF2122/97
ccgcacguucacgc

SEQ ID NO: 1107283 - RNA, 17 nt, Mycobacterium bovis subsp bovis AF2122/97
ccgcacguucacgcgcg

SEQ ID NO: 1107284 - RNA, 14 nt, Mycobacterium bovis subsp bovis AF2122/97
ccgcacguucggcg

SEQ ID NO: 1107285 - RNA, 15 nt, Mycobacterium bovis subsp bovis AF2122/97
ccgcacguucggcga

SEQ ID NO: 1107286 - RNA, 21 nt, Mycobacterium bovis subsp bovis AF2122/97
ccgcacgauggccgucgauca

SEQ ID NO: 1107287 - RNA, 12 nt, Mycobacterium bovis subsp bovis AF2122/97
ccgcacgaugcc

SEQ ID NO: 1107288 - RNA, 16 nt, Mycobacterium bovis subsp bovis AF2122/97
ccgcacgaucgcccgu

SEQ ID NO: 1107289 - RNA, 14 nt, Mycobacterium bovis subsp bovis AF2122/97
ccgcacguuggcgg

SEQ ID NO: 1107290 - RNA, 17 nt, Mycobacterium bovis subsp bovis AF2122/97
ccgcacguuggcggcca

SEQ ID NO: 1107291 - RNA, 13 nt, Mycobacterium bovis subsp bovis AF2122/97
ccgcacuccacga

SEQ ID NO: 1107292 - RNA, 19 nt, Mycobacterium bovis subsp bovis AF2122/97
ccgcacugggugcgucgac

SEQ ID NO: 1107293 - RNA, 22 nt, Mycobacterium bovis subsp bovis AF2122/97
ccgcacuccacgaucggcccag

SEQ ID NO: 1107294 - RNA, 23 nt, Mycobacterium bovis subsp bovis AF2122/97
ccgcacucggcgguuccggcggu

SEQ ID NO: 1107295 - RNA, 15 nt, Mycobacterium bovis subsp bovis AF2122/97
ccgcacugccgccgg

SEQ ID NO: 1107296 - RNA, 22 nt, Mycobacterium bovis subsp bovis AF2122/97
ccgcacugccgccgguuccgcc

SEQ ID NO: 1107297 - RNA, 15 nt, Mycobacterium bovis subsp bovis AF2122/97
ccgcacugugcccuc

SEQ ID NO: 1107298 - RNA, 17 nt, Mycobacterium bovis subsp bovis AF2122/97
ccgcacugugcccucaa

SEQ ID NO: 1107299 - RNA, 22 nt, Mycobacterium bovis subsp bovis AF2122/97
ccgcacugggcgaugacgccau

SEQ ID NO: 1107300 - RNA, 17 nt, Mycobacterium bovis subsp bovis AF2122/97
ccgcagaauccggcaac

SEQ ID NO: 1107301 - RNA, 16 nt, Mycobacterium bovis subsp bovis AF2122/97
ccgcagaccgccaccg

SEQ ID NO: 1107302 - RNA, 13 nt, Mycobacterium bovis subsp bovis AF2122/97
ccgcagccgguua

SEQ ID NO: 1107303 - RNA, 14 nt, Mycobacterium bovis subsp bovis AF2122/97
ccgcagcaccucgg

SEQ ID NO: 1107304 - RNA, 20 nt, Mycobacterium bovis subsp bovis AF2122/97
ccgcagaucaccgccagcug

SEQ ID NO: 1107305 - RNA, 17 nt, Mycobacterium bovis subsp bovis AF2122/97
ccgcagauccccgccac

SEQ ID NO: 1107306 - RNA, 19 nt, Mycobacterium bovis subsp bovis AF2122/97
ccgcagauccccgccaccg

SEQ ID NO: 1107307 - RNA, 18 nt, Mycobacterium bovis subsp bovis AF2122/97
ccgcagaugcaccugcga

SEQ ID NO: 1107308 - RNA, 20 nt, Mycobacterium bovis subsp bovis AF2122/97
ccgcagaugcaccugcgagg

SEQ ID NO: 1107309 - RNA, 22 nt, Mycobacterium bovis subsp bovis AF2122/97
ccgcagaugcaccugcgaggug

SEQ ID NO: 1107310 - RNA, 23 nt, Mycobacterium bovis subsp bovis AF2122/97
ccgcagagaccaagguccgcacg

SEQ ID NO: 1107311 - RNA, 16 nt, Mycobacterium bovis subsp bovis AF2122/97
ccgcagagcaccgcga

SEQ ID NO: 1107312 - RNA, 17 nt, Mycobacterium bovis subsp bovis AF2122/97
ccgcagacgacaaccga

SEQ ID NO: 1107313 - RNA, 15 nt, Mycobacterium bovis subsp bovis AF2122/97
ccgcagacgccgacu

SEQ ID NO: 1107314 - RNA, 20 nt, Mycobacterium bovis subsp bovis AF2122/97
ccgcagacgugguagccggc

SEQ ID NO: 1107315 - RNA, 21 nt, Mycobacterium bovis subsp bovis AF2122/97
ccgcagacgugguagccggcg

SEQ ID NO: 1107316 - RNA, 22 nt, Mycobacterium bovis subsp bovis AF2122/97
ccguagugaacggcucgggcag

SEQ ID NO: 1107317 - RNA, 18 nt, Mycobacterium bovis subsp bovis AF2122/97
ccguaguaguggccgcca

SEQ ID NO: 1107318 - RNA, 19 nt, Mycobacterium bovis subsp bovis AF2122/97
ccguaguaguucagccagg

SEQ ID NO: 1107319 - RNA, 23 nt, Mycobacterium bovis subsp bovis AF2122/97
ccguaguaguucagccaggccgc

SEQ ID NO: 1107320 - RNA, 23 nt, Mycobacterium bovis subsp bovis AF2122/97
ccguauagcgugaccgugccguc

SEQ ID NO: 1107321 - RNA, 21 nt, Mycobacterium bovis subsp bovis AF2122/97
ccguauaggcccgggcggcca

SEQ ID NO: 1107322 - RNA, 14 nt, Mycobacterium bovis subsp bovis AF2122/97
ccguagugucggcg

SEQ ID NO: 1107323 - RNA, 13 nt, Mycobacterium bovis subsp bovis AF2122/97
ccguagccggcgg

SEQ ID NO: 1107324 - RNA, 18 nt, Mycobacterium bovis subsp bovis AF2122/97
ccguagcugcgcagcgca

SEQ ID NO: 1107325 - RNA, 20 nt, Mycobacterium bovis subsp bovis AF2122/97
ccguaggccacagcccggcg

SEQ ID NO: 1107326 - RNA, 18 nt, Mycobacterium bovis subsp bovis AF2122/97
ccguaggcggcgacccgc

SEQ ID NO: 1107327 - RNA, 19 nt, Mycobacterium bovis subsp bovis AF2122/97
ccguaggcggcgacccgcc

SEQ ID NO: 1107328 - RNA, 21 nt, Mycobacterium bovis subsp bovis AF2122/97
ccgguucccgggcagccgcac

SEQ ID NO: 1107329 - RNA, 15 nt, Mycobacterium bovis subsp bovis AF2122/97
ccgguucgcccagca

SEQ ID NO: 1107330 - RNA, 14 nt, Mycobacterium bovis subsp bovis AF2122/97
ccgguucagcgcug

SEQ ID NO: 1107331 - RNA, 22 nt, Mycobacterium bovis subsp bovis AF2122/97
ccgguucagcgcuggcaggccg

SEQ ID NO: 1107332 - RNA, 23 nt, Mycobacterium bovis subsp bovis AF2122/97
ccgguucagcgcuggcaggccgg

SEQ ID NO: 1107333 - RNA, 18 nt, Mycobacterium bovis subsp bovis AF2122/97
ccguagccggcggugggg

SEQ ID NO: 1107334 - RNA, 19 nt, Mycobacterium bovis subsp bovis AF2122/97
ccguagagcaugccgcccg

SEQ ID NO: 1107335 - RNA, 17 nt, Mycobacterium bovis subsp bovis AF2122/97
ccguagagcuggugcgg

SEQ ID NO: 1107336 - RNA, 14 nt, Mycobacterium bovis subsp bovis AF2122/97
ccguagccagcagg

SEQ ID NO: 1107337 - RNA, 22 nt, Mycobacterium bovis subsp bovis AF2122/97
ccguagccagcaggaacgccgu

SEQ ID NO: 1107338 - RNA, 14 nt, Mycobacterium bovis subsp bovis AF2122/97
ccguagcccacgac

SEQ ID NO: 1107339 - RNA, 15 nt, Mycobacterium bovis subsp bovis AF2122/97
ccguagcccacgacg

SEQ ID NO: 1107340 - RNA, 16 nt, Mycobacterium bovis subsp bovis AF2122/97
ccguagaugguggugg

SEQ ID NO: 1107341 - RNA, 23 nt, Mycobacterium bovis subsp bovis AF2122/97
ccguagauggugguggcccggcu

SEQ ID NO: 1107342 - RNA, 16 nt, Mycobacterium bovis subsp bovis AF2122/97
ccguagacgccgagca

SEQ ID NO: 1107343 - RNA, 14 nt, Mycobacterium bovis subsp bovis AF2122/97
ccgguucgccgccg

SEQ ID NO: 1107344 - RNA, 18 nt, Mycobacterium bovis subsp bovis AF2122/97
ccguccgguggaccgccg

SEQ ID NO: 1107345 - RNA, 18 nt, Mycobacterium bovis subsp bovis AF2122/97
ccguccgguggacgcaga

SEQ ID NO: 1107346 - RNA, 15 nt, Mycobacterium bovis subsp bovis AF2122/97
ccguccgggucacca

SEQ ID NO: 1107347 - RNA, 19 nt, Mycobacterium bovis subsp bovis AF2122/97
ccguccggcuuggcggcga

SEQ ID NO: 1107348 - RNA, 20 nt, Mycobacterium bovis subsp bovis AF2122/97
ccguccgggcggccucccgg

SEQ ID NO: 1107349 - RNA, 15 nt, Mycobacterium bovis subsp bovis AF2122/97
ccguccucggucagc

SEQ ID NO: 1107350 - RNA, 20 nt, Mycobacterium bovis subsp bovis AF2122/97
ccguccucggucagcucguc

SEQ ID NO: 1107351 - RNA, 14 nt, Mycobacterium bovis subsp bovis AF2122/97
ccgucccagcgccg

SEQ ID NO: 1107352 - RNA, 21 nt, Mycobacterium bovis subsp bovis AF2122/97
ccguccgcugguggucagcac

SEQ ID NO: 1107353 - RNA, 14 nt, Mycobacterium bovis subsp bovis AF2122/97
ccgucccagcugac

SEQ ID NO: 1107354 - RNA, 18 nt, Mycobacterium bovis subsp bovis AF2122/97
ccgucccagcugaccagc

SEQ ID NO: 1107355 - RNA, 20 nt, Mycobacterium bovis subsp bovis AF2122/97
ccgucccaaugcaacaaggc

SEQ ID NO: 1107356 - RNA, 17 nt, Mycobacterium bovis subsp bovis AF2122/97
ccguccaggcgcugcag

SEQ ID NO: 1107357 - RNA, 13 nt, Mycobacterium bovis subsp bovis AF2122/97
ccgucacggucgc

SEQ ID NO: 1107358 - RNA, 17 nt, Mycobacterium bovis subsp bovis AF2122/97
ccguccaggacggaucg

SEQ ID NO: 1107359 - RNA, 14 nt, Mycobacterium bovis subsp bovis AF2122/97
ccgucagaacaccg

SEQ ID NO: 1107360 - RNA, 16 nt, Mycobacterium bovis subsp bovis AF2122/97
ccguccagcagcucgg

SEQ ID NO: 1107361 - RNA, 22 nt, Mycobacterium bovis subsp bovis AF2122/97
ccguccaccgacguggccagcc

SEQ ID NO: 1107362 - RNA, 14 nt, Mycobacterium bovis subsp bovis AF2122/97
ccguccaccgucac

SEQ ID NO: 1107363 - RNA, 13 nt, Mycobacterium bovis subsp bovis AF2122/97
ccgucaccgccgg

SEQ ID NO: 1107364 - RNA, 14 nt, Mycobacterium bovis subsp bovis AF2122/97
ccgucaccgccggc

SEQ ID NO: 1107365 - RNA, 14 nt, Mycobacterium bovis subsp bovis AF2122/97
ccgucaccgccguc

SEQ ID NO: 1107366 - RNA, 12 nt, Mycobacterium bovis subsp bovis AF2122/97
ccgucaccgccg

SEQ ID NO: 1107367 - RNA, 13 nt, Mycobacterium bovis subsp bovis AF2122/97
ccgucaccgccga

SEQ ID NO: 1107368 - RNA, 14 nt, Mycobacterium bovis subsp bovis AF2122/97
ccgucaccggucgg

SEQ ID NO: 1107369 - RNA, 18 nt, Mycobacterium bovis subsp bovis AF2122/97
ccgucaccggucggccau

SEQ ID NO: 1107370 - RNA, 23 nt, Mycobacterium bovis subsp bovis AF2122/97
ccgucacgcguacgucgguccac

SEQ ID NO: 1107371 - RNA, 15 nt, Mycobacterium bovis subsp bovis AF2122/97
ccgucacgccggaug

SEQ ID NO: 1107372 - RNA, 22 nt, Mycobacterium bovis subsp bovis AF2122/97
ccgguggucagguuggcacgcu

SEQ ID NO: 1107373 - RNA, 15 nt, Mycobacterium bovis subsp bovis AF2122/97
ccgguggucgcgccc

SEQ ID NO: 1107374 - RNA, 22 nt, Mycobacterium bovis subsp bovis AF2122/97
ccgguggucgucccgcccaucc

SEQ ID NO: 1107375 - RNA, 14 nt, Mycobacterium bovis subsp bovis AF2122/97
ccgguggguagcca

SEQ ID NO: 1107376 - RNA, 16 nt, Mycobacterium bovis subsp bovis AF2122/97
ccggugguaccggcgg

SEQ ID NO: 1107377 - RNA, 18 nt, Mycobacterium bovis subsp bovis AF2122/97
ccggugguaccggcggcg

SEQ ID NO: 1107378 - RNA, 19 nt, Mycobacterium bovis subsp bovis AF2122/97
ccggugguagcgacgaugu

SEQ ID NO: 1107379 - RNA, 21 nt, Mycobacterium bovis subsp bovis AF2122/97
ccgguggaauccaccagccgg

SEQ ID NO: 1107380 - RNA, 18 nt, Mycobacterium bovis subsp bovis AF2122/97
ccgguggcuggccgccac

SEQ ID NO: 1107381 - RNA, 23 nt, Mycobacterium bovis subsp bovis AF2122/97
ccgguggcuggccgccaccgcac

SEQ ID NO: 1107382 - RNA, 24 nt, Mycobacterium bovis subsp bovis AF2122/97
ccgguggcuggccgccaccgcacg

SEQ ID NO: 1107383 - RNA, 16 nt, Mycobacterium bovis subsp bovis AF2122/97
ccggugggcggcucgu

SEQ ID NO: 1107384 - RNA, 22 nt, Mycobacterium bovis subsp bovis AF2122/97
ccgguggggauagccgcgucgc

SEQ ID NO: 1107385 - RNA, 13 nt, Mycobacterium bovis subsp bovis AF2122/97
ccggugggccgcc

SEQ ID NO: 1107386 - RNA, 19 nt, Mycobacterium bovis subsp bovis AF2122/97
ccggugggccgcccaaaga

SEQ ID NO: 1107387 - RNA, 22 nt, Mycobacterium bovis subsp bovis AF2122/97
ccggugguagcggacagcucgc

SEQ ID NO: 1107388 - RNA, 16 nt, Mycobacterium bovis subsp bovis AF2122/97
ccgguggugccggcgc

SEQ ID NO: 1107389 - RNA, 19 nt, Mycobacterium bovis subsp bovis AF2122/97
ccgguggugccggcgccgc

SEQ ID NO: 1107390 - RNA, 21 nt, Mycobacterium bovis subsp bovis AF2122/97
ccgguggugccggcgccgcca

SEQ ID NO: 1107391 - RNA, 14 nt, Mycobacterium bovis subsp bovis AF2122/97
ccgguggugcggcc

SEQ ID NO: 1107392 - RNA, 15 nt, Mycobacterium bovis subsp bovis AF2122/97
ccggugguggcgacc

SEQ ID NO: 1107393 - RNA, 15 nt, Mycobacterium bovis subsp bovis AF2122/97
ccgguguugccguga

SEQ ID NO: 1107394 - RNA, 17 nt, Mycobacterium bovis subsp bovis AF2122/97
ccgguguugccguuacc

SEQ ID NO: 1107395 - RNA, 19 nt, Mycobacterium bovis subsp bovis AF2122/97
ccgguguucaucacgccgc

SEQ ID NO: 1107396 - RNA, 22 nt, Mycobacterium bovis subsp bovis AF2122/97
ccgguguucaucacgccgccgg

SEQ ID NO: 1107397 - RNA, 22 nt, Mycobacterium bovis subsp bovis AF2122/97
ccgguguugagaucgcccgagu

SEQ ID NO: 1107398 - RNA, 14 nt, Mycobacterium bovis subsp bovis AF2122/97
ccgguuacccggac

SEQ ID NO: 1107399 - RNA, 20 nt, Mycobacterium bovis subsp bovis AF2122/97
ccgguuaugcgguacccgau

SEQ ID NO: 1107400 - RNA, 20 nt, Mycobacterium bovis subsp bovis AF2122/97
ccggugcgguuucaccgacg

SEQ ID NO: 1107401 - RNA, 18 nt, Mycobacterium bovis subsp bovis AF2122/97
ccggugcgucacagccgg

SEQ ID NO: 1107402 - RNA, 18 nt, Mycobacterium bovis subsp bovis AF2122/97
ccggugcucaagcgcguc

SEQ ID NO: 1107403 - RNA, 20 nt, Mycobacterium bovis subsp bovis AF2122/97
ccggugcucaagcgcgucgu

SEQ ID NO: 1107404 - RNA, 19 nt, Mycobacterium bovis subsp bovis AF2122/97
ccggugcuccucggcaggc

SEQ ID NO: 1107405 - RNA, 17 nt, Mycobacterium bovis subsp bovis AF2122/97
ccggugcucgucgagca

SEQ ID NO: 1107406 - RNA, 18 nt, Mycobacterium bovis subsp bovis AF2122/97
ccggugcucgucgagcau

SEQ ID NO: 1107407 - RNA, 22 nt, Mycobacterium bovis subsp bovis AF2122/97
ccggugcucgucgagcaugcga

SEQ ID NO: 1107408 - RNA, 19 nt, Mycobacterium bovis subsp bovis AF2122/97
ccggugcugguccagccgg

SEQ ID NO: 1107409 - RNA, 23 nt, Mycobacterium bovis subsp bovis AF2122/97
ccgguggacagaaucgaccgccg

SEQ ID NO: 1107410 - RNA, 22 nt, Mycobacterium bovis subsp bovis AF2122/97
ccgguggacagaugcauccagc

SEQ ID NO: 1107411 - RNA, 22 nt, Mycobacterium bovis subsp bovis AF2122/97
ccggugccgggaugccgccgcu

SEQ ID NO: 1107412 - RNA, 17 nt, Mycobacterium bovis subsp bovis AF2122/97
ccggugcgcaccagcac

SEQ ID NO: 1107413 - RNA, 16 nt, Mycobacterium bovis subsp bovis AF2122/97
ccggugcgcagccagg

SEQ ID NO: 1107414 - RNA, 14 nt, Mycobacterium bovis subsp bovis AF2122/97
ccggugcgcgcggu

SEQ ID NO: 1107415 - RNA, 17 nt, Mycobacterium bovis subsp bovis AF2122/97
ccggugcgcgcggucga

SEQ ID NO: 1107416 - RNA, 12 nt, Mycobacterium bovis subsp bovis AF2122/97
ccggugccggcg

SEQ ID NO: 1107417 - RNA, 22 nt, Mycobacterium bovis subsp bovis AF2122/97
ccggugccggccaucgcccgga

SEQ ID NO: 1107418 - RNA, 19 nt, Mycobacterium bovis subsp bovis AF2122/97
ccggugccgccugcgccgc

SEQ ID NO: 1107419 - RNA, 20 nt, Mycobacterium bovis subsp bovis AF2122/97
ccggugccgccugcgccgcc

SEQ ID NO: 1107420 - RNA, 12 nt, Mycobacterium bovis subsp bovis AF2122/97
ccggugccgcgg

SEQ ID NO: 1107421 - RNA, 21 nt, Mycobacterium bovis subsp bovis AF2122/97
ccggugccguuggagccgcca

SEQ ID NO: 1107422 - RNA, 22 nt, Mycobacterium bovis subsp bovis AF2122/97
ccggugccguuggagccgccac

SEQ ID NO: 1107423 - RNA, 20 nt, Mycobacterium bovis subsp bovis AF2122/97
ccggugcgaauggugcaacg

SEQ ID NO: 1107424 - RNA, 22 nt, Mycobacterium bovis subsp bovis AF2122/97
ccggugcgaauggugcaacgcg

SEQ ID NO: 1107425 - RNA, 18 nt, Mycobacterium bovis subsp bovis AF2122/97
ccggugcgaccaacacgg

SEQ ID NO: 1107426 - RNA, 16 nt, Mycobacterium bovis subsp bovis AF2122/97
ccggucuuggacagca

SEQ ID NO: 1107427 - RNA, 14 nt, Mycobacterium bovis subsp bovis AF2122/97
ccggucucggccga

SEQ ID NO: 1107428 - RNA, 12 nt, Mycobacterium bovis subsp bovis AF2122/97
ccggucuucgcg

SEQ ID NO: 1107429 - RNA, 21 nt, Mycobacterium bovis subsp bovis AF2122/97
ccggucuuuaauccagcgccg

SEQ ID NO: 1107430 - RNA, 18 nt, Mycobacterium bovis subsp bovis AF2122/97
ccggugaacaccagcagg

SEQ ID NO: 1107431 - RNA, 16 nt, Mycobacterium bovis subsp bovis AF2122/97
ccggugaacggcagca

SEQ ID NO: 1107432 - RNA, 20 nt, Mycobacterium bovis subsp bovis AF2122/97
ccggugaacggcagcacggu

SEQ ID NO: 1107433 - RNA, 23 nt, Mycobacterium bovis subsp bovis AF2122/97
ccggugaacgguagcacugucga

SEQ ID NO: 1107434 - RNA, 21 nt, Mycobacterium bovis subsp bovis AF2122/97
ccggugccgccaucgccgccg

SEQ ID NO: 1107435 - RNA, 13 nt, Mycobacterium bovis subsp bovis AF2122/97
ccggugccgcagc

SEQ ID NO: 1107436 - RNA, 13 nt, Mycobacterium bovis subsp bovis AF2122/97
ccggugccgacgg

SEQ ID NO: 1107437 - RNA, 14 nt, Mycobacterium bovis subsp bovis AF2122/97
ccggugccgacggc

SEQ ID NO: 1107438 - RNA, 14 nt, Mycobacterium bovis subsp bovis AF2122/97
ccggugccgaccgg

SEQ ID NO: 1107439 - RNA, 23 nt, Mycobacterium bovis subsp bovis AF2122/97
ccggugacaaguggugcccuuga

SEQ ID NO: 1107440 - RNA, 22 nt, Mycobacterium bovis subsp bovis AF2122/97
ccggugccgcccgcgccgccgc

SEQ ID NO: 1107441 - RNA, 13 nt, Mycobacterium bovis subsp bovis AF2122/97
ccggugccgccga

SEQ ID NO: 1107442 - RNA, 13 nt, Mycobacterium bovis subsp bovis AF2122/97
ccggugccgccgc

SEQ ID NO: 1107443 - RNA, 14 nt, Mycobacterium bovis subsp bovis AF2122/97
ccggugccgccgcg

SEQ ID NO: 1107444 - RNA, 15 nt, Mycobacterium bovis subsp bovis AF2122/97
ccggugccgccgcgg

SEQ ID NO: 1107445 - RNA, 20 nt, Mycobacterium bovis subsp bovis AF2122/97
ccggugccgccgcggccacc

SEQ ID NO: 1107446 - RNA, 14 nt, Mycobacterium bovis subsp bovis AF2122/97
ccggugccgccggu

SEQ ID NO: 1107447 - RNA, 21 nt, Mycobacterium bovis subsp bovis AF2122/97
ccggugccgccggugccgcca

SEQ ID NO: 1107448 - RNA, 19 nt, Mycobacterium bovis subsp bovis AF2122/97
ccggugccgccgucgccgc

SEQ ID NO: 1107449 - RNA, 20 nt, Mycobacterium bovis subsp bovis AF2122/97
ccggugccgccguugccauu

SEQ ID NO: 1107450 - RNA, 16 nt, Mycobacterium bovis subsp bovis AF2122/97
ccggucgugccggggc

SEQ ID NO: 1107451 - RNA, 21 nt, Mycobacterium bovis subsp bovis AF2122/97
ccggucgugccggggcugccg

SEQ ID NO: 1107452 - RNA, 13 nt, Mycobacterium bovis subsp bovis AF2122/97
ccggucggugcgg

SEQ ID NO: 1107453 - RNA, 19 nt, Mycobacterium bovis subsp bovis AF2122/97
ccggucggugagccgugcc

SEQ ID NO: 1107454 - RNA, 20 nt, Mycobacterium bovis subsp bovis AF2122/97
ccggucggugagccgugccg

SEQ ID NO: 1107455 - RNA, 21 nt, Mycobacterium bovis subsp bovis AF2122/97
ccggucggugagccgugccgc

SEQ ID NO: 1107456 - RNA, 23 nt, Mycobacterium bovis subsp bovis AF2122/97
ccggucggugagccgugccgcca

SEQ ID NO: 1107457 - RNA, 14 nt, Mycobacterium bovis subsp bovis AF2122/97
ccggucggcgucga

SEQ ID NO: 1107458 - RNA, 18 nt, Mycobacterium bovis subsp bovis AF2122/97
ccggucggcgguagccga

SEQ ID NO: 1107459 - RNA, 21 nt, Mycobacterium bovis subsp bovis AF2122/97
ccggucguagcuuccggucca

SEQ ID NO: 1107460 - RNA, 20 nt, Mycobacterium bovis subsp bovis AF2122/97
ccggucugcugggcacgaug

SEQ ID NO: 1107461 - RNA, 18 nt, Mycobacterium bovis subsp bovis AF2122/97
ccggucuggcgaugacga

SEQ ID NO: 1107462 - RNA, 15 nt, Mycobacterium bovis subsp bovis AF2122/97
ccggucuacgacguc

SEQ ID NO: 1107463 - RNA, 17 nt, Mycobacterium bovis subsp bovis AF2122/97
ccgguaacuguccgccc

SEQ ID NO: 1107464 - RNA, 20 nt, Mycobacterium bovis subsp bovis AF2122/97
ccgguaacuguccgcccgga

SEQ ID NO: 1107465 - RNA, 13 nt, Mycobacterium bovis subsp bovis AF2122/97
ccgguaacgccaa

SEQ ID NO: 1107466 - RNA, 17 nt, Mycobacterium bovis subsp bovis AF2122/97
ccgguaacgccaacacc

SEQ ID NO: 1107467 - RNA, 19 nt, Mycobacterium bovis subsp bovis AF2122/97
ccgguaacgccaacaccgg

SEQ ID NO: 1107468 - RNA, 20 nt, Mycobacterium bovis subsp bovis AF2122/97
ccgguaacgccaacaccggc

SEQ ID NO: 1107469 - RNA, 13 nt, Mycobacterium bovis subsp bovis AF2122/97
ccgguaacgccau

SEQ ID NO: 1107470 - RNA, 17 nt, Mycobacterium bovis subsp bovis AF2122/97
ccggguugagccgccgc

SEQ ID NO: 1107471 - RNA, 15 nt, Mycobacterium bovis subsp bovis AF2122/97
ccggguuggccgaac

SEQ ID NO: 1107472 - RNA, 16 nt, Mycobacterium bovis subsp bovis AF2122/97
ccggguuggccggcgc

SEQ ID NO: 1107473 - RNA, 18 nt, Mycobacterium bovis subsp bovis AF2122/97
ccggguuuugcgcggcca

SEQ ID NO: 1107474 - RNA, 20 nt, Mycobacterium bovis subsp bovis AF2122/97
ccggguuuugcgcggccacc

SEQ ID NO: 1107475 - RNA, 18 nt, Mycobacterium bovis subsp bovis AF2122/97
ccggguuuggugcagccg

SEQ ID NO: 1107476 - RNA, 15 nt, Mycobacterium bovis subsp bovis AF2122/97
ccgguagcgcgggug

SEQ ID NO: 1107477 - RNA, 17 nt, Mycobacterium bovis subsp bovis AF2122/97
ccgguagcgcggguggc

SEQ ID NO: 1107478 - RNA, 14 nt, Mycobacterium bovis subsp bovis AF2122/97
ccgguagcggcggc

SEQ ID NO: 1107479 - RNA, 15 nt, Mycobacterium bovis subsp bovis AF2122/97
ccgguagcguucggc

SEQ ID NO: 1107480 - RNA, 18 nt, Mycobacterium bovis subsp bovis AF2122/97
ccgguagcguucggcgag

SEQ ID NO: 1107481 - RNA, 15 nt, Mycobacterium bovis subsp bovis AF2122/97
ccgguagcugucgcc

SEQ ID NO: 1107482 - RNA, 12 nt, Mycobacterium bovis subsp bovis AF2122/97
ccgguagccggg

SEQ ID NO: 1107483 - RNA, 18 nt, Mycobacterium bovis subsp bovis AF2122/97
ccgguagccaggcgcgcu

SEQ ID NO: 1107484 - RNA, 18 nt, Mycobacterium bovis subsp bovis AF2122/97
ccgguagccccgucgacc

SEQ ID NO: 1107485 - RNA, 23 nt, Mycobacterium bovis subsp bovis AF2122/97
ccgguagagcgggccaacucggc

SEQ ID NO: 1107486 - RNA, 23 nt, Mycobacterium bovis subsp bovis AF2122/97
ccgguagcacagcagcaacgcgg

SEQ ID NO: 1107487 - RNA, 16 nt, Mycobacterium bovis subsp bovis AF2122/97
ccgguagcagcgcucg

SEQ ID NO: 1107488 - RNA, 20 nt, Mycobacterium bovis subsp bovis AF2122/97
ccgguagaucuucggccgca

SEQ ID NO: 1107489 - RNA, 14 nt, Mycobacterium bovis subsp bovis AF2122/97
ccgguaccggcgac

SEQ ID NO: 1107490 - RNA, 18 nt, Mycobacterium bovis subsp bovis AF2122/97
ccgguaccucaacaccag

SEQ ID NO: 1107491 - RNA, 17 nt, Mycobacterium bovis subsp bovis AF2122/97
ccgguacgccgcgccga

SEQ ID NO: 1107492 - RNA, 13 nt, Mycobacterium bovis subsp bovis AF2122/97
ccgguaccgccac

SEQ ID NO: 1107493 - RNA, 15 nt, Mycobacterium bovis subsp bovis AF2122/97
ccgggcgcuggacgg

SEQ ID NO: 1107494 - RNA, 23 nt, Mycobacterium bovis subsp bovis AF2122/97
ccgggcucagacuuucgcccagu

SEQ ID NO: 1107495 - RNA, 22 nt, Mycobacterium bovis subsp bovis AF2122/97
ccgggcguugggaucgcgcagc

SEQ ID NO: 1107496 - RNA, 15 nt, Mycobacterium bovis subsp bovis AF2122/97
ccgggcucggcgaag

SEQ ID NO: 1107497 - RNA, 12 nt, Mycobacterium bovis subsp bovis AF2122/97
ccgggcucgcau

SEQ ID NO: 1107498 - RNA, 20 nt, Mycobacterium bovis subsp bovis AF2122/97
ccgggcucggcgucgccgcc

SEQ ID NO: 1107499 - RNA, 18 nt, Mycobacterium bovis subsp bovis AF2122/97
ccgggucggcacgacccg

SEQ ID NO: 1107500 - RNA, 19 nt, Mycobacterium bovis subsp bovis AF2122/97
ccgggucggcacgacccgg

SEQ ID NO: 1107501 - RNA, 13 nt, Mycobacterium bovis subsp bovis AF2122/97
ccgggucggccgg

SEQ ID NO: 1107502 - RNA, 14 nt, Mycobacterium bovis subsp bovis AF2122/97
ccgggucggcgaac

SEQ ID NO: 1107503 - RNA, 14 nt, Mycobacterium bovis subsp bovis AF2122/97
ccgggucggcacga

SEQ ID NO: 1107504 - RNA, 17 nt, Mycobacterium bovis subsp bovis AF2122/97
ccgggucggcacgaccc

SEQ ID NO: 1107505 - RNA, 15 nt, Mycobacterium bovis subsp bovis AF2122/97
ccgggucgggcaccg

SEQ ID NO: 1107506 - RNA, 17 nt, Mycobacterium bovis subsp bovis AF2122/97
ccgggucgggcaccgcg

SEQ ID NO: 1107507 - RNA, 20 nt, Mycobacterium bovis subsp bovis AF2122/97
ccgggucgggcaccgcgcgc

SEQ ID NO: 1107508 - RNA, 15 nt, Mycobacterium bovis subsp bovis AF2122/97
ccgggucggugacga

SEQ ID NO: 1107509 - RNA, 19 nt, Mycobacterium bovis subsp bovis AF2122/97
ccgggucguacaacacggg

SEQ ID NO: 1107510 - RNA, 14 nt, Mycobacterium bovis subsp bovis AF2122/97
ccggguugagccgc

SEQ ID NO: 1107511 - RNA, 18 nt, Mycobacterium bovis subsp bovis AF2122/97
ccggguuccagcggcacc

SEQ ID NO: 1107512 - RNA, 19 nt, Mycobacterium bovis subsp bovis AF2122/97
ccggguuccagcggcaccg

SEQ ID NO: 1107513 - RNA, 16 nt, Mycobacterium bovis subsp bovis AF2122/97
ccggguuaucggcagc

SEQ ID NO: 1107514 - RNA, 23 nt, Mycobacterium bovis subsp bovis AF2122/97
ccggguuaucggcagcaggacac

SEQ ID NO: 1107515 - RNA, 19 nt, Mycobacterium bovis subsp bovis AF2122/97
ccggguguuggggaucgca

SEQ ID NO: 1107516 - RNA, 20 nt, Mycobacterium bovis subsp bovis AF2122/97
ccggguguggucgguggcgg

SEQ ID NO: 1107517 - RNA, 17 nt, Mycobacterium bovis subsp bovis AF2122/97
ccgggugggagcagccg

SEQ ID NO: 1107518 - RNA, 20 nt, Mycobacterium bovis subsp bovis AF2122/97
ccgggugggagcagccgaac

SEQ ID NO: 1107519 - RNA, 16 nt, Mycobacterium bovis subsp bovis AF2122/97
ccgggucucggugcgg

SEQ ID NO: 1107520 - RNA, 24 nt, Mycobacterium bovis subsp bovis AF2122/97
ccgggugggagcagccgaaccggc

SEQ ID NO: 1107521 - RNA, 19 nt, Mycobacterium bovis subsp bovis AF2122/97
ccggguggcgucgaucucg

SEQ ID NO: 1107522 - RNA, 23 nt, Mycobacterium bovis subsp bovis AF2122/97
ccggguggcccggaacaccgacg

SEQ ID NO: 1107523 - RNA, 21 nt, Mycobacterium bovis subsp bovis AF2122/97
ccgggucuuccggugcgccga

SEQ ID NO: 1107524 - RNA, 16 nt, Mycobacterium bovis subsp bovis AF2122/97
ccgggucuccggcgca

SEQ ID NO: 1107525 - RNA, 17 nt, Mycobacterium bovis subsp bovis AF2122/97
ccgggucuccggcgcac

SEQ ID NO: 1107526 - RNA, 19 nt, Mycobacterium bovis subsp bovis AF2122/97
ccgggucuccggcgcaccu

SEQ ID NO: 1107527 - RNA, 19 nt, Mycobacterium bovis subsp bovis AF2122/97
ccggucgccaaauccgacg

SEQ ID NO: 1107528 - RNA, 22 nt, Mycobacterium bovis subsp bovis AF2122/97
ccggucgcacuuggcccccgac

SEQ ID NO: 1107529 - RNA, 23 nt, Mycobacterium bovis subsp bovis AF2122/97
ccggucgcacuuggcccccgacg

SEQ ID NO: 1107530 - RNA, 18 nt, Mycobacterium bovis subsp bovis AF2122/97
ccggucgcacuuggcccc

SEQ ID NO: 1107531 - RNA, 19 nt, Mycobacterium bovis subsp bovis AF2122/97
ccggucgaugaccucguca

SEQ ID NO: 1107532 - RNA, 12 nt, Mycobacterium bovis subsp bovis AF2122/97
ccggucgacggg

SEQ ID NO: 1107533 - RNA, 19 nt, Mycobacterium bovis subsp bovis AF2122/97
ccggucgacgggucggcgc

SEQ ID NO: 1107534 - RNA, 21 nt, Mycobacterium bovis subsp bovis AF2122/97
ccggucgacgggucggcgccg

SEQ ID NO: 1107535 - RNA, 16 nt, Mycobacterium bovis subsp bovis AF2122/97
ccggucgaugucagcc

SEQ ID NO: 1107536 - RNA, 20 nt, Mycobacterium bovis subsp bovis AF2122/97
ccggucgaugucagccacca

SEQ ID NO: 1107537 - RNA, 20 nt, Mycobacterium bovis subsp bovis AF2122/97
ccggucgccggucaucgccg

SEQ ID NO: 1107538 - RNA, 15 nt, Mycobacterium bovis subsp bovis AF2122/97
ccggucgccgcgaag

SEQ ID NO: 1107539 - RNA, 13 nt, Mycobacterium bovis subsp bovis AF2122/97
ccggucgccggga

SEQ ID NO: 1107540 - RNA, 15 nt, Mycobacterium bovis subsp bovis AF2122/97
ccggucgccgggacg

SEQ ID NO: 1107541 - RNA, 23 nt, Mycobacterium bovis subsp bovis AF2122/97
ccggucgcgcauuucguggcgcg

SEQ ID NO: 1107542 - RNA, 17 nt, Mycobacterium bovis subsp bovis AF2122/97
ccggucgccucaccggc

SEQ ID NO: 1107543 - RNA, 21 nt, Mycobacterium bovis subsp bovis AF2122/97
ccggucggagcggugccgacg

SEQ ID NO: 1107544 - RNA, 13 nt, Mycobacterium bovis subsp bovis AF2122/97
ccggucgcggaac

SEQ ID NO: 1107545 - RNA, 20 nt, Mycobacterium bovis subsp bovis AF2122/97
ccggucgcuccggguagcgg

SEQ ID NO: 1107546 - RNA, 21 nt, Mycobacterium bovis subsp bovis AF2122/97
ccggucgcuccggguagcgga

SEQ ID NO: 1107547 - RNA, 13 nt, Mycobacterium bovis subsp bovis AF2122/97
ccggucggaucgg

SEQ ID NO: 1107548 - RNA, 12 nt, Mycobacterium bovis subsp bovis AF2122/97
ccggucggcacc

SEQ ID NO: 1107549 - RNA, 13 nt, Mycobacterium bovis subsp bovis AF2122/97
ccggucggcagcu

SEQ ID NO: 1107550 - RNA, 14 nt, Mycobacterium bovis subsp bovis AF2122/97
ccggucggccaggc

SEQ ID NO: 1107551 - RNA, 15 nt, Mycobacterium bovis subsp bovis AF2122/97
ccggucggcccacac

SEQ ID NO: 1107552 - RNA, 13 nt, Mycobacterium bovis subsp bovis AF2122/97
ccggucggcgaaa

SEQ ID NO: 1107553 - RNA, 20 nt, Mycobacterium bovis subsp bovis AF2122/97
ccggucccuuuguggggccg

SEQ ID NO: 1107554 - RNA, 14 nt, Mycobacterium bovis subsp bovis AF2122/97
ccggucccgccgac

SEQ ID NO: 1107555 - RNA, 15 nt, Mycobacterium bovis subsp bovis AF2122/97
ccggucccgccgacc

SEQ ID NO: 1107556 - RNA, 17 nt, Mycobacterium bovis subsp bovis AF2122/97
ccggucccgccgugccg

SEQ ID NO: 1107557 - RNA, 18 nt, Mycobacterium bovis subsp bovis AF2122/97
ccggucccgccgugccgc

SEQ ID NO: 1107558 - RNA, 20 nt, Mycobacterium bovis subsp bovis AF2122/97
ccggucccgccgugccgcgg

SEQ ID NO: 1107559 - RNA, 21 nt, Mycobacterium bovis subsp bovis AF2122/97
ccggucccgccgugccgcggc

SEQ ID NO: 1107560 - RNA, 23 nt, Mycobacterium bovis subsp bovis AF2122/97
ccggucccgccgugccgcggcga

SEQ ID NO: 1107561 - RNA, 20 nt, Mycobacterium bovis subsp bovis AF2122/97
ccgguccccgguuucgauca

SEQ ID NO: 1107562 - RNA, 20 nt, Mycobacterium bovis subsp bovis AF2122/97
ccgguccccccguugccgcc

SEQ ID NO: 1107563 - RNA, 15 nt, Mycobacterium bovis subsp bovis AF2122/97
ccgguccccgccggc

SEQ ID NO: 1107564 - RNA, 15 nt, Mycobacterium bovis subsp bovis AF2122/97
ccgguccgccagcgc

SEQ ID NO: 1107565 - RNA, 16 nt, Mycobacterium bovis subsp bovis AF2122/97
ccgguccgccagcgcg

SEQ ID NO: 1107566 - RNA, 15 nt, Mycobacterium bovis subsp bovis AF2122/97
ccgguccgccgcaga

SEQ ID NO: 1107567 - RNA, 16 nt, Mycobacterium bovis subsp bovis AF2122/97
ccgguccggcgucgug

SEQ ID NO: 1107568 - RNA, 21 nt, Mycobacterium bovis subsp bovis AF2122/97
ccgguccugggauccggcggc

SEQ ID NO: 1107569 - RNA, 16 nt, Mycobacterium bovis subsp bovis AF2122/97
ccgguccugcucgcac

SEQ ID NO: 1107570 - RNA, 13 nt, Mycobacterium bovis subsp bovis AF2122/97
ccgguccgggucg

SEQ ID NO: 1107571 - RNA, 13 nt, Mycobacterium bovis subsp bovis AF2122/97
ccgguccgucacc

SEQ ID NO: 1107572 - RNA, 23 nt, Mycobacterium bovis subsp bovis AF2122/97
ccggucgacagcgaaggcgccga

SEQ ID NO: 1107573 - RNA, 18 nt, Mycobacterium bovis subsp bovis AF2122/97
ccgguaggcggccagcgc

SEQ ID NO: 1107574 - RNA, 13 nt, Mycobacterium bovis subsp bovis AF2122/97
ccgguaguagcug

SEQ ID NO: 1107575 - RNA, 19 nt, Mycobacterium bovis subsp bovis AF2122/97
ccgguaucgucccggcgac

SEQ ID NO: 1107576 - RNA, 13 nt, Mycobacterium bovis subsp bovis AF2122/97
ccgguaucggcga

SEQ ID NO: 1107577 - RNA, 14 nt, Mycobacterium bovis subsp bovis AF2122/97
ccgguaucggcgac

SEQ ID NO: 1107578 - RNA, 16 nt, Mycobacterium bovis subsp bovis AF2122/97
ccggucaaacgcgcgc

SEQ ID NO: 1107579 - RNA, 19 nt, Mycobacterium bovis subsp bovis AF2122/97
ccggucaaacgcgcgcgcc

SEQ ID NO: 1107580 - RNA, 20 nt, Mycobacterium bovis subsp bovis AF2122/97
ccgguauuaccgccguggcc

SEQ ID NO: 1107581 - RNA, 17 nt, Mycobacterium bovis subsp bovis AF2122/97
ccggucagcaccuccac

SEQ ID NO: 1107582 - RNA, 22 nt, Mycobacterium bovis subsp bovis AF2122/97
ccggucagcaccuccaccgcgc

SEQ ID NO: 1107583 - RNA, 23 nt, Mycobacterium bovis subsp bovis AF2122/97
ccggucaacacccgcccgggcgu

SEQ ID NO: 1107584 - RNA, 17 nt, Mycobacterium bovis subsp bovis AF2122/97
ccggucacgcugugcgg

SEQ ID NO: 1107585 - RNA, 17 nt, Mycobacterium bovis subsp bovis AF2122/97
ccggucaccucgccggc

SEQ ID NO: 1107586 - RNA, 17 nt, Mycobacterium bovis subsp bovis AF2122/97
ccggucagcgcggcgac

SEQ ID NO: 1107587 - RNA, 18 nt, Mycobacterium bovis subsp bovis AF2122/97
ccggucagcgacgcacgc

SEQ ID NO: 1107588 - RNA, 19 nt, Mycobacterium bovis subsp bovis AF2122/97
ccggucagcgacgcacgca

SEQ ID NO: 1107589 - RNA, 23 nt, Mycobacterium bovis subsp bovis AF2122/97
ccggucagcgacgcacgcaguuc

SEQ ID NO: 1107590 - RNA, 21 nt, Mycobacterium bovis subsp bovis AF2122/97
ccggucagcaauacggcggcg

SEQ ID NO: 1107591 - RNA, 17 nt, Mycobacterium bovis subsp bovis AF2122/97
ccggucagcgacgcacg

SEQ ID NO: 1107592 - RNA, 18 nt, Mycobacterium bovis subsp bovis AF2122/97
ccggucaggcaguccacc

SEQ ID NO: 1107593 - RNA, 19 nt, Mycobacterium bovis subsp bovis AF2122/97
ccggucagguacaucccgg

SEQ ID NO: 1107594 - RNA, 15 nt, Mycobacterium bovis subsp bovis AF2122/97
ccggucaggccgccg

SEQ ID NO: 1107595 - RNA, 16 nt, Mycobacterium bovis subsp bovis AF2122/97
ccggucaggccgccgc

SEQ ID NO: 1107596 - RNA, 11 nt, Mycobacterium bovis subsp bovis AF2122/97
ccggucagcga

SEQ ID NO: 1107597 - RNA, 21 nt, Mycobacterium bovis subsp bovis AF2122/97
ccggucauaccaagcgcggug

SEQ ID NO: 1107598 - RNA, 16 nt, Mycobacterium bovis subsp bovis AF2122/97
ccggucauaccaagcg

SEQ ID NO: 1107599 - RNA, 17 nt, Mycobacterium bovis subsp bovis AF2122/97
ccggucaucgccgaaac

SEQ ID NO: 1107600 - RNA, 22 nt, Mycobacterium bovis subsp bovis AF2122/97
ccggucauccgggcgaccacca

SEQ ID NO: 1107601 - RNA, 14 nt, Mycobacterium bovis subsp bovis AF2122/97
ccgguccagcggcc

SEQ ID NO: 1107602 - RNA, 15 nt, Mycobacterium bovis subsp bovis AF2122/97
ccgguccagcggccg

SEQ ID NO: 1107603 - RNA, 16 nt, Mycobacterium bovis subsp bovis AF2122/97
ccgguccagcggccgc

SEQ ID NO: 1107604 - RNA, 21 nt, Mycobacterium bovis subsp bovis AF2122/97
ccgguccagcggccgccgcgg

SEQ ID NO: 1107605 - RNA, 22 nt, Mycobacterium bovis subsp bovis AF2122/97
ccgguccagcggccgccgcggc

SEQ ID NO: 1107606 - RNA, 23 nt, Mycobacterium bovis subsp bovis AF2122/97
ccgguccagacccagcucgucga

SEQ ID NO: 1107607 - RNA, 14 nt, Mycobacterium bovis subsp bovis AF2122/97
ccggccagccgcac

SEQ ID NO: 1107608 - RNA, 16 nt, Mycobacterium bovis subsp bovis AF2122/97
ccggccagccgcacgg

SEQ ID NO: 1107609 - RNA, 21 nt, Mycobacterium bovis subsp bovis AF2122/97
ccggccagccgcacgguugcc

SEQ ID NO: 1107610 - RNA, 15 nt, Mycobacterium bovis subsp bovis AF2122/97
ccggccagccgcggc

SEQ ID NO: 1107611 - RNA, 13 nt, Mycobacterium bovis subsp bovis AF2122/97
ccggccagcggca

SEQ ID NO: 1107612 - RNA, 17 nt, Mycobacterium bovis subsp bovis AF2122/97
ccggccagcugcguggc

SEQ ID NO: 1107613 - RNA, 14 nt, Mycobacterium bovis subsp bovis AF2122/97
ccggccagcggccc

SEQ ID NO: 1107614 - RNA, 19 nt, Mycobacterium bovis subsp bovis AF2122/97
ccggccagcggcccgucac

SEQ ID NO: 1107615 - RNA, 19 nt, Mycobacterium bovis subsp bovis AF2122/97
ccggccaggaguuugacca

SEQ ID NO: 1107616 - RNA, 16 nt, Mycobacterium bovis subsp bovis AF2122/97
ccggcgccaucggguc

SEQ ID NO: 1107617 - RNA, 22 nt, Mycobacterium bovis subsp bovis AF2122/97
ccggcgccaucgggucaccccc

SEQ ID NO: 1107618 - RNA, 20 nt, Mycobacterium bovis subsp bovis AF2122/97
ccggcgccauucgccccacc

SEQ ID NO: 1107619 - RNA, 15 nt, Mycobacterium bovis subsp bovis AF2122/97
ccggcgccagcgccg

SEQ ID NO: 1107620 - RNA, 16 nt, Mycobacterium bovis subsp bovis AF2122/97
ccggcgccagcgccgc

SEQ ID NO: 1107621 - RNA, 15 nt, Mycobacterium bovis subsp bovis AF2122/97
ccggcgccaggaucg

SEQ ID NO: 1107622 - RNA, 13 nt, Mycobacterium bovis subsp bovis AF2122/97
ccggcgcccaggc

SEQ ID NO: 1107623 - RNA, 23 nt, Mycobacterium bovis subsp bovis AF2122/97
ccggcgcccagcgccucgauggu

SEQ ID NO: 1107624 - RNA, 12 nt, Mycobacterium bovis subsp bovis AF2122/97
ccggcgcccgcc

SEQ ID NO: 1107625 - RNA, 16 nt, Mycobacterium bovis subsp bovis AF2122/97
ccggcgcccgccgcga

SEQ ID NO: 1107626 - RNA, 18 nt, Mycobacterium bovis subsp bovis AF2122/97
ccggcgccgccggcgccg

SEQ ID NO: 1107627 - RNA, 14 nt, Mycobacterium bovis subsp bovis AF2122/97
ccggcgccgccggu

SEQ ID NO: 1107628 - RNA, 18 nt, Mycobacterium bovis subsp bovis AF2122/97
ccggcgccgccgucgccg

SEQ ID NO: 1107629 - RNA, 17 nt, Mycobacterium bovis subsp bovis AF2122/97
ccggcgccgccguuacc

SEQ ID NO: 1107630 - RNA, 18 nt, Mycobacterium bovis subsp bovis AF2122/97
ccggcgcccaggccgauc

SEQ ID NO: 1107631 - RNA, 23 nt, Mycobacterium bovis subsp bovis AF2122/97
ccggcgccgccguuaccgccggc

SEQ ID NO: 1107632 - RNA, 16 nt, Mycobacterium bovis subsp bovis AF2122/97
ccggcgccgccguucc

SEQ ID NO: 1107633 - RNA, 16 nt, Mycobacterium bovis subsp bovis AF2122/97
ccggcgccgccguugc

SEQ ID NO: 1107634 - RNA, 13 nt, Mycobacterium bovis subsp bovis AF2122/97
ccggcgccgcgcg

SEQ ID NO: 1107635 - RNA, 16 nt, Mycobacterium bovis subsp bovis AF2122/97
ccggcgccgcgcggcu

SEQ ID NO: 1107636 - RNA, 14 nt, Mycobacterium bovis subsp bovis AF2122/97
ccggcgccgcgggu

SEQ ID NO: 1107637 - RNA, 16 nt, Mycobacterium bovis subsp bovis AF2122/97
ccggcgccggagccgc

SEQ ID NO: 1107638 - RNA, 16 nt, Mycobacterium bovis subsp bovis AF2122/97
ccggcgccggugccgc

SEQ ID NO: 1107639 - RNA, 17 nt, Mycobacterium bovis subsp bovis AF2122/97
ccggcgccggugccgcc

SEQ ID NO: 1107640 - RNA, 13 nt, Mycobacterium bovis subsp bovis AF2122/97
ccggcgccggcgc

SEQ ID NO: 1107641 - RNA, 17 nt, Mycobacterium bovis subsp bovis AF2122/97
ccggcgccggcgcugcu

SEQ ID NO: 1107642 - RNA, 22 nt, Mycobacterium bovis subsp bovis AF2122/97
ccggcgccgucgaugaccagca

SEQ ID NO: 1107643 - RNA, 17 nt, Mycobacterium bovis subsp bovis AF2122/97
ccggcgcgaccgcggcg

SEQ ID NO: 1107644 - RNA, 17 nt, Mycobacterium bovis subsp bovis AF2122/97
ccggcgcgauccccgcg

SEQ ID NO: 1107645 - RNA, 18 nt, Mycobacterium bovis subsp bovis AF2122/97
ccggcgcgauccccgcgc

SEQ ID NO: 1107646 - RNA, 19 nt, Mycobacterium bovis subsp bovis AF2122/97
ccggcgccuuggucgccgc

SEQ ID NO: 1107647 - RNA, 14 nt, Mycobacterium bovis subsp bovis AF2122/97
ccggcgcgacgccc

SEQ ID NO: 1107648 - RNA, 15 nt, Mycobacterium bovis subsp bovis AF2122/97
ccggcgcgcagccgg

SEQ ID NO: 1107649 - RNA, 14 nt, Mycobacterium bovis subsp bovis AF2122/97
ccggcgccgggucg

SEQ ID NO: 1107650 - RNA, 12 nt, Mycobacterium bovis subsp bovis AF2122/97
ccggcgcgcccc

SEQ ID NO: 1107651 - RNA, 19 nt, Mycobacterium bovis subsp bovis AF2122/97
ccggcgcgccccaccgcgc

SEQ ID NO: 1107652 - RNA, 14 nt, Mycobacterium bovis subsp bovis AF2122/97
ccggcgcgccccgc

SEQ ID NO: 1107653 - RNA, 16 nt, Mycobacterium bovis subsp bovis AF2122/97
ccggcgcgccccgccg

SEQ ID NO: 1107654 - RNA, 19 nt, Mycobacterium bovis subsp bovis AF2122/97
ccggcgcgccccgccgcac

SEQ ID NO: 1107655 - RNA, 12 nt, Mycobacterium bovis subsp bovis AF2122/97
ccggcgcgccga

SEQ ID NO: 1107656 - RNA, 19 nt, Mycobacterium bovis subsp bovis AF2122/97
ccggcgcggaacgcgucgc

SEQ ID NO: 1107657 - RNA, 15 nt, Mycobacterium bovis subsp bovis AF2122/97
ccggcgcggccggcc

SEQ ID NO: 1107658 - RNA, 22 nt, Mycobacterium bovis subsp bovis AF2122/97
ccggcgcggccggccgcucacc

SEQ ID NO: 1107659 - RNA, 20 nt, Mycobacterium bovis subsp bovis AF2122/97
ccggcgcggagugcccaggg

SEQ ID NO: 1107660 - RNA, 22 nt, Mycobacterium bovis subsp bovis AF2122/97
ccggcgcggccgcaagccgcga

SEQ ID NO: 1107661 - RNA, 13 nt, Mycobacterium bovis subsp bovis AF2122/97
ccggcgcggcgga

SEQ ID NO: 1107662 - RNA, 17 nt, Mycobacterium bovis subsp bovis AF2122/97
ccggcgcggcggaccgu

SEQ ID NO: 1107663 - RNA, 21 nt, Mycobacterium bovis subsp bovis AF2122/97
ccggcgcggucaucauggccg

SEQ ID NO: 1107664 - RNA, 14 nt, Mycobacterium bovis subsp bovis AF2122/97
ccggcgcgguggcc

SEQ ID NO: 1107665 - RNA, 19 nt, Mycobacterium bovis subsp bovis AF2122/97
ccggcgcguuccaucaggg

SEQ ID NO: 1107666 - RNA, 22 nt, Mycobacterium bovis subsp bovis AF2122/97
ccggcgcguaguaaugcucgac

SEQ ID NO: 1107667 - RNA, 22 nt, Mycobacterium bovis subsp bovis AF2122/97
ccggcgcguuccaucagggccu

SEQ ID NO: 1107668 - RNA, 19 nt, Mycobacterium bovis subsp bovis AF2122/97
ccggcgcuagcgccgcgcu

SEQ ID NO: 1107669 - RNA, 20 nt, Mycobacterium bovis subsp bovis AF2122/97
ccggcgcucgcggcggcgcu

SEQ ID NO: 1107670 - RNA, 19 nt, Mycobacterium bovis subsp bovis AF2122/97
ccggcgcuccaacgcacac

SEQ ID NO: 1107671 - RNA, 20 nt, Mycobacterium bovis subsp bovis AF2122/97
ccggcgcuccacugaccagg

SEQ ID NO: 1107672 - RNA, 23 nt, Mycobacterium bovis subsp bovis AF2122/97
ccggcgcuccacugaccaggucu

SEQ ID NO: 1107673 - RNA, 14 nt, Mycobacterium bovis subsp bovis AF2122/97
ccggcgcuccgcca

SEQ ID NO: 1107674 - RNA, 19 nt, Mycobacterium bovis subsp bovis AF2122/97
ccggcgcugcccgggcugc

SEQ ID NO: 1107675 - RNA, 14 nt, Mycobacterium bovis subsp bovis AF2122/97
ccggcgcuggagac

SEQ ID NO: 1107676 - RNA, 14 nt, Mycobacterium bovis subsp bovis AF2122/97
ccggcggacaccuc

SEQ ID NO: 1107677 - RNA, 15 nt, Mycobacterium bovis subsp bovis AF2122/97
ccggcggagcgggcc

SEQ ID NO: 1107678 - RNA, 16 nt, Mycobacterium bovis subsp bovis AF2122/97
ccggcggagcgggcca

SEQ ID NO: 1107679 - RNA, 23 nt, Mycobacterium bovis subsp bovis AF2122/97
ccggcggagcgggccagcacccg

SEQ ID NO: 1107680 - RNA, 12 nt, Mycobacterium bovis subsp bovis AF2122/97
ccggcggcagcg

SEQ ID NO: 1107681 - RNA, 16 nt, Mycobacterium bovis subsp bovis AF2122/97
ccggcggacgcccggc

SEQ ID NO: 1107682 - RNA, 21 nt, Mycobacterium bovis subsp bovis AF2122/97
ccggcggacgcccggcgcacc

SEQ ID NO: 1107683 - RNA, 20 nt, Mycobacterium bovis subsp bovis AF2122/97
ccggcggaucugaucggcgc

SEQ ID NO: 1107684 - RNA, 17 nt, Mycobacterium bovis subsp bovis AF2122/97
ccggcgguggggccggc

SEQ ID NO: 1107685 - RNA, 15 nt, Mycobacterium bovis subsp bovis AF2122/97
ccggcguagcggcga

SEQ ID NO: 1107686 - RNA, 16 nt, Mycobacterium bovis subsp bovis AF2122/97
ccggcguagcggcgau

SEQ ID NO: 1107687 - RNA, 20 nt, Mycobacterium bovis subsp bovis AF2122/97
ccggcguauagcccguagcc

SEQ ID NO: 1107688 - RNA, 13 nt, Mycobacterium bovis subsp bovis AF2122/97
ccggcgucacggc

SEQ ID NO: 1107689 - RNA, 23 nt, Mycobacterium bovis subsp bovis AF2122/97
ccggcgucacggcgugaccacug

SEQ ID NO: 1107690 - RNA, 19 nt, Mycobacterium bovis subsp bovis AF2122/97
ccggcguauugcaccgcca

SEQ ID NO: 1107691 - RNA, 21 nt, Mycobacterium bovis subsp bovis AF2122/97
ccggcgggcucgcccgcuacg

SEQ ID NO: 1107692 - RNA, 14 nt, Mycobacterium bovis subsp bovis AF2122/97
ccggcgggugccga

SEQ ID NO: 1107693 - RNA, 16 nt, Mycobacterium bovis subsp bovis AF2122/97
ccggcgggugccgagc

SEQ ID NO: 1107694 - RNA, 17 nt, Mycobacterium bovis subsp bovis AF2122/97
ccggcgggugccgagcu

SEQ ID NO: 1107695 - RNA, 19 nt, Mycobacterium bovis subsp bovis AF2122/97
ccggcgggugccgagcugg

SEQ ID NO: 1107696 - RNA, 14 nt, Mycobacterium bovis subsp bovis AF2122/97
ccggcggguggccc

SEQ ID NO: 1107697 - RNA, 11 nt, Mycobacterium bovis subsp bovis AF2122/97
ccggcggcgac

SEQ ID NO: 1107698 - RNA, 21 nt, Mycobacterium bovis subsp bovis AF2122/97
ccggcggcgaccagcucagcu

SEQ ID NO: 1107699 - RNA, 16 nt, Mycobacterium bovis subsp bovis AF2122/97
ccggcggcgacggcgg

SEQ ID NO: 1107700 - RNA, 20 nt, Mycobacterium bovis subsp bovis AF2122/97
ccggcggcgacggcggcacg

SEQ ID NO: 1107701 - RNA, 14 nt, Mycobacterium bovis subsp bovis AF2122/97
ccggcggcgacggu

SEQ ID NO: 1107702 - RNA, 15 nt, Mycobacterium bovis subsp bovis AF2122/97
ccggcggcgacggug

SEQ ID NO: 1107703 - RNA, 19 nt, Mycobacterium bovis subsp bovis AF2122/97
ccggcggcgacggugccac

SEQ ID NO: 1107704 - RNA, 14 nt, Mycobacterium bovis subsp bovis AF2122/97
ccggcggcgagcgg

SEQ ID NO: 1107705 - RNA, 18 nt, Mycobacterium bovis subsp bovis AF2122/97
ccggcggcgagcggccuc

SEQ ID NO: 1107706 - RNA, 19 nt, Mycobacterium bovis subsp bovis AF2122/97
ccggcggcagcggcgccgc

SEQ ID NO: 1107707 - RNA, 12 nt, Mycobacterium bovis subsp bovis AF2122/97
ccggcggcagcu

SEQ ID NO: 1107708 - RNA, 15 nt, Mycobacterium bovis subsp bovis AF2122/97
ccggcggauucggcg

SEQ ID NO: 1107709 - RNA, 15 nt, Mycobacterium bovis subsp bovis AF2122/97
ccggcggcaucgagu

SEQ ID NO: 1107710 - RNA, 23 nt, Mycobacterium bovis subsp bovis AF2122/97
ccggcggcgcccaucgcgacggc

SEQ ID NO: 1107711 - RNA, 21 nt, Mycobacterium bovis subsp bovis AF2122/97
ccggcggcgcccaucgcgacg

SEQ ID NO: 1107712 - RNA, 22 nt, Mycobacterium bovis subsp bovis AF2122/97
ccggcggcgcccaucgcgacgg

SEQ ID NO: 1107713 - RNA, 14 nt, Mycobacterium bovis subsp bovis AF2122/97
ccggcggcgccgga

SEQ ID NO: 1107714 - RNA, 19 nt, Mycobacterium bovis subsp bovis AF2122/97
ccggcggcgccggaggcgg

SEQ ID NO: 1107715 - RNA, 15 nt, Mycobacterium bovis subsp bovis AF2122/97
ccggcggcgccgggg

SEQ ID NO: 1107716 - RNA, 14 nt, Mycobacterium bovis subsp bovis AF2122/97
ccggcgggcccgcc

SEQ ID NO: 1107717 - RNA, 15 nt, Mycobacterium bovis subsp bovis AF2122/97
ccggcgggcccgccg

SEQ ID NO: 1107718 - RNA, 17 nt, Mycobacterium bovis subsp bovis AF2122/97
ccggcgggcccgccggc

SEQ ID NO: 1107719 - RNA, 20 nt, Mycobacterium bovis subsp bovis AF2122/97
ccggcgggcccgccggcccc

SEQ ID NO: 1107720 - RNA, 15 nt, Mycobacterium bovis subsp bovis AF2122/97
ccgggcccgacgacg

SEQ ID NO: 1107721 - RNA, 21 nt, Mycobacterium bovis subsp bovis AF2122/97
ccgggcccgacgacgacguuc

SEQ ID NO: 1107722 - RNA, 14 nt, Mycobacterium bovis subsp bovis AF2122/97
ccgggcccgacgcg

SEQ ID NO: 1107723 - RNA, 22 nt, Mycobacterium bovis subsp bovis AF2122/97
ccgggcccgacgcguggcaucc

SEQ ID NO: 1107724 - RNA, 18 nt, Mycobacterium bovis subsp bovis AF2122/97
ccgggccccacaucgccc

SEQ ID NO: 1107725 - RNA, 15 nt, Mycobacterium bovis subsp bovis AF2122/97
ccgggccccacggcg

SEQ ID NO: 1107726 - RNA, 14 nt, Mycobacterium bovis subsp bovis AF2122/97
ccgggccccggggu

SEQ ID NO: 1107727 - RNA, 20 nt, Mycobacterium bovis subsp bovis AF2122/97
ccgggccccuucgcagcaug

SEQ ID NO: 1107728 - RNA, 12 nt, Mycobacterium bovis subsp bovis AF2122/97
ccgggcccgccg

SEQ ID NO: 1107729 - RNA, 14 nt, Mycobacterium bovis subsp bovis AF2122/97
ccgggcccgccggc

SEQ ID NO: 1107730 - RNA, 18 nt, Mycobacterium bovis subsp bovis AF2122/97
ccgggccaggccgaugcc

SEQ ID NO: 1107731 - RNA, 14 nt, Mycobacterium bovis subsp bovis AF2122/97
ccgggcccgcggga

SEQ ID NO: 1107732 - RNA, 14 nt, Mycobacterium bovis subsp bovis AF2122/97
ccgggcccgcguuc

SEQ ID NO: 1107733 - RNA, 12 nt, Mycobacterium bovis subsp bovis AF2122/97
ccgggccggcca

SEQ ID NO: 1107734 - RNA, 14 nt, Mycobacterium bovis subsp bovis AF2122/97
ccgggccggccacg

SEQ ID NO: 1107735 - RNA, 19 nt, Mycobacterium bovis subsp bovis AF2122/97
ccgggccaggccgaugccg

SEQ ID NO: 1107736 - RNA, 12 nt, Mycobacterium bovis subsp bovis AF2122/97
ccgggccgcgcg

SEQ ID NO: 1107737 - RNA, 15 nt, Mycobacterium bovis subsp bovis AF2122/97
ccgggccgcggccac

SEQ ID NO: 1107738 - RNA, 13 nt, Mycobacterium bovis subsp bovis AF2122/97
ccgggccggucgg

SEQ ID NO: 1107739 - RNA, 16 nt, Mycobacterium bovis subsp bovis AF2122/97
ccgggccguacggcgc

SEQ ID NO: 1107740 - RNA, 16 nt, Mycobacterium bovis subsp bovis AF2122/97
ccgggccguguccgcc

SEQ ID NO: 1107741 - RNA, 17 nt, Mycobacterium bovis subsp bovis AF2122/97
ccgggccguguccgccg

SEQ ID NO: 1107742 - RNA, 19 nt, Mycobacterium bovis subsp bovis AF2122/97
ccgggccugcaccacggcg

SEQ ID NO: 1107743 - RNA, 20 nt, Mycobacterium bovis subsp bovis AF2122/97
ccgggccugcaccacggcgg

SEQ ID NO: 1107744 - RNA, 21 nt, Mycobacterium bovis subsp bovis AF2122/97
ccgggccugcaccacggcggc

SEQ ID NO: 1107745 - RNA, 18 nt, Mycobacterium bovis subsp bovis AF2122/97
ccgggccuugcgcgcgca

SEQ ID NO: 1107746 - RNA, 16 nt, Mycobacterium bovis subsp bovis AF2122/97
ccgggcgccgaucacg

SEQ ID NO: 1107747 - RNA, 15 nt, Mycobacterium bovis subsp bovis AF2122/97
ccgggccuggccugc

SEQ ID NO: 1107748 - RNA, 15 nt, Mycobacterium bovis subsp bovis AF2122/97
ccgggcgcgccggcc

SEQ ID NO: 1107749 - RNA, 19 nt, Mycobacterium bovis subsp bovis AF2122/97
ccgggcgcugcuugagguc

SEQ ID NO: 1107750 - RNA, 16 nt, Mycobacterium bovis subsp bovis AF2122/97
ccgggcguccgccggc

SEQ ID NO: 1107751 - RNA, 15 nt, Mycobacterium bovis subsp bovis AF2122/97
ccgggcgucgucggu

SEQ ID NO: 1107752 - RNA, 19 nt, Mycobacterium bovis subsp bovis AF2122/97
ccgggcgugcggcggccca

SEQ ID NO: 1107753 - RNA, 22 nt, Mycobacterium bovis subsp bovis AF2122/97
ccgggcgugcggcggcccaucg

SEQ ID NO: 1107754 - RNA, 19 nt, Mycobacterium bovis subsp bovis AF2122/97
ccgggcgugggcaccccgc

SEQ ID NO: 1107755 - RNA, 13 nt, Mycobacterium bovis subsp bovis AF2122/97
ccgggcgugggug

SEQ ID NO: 1107756 - RNA, 15 nt, Mycobacterium bovis subsp bovis AF2122/97
ccgggaugccgccgc

SEQ ID NO: 1107757 - RNA, 17 nt, Mycobacterium bovis subsp bovis AF2122/97
ccgggaugaagccaccc

SEQ ID NO: 1107758 - RNA, 20 nt, Mycobacterium bovis subsp bovis AF2122/97
ccgggaugaagcucgaccgc

SEQ ID NO: 1107759 - RNA, 23 nt, Mycobacterium bovis subsp bovis AF2122/97
ccgggaugaagcucgaccgcccg

SEQ ID NO: 1107760 - RNA, 14 nt, Mycobacterium bovis subsp bovis AF2122/97
ccgggcaccgucgg

SEQ ID NO: 1107761 - RNA, 18 nt, Mycobacterium bovis subsp bovis AF2122/97
ccgggcaccaccacaccg

SEQ ID NO: 1107762 - RNA, 19 nt, Mycobacterium bovis subsp bovis AF2122/97
ccgggcaccaccacaccgg

SEQ ID NO: 1107763 - RNA, 22 nt, Mycobacterium bovis subsp bovis AF2122/97
ccgggaucggggcaccgugcgg

SEQ ID NO: 1107764 - RNA, 17 nt, Mycobacterium bovis subsp bovis AF2122/97
ccgggcagaugaugccg

SEQ ID NO: 1107765 - RNA, 23 nt, Mycobacterium bovis subsp bovis AF2122/97
ccgggcagaugaugccguucgga

SEQ ID NO: 1107766 - RNA, 16 nt, Mycobacterium bovis subsp bovis AF2122/97
ccgggcagccgcacgg

SEQ ID NO: 1107767 - RNA, 14 nt, Mycobacterium bovis subsp bovis AF2122/97
ccgggcagccgcgc

SEQ ID NO: 1107768 - RNA, 17 nt, Mycobacterium bovis subsp bovis AF2122/97
ccgggcagccgcgccgc

SEQ ID NO: 1107769 - RNA, 19 nt, Mycobacterium bovis subsp bovis AF2122/97
ccgggcagccgcgccgcgg

SEQ ID NO: 1107770 - RNA, 16 nt, Mycobacterium bovis subsp bovis AF2122/97
ccgggcagccugcugc

SEQ ID NO: 1107771 - RNA, 12 nt, Mycobacterium bovis subsp bovis AF2122/97
ccgggcagccgc

SEQ ID NO: 1107772 - RNA, 14 nt, Mycobacterium bovis subsp bovis AF2122/97
ccgggcagccccuc

SEQ ID NO: 1107773 - RNA, 21 nt, Mycobacterium bovis subsp bovis AF2122/97
ccgggcagcaucaacaccggc

SEQ ID NO: 1107774 - RNA, 22 nt, Mycobacterium bovis subsp bovis AF2122/97
ccgggcagccccuccgcgccga

SEQ ID NO: 1107775 - RNA, 21 nt, Mycobacterium bovis subsp bovis AF2122/97
ccgggccaccaguuguccggc

SEQ ID NO: 1107776 - RNA, 22 nt, Mycobacterium bovis subsp bovis AF2122/97
ccgggccacgucgagcacccgc

SEQ ID NO: 1107777 - RNA, 22 nt, Mycobacterium bovis subsp bovis AF2122/97
ccgggccagaucgaagcgcagc

SEQ ID NO: 1107778 - RNA, 22 nt, Mycobacterium bovis subsp bovis AF2122/97
ccgggccauuaaaaagcccagc

SEQ ID NO: 1107779 - RNA, 23 nt, Mycobacterium bovis subsp bovis AF2122/97
ccgggccauuaaaaagcccagcg

SEQ ID NO: 1107780 - RNA, 17 nt, Mycobacterium bovis subsp bovis AF2122/97
ccgggcaguuuggcggc

SEQ ID NO: 1107781 - RNA, 23 nt, Mycobacterium bovis subsp bovis AF2122/97
ccgggcaguuuguucgcgaagcu

SEQ ID NO: 1107782 - RNA, 20 nt, Mycobacterium bovis subsp bovis AF2122/97
ccgggcaucggugccacggc

SEQ ID NO: 1107783 - RNA, 14 nt, Mycobacterium bovis subsp bovis AF2122/97
ccggcgucucgcag

SEQ ID NO: 1107784 - RNA, 23 nt, Mycobacterium bovis subsp bovis AF2122/97
ccggcgucucgcagcaacggcgg

SEQ ID NO: 1107785 - RNA, 19 nt, Mycobacterium bovis subsp bovis AF2122/97
ccggcgucguugaccaaug

SEQ ID NO: 1107786 - RNA, 21 nt, Mycobacterium bovis subsp bovis AF2122/97
ccggcgucguaggagccguca

SEQ ID NO: 1107787 - RNA, 23 nt, Mycobacterium bovis subsp bovis AF2122/97
ccggcgucgcuggccaggccggc

SEQ ID NO: 1107788 - RNA, 13 nt, Mycobacterium bovis subsp bovis AF2122/97
ccggcgucggcgc

SEQ ID NO: 1107789 - RNA, 17 nt, Mycobacterium bovis subsp bovis AF2122/97
ccggcgucggcgcggcc

SEQ ID NO: 1107790 - RNA, 19 nt, Mycobacterium bovis subsp bovis AF2122/97
ccggcgucggcgcggccgu

SEQ ID NO: 1107791 - RNA, 17 nt, Mycobacterium bovis subsp bovis AF2122/97
ccggcgucugcccgccc

SEQ ID NO: 1107792 - RNA, 18 nt, Mycobacterium bovis subsp bovis AF2122/97
ccggcgucugcccgccca

SEQ ID NO: 1107793 - RNA, 21 nt, Mycobacterium bovis subsp bovis AF2122/97
ccggcgucugcccgcccagcc

SEQ ID NO: 1107794 - RNA, 17 nt, Mycobacterium bovis subsp bovis AF2122/97
ccggcuaugcuggcgca

SEQ ID NO: 1107795 - RNA, 18 nt, Mycobacterium bovis subsp bovis AF2122/97
ccggcucaaggacgcacc

SEQ ID NO: 1107796 - RNA, 21 nt, Mycobacterium bovis subsp bovis AF2122/97
ccggcugaaacguccuugaac

SEQ ID NO: 1107797 - RNA, 17 nt, Mycobacterium bovis subsp bovis AF2122/97
ccggcucucuucgcgcg

SEQ ID NO: 1107798 - RNA, 18 nt, Mycobacterium bovis subsp bovis AF2122/97
ccggcucucuucgcgcgc

SEQ ID NO: 1107799 - RNA, 19 nt, Mycobacterium bovis subsp bovis AF2122/97
ccggcucucuucgcgcgcu

SEQ ID NO: 1107800 - RNA, 14 nt, Mycobacterium bovis subsp bovis AF2122/97
ccggcucggugcgc

SEQ ID NO: 1107801 - RNA, 12 nt, Mycobacterium bovis subsp bovis AF2122/97
ccggcucgggug

SEQ ID NO: 1107802 - RNA, 20 nt, Mycobacterium bovis subsp bovis AF2122/97
ccggcucccgggggcacucc

SEQ ID NO: 1107803 - RNA, 13 nt, Mycobacterium bovis subsp bovis AF2122/97
ccggcucgucagg

SEQ ID NO: 1107804 - RNA, 13 nt, Mycobacterium bovis subsp bovis AF2122/97
ccggcucguccgg

SEQ ID NO: 1107805 - RNA, 12 nt, Mycobacterium bovis subsp bovis AF2122/97
ccggcucgucga

SEQ ID NO: 1107806 - RNA, 15 nt, Mycobacterium bovis subsp bovis AF2122/97
ccggcucgucgaucc

SEQ ID NO: 1107807 - RNA, 22 nt, Mycobacterium bovis subsp bovis AF2122/97
ccggcucgucgauccccgcaau

SEQ ID NO: 1107808 - RNA, 23 nt, Mycobacterium bovis subsp bovis AF2122/97
ccggcucgucgaugucgacgucg

SEQ ID NO: 1107809 - RNA, 17 nt, Mycobacterium bovis subsp bovis AF2122/97
ccggcucacagcacagc

SEQ ID NO: 1107810 - RNA, 20 nt, Mycobacterium bovis subsp bovis AF2122/97
ccggcucacagcacagcgca

SEQ ID NO: 1107811 - RNA, 22 nt, Mycobacterium bovis subsp bovis AF2122/97
ccggcucaaggacgcaccgcca

SEQ ID NO: 1107812 - RNA, 18 nt, Mycobacterium bovis subsp bovis AF2122/97
ccggcucagucacgcacu

SEQ ID NO: 1107813 - RNA, 16 nt, Mycobacterium bovis subsp bovis AF2122/97
ccggcucauccgacgg

SEQ ID NO: 1107814 - RNA, 16 nt, Mycobacterium bovis subsp bovis AF2122/97
ccggcuccagcaccgu

SEQ ID NO: 1107815 - RNA, 19 nt, Mycobacterium bovis subsp bovis AF2122/97
ccgggauaguuuucggccg

SEQ ID NO: 1107816 - RNA, 13 nt, Mycobacterium bovis subsp bovis AF2122/97
ccgggaucggcuc

SEQ ID NO: 1107817 - RNA, 18 nt, Mycobacterium bovis subsp bovis AF2122/97
ccgggaucggcuccgccg

SEQ ID NO: 1107818 - RNA, 15 nt, Mycobacterium bovis subsp bovis AF2122/97
ccgggaucccacggc

SEQ ID NO: 1107819 - RNA, 17 nt, Mycobacterium bovis subsp bovis AF2122/97
ccgggaucccacggcgg

SEQ ID NO: 1107820 - RNA, 19 nt, Mycobacterium bovis subsp bovis AF2122/97
ccgggaucccacggcgggc

SEQ ID NO: 1107821 - RNA, 16 nt, Mycobacterium bovis subsp bovis AF2122/97
ccgggaauuucgacac

SEQ ID NO: 1107822 - RNA, 18 nt, Mycobacterium bovis subsp bovis AF2122/97
ccgggacaaucucggccg

SEQ ID NO: 1107823 - RNA, 19 nt, Mycobacterium bovis subsp bovis AF2122/97
ccgggacaaucucggccgc

SEQ ID NO: 1107824 - RNA, 16 nt, Mycobacterium bovis subsp bovis AF2122/97
ccgggaauggacaggu

SEQ ID NO: 1107825 - RNA, 22 nt, Mycobacterium bovis subsp bovis AF2122/97
ccgggaacaucccagcgaaugc

SEQ ID NO: 1107826 - RNA, 21 nt, Mycobacterium bovis subsp bovis AF2122/97
ccgggaaccacggucagcacg

SEQ ID NO: 1107827 - RNA, 13 nt, Mycobacterium bovis subsp bovis AF2122/97
ccgggaacgaggu

SEQ ID NO: 1107828 - RNA, 15 nt, Mycobacterium bovis subsp bovis AF2122/97
ccggcuggggccgcu

SEQ ID NO: 1107829 - RNA, 14 nt, Mycobacterium bovis subsp bovis AF2122/97
ccggcuggcccacc

SEQ ID NO: 1107830 - RNA, 15 nt, Mycobacterium bovis subsp bovis AF2122/97
ccggcuggcccagcg

SEQ ID NO: 1107831 - RNA, 13 nt, Mycobacterium bovis subsp bovis AF2122/97
ccggcuggcggcc

SEQ ID NO: 1107832 - RNA, 20 nt, Mycobacterium bovis subsp bovis AF2122/97
ccggcuggcggcguggcgcc

SEQ ID NO: 1107833 - RNA, 15 nt, Mycobacterium bovis subsp bovis AF2122/97
ccggcugacgaccaa

SEQ ID NO: 1107834 - RNA, 17 nt, Mycobacterium bovis subsp bovis AF2122/97
ccggcugaccgacccgg

SEQ ID NO: 1107835 - RNA, 12 nt, Mycobacterium bovis subsp bovis AF2122/97
ccggcugaccgg

SEQ ID NO: 1107836 - RNA, 17 nt, Mycobacterium bovis subsp bovis AF2122/97
ccggcuguuaggcgaua

SEQ ID NO: 1107837 - RNA, 17 nt, Mycobacterium bovis subsp bovis AF2122/97
ccggcugucggucaucc

SEQ ID NO: 1107838 - RNA, 21 nt, Mycobacterium bovis subsp bovis AF2122/97
ccggcugucggucauccggau

SEQ ID NO: 1107839 - RNA, 22 nt, Mycobacterium bovis subsp bovis AF2122/97
ccggcuggugggacgcggccga

SEQ ID NO: 1107840 - RNA, 14 nt, Mycobacterium bovis subsp bovis AF2122/97
ccggcuuaccggcg

SEQ ID NO: 1107841 - RNA, 15 nt, Mycobacterium bovis subsp bovis AF2122/97
ccggcuuaccggcgg

SEQ ID NO: 1107842 - RNA, 16 nt, Mycobacterium bovis subsp bovis AF2122/97
ccggcuuaccggcggg

SEQ ID NO: 1107843 - RNA, 17 nt, Mycobacterium bovis subsp bovis AF2122/97
ccgggaacaggguggug

SEQ ID NO: 1107844 - RNA, 14 nt, Mycobacterium bovis subsp bovis AF2122/97
ccggcuggcuagca

SEQ ID NO: 1107845 - RNA, 20 nt, Mycobacterium bovis subsp bovis AF2122/97
ccggcuguucucgccgaagc

SEQ ID NO: 1107846 - RNA, 22 nt, Mycobacterium bovis subsp bovis AF2122/97
ccggcuguuaggcgauaucgca

SEQ ID NO: 1107847 - RNA, 22 nt, Mycobacterium bovis subsp bovis AF2122/97
ccucggccagcuccgccugccg

SEQ ID NO: 1107848 - RNA, 23 nt, Mycobacterium bovis subsp bovis AF2122/97
ccucggccagcuccgccugccgc

SEQ ID NO: 1107849 - RNA, 12 nt, Mycobacterium bovis subsp bovis AF2122/97
ccucggccaccc

SEQ ID NO: 1107850 - RNA, 13 nt, Mycobacterium bovis subsp bovis AF2122/97
ccucggccacccg

SEQ ID NO: 1107851 - RNA, 16 nt, Mycobacterium bovis subsp bovis AF2122/97
ccucggccgccagccc

SEQ ID NO: 1107852 - RNA, 12 nt, Mycobacterium bovis subsp bovis AF2122/97
ccucggcgacca

SEQ ID NO: 1107853 - RNA, 20 nt, Mycobacterium bovis subsp bovis AF2122/97
ccucggcguaggcgauggcg

SEQ ID NO: 1107854 - RNA, 19 nt, Mycobacterium bovis subsp bovis AF2122/97
ccucggcgggauccucgaa

SEQ ID NO: 1107855 - RNA, 14 nt, Mycobacterium bovis subsp bovis AF2122/97
ccucgggaucaccg

SEQ ID NO: 1107856 - RNA, 15 nt, Mycobacterium bovis subsp bovis AF2122/97
ccucgggaucggcgg

SEQ ID NO: 1107857 - RNA, 18 nt, Mycobacterium bovis subsp bovis AF2122/97
ccucgggaggcagcgcga

SEQ ID NO: 1107858 - RNA, 21 nt, Mycobacterium bovis subsp bovis AF2122/97
ccucgggaggcagcgcgaggc

SEQ ID NO: 1107859 - RNA, 22 nt, Mycobacterium bovis subsp bovis AF2122/97
ccucggcuucggagccgacaac

SEQ ID NO: 1107860 - RNA, 17 nt, Mycobacterium bovis subsp bovis AF2122/97
ccucgggcaccuggucg

SEQ ID NO: 1107861 - RNA, 18 nt, Mycobacterium bovis subsp bovis AF2122/97
ccucggguguggucacca

SEQ ID NO: 1107862 - RNA, 19 nt, Mycobacterium bovis subsp bovis AF2122/97
ccucggggaacaccgcggu

SEQ ID NO: 1107863 - RNA, 19 nt, Mycobacterium bovis subsp bovis AF2122/97
ccucguagucccacugcca

SEQ ID NO: 1107864 - RNA, 22 nt, Mycobacterium bovis subsp bovis AF2122/97
ccucgucgacgucggcaucggc

SEQ ID NO: 1107865 - RNA, 22 nt, Mycobacterium bovis subsp bovis AF2122/97
ccucgucgagagguucgccguc

SEQ ID NO: 1107866 - RNA, 17 nt, Mycobacterium bovis subsp bovis AF2122/97
ccucgucgagcgugcgc

SEQ ID NO: 1107867 - RNA, 12 nt, Mycobacterium bovis subsp bovis AF2122/97
ccucgucgaccg

SEQ ID NO: 1107868 - RNA, 23 nt, Mycobacterium bovis subsp bovis AF2122/97
ccucgucgagagguucgccgucg

SEQ ID NO: 1107869 - RNA, 12 nt, Mycobacterium bovis subsp bovis AF2122/97
ccucgaccugga

SEQ ID NO: 1107870 - RNA, 16 nt, Mycobacterium bovis subsp bovis AF2122/97
ccucgaccuggauggg

SEQ ID NO: 1107871 - RNA, 23 nt, Mycobacterium bovis subsp bovis AF2122/97
ccucgaccuggaugggcucgacg

SEQ ID NO: 1107872 - RNA, 12 nt, Mycobacterium bovis subsp bovis AF2122/97
ccucgacgagca

SEQ ID NO: 1107873 - RNA, 23 nt, Mycobacterium bovis subsp bovis AF2122/97
ccucgacgaucagcacgucgcgg

SEQ ID NO: 1107874 - RNA, 18 nt, Mycobacterium bovis subsp bovis AF2122/97
ccucgacgcacacccggu

SEQ ID NO: 1107875 - RNA, 21 nt, Mycobacterium bovis subsp bovis AF2122/97
ccucgaauucggccggcgcgg

SEQ ID NO: 1107876 - RNA, 16 nt, Mycobacterium bovis subsp bovis AF2122/97
ccucgaccgccagccg

SEQ ID NO: 1107877 - RNA, 17 nt, Mycobacterium bovis subsp bovis AF2122/97
ccucgaccgccagccgc

SEQ ID NO: 1107878 - RNA, 17 nt, Mycobacterium bovis subsp bovis AF2122/97
ccucgacacccagccgc

SEQ ID NO: 1107879 - RNA, 21 nt, Mycobacterium bovis subsp bovis AF2122/97
ccucgacacccagccgcagcc

SEQ ID NO: 1107880 - RNA, 21 nt, Mycobacterium bovis subsp bovis AF2122/97
ccucgacacccauccucgcgg

SEQ ID NO: 1107881 - RNA, 14 nt, Mycobacterium bovis subsp bovis AF2122/97
ccucgacacgccgu

SEQ ID NO: 1107882 - RNA, 17 nt, Mycobacterium bovis subsp bovis AF2122/97
ccucgaaggcacugcga

SEQ ID NO: 1107883 - RNA, 15 nt, Mycobacterium bovis subsp bovis AF2122/97
ccucgaauucggccg

SEQ ID NO: 1107884 - RNA, 15 nt, Mycobacterium bovis subsp bovis AF2122/97
ccucgacgccgcgca

SEQ ID NO: 1107885 - RNA, 14 nt, Mycobacterium bovis subsp bovis AF2122/97
ccucgacgcccgcc

SEQ ID NO: 1107886 - RNA, 19 nt, Mycobacterium bovis subsp bovis AF2122/97
ccucgacggugacgaccac

SEQ ID NO: 1107887 - RNA, 15 nt, Mycobacterium bovis subsp bovis AF2122/97
ccucggcacggaccg

SEQ ID NO: 1107888 - RNA, 19 nt, Mycobacterium bovis subsp bovis AF2122/97
ccucggcaagucgacgccg

SEQ ID NO: 1107889 - RNA, 21 nt, Mycobacterium bovis subsp bovis AF2122/97
ccucggauugcagcgcgaugg

SEQ ID NO: 1107890 - RNA, 19 nt, Mycobacterium bovis subsp bovis AF2122/97
ccucggcaaaccaagcgcg

SEQ ID NO: 1107891 - RNA, 23 nt, Mycobacterium bovis subsp bovis AF2122/97
ccucggcaaaccaagcgcgccag

SEQ ID NO: 1107892 - RNA, 23 nt, Mycobacterium bovis subsp bovis AF2122/97
ccucggagaugaacucggcgauc

SEQ ID NO: 1107893 - RNA, 13 nt, Mycobacterium bovis subsp bovis AF2122/97
ccucgcuggccgc

SEQ ID NO: 1107894 - RNA, 20 nt, Mycobacterium bovis subsp bovis AF2122/97
ccucgcugcucagcaacggc

SEQ ID NO: 1107895 - RNA, 18 nt, Mycobacterium bovis subsp bovis AF2122/97
ccucggaccagacccacg

SEQ ID NO: 1107896 - RNA, 17 nt, Mycobacterium bovis subsp bovis AF2122/97
ccucggacacggcagcc

SEQ ID NO: 1107897 - RNA, 20 nt, Mycobacterium bovis subsp bovis AF2122/97
ccucgucgauguucgccgcg

SEQ ID NO: 1107898 - RNA, 21 nt, Mycobacterium bovis subsp bovis AF2122/97
ccucgucgauguucgccgcgc

SEQ ID NO: 1107899 - RNA, 15 nt, Mycobacterium bovis subsp bovis AF2122/97
ccucgucgaggucag

SEQ ID NO: 1107900 - RNA, 22 nt, Mycobacterium bovis subsp bovis AF2122/97
ccucgucgagguccucgucguc

SEQ ID NO: 1107901 - RNA, 17 nt, Mycobacterium bovis subsp bovis AF2122/97
ccucgucgaucgccgcg

SEQ ID NO: 1107902 - RNA, 19 nt, Mycobacterium bovis subsp bovis AF2122/97
ccucgucgaucgccgcgcc

SEQ ID NO: 1107903 - RNA, 20 nt, Mycobacterium bovis subsp bovis AF2122/97
ccucgucgaucgccgcgccg

SEQ ID NO: 1107904 - RNA, 19 nt, Mycobacterium bovis subsp bovis AF2122/97
ccucgucggucacgugguc

SEQ ID NO: 1107905 - RNA, 13 nt, Mycobacterium bovis subsp bovis AF2122/97
ccucgucggcguc

SEQ ID NO: 1107906 - RNA, 17 nt, Mycobacterium bovis subsp bovis AF2122/97
ccucgucggcgucgagc

SEQ ID NO: 1107907 - RNA, 17 nt, Mycobacterium bovis subsp bovis AF2122/97
ccucgucgccuagccgc

SEQ ID NO: 1107908 - RNA, 22 nt, Mycobacterium bovis subsp bovis AF2122/97
ccucgucgccuagccgcuccgc

SEQ ID NO: 1107909 - RNA, 17 nt, Mycobacterium bovis subsp bovis AF2122/97
ccucguuaucgaccgcc

SEQ ID NO: 1107910 - RNA, 16 nt, Mycobacterium bovis subsp bovis AF2122/97
ccucgucuucgucggu

SEQ ID NO: 1107911 - RNA, 15 nt, Mycobacterium bovis subsp bovis AF2122/97
ccucguugaccgggu

SEQ ID NO: 1107912 - RNA, 12 nt, Mycobacterium bovis subsp bovis AF2122/97
ccugaccggcuc

SEQ ID NO: 1107913 - RNA, 22 nt, Mycobacterium bovis subsp bovis AF2122/97
ccugaccggcucgccggcgcgc

SEQ ID NO: 1107914 - RNA, 23 nt, Mycobacterium bovis subsp bovis AF2122/97
ccucguugaccgggucgccgaug

SEQ ID NO: 1107915 - RNA, 21 nt, Mycobacterium bovis subsp bovis AF2122/97
ccucuaaaccaagaaucaccg

SEQ ID NO: 1107916 - RNA, 15 nt, Mycobacterium bovis subsp bovis AF2122/97
ccugagccucagugc

SEQ ID NO: 1107917 - RNA, 22 nt, Mycobacterium bovis subsp bovis AF2122/97
ccugagccucagugcgcacggu

SEQ ID NO: 1107918 - RNA, 18 nt, Mycobacterium bovis subsp bovis AF2122/97
ccugagcacguucaccgc

SEQ ID NO: 1107919 - RNA, 20 nt, Mycobacterium bovis subsp bovis AF2122/97
ccugagcacguucaccgcgc

SEQ ID NO: 1107920 - RNA, 19 nt, Mycobacterium bovis subsp bovis AF2122/97
ccugagaacacguucggcg

SEQ ID NO: 1107921 - RNA, 17 nt, Mycobacterium bovis subsp bovis AF2122/97
ccugacgccauucaucg

SEQ ID NO: 1107922 - RNA, 16 nt, Mycobacterium bovis subsp bovis AF2122/97
ccugacgccccgccac

SEQ ID NO: 1107923 - RNA, 21 nt, Mycobacterium bovis subsp bovis AF2122/97
ccugacgaucauugcacccac

SEQ ID NO: 1107924 - RNA, 21 nt, Mycobacterium bovis subsp bovis AF2122/97
ccugaccgguggccaucgcgc

SEQ ID NO: 1107925 - RNA, 22 nt, Mycobacterium bovis subsp bovis AF2122/97
ccugaccgguggccaucgcgcg

SEQ ID NO: 1107926 - RNA, 15 nt, Mycobacterium bovis subsp bovis AF2122/97
ccugacgcucggucg

SEQ ID NO: 1107927 - RNA, 16 nt, Mycobacterium bovis subsp bovis AF2122/97
ccugacgcucggucgc

SEQ ID NO: 1107928 - RNA, 13 nt, Mycobacterium bovis subsp bovis AF2122/97
ccugacgcucggu

SEQ ID NO: 1107929 - RNA, 13 nt, Mycobacterium bovis subsp bovis AF2122/97
ccugacgcgucag

SEQ ID NO: 1107930 - RNA, 22 nt, Mycobacterium bovis subsp bovis AF2122/97
ccugacgcgucagcggcgagca

SEQ ID NO: 1107931 - RNA, 13 nt, Mycobacterium bovis subsp bovis AF2122/97
ccugcacgccggc

SEQ ID NO: 1107932 - RNA, 19 nt, Mycobacterium bovis subsp bovis AF2122/97
ccugcacgacccgcugguc

SEQ ID NO: 1107933 - RNA, 19 nt, Mycobacterium bovis subsp bovis AF2122/97
ccugcacggugcccagggc

SEQ ID NO: 1107934 - RNA, 13 nt, Mycobacterium bovis subsp bovis AF2122/97
ccugcaccacggc

SEQ ID NO: 1107935 - RNA, 19 nt, Mycobacterium bovis subsp bovis AF2122/97
ccugcaccacggcggccac

SEQ ID NO: 1107936 - RNA, 13 nt, Mycobacterium bovis subsp bovis AF2122/97
ccugcaccagcga

SEQ ID NO: 1107937 - RNA, 20 nt, Mycobacterium bovis subsp bovis AF2122/97
ccugcaccgccgccgcccgu

SEQ ID NO: 1107938 - RNA, 15 nt, Mycobacterium bovis subsp bovis AF2122/97
ccugaggcaccucgg

SEQ ID NO: 1107939 - RNA, 16 nt, Mycobacterium bovis subsp bovis AF2122/97
ccugaggcaccucggc

SEQ ID NO: 1107940 - RNA, 20 nt, Mycobacterium bovis subsp bovis AF2122/97
ccugagccaccaacaccgcg

SEQ ID NO: 1107941 - RNA, 15 nt, Mycobacterium bovis subsp bovis AF2122/97
ccugagucggcauug

SEQ ID NO: 1107942 - RNA, 12 nt, Mycobacterium bovis subsp bovis AF2122/97
ccugagcggcca

SEQ ID NO: 1107943 - RNA, 16 nt, Mycobacterium bovis subsp bovis AF2122/97
ccugaguuccggucga

SEQ ID NO: 1107944 - RNA, 16 nt, Mycobacterium bovis subsp bovis AF2122/97
ccugaguugcggugug

SEQ ID NO: 1107945 - RNA, 17 nt, Mycobacterium bovis subsp bovis AF2122/97
ccugaguugcggugugc

SEQ ID NO: 1107946 - RNA, 18 nt, Mycobacterium bovis subsp bovis AF2122/97
ccugauaaagcccggcgg

SEQ ID NO: 1107947 - RNA, 19 nt, Mycobacterium bovis subsp bovis AF2122/97
ccugcaagcuaagcgccug

SEQ ID NO: 1107948 - RNA, 21 nt, Mycobacterium bovis subsp bovis AF2122/97
ccugcaagacaaagccgucga

SEQ ID NO: 1107949 - RNA, 17 nt, Mycobacterium bovis subsp bovis AF2122/97
ccugagcugccgagcgg

SEQ ID NO: 1107950 - RNA, 19 nt, Mycobacterium bovis subsp bovis AF2122/97
ccugcgccgacccgcgcgc

SEQ ID NO: 1107951 - RNA, 22 nt, Mycobacterium bovis subsp bovis AF2122/97
ccugcgccgacccgcgcgccgg

SEQ ID NO: 1107952 - RNA, 20 nt, Mycobacterium bovis subsp bovis AF2122/97
ccugcgccucggcggccagc

SEQ ID NO: 1107953 - RNA, 17 nt, Mycobacterium bovis subsp bovis AF2122/97
ccugcgccgccacagca

SEQ ID NO: 1107954 - RNA, 18 nt, Mycobacterium bovis subsp bovis AF2122/97
ccugcgccgccagcgccg

SEQ ID NO: 1107955 - RNA, 21 nt, Mycobacterium bovis subsp bovis AF2122/97
ccugcgccgccagcgccgccg

SEQ ID NO: 1107956 - RNA, 18 nt, Mycobacterium bovis subsp bovis AF2122/97
ccugcgcaucaccacugg

SEQ ID NO: 1107957 - RNA, 21 nt, Mycobacterium bovis subsp bovis AF2122/97
ccugcgacgagcccaccgucg

SEQ ID NO: 1107958 - RNA, 15 nt, Mycobacterium bovis subsp bovis AF2122/97
ccugcgccgacccgc

SEQ ID NO: 1107959 - RNA, 17 nt, Mycobacterium bovis subsp bovis AF2122/97
ccugcagcuuggcauug

SEQ ID NO: 1107960 - RNA, 20 nt, Mycobacterium bovis subsp bovis AF2122/97
ccugcgagacuuggugaucc

SEQ ID NO: 1107961 - RNA, 15 nt, Mycobacterium bovis subsp bovis AF2122/97
ccugcgacgagccca

SEQ ID NO: 1107962 - RNA, 14 nt, Mycobacterium bovis subsp bovis AF2122/97
ccugcgcagccgcc

SEQ ID NO: 1107963 - RNA, 21 nt, Mycobacterium bovis subsp bovis AF2122/97
ccugcgaagucgcauggcggc

SEQ ID NO: 1107964 - RNA, 17 nt, Mycobacterium bovis subsp bovis AF2122/97
ccugcgaauagccacca

SEQ ID NO: 1107965 - RNA, 15 nt, Mycobacterium bovis subsp bovis AF2122/97
ccugcaguacggcca

SEQ ID NO: 1107966 - RNA, 17 nt, Mycobacterium bovis subsp bovis AF2122/97
ccugcauaggcgcgguc

SEQ ID NO: 1107967 - RNA, 23 nt, Mycobacterium bovis subsp bovis AF2122/97
ccugcauaggcgcggucaccgcg

SEQ ID NO: 1107968 - RNA, 23 nt, Mycobacterium bovis subsp bovis AF2122/97
ccugcggcugcuuggucgcccag

SEQ ID NO: 1107969 - RNA, 19 nt, Mycobacterium bovis subsp bovis AF2122/97
ccugcgggaaguugcccag

SEQ ID NO: 1107970 - RNA, 21 nt, Mycobacterium bovis subsp bovis AF2122/97
ccugcggguaggugacgacgu

SEQ ID NO: 1107971 - RNA, 22 nt, Mycobacterium bovis subsp bovis AF2122/97
ccugcggguaggugacgacguc

SEQ ID NO: 1107972 - RNA, 16 nt, Mycobacterium bovis subsp bovis AF2122/97
ccugcgggugcgucga

SEQ ID NO: 1107973 - RNA, 22 nt, Mycobacterium bovis subsp bovis AF2122/97
ccugcggauagugguugcggcc

SEQ ID NO: 1107974 - RNA, 12 nt, Mycobacterium bovis subsp bovis AF2122/97
ccugcggccacg

SEQ ID NO: 1107975 - RNA, 14 nt, Mycobacterium bovis subsp bovis AF2122/97
ccugcggccacggu

SEQ ID NO: 1107976 - RNA, 15 nt, Mycobacterium bovis subsp bovis AF2122/97
ccugcggcaccgcug

SEQ ID NO: 1107977 - RNA, 23 nt, Mycobacterium bovis subsp bovis AF2122/97
ccugcgcggcgugcgcggugaug

SEQ ID NO: 1107978 - RNA, 17 nt, Mycobacterium bovis subsp bovis AF2122/97
ccugcgcggcgaucgcu

SEQ ID NO: 1107979 - RNA, 18 nt, Mycobacterium bovis subsp bovis AF2122/97
ccugcgcggcgaucgcuc

SEQ ID NO: 1107980 - RNA, 17 nt, Mycobacterium bovis subsp bovis AF2122/97
ccugcgcuguucggcac

SEQ ID NO: 1107981 - RNA, 13 nt, Mycobacterium bovis subsp bovis AF2122/97
ccugcgcgacggc

SEQ ID NO: 1107982 - RNA, 12 nt, Mycobacterium bovis subsp bovis AF2122/97
ccugcgcgaggu

SEQ ID NO: 1107983 - RNA, 13 nt, Mycobacterium bovis subsp bovis AF2122/97
ccugcgcggccac

SEQ ID NO: 1107984 - RNA, 19 nt, Mycobacterium bovis subsp bovis AF2122/97
ccugcugcaaccgacuucg

SEQ ID NO: 1107985 - RNA, 16 nt, Mycobacterium bovis subsp bovis AF2122/97
ccugcucgucggucac

SEQ ID NO: 1107986 - RNA, 21 nt, Mycobacterium bovis subsp bovis AF2122/97
ccugcugcagggccuggccac

SEQ ID NO: 1107987 - RNA, 15 nt, Mycobacterium bovis subsp bovis AF2122/97
ccugcuggccgcggc

SEQ ID NO: 1107988 - RNA, 21 nt, Mycobacterium bovis subsp bovis AF2122/97
ccugcuggcccaacaucaacg

SEQ ID NO: 1107989 - RNA, 18 nt, Mycobacterium bovis subsp bovis AF2122/97
ccugcugugggauucggg

SEQ ID NO: 1107990 - RNA, 16 nt, Mycobacterium bovis subsp bovis AF2122/97
ccugcuccaccgucga

SEQ ID NO: 1107991 - RNA, 19 nt, Mycobacterium bovis subsp bovis AF2122/97
ccugcuccaccgucgaacc

SEQ ID NO: 1107992 - RNA, 16 nt, Mycobacterium bovis subsp bovis AF2122/97
ccugcgguccgcugcc

SEQ ID NO: 1107993 - RNA, 15 nt, Mycobacterium bovis subsp bovis AF2122/97
ccugcucaaccagca

SEQ ID NO: 1107994 - RNA, 19 nt, Mycobacterium bovis subsp bovis AF2122/97
ccugcuagcagcagcccga

SEQ ID NO: 1107995 - RNA, 21 nt, Mycobacterium bovis subsp bovis AF2122/97
ccugcucggcgcgccggucgc

SEQ ID NO: 1107996 - RNA, 13 nt, Mycobacterium bovis subsp bovis AF2122/97
ccugcucgccguc

SEQ ID NO: 1107997 - RNA, 19 nt, Mycobacterium bovis subsp bovis AF2122/97
ccugcucgaccaugccguc

SEQ ID NO: 1107998 - RNA, 18 nt, Mycobacterium bovis subsp bovis AF2122/97
ccugcucgcacagcacca

SEQ ID NO: 1107999 - RNA, 16 nt, Mycobacterium bovis subsp bovis AF2122/97
ccugcucgcagcgggc

SEQ ID NO: 1108000 - RNA, 13 nt, Mycobacterium bovis subsp bovis AF2122/97
ccuggaguccagc

SEQ ID NO: 1108001 - RNA, 20 nt, Mycobacterium bovis subsp bovis AF2122/97
ccuggaucacacccacgucg

SEQ ID NO: 1108002 - RNA, 14 nt, Mycobacterium bovis subsp bovis AF2122/97
ccuggaucagccag

SEQ ID NO: 1108003 - RNA, 21 nt, Mycobacterium bovis subsp bovis AF2122/97
ccuggaccucguugcugccgg

SEQ ID NO: 1108004 - RNA, 17 nt, Mycobacterium bovis subsp bovis AF2122/97
ccuggacauaccggccc

SEQ ID NO: 1108005 - RNA, 13 nt, Mycobacterium bovis subsp bovis AF2122/97
ccugcuuguccgu

SEQ ID NO: 1108006 - RNA, 20 nt, Mycobacterium bovis subsp bovis AF2122/97
ccuggaaaggacggccggcc

SEQ ID NO: 1108007 - RNA, 21 nt, Mycobacterium bovis subsp bovis AF2122/97
ccuggaaagggccgccgcugg

SEQ ID NO: 1108008 - RNA, 19 nt, Mycobacterium bovis subsp bovis AF2122/97
ccuggaaccaaaccugggc

SEQ ID NO: 1108009 - RNA, 17 nt, Mycobacterium bovis subsp bovis AF2122/97
ccuggaagacggugcgg

SEQ ID NO: 1108010 - RNA, 13 nt, Mycobacterium bovis subsp bovis AF2122/97
ccugcuuggccac

SEQ ID NO: 1108011 - RNA, 12 nt, Mycobacterium bovis subsp bovis AF2122/97
ccgucgauuucg

SEQ ID NO: 1108012 - RNA, 22 nt, Mycobacterium bovis subsp bovis AF2122/97
ccgucgauguggcgcuccggcg

SEQ ID NO: 1108013 - RNA, 19 nt, Mycobacterium bovis subsp bovis AF2122/97
ccgucgauguugcccagca

SEQ ID NO: 1108014 - RNA, 17 nt, Mycobacterium bovis subsp bovis AF2122/97
ccgucgauggaccgcac

SEQ ID NO: 1108015 - RNA, 16 nt, Mycobacterium bovis subsp bovis AF2122/97
ccgucgauggucagca

SEQ ID NO: 1108016 - RNA, 11 nt, Mycobacterium bovis subsp bovis AF2122/97
ccgucgcagaa

SEQ ID NO: 1108017 - RNA, 12 nt, Mycobacterium bovis subsp bovis AF2122/97
ccgucgcagcca

SEQ ID NO: 1108018 - RNA, 14 nt, Mycobacterium bovis subsp bovis AF2122/97
ccgucgcagccagc

SEQ ID NO: 1108019 - RNA, 17 nt, Mycobacterium bovis subsp bovis AF2122/97
ccgucgaguccaggccg

SEQ ID NO: 1108020 - RNA, 20 nt, Mycobacterium bovis subsp bovis AF2122/97
ccgucgaguccaggccggca

SEQ ID NO: 1108021 - RNA, 19 nt, Mycobacterium bovis subsp bovis AF2122/97
ccgucgagguacacgccga

SEQ ID NO: 1108022 - RNA, 24 nt, Mycobacterium bovis subsp bovis AF2122/97
ccgucgaguagguaacgcgcacgc

SEQ ID NO: 1108023 - RNA, 15 nt, Mycobacterium bovis subsp bovis AF2122/97
ccgucgaguccaggc

SEQ ID NO: 1108024 - RNA, 19 nt, Mycobacterium bovis subsp bovis AF2122/97
ccgucgaucagcggcagca

SEQ ID NO: 1108025 - RNA, 19 nt, Mycobacterium bovis subsp bovis AF2122/97
ccgucgaguuccggccggu

SEQ ID NO: 1108026 - RNA, 17 nt, Mycobacterium bovis subsp bovis AF2122/97
ccgucgaugaccagcac

SEQ ID NO: 1108027 - RNA, 14 nt, Mycobacterium bovis subsp bovis AF2122/97
ccguccucgcuauu

SEQ ID NO: 1108028 - RNA, 22 nt, Mycobacterium bovis subsp bovis AF2122/97
ccgucgaguccaggccggcagc

SEQ ID NO: 1108029 - RNA, 15 nt, Mycobacterium bovis subsp bovis AF2122/97
ccgucgagucgccga

SEQ ID NO: 1108030 - RNA, 14 nt, Mycobacterium bovis subsp bovis AF2122/97
ccgucgccugccga

SEQ ID NO: 1108031 - RNA, 18 nt, Mycobacterium bovis subsp bovis AF2122/97
ccgucgcgacgucggccg

SEQ ID NO: 1108032 - RNA, 21 nt, Mycobacterium bovis subsp bovis AF2122/97
ccgucgccuccagcagguccg

SEQ ID NO: 1108033 - RNA, 22 nt, Mycobacterium bovis subsp bovis AF2122/97
ccgucgccuccagcagguccgc

SEQ ID NO: 1108034 - RNA, 20 nt, Mycobacterium bovis subsp bovis AF2122/97
ccgucgcgcgggcgagcgca

SEQ ID NO: 1108035 - RNA, 19 nt, Mycobacterium bovis subsp bovis AF2122/97
ccgucgccgcccuggccgc

SEQ ID NO: 1108036 - RNA, 14 nt, Mycobacterium bovis subsp bovis AF2122/97
ccgucgccgccggc

SEQ ID NO: 1108037 - RNA, 15 nt, Mycobacterium bovis subsp bovis AF2122/97
ccgucgccgccggcg

SEQ ID NO: 1108038 - RNA, 16 nt, Mycobacterium bovis subsp bovis AF2122/97
ccgucgccgccggcgc

SEQ ID NO: 1108039 - RNA, 23 nt, Mycobacterium bovis subsp bovis AF2122/97
ccgucgccgccggcgccgccggu

SEQ ID NO: 1108040 - RNA, 17 nt, Mycobacterium bovis subsp bovis AF2122/97
ccgucgccgccgucacc

SEQ ID NO: 1108041 - RNA, 14 nt, Mycobacterium bovis subsp bovis AF2122/97
ccgucgccgcccgu

SEQ ID NO: 1108042 - RNA, 18 nt, Mycobacterium bovis subsp bovis AF2122/97
ccgucgccgcccgugccg

SEQ ID NO: 1108043 - RNA, 22 nt, Mycobacterium bovis subsp bovis AF2122/97
ccgucgccgcccgugccgcccu

SEQ ID NO: 1108044 - RNA, 13 nt, Mycobacterium bovis subsp bovis AF2122/97
ccgucgccgcccu

SEQ ID NO: 1108045 - RNA, 21 nt, Mycobacterium bovis subsp bovis AF2122/97
ccgucgccgaucagcugcgca

SEQ ID NO: 1108046 - RNA, 12 nt, Mycobacterium bovis subsp bovis AF2122/97
ccgucgcccggg

SEQ ID NO: 1108047 - RNA, 18 nt, Mycobacterium bovis subsp bovis AF2122/97
ccgucgccaaucugcgcg

SEQ ID NO: 1108048 - RNA, 22 nt, Mycobacterium bovis subsp bovis AF2122/97
ccgucgggauggacggcagcca

SEQ ID NO: 1108049 - RNA, 14 nt, Mycobacterium bovis subsp bovis AF2122/97
ccgucggcguggcu

SEQ ID NO: 1108050 - RNA, 19 nt, Mycobacterium bovis subsp bovis AF2122/97
ccgucgggaccaccgaccg

SEQ ID NO: 1108051 - RNA, 24 nt, Mycobacterium bovis subsp bovis AF2122/97
ccgucgggauggacggcagccagc

SEQ ID NO: 1108052 - RNA, 18 nt, Mycobacterium bovis subsp bovis AF2122/97
ccgucgggcacaccgacg

SEQ ID NO: 1108053 - RNA, 21 nt, Mycobacterium bovis subsp bovis AF2122/97
ccgucgggcacaccgacgccg

SEQ ID NO: 1108054 - RNA, 22 nt, Mycobacterium bovis subsp bovis AF2122/97
ccgucggggaguucgcgcagca

SEQ ID NO: 1108055 - RNA, 19 nt, Mycobacterium bovis subsp bovis AF2122/97
ccgucggggacauccgcuu

SEQ ID NO: 1108056 - RNA, 12 nt, Mycobacterium bovis subsp bovis AF2122/97
ccgucgggugca

SEQ ID NO: 1108057 - RNA, 18 nt, Mycobacterium bovis subsp bovis AF2122/97
ccgucgggugcagcacgg

SEQ ID NO: 1108058 - RNA, 19 nt, Mycobacterium bovis subsp bovis AF2122/97
ccgucgguaaagggcucga

SEQ ID NO: 1108059 - RNA, 14 nt, Mycobacterium bovis subsp bovis AF2122/97
ccgucggggucggg

SEQ ID NO: 1108060 - RNA, 18 nt, Mycobacterium bovis subsp bovis AF2122/97
ccgucggggaugccgaac

SEQ ID NO: 1108061 - RNA, 13 nt, Mycobacterium bovis subsp bovis AF2122/97
ccgucggugaugg

SEQ ID NO: 1108062 - RNA, 19 nt, Mycobacterium bovis subsp bovis AF2122/97
ccgucggugauggagccgg

SEQ ID NO: 1108063 - RNA, 22 nt, Mycobacterium bovis subsp bovis AF2122/97
ccgucggugauggagccgguga

SEQ ID NO: 1108064 - RNA, 14 nt, Mycobacterium bovis subsp bovis AF2122/97
ccgucggugccgcc

SEQ ID NO: 1108065 - RNA, 15 nt, Mycobacterium bovis subsp bovis AF2122/97
ccgucggugccgccg

SEQ ID NO: 1108066 - RNA, 18 nt, Mycobacterium bovis subsp bovis AF2122/97
ccgucggugccgccgccg

SEQ ID NO: 1108067 - RNA, 14 nt, Mycobacterium bovis subsp bovis AF2122/97
ccgucggugccggg

SEQ ID NO: 1108068 - RNA, 21 nt, Mycobacterium bovis subsp bovis AF2122/97
ccgucggugccggggcugccg

SEQ ID NO: 1108069 - RNA, 21 nt, Mycobacterium bovis subsp bovis AF2122/97
ccgucggugggugccagccgg

SEQ ID NO: 1108070 - RNA, 22 nt, Mycobacterium bovis subsp bovis AF2122/97
ccgucggugaaauucgcggcgg

SEQ ID NO: 1108071 - RNA, 18 nt, Mycobacterium bovis subsp bovis AF2122/97
ccgucggguaggccgccg

SEQ ID NO: 1108072 - RNA, 22 nt, Mycobacterium bovis subsp bovis AF2122/97
ccgucgguaaagggcucgaugg

SEQ ID NO: 1108073 - RNA, 19 nt, Mycobacterium bovis subsp bovis AF2122/97
ccgucggcgugacgucguc

SEQ ID NO: 1108074 - RNA, 19 nt, Mycobacterium bovis subsp bovis AF2122/97
ccgucggcgugcagcagcu

SEQ ID NO: 1108075 - RNA, 20 nt, Mycobacterium bovis subsp bovis AF2122/97
ccgucggcgugcagcagcuu

SEQ ID NO: 1108076 - RNA, 14 nt, Mycobacterium bovis subsp bovis AF2122/97
ccgucggcggcguu

SEQ ID NO: 1108077 - RNA, 21 nt, Mycobacterium bovis subsp bovis AF2122/97
ccgucggauggaaggcggcca

SEQ ID NO: 1108078 - RNA, 18 nt, Mycobacterium bovis subsp bovis AF2122/97
ccgucggcaccagcagcc

SEQ ID NO: 1108079 - RNA, 19 nt, Mycobacterium bovis subsp bovis AF2122/97
ccgucggcaccagcagcca

SEQ ID NO: 1108080 - RNA, 23 nt, Mycobacterium bovis subsp bovis AF2122/97
ccgucggcaccagcagccagccc

SEQ ID NO: 1108081 - RNA, 14 nt, Mycobacterium bovis subsp bovis AF2122/97
ccgucggcagcagc

SEQ ID NO: 1108082 - RNA, 14 nt, Mycobacterium bovis subsp bovis AF2122/97
ccgucggcaccagc

SEQ ID NO: 1108083 - RNA, 16 nt, Mycobacterium bovis subsp bovis AF2122/97
ccgucggauggaaggc

SEQ ID NO: 1108084 - RNA, 19 nt, Mycobacterium bovis subsp bovis AF2122/97
ccgucgcggccggcggccg

SEQ ID NO: 1108085 - RNA, 18 nt, Mycobacterium bovis subsp bovis AF2122/97
ccgucgcggcggcacuac

SEQ ID NO: 1108086 - RNA, 15 nt, Mycobacterium bovis subsp bovis AF2122/97
ccgucggagaccagc

SEQ ID NO: 1108087 - RNA, 17 nt, Mycobacterium bovis subsp bovis AF2122/97
ccgucggagaccagcuc

SEQ ID NO: 1108088 - RNA, 14 nt, Mycobacterium bovis subsp bovis AF2122/97
ccgucgcgucgacc

SEQ ID NO: 1108089 - RNA, 14 nt, Mycobacterium bovis subsp bovis AF2122/97
ccgucgcuagggug

SEQ ID NO: 1108090 - RNA, 17 nt, Mycobacterium bovis subsp bovis AF2122/97
ccgucgcugcccgcgcg

SEQ ID NO: 1108091 - RNA, 19 nt, Mycobacterium bovis subsp bovis AF2122/97
ccgucgcugcccgcgcggc

SEQ ID NO: 1108092 - RNA, 12 nt, Mycobacterium bovis subsp bovis AF2122/97
ccgucgcuggcc

SEQ ID NO: 1108093 - RNA, 15 nt, Mycobacterium bovis subsp bovis AF2122/97
ccgucgcuggccggc

SEQ ID NO: 1108094 - RNA, 17 nt, Mycobacterium bovis subsp bovis AF2122/97
ccgucgcuggccggcac

SEQ ID NO: 1108095 - RNA, 18 nt, Mycobacterium bovis subsp bovis AF2122/97
ccgucgcuggccggcacc

SEQ ID NO: 1108096 - RNA, 21 nt, Mycobacterium bovis subsp bovis AF2122/97
ccgucgcuggccggcaccgug

SEQ ID NO: 1108097 - RNA, 15 nt, Mycobacterium bovis subsp bovis AF2122/97
ccgucgcugguggcg

SEQ ID NO: 1108098 - RNA, 20 nt, Mycobacterium bovis subsp bovis AF2122/97
ccgucgcugguggcggucac

SEQ ID NO: 1108099 - RNA, 18 nt, Mycobacterium bovis subsp bovis AF2122/97
ccgucgcgggacaacagc

SEQ ID NO: 1108100 - RNA, 17 nt, Mycobacterium bovis subsp bovis AF2122/97
ccgucgcgcucgcacca

SEQ ID NO: 1108101 - RNA, 15 nt, Mycobacterium bovis subsp bovis AF2122/97
ccgucgcgcugccgg

SEQ ID NO: 1108102 - RNA, 16 nt, Mycobacterium bovis subsp bovis AF2122/97
ccgucgcgcugccggc

SEQ ID NO: 1108103 - RNA, 18 nt, Mycobacterium bovis subsp bovis AF2122/97
ccgucgcgcugccggccg

SEQ ID NO: 1108104 - RNA, 17 nt, Mycobacterium bovis subsp bovis AF2122/97
ccgugcgggccggucgu

SEQ ID NO: 1108105 - RNA, 23 nt, Mycobacterium bovis subsp bovis AF2122/97
ccguggcggggaaaccggccagc

SEQ ID NO: 1108106 - RNA, 20 nt, Mycobacterium bovis subsp bovis AF2122/97
ccgugggugucgguggccgc

SEQ ID NO: 1108107 - RNA, 20 nt, Mycobacterium bovis subsp bovis AF2122/97
ccgugggguaucgccagcca

SEQ ID NO: 1108108 - RNA, 10 nt, Mycobacterium bovis subsp bovis AF2122/97
ccguggucga

SEQ ID NO: 1108109 - RNA, 15 nt, Mycobacterium bovis subsp bovis AF2122/97
ccguggucgagggcg

SEQ ID NO: 1108110 - RNA, 18 nt, Mycobacterium bovis subsp bovis AF2122/97
ccguggugcuagcgccgc

SEQ ID NO: 1108111 - RNA, 20 nt, Mycobacterium bovis subsp bovis AF2122/97
ccgugguggacgaccgcgcg

SEQ ID NO: 1108112 - RNA, 22 nt, Mycobacterium bovis subsp bovis AF2122/97
ccgugguggacgaccgcgcggc

SEQ ID NO: 1108113 - RNA, 19 nt, Mycobacterium bovis subsp bovis AF2122/97
ccgugguggacgaugcggu

SEQ ID NO: 1108114 - RNA, 19 nt, Mycobacterium bovis subsp bovis AF2122/97
ccgugcggcggcugccggu

SEQ ID NO: 1108115 - RNA, 15 nt, Mycobacterium bovis subsp bovis AF2122/97
ccgugcgcgcgcagc

SEQ ID NO: 1108116 - RNA, 16 nt, Mycobacterium bovis subsp bovis AF2122/97
ccgugcgcgcgcagcu

SEQ ID NO: 1108117 - RNA, 18 nt, Mycobacterium bovis subsp bovis AF2122/97
ccgugccucgaggacggc

SEQ ID NO: 1108118 - RNA, 15 nt, Mycobacterium bovis subsp bovis AF2122/97
ccgugccuggccggu

SEQ ID NO: 1108119 - RNA, 17 nt, Mycobacterium bovis subsp bovis AF2122/97
ccgugcgaucaccuccg

SEQ ID NO: 1108120 - RNA, 22 nt, Mycobacterium bovis subsp bovis AF2122/97
ccgugcgaucaccuccgcgacg

SEQ ID NO: 1108121 - RNA, 12 nt, Mycobacterium bovis subsp bovis AF2122/97
ccgucuccggcg

SEQ ID NO: 1108122 - RNA, 20 nt, Mycobacterium bovis subsp bovis AF2122/97
ccgucuccuggucaaccgcg

SEQ ID NO: 1108123 - RNA, 12 nt, Mycobacterium bovis subsp bovis AF2122/97
ccgucucgacac

SEQ ID NO: 1108124 - RNA, 22 nt, Mycobacterium bovis subsp bovis AF2122/97
ccgugacguagggcagcgccag

SEQ ID NO: 1108125 - RNA, 15 nt, Mycobacterium bovis subsp bovis AF2122/97
ccgucguacucggcg

SEQ ID NO: 1108126 - RNA, 17 nt, Mycobacterium bovis subsp bovis AF2122/97
ccgucguacucggcggc

SEQ ID NO: 1108127 - RNA, 20 nt, Mycobacterium bovis subsp bovis AF2122/97
ccgucguacucggcggccac

SEQ ID NO: 1108128 - RNA, 18 nt, Mycobacterium bovis subsp bovis AF2122/97
ccgucgugcgugcggcga

SEQ ID NO: 1108129 - RNA, 16 nt, Mycobacterium bovis subsp bovis AF2122/97
ccgucgggcccagccg

SEQ ID NO: 1108130 - RNA, 23 nt, Mycobacterium bovis subsp bovis AF2122/97
ccgucggugguuuucccgucgcc

SEQ ID NO: 1108131 - RNA, 16 nt, Mycobacterium bovis subsp bovis AF2122/97
ccgucgugaccgaccg

SEQ ID NO: 1108132 - RNA, 19 nt, Mycobacterium bovis subsp bovis AF2122/97
ccgucgugaucggcgaacc

SEQ ID NO: 1108133 - RNA, 18 nt, Mycobacterium bovis subsp bovis AF2122/97
ccgucguggcgguggccg

SEQ ID NO: 1108134 - RNA, 24 nt, Mycobacterium bovis subsp bovis AF2122/97
ccgucguggcgguggccgucgggu

SEQ ID NO: 1108135 - RNA, 21 nt, Mycobacterium bovis subsp bovis AF2122/97
ccgucguugcccgacccgccg

SEQ ID NO: 1108136 - RNA, 14 nt, Mycobacterium bovis subsp bovis AF2122/97
ccgucguugccggc

SEQ ID NO: 1108137 - RNA, 19 nt, Mycobacterium bovis subsp bovis AF2122/97
ccgucguuaagacggcgac

SEQ ID NO: 1108138 - RNA, 20 nt, Mycobacterium bovis subsp bovis AF2122/97
ccgucguuaagacggcgacg

SEQ ID NO: 1108139 - RNA, 23 nt, Mycobacterium bovis subsp bovis AF2122/97
ccgucguuaagacggcgacgaca

SEQ ID NO: 1108140 - RNA, 18 nt, Mycobacterium bovis subsp bovis AF2122/97
ccgugaguacucggucaa

SEQ ID NO: 1108141 - RNA, 22 nt, Mycobacterium bovis subsp bovis AF2122/97
ccgugaguagguccacguucgg

SEQ ID NO: 1108142 - RNA, 18 nt, Mycobacterium bovis subsp bovis AF2122/97
ccgugaguucacguucgg

SEQ ID NO: 1108143 - RNA, 17 nt, Mycobacterium bovis subsp bovis AF2122/97
ccgugagccggaccggc

SEQ ID NO: 1108144 - RNA, 14 nt, Mycobacterium bovis subsp bovis AF2122/97
ccgugaucggcgcc

SEQ ID NO: 1108145 - RNA, 17 nt, Mycobacterium bovis subsp bovis AF2122/97
ccgugaucgaggcggcg

SEQ ID NO: 1108146 - RNA, 19 nt, Mycobacterium bovis subsp bovis AF2122/97
ccgugaucgaggcggcggu

SEQ ID NO: 1108147 - RNA, 16 nt, Mycobacterium bovis subsp bovis AF2122/97
ccgugaucggcgcccg

SEQ ID NO: 1108148 - RNA, 18 nt, Mycobacterium bovis subsp bovis AF2122/97
ccgugaucggcgcccggg

SEQ ID NO: 1108149 - RNA, 17 nt, Mycobacterium bovis subsp bovis AF2122/97
ccgugauccgccgacag

SEQ ID NO: 1108150 - RNA, 23 nt, Mycobacterium bovis subsp bovis AF2122/97
ccgugauaucagagggccgcggu

SEQ ID NO: 1108151 - RNA, 16 nt, Mycobacterium bovis subsp bovis AF2122/97
ccgugaucaccacgaa

SEQ ID NO: 1108152 - RNA, 21 nt, Mycobacterium bovis subsp bovis AF2122/97
ccgugaucagcucgcgcacgu

SEQ ID NO: 1108153 - RNA, 12 nt, Mycobacterium bovis subsp bovis AF2122/97
ccgugcaccagc

SEQ ID NO: 1108154 - RNA, 16 nt, Mycobacterium bovis subsp bovis AF2122/97
ccgugcaccagcgacc

SEQ ID NO: 1108155 - RNA, 19 nt, Mycobacterium bovis subsp bovis AF2122/97
ccgugcaccagcucacccg

SEQ ID NO: 1108156 - RNA, 20 nt, Mycobacterium bovis subsp bovis AF2122/97
ccgugcaccagcucacccgg

SEQ ID NO: 1108157 - RNA, 16 nt, Mycobacterium bovis subsp bovis AF2122/97
ccgugcacgucagcgg

SEQ ID NO: 1108158 - RNA, 20 nt, Mycobacterium bovis subsp bovis AF2122/97
ccgugcacgaucgcggugac

SEQ ID NO: 1108159 - RNA, 23 nt, Mycobacterium bovis subsp bovis AF2122/97
ccgugauggcguuugccggccga

SEQ ID NO: 1108160 - RNA, 19 nt, Mycobacterium bovis subsp bovis AF2122/97
ccgugaugucccgcaaaau

SEQ ID NO: 1108161 - RNA, 19 nt, Mycobacterium bovis subsp bovis AF2122/97
ccguugcccgacucggccg

SEQ ID NO: 1108162 - RNA, 20 nt, Mycobacterium bovis subsp bovis AF2122/97
ccguugccaccggugccggc

SEQ ID NO: 1108163 - RNA, 20 nt, Mycobacterium bovis subsp bovis AF2122/97
ccguugcccgacucggccgu

SEQ ID NO: 1108164 - RNA, 21 nt, Mycobacterium bovis subsp bovis AF2122/97
ccguugccauugccucccgcg

SEQ ID NO: 1108165 - RNA, 19 nt, Mycobacterium bovis subsp bovis AF2122/97
ccguugcccccauugccgc

SEQ ID NO: 1108166 - RNA, 18 nt, Mycobacterium bovis subsp bovis AF2122/97
ccguugccgccggcgccg

SEQ ID NO: 1108167 - RNA, 14 nt, Mycobacterium bovis subsp bovis AF2122/97
ccguugccgccggu

SEQ ID NO: 1108168 - RNA, 14 nt, Mycobacterium bovis subsp bovis AF2122/97
ccguugccgccguc

SEQ ID NO: 1108169 - RNA, 18 nt, Mycobacterium bovis subsp bovis AF2122/97
ccguugccgccgucgccg

SEQ ID NO: 1108170 - RNA, 21 nt, Mycobacterium bovis subsp bovis AF2122/97
ccguugccgccguugccgauc

SEQ ID NO: 1108171 - RNA, 20 nt, Mycobacterium bovis subsp bovis AF2122/97
ccguugccgccguugccggc

SEQ ID NO: 1108172 - RNA, 21 nt, Mycobacterium bovis subsp bovis AF2122/97
ccguugccgccugucccgccg

SEQ ID NO: 1108173 - RNA, 12 nt, Mycobacterium bovis subsp bovis AF2122/97
ccguugccgccg

SEQ ID NO: 1108174 - RNA, 23 nt, Mycobacterium bovis subsp bovis AF2122/97
ccguugccgauggugauggggga

SEQ ID NO: 1108175 - RNA, 14 nt, Mycobacterium bovis subsp bovis AF2122/97
ccguugccgccacg

SEQ ID NO: 1108176 - RNA, 15 nt, Mycobacterium bovis subsp bovis AF2122/97
ccguugccgcccacg

SEQ ID NO: 1108177 - RNA, 13 nt, Mycobacterium bovis subsp bovis AF2122/97
ccguugccgauca

SEQ ID NO: 1108178 - RNA, 16 nt, Mycobacterium bovis subsp bovis AF2122/97
ccguugaugucggcag

SEQ ID NO: 1108179 - RNA, 15 nt, Mycobacterium bovis subsp bovis AF2122/97
ccguugauucggccg

SEQ ID NO: 1108180 - RNA, 16 nt, Mycobacterium bovis subsp bovis AF2122/97
ccguugaugccgccgg

SEQ ID NO: 1108181 - RNA, 17 nt, Mycobacterium bovis subsp bovis AF2122/97
ccguugaugccgccgga

SEQ ID NO: 1108182 - RNA, 19 nt, Mycobacterium bovis subsp bovis AF2122/97
ccguugaucaagaaggcca

SEQ ID NO: 1108183 - RNA, 20 nt, Mycobacterium bovis subsp bovis AF2122/97
ccguugaccucuucgggcag

SEQ ID NO: 1108184 - RNA, 14 nt, Mycobacterium bovis subsp bovis AF2122/97
ccguugagcagcac

SEQ ID NO: 1108185 - RNA, 22 nt, Mycobacterium bovis subsp bovis AF2122/97
ccguugaggaacuccgcgaucc

SEQ ID NO: 1108186 - RNA, 15 nt, Mycobacterium bovis subsp bovis AF2122/97
ccguucugucccggc

SEQ ID NO: 1108187 - RNA, 21 nt, Mycobacterium bovis subsp bovis AF2122/97
ccguucugucccggcgcgcca

SEQ ID NO: 1108188 - RNA, 17 nt, Mycobacterium bovis subsp bovis AF2122/97
ccguucgugagcggcca

SEQ ID NO: 1108189 - RNA, 19 nt, Mycobacterium bovis subsp bovis AF2122/97
ccguucguucccgcucggg

SEQ ID NO: 1108190 - RNA, 14 nt, Mycobacterium bovis subsp bovis AF2122/97
ccguguccgccgga

SEQ ID NO: 1108191 - RNA, 18 nt, Mycobacterium bovis subsp bovis AF2122/97
ccgugguugcacguucgg

SEQ ID NO: 1108192 - RNA, 14 nt, Mycobacterium bovis subsp bovis AF2122/97
ccgugucgacgguc

SEQ ID NO: 1108193 - RNA, 22 nt, Mycobacterium bovis subsp bovis AF2122/97
ccgugguugcacguucggcgug

SEQ ID NO: 1108194 - RNA, 20 nt, Mycobacterium bovis subsp bovis AF2122/97
ccgugucgcagaucaggacg

SEQ ID NO: 1108195 - RNA, 14 nt, Mycobacterium bovis subsp bovis AF2122/97
ccguucggcgcccg

SEQ ID NO: 1108196 - RNA, 17 nt, Mycobacterium bovis subsp bovis AF2122/97
ccguucggcgcccgcuc

SEQ ID NO: 1108197 - RNA, 14 nt, Mycobacterium bovis subsp bovis AF2122/97
ccguucggcugccg

SEQ ID NO: 1108198 - RNA, 20 nt, Mycobacterium bovis subsp bovis AF2122/97
ccguucggggccccgcggcg

SEQ ID NO: 1108199 - RNA, 21 nt, Mycobacterium bovis subsp bovis AF2122/97
ccguggugaucaaacuaccga

SEQ ID NO: 1108200 - RNA, 17 nt, Mycobacterium bovis subsp bovis AF2122/97
ccgugucaaccggucgg

SEQ ID NO: 1108201 - RNA, 13 nt, Mycobacterium bovis subsp bovis AF2122/97
ccgugucaccgcc

SEQ ID NO: 1108202 - RNA, 14 nt, Mycobacterium bovis subsp bovis AF2122/97
ccgugucaccgccg

SEQ ID NO: 1108203 - RNA, 15 nt, Mycobacterium bovis subsp bovis AF2122/97
ccgugucaccgccgg

SEQ ID NO: 1108204 - RNA, 17 nt, Mycobacterium bovis subsp bovis AF2122/97
ccgugucaccgccggga

SEQ ID NO: 1108205 - RNA, 13 nt, Mycobacterium bovis subsp bovis AF2122/97
ccgugucaccggg

SEQ ID NO: 1108206 - RNA, 14 nt, Mycobacterium bovis subsp bovis AF2122/97
ccguuggcgguggu

SEQ ID NO: 1108207 - RNA, 16 nt, Mycobacterium bovis subsp bovis AF2122/97
ccguugggccaccggc

SEQ ID NO: 1108208 - RNA, 16 nt, Mycobacterium bovis subsp bovis AF2122/97
ccguugggccgacugg

SEQ ID NO: 1108209 - RNA, 15 nt, Mycobacterium bovis subsp bovis AF2122/97
ccguugggccgcgcc

SEQ ID NO: 1108210 - RNA, 17 nt, Mycobacterium bovis subsp bovis AF2122/97
ccguuggggccguucaa

SEQ ID NO: 1108211 - RNA, 22 nt, Mycobacterium bovis subsp bovis AF2122/97
ccguuggugaggccccccgcgc

SEQ ID NO: 1108212 - RNA, 15 nt, Mycobacterium bovis subsp bovis AF2122/97
ccguuggugccgccu

SEQ ID NO: 1108213 - RNA, 17 nt, Mycobacterium bovis subsp bovis AF2122/97
ccguugcgaucgcgugc

SEQ ID NO: 1108214 - RNA, 14 nt, Mycobacterium bovis subsp bovis AF2122/97
ccguugcgcaagcu

SEQ ID NO: 1108215 - RNA, 18 nt, Mycobacterium bovis subsp bovis AF2122/97
ccguugccguacagcccg

SEQ ID NO: 1108216 - RNA, 21 nt, Mycobacterium bovis subsp bovis AF2122/97
ccguugccggcguugccgccg

SEQ ID NO: 1108217 - RNA, 16 nt, Mycobacterium bovis subsp bovis AF2122/97
ccguugccgccggcgc

SEQ ID NO: 1108218 - RNA, 15 nt, Mycobacterium bovis subsp bovis AF2122/97
ccguugccgccggcg

SEQ ID NO: 1108219 - RNA, 23 nt, Mycobacterium bovis subsp bovis AF2122/97
ccguugccggcguugccgccguc

SEQ ID NO: 1108220 - RNA, 13 nt, Mycobacterium bovis subsp bovis AF2122/97
ccguuguugagga

SEQ ID NO: 1108221 - RNA, 23 nt, Mycobacterium bovis subsp bovis AF2122/97
ccguugcuauucgccagcgccgg

SEQ ID NO: 1108222 - RNA, 18 nt, Mycobacterium bovis subsp bovis AF2122/97
ccguuguccagcgcgacg

SEQ ID NO: 1108223 - RNA, 20 nt, Mycobacterium bovis subsp bovis AF2122/97
ccguuucgccggcgcgccgg

SEQ ID NO: 1108224 - RNA, 15 nt, Mycobacterium bovis subsp bovis AF2122/97
ccguuugggcgccgg

SEQ ID NO: 1108225 - RNA, 13 nt, Mycobacterium bovis subsp bovis AF2122/97
ccguuucggcgcc

SEQ ID NO: 1108226 - RNA, 16 nt, Mycobacterium bovis subsp bovis AF2122/97
ccguuucggcgccguc

SEQ ID NO: 1108227 - RNA, 22 nt, Mycobacterium bovis subsp bovis AF2122/97
ccguuucgggaagucgggccgg

SEQ ID NO: 1108228 - RNA, 21 nt, Mycobacterium bovis subsp bovis AF2122/97
ccguuuggccucacccgguca

SEQ ID NO: 1108229 - RNA, 12 nt, Mycobacterium bovis subsp bovis AF2122/97
ccuaaacaccgc

SEQ ID NO: 1108230 - RNA, 15 nt, Mycobacterium bovis subsp bovis AF2122/97
ccuaaacccgugcgg

SEQ ID NO: 1108231 - RNA, 22 nt, Mycobacterium bovis subsp bovis AF2122/97
ccucccaccagcggcggcccuu

SEQ ID NO: 1108232 - RNA, 21 nt, Mycobacterium bovis subsp bovis AF2122/97
ccuccagugcggccuuggcga

SEQ ID NO: 1108233 - RNA, 20 nt, Mycobacterium bovis subsp bovis AF2122/97
ccuccagggcccugcuggcc

SEQ ID NO: 1108234 - RNA, 21 nt, Mycobacterium bovis subsp bovis AF2122/97
ccucccgcaaugcgagcgcgc

SEQ ID NO: 1108235 - RNA, 14 nt, Mycobacterium bovis subsp bovis AF2122/97
ccucccacgccgcc

SEQ ID NO: 1108236 - RNA, 17 nt, Mycobacterium bovis subsp bovis AF2122/97
ccucccacucacccagc

SEQ ID NO: 1108237 - RNA, 20 nt, Mycobacterium bovis subsp bovis AF2122/97
ccucccauucccaacacagc

SEQ ID NO: 1108238 - RNA, 15 nt, Mycobacterium bovis subsp bovis AF2122/97
ccucccuuccgcgcu

SEQ ID NO: 1108239 - RNA, 18 nt, Mycobacterium bovis subsp bovis AF2122/97
ccucgaaaccguggccau

SEQ ID NO: 1108240 - RNA, 20 nt, Mycobacterium bovis subsp bovis AF2122/97
ccuccgcaaucgcgacgggg

SEQ ID NO: 1108241 - RNA, 17 nt, Mycobacterium bovis subsp bovis AF2122/97
ccuccuugagccgggca

SEQ ID NO: 1108242 - RNA, 13 nt, Mycobacterium bovis subsp bovis AF2122/97
ccucccgggccgc

SEQ ID NO: 1108243 - RNA, 14 nt, Mycobacterium bovis subsp bovis AF2122/97
ccucccgggccgcc

SEQ ID NO: 1108244 - RNA, 17 nt, Mycobacterium bovis subsp bovis AF2122/97
ccuccgacggccgcggc

SEQ ID NO: 1108245 - RNA, 22 nt, Mycobacterium bovis subsp bovis AF2122/97
ccuccgacgggacaaggucauc

SEQ ID NO: 1108246 - RNA, 13 nt, Mycobacterium bovis subsp bovis AF2122/97
ccuccgacgugcc

SEQ ID NO: 1108247 - RNA, 18 nt, Mycobacterium bovis subsp bovis AF2122/97
ccuccgacuaacggugcg

SEQ ID NO: 1108248 - RNA, 12 nt, Mycobacterium bovis subsp bovis AF2122/97
ccuccgaucacg

SEQ ID NO: 1108249 - RNA, 13 nt, Mycobacterium bovis subsp bovis AF2122/97
ccuccgaucacgc

SEQ ID NO: 1108250 - RNA, 17 nt, Mycobacterium bovis subsp bovis AF2122/97
ccuccgcaaucgcgacg

SEQ ID NO: 1108251 - RNA, 15 nt, Mycobacterium bovis subsp bovis AF2122/97
ccuccagcagguccg

SEQ ID NO: 1108252 - RNA, 17 nt, Mycobacterium bovis subsp bovis AF2122/97
ccuccagcacccggucg

SEQ ID NO: 1108253 - RNA, 18 nt, Mycobacterium bovis subsp bovis AF2122/97
ccuccagcagguccgcgg

SEQ ID NO: 1108254 - RNA, 20 nt, Mycobacterium bovis subsp bovis AF2122/97
ccuccacuuuuccgccggcc

SEQ ID NO: 1108255 - RNA, 14 nt, Mycobacterium bovis subsp bovis AF2122/97
ccuccagagacagc

SEQ ID NO: 1108256 - RNA, 15 nt, Mycobacterium bovis subsp bovis AF2122/97
ccucacugcggcgcc

SEQ ID NO: 1108257 - RNA, 16 nt, Mycobacterium bovis subsp bovis AF2122/97
ccuaugggaccggcaa

SEQ ID NO: 1108258 - RNA, 17 nt, Mycobacterium bovis subsp bovis AF2122/97
ccuaucugccgguaccg

SEQ ID NO: 1108259 - RNA, 16 nt, Mycobacterium bovis subsp bovis AF2122/97
ccucacccacccgcgg

SEQ ID NO: 1108260 - RNA, 18 nt, Mycobacterium bovis subsp bovis AF2122/97
ccucaccgccgcuaccgc

SEQ ID NO: 1108261 - RNA, 17 nt, Mycobacterium bovis subsp bovis AF2122/97
ccucacaugcccggacg

SEQ ID NO: 1108262 - RNA, 16 nt, Mycobacterium bovis subsp bovis AF2122/97
ccucaaggucggccag

SEQ ID NO: 1108263 - RNA, 18 nt, Mycobacterium bovis subsp bovis AF2122/97
ccucaauuggcucggcgu

SEQ ID NO: 1108264 - RNA, 14 nt, Mycobacterium bovis subsp bovis AF2122/97
ccuaacccgcaccg

SEQ ID NO: 1108265 - RNA, 15 nt, Mycobacterium bovis subsp bovis AF2122/97
ccuaacccgcgccgg

SEQ ID NO: 1108266 - RNA, 17 nt, Mycobacterium bovis subsp bovis AF2122/97
ccuaacccgcgccggcc

SEQ ID NO: 1108267 - RNA, 19 nt, Mycobacterium bovis subsp bovis AF2122/97
ccuaaggcucaccaggcga

SEQ ID NO: 1108268 - RNA, 17 nt, Mycobacterium bovis subsp bovis AF2122/97
ccuaauucggggccgcg

SEQ ID NO: 1108269 - RNA, 19 nt, Mycobacterium bovis subsp bovis AF2122/97
cgccccgaggaugccgaac

SEQ ID NO: 1108270 - RNA, 13 nt, Mycobacterium bovis subsp bovis AF2122/97
cgccccgaucggc

SEQ ID NO: 1108271 - RNA, 15 nt, Mycobacterium bovis subsp bovis AF2122/97
cgccccgaucggcca

SEQ ID NO: 1108272 - RNA, 15 nt, Mycobacterium bovis subsp bovis AF2122/97
cgccccgaugaccgc

SEQ ID NO: 1108273 - RNA, 17 nt, Mycobacterium bovis subsp bovis AF2122/97
cgccccgaugaccgccu

SEQ ID NO: 1108274 - RNA, 19 nt, Mycobacterium bovis subsp bovis AF2122/97
cgcccccguuuacggcccg

SEQ ID NO: 1108275 - RNA, 18 nt, Mycobacterium bovis subsp bovis AF2122/97
cgcccccgccauugccgc

SEQ ID NO: 1108276 - RNA, 12 nt, Mycobacterium bovis subsp bovis AF2122/97
cgcccccggcac

SEQ ID NO: 1108277 - RNA, 15 nt, Mycobacterium bovis subsp bovis AF2122/97
cgccaugccgggaac

SEQ ID NO: 1108278 - RNA, 20 nt, Mycobacterium bovis subsp bovis AF2122/97
cgccaugcccgcacgcucgg

SEQ ID NO: 1108279 - RNA, 23 nt, Mycobacterium bovis subsp bovis AF2122/97
cgccaugcccgcacgcucggcgg

SEQ ID NO: 1108280 - RNA, 18 nt, Mycobacterium bovis subsp bovis AF2122/97
cgccaucuucgggccgac

SEQ ID NO: 1108281 - RNA, 13 nt, Mycobacterium bovis subsp bovis AF2122/97
cgccccggcggcg

SEQ ID NO: 1108282 - RNA, 20 nt, Mycobacterium bovis subsp bovis AF2122/97
cgcccgacggaguucgacgu

SEQ ID NO: 1108283 - RNA, 17 nt, Mycobacterium bovis subsp bovis AF2122/97
cgcccgacgccagcugc

SEQ ID NO: 1108284 - RNA, 21 nt, Mycobacterium bovis subsp bovis AF2122/97
cgcccgacgaacagcggucca

SEQ ID NO: 1108285 - RNA, 22 nt, Mycobacterium bovis subsp bovis AF2122/97
cgcccgacgagauugccgggcc

SEQ ID NO: 1108286 - RNA, 13 nt, Mycobacterium bovis subsp bovis AF2122/97
cgccccggccagg

SEQ ID NO: 1108287 - RNA, 13 nt, Mycobacterium bovis subsp bovis AF2122/97
cgccccggccgcu

SEQ ID NO: 1108288 - RNA, 14 nt, Mycobacterium bovis subsp bovis AF2122/97
cgccccggcgcguu

SEQ ID NO: 1108289 - RNA, 12 nt, Mycobacterium bovis subsp bovis AF2122/97
cgccccggcgcg

SEQ ID NO: 1108290 - RNA, 13 nt, Mycobacterium bovis subsp bovis AF2122/97
cgccccgccguug

SEQ ID NO: 1108291 - RNA, 14 nt, Mycobacterium bovis subsp bovis AF2122/97
cgccccgcgcccaa

SEQ ID NO: 1108292 - RNA, 23 nt, Mycobacterium bovis subsp bovis AF2122/97
cgccccgcgcccaacgcgggugc

SEQ ID NO: 1108293 - RNA, 14 nt, Mycobacterium bovis subsp bovis AF2122/97
cgccccgcgccuug

SEQ ID NO: 1108294 - RNA, 12 nt, Mycobacterium bovis subsp bovis AF2122/97
cgccccgcgguc

SEQ ID NO: 1108295 - RNA, 13 nt, Mycobacterium bovis subsp bovis AF2122/97
cgccccgcguugg

SEQ ID NO: 1108296 - RNA, 19 nt, Mycobacterium bovis subsp bovis AF2122/97
cgccccgcgccuuggcacc

SEQ ID NO: 1108297 - RNA, 15 nt, Mycobacterium bovis subsp bovis AF2122/97
cgcccgaucggcgga

SEQ ID NO: 1108298 - RNA, 22 nt, Mycobacterium bovis subsp bovis AF2122/97
cgcccgauccggaucccaccac

SEQ ID NO: 1108299 - RNA, 15 nt, Mycobacterium bovis subsp bovis AF2122/97
cgcccgauccgguua

SEQ ID NO: 1108300 - RNA, 14 nt, Mycobacterium bovis subsp bovis AF2122/97
cgcccgaucggcgg

SEQ ID NO: 1108301 - RNA, 15 nt, Mycobacterium bovis subsp bovis AF2122/97
cgcccgagccggugc

SEQ ID NO: 1108302 - RNA, 17 nt, Mycobacterium bovis subsp bovis AF2122/97
cgcccgagccggugcca

SEQ ID NO: 1108303 - RNA, 21 nt, Mycobacterium bovis subsp bovis AF2122/97
cgcccgagccggugccacugc

SEQ ID NO: 1108304 - RNA, 22 nt, Mycobacterium bovis subsp bovis AF2122/97
cgcccgacggaguucgacgucg

SEQ ID NO: 1108305 - RNA, 22 nt, Mycobacterium bovis subsp bovis AF2122/97
cgcccgaguuguggacgcccga

SEQ ID NO: 1108306 - RNA, 17 nt, Mycobacterium bovis subsp bovis AF2122/97
cgcccgauacgccaccg

SEQ ID NO: 1108307 - RNA, 19 nt, Mycobacterium bovis subsp bovis AF2122/97
cgcccgaguuaaacgcagc

SEQ ID NO: 1108308 - RNA, 19 nt, Mycobacterium bovis subsp bovis AF2122/97
cgcccgaguugaagaagcc

SEQ ID NO: 1108309 - RNA, 18 nt, Mycobacterium bovis subsp bovis AF2122/97
cgcccgaguuguggacgc

SEQ ID NO: 1108310 - RNA, 14 nt, Mycobacterium bovis subsp bovis AF2122/97
cgcccgcgcugccg

SEQ ID NO: 1108311 - RNA, 15 nt, Mycobacterium bovis subsp bovis AF2122/97
cgcccgcgcugccga

SEQ ID NO: 1108312 - RNA, 18 nt, Mycobacterium bovis subsp bovis AF2122/97
cgcccgcgcugccgacuc

SEQ ID NO: 1108313 - RNA, 15 nt, Mycobacterium bovis subsp bovis AF2122/97
cgcccgccucgaccg

SEQ ID NO: 1108314 - RNA, 13 nt, Mycobacterium bovis subsp bovis AF2122/97
cgcccgcgcggug

SEQ ID NO: 1108315 - RNA, 13 nt, Mycobacterium bovis subsp bovis AF2122/97
cgcccgccggcaa

SEQ ID NO: 1108316 - RNA, 14 nt, Mycobacterium bovis subsp bovis AF2122/97
cgcccgccggcgcg

SEQ ID NO: 1108317 - RNA, 14 nt, Mycobacterium bovis subsp bovis AF2122/97
cgcccgccgcgaac

SEQ ID NO: 1108318 - RNA, 14 nt, Mycobacterium bovis subsp bovis AF2122/97
cgcccgcaccaccg

SEQ ID NO: 1108319 - RNA, 16 nt, Mycobacterium bovis subsp bovis AF2122/97
cgcccgcaccaccggc

SEQ ID NO: 1108320 - RNA, 20 nt, Mycobacterium bovis subsp bovis AF2122/97
cgcccgcccuugcggcguga

SEQ ID NO: 1108321 - RNA, 11 nt, Mycobacterium bovis subsp bovis AF2122/97
cgcccgcccgu

SEQ ID NO: 1108322 - RNA, 17 nt, Mycobacterium bovis subsp bovis AF2122/97
cgcccgccgccaccagc

SEQ ID NO: 1108323 - RNA, 14 nt, Mycobacterium bovis subsp bovis AF2122/97
cgcccgcaccagcu

SEQ ID NO: 1108324 - RNA, 19 nt, Mycobacterium bovis subsp bovis AF2122/97
cgcccgcaccagcugucgg

SEQ ID NO: 1108325 - RNA, 16 nt, Mycobacterium bovis subsp bovis AF2122/97
cgcccgaugcgccagc

SEQ ID NO: 1108326 - RNA, 17 nt, Mycobacterium bovis subsp bovis AF2122/97
cgcccgaugcgccagcg

SEQ ID NO: 1108327 - RNA, 20 nt, Mycobacterium bovis subsp bovis AF2122/97
cgcccgcaagucggacgggu

SEQ ID NO: 1108328 - RNA, 23 nt, Mycobacterium bovis subsp bovis AF2122/97
cgcccgcaauuguucgcggccgu

SEQ ID NO: 1108329 - RNA, 15 nt, Mycobacterium bovis subsp bovis AF2122/97
cgcccgugcggcucg

SEQ ID NO: 1108330 - RNA, 17 nt, Mycobacterium bovis subsp bovis AF2122/97
cgcccgugcggcucgcc

SEQ ID NO: 1108331 - RNA, 21 nt, Mycobacterium bovis subsp bovis AF2122/97
cgcccuauacgcaacaggcca

SEQ ID NO: 1108332 - RNA, 16 nt, Mycobacterium bovis subsp bovis AF2122/97
cgcccuagcgagcggc

SEQ ID NO: 1108333 - RNA, 19 nt, Mycobacterium bovis subsp bovis AF2122/97
cgcccgucuuccagccagg

SEQ ID NO: 1108334 - RNA, 22 nt, Mycobacterium bovis subsp bovis AF2122/97
cgcccgucuuccagccaggccu

SEQ ID NO: 1108335 - RNA, 15 nt, Mycobacterium bovis subsp bovis AF2122/97
cgcccgugccgcccg

SEQ ID NO: 1108336 - RNA, 16 nt, Mycobacterium bovis subsp bovis AF2122/97
cgcccgugccgcccgc

SEQ ID NO: 1108337 - RNA, 22 nt, Mycobacterium bovis subsp bovis AF2122/97
cgcccgugccgcccgcgccgcc

SEQ ID NO: 1108338 - RNA, 19 nt, Mycobacterium bovis subsp bovis AF2122/97
cgcccguaucggcuucguc

SEQ ID NO: 1108339 - RNA, 23 nt, Mycobacterium bovis subsp bovis AF2122/97
cgcccguauugaugcugcccgag

SEQ ID NO: 1108340 - RNA, 23 nt, Mycobacterium bovis subsp bovis AF2122/97
cgcccguagacccacagucgccg

SEQ ID NO: 1108341 - RNA, 14 nt, Mycobacterium bovis subsp bovis AF2122/97
cgcccguccgcgcg

SEQ ID NO: 1108342 - RNA, 20 nt, Mycobacterium bovis subsp bovis AF2122/97
cgcccguccgcgcgccgacc

SEQ ID NO: 1108343 - RNA, 16 nt, Mycobacterium bovis subsp bovis AF2122/97
cgcccgucccacugac

SEQ ID NO: 1108344 - RNA, 16 nt, Mycobacterium bovis subsp bovis AF2122/97
cgcccucaugucgggc

SEQ ID NO: 1108345 - RNA, 20 nt, Mycobacterium bovis subsp bovis AF2122/97
cgcccucgacgcgcucgggc

SEQ ID NO: 1108346 - RNA, 19 nt, Mycobacterium bovis subsp bovis AF2122/97
cgcccucaguucacguucg

SEQ ID NO: 1108347 - RNA, 15 nt, Mycobacterium bovis subsp bovis AF2122/97
cgcccucgacgccgc

SEQ ID NO: 1108348 - RNA, 20 nt, Mycobacterium bovis subsp bovis AF2122/97
cgcccucgacgccgcgcagc

SEQ ID NO: 1108349 - RNA, 15 nt, Mycobacterium bovis subsp bovis AF2122/97
cgcccucccuggggc

SEQ ID NO: 1108350 - RNA, 16 nt, Mycobacterium bovis subsp bovis AF2122/97
cgcccucccuggggcc

SEQ ID NO: 1108351 - RNA, 15 nt, Mycobacterium bovis subsp bovis AF2122/97
cgcccuccuggcggg

SEQ ID NO: 1108352 - RNA, 20 nt, Mycobacterium bovis subsp bovis AF2122/97
cgcccucagccgcggccaca

SEQ ID NO: 1108353 - RNA, 14 nt, Mycobacterium bovis subsp bovis AF2122/97
cgcccucagccgcg

SEQ ID NO: 1108354 - RNA, 19 nt, Mycobacterium bovis subsp bovis AF2122/97
cgcccucacaacgauugcg

SEQ ID NO: 1108355 - RNA, 19 nt, Mycobacterium bovis subsp bovis AF2122/97
cgcccucaguucacgcucg

SEQ ID NO: 1108356 - RNA, 23 nt, Mycobacterium bovis subsp bovis AF2122/97
cgcccucaguucacgcucgacga

SEQ ID NO: 1108357 - RNA, 20 nt, Mycobacterium bovis subsp bovis AF2122/97
cgcccucguaauccacgccg

SEQ ID NO: 1108358 - RNA, 12 nt, Mycobacterium bovis subsp bovis AF2122/97
cgcccucgucgc

SEQ ID NO: 1108359 - RNA, 15 nt, Mycobacterium bovis subsp bovis AF2122/97
cgcccggcacacggc

SEQ ID NO: 1108360 - RNA, 19 nt, Mycobacterium bovis subsp bovis AF2122/97
cgcccgggcaccggccggu

SEQ ID NO: 1108361 - RNA, 21 nt, Mycobacterium bovis subsp bovis AF2122/97
cgcccgggcaccggccggugg

SEQ ID NO: 1108362 - RNA, 15 nt, Mycobacterium bovis subsp bovis AF2122/97
cgcccgggccgcgua

SEQ ID NO: 1108363 - RNA, 13 nt, Mycobacterium bovis subsp bovis AF2122/97
cgcccgggccgcg

SEQ ID NO: 1108364 - RNA, 15 nt, Mycobacterium bovis subsp bovis AF2122/97
cgcccggggcgcaca

SEQ ID NO: 1108365 - RNA, 19 nt, Mycobacterium bovis subsp bovis AF2122/97
cgcccgggcggcgucggug

SEQ ID NO: 1108366 - RNA, 12 nt, Mycobacterium bovis subsp bovis AF2122/97
cgcccgggcggg

SEQ ID NO: 1108367 - RNA, 22 nt, Mycobacterium bovis subsp bovis AF2122/97
cgcccgggauaguuuucggccg

SEQ ID NO: 1108368 - RNA, 14 nt, Mycobacterium bovis subsp bovis AF2122/97
cgcccgcggccgcc

SEQ ID NO: 1108369 - RNA, 15 nt, Mycobacterium bovis subsp bovis AF2122/97
cgcccgcggccgcca

SEQ ID NO: 1108370 - RNA, 18 nt, Mycobacterium bovis subsp bovis AF2122/97
cgcccgcggccgccagcg

SEQ ID NO: 1108371 - RNA, 13 nt, Mycobacterium bovis subsp bovis AF2122/97
cgcccgcggccgu

SEQ ID NO: 1108372 - RNA, 15 nt, Mycobacterium bovis subsp bovis AF2122/97
cgcccgcgggcccca

SEQ ID NO: 1108373 - RNA, 17 nt, Mycobacterium bovis subsp bovis AF2122/97
cgcccgcgguccggcga

SEQ ID NO: 1108374 - RNA, 22 nt, Mycobacterium bovis subsp bovis AF2122/97
cgcccgcuaacuggcccggaca

SEQ ID NO: 1108375 - RNA, 14 nt, Mycobacterium bovis subsp bovis AF2122/97
cgcccgcgugacgc

SEQ ID NO: 1108376 - RNA, 20 nt, Mycobacterium bovis subsp bovis AF2122/97
cgcccggacgcaacacccgg

SEQ ID NO: 1108377 - RNA, 20 nt, Mycobacterium bovis subsp bovis AF2122/97
cgcccggauguccgccgacg

SEQ ID NO: 1108378 - RNA, 21 nt, Mycobacterium bovis subsp bovis AF2122/97
cgcccgcuaggcgaagcgucu

SEQ ID NO: 1108379 - RNA, 14 nt, Mycobacterium bovis subsp bovis AF2122/97
cgcccgcuccaaca

SEQ ID NO: 1108380 - RNA, 23 nt, Mycobacterium bovis subsp bovis AF2122/97
cgccgaggucgaaccgccggcug

SEQ ID NO: 1108381 - RNA, 21 nt, Mycobacterium bovis subsp bovis AF2122/97
cgccgaggucgguucggccgg

SEQ ID NO: 1108382 - RNA, 16 nt, Mycobacterium bovis subsp bovis AF2122/97
cgccgagggcgccggg

SEQ ID NO: 1108383 - RNA, 12 nt, Mycobacterium bovis subsp bovis AF2122/97
cgccgaggucgg

SEQ ID NO: 1108384 - RNA, 17 nt, Mycobacterium bovis subsp bovis AF2122/97
cgccgaguaccggccag

SEQ ID NO: 1108385 - RNA, 18 nt, Mycobacterium bovis subsp bovis AF2122/97
cgccgaguaccggccagc

SEQ ID NO: 1108386 - RNA, 22 nt, Mycobacterium bovis subsp bovis AF2122/97
cgccgagucaaacaaccgugaa

SEQ ID NO: 1108387 - RNA, 16 nt, Mycobacterium bovis subsp bovis AF2122/97
cgccgaguugaccgcc

SEQ ID NO: 1108388 - RNA, 18 nt, Mycobacterium bovis subsp bovis AF2122/97
cgccgaguugcccggguc

SEQ ID NO: 1108389 - RNA, 16 nt, Mycobacterium bovis subsp bovis AF2122/97
cgccgagcacacgucg

SEQ ID NO: 1108390 - RNA, 17 nt, Mycobacterium bovis subsp bovis AF2122/97
cgccgagcacacgucgg

SEQ ID NO: 1108391 - RNA, 21 nt, Mycobacterium bovis subsp bovis AF2122/97
cgccgagaugcuggucggcga

SEQ ID NO: 1108392 - RNA, 14 nt, Mycobacterium bovis subsp bovis AF2122/97
cgccgagcaccggg

SEQ ID NO: 1108393 - RNA, 17 nt, Mycobacterium bovis subsp bovis AF2122/97
cgccgagcaccgggcuc

SEQ ID NO: 1108394 - RNA, 14 nt, Mycobacterium bovis subsp bovis AF2122/97
cgccgagcacgccg

SEQ ID NO: 1108395 - RNA, 16 nt, Mycobacterium bovis subsp bovis AF2122/97
cgccgagcacgccgag

SEQ ID NO: 1108396 - RNA, 14 nt, Mycobacterium bovis subsp bovis AF2122/97
cgccgagcggugcc

SEQ ID NO: 1108397 - RNA, 18 nt, Mycobacterium bovis subsp bovis AF2122/97
cgccgagcggugccggcg

SEQ ID NO: 1108398 - RNA, 16 nt, Mycobacterium bovis subsp bovis AF2122/97
cgccgagcgguugccu

SEQ ID NO: 1108399 - RNA, 18 nt, Mycobacterium bovis subsp bovis AF2122/97
cgccgagcggaccaccgc

SEQ ID NO: 1108400 - RNA, 14 nt, Mycobacterium bovis subsp bovis AF2122/97
cgccgagcggaucg

SEQ ID NO: 1108401 - RNA, 18 nt, Mycobacterium bovis subsp bovis AF2122/97
cgccgagcggaucgucgu

SEQ ID NO: 1108402 - RNA, 14 nt, Mycobacterium bovis subsp bovis AF2122/97
cgccgagcucggcg

SEQ ID NO: 1108403 - RNA, 16 nt, Mycobacterium bovis subsp bovis AF2122/97
cgccgagcucggcgcc

SEQ ID NO: 1108404 - RNA, 19 nt, Mycobacterium bovis subsp bovis AF2122/97
cgccgagcucggucaccac

SEQ ID NO: 1108405 - RNA, 22 nt, Mycobacterium bovis subsp bovis AF2122/97
cgccgagcucggucaccacggc

SEQ ID NO: 1108406 - RNA, 22 nt, Mycobacterium bovis subsp bovis AF2122/97
cgccgagcgugaagucacggcg

SEQ ID NO: 1108407 - RNA, 23 nt, Mycobacterium bovis subsp bovis AF2122/97
cgccgagaugcuggucggcgaug

SEQ ID NO: 1108408 - RNA, 14 nt, Mycobacterium bovis subsp bovis AF2122/97
cgccgaggcguucg

SEQ ID NO: 1108409 - RNA, 14 nt, Mycobacterium bovis subsp bovis AF2122/97
cgccgagcuggcgc

SEQ ID NO: 1108410 - RNA, 18 nt, Mycobacterium bovis subsp bovis AF2122/97
cgccgagcuagaucacgg

SEQ ID NO: 1108411 - RNA, 19 nt, Mycobacterium bovis subsp bovis AF2122/97
cgccgagcuggcaacgccg

SEQ ID NO: 1108412 - RNA, 20 nt, Mycobacterium bovis subsp bovis AF2122/97
cgccgagcuggcaacgccgc

SEQ ID NO: 1108413 - RNA, 14 nt, Mycobacterium bovis subsp bovis AF2122/97
cgccgaccuaguca

SEQ ID NO: 1108414 - RNA, 17 nt, Mycobacterium bovis subsp bovis AF2122/97
cgccgaccucaucggca

SEQ ID NO: 1108415 - RNA, 20 nt, Mycobacterium bovis subsp bovis AF2122/97
cgccgaccucaucggcaccg

SEQ ID NO: 1108416 - RNA, 22 nt, Mycobacterium bovis subsp bovis AF2122/97
cgccgaccucaucggcaccguc

SEQ ID NO: 1108417 - RNA, 13 nt, Mycobacterium bovis subsp bovis AF2122/97
cgccgaccggugg

SEQ ID NO: 1108418 - RNA, 14 nt, Mycobacterium bovis subsp bovis AF2122/97
cgccgaccgguggc

SEQ ID NO: 1108419 - RNA, 21 nt, Mycobacterium bovis subsp bovis AF2122/97
cgccgaccgguggcaccggcg

SEQ ID NO: 1108420 - RNA, 22 nt, Mycobacterium bovis subsp bovis AF2122/97
cgccgaccaucucaccgggccc

SEQ ID NO: 1108421 - RNA, 15 nt, Mycobacterium bovis subsp bovis AF2122/97
cgccgacccaacccg

SEQ ID NO: 1108422 - RNA, 17 nt, Mycobacterium bovis subsp bovis AF2122/97
cgccgacccaacccgau

SEQ ID NO: 1108423 - RNA, 23 nt, Mycobacterium bovis subsp bovis AF2122/97
cgccgaccuggacaaccucgucg

SEQ ID NO: 1108424 - RNA, 17 nt, Mycobacterium bovis subsp bovis AF2122/97
cgccgaccuucggcccg

SEQ ID NO: 1108425 - RNA, 13 nt, Mycobacterium bovis subsp bovis AF2122/97
cgccgaccuucgg

SEQ ID NO: 1108426 - RNA, 17 nt, Mycobacterium bovis subsp bovis AF2122/97
cgccgaccuuggcgucg

SEQ ID NO: 1108427 - RNA, 19 nt, Mycobacterium bovis subsp bovis AF2122/97
cgccgaccuucggcccgcu

SEQ ID NO: 1108428 - RNA, 13 nt, Mycobacterium bovis subsp bovis AF2122/97
cgccgaccuugau

SEQ ID NO: 1108429 - RNA, 17 nt, Mycobacterium bovis subsp bovis AF2122/97
cgccgacgaacugcagc

SEQ ID NO: 1108430 - RNA, 20 nt, Mycobacterium bovis subsp bovis AF2122/97
cgccgacggcgaccaccgcg

SEQ ID NO: 1108431 - RNA, 13 nt, Mycobacterium bovis subsp bovis AF2122/97
cgccgacggcgcc

SEQ ID NO: 1108432 - RNA, 21 nt, Mycobacterium bovis subsp bovis AF2122/97
cgccgacguauagaccaggua

SEQ ID NO: 1108433 - RNA, 22 nt, Mycobacterium bovis subsp bovis AF2122/97
cgccgacgucgacgccggccag

SEQ ID NO: 1108434 - RNA, 12 nt, Mycobacterium bovis subsp bovis AF2122/97
cgccgacggugc

SEQ ID NO: 1108435 - RNA, 16 nt, Mycobacterium bovis subsp bovis AF2122/97
cgccgacucggcaccg

SEQ ID NO: 1108436 - RNA, 18 nt, Mycobacterium bovis subsp bovis AF2122/97
cgccgacuccccgccggg

SEQ ID NO: 1108437 - RNA, 16 nt, Mycobacterium bovis subsp bovis AF2122/97
cgccgacuccgcguag

SEQ ID NO: 1108438 - RNA, 15 nt, Mycobacterium bovis subsp bovis AF2122/97
cgccgacuccaguuc

SEQ ID NO: 1108439 - RNA, 19 nt, Mycobacterium bovis subsp bovis AF2122/97
cgccgagaugaugcugccg

SEQ ID NO: 1108440 - RNA, 22 nt, Mycobacterium bovis subsp bovis AF2122/97
cgccgagaugaugcugccggca

SEQ ID NO: 1108441 - RNA, 20 nt, Mycobacterium bovis subsp bovis AF2122/97
cgccgagaugcugcacccgg

SEQ ID NO: 1108442 - RNA, 16 nt, Mycobacterium bovis subsp bovis AF2122/97
cgccgagaugcugguc

SEQ ID NO: 1108443 - RNA, 18 nt, Mycobacterium bovis subsp bovis AF2122/97
cgccgagaugcuggucgg

SEQ ID NO: 1108444 - RNA, 20 nt, Mycobacterium bovis subsp bovis AF2122/97
cgccgagaugcuggucggcg

SEQ ID NO: 1108445 - RNA, 19 nt, Mycobacterium bovis subsp bovis AF2122/97
cgccgacucggcaccgcgg

SEQ ID NO: 1108446 - RNA, 17 nt, Mycobacterium bovis subsp bovis AF2122/97
cgccgagauccgcgcuu

SEQ ID NO: 1108447 - RNA, 18 nt, Mycobacterium bovis subsp bovis AF2122/97
cgccgaacccgguguuga

SEQ ID NO: 1108448 - RNA, 23 nt, Mycobacterium bovis subsp bovis AF2122/97
cgccgaacgccucugcgaucagu

SEQ ID NO: 1108449 - RNA, 14 nt, Mycobacterium bovis subsp bovis AF2122/97
cgccgaacgcgagg

SEQ ID NO: 1108450 - RNA, 13 nt, Mycobacterium bovis subsp bovis AF2122/97
cgccgaacgcucc

SEQ ID NO: 1108451 - RNA, 16 nt, Mycobacterium bovis subsp bovis AF2122/97
cgccgaacgccagcag

SEQ ID NO: 1108452 - RNA, 21 nt, Mycobacterium bovis subsp bovis AF2122/97
cgccgaacgcaacgccgaugg

SEQ ID NO: 1108453 - RNA, 18 nt, Mycobacterium bovis subsp bovis AF2122/97
cgccgaacgcuccaggcc

SEQ ID NO: 1108454 - RNA, 18 nt, Mycobacterium bovis subsp bovis AF2122/97
cgccgaacgccaccaccu

SEQ ID NO: 1108455 - RNA, 19 nt, Mycobacterium bovis subsp bovis AF2122/97
cgccgaaccagcgaugggu

SEQ ID NO: 1108456 - RNA, 22 nt, Mycobacterium bovis subsp bovis AF2122/97
cgccgaacgugaacucacggcg

SEQ ID NO: 1108457 - RNA, 20 nt, Mycobacterium bovis subsp bovis AF2122/97
cgccgaacgugcaaccacgg

SEQ ID NO: 1108458 - RNA, 15 nt, Mycobacterium bovis subsp bovis AF2122/97
cgccgaacgugcggu

SEQ ID NO: 1108459 - RNA, 21 nt, Mycobacterium bovis subsp bovis AF2122/97
cgccgaacgugcaaccacggc

SEQ ID NO: 1108460 - RNA, 20 nt, Mycobacterium bovis subsp bovis AF2122/97
cgccgaacgugcaaccaugg

SEQ ID NO: 1108461 - RNA, 14 nt, Mycobacterium bovis subsp bovis AF2122/97
cgccgaagaaggug

SEQ ID NO: 1108462 - RNA, 17 nt, Mycobacterium bovis subsp bovis AF2122/97
cgccgaagaaggugacg

SEQ ID NO: 1108463 - RNA, 13 nt, Mycobacterium bovis subsp bovis AF2122/97
cgccgaccagcac

SEQ ID NO: 1108464 - RNA, 15 nt, Mycobacterium bovis subsp bovis AF2122/97
cgccgaccagcaccc

SEQ ID NO: 1108465 - RNA, 13 nt, Mycobacterium bovis subsp bovis AF2122/97
cgccgaccacccg

SEQ ID NO: 1108466 - RNA, 14 nt, Mycobacterium bovis subsp bovis AF2122/97
cgccgaccacccgg

SEQ ID NO: 1108467 - RNA, 16 nt, Mycobacterium bovis subsp bovis AF2122/97
cgccgaaucucaccgu

SEQ ID NO: 1108468 - RNA, 19 nt, Mycobacterium bovis subsp bovis AF2122/97
cgccgaaugccaccucgac

SEQ ID NO: 1108469 - RNA, 15 nt, Mycobacterium bovis subsp bovis AF2122/97
cgccgaaucgcgggc

SEQ ID NO: 1108470 - RNA, 19 nt, Mycobacterium bovis subsp bovis AF2122/97
cgccgaaguagacgguggu

SEQ ID NO: 1108471 - RNA, 16 nt, Mycobacterium bovis subsp bovis AF2122/97
cgccgaaguagccgac

SEQ ID NO: 1108472 - RNA, 18 nt, Mycobacterium bovis subsp bovis AF2122/97
cgccgaaguagccgaccg

SEQ ID NO: 1108473 - RNA, 21 nt, Mycobacterium bovis subsp bovis AF2122/97
cgccgaaguagccgaccggca

SEQ ID NO: 1108474 - RNA, 20 nt, Mycobacterium bovis subsp bovis AF2122/97
cgccgaaguuccagccgacg

SEQ ID NO: 1108475 - RNA, 15 nt, Mycobacterium bovis subsp bovis AF2122/97
cgccgaauccgacgu

SEQ ID NO: 1108476 - RNA, 17 nt, Mycobacterium bovis subsp bovis AF2122/97
cgccgaauccgacgucg

SEQ ID NO: 1108477 - RNA, 22 nt, Mycobacterium bovis subsp bovis AF2122/97
cgccgaauccgacgucgacgag

SEQ ID NO: 1108478 - RNA, 16 nt, Mycobacterium bovis subsp bovis AF2122/97
cgccgaaccagcgaug

SEQ ID NO: 1108479 - RNA, 19 nt, Mycobacterium bovis subsp bovis AF2122/97
cgccgaacaccucggcacg

SEQ ID NO: 1108480 - RNA, 23 nt, Mycobacterium bovis subsp bovis AF2122/97
cgccgaacacgcacacgaucgcg

SEQ ID NO: 1108481 - RNA, 16 nt, Mycobacterium bovis subsp bovis AF2122/97
cgccgaacaccggcuc

SEQ ID NO: 1108482 - RNA, 23 nt, Mycobacterium bovis subsp bovis AF2122/97
cgccgaacaccggcuccagcaug

SEQ ID NO: 1108483 - RNA, 17 nt, Mycobacterium bovis subsp bovis AF2122/97
cgccgaacaccgguaac

SEQ ID NO: 1108484 - RNA, 14 nt, Mycobacterium bovis subsp bovis AF2122/97
cgcccugggcgccg

SEQ ID NO: 1108485 - RNA, 19 nt, Mycobacterium bovis subsp bovis AF2122/97
cgcccuuagggucgccgca

SEQ ID NO: 1108486 - RNA, 20 nt, Mycobacterium bovis subsp bovis AF2122/97
cgcccuguucuccgugaucg

SEQ ID NO: 1108487 - RNA, 16 nt, Mycobacterium bovis subsp bovis AF2122/97
cgcccucgucgcgggc

SEQ ID NO: 1108488 - RNA, 22 nt, Mycobacterium bovis subsp bovis AF2122/97
cgcccucgucgcgggccaccgc

SEQ ID NO: 1108489 - RNA, 21 nt, Mycobacterium bovis subsp bovis AF2122/97
cgcccugacacaacaccggcg

SEQ ID NO: 1108490 - RNA, 16 nt, Mycobacterium bovis subsp bovis AF2122/97
cgcccugacgucacgu

SEQ ID NO: 1108491 - RNA, 20 nt, Mycobacterium bovis subsp bovis AF2122/97
cgcccugacgucacguucgg

SEQ ID NO: 1108492 - RNA, 14 nt, Mycobacterium bovis subsp bovis AF2122/97
cgcccugagaacac

SEQ ID NO: 1108493 - RNA, 19 nt, Mycobacterium bovis subsp bovis AF2122/97
cgcccugagaacacguucg

SEQ ID NO: 1108494 - RNA, 14 nt, Mycobacterium bovis subsp bovis AF2122/97
cgcccugacccgga

SEQ ID NO: 1108495 - RNA, 20 nt, Mycobacterium bovis subsp bovis AF2122/97
cgcccugacccggagccgcc

SEQ ID NO: 1108496 - RNA, 21 nt, Mycobacterium bovis subsp bovis AF2122/97
cgcccuggccgccggccccgc

SEQ ID NO: 1108497 - RNA, 21 nt, Mycobacterium bovis subsp bovis AF2122/97
cgcccugcagacggguggccc

SEQ ID NO: 1108498 - RNA, 17 nt, Mycobacterium bovis subsp bovis AF2122/97
cgccgcgaggcaccgac

SEQ ID NO: 1108499 - RNA, 17 nt, Mycobacterium bovis subsp bovis AF2122/97
cgccgcgagcgccggcc

SEQ ID NO: 1108500 - RNA, 18 nt, Mycobacterium bovis subsp bovis AF2122/97
cgccgcgagcgccggccg

SEQ ID NO: 1108501 - RNA, 13 nt, Mycobacterium bovis subsp bovis AF2122/97
cgccgcgaggaug

SEQ ID NO: 1108502 - RNA, 14 nt, Mycobacterium bovis subsp bovis AF2122/97
cgccgcgacgaugc

SEQ ID NO: 1108503 - RNA, 19 nt, Mycobacterium bovis subsp bovis AF2122/97
cgccgcgagagccggcggc

SEQ ID NO: 1108504 - RNA, 13 nt, Mycobacterium bovis subsp bovis AF2122/97
cgccgcgaugcca

SEQ ID NO: 1108505 - RNA, 23 nt, Mycobacterium bovis subsp bovis AF2122/97
cgccgcgaugccacccaacagcg

SEQ ID NO: 1108506 - RNA, 13 nt, Mycobacterium bovis subsp bovis AF2122/97
cgccgcgauggcc

SEQ ID NO: 1108507 - RNA, 13 nt, Mycobacterium bovis subsp bovis AF2122/97
cgccgcgcaccgc

SEQ ID NO: 1108508 - RNA, 20 nt, Mycobacterium bovis subsp bovis AF2122/97
cgccgcgauggcgguccacc

SEQ ID NO: 1108509 - RNA, 14 nt, Mycobacterium bovis subsp bovis AF2122/97
cgccgcgcaccgcg

SEQ ID NO: 1108510 - RNA, 12 nt, Mycobacterium bovis subsp bovis AF2122/97
cgccgcgcagcc

SEQ ID NO: 1108511 - RNA, 16 nt, Mycobacterium bovis subsp bovis AF2122/97
cgccgcgcauccgcag

SEQ ID NO: 1108512 - RNA, 15 nt, Mycobacterium bovis subsp bovis AF2122/97
cgccgcgcagccggc

SEQ ID NO: 1108513 - RNA, 17 nt, Mycobacterium bovis subsp bovis AF2122/97
cgccgcgcagccggccc

SEQ ID NO: 1108514 - RNA, 13 nt, Mycobacterium bovis subsp bovis AF2122/97
cgccgcgcagcga

SEQ ID NO: 1108515 - RNA, 20 nt, Mycobacterium bovis subsp bovis AF2122/97
cgccgccuucuuggcggccu

SEQ ID NO: 1108516 - RNA, 22 nt, Mycobacterium bovis subsp bovis AF2122/97
cgccgccuucuucucggcgagc

SEQ ID NO: 1108517 - RNA, 21 nt, Mycobacterium bovis subsp bovis AF2122/97
cgccgccugugcgcggugacg

SEQ ID NO: 1108518 - RNA, 22 nt, Mycobacterium bovis subsp bovis AF2122/97
cgccgccugugcgcggugacga

SEQ ID NO: 1108519 - RNA, 19 nt, Mycobacterium bovis subsp bovis AF2122/97
cgccgccuuacgcaccgau

SEQ ID NO: 1108520 - RNA, 22 nt, Mycobacterium bovis subsp bovis AF2122/97
cgccgcgaacuccagcagcccg

SEQ ID NO: 1108521 - RNA, 21 nt, Mycobacterium bovis subsp bovis AF2122/97
cgccgcgaagcgcucggcagc

SEQ ID NO: 1108522 - RNA, 22 nt, Mycobacterium bovis subsp bovis AF2122/97
cgccgcgaagcgcucggcagcc

SEQ ID NO: 1108523 - RNA, 13 nt, Mycobacterium bovis subsp bovis AF2122/97
cgccgcgacgugg

SEQ ID NO: 1108524 - RNA, 14 nt, Mycobacterium bovis subsp bovis AF2122/97
cgccgcgacgugga

SEQ ID NO: 1108525 - RNA, 23 nt, Mycobacterium bovis subsp bovis AF2122/97
cgccgcgacugcaccuggccgcc

SEQ ID NO: 1108526 - RNA, 15 nt, Mycobacterium bovis subsp bovis AF2122/97
cgccgcgagagccgg

SEQ ID NO: 1108527 - RNA, 17 nt, Mycobacterium bovis subsp bovis AF2122/97
cgccgcgagagccggcg

SEQ ID NO: 1108528 - RNA, 23 nt, Mycobacterium bovis subsp bovis AF2122/97
cgccgcgacaaaucggucgacga

SEQ ID NO: 1108529 - RNA, 22 nt, Mycobacterium bovis subsp bovis AF2122/97
cgccgcgaaggggugcccggcg

SEQ ID NO: 1108530 - RNA, 20 nt, Mycobacterium bovis subsp bovis AF2122/97
cgccgcgaaugucgccgccu

SEQ ID NO: 1108531 - RNA, 19 nt, Mycobacterium bovis subsp bovis AF2122/97
cgccgcgacaaaucggucg

SEQ ID NO: 1108532 - RNA, 23 nt, Mycobacterium bovis subsp bovis AF2122/97
cgccgcgaacuccagcagcccgg

SEQ ID NO: 1108533 - RNA, 13 nt, Mycobacterium bovis subsp bovis AF2122/97
cgccgccggcggc

SEQ ID NO: 1108534 - RNA, 12 nt, Mycobacterium bovis subsp bovis AF2122/97
cgccgccgggca

SEQ ID NO: 1108535 - RNA, 23 nt, Mycobacterium bovis subsp bovis AF2122/97
cgccgccgggauaacccagcacc

SEQ ID NO: 1108536 - RNA, 14 nt, Mycobacterium bovis subsp bovis AF2122/97
cgccgccgggucga

SEQ ID NO: 1108537 - RNA, 22 nt, Mycobacterium bovis subsp bovis AF2122/97
cgccgccggguuuauccagucg

SEQ ID NO: 1108538 - RNA, 20 nt, Mycobacterium bovis subsp bovis AF2122/97
cgccgccuuccuggcgggcg

SEQ ID NO: 1108539 - RNA, 22 nt, Mycobacterium bovis subsp bovis AF2122/97
cgccgccuuccuggcgggcgcc

SEQ ID NO: 1108540 - RNA, 16 nt, Mycobacterium bovis subsp bovis AF2122/97
cgccgccugcccggcc

SEQ ID NO: 1108541 - RNA, 19 nt, Mycobacterium bovis subsp bovis AF2122/97
cgccgccugcccggcccgc

SEQ ID NO: 1108542 - RNA, 23 nt, Mycobacterium bovis subsp bovis AF2122/97
cgccgccugcuccucggccagcg

SEQ ID NO: 1108543 - RNA, 19 nt, Mycobacterium bovis subsp bovis AF2122/97
cgccgccuggacgccgccg

SEQ ID NO: 1108544 - RNA, 21 nt, Mycobacterium bovis subsp bovis AF2122/97
cgccgccuggacgccgccgga

SEQ ID NO: 1108545 - RNA, 13 nt, Mycobacterium bovis subsp bovis AF2122/97
cgccgccugcgca

SEQ ID NO: 1108546 - RNA, 14 nt, Mycobacterium bovis subsp bovis AF2122/97
cgccgccucgggca

SEQ ID NO: 1108547 - RNA, 15 nt, Mycobacterium bovis subsp bovis AF2122/97
cgccgcccggcguau

SEQ ID NO: 1108548 - RNA, 12 nt, Mycobacterium bovis subsp bovis AF2122/97
cgccgccggcgg

SEQ ID NO: 1108549 - RNA, 14 nt, Mycobacterium bovis subsp bovis AF2122/97
cgccgccggcgcca

SEQ ID NO: 1108550 - RNA, 14 nt, Mycobacterium bovis subsp bovis AF2122/97
cgccgccggcgccc

SEQ ID NO: 1108551 - RNA, 15 nt, Mycobacterium bovis subsp bovis AF2122/97
cgccgccggcgccca

SEQ ID NO: 1108552 - RNA, 19 nt, Mycobacterium bovis subsp bovis AF2122/97
cgccgccggcgcccaggcc

SEQ ID NO: 1108553 - RNA, 18 nt, Mycobacterium bovis subsp bovis AF2122/97
cgccgccggcgccgccgg

SEQ ID NO: 1108554 - RNA, 14 nt, Mycobacterium bovis subsp bovis AF2122/97
cgccgccggcggcg

SEQ ID NO: 1108555 - RNA, 15 nt, Mycobacterium bovis subsp bovis AF2122/97
cgccgccggcggcgg

SEQ ID NO: 1108556 - RNA, 16 nt, Mycobacterium bovis subsp bovis AF2122/97
cgccgccggcggcggu

SEQ ID NO: 1108557 - RNA, 19 nt, Mycobacterium bovis subsp bovis AF2122/97
cgccgcccgcagggccgcc

SEQ ID NO: 1108558 - RNA, 12 nt, Mycobacterium bovis subsp bovis AF2122/97
cgccgcccgccg

SEQ ID NO: 1108559 - RNA, 19 nt, Mycobacterium bovis subsp bovis AF2122/97
cgccgcccgcgccaccgau

SEQ ID NO: 1108560 - RNA, 21 nt, Mycobacterium bovis subsp bovis AF2122/97
cgccgcccgcgcccccggugc

SEQ ID NO: 1108561 - RNA, 16 nt, Mycobacterium bovis subsp bovis AF2122/97
cgccgcccgcgccgcc

SEQ ID NO: 1108562 - RNA, 20 nt, Mycobacterium bovis subsp bovis AF2122/97
cgccgcccgcgccgccgcca

SEQ ID NO: 1108563 - RNA, 21 nt, Mycobacterium bovis subsp bovis AF2122/97
cgccgccauuggacagcgcga

SEQ ID NO: 1108564 - RNA, 13 nt, Mycobacterium bovis subsp bovis AF2122/97
cgccgccccgcuc

SEQ ID NO: 1108565 - RNA, 16 nt, Mycobacterium bovis subsp bovis AF2122/97
cgccgccccgcucggu

SEQ ID NO: 1108566 - RNA, 19 nt, Mycobacterium bovis subsp bovis AF2122/97
cgccgcccgagcaccccag

SEQ ID NO: 1108567 - RNA, 17 nt, Mycobacterium bovis subsp bovis AF2122/97
cgccgccccugcgcggc

SEQ ID NO: 1108568 - RNA, 21 nt, Mycobacterium bovis subsp bovis AF2122/97
cgccgccccugcgcggccacc

SEQ ID NO: 1108569 - RNA, 13 nt, Mycobacterium bovis subsp bovis AF2122/97
cgccgccccggcg

SEQ ID NO: 1108570 - RNA, 16 nt, Mycobacterium bovis subsp bovis AF2122/97
cgccgccccggcgcug

SEQ ID NO: 1108571 - RNA, 21 nt, Mycobacterium bovis subsp bovis AF2122/97
cgccgcauugcagaaccgcca

SEQ ID NO: 1108572 - RNA, 22 nt, Mycobacterium bovis subsp bovis AF2122/97
cgccgcauugcagaaccgccaa

SEQ ID NO: 1108573 - RNA, 23 nt, Mycobacterium bovis subsp bovis AF2122/97
cgccgcauugcagaaccgccaac

SEQ ID NO: 1108574 - RNA, 22 nt, Mycobacterium bovis subsp bovis AF2122/97
cgccgcauggugggugccggcg

SEQ ID NO: 1108575 - RNA, 13 nt, Mycobacterium bovis subsp bovis AF2122/97
cgccgcaucggcg

SEQ ID NO: 1108576 - RNA, 14 nt, Mycobacterium bovis subsp bovis AF2122/97
cgccgcaucggcga

SEQ ID NO: 1108577 - RNA, 16 nt, Mycobacterium bovis subsp bovis AF2122/97
cgccgcaucggcgaac

SEQ ID NO: 1108578 - RNA, 14 nt, Mycobacterium bovis subsp bovis AF2122/97
cgccgcaucggcgg

SEQ ID NO: 1108579 - RNA, 16 nt, Mycobacterium bovis subsp bovis AF2122/97
cgccgcaucggcgggu

SEQ ID NO: 1108580 - RNA, 16 nt, Mycobacterium bovis subsp bovis AF2122/97
cgccgcaucguuuucg

SEQ ID NO: 1108581 - RNA, 22 nt, Mycobacterium bovis subsp bovis AF2122/97
cgccgcauccagccgugcggcg

SEQ ID NO: 1108582 - RNA, 23 nt, Mycobacterium bovis subsp bovis AF2122/97
cgccgcauaccaguaccgucauc

SEQ ID NO: 1108583 - RNA, 15 nt, Mycobacterium bovis subsp bovis AF2122/97
cgccgcaguggaugc

SEQ ID NO: 1108584 - RNA, 16 nt, Mycobacterium bovis subsp bovis AF2122/97
cgccgaucgcggcggc

SEQ ID NO: 1108585 - RNA, 20 nt, Mycobacterium bovis subsp bovis AF2122/97
cgccgauaucgcagauggcg

SEQ ID NO: 1108586 - RNA, 22 nt, Mycobacterium bovis subsp bovis AF2122/97
cgccgauaucggugaccguggc

SEQ ID NO: 1108587 - RNA, 18 nt, Mycobacterium bovis subsp bovis AF2122/97
cgccgauaccggcggcga

SEQ ID NO: 1108588 - RNA, 18 nt, Mycobacterium bovis subsp bovis AF2122/97
cgccgaucaacagcaccg

SEQ ID NO: 1108589 - RNA, 15 nt, Mycobacterium bovis subsp bovis AF2122/97
cgccgaucgacaccc

SEQ ID NO: 1108590 - RNA, 13 nt, Mycobacterium bovis subsp bovis AF2122/97
cgccgaucgagac

SEQ ID NO: 1108591 - RNA, 15 nt, Mycobacterium bovis subsp bovis AF2122/97
cgccgaucggccaca

SEQ ID NO: 1108592 - RNA, 12 nt, Mycobacterium bovis subsp bovis AF2122/97
cgccgauccggu

SEQ ID NO: 1108593 - RNA, 20 nt, Mycobacterium bovis subsp bovis AF2122/97
cgccgauccgguggcuggcc

SEQ ID NO: 1108594 - RNA, 13 nt, Mycobacterium bovis subsp bovis AF2122/97
cgccgaucgaacc

SEQ ID NO: 1108595 - RNA, 14 nt, Mycobacterium bovis subsp bovis AF2122/97
cgccgauaucggug

SEQ ID NO: 1108596 - RNA, 15 nt, Mycobacterium bovis subsp bovis AF2122/97
cgccgauaucgguga

SEQ ID NO: 1108597 - RNA, 16 nt, Mycobacterium bovis subsp bovis AF2122/97
cgccgauaucgcagau

SEQ ID NO: 1108598 - RNA, 14 nt, Mycobacterium bovis subsp bovis AF2122/97
cgccgauaccgccg

SEQ ID NO: 1108599 - RNA, 20 nt, Mycobacterium bovis subsp bovis AF2122/97
cgccgauaccgccggcccca

SEQ ID NO: 1108600 - RNA, 23 nt, Mycobacterium bovis subsp bovis AF2122/97
cgccgauaccgccggccccaccg

SEQ ID NO: 1108601 - RNA, 13 nt, Mycobacterium bovis subsp bovis AF2122/97
cgccgauaccgcc

SEQ ID NO: 1108602 - RNA, 23 nt, Mycobacterium bovis subsp bovis AF2122/97
cgccgauacccagcgggucgcgg

SEQ ID NO: 1108603 - RNA, 15 nt, Mycobacterium bovis subsp bovis AF2122/97
cgccgccacugccgg

SEQ ID NO: 1108604 - RNA, 22 nt, Mycobacterium bovis subsp bovis AF2122/97
cgccgccacggaucgcggcggc

SEQ ID NO: 1108605 - RNA, 16 nt, Mycobacterium bovis subsp bovis AF2122/97
cgccgccacugccggc

SEQ ID NO: 1108606 - RNA, 13 nt, Mycobacterium bovis subsp bovis AF2122/97
cgccgccagauga

SEQ ID NO: 1108607 - RNA, 16 nt, Mycobacterium bovis subsp bovis AF2122/97
cgccgccagcaccucg

SEQ ID NO: 1108608 - RNA, 12 nt, Mycobacterium bovis subsp bovis AF2122/97
cgccgccagucg

SEQ ID NO: 1108609 - RNA, 13 nt, Mycobacterium bovis subsp bovis AF2122/97
cgccgccagucgu

SEQ ID NO: 1108610 - RNA, 13 nt, Mycobacterium bovis subsp bovis AF2122/97
cgccgccaucacg

SEQ ID NO: 1108611 - RNA, 17 nt, Mycobacterium bovis subsp bovis AF2122/97
cgccgccauugccgccg

SEQ ID NO: 1108612 - RNA, 18 nt, Mycobacterium bovis subsp bovis AF2122/97
cgccgccauugccgccgg

SEQ ID NO: 1108613 - RNA, 19 nt, Mycobacterium bovis subsp bovis AF2122/97
cgccgccauugccgccggu

SEQ ID NO: 1108614 - RNA, 15 nt, Mycobacterium bovis subsp bovis AF2122/97
cgccgccauuggaca

SEQ ID NO: 1108615 - RNA, 15 nt, Mycobacterium bovis subsp bovis AF2122/97
cgccgccauuggcuu

SEQ ID NO: 1108616 - RNA, 20 nt, Mycobacterium bovis subsp bovis AF2122/97
cgccgccauugucgccaaau

SEQ ID NO: 1108617 - RNA, 20 nt, Mycobacterium bovis subsp bovis AF2122/97
cgccgccaccccgcgcgcca

SEQ ID NO: 1108618 - RNA, 20 nt, Mycobacterium bovis subsp bovis AF2122/97
cgccgccacccggcgggcgg

SEQ ID NO: 1108619 - RNA, 12 nt, Mycobacterium bovis subsp bovis AF2122/97
cgccgccaccga

SEQ ID NO: 1108620 - RNA, 13 nt, Mycobacterium bovis subsp bovis AF2122/97
cgccgccaccgaa

SEQ ID NO: 1108621 - RNA, 21 nt, Mycobacterium bovis subsp bovis AF2122/97
cgccgccaccgaagccgccgg

SEQ ID NO: 1108622 - RNA, 22 nt, Mycobacterium bovis subsp bovis AF2122/97
cgccgccaccgaagccgccggg

SEQ ID NO: 1108623 - RNA, 14 nt, Mycobacterium bovis subsp bovis AF2122/97
cgccgccaccagcg

SEQ ID NO: 1108624 - RNA, 14 nt, Mycobacterium bovis subsp bovis AF2122/97
cgccgccaccagcu

SEQ ID NO: 1108625 - RNA, 16 nt, Mycobacterium bovis subsp bovis AF2122/97
cgccgccaccagcugc

SEQ ID NO: 1108626 - RNA, 20 nt, Mycobacterium bovis subsp bovis AF2122/97
cgccgccaccagcugcgcga

SEQ ID NO: 1108627 - RNA, 18 nt, Mycobacterium bovis subsp bovis AF2122/97
cgccgccaccagggcggc

SEQ ID NO: 1108628 - RNA, 15 nt, Mycobacterium bovis subsp bovis AF2122/97
cgccgccaccagcgc

SEQ ID NO: 1108629 - RNA, 16 nt, Mycobacterium bovis subsp bovis AF2122/97
cgccgccaccggcgcc

SEQ ID NO: 1108630 - RNA, 22 nt, Mycobacterium bovis subsp bovis AF2122/97
cgccgccacagcacccacgccg

SEQ ID NO: 1108631 - RNA, 23 nt, Mycobacterium bovis subsp bovis AF2122/97
cgccgccaagcucggccaccagc

SEQ ID NO: 1108632 - RNA, 14 nt, Mycobacterium bovis subsp bovis AF2122/97
cgccgccaccaccc

SEQ ID NO: 1108633 - RNA, 18 nt, Mycobacterium bovis subsp bovis AF2122/97
cgccgccaccacccaaca

SEQ ID NO: 1108634 - RNA, 16 nt, Mycobacterium bovis subsp bovis AF2122/97
cgccgccaaagccggg

SEQ ID NO: 1108635 - RNA, 18 nt, Mycobacterium bovis subsp bovis AF2122/97
cgccgccaagcucggcca

SEQ ID NO: 1108636 - RNA, 16 nt, Mycobacterium bovis subsp bovis AF2122/97
cgccggaccggugugg

SEQ ID NO: 1108637 - RNA, 20 nt, Mycobacterium bovis subsp bovis AF2122/97
cgccggacgacaacaggccg

SEQ ID NO: 1108638 - RNA, 21 nt, Mycobacterium bovis subsp bovis AF2122/97
cgccggacgacaacaggccgu

SEQ ID NO: 1108639 - RNA, 14 nt, Mycobacterium bovis subsp bovis AF2122/97
cgccggacccgccc

SEQ ID NO: 1108640 - RNA, 20 nt, Mycobacterium bovis subsp bovis AF2122/97
cgccggacccgcccuugccg

SEQ ID NO: 1108641 - RNA, 23 nt, Mycobacterium bovis subsp bovis AF2122/97
cgccggacccgcccuugccgccg

SEQ ID NO: 1108642 - RNA, 17 nt, Mycobacterium bovis subsp bovis AF2122/97
cgccggacccgccgggu

SEQ ID NO: 1108643 - RNA, 20 nt, Mycobacterium bovis subsp bovis AF2122/97
cgccggacgggugcagcgca

SEQ ID NO: 1108644 - RNA, 23 nt, Mycobacterium bovis subsp bovis AF2122/97
cgccggauugcuugggugccucg

SEQ ID NO: 1108645 - RNA, 19 nt, Mycobacterium bovis subsp bovis AF2122/97
cgccggcaaaggacgucga

SEQ ID NO: 1108646 - RNA, 20 nt, Mycobacterium bovis subsp bovis AF2122/97
cgccggcacauugaucgacg

SEQ ID NO: 1108647 - RNA, 21 nt, Mycobacterium bovis subsp bovis AF2122/97
cgccggcaacccagugucagc

SEQ ID NO: 1108648 - RNA, 14 nt, Mycobacterium bovis subsp bovis AF2122/97
cgccggcaaccggg

SEQ ID NO: 1108649 - RNA, 17 nt, Mycobacterium bovis subsp bovis AF2122/97
cgccggcaacgcggcuc

SEQ ID NO: 1108650 - RNA, 18 nt, Mycobacterium bovis subsp bovis AF2122/97
cgccggcaauaccgccag

SEQ ID NO: 1108651 - RNA, 20 nt, Mycobacterium bovis subsp bovis AF2122/97
cgccggcaauaccgccagcg

SEQ ID NO: 1108652 - RNA, 15 nt, Mycobacterium bovis subsp bovis AF2122/97
cgccggcaccgacac

SEQ ID NO: 1108653 - RNA, 13 nt, Mycobacterium bovis subsp bovis AF2122/97
cgccggcaccgcc

SEQ ID NO: 1108654 - RNA, 15 nt, Mycobacterium bovis subsp bovis AF2122/97
cgccggcaccgccag

SEQ ID NO: 1108655 - RNA, 13 nt, Mycobacterium bovis subsp bovis AF2122/97
cgccggcacgggc

SEQ ID NO: 1108656 - RNA, 14 nt, Mycobacterium bovis subsp bovis AF2122/97
cgccggcacgggcg

SEQ ID NO: 1108657 - RNA, 17 nt, Mycobacterium bovis subsp bovis AF2122/97
cgccggcacgggcgucg

SEQ ID NO: 1108658 - RNA, 22 nt, Mycobacterium bovis subsp bovis AF2122/97
cgccggcaccgccagugcccgc

SEQ ID NO: 1108659 - RNA, 15 nt, Mycobacterium bovis subsp bovis AF2122/97
cgccggcaccgccgc

SEQ ID NO: 1108660 - RNA, 20 nt, Mycobacterium bovis subsp bovis AF2122/97
cgccggcaccgccgcccccg

SEQ ID NO: 1108661 - RNA, 17 nt, Mycobacterium bovis subsp bovis AF2122/97
cgccggcaccgccggca

SEQ ID NO: 1108662 - RNA, 23 nt, Mycobacterium bovis subsp bovis AF2122/97
cgccggcaccgccggcaccgccg

SEQ ID NO: 1108663 - RNA, 20 nt, Mycobacterium bovis subsp bovis AF2122/97
cgccggcaccgccggcgcca

SEQ ID NO: 1108664 - RNA, 19 nt, Mycobacterium bovis subsp bovis AF2122/97
cgccggcaccgccgguggc

SEQ ID NO: 1108665 - RNA, 21 nt, Mycobacterium bovis subsp bovis AF2122/97
cgccggaauacaccagcgacg

SEQ ID NO: 1108666 - RNA, 16 nt, Mycobacterium bovis subsp bovis AF2122/97
cgccggacagcgcauc

SEQ ID NO: 1108667 - RNA, 14 nt, Mycobacterium bovis subsp bovis AF2122/97
cgccggaagcgccg

SEQ ID NO: 1108668 - RNA, 20 nt, Mycobacterium bovis subsp bovis AF2122/97
cgccgcuucaccccacuggc

SEQ ID NO: 1108669 - RNA, 23 nt, Mycobacterium bovis subsp bovis AF2122/97
cgccgcuggccagcacaccgucg

SEQ ID NO: 1108670 - RNA, 21 nt, Mycobacterium bovis subsp bovis AF2122/97
cgccgcuggagaucacgccga

SEQ ID NO: 1108671 - RNA, 13 nt, Mycobacterium bovis subsp bovis AF2122/97
cgccgcuggguga

SEQ ID NO: 1108672 - RNA, 23 nt, Mycobacterium bovis subsp bovis AF2122/97
cgccgcuggagaucacgccgacg

SEQ ID NO: 1108673 - RNA, 18 nt, Mycobacterium bovis subsp bovis AF2122/97
cgccgcgguagacgccgc

SEQ ID NO: 1108674 - RNA, 20 nt, Mycobacterium bovis subsp bovis AF2122/97
cgccgcgguagacgccgccg

SEQ ID NO: 1108675 - RNA, 16 nt, Mycobacterium bovis subsp bovis AF2122/97
cgccgcggucggacca

SEQ ID NO: 1108676 - RNA, 18 nt, Mycobacterium bovis subsp bovis AF2122/97
cgccgcgguuaucgccga

SEQ ID NO: 1108677 - RNA, 20 nt, Mycobacterium bovis subsp bovis AF2122/97
cgccgcgguuuucgccggau

SEQ ID NO: 1108678 - RNA, 18 nt, Mycobacterium bovis subsp bovis AF2122/97
cgccgcgucauucaccgc

SEQ ID NO: 1108679 - RNA, 23 nt, Mycobacterium bovis subsp bovis AF2122/97
cgccgcguccucgcccuggccgc

SEQ ID NO: 1108680 - RNA, 23 nt, Mycobacterium bovis subsp bovis AF2122/97
cgccgcuaucgaggaggcggucg

SEQ ID NO: 1108681 - RNA, 20 nt, Mycobacterium bovis subsp bovis AF2122/97
cgccgcuaggugacgccgcc

SEQ ID NO: 1108682 - RNA, 21 nt, Mycobacterium bovis subsp bovis AF2122/97
cgccgcuaggugacgccgcca

SEQ ID NO: 1108683 - RNA, 20 nt, Mycobacterium bovis subsp bovis AF2122/97
cgccgcuccaugacaaaccu

SEQ ID NO: 1108684 - RNA, 13 nt, Mycobacterium bovis subsp bovis AF2122/97
cgccgcucccgca

SEQ ID NO: 1108685 - RNA, 17 nt, Mycobacterium bovis subsp bovis AF2122/97
cgccgcucauccagcgc

SEQ ID NO: 1108686 - RNA, 19 nt, Mycobacterium bovis subsp bovis AF2122/97
cgccgcucauccagcgcgu

SEQ ID NO: 1108687 - RNA, 18 nt, Mycobacterium bovis subsp bovis AF2122/97
cgccgcgcaucgcggccg

SEQ ID NO: 1108688 - RNA, 20 nt, Mycobacterium bovis subsp bovis AF2122/97
cgccgcgcauccgcagccca

SEQ ID NO: 1108689 - RNA, 17 nt, Mycobacterium bovis subsp bovis AF2122/97
cgccgcgcccaccauga

SEQ ID NO: 1108690 - RNA, 18 nt, Mycobacterium bovis subsp bovis AF2122/97
cgccgcgcccaccaugau

SEQ ID NO: 1108691 - RNA, 22 nt, Mycobacterium bovis subsp bovis AF2122/97
cgccgcgcccaccaugaucaca

SEQ ID NO: 1108692 - RNA, 14 nt, Mycobacterium bovis subsp bovis AF2122/97
cgccgcgcccggcg

SEQ ID NO: 1108693 - RNA, 22 nt, Mycobacterium bovis subsp bovis AF2122/97
cgccgcgccgauuccaccgccg

SEQ ID NO: 1108694 - RNA, 13 nt, Mycobacterium bovis subsp bovis AF2122/97
cgccgcgccgaau

SEQ ID NO: 1108695 - RNA, 18 nt, Mycobacterium bovis subsp bovis AF2122/97
cgccgcgccgaaucgcgg

SEQ ID NO: 1108696 - RNA, 13 nt, Mycobacterium bovis subsp bovis AF2122/97
cgccgcgccgccu

SEQ ID NO: 1108697 - RNA, 15 nt, Mycobacterium bovis subsp bovis AF2122/97
cgccgcgccggcggc

SEQ ID NO: 1108698 - RNA, 16 nt, Mycobacterium bovis subsp bovis AF2122/97
cgccgcgccggcggcc

SEQ ID NO: 1108699 - RNA, 21 nt, Mycobacterium bovis subsp bovis AF2122/97
cgccgcgcgcauuuuucgcca

SEQ ID NO: 1108700 - RNA, 13 nt, Mycobacterium bovis subsp bovis AF2122/97
cgccgcgccguuc

SEQ ID NO: 1108701 - RNA, 14 nt, Mycobacterium bovis subsp bovis AF2122/97
cgccgcgccggugu

SEQ ID NO: 1108702 - RNA, 13 nt, Mycobacterium bovis subsp bovis AF2122/97
cgccgcgcucgac

SEQ ID NO: 1108703 - RNA, 15 nt, Mycobacterium bovis subsp bovis AF2122/97
cgccgcgcucgacga

SEQ ID NO: 1108704 - RNA, 20 nt, Mycobacterium bovis subsp bovis AF2122/97
cgccgcgcucaucugcgcgc

SEQ ID NO: 1108705 - RNA, 14 nt, Mycobacterium bovis subsp bovis AF2122/97
cgccgcgcguucgg

SEQ ID NO: 1108706 - RNA, 17 nt, Mycobacterium bovis subsp bovis AF2122/97
cgccgcgcguucggcgc

SEQ ID NO: 1108707 - RNA, 17 nt, Mycobacterium bovis subsp bovis AF2122/97
cgccgcgcuugcgaucg

SEQ ID NO: 1108708 - RNA, 19 nt, Mycobacterium bovis subsp bovis AF2122/97
cgccgcgcuugcgaucggc

SEQ ID NO: 1108709 - RNA, 14 nt, Mycobacterium bovis subsp bovis AF2122/97
cgccgcggcggcag

SEQ ID NO: 1108710 - RNA, 15 nt, Mycobacterium bovis subsp bovis AF2122/97
cgccgcggcggcagc

SEQ ID NO: 1108711 - RNA, 14 nt, Mycobacterium bovis subsp bovis AF2122/97
cgccgcggcgcccg

SEQ ID NO: 1108712 - RNA, 14 nt, Mycobacterium bovis subsp bovis AF2122/97
cgccgcggcggaug

SEQ ID NO: 1108713 - RNA, 14 nt, Mycobacterium bovis subsp bovis AF2122/97
cgccgcgggcgccg

SEQ ID NO: 1108714 - RNA, 13 nt, Mycobacterium bovis subsp bovis AF2122/97
cgccgcgggcgcc

SEQ ID NO: 1108715 - RNA, 15 nt, Mycobacterium bovis subsp bovis AF2122/97
cgccgcgggacacca

SEQ ID NO: 1108716 - RNA, 19 nt, Mycobacterium bovis subsp bovis AF2122/97
cgccgcgggacaccaccgc

SEQ ID NO: 1108717 - RNA, 18 nt, Mycobacterium bovis subsp bovis AF2122/97
cgccgcgggcugaccaac

SEQ ID NO: 1108718 - RNA, 22 nt, Mycobacterium bovis subsp bovis AF2122/97
cgccgcgggcugaccaacccaa

SEQ ID NO: 1108719 - RNA, 14 nt, Mycobacterium bovis subsp bovis AF2122/97
cgccgcggacacca

SEQ ID NO: 1108720 - RNA, 16 nt, Mycobacterium bovis subsp bovis AF2122/97
cgccgcggacaccagg

SEQ ID NO: 1108721 - RNA, 22 nt, Mycobacterium bovis subsp bovis AF2122/97
cgccgcggaccagaggucgagg

SEQ ID NO: 1108722 - RNA, 20 nt, Mycobacterium bovis subsp bovis AF2122/97
cgccgcgcuugcgaucgccg

SEQ ID NO: 1108723 - RNA, 13 nt, Mycobacterium bovis subsp bovis AF2122/97
cgccgcggccaca

SEQ ID NO: 1108724 - RNA, 15 nt, Mycobacterium bovis subsp bovis AF2122/97
cgccgcggccaccac

SEQ ID NO: 1108725 - RNA, 19 nt, Mycobacterium bovis subsp bovis AF2122/97
cgccgcggccaccaccgcc

SEQ ID NO: 1108726 - RNA, 16 nt, Mycobacterium bovis subsp bovis AF2122/97
cgccgcggcagcguug

SEQ ID NO: 1108727 - RNA, 23 nt, Mycobacterium bovis subsp bovis AF2122/97
cgccgcggcagcguugacgguca

SEQ ID NO: 1108728 - RNA, 13 nt, Mycobacterium bovis subsp bovis AF2122/97
cgccgcggcaggg

SEQ ID NO: 1108729 - RNA, 13 nt, Mycobacterium bovis subsp bovis AF2122/97
cgccgcggccgcc

SEQ ID NO: 1108730 - RNA, 14 nt, Mycobacterium bovis subsp bovis AF2122/97
cgccgcggccgccg

SEQ ID NO: 1108731 - RNA, 13 nt, Mycobacterium bovis subsp bovis AF2122/97
cgccgcggcccgc

SEQ ID NO: 1108732 - RNA, 17 nt, Mycobacterium bovis subsp bovis AF2122/97
cgccgcggcccgcucca

SEQ ID NO: 1108733 - RNA, 15 nt, Mycobacterium bovis subsp bovis AF2122/97
cgccgcggccggcgc

SEQ ID NO: 1108734 - RNA, 13 nt, Mycobacterium bovis subsp bovis AF2122/97
cgccgcggcgacg

SEQ ID NO: 1108735 - RNA, 12 nt, Mycobacterium bovis subsp bovis AF2122/97
cgccgcggcgcc

SEQ ID NO: 1108736 - RNA, 12 nt, Mycobacterium bovis subsp bovis AF2122/97
cgcgaucggugc

SEQ ID NO: 1108737 - RNA, 19 nt, Mycobacterium bovis subsp bovis AF2122/97
cgcgaucgggcccagcagc

SEQ ID NO: 1108738 - RNA, 14 nt, Mycobacterium bovis subsp bovis AF2122/97
cgcgaucgggccga

SEQ ID NO: 1108739 - RNA, 20 nt, Mycobacterium bovis subsp bovis AF2122/97
cgcgaucgggccggcgcggu

SEQ ID NO: 1108740 - RNA, 22 nt, Mycobacterium bovis subsp bovis AF2122/97
cgcgaucggggcgacgauccgc

SEQ ID NO: 1108741 - RNA, 20 nt, Mycobacterium bovis subsp bovis AF2122/97
cgcgaucuccuuggccguuc

SEQ ID NO: 1108742 - RNA, 17 nt, Mycobacterium bovis subsp bovis AF2122/97
cgcgaucggugcgggcg

SEQ ID NO: 1108743 - RNA, 17 nt, Mycobacterium bovis subsp bovis AF2122/97
cgcgaucgucgacucgg

SEQ ID NO: 1108744 - RNA, 22 nt, Mycobacterium bovis subsp bovis AF2122/97
cgcgaucgucggguugucgcgg

SEQ ID NO: 1108745 - RNA, 23 nt, Mycobacterium bovis subsp bovis AF2122/97
cgcgaucugcucguagcggcggc

SEQ ID NO: 1108746 - RNA, 18 nt, Mycobacterium bovis subsp bovis AF2122/97
cgcgaugauaccugccca

SEQ ID NO: 1108747 - RNA, 20 nt, Mycobacterium bovis subsp bovis AF2122/97
cgcgaugaugaguucgcgca

SEQ ID NO: 1108748 - RNA, 14 nt, Mycobacterium bovis subsp bovis AF2122/97
cgcgaugaugaucg

SEQ ID NO: 1108749 - RNA, 18 nt, Mycobacterium bovis subsp bovis AF2122/97
cgcgaugaugaucggguc

SEQ ID NO: 1108750 - RNA, 15 nt, Mycobacterium bovis subsp bovis AF2122/97
cgcgaugcagugcga

SEQ ID NO: 1108751 - RNA, 18 nt, Mycobacterium bovis subsp bovis AF2122/97
cgcgaugccacccaacag

SEQ ID NO: 1108752 - RNA, 19 nt, Mycobacterium bovis subsp bovis AF2122/97
cgcgaugccacccaacagc

SEQ ID NO: 1108753 - RNA, 23 nt, Mycobacterium bovis subsp bovis AF2122/97
cgcgaugccacccaacagcgcua

SEQ ID NO: 1108754 - RNA, 18 nt, Mycobacterium bovis subsp bovis AF2122/97
cgcgaugaucaugaacgc

SEQ ID NO: 1108755 - RNA, 18 nt, Mycobacterium bovis subsp bovis AF2122/97
cgcgaugacggugccgac

SEQ ID NO: 1108756 - RNA, 21 nt, Mycobacterium bovis subsp bovis AF2122/97
cgcgaugacggugccgaccgc

SEQ ID NO: 1108757 - RNA, 13 nt, Mycobacterium bovis subsp bovis AF2122/97
cgcgaugaccgca

SEQ ID NO: 1108758 - RNA, 20 nt, Mycobacterium bovis subsp bovis AF2122/97
cgcgaugaccgcaccgaccu

SEQ ID NO: 1108759 - RNA, 24 nt, Mycobacterium bovis subsp bovis AF2122/97
cgcgaugaccgcaccgaccugagu

SEQ ID NO: 1108760 - RNA, 16 nt, Mycobacterium bovis subsp bovis AF2122/97
cgcgaugacgaugucc

SEQ ID NO: 1108761 - RNA, 17 nt, Mycobacterium bovis subsp bovis AF2122/97
cgcgaugacggugccga

SEQ ID NO: 1108762 - RNA, 18 nt, Mycobacterium bovis subsp bovis AF2122/97
cgcgaucgacgcucggcu

SEQ ID NO: 1108763 - RNA, 12 nt, Mycobacterium bovis subsp bovis AF2122/97
cgcgaucgacgg

SEQ ID NO: 1108764 - RNA, 15 nt, Mycobacterium bovis subsp bovis AF2122/97
cgcgaucgccgacgc

SEQ ID NO: 1108765 - RNA, 22 nt, Mycobacterium bovis subsp bovis AF2122/97
cgcgaucgcucauucgugcccg

SEQ ID NO: 1108766 - RNA, 11 nt, Mycobacterium bovis subsp bovis AF2122/97
cgcgaucgcga

SEQ ID NO: 1108767 - RNA, 15 nt, Mycobacterium bovis subsp bovis AF2122/97
cgcgauccacuccgg

SEQ ID NO: 1108768 - RNA, 13 nt, Mycobacterium bovis subsp bovis AF2122/97
cgcgaucagcugg

SEQ ID NO: 1108769 - RNA, 12 nt, Mycobacterium bovis subsp bovis AF2122/97
cgcgauccgcgc

SEQ ID NO: 1108770 - RNA, 18 nt, Mycobacterium bovis subsp bovis AF2122/97
cgcgaucccaacgcccgg

SEQ ID NO: 1108771 - RNA, 13 nt, Mycobacterium bovis subsp bovis AF2122/97
cgcgauccccacg

SEQ ID NO: 1108772 - RNA, 19 nt, Mycobacterium bovis subsp bovis AF2122/97
cgcgauccagcgcugaccg

SEQ ID NO: 1108773 - RNA, 14 nt, Mycobacterium bovis subsp bovis AF2122/97
cgcgaugucguucg

SEQ ID NO: 1108774 - RNA, 17 nt, Mycobacterium bovis subsp bovis AF2122/97
cgcgaugucgccggcga

SEQ ID NO: 1108775 - RNA, 15 nt, Mycobacterium bovis subsp bovis AF2122/97
cgcgauuccggcggc

SEQ ID NO: 1108776 - RNA, 17 nt, Mycobacterium bovis subsp bovis AF2122/97
cgcgauucgaccgguga

SEQ ID NO: 1108777 - RNA, 18 nt, Mycobacterium bovis subsp bovis AF2122/97
cgcgauucgaccggugau

SEQ ID NO: 1108778 - RNA, 16 nt, Mycobacterium bovis subsp bovis AF2122/97
cgcgauuagcaaaccg

SEQ ID NO: 1108779 - RNA, 18 nt, Mycobacterium bovis subsp bovis AF2122/97
cgcgauucgcggcagccg

SEQ ID NO: 1108780 - RNA, 21 nt, Mycobacterium bovis subsp bovis AF2122/97
cgcgcaaaugccugcuggucg

SEQ ID NO: 1108781 - RNA, 22 nt, Mycobacterium bovis subsp bovis AF2122/97
cgcgcaaaugccugcuggucgg

SEQ ID NO: 1108782 - RNA, 18 nt, Mycobacterium bovis subsp bovis AF2122/97
cgcgcaaaugccugcugg

SEQ ID NO: 1108783 - RNA, 20 nt, Mycobacterium bovis subsp bovis AF2122/97
cgcgcaaaugccugcugguc

SEQ ID NO: 1108784 - RNA, 17 nt, Mycobacterium bovis subsp bovis AF2122/97
cgcgauuucgucgucgu

SEQ ID NO: 1108785 - RNA, 14 nt, Mycobacterium bovis subsp bovis AF2122/97
cgcgcaaccagauc

SEQ ID NO: 1108786 - RNA, 23 nt, Mycobacterium bovis subsp bovis AF2122/97
cgcgcaacaccucgucggcuuug

SEQ ID NO: 1108787 - RNA, 17 nt, Mycobacterium bovis subsp bovis AF2122/97
cgcgcaacccggacgaa

SEQ ID NO: 1108788 - RNA, 18 nt, Mycobacterium bovis subsp bovis AF2122/97
cgcgcaacccggacgaac

SEQ ID NO: 1108789 - RNA, 17 nt, Mycobacterium bovis subsp bovis AF2122/97
cgcgcaacccugccgcg

SEQ ID NO: 1108790 - RNA, 13 nt, Mycobacterium bovis subsp bovis AF2122/97
cgcgcaaccagcc

SEQ ID NO: 1108791 - RNA, 13 nt, Mycobacterium bovis subsp bovis AF2122/97
cgcgcaaccgcuc

SEQ ID NO: 1108792 - RNA, 22 nt, Mycobacterium bovis subsp bovis AF2122/97
cgcgauggugguuccgcccggu

SEQ ID NO: 1108793 - RNA, 14 nt, Mycobacterium bovis subsp bovis AF2122/97
cgcgaugguggccg

SEQ ID NO: 1108794 - RNA, 19 nt, Mycobacterium bovis subsp bovis AF2122/97
cgcgaugguggccgccacc

SEQ ID NO: 1108795 - RNA, 13 nt, Mycobacterium bovis subsp bovis AF2122/97
cgcgauggcgcgu

SEQ ID NO: 1108796 - RNA, 18 nt, Mycobacterium bovis subsp bovis AF2122/97
cgcgauggcgcguggucg

SEQ ID NO: 1108797 - RNA, 17 nt, Mycobacterium bovis subsp bovis AF2122/97
cgcgauggcguagccca

SEQ ID NO: 1108798 - RNA, 14 nt, Mycobacterium bovis subsp bovis AF2122/97
cgcgauggccauca

SEQ ID NO: 1108799 - RNA, 20 nt, Mycobacterium bovis subsp bovis AF2122/97
cgcgaugcccacgcacagca

SEQ ID NO: 1108800 - RNA, 20 nt, Mycobacterium bovis subsp bovis AF2122/97
cgcgaugccccacggugcgg

SEQ ID NO: 1108801 - RNA, 13 nt, Mycobacterium bovis subsp bovis AF2122/97
cgcgaugccguuc

SEQ ID NO: 1108802 - RNA, 13 nt, Mycobacterium bovis subsp bovis AF2122/97
cgcgauggcagcg

SEQ ID NO: 1108803 - RNA, 23 nt, Mycobacterium bovis subsp bovis AF2122/97
cgcgaugauggcgguaccgggau

SEQ ID NO: 1108804 - RNA, 19 nt, Mycobacterium bovis subsp bovis AF2122/97
cgcgauagauacccgcggc

SEQ ID NO: 1108805 - RNA, 23 nt, Mycobacterium bovis subsp bovis AF2122/97
cgcgauagauacccgcggcagca

SEQ ID NO: 1108806 - RNA, 14 nt, Mycobacterium bovis subsp bovis AF2122/97
cgcgaucagcgcgc

SEQ ID NO: 1108807 - RNA, 21 nt, Mycobacterium bovis subsp bovis AF2122/97
cgcgaucacuuccggauucgg

SEQ ID NO: 1108808 - RNA, 20 nt, Mycobacterium bovis subsp bovis AF2122/97
cgcgaucaccgagucgacgg

SEQ ID NO: 1108809 - RNA, 16 nt, Mycobacterium bovis subsp bovis AF2122/97
cgcgagggcgcguguc

SEQ ID NO: 1108810 - RNA, 21 nt, Mycobacterium bovis subsp bovis AF2122/97
cgcgaggggccggcucaguca

SEQ ID NO: 1108811 - RNA, 17 nt, Mycobacterium bovis subsp bovis AF2122/97
cgcgaggcgucaccccg

SEQ ID NO: 1108812 - RNA, 18 nt, Mycobacterium bovis subsp bovis AF2122/97
cgcgaggcucgcguggcc

SEQ ID NO: 1108813 - RNA, 21 nt, Mycobacterium bovis subsp bovis AF2122/97
cgcgaggcucgcguggccgcc

SEQ ID NO: 1108814 - RNA, 15 nt, Mycobacterium bovis subsp bovis AF2122/97
cgcgaggcucggucg

SEQ ID NO: 1108815 - RNA, 21 nt, Mycobacterium bovis subsp bovis AF2122/97
cgcgaggcucguggcgacggc

SEQ ID NO: 1108816 - RNA, 14 nt, Mycobacterium bovis subsp bovis AF2122/97
cgcgaggucggcgg

SEQ ID NO: 1108817 - RNA, 18 nt, Mycobacterium bovis subsp bovis AF2122/97
cgcgaggucggcggcgca

SEQ ID NO: 1108818 - RNA, 23 nt, Mycobacterium bovis subsp bovis AF2122/97
cgcgagggggguguugaggccgg

SEQ ID NO: 1108819 - RNA, 16 nt, Mycobacterium bovis subsp bovis AF2122/97
cgcgagucgcccguga

SEQ ID NO: 1108820 - RNA, 13 nt, Mycobacterium bovis subsp bovis AF2122/97
cgcgagucggcgg

SEQ ID NO: 1108821 - RNA, 19 nt, Mycobacterium bovis subsp bovis AF2122/97
cgcgagucggcggggcgga

SEQ ID NO: 1108822 - RNA, 21 nt, Mycobacterium bovis subsp bovis AF2122/97
cgcgaguaagcgaacagcggc

SEQ ID NO: 1108823 - RNA, 17 nt, Mycobacterium bovis subsp bovis AF2122/97
cgcgagggcauccgagc

SEQ ID NO: 1108824 - RNA, 23 nt, Mycobacterium bovis subsp bovis AF2122/97
cgcgaguagcugacccgcgguag

SEQ ID NO: 1108825 - RNA, 23 nt, Mycobacterium bovis subsp bovis AF2122/97
cgcgagcuuggccagcagcagcg

SEQ ID NO: 1108826 - RNA, 19 nt, Mycobacterium bovis subsp bovis AF2122/97
cgcgagcuuggccggcagg

SEQ ID NO: 1108827 - RNA, 22 nt, Mycobacterium bovis subsp bovis AF2122/97
cgcgagcuguaggucagcgcgu

SEQ ID NO: 1108828 - RNA, 20 nt, Mycobacterium bovis subsp bovis AF2122/97
cgcgagcuuggccagcagca

SEQ ID NO: 1108829 - RNA, 22 nt, Mycobacterium bovis subsp bovis AF2122/97
cgcgaggaggcuuacaugcccu

SEQ ID NO: 1108830 - RNA, 23 nt, Mycobacterium bovis subsp bovis AF2122/97
cgcgaggaugcugagcgccaggc

SEQ ID NO: 1108831 - RNA, 18 nt, Mycobacterium bovis subsp bovis AF2122/97
cgcgaggcaagaacccga

SEQ ID NO: 1108832 - RNA, 20 nt, Mycobacterium bovis subsp bovis AF2122/97
cgcgaggcgcucacccgccg

SEQ ID NO: 1108833 - RNA, 14 nt, Mycobacterium bovis subsp bovis AF2122/97
cgcgagcgagccaa

SEQ ID NO: 1108834 - RNA, 20 nt, Mycobacterium bovis subsp bovis AF2122/97
cgcgagcgccgcuaugaggc

SEQ ID NO: 1108835 - RNA, 13 nt, Mycobacterium bovis subsp bovis AF2122/97
cgcgagcgccggc

SEQ ID NO: 1108836 - RNA, 17 nt, Mycobacterium bovis subsp bovis AF2122/97
cgcgagcgccggccgcg

SEQ ID NO: 1108837 - RNA, 18 nt, Mycobacterium bovis subsp bovis AF2122/97
cgcgagccgcacgaugcc

SEQ ID NO: 1108838 - RNA, 18 nt, Mycobacterium bovis subsp bovis AF2122/97
cgcgagcccgaaccaccg

SEQ ID NO: 1108839 - RNA, 14 nt, Mycobacterium bovis subsp bovis AF2122/97
cgcgagccucgcgc

SEQ ID NO: 1108840 - RNA, 22 nt, Mycobacterium bovis subsp bovis AF2122/97
cgcgagccugauaaagcccggc

SEQ ID NO: 1108841 - RNA, 13 nt, Mycobacterium bovis subsp bovis AF2122/97
cgcgagccgguga

SEQ ID NO: 1108842 - RNA, 14 nt, Mycobacterium bovis subsp bovis AF2122/97
cgcgagccggugau

SEQ ID NO: 1108843 - RNA, 18 nt, Mycobacterium bovis subsp bovis AF2122/97
cgcgagccggugauccgg

SEQ ID NO: 1108844 - RNA, 19 nt, Mycobacterium bovis subsp bovis AF2122/97
cgcgagccggugauccggu

SEQ ID NO: 1108845 - RNA, 15 nt, Mycobacterium bovis subsp bovis AF2122/97
cgcgagcagcccggc

SEQ ID NO: 1108846 - RNA, 16 nt, Mycobacterium bovis subsp bovis AF2122/97
cgcgagcagcccggcg

SEQ ID NO: 1108847 - RNA, 20 nt, Mycobacterium bovis subsp bovis AF2122/97
cgcgagcaacaccagggccu

SEQ ID NO: 1108848 - RNA, 13 nt, Mycobacterium bovis subsp bovis AF2122/97
cgcgagcagcccg

SEQ ID NO: 1108849 - RNA, 14 nt, Mycobacterium bovis subsp bovis AF2122/97
cgcgagcacgucgg

SEQ ID NO: 1108850 - RNA, 21 nt, Mycobacterium bovis subsp bovis AF2122/97
cgcgagcagacacagaaucgc

SEQ ID NO: 1108851 - RNA, 15 nt, Mycobacterium bovis subsp bovis AF2122/97
cgcgagcagacgcag

SEQ ID NO: 1108852 - RNA, 21 nt, Mycobacterium bovis subsp bovis AF2122/97
cgcgagcagacgcagaaucgc

SEQ ID NO: 1108853 - RNA, 22 nt, Mycobacterium bovis subsp bovis AF2122/97
cgcgagcagacguaaaagcccc

SEQ ID NO: 1108854 - RNA, 17 nt, Mycobacterium bovis subsp bovis AF2122/97
cgcgagaucagccggca

SEQ ID NO: 1108855 - RNA, 20 nt, Mycobacterium bovis subsp bovis AF2122/97
cgcgacgaugccucggcggc

SEQ ID NO: 1108856 - RNA, 16 nt, Mycobacterium bovis subsp bovis AF2122/97
cgcgacgccgucaugc

SEQ ID NO: 1108857 - RNA, 16 nt, Mycobacterium bovis subsp bovis AF2122/97
cgcgacgcggggcuca

SEQ ID NO: 1108858 - RNA, 12 nt, Mycobacterium bovis subsp bovis AF2122/97
cgcgacgcucgc

SEQ ID NO: 1108859 - RNA, 13 nt, Mycobacterium bovis subsp bovis AF2122/97
cgcgacgcucgcu

SEQ ID NO: 1108860 - RNA, 16 nt, Mycobacterium bovis subsp bovis AF2122/97
cgcgacggaaccaguu

SEQ ID NO: 1108861 - RNA, 22 nt, Mycobacterium bovis subsp bovis AF2122/97
cgcgacggaaccaguugacgaa

SEQ ID NO: 1108862 - RNA, 14 nt, Mycobacterium bovis subsp bovis AF2122/97
cgcgaccucgcggc

SEQ ID NO: 1108863 - RNA, 16 nt, Mycobacterium bovis subsp bovis AF2122/97
cgcgaccucgcuggcc

SEQ ID NO: 1108864 - RNA, 19 nt, Mycobacterium bovis subsp bovis AF2122/97
cgcgaccuggucgaacugu

SEQ ID NO: 1108865 - RNA, 14 nt, Mycobacterium bovis subsp bovis AF2122/97
cgcgacgacacgcc

SEQ ID NO: 1108866 - RNA, 20 nt, Mycobacterium bovis subsp bovis AF2122/97
cgcgaccgucagggucaccu

SEQ ID NO: 1108867 - RNA, 22 nt, Mycobacterium bovis subsp bovis AF2122/97
cgcgaccgucagggucaccugc

SEQ ID NO: 1108868 - RNA, 12 nt, Mycobacterium bovis subsp bovis AF2122/97
cgcgaccggcgu

SEQ ID NO: 1108869 - RNA, 20 nt, Mycobacterium bovis subsp bovis AF2122/97
cgcgaccggcguaaccggca

SEQ ID NO: 1108870 - RNA, 22 nt, Mycobacterium bovis subsp bovis AF2122/97
cgcgagauccuucgcguuggcc

SEQ ID NO: 1108871 - RNA, 17 nt, Mycobacterium bovis subsp bovis AF2122/97
cgcgagaucgggccggc

SEQ ID NO: 1108872 - RNA, 18 nt, Mycobacterium bovis subsp bovis AF2122/97
cgcgagaucgggccggcc

SEQ ID NO: 1108873 - RNA, 19 nt, Mycobacterium bovis subsp bovis AF2122/97
cgcgagaucgggccggccg

SEQ ID NO: 1108874 - RNA, 18 nt, Mycobacterium bovis subsp bovis AF2122/97
cgcgagagccuccauggc

SEQ ID NO: 1108875 - RNA, 23 nt, Mycobacterium bovis subsp bovis AF2122/97
cgcgagaccuucgggguaguuga

SEQ ID NO: 1108876 - RNA, 21 nt, Mycobacterium bovis subsp bovis AF2122/97
cgcgagaccaacauacagcaa

SEQ ID NO: 1108877 - RNA, 18 nt, Mycobacterium bovis subsp bovis AF2122/97
cgcgacuugcaccccguc

SEQ ID NO: 1108878 - RNA, 22 nt, Mycobacterium bovis subsp bovis AF2122/97
cgcgacuugcaccccgucucgg

SEQ ID NO: 1108879 - RNA, 12 nt, Mycobacterium bovis subsp bovis AF2122/97
cgcgacgucugc

SEQ ID NO: 1108880 - RNA, 14 nt, Mycobacterium bovis subsp bovis AF2122/97
cgcgacgucggccg

SEQ ID NO: 1108881 - RNA, 19 nt, Mycobacterium bovis subsp bovis AF2122/97
cgcgacguaguugccggcu

SEQ ID NO: 1108882 - RNA, 16 nt, Mycobacterium bovis subsp bovis AF2122/97
cgcgacguccaccagc

SEQ ID NO: 1108883 - RNA, 18 nt, Mycobacterium bovis subsp bovis AF2122/97
cgcgacguccaccagccg

SEQ ID NO: 1108884 - RNA, 16 nt, Mycobacterium bovis subsp bovis AF2122/97
cgcgacugcaccuggc

SEQ ID NO: 1108885 - RNA, 21 nt, Mycobacterium bovis subsp bovis AF2122/97
cgcgacugcaccuggccgccc

SEQ ID NO: 1108886 - RNA, 16 nt, Mycobacterium bovis subsp bovis AF2122/97
cgcgacuagacgccgc

SEQ ID NO: 1108887 - RNA, 21 nt, Mycobacterium bovis subsp bovis AF2122/97
cgcgacguaguggaagccgac

SEQ ID NO: 1108888 - RNA, 19 nt, Mycobacterium bovis subsp bovis AF2122/97
cgcgacuagacgccgccgc

SEQ ID NO: 1108889 - RNA, 17 nt, Mycobacterium bovis subsp bovis AF2122/97
cgcgacggcccgauccc

SEQ ID NO: 1108890 - RNA, 23 nt, Mycobacterium bovis subsp bovis AF2122/97
cgcgacggcccgaucccgaucga

SEQ ID NO: 1108891 - RNA, 14 nt, Mycobacterium bovis subsp bovis AF2122/97
cgcgacggccggga

SEQ ID NO: 1108892 - RNA, 14 nt, Mycobacterium bovis subsp bovis AF2122/97
cgcgacggcaagca

SEQ ID NO: 1108893 - RNA, 20 nt, Mycobacterium bovis subsp bovis AF2122/97
cgcgacggcaagcacggugg

SEQ ID NO: 1108894 - RNA, 18 nt, Mycobacterium bovis subsp bovis AF2122/97
cgcgacggcauguaccga

SEQ ID NO: 1108895 - RNA, 21 nt, Mycobacterium bovis subsp bovis AF2122/97
cgcgacggcauguaccgaccg

SEQ ID NO: 1108896 - RNA, 13 nt, Mycobacterium bovis subsp bovis AF2122/97
cgcgacggcgccg

SEQ ID NO: 1108897 - RNA, 12 nt, Mycobacterium bovis subsp bovis AF2122/97
cgcgacggcgcg

SEQ ID NO: 1108898 - RNA, 16 nt, Mycobacterium bovis subsp bovis AF2122/97
cgcgacggcgcggugc

SEQ ID NO: 1108899 - RNA, 14 nt, Mycobacterium bovis subsp bovis AF2122/97
cgcgacggcggcuc

SEQ ID NO: 1108900 - RNA, 22 nt, Mycobacterium bovis subsp bovis AF2122/97
cgcgacggucccuucgucaccg

SEQ ID NO: 1108901 - RNA, 19 nt, Mycobacterium bovis subsp bovis AF2122/97
cgcgacggggucgcgaugc

SEQ ID NO: 1108902 - RNA, 14 nt, Mycobacterium bovis subsp bovis AF2122/97
cgcgacgggccgcg

SEQ ID NO: 1108903 - RNA, 22 nt, Mycobacterium bovis subsp bovis AF2122/97
cgcgacgguucgaugaaaaugc

SEQ ID NO: 1108904 - RNA, 19 nt, Mycobacterium bovis subsp bovis AF2122/97
cgcgacgggcacccgagcc

SEQ ID NO: 1108905 - RNA, 20 nt, Mycobacterium bovis subsp bovis AF2122/97
cgcgacguaguggaagccga

SEQ ID NO: 1108906 - RNA, 23 nt, Mycobacterium bovis subsp bovis AF2122/97
cgcgaacgggucgggacgcugcc

SEQ ID NO: 1108907 - RNA, 19 nt, Mycobacterium bovis subsp bovis AF2122/97
cgcgaacgucaaccgggcg

SEQ ID NO: 1108908 - RNA, 19 nt, Mycobacterium bovis subsp bovis AF2122/97
cgcgaacgucagugccccg

SEQ ID NO: 1108909 - RNA, 20 nt, Mycobacterium bovis subsp bovis AF2122/97
cgcgaacgucagugccccgc

SEQ ID NO: 1108910 - RNA, 17 nt, Mycobacterium bovis subsp bovis AF2122/97
cgcgaacuccagcagcc

SEQ ID NO: 1108911 - RNA, 18 nt, Mycobacterium bovis subsp bovis AF2122/97
cgcgaacgcggccaccac

SEQ ID NO: 1108912 - RNA, 17 nt, Mycobacterium bovis subsp bovis AF2122/97
cgcgaagucuugaccgc

SEQ ID NO: 1108913 - RNA, 19 nt, Mycobacterium bovis subsp bovis AF2122/97
cgcgaagucuugaccgcac

SEQ ID NO: 1108914 - RNA, 21 nt, Mycobacterium bovis subsp bovis AF2122/97
cgcgaagucuugaccgcaccg

SEQ ID NO: 1108915 - RNA, 17 nt, Mycobacterium bovis subsp bovis AF2122/97
cgcgaacuugcugacga

SEQ ID NO: 1108916 - RNA, 19 nt, Mycobacterium bovis subsp bovis AF2122/97
cgcgaagugcuugggccgc

SEQ ID NO: 1108917 - RNA, 17 nt, Mycobacterium bovis subsp bovis AF2122/97
cgcgaaguuugcgacga

SEQ ID NO: 1108918 - RNA, 14 nt, Mycobacterium bovis subsp bovis AF2122/97
cgcgaauaccagac

SEQ ID NO: 1108919 - RNA, 16 nt, Mycobacterium bovis subsp bovis AF2122/97
cgcgacaucgguggcg

SEQ ID NO: 1108920 - RNA, 18 nt, Mycobacterium bovis subsp bovis AF2122/97
cgcgacaucgguggcggc

SEQ ID NO: 1108921 - RNA, 15 nt, Mycobacterium bovis subsp bovis AF2122/97
cgcgacauccgcggc

SEQ ID NO: 1108922 - RNA, 16 nt, Mycobacterium bovis subsp bovis AF2122/97
cgcgacagccguggcg

SEQ ID NO: 1108923 - RNA, 16 nt, Mycobacterium bovis subsp bovis AF2122/97
cgcgaaugucgccgcc

SEQ ID NO: 1108924 - RNA, 20 nt, Mycobacterium bovis subsp bovis AF2122/97
cgcgacagacagcaccgccg

SEQ ID NO: 1108925 - RNA, 13 nt, Mycobacterium bovis subsp bovis AF2122/97
cgcgacagccacc

SEQ ID NO: 1108926 - RNA, 23 nt, Mycobacterium bovis subsp bovis AF2122/97
cgcgacagacagcaccgccggug

SEQ ID NO: 1108927 - RNA, 14 nt, Mycobacterium bovis subsp bovis AF2122/97
cgcgaauguccggc

SEQ ID NO: 1108928 - RNA, 16 nt, Mycobacterium bovis subsp bovis AF2122/97
cgcgaauccuggcggg

SEQ ID NO: 1108929 - RNA, 15 nt, Mycobacterium bovis subsp bovis AF2122/97
cgcgaaugaagcccu

SEQ ID NO: 1108930 - RNA, 21 nt, Mycobacterium bovis subsp bovis AF2122/97
cgcgaaugacgauccagccca

SEQ ID NO: 1108931 - RNA, 15 nt, Mycobacterium bovis subsp bovis AF2122/97
cgcgaaaggccacga

SEQ ID NO: 1108932 - RNA, 15 nt, Mycobacterium bovis subsp bovis AF2122/97
cgcgaaagcaccgag

SEQ ID NO: 1108933 - RNA, 18 nt, Mycobacterium bovis subsp bovis AF2122/97
cgcgaaacccugaaaagg

SEQ ID NO: 1108934 - RNA, 19 nt, Mycobacterium bovis subsp bovis AF2122/97
cgcgaaaccgccgucccgg

SEQ ID NO: 1108935 - RNA, 18 nt, Mycobacterium bovis subsp bovis AF2122/97
cgcgaaaccaguccaucg

SEQ ID NO: 1108936 - RNA, 14 nt, Mycobacterium bovis subsp bovis AF2122/97
cgccuugucgaucu

SEQ ID NO: 1108937 - RNA, 15 nt, Mycobacterium bovis subsp bovis AF2122/97
cgccuuuggcguucu

SEQ ID NO: 1108938 - RNA, 15 nt, Mycobacterium bovis subsp bovis AF2122/97
cgccuuugcccgccg

SEQ ID NO: 1108939 - RNA, 14 nt, Mycobacterium bovis subsp bovis AF2122/97
cgccuuugccgccg

SEQ ID NO: 1108940 - RNA, 15 nt, Mycobacterium bovis subsp bovis AF2122/97
cgccuuugccgccgg

SEQ ID NO: 1108941 - RNA, 22 nt, Mycobacterium bovis subsp bovis AF2122/97
cgccuuugccgccggcaccgcc

SEQ ID NO: 1108942 - RNA, 15 nt, Mycobacterium bovis subsp bovis AF2122/97
cgccugcugguaccg

SEQ ID NO: 1108943 - RNA, 22 nt, Mycobacterium bovis subsp bovis AF2122/97
cgccuugcuuccgggacuacca

SEQ ID NO: 1108944 - RNA, 13 nt, Mycobacterium bovis subsp bovis AF2122/97
cgccuuggccccc

SEQ ID NO: 1108945 - RNA, 14 nt, Mycobacterium bovis subsp bovis AF2122/97
cgccuuggucaccu

SEQ ID NO: 1108946 - RNA, 17 nt, Mycobacterium bovis subsp bovis AF2122/97
cgccuuggucgccgccu

SEQ ID NO: 1108947 - RNA, 13 nt, Mycobacterium bovis subsp bovis AF2122/97
cgccuuggucgcg

SEQ ID NO: 1108948 - RNA, 21 nt, Mycobacterium bovis subsp bovis AF2122/97
cgccuugguccguagcgcggc

SEQ ID NO: 1108949 - RNA, 16 nt, Mycobacterium bovis subsp bovis AF2122/97
cgccuugucggcgaug

SEQ ID NO: 1108950 - RNA, 22 nt, Mycobacterium bovis subsp bovis AF2122/97
cgccuugucggcgugucgcguc

SEQ ID NO: 1108951 - RNA, 18 nt, Mycobacterium bovis subsp bovis AF2122/97
cgccucgacacccagccg

SEQ ID NO: 1108952 - RNA, 19 nt, Mycobacterium bovis subsp bovis AF2122/97
cgccucgacacccagccgc

SEQ ID NO: 1108953 - RNA, 14 nt, Mycobacterium bovis subsp bovis AF2122/97
cgccucgaccgcca

SEQ ID NO: 1108954 - RNA, 17 nt, Mycobacterium bovis subsp bovis AF2122/97
cgccucgaccgccagcc

SEQ ID NO: 1108955 - RNA, 15 nt, Mycobacterium bovis subsp bovis AF2122/97
cgccucgacacccag

SEQ ID NO: 1108956 - RNA, 18 nt, Mycobacterium bovis subsp bovis AF2122/97
cgccucgaggaccaccac

SEQ ID NO: 1108957 - RNA, 19 nt, Mycobacterium bovis subsp bovis AF2122/97
cgccucgaggaccaccacu

SEQ ID NO: 1108958 - RNA, 13 nt, Mycobacterium bovis subsp bovis AF2122/97
cgccucgccggcc

SEQ ID NO: 1108959 - RNA, 13 nt, Mycobacterium bovis subsp bovis AF2122/97
cgccucgcccagc

SEQ ID NO: 1108960 - RNA, 16 nt, Mycobacterium bovis subsp bovis AF2122/97
cgccucgauggcggug

SEQ ID NO: 1108961 - RNA, 17 nt, Mycobacterium bovis subsp bovis AF2122/97
cgccucgauggcggugg

SEQ ID NO: 1108962 - RNA, 12 nt, Mycobacterium bovis subsp bovis AF2122/97
cgccucaccgac

SEQ ID NO: 1108963 - RNA, 14 nt, Mycobacterium bovis subsp bovis AF2122/97
cgccucaagcucgc

SEQ ID NO: 1108964 - RNA, 18 nt, Mycobacterium bovis subsp bovis AF2122/97
cgccucaagcucgccgga

SEQ ID NO: 1108965 - RNA, 16 nt, Mycobacterium bovis subsp bovis AF2122/97
cgccucaaugaccacc

SEQ ID NO: 1108966 - RNA, 19 nt, Mycobacterium bovis subsp bovis AF2122/97
cgccucaaugaccaccggg

SEQ ID NO: 1108967 - RNA, 17 nt, Mycobacterium bovis subsp bovis AF2122/97
cgccucaccgacgucgc

SEQ ID NO: 1108968 - RNA, 15 nt, Mycobacterium bovis subsp bovis AF2122/97
cgccucaccacgucg

SEQ ID NO: 1108969 - RNA, 19 nt, Mycobacterium bovis subsp bovis AF2122/97
cgccucaccgacgucgcca

SEQ ID NO: 1108970 - RNA, 14 nt, Mycobacterium bovis subsp bovis AF2122/97
cgccuccugccgcc

SEQ ID NO: 1108971 - RNA, 14 nt, Mycobacterium bovis subsp bovis AF2122/97
cgccuccucgacgu

SEQ ID NO: 1108972 - RNA, 14 nt, Mycobacterium bovis subsp bovis AF2122/97
cgccuccagcacca

SEQ ID NO: 1108973 - RNA, 14 nt, Mycobacterium bovis subsp bovis AF2122/97
cgccuccaccgccg

SEQ ID NO: 1108974 - RNA, 17 nt, Mycobacterium bovis subsp bovis AF2122/97
cgccuccaccgccgcgc

SEQ ID NO: 1108975 - RNA, 21 nt, Mycobacterium bovis subsp bovis AF2122/97
cgccucgugaguugacggugg

SEQ ID NO: 1108976 - RNA, 14 nt, Mycobacterium bovis subsp bovis AF2122/97
cgccucgccggcca

SEQ ID NO: 1108977 - RNA, 17 nt, Mycobacterium bovis subsp bovis AF2122/97
cgccucgccggccacca

SEQ ID NO: 1108978 - RNA, 19 nt, Mycobacterium bovis subsp bovis AF2122/97
cgccucgccggccaccagc

SEQ ID NO: 1108979 - RNA, 17 nt, Mycobacterium bovis subsp bovis AF2122/97
cgccucgccggccaccc

SEQ ID NO: 1108980 - RNA, 23 nt, Mycobacterium bovis subsp bovis AF2122/97
cgccugccaucacgcgcucaccg

SEQ ID NO: 1108981 - RNA, 15 nt, Mycobacterium bovis subsp bovis AF2122/97
cgccugagccaccaa

SEQ ID NO: 1108982 - RNA, 16 nt, Mycobacterium bovis subsp bovis AF2122/97
cgccugagcgccgcgg

SEQ ID NO: 1108983 - RNA, 13 nt, Mycobacterium bovis subsp bovis AF2122/97
cgccugagcgcuc

SEQ ID NO: 1108984 - RNA, 15 nt, Mycobacterium bovis subsp bovis AF2122/97
cgccugaccgccacc

SEQ ID NO: 1108985 - RNA, 19 nt, Mycobacterium bovis subsp bovis AF2122/97
cgccugaauaggucggucc

SEQ ID NO: 1108986 - RNA, 19 nt, Mycobacterium bovis subsp bovis AF2122/97
cgccugacucaucaccgau

SEQ ID NO: 1108987 - RNA, 20 nt, Mycobacterium bovis subsp bovis AF2122/97
cgccugacucaucaccgaug

SEQ ID NO: 1108988 - RNA, 16 nt, Mycobacterium bovis subsp bovis AF2122/97
cgccugccucaccgcc

SEQ ID NO: 1108989 - RNA, 15 nt, Mycobacterium bovis subsp bovis AF2122/97
cgccugccgacgagg

SEQ ID NO: 1108990 - RNA, 18 nt, Mycobacterium bovis subsp bovis AF2122/97
cgccugccgacggcauca

SEQ ID NO: 1108991 - RNA, 17 nt, Mycobacterium bovis subsp bovis AF2122/97
cgccugcccgggugaga

SEQ ID NO: 1108992 - RNA, 16 nt, Mycobacterium bovis subsp bovis AF2122/97
cgccugcccccgcgcg

SEQ ID NO: 1108993 - RNA, 19 nt, Mycobacterium bovis subsp bovis AF2122/97
cgccugccccacccgcggc

SEQ ID NO: 1108994 - RNA, 23 nt, Mycobacterium bovis subsp bovis AF2122/97
cgccugccccacccgcggcgccg

SEQ ID NO: 1108995 - RNA, 18 nt, Mycobacterium bovis subsp bovis AF2122/97
cgccugccucaccgccgc

SEQ ID NO: 1108996 - RNA, 18 nt, Mycobacterium bovis subsp bovis AF2122/97
cgccugcgccacccgcgg

SEQ ID NO: 1108997 - RNA, 16 nt, Mycobacterium bovis subsp bovis AF2122/97
cgccugcuccaccguc

SEQ ID NO: 1108998 - RNA, 17 nt, Mycobacterium bovis subsp bovis AF2122/97
cgccugcuccucggcca

SEQ ID NO: 1108999 - RNA, 20 nt, Mycobacterium bovis subsp bovis AF2122/97
cgccugcucgucggccaccg

SEQ ID NO: 1109000 - RNA, 19 nt, Mycobacterium bovis subsp bovis AF2122/97
cgccugcuccucggccagc

SEQ ID NO: 1109001 - RNA, 20 nt, Mycobacterium bovis subsp bovis AF2122/97
cgccugcuccucggccagcg

SEQ ID NO: 1109002 - RNA, 16 nt, Mycobacterium bovis subsp bovis AF2122/97
cgccgucccggcucga

SEQ ID NO: 1109003 - RNA, 20 nt, Mycobacterium bovis subsp bovis AF2122/97
cgccguccccgccgucgcca

SEQ ID NO: 1109004 - RNA, 18 nt, Mycobacterium bovis subsp bovis AF2122/97
cgccgucgaagacguugg

SEQ ID NO: 1109005 - RNA, 21 nt, Mycobacterium bovis subsp bovis AF2122/97
cgccgucgacaacaaacccgg

SEQ ID NO: 1109006 - RNA, 22 nt, Mycobacterium bovis subsp bovis AF2122/97
cgccgucgacaacaaacccggc

SEQ ID NO: 1109007 - RNA, 13 nt, Mycobacterium bovis subsp bovis AF2122/97
cgccgucgaccac

SEQ ID NO: 1109008 - RNA, 20 nt, Mycobacterium bovis subsp bovis AF2122/97
cgccgucgaagcggaccagc

SEQ ID NO: 1109009 - RNA, 14 nt, Mycobacterium bovis subsp bovis AF2122/97
cgccgucgacgucg

SEQ ID NO: 1109010 - RNA, 15 nt, Mycobacterium bovis subsp bovis AF2122/97
cgccgucgacgucga

SEQ ID NO: 1109011 - RNA, 17 nt, Mycobacterium bovis subsp bovis AF2122/97
cgccgucgacgcggccg

SEQ ID NO: 1109012 - RNA, 20 nt, Mycobacterium bovis subsp bovis AF2122/97
cgccgucgacgcggccggcc

SEQ ID NO: 1109013 - RNA, 18 nt, Mycobacterium bovis subsp bovis AF2122/97
cgccgucucugccacgcg

SEQ ID NO: 1109014 - RNA, 20 nt, Mycobacterium bovis subsp bovis AF2122/97
cgccgugaccaggugccagg

SEQ ID NO: 1109015 - RNA, 19 nt, Mycobacterium bovis subsp bovis AF2122/97
cgccgucuuggcccggucc

SEQ ID NO: 1109016 - RNA, 22 nt, Mycobacterium bovis subsp bovis AF2122/97
cgccgucuuggcccgguccgcc

SEQ ID NO: 1109017 - RNA, 19 nt, Mycobacterium bovis subsp bovis AF2122/97
cgccgugaguagguccacg

SEQ ID NO: 1109018 - RNA, 22 nt, Mycobacterium bovis subsp bovis AF2122/97
cgccgugaguagguccacguuc

SEQ ID NO: 1109019 - RNA, 23 nt, Mycobacterium bovis subsp bovis AF2122/97
cgccgugaguagguccacguucg

SEQ ID NO: 1109020 - RNA, 20 nt, Mycobacterium bovis subsp bovis AF2122/97
cgccgugaguucacguucgg

SEQ ID NO: 1109021 - RNA, 22 nt, Mycobacterium bovis subsp bovis AF2122/97
cgccgugaguucacguucggcg

SEQ ID NO: 1109022 - RNA, 20 nt, Mycobacterium bovis subsp bovis AF2122/97
cgccgugcgccgugcgaucg

SEQ ID NO: 1109023 - RNA, 18 nt, Mycobacterium bovis subsp bovis AF2122/97
cgccgugcgugcgggggc

SEQ ID NO: 1109024 - RNA, 22 nt, Mycobacterium bovis subsp bovis AF2122/97
cgccgugugcucuugcgccacg

SEQ ID NO: 1109025 - RNA, 20 nt, Mycobacterium bovis subsp bovis AF2122/97
cgccguggaacacgaagucg

SEQ ID NO: 1109026 - RNA, 20 nt, Mycobacterium bovis subsp bovis AF2122/97
cgccgugccguacgcccagg

SEQ ID NO: 1109027 - RNA, 23 nt, Mycobacterium bovis subsp bovis AF2122/97
cgccguggacgaucaacccgguc

SEQ ID NO: 1109028 - RNA, 22 nt, Mycobacterium bovis subsp bovis AF2122/97
cgccguugacgccguugccacc

SEQ ID NO: 1109029 - RNA, 18 nt, Mycobacterium bovis subsp bovis AF2122/97
cgccguuaccgacgccgg

SEQ ID NO: 1109030 - RNA, 15 nt, Mycobacterium bovis subsp bovis AF2122/97
cgccguuagcgucgc

SEQ ID NO: 1109031 - RNA, 15 nt, Mycobacterium bovis subsp bovis AF2122/97
cgccguucacccugg

SEQ ID NO: 1109032 - RNA, 15 nt, Mycobacterium bovis subsp bovis AF2122/97
cgccuaccagcaccg

SEQ ID NO: 1109033 - RNA, 17 nt, Mycobacterium bovis subsp bovis AF2122/97
cgccuaccagcaccggg

SEQ ID NO: 1109034 - RNA, 12 nt, Mycobacterium bovis subsp bovis AF2122/97
cgccuaccgcga

SEQ ID NO: 1109035 - RNA, 14 nt, Mycobacterium bovis subsp bovis AF2122/97
cgccuaccgcgacg

SEQ ID NO: 1109036 - RNA, 19 nt, Mycobacterium bovis subsp bovis AF2122/97
cgccuagccgcuccgccca

SEQ ID NO: 1109037 - RNA, 18 nt, Mycobacterium bovis subsp bovis AF2122/97
cgccuaggaguuccucga

SEQ ID NO: 1109038 - RNA, 17 nt, Mycobacterium bovis subsp bovis AF2122/97
cgccguggauacgcacg

SEQ ID NO: 1109039 - RNA, 21 nt, Mycobacterium bovis subsp bovis AF2122/97
cgccguucugaucugcgcaac

SEQ ID NO: 1109040 - RNA, 23 nt, Mycobacterium bovis subsp bovis AF2122/97
cgccguugaacggcaccagcggg

SEQ ID NO: 1109041 - RNA, 18 nt, Mycobacterium bovis subsp bovis AF2122/97
cgccuaagcauucagcgc

SEQ ID NO: 1109042 - RNA, 16 nt, Mycobacterium bovis subsp bovis AF2122/97
cgccuaaucggccugc

SEQ ID NO: 1109043 - RNA, 18 nt, Mycobacterium bovis subsp bovis AF2122/97
cgccuaaucggccugccg

SEQ ID NO: 1109044 - RNA, 23 nt, Mycobacterium bovis subsp bovis AF2122/97
cgccuaaucggccugccggcagc

SEQ ID NO: 1109045 - RNA, 20 nt, Mycobacterium bovis subsp bovis AF2122/97
cgccuaagcauucagcgcgc

SEQ ID NO: 1109046 - RNA, 19 nt, Mycobacterium bovis subsp bovis AF2122/97
cgccgggugccgccacgug

SEQ ID NO: 1109047 - RNA, 15 nt, Mycobacterium bovis subsp bovis AF2122/97
cgccgggugcgccgu

SEQ ID NO: 1109048 - RNA, 16 nt, Mycobacterium bovis subsp bovis AF2122/97
cgccgggugucggugg

SEQ ID NO: 1109049 - RNA, 18 nt, Mycobacterium bovis subsp bovis AF2122/97
cgccggggggcugcugcu

SEQ ID NO: 1109050 - RNA, 16 nt, Mycobacterium bovis subsp bovis AF2122/97
cgccgggguagacgcc

SEQ ID NO: 1109051 - RNA, 18 nt, Mycobacterium bovis subsp bovis AF2122/97
cgccgggugcgccguugc

SEQ ID NO: 1109052 - RNA, 16 nt, Mycobacterium bovis subsp bovis AF2122/97
cgccggguuggcgccg

SEQ ID NO: 1109053 - RNA, 20 nt, Mycobacterium bovis subsp bovis AF2122/97
cgccggguuggcgccggcca

SEQ ID NO: 1109054 - RNA, 22 nt, Mycobacterium bovis subsp bovis AF2122/97
cgccggguuggcgccggccagu

SEQ ID NO: 1109055 - RNA, 19 nt, Mycobacterium bovis subsp bovis AF2122/97
cgccggggcgcagguuggc

SEQ ID NO: 1109056 - RNA, 17 nt, Mycobacterium bovis subsp bovis AF2122/97
cgccgggggcgccgccg

SEQ ID NO: 1109057 - RNA, 13 nt, Mycobacterium bovis subsp bovis AF2122/97
cgccggggccgcu

SEQ ID NO: 1109058 - RNA, 19 nt, Mycobacterium bovis subsp bovis AF2122/97
cgccggggccgcuggcggu

SEQ ID NO: 1109059 - RNA, 19 nt, Mycobacterium bovis subsp bovis AF2122/97
cgccggggcaaacgggguc

SEQ ID NO: 1109060 - RNA, 13 nt, Mycobacterium bovis subsp bovis AF2122/97
cgccggggccgcc

SEQ ID NO: 1109061 - RNA, 20 nt, Mycobacterium bovis subsp bovis AF2122/97
cgccggggcgaugucggcug

SEQ ID NO: 1109062 - RNA, 16 nt, Mycobacterium bovis subsp bovis AF2122/97
cgccggucggugcgga

SEQ ID NO: 1109063 - RNA, 18 nt, Mycobacterium bovis subsp bovis AF2122/97
cgccgguccccgccggcg

SEQ ID NO: 1109064 - RNA, 19 nt, Mycobacterium bovis subsp bovis AF2122/97
cgccgguccccgccggcgg

SEQ ID NO: 1109065 - RNA, 19 nt, Mycobacterium bovis subsp bovis AF2122/97
cgccgguccccucggugcc

SEQ ID NO: 1109066 - RNA, 22 nt, Mycobacterium bovis subsp bovis AF2122/97
cgccggguuuauccagucgauc

SEQ ID NO: 1109067 - RNA, 22 nt, Mycobacterium bovis subsp bovis AF2122/97
cgccgguaacuguccgcccgga

SEQ ID NO: 1109068 - RNA, 16 nt, Mycobacterium bovis subsp bovis AF2122/97
cgccgggcaguuuggc

SEQ ID NO: 1109069 - RNA, 21 nt, Mycobacterium bovis subsp bovis AF2122/97
cgccgggcaguuuggcggcag

SEQ ID NO: 1109070 - RNA, 22 nt, Mycobacterium bovis subsp bovis AF2122/97
cgccgggcaguuuggcggcagg

SEQ ID NO: 1109071 - RNA, 15 nt, Mycobacterium bovis subsp bovis AF2122/97
cgccgggcaucggcg

SEQ ID NO: 1109072 - RNA, 22 nt, Mycobacterium bovis subsp bovis AF2122/97
cgccgggcagcuacggggcggu

SEQ ID NO: 1109073 - RNA, 17 nt, Mycobacterium bovis subsp bovis AF2122/97
cgccggcauagaugccg

SEQ ID NO: 1109074 - RNA, 22 nt, Mycobacterium bovis subsp bovis AF2122/97
cgccgggcaucggugccacggc

SEQ ID NO: 1109075 - RNA, 21 nt, Mycobacterium bovis subsp bovis AF2122/97
cgccgggccacguccugcccg

SEQ ID NO: 1109076 - RNA, 14 nt, Mycobacterium bovis subsp bovis AF2122/97
cgccgggccaggcc

SEQ ID NO: 1109077 - RNA, 21 nt, Mycobacterium bovis subsp bovis AF2122/97
cgccgggccaggccgaugccg

SEQ ID NO: 1109078 - RNA, 13 nt, Mycobacterium bovis subsp bovis AF2122/97
cgccgggcccguc

SEQ ID NO: 1109079 - RNA, 15 nt, Mycobacterium bovis subsp bovis AF2122/97
cgccgggcccgucgg

SEQ ID NO: 1109080 - RNA, 17 nt, Mycobacterium bovis subsp bovis AF2122/97
cgccgggcccucgccau

SEQ ID NO: 1109081 - RNA, 15 nt, Mycobacterium bovis subsp bovis AF2122/97
cgccggcaucgacgu

SEQ ID NO: 1109082 - RNA, 19 nt, Mycobacterium bovis subsp bovis AF2122/97
cgccggcacgaaucccccg

SEQ ID NO: 1109083 - RNA, 19 nt, Mycobacterium bovis subsp bovis AF2122/97
cgccgggcaaggccaccgu

SEQ ID NO: 1109084 - RNA, 20 nt, Mycobacterium bovis subsp bovis AF2122/97
cgccgggcaauacguagucg

SEQ ID NO: 1109085 - RNA, 23 nt, Mycobacterium bovis subsp bovis AF2122/97
cgccgggcaauacguagucgccg

SEQ ID NO: 1109086 - RNA, 18 nt, Mycobacterium bovis subsp bovis AF2122/97
cgccgggauuaugccggc

SEQ ID NO: 1109087 - RNA, 20 nt, Mycobacterium bovis subsp bovis AF2122/97
cgccgggauaucgucgacgc

SEQ ID NO: 1109088 - RNA, 15 nt, Mycobacterium bovis subsp bovis AF2122/97
cgccggcaucgucga

SEQ ID NO: 1109089 - RNA, 14 nt, Mycobacterium bovis subsp bovis AF2122/97
cgccggcaucgguc

SEQ ID NO: 1109090 - RNA, 15 nt, Mycobacterium bovis subsp bovis AF2122/97
cgccggcaucgguca

SEQ ID NO: 1109091 - RNA, 19 nt, Mycobacterium bovis subsp bovis AF2122/97
cgccgucagaacaccggcc

SEQ ID NO: 1109092 - RNA, 21 nt, Mycobacterium bovis subsp bovis AF2122/97
cgccgucagaacaccggccag

SEQ ID NO: 1109093 - RNA, 22 nt, Mycobacterium bovis subsp bovis AF2122/97
cgccgucagaacaccggccagg

SEQ ID NO: 1109094 - RNA, 14 nt, Mycobacterium bovis subsp bovis AF2122/97
cgccgucacggcag

SEQ ID NO: 1109095 - RNA, 18 nt, Mycobacterium bovis subsp bovis AF2122/97
cgccgucacgcacgccgc

SEQ ID NO: 1109096 - RNA, 16 nt, Mycobacterium bovis subsp bovis AF2122/97
cgccgucacgcacgcc

SEQ ID NO: 1109097 - RNA, 12 nt, Mycobacterium bovis subsp bovis AF2122/97
cgccgucagccc

SEQ ID NO: 1109098 - RNA, 17 nt, Mycobacterium bovis subsp bovis AF2122/97
cgccgucagcggccaag

SEQ ID NO: 1109099 - RNA, 13 nt, Mycobacterium bovis subsp bovis AF2122/97
cgccgucaccccg

SEQ ID NO: 1109100 - RNA, 16 nt, Mycobacterium bovis subsp bovis AF2122/97
cgccgucagcaccgcu

SEQ ID NO: 1109101 - RNA, 14 nt, Mycobacterium bovis subsp bovis AF2122/97
cgccgucaugccca

SEQ ID NO: 1109102 - RNA, 20 nt, Mycobacterium bovis subsp bovis AF2122/97
cgccgucccgaaacgccggg

SEQ ID NO: 1109103 - RNA, 18 nt, Mycobacterium bovis subsp bovis AF2122/97
cgccguccccgccgucgc

SEQ ID NO: 1109104 - RNA, 17 nt, Mycobacterium bovis subsp bovis AF2122/97
cgccguccccgccgacg

SEQ ID NO: 1109105 - RNA, 15 nt, Mycobacterium bovis subsp bovis AF2122/97
cgccguccccgccgu

SEQ ID NO: 1109106 - RNA, 19 nt, Mycobacterium bovis subsp bovis AF2122/97
cgccguccagucggucggu

SEQ ID NO: 1109107 - RNA, 12 nt, Mycobacterium bovis subsp bovis AF2122/97
cgccguccacgc

SEQ ID NO: 1109108 - RNA, 18 nt, Mycobacterium bovis subsp bovis AF2122/97
cgccguagcaucgggcga

SEQ ID NO: 1109109 - RNA, 14 nt, Mycobacterium bovis subsp bovis AF2122/97
cgccguagaccagc

SEQ ID NO: 1109110 - RNA, 22 nt, Mycobacterium bovis subsp bovis AF2122/97
cgccguagaccagcaggcccug

SEQ ID NO: 1109111 - RNA, 16 nt, Mycobacterium bovis subsp bovis AF2122/97
cgccguagaccagccg

SEQ ID NO: 1109112 - RNA, 18 nt, Mycobacterium bovis subsp bovis AF2122/97
cgccguagagcuggugcg

SEQ ID NO: 1109113 - RNA, 15 nt, Mycobacterium bovis subsp bovis AF2122/97
cgccguagccggccg

SEQ ID NO: 1109114 - RNA, 17 nt, Mycobacterium bovis subsp bovis AF2122/97
cgccguagcgcagcgcc

SEQ ID NO: 1109115 - RNA, 14 nt, Mycobacterium bovis subsp bovis AF2122/97
cgccgucaccgccc

SEQ ID NO: 1109116 - RNA, 23 nt, Mycobacterium bovis subsp bovis AF2122/97
cgccgucaccgcccuugccgccg

SEQ ID NO: 1109117 - RNA, 14 nt, Mycobacterium bovis subsp bovis AF2122/97
cgccgucacccccg

SEQ ID NO: 1109118 - RNA, 15 nt, Mycobacterium bovis subsp bovis AF2122/97
cgccgucacccccga

SEQ ID NO: 1109119 - RNA, 17 nt, Mycobacterium bovis subsp bovis AF2122/97
cgccgucacccccgaua

SEQ ID NO: 1109120 - RNA, 13 nt, Mycobacterium bovis subsp bovis AF2122/97
cgccguaugccgc

SEQ ID NO: 1109121 - RNA, 15 nt, Mycobacterium bovis subsp bovis AF2122/97
cgccguaugccgcca

SEQ ID NO: 1109122 - RNA, 17 nt, Mycobacterium bovis subsp bovis AF2122/97
cgccguaugccgccaac

SEQ ID NO: 1109123 - RNA, 19 nt, Mycobacterium bovis subsp bovis AF2122/97
cgccguaugccgccaaccg

SEQ ID NO: 1109124 - RNA, 21 nt, Mycobacterium bovis subsp bovis AF2122/97
cgccguaguucuccgccaaca

SEQ ID NO: 1109125 - RNA, 23 nt, Mycobacterium bovis subsp bovis AF2122/97
cgccguaguucuccgccaacaac

SEQ ID NO: 1109126 - RNA, 13 nt, Mycobacterium bovis subsp bovis AF2122/97
cgccguaucgggg

SEQ ID NO: 1109127 - RNA, 14 nt, Mycobacterium bovis subsp bovis AF2122/97
cgccggugccaccg

SEQ ID NO: 1109128 - RNA, 16 nt, Mycobacterium bovis subsp bovis AF2122/97
cgccggugccaccgac

SEQ ID NO: 1109129 - RNA, 17 nt, Mycobacterium bovis subsp bovis AF2122/97
cgccggugccaccggcu

SEQ ID NO: 1109130 - RNA, 17 nt, Mycobacterium bovis subsp bovis AF2122/97
cgccggugaucggcggc

SEQ ID NO: 1109131 - RNA, 19 nt, Mycobacterium bovis subsp bovis AF2122/97
cgccgguuccgccggcccc

SEQ ID NO: 1109132 - RNA, 15 nt, Mycobacterium bovis subsp bovis AF2122/97
cgccgguccucgucg

SEQ ID NO: 1109133 - RNA, 14 nt, Mycobacterium bovis subsp bovis AF2122/97
cgccggugacgacg

SEQ ID NO: 1109134 - RNA, 18 nt, Mycobacterium bovis subsp bovis AF2122/97
cgccggugacgacgucgc

SEQ ID NO: 1109135 - RNA, 23 nt, Mycobacterium bovis subsp bovis AF2122/97
cgccggugacgacgucgccgccg

SEQ ID NO: 1109136 - RNA, 13 nt, Mycobacterium bovis subsp bovis AF2122/97
cgccggugagccg

SEQ ID NO: 1109137 - RNA, 17 nt, Mycobacterium bovis subsp bovis AF2122/97
cgccggugagccggaug

SEQ ID NO: 1109138 - RNA, 18 nt, Mycobacterium bovis subsp bovis AF2122/97
cgccggugaggaucagcg

SEQ ID NO: 1109139 - RNA, 14 nt, Mycobacterium bovis subsp bovis AF2122/97
cgccggugaggcga

SEQ ID NO: 1109140 - RNA, 15 nt, Mycobacterium bovis subsp bovis AF2122/97
cgccguacaucagcg

SEQ ID NO: 1109141 - RNA, 13 nt, Mycobacterium bovis subsp bovis AF2122/97
cgccguacaucag

SEQ ID NO: 1109142 - RNA, 19 nt, Mycobacterium bovis subsp bovis AF2122/97
cgccguacaucagcgcgaa

SEQ ID NO: 1109143 - RNA, 20 nt, Mycobacterium bovis subsp bovis AF2122/97
cgccguacaucagcgcgaac

SEQ ID NO: 1109144 - RNA, 15 nt, Mycobacterium bovis subsp bovis AF2122/97
cgccguacagcgcaa

SEQ ID NO: 1109145 - RNA, 14 nt, Mycobacterium bovis subsp bovis AF2122/97
cgccguacagcggc

SEQ ID NO: 1109146 - RNA, 17 nt, Mycobacterium bovis subsp bovis AF2122/97
cgccguacagcggcggc

SEQ ID NO: 1109147 - RNA, 21 nt, Mycobacterium bovis subsp bovis AF2122/97
cgccguacagcggcggcgucg

SEQ ID NO: 1109148 - RNA, 21 nt, Mycobacterium bovis subsp bovis AF2122/97
cgccguaagcaccagccagcc

SEQ ID NO: 1109149 - RNA, 23 nt, Mycobacterium bovis subsp bovis AF2122/97
cgccguacaaccacccacccgca

SEQ ID NO: 1109150 - RNA, 21 nt, Mycobacterium bovis subsp bovis AF2122/97
cgccguaaagccaacuggucg

SEQ ID NO: 1109151 - RNA, 15 nt, Mycobacterium bovis subsp bovis AF2122/97
cgccguaacagccgg

SEQ ID NO: 1109152 - RNA, 16 nt, Mycobacterium bovis subsp bovis AF2122/97
cgccguaacagccggc

SEQ ID NO: 1109153 - RNA, 16 nt, Mycobacterium bovis subsp bovis AF2122/97
cgccguaagcaccagc

SEQ ID NO: 1109154 - RNA, 17 nt, Mycobacterium bovis subsp bovis AF2122/97
cgccguaagcaccagcc

SEQ ID NO: 1109155 - RNA, 12 nt, Mycobacterium bovis subsp bovis AF2122/97
cgcgcgcccggg

SEQ ID NO: 1109156 - RNA, 13 nt, Mycobacterium bovis subsp bovis AF2122/97
cgcgcgccgcgac

SEQ ID NO: 1109157 - RNA, 20 nt, Mycobacterium bovis subsp bovis AF2122/97
cgcgcgccgaccgacgucgc

SEQ ID NO: 1109158 - RNA, 12 nt, Mycobacterium bovis subsp bovis AF2122/97
cgcgcgccggcg

SEQ ID NO: 1109159 - RNA, 13 nt, Mycobacterium bovis subsp bovis AF2122/97
cgcgcgcagggcg

SEQ ID NO: 1109160 - RNA, 12 nt, Mycobacterium bovis subsp bovis AF2122/97
cgcgcgccagcu

SEQ ID NO: 1109161 - RNA, 17 nt, Mycobacterium bovis subsp bovis AF2122/97
cgcgcgccagcucggcg

SEQ ID NO: 1109162 - RNA, 20 nt, Mycobacterium bovis subsp bovis AF2122/97
cgcgcgccagcucggcggca

SEQ ID NO: 1109163 - RNA, 13 nt, Mycobacterium bovis subsp bovis AF2122/97
cgcgcgcccgccu

SEQ ID NO: 1109164 - RNA, 19 nt, Mycobacterium bovis subsp bovis AF2122/97
cgcgcgccauuggcggugg

SEQ ID NO: 1109165 - RNA, 14 nt, Mycobacterium bovis subsp bovis AF2122/97
cgcgcgccaucgcc

SEQ ID NO: 1109166 - RNA, 16 nt, Mycobacterium bovis subsp bovis AF2122/97
cgcgcgcagccgggca

SEQ ID NO: 1109167 - RNA, 21 nt, Mycobacterium bovis subsp bovis AF2122/97
cgcgcggggugcgcgcgacca

SEQ ID NO: 1109168 - RNA, 17 nt, Mycobacterium bovis subsp bovis AF2122/97
cgcgcgggugcaaccgg

SEQ ID NO: 1109169 - RNA, 19 nt, Mycobacterium bovis subsp bovis AF2122/97
cgcgcgggucacgaccugc

SEQ ID NO: 1109170 - RNA, 18 nt, Mycobacterium bovis subsp bovis AF2122/97
cgcgcgggugcucggugg

SEQ ID NO: 1109171 - RNA, 16 nt, Mycobacterium bovis subsp bovis AF2122/97
cgcgcggguuacccgc

SEQ ID NO: 1109172 - RNA, 14 nt, Mycobacterium bovis subsp bovis AF2122/97
cgcgcgucgcgagu

SEQ ID NO: 1109173 - RNA, 15 nt, Mycobacterium bovis subsp bovis AF2122/97
cgcgcgggcggaucg

SEQ ID NO: 1109174 - RNA, 18 nt, Mycobacterium bovis subsp bovis AF2122/97
cgcgcuaucaugaccacc

SEQ ID NO: 1109175 - RNA, 18 nt, Mycobacterium bovis subsp bovis AF2122/97
cgcgcucguuagcggcgg

SEQ ID NO: 1109176 - RNA, 20 nt, Mycobacterium bovis subsp bovis AF2122/97
cgcgcguuuagucuccggcg

SEQ ID NO: 1109177 - RNA, 15 nt, Mycobacterium bovis subsp bovis AF2122/97
cgcgcguugcgguca

SEQ ID NO: 1109178 - RNA, 19 nt, Mycobacterium bovis subsp bovis AF2122/97
cgcgcuaaugucgauuucg

SEQ ID NO: 1109179 - RNA, 15 nt, Mycobacterium bovis subsp bovis AF2122/97
cgcgcguugcugguc

SEQ ID NO: 1109180 - RNA, 16 nt, Mycobacterium bovis subsp bovis AF2122/97
cgcgcguugcuggucg

SEQ ID NO: 1109181 - RNA, 21 nt, Mycobacterium bovis subsp bovis AF2122/97
cgcgcguugcuggucgccguc

SEQ ID NO: 1109182 - RNA, 13 nt, Mycobacterium bovis subsp bovis AF2122/97
cgcgcucaacggc

SEQ ID NO: 1109183 - RNA, 16 nt, Mycobacterium bovis subsp bovis AF2122/97
cgcgcuaucaugacca

SEQ ID NO: 1109184 - RNA, 20 nt, Mycobacterium bovis subsp bovis AF2122/97
cgcgcuaccagcucacggcg

SEQ ID NO: 1109185 - RNA, 13 nt, Mycobacterium bovis subsp bovis AF2122/97
cgcgcuacgcggc

SEQ ID NO: 1109186 - RNA, 21 nt, Mycobacterium bovis subsp bovis AF2122/97
cgcgcuacgucaagccgugcu

SEQ ID NO: 1109187 - RNA, 17 nt, Mycobacterium bovis subsp bovis AF2122/97
cgcgcguggucgccccg

SEQ ID NO: 1109188 - RNA, 16 nt, Mycobacterium bovis subsp bovis AF2122/97
cgcgcguuccagcaca

SEQ ID NO: 1109189 - RNA, 20 nt, Mycobacterium bovis subsp bovis AF2122/97
cgcgcguucggcgcugaucg

SEQ ID NO: 1109190 - RNA, 16 nt, Mycobacterium bovis subsp bovis AF2122/97
cgcgcguugaagucgc

SEQ ID NO: 1109191 - RNA, 22 nt, Mycobacterium bovis subsp bovis AF2122/97
cgcgcguugaagucgccgguga

SEQ ID NO: 1109192 - RNA, 18 nt, Mycobacterium bovis subsp bovis AF2122/97
cgcgcguggucgccccga

SEQ ID NO: 1109193 - RNA, 15 nt, Mycobacterium bovis subsp bovis AF2122/97
cgcgcgugugccuga

SEQ ID NO: 1109194 - RNA, 15 nt, Mycobacterium bovis subsp bovis AF2122/97
cgcggaucgaccgcc

SEQ ID NO: 1109195 - RNA, 19 nt, Mycobacterium bovis subsp bovis AF2122/97
cgcggaucgaccgccagcg

SEQ ID NO: 1109196 - RNA, 15 nt, Mycobacterium bovis subsp bovis AF2122/97
cgcggauccgggcgu

SEQ ID NO: 1109197 - RNA, 19 nt, Mycobacterium bovis subsp bovis AF2122/97
cgcggauccgggcguggug

SEQ ID NO: 1109198 - RNA, 16 nt, Mycobacterium bovis subsp bovis AF2122/97
cgcggaucugggcggc

SEQ ID NO: 1109199 - RNA, 18 nt, Mycobacterium bovis subsp bovis AF2122/97
cgcggaucugggcggccu

SEQ ID NO: 1109200 - RNA, 19 nt, Mycobacterium bovis subsp bovis AF2122/97
cgcggaucugguccagugg

SEQ ID NO: 1109201 - RNA, 14 nt, Mycobacterium bovis subsp bovis AF2122/97
cgcggaucugggcg

SEQ ID NO: 1109202 - RNA, 15 nt, Mycobacterium bovis subsp bovis AF2122/97
cgcggaucugggcgg

SEQ ID NO: 1109203 - RNA, 21 nt, Mycobacterium bovis subsp bovis AF2122/97
cgcggaucucaccacccgucg

SEQ ID NO: 1109204 - RNA, 21 nt, Mycobacterium bovis subsp bovis AF2122/97
cgcggaucucaucgggccaca

SEQ ID NO: 1109205 - RNA, 14 nt, Mycobacterium bovis subsp bovis AF2122/97
cgcggaucggcggc

SEQ ID NO: 1109206 - RNA, 16 nt, Mycobacterium bovis subsp bovis AF2122/97
cgcggaucggcggccg

SEQ ID NO: 1109207 - RNA, 18 nt, Mycobacterium bovis subsp bovis AF2122/97
cgcggaucggcggccgcg

SEQ ID NO: 1109208 - RNA, 15 nt, Mycobacterium bovis subsp bovis AF2122/97
cgcggaucgggcacc

SEQ ID NO: 1109209 - RNA, 23 nt, Mycobacterium bovis subsp bovis AF2122/97
cgcggauucgguuagcgcggcca

SEQ ID NO: 1109210 - RNA, 23 nt, Mycobacterium bovis subsp bovis AF2122/97
cgcggauggguacgacaccgcag

SEQ ID NO: 1109211 - RNA, 16 nt, Mycobacterium bovis subsp bovis AF2122/97
cgcggauguccaggag

SEQ ID NO: 1109212 - RNA, 17 nt, Mycobacterium bovis subsp bovis AF2122/97
cgcggauggccucggcg

SEQ ID NO: 1109213 - RNA, 19 nt, Mycobacterium bovis subsp bovis AF2122/97
cgcggaugcucaggucacc

SEQ ID NO: 1109214 - RNA, 20 nt, Mycobacterium bovis subsp bovis AF2122/97
cgcggaugcucaggucaccg

SEQ ID NO: 1109215 - RNA, 24 nt, Mycobacterium bovis subsp bovis AF2122/97
cgcggaugcucaggucaccggccg

SEQ ID NO: 1109216 - RNA, 15 nt, Mycobacterium bovis subsp bovis AF2122/97
cgcggaugagcucgg

SEQ ID NO: 1109217 - RNA, 23 nt, Mycobacterium bovis subsp bovis AF2122/97
cgcggaugauguaaccguagccc

SEQ ID NO: 1109218 - RNA, 17 nt, Mycobacterium bovis subsp bovis AF2122/97
cgcggaugcucagguca

SEQ ID NO: 1109219 - RNA, 20 nt, Mycobacterium bovis subsp bovis AF2122/97
cgcggaguccgucgacaccg

SEQ ID NO: 1109220 - RNA, 23 nt, Mycobacterium bovis subsp bovis AF2122/97
cgcggagucugcugaucgagcgg

SEQ ID NO: 1109221 - RNA, 17 nt, Mycobacterium bovis subsp bovis AF2122/97
cgcggagugcccagggc

SEQ ID NO: 1109222 - RNA, 19 nt, Mycobacterium bovis subsp bovis AF2122/97
cgcggagugcccagggccg

SEQ ID NO: 1109223 - RNA, 23 nt, Mycobacterium bovis subsp bovis AF2122/97
cgcggauacgccccugguccacc

SEQ ID NO: 1109224 - RNA, 18 nt, Mycobacterium bovis subsp bovis AF2122/97
cgcggaggcggccagccu

SEQ ID NO: 1109225 - RNA, 21 nt, Mycobacterium bovis subsp bovis AF2122/97
cgcggagcgugagccaugccg

SEQ ID NO: 1109226 - RNA, 16 nt, Mycobacterium bovis subsp bovis AF2122/97
cgcggagcucaaccac

SEQ ID NO: 1109227 - RNA, 12 nt, Mycobacterium bovis subsp bovis AF2122/97
cgcggagccguc

SEQ ID NO: 1109228 - RNA, 21 nt, Mycobacterium bovis subsp bovis AF2122/97
cgcggagagcgccuuagccau

SEQ ID NO: 1109229 - RNA, 15 nt, Mycobacterium bovis subsp bovis AF2122/97
cgcggagauaccgga

SEQ ID NO: 1109230 - RNA, 19 nt, Mycobacterium bovis subsp bovis AF2122/97
cgcggacucgggcaggccc

SEQ ID NO: 1109231 - RNA, 19 nt, Mycobacterium bovis subsp bovis AF2122/97
cgcggagccaggacgacgc

SEQ ID NO: 1109232 - RNA, 21 nt, Mycobacterium bovis subsp bovis AF2122/97
cgcggaucaccaucgccgccg

SEQ ID NO: 1109233 - RNA, 24 nt, Mycobacterium bovis subsp bovis AF2122/97
cgcggaucaaaaaccacgcgucgc

SEQ ID NO: 1109234 - RNA, 19 nt, Mycobacterium bovis subsp bovis AF2122/97
cgcggaucaacaggccggc

SEQ ID NO: 1109235 - RNA, 17 nt, Mycobacterium bovis subsp bovis AF2122/97
cgcggaucaccaucgcc

SEQ ID NO: 1109236 - RNA, 15 nt, Mycobacterium bovis subsp bovis AF2122/97
cgcggauaggccgcg

SEQ ID NO: 1109237 - RNA, 19 nt, Mycobacterium bovis subsp bovis AF2122/97
cgcggaguacuccagccgc

SEQ ID NO: 1109238 - RNA, 21 nt, Mycobacterium bovis subsp bovis AF2122/97
cgcggauacgggcagugaaca

SEQ ID NO: 1109239 - RNA, 16 nt, Mycobacterium bovis subsp bovis AF2122/97
cgcgcugaaccagaug

SEQ ID NO: 1109240 - RNA, 15 nt, Mycobacterium bovis subsp bovis AF2122/97
cgcgcuggcgcccuu

SEQ ID NO: 1109241 - RNA, 15 nt, Mycobacterium bovis subsp bovis AF2122/97
cgcgcuggcgggcgg

SEQ ID NO: 1109242 - RNA, 16 nt, Mycobacterium bovis subsp bovis AF2122/97
cgcgcugggcgccgua

SEQ ID NO: 1109243 - RNA, 13 nt, Mycobacterium bovis subsp bovis AF2122/97
cgcgcugggcgcg

SEQ ID NO: 1109244 - RNA, 15 nt, Mycobacterium bovis subsp bovis AF2122/97
cgcgcugggcgcgcu

SEQ ID NO: 1109245 - RNA, 18 nt, Mycobacterium bovis subsp bovis AF2122/97
cgcgcugggcgcgcucau

SEQ ID NO: 1109246 - RNA, 23 nt, Mycobacterium bovis subsp bovis AF2122/97
cgcgcuggucaacuccacgcgga

SEQ ID NO: 1109247 - RNA, 17 nt, Mycobacterium bovis subsp bovis AF2122/97
cgcgcuggugauucgca

SEQ ID NO: 1109248 - RNA, 20 nt, Mycobacterium bovis subsp bovis AF2122/97
cgcgcuggucaacuccacgc

SEQ ID NO: 1109249 - RNA, 19 nt, Mycobacterium bovis subsp bovis AF2122/97
cgcggaacgcgucgccgac

SEQ ID NO: 1109250 - RNA, 15 nt, Mycobacterium bovis subsp bovis AF2122/97
cgcggacgugccggu

SEQ ID NO: 1109251 - RNA, 17 nt, Mycobacterium bovis subsp bovis AF2122/97
cgcggacuugcgagccg

SEQ ID NO: 1109252 - RNA, 19 nt, Mycobacterium bovis subsp bovis AF2122/97
cgcggacuuggcggucggu

SEQ ID NO: 1109253 - RNA, 20 nt, Mycobacterium bovis subsp bovis AF2122/97
cgcggagaacaucccccggc

SEQ ID NO: 1109254 - RNA, 19 nt, Mycobacterium bovis subsp bovis AF2122/97
cgcggaaucgcaucggcgg

SEQ ID NO: 1109255 - RNA, 14 nt, Mycobacterium bovis subsp bovis AF2122/97
cgcggaaucgcgac

SEQ ID NO: 1109256 - RNA, 16 nt, Mycobacterium bovis subsp bovis AF2122/97
cgcggaagugucgucg

SEQ ID NO: 1109257 - RNA, 14 nt, Mycobacterium bovis subsp bovis AF2122/97
cgcggacacugcga

SEQ ID NO: 1109258 - RNA, 16 nt, Mycobacterium bovis subsp bovis AF2122/97
cgcggacaccaggaug

SEQ ID NO: 1109259 - RNA, 23 nt, Mycobacterium bovis subsp bovis AF2122/97
cgcggacaccaggaugccuaccg

SEQ ID NO: 1109260 - RNA, 16 nt, Mycobacterium bovis subsp bovis AF2122/97
cgcgcgaaccgcuccg

SEQ ID NO: 1109261 - RNA, 14 nt, Mycobacterium bovis subsp bovis AF2122/97
cgcgcgaaugguca

SEQ ID NO: 1109262 - RNA, 16 nt, Mycobacterium bovis subsp bovis AF2122/97
cgcgcgaauguccggc

SEQ ID NO: 1109263 - RNA, 14 nt, Mycobacterium bovis subsp bovis AF2122/97
cgcgcgacaacccg

SEQ ID NO: 1109264 - RNA, 18 nt, Mycobacterium bovis subsp bovis AF2122/97
cgcgcgacaacccggcgu

SEQ ID NO: 1109265 - RNA, 17 nt, Mycobacterium bovis subsp bovis AF2122/97
cgcgcgaaccccagccg

SEQ ID NO: 1109266 - RNA, 18 nt, Mycobacterium bovis subsp bovis AF2122/97
cgcgcgaaccccagccga

SEQ ID NO: 1109267 - RNA, 21 nt, Mycobacterium bovis subsp bovis AF2122/97
cgcgcgaccucgcuggccgca

SEQ ID NO: 1109268 - RNA, 18 nt, Mycobacterium bovis subsp bovis AF2122/97
cgcgccuuucgucgaagg

SEQ ID NO: 1109269 - RNA, 14 nt, Mycobacterium bovis subsp bovis AF2122/97
cgcgcgaccauacc

SEQ ID NO: 1109270 - RNA, 16 nt, Mycobacterium bovis subsp bovis AF2122/97
cgcgcgaccuggucga

SEQ ID NO: 1109271 - RNA, 12 nt, Mycobacterium bovis subsp bovis AF2122/97
cgcgcgacggac

SEQ ID NO: 1109272 - RNA, 17 nt, Mycobacterium bovis subsp bovis AF2122/97
cgcgcgacuuucugcgc

SEQ ID NO: 1109273 - RNA, 21 nt, Mycobacterium bovis subsp bovis AF2122/97
cgcgcgacuuucugcgcgugg

SEQ ID NO: 1109274 - RNA, 14 nt, Mycobacterium bovis subsp bovis AF2122/97
cgcgcgagaacacc

SEQ ID NO: 1109275 - RNA, 18 nt, Mycobacterium bovis subsp bovis AF2122/97
cgcgcgaugcuggcgaac

SEQ ID NO: 1109276 - RNA, 20 nt, Mycobacterium bovis subsp bovis AF2122/97
cgcgcgcaacccugccgcga

SEQ ID NO: 1109277 - RNA, 23 nt, Mycobacterium bovis subsp bovis AF2122/97
cgcgcgcaacccugccgcgauga

SEQ ID NO: 1109278 - RNA, 13 nt, Mycobacterium bovis subsp bovis AF2122/97
cgcgcgcaccaga

SEQ ID NO: 1109279 - RNA, 15 nt, Mycobacterium bovis subsp bovis AF2122/97
cgcgcgauggcgcgu

SEQ ID NO: 1109280 - RNA, 13 nt, Mycobacterium bovis subsp bovis AF2122/97
cgcgcgcaccggg

SEQ ID NO: 1109281 - RNA, 13 nt, Mycobacterium bovis subsp bovis AF2122/97
cgcgcgcacggcg

SEQ ID NO: 1109282 - RNA, 19 nt, Mycobacterium bovis subsp bovis AF2122/97
cgcgcgcaggccgccgcca

SEQ ID NO: 1109283 - RNA, 13 nt, Mycobacterium bovis subsp bovis AF2122/97
cgcgcgcagcuga

SEQ ID NO: 1109284 - RNA, 14 nt, Mycobacterium bovis subsp bovis AF2122/97
cgcgcgcagccggg

SEQ ID NO: 1109285 - RNA, 20 nt, Mycobacterium bovis subsp bovis AF2122/97
cgcgccggugaggcgaccgg

SEQ ID NO: 1109286 - RNA, 12 nt, Mycobacterium bovis subsp bovis AF2122/97
cgcgccggucgu

SEQ ID NO: 1109287 - RNA, 14 nt, Mycobacterium bovis subsp bovis AF2122/97
cgcgccggucagca

SEQ ID NO: 1109288 - RNA, 14 nt, Mycobacterium bovis subsp bovis AF2122/97
cgcgccgguucaga

SEQ ID NO: 1109289 - RNA, 17 nt, Mycobacterium bovis subsp bovis AF2122/97
cgcgccgguuggccagu

SEQ ID NO: 1109290 - RNA, 14 nt, Mycobacterium bovis subsp bovis AF2122/97
cgcgccgucgucga

SEQ ID NO: 1109291 - RNA, 13 nt, Mycobacterium bovis subsp bovis AF2122/97
cgcgccugccuca

SEQ ID NO: 1109292 - RNA, 17 nt, Mycobacterium bovis subsp bovis AF2122/97
cgcgccgguggucaggu

SEQ ID NO: 1109293 - RNA, 20 nt, Mycobacterium bovis subsp bovis AF2122/97
cgcgccugugcgcaaggccg

SEQ ID NO: 1109294 - RNA, 15 nt, Mycobacterium bovis subsp bovis AF2122/97
cgcgccugugccacc

SEQ ID NO: 1109295 - RNA, 20 nt, Mycobacterium bovis subsp bovis AF2122/97
cgcgccugugccaccgcugg

SEQ ID NO: 1109296 - RNA, 19 nt, Mycobacterium bovis subsp bovis AF2122/97
cgcgccugugcgcaaggcc

SEQ ID NO: 1109297 - RNA, 14 nt, Mycobacterium bovis subsp bovis AF2122/97
cgcgccuucacgcu

SEQ ID NO: 1109298 - RNA, 13 nt, Mycobacterium bovis subsp bovis AF2122/97
cgcgccggcguug

SEQ ID NO: 1109299 - RNA, 20 nt, Mycobacterium bovis subsp bovis AF2122/97
cgcgccgcgcaucgcggccg

SEQ ID NO: 1109300 - RNA, 19 nt, Mycobacterium bovis subsp bovis AF2122/97
cgcgccggcucuccgguga

SEQ ID NO: 1109301 - RNA, 13 nt, Mycobacterium bovis subsp bovis AF2122/97
cgcgccgccggcu

SEQ ID NO: 1109302 - RNA, 14 nt, Mycobacterium bovis subsp bovis AF2122/97
cgcgccgcgccgcc

SEQ ID NO: 1109303 - RNA, 14 nt, Mycobacterium bovis subsp bovis AF2122/97
cgcgccggucgccg

SEQ ID NO: 1109304 - RNA, 19 nt, Mycobacterium bovis subsp bovis AF2122/97
cgcgccggucgccgacggc

SEQ ID NO: 1109305 - RNA, 20 nt, Mycobacterium bovis subsp bovis AF2122/97
cgcgccggucgccgacggcg

SEQ ID NO: 1109306 - RNA, 17 nt, Mycobacterium bovis subsp bovis AF2122/97
cgcgccgcgaggcaccg

SEQ ID NO: 1109307 - RNA, 16 nt, Mycobacterium bovis subsp bovis AF2122/97
cgcgccgccucgggca

SEQ ID NO: 1109308 - RNA, 17 nt, Mycobacterium bovis subsp bovis AF2122/97
cgcgccgaucggcaccg

SEQ ID NO: 1109309 - RNA, 19 nt, Mycobacterium bovis subsp bovis AF2122/97
cgcgccgaucaccaccggc

SEQ ID NO: 1109310 - RNA, 20 nt, Mycobacterium bovis subsp bovis AF2122/97
cgcgccgaucaccaccggca

SEQ ID NO: 1109311 - RNA, 15 nt, Mycobacterium bovis subsp bovis AF2122/97
cgcgccgagccagca

SEQ ID NO: 1109312 - RNA, 19 nt, Mycobacterium bovis subsp bovis AF2122/97
cgcgcaacgccgccagccu

SEQ ID NO: 1109313 - RNA, 19 nt, Mycobacterium bovis subsp bovis AF2122/97
cgcgcaacguacgcacgca

SEQ ID NO: 1109314 - RNA, 13 nt, Mycobacterium bovis subsp bovis AF2122/97
cgcgcaacgcugg

SEQ ID NO: 1109315 - RNA, 19 nt, Mycobacterium bovis subsp bovis AF2122/97
cgcgcccccggugccguug

SEQ ID NO: 1109316 - RNA, 22 nt, Mycobacterium bovis subsp bovis AF2122/97
cgcgcccccggugccguuggag

SEQ ID NO: 1109317 - RNA, 14 nt, Mycobacterium bovis subsp bovis AF2122/97
cgcgccccgccgca

SEQ ID NO: 1109318 - RNA, 12 nt, Mycobacterium bovis subsp bovis AF2122/97
cgcgcccgacga

SEQ ID NO: 1109319 - RNA, 13 nt, Mycobacterium bovis subsp bovis AF2122/97
cgcgcccgacacc

SEQ ID NO: 1109320 - RNA, 19 nt, Mycobacterium bovis subsp bovis AF2122/97
cgcgcccgcaccaccggcc

SEQ ID NO: 1109321 - RNA, 14 nt, Mycobacterium bovis subsp bovis AF2122/97
cgcgcccgccgcgg

SEQ ID NO: 1109322 - RNA, 15 nt, Mycobacterium bovis subsp bovis AF2122/97
cgcgccccgccgcac

SEQ ID NO: 1109323 - RNA, 14 nt, Mycobacterium bovis subsp bovis AF2122/97
cgcgcccgccucau

SEQ ID NO: 1109324 - RNA, 13 nt, Mycobacterium bovis subsp bovis AF2122/97
cgcgcccgcggcc

SEQ ID NO: 1109325 - RNA, 21 nt, Mycobacterium bovis subsp bovis AF2122/97
cgcgcccggaucucggcguag

SEQ ID NO: 1109326 - RNA, 17 nt, Mycobacterium bovis subsp bovis AF2122/97
cgcgcccgccucaucgg

SEQ ID NO: 1109327 - RNA, 14 nt, Mycobacterium bovis subsp bovis AF2122/97
cgcgcccgccucga

SEQ ID NO: 1109328 - RNA, 18 nt, Mycobacterium bovis subsp bovis AF2122/97
cgcgcccgccucgaccgc

SEQ ID NO: 1109329 - RNA, 16 nt, Mycobacterium bovis subsp bovis AF2122/97
cgcgcccgcggccgcc

SEQ ID NO: 1109330 - RNA, 15 nt, Mycobacterium bovis subsp bovis AF2122/97
cgcgccgaccaccgc

SEQ ID NO: 1109331 - RNA, 19 nt, Mycobacterium bovis subsp bovis AF2122/97
cgcgccgacggccagcagg

SEQ ID NO: 1109332 - RNA, 14 nt, Mycobacterium bovis subsp bovis AF2122/97
cgcgcccggccggu

SEQ ID NO: 1109333 - RNA, 18 nt, Mycobacterium bovis subsp bovis AF2122/97
cgcggcugcuccgucgcc

SEQ ID NO: 1109334 - RNA, 22 nt, Mycobacterium bovis subsp bovis AF2122/97
cgcggcugcuccgucgccgaac

SEQ ID NO: 1109335 - RNA, 14 nt, Mycobacterium bovis subsp bovis AF2122/97
cgcggcuggggccc

SEQ ID NO: 1109336 - RNA, 21 nt, Mycobacterium bovis subsp bovis AF2122/97
cgcggcugggggauaccgcug

SEQ ID NO: 1109337 - RNA, 22 nt, Mycobacterium bovis subsp bovis AF2122/97
cgcggcugggggauaccgcugg

SEQ ID NO: 1109338 - RNA, 22 nt, Mycobacterium bovis subsp bovis AF2122/97
cgcggcugccagaaugggcggc

SEQ ID NO: 1109339 - RNA, 21 nt, Mycobacterium bovis subsp bovis AF2122/97
cgcggcugccaucccgauccc

SEQ ID NO: 1109340 - RNA, 22 nt, Mycobacterium bovis subsp bovis AF2122/97
cgcggcuucaguccggcccccg

SEQ ID NO: 1109341 - RNA, 23 nt, Mycobacterium bovis subsp bovis AF2122/97
cgcggcuucgucgacaucgccau

SEQ ID NO: 1109342 - RNA, 21 nt, Mycobacterium bovis subsp bovis AF2122/97
cgcggcugucacgccugccac

SEQ ID NO: 1109343 - RNA, 20 nt, Mycobacterium bovis subsp bovis AF2122/97
cgcggcugugcccgaucagc

SEQ ID NO: 1109344 - RNA, 20 nt, Mycobacterium bovis subsp bovis AF2122/97
cgcggcuugggcuugcgccg

SEQ ID NO: 1109345 - RNA, 21 nt, Mycobacterium bovis subsp bovis AF2122/97
cgcggcuugggcuugcgccgg

SEQ ID NO: 1109346 - RNA, 17 nt, Mycobacterium bovis subsp bovis AF2122/97
cgcggcuugucgcggug

SEQ ID NO: 1109347 - RNA, 18 nt, Mycobacterium bovis subsp bovis AF2122/97
cgcgggaaaacggggugg

SEQ ID NO: 1109348 - RNA, 19 nt, Mycobacterium bovis subsp bovis AF2122/97
cgcgggaaaacgggguggc

SEQ ID NO: 1109349 - RNA, 16 nt, Mycobacterium bovis subsp bovis AF2122/97
cgcggcuuugacgccc

SEQ ID NO: 1109350 - RNA, 18 nt, Mycobacterium bovis subsp bovis AF2122/97
cgcgggacaccaccgccc

SEQ ID NO: 1109351 - RNA, 20 nt, Mycobacterium bovis subsp bovis AF2122/97
cgcgggacagauggcggccg

SEQ ID NO: 1109352 - RNA, 20 nt, Mycobacterium bovis subsp bovis AF2122/97
cgcgggacgcgacucggcgg

SEQ ID NO: 1109353 - RNA, 21 nt, Mycobacterium bovis subsp bovis AF2122/97
cgcgggaccuucgagccgcac

SEQ ID NO: 1109354 - RNA, 23 nt, Mycobacterium bovis subsp bovis AF2122/97
cgcgggacacgucgcgccaggcg

SEQ ID NO: 1109355 - RNA, 17 nt, Mycobacterium bovis subsp bovis AF2122/97
cgcgggacagauggcgg

SEQ ID NO: 1109356 - RNA, 15 nt, Mycobacterium bovis subsp bovis AF2122/97
cgcgggacaccaccg

SEQ ID NO: 1109357 - RNA, 16 nt, Mycobacterium bovis subsp bovis AF2122/97
cgcgggaacgaugccg

SEQ ID NO: 1109358 - RNA, 21 nt, Mycobacterium bovis subsp bovis AF2122/97
cgcgggaacgaugccgccggc

SEQ ID NO: 1109359 - RNA, 13 nt, Mycobacterium bovis subsp bovis AF2122/97
cgcgggaagugca

SEQ ID NO: 1109360 - RNA, 19 nt, Mycobacterium bovis subsp bovis AF2122/97
cgcgggaaguucgccgguc

SEQ ID NO: 1109361 - RNA, 21 nt, Mycobacterium bovis subsp bovis AF2122/97
cgcgggauugcgcgcugagcu

SEQ ID NO: 1109362 - RNA, 15 nt, Mycobacterium bovis subsp bovis AF2122/97
cgcgggaucgguggc

SEQ ID NO: 1109363 - RNA, 20 nt, Mycobacterium bovis subsp bovis AF2122/97
cgcgggaucgguggcggcac

SEQ ID NO: 1109364 - RNA, 21 nt, Mycobacterium bovis subsp bovis AF2122/97
cgcgggauguaccccggcccg

SEQ ID NO: 1109365 - RNA, 20 nt, Mycobacterium bovis subsp bovis AF2122/97
cgcgggagaaaacggcggcg

SEQ ID NO: 1109366 - RNA, 23 nt, Mycobacterium bovis subsp bovis AF2122/97
cgcgggagaaaacggcggcgccg

SEQ ID NO: 1109367 - RNA, 20 nt, Mycobacterium bovis subsp bovis AF2122/97
cgcgggauccaggcccagcc

SEQ ID NO: 1109368 - RNA, 22 nt, Mycobacterium bovis subsp bovis AF2122/97
cgcgggauccaggcccagccga

SEQ ID NO: 1109369 - RNA, 17 nt, Mycobacterium bovis subsp bovis AF2122/97
cgcgggcaguggcagcc

SEQ ID NO: 1109370 - RNA, 18 nt, Mycobacterium bovis subsp bovis AF2122/97
cgcgggcaguggcagccc

SEQ ID NO: 1109371 - RNA, 21 nt, Mycobacterium bovis subsp bovis AF2122/97
cgcgggcaguggcagcccguc

SEQ ID NO: 1109372 - RNA, 12 nt, Mycobacterium bovis subsp bovis AF2122/97
cgcgggcaucgu

SEQ ID NO: 1109373 - RNA, 23 nt, Mycobacterium bovis subsp bovis AF2122/97
cgcgggcaguggcagcccgucgg

SEQ ID NO: 1109374 - RNA, 19 nt, Mycobacterium bovis subsp bovis AF2122/97
cgcgggcccgcgcggcggu

SEQ ID NO: 1109375 - RNA, 18 nt, Mycobacterium bovis subsp bovis AF2122/97
cgcgggccaccgcuguca

SEQ ID NO: 1109376 - RNA, 12 nt, Mycobacterium bovis subsp bovis AF2122/97
cgcgggccacca

SEQ ID NO: 1109377 - RNA, 19 nt, Mycobacterium bovis subsp bovis AF2122/97
cgcgggccaccacgcgccg

SEQ ID NO: 1109378 - RNA, 22 nt, Mycobacterium bovis subsp bovis AF2122/97
cgcgggccaccacgcgccgcac

SEQ ID NO: 1109379 - RNA, 13 nt, Mycobacterium bovis subsp bovis AF2122/97
cgcgggccaccgc

SEQ ID NO: 1109380 - RNA, 16 nt, Mycobacterium bovis subsp bovis AF2122/97
cgcgggccgacgcagg

SEQ ID NO: 1109381 - RNA, 17 nt, Mycobacterium bovis subsp bovis AF2122/97
cgcgggccgacgcaggu

SEQ ID NO: 1109382 - RNA, 13 nt, Mycobacterium bovis subsp bovis AF2122/97
cgcgggccgcguc

SEQ ID NO: 1109383 - RNA, 15 nt, Mycobacterium bovis subsp bovis AF2122/97
cgcgggccgcgucga

SEQ ID NO: 1109384 - RNA, 12 nt, Mycobacterium bovis subsp bovis AF2122/97
cgcgggccgccg

SEQ ID NO: 1109385 - RNA, 17 nt, Mycobacterium bovis subsp bovis AF2122/97
cgcgggccggcgacugu

SEQ ID NO: 1109386 - RNA, 15 nt, Mycobacterium bovis subsp bovis AF2122/97
cgcgggccuggccca

SEQ ID NO: 1109387 - RNA, 13 nt, Mycobacterium bovis subsp bovis AF2122/97
cgcgggcggcgcu

SEQ ID NO: 1109388 - RNA, 16 nt, Mycobacterium bovis subsp bovis AF2122/97
cgcgggcggcgcuggc

SEQ ID NO: 1109389 - RNA, 19 nt, Mycobacterium bovis subsp bovis AF2122/97
cgcgggcggaucgccgggg

SEQ ID NO: 1109390 - RNA, 15 nt, Mycobacterium bovis subsp bovis AF2122/97
cgcgggcggaucgcc

SEQ ID NO: 1109391 - RNA, 16 nt, Mycobacterium bovis subsp bovis AF2122/97
cgcgggcggaucgccg

SEQ ID NO: 1109392 - RNA, 16 nt, Mycobacterium bovis subsp bovis AF2122/97
cgcgggcgagcgcauc

SEQ ID NO: 1109393 - RNA, 13 nt, Mycobacterium bovis subsp bovis AF2122/97
cgcgggcgaccac

SEQ ID NO: 1109394 - RNA, 17 nt, Mycobacterium bovis subsp bovis AF2122/97
cgcgggcgaccaccgcg

SEQ ID NO: 1109395 - RNA, 16 nt, Mycobacterium bovis subsp bovis AF2122/97
cgcgggccgcgucgaa

SEQ ID NO: 1109396 - RNA, 16 nt, Mycobacterium bovis subsp bovis AF2122/97
cgcgggcgaucggcau

SEQ ID NO: 1109397 - RNA, 13 nt, Mycobacterium bovis subsp bovis AF2122/97
cgcggucgccacc

SEQ ID NO: 1109398 - RNA, 14 nt, Mycobacterium bovis subsp bovis AF2122/97
cgcggucgcugcga

SEQ ID NO: 1109399 - RNA, 23 nt, Mycobacterium bovis subsp bovis AF2122/97
cgcggucgcugcgaugcugauca

SEQ ID NO: 1109400 - RNA, 23 nt, Mycobacterium bovis subsp bovis AF2122/97
cgcggucgcgacuaccaucgccg

SEQ ID NO: 1109401 - RNA, 13 nt, Mycobacterium bovis subsp bovis AF2122/97
cgcggucgcgcga

SEQ ID NO: 1109402 - RNA, 16 nt, Mycobacterium bovis subsp bovis AF2122/97
cgcggugauggucacc

SEQ ID NO: 1109403 - RNA, 15 nt, Mycobacterium bovis subsp bovis AF2122/97
cgcggugcccgucgg

SEQ ID NO: 1109404 - RNA, 13 nt, Mycobacterium bovis subsp bovis AF2122/97
cgcggugcccugc

SEQ ID NO: 1109405 - RNA, 17 nt, Mycobacterium bovis subsp bovis AF2122/97
cgcggugcccugccggc

SEQ ID NO: 1109406 - RNA, 13 nt, Mycobacterium bovis subsp bovis AF2122/97
cgcggugccgcca

SEQ ID NO: 1109407 - RNA, 14 nt, Mycobacterium bovis subsp bovis AF2122/97
cgcggugccgccac

SEQ ID NO: 1109408 - RNA, 15 nt, Mycobacterium bovis subsp bovis AF2122/97
cgcggugccgccacc

SEQ ID NO: 1109409 - RNA, 16 nt, Mycobacterium bovis subsp bovis AF2122/97
cgcggugccgccaccg

SEQ ID NO: 1109410 - RNA, 18 nt, Mycobacterium bovis subsp bovis AF2122/97
cgcggugccgccaccggc

SEQ ID NO: 1109411 - RNA, 12 nt, Mycobacterium bovis subsp bovis AF2122/97
cgcggugccggc

SEQ ID NO: 1109412 - RNA, 15 nt, Mycobacterium bovis subsp bovis AF2122/97
cgcggugccggccgu

SEQ ID NO: 1109413 - RNA, 20 nt, Mycobacterium bovis subsp bovis AF2122/97
cgcggugcgcgugacgacca

SEQ ID NO: 1109414 - RNA, 18 nt, Mycobacterium bovis subsp bovis AF2122/97
cgcggugccggccguucg

SEQ ID NO: 1109415 - RNA, 19 nt, Mycobacterium bovis subsp bovis AF2122/97
cgcggugcgcucacuggcg

SEQ ID NO: 1109416 - RNA, 13 nt, Mycobacterium bovis subsp bovis AF2122/97
cgcggugcggcaa

SEQ ID NO: 1109417 - RNA, 18 nt, Mycobacterium bovis subsp bovis AF2122/97
cgcggugcggcaacagcg

SEQ ID NO: 1109418 - RNA, 13 nt, Mycobacterium bovis subsp bovis AF2122/97
cgcggugcgcgca

SEQ ID NO: 1109419 - RNA, 21 nt, Mycobacterium bovis subsp bovis AF2122/97
cgcgguggaccgcucgauguc

SEQ ID NO: 1109420 - RNA, 17 nt, Mycobacterium bovis subsp bovis AF2122/97
cgcgguggaccgggcaa

SEQ ID NO: 1109421 - RNA, 13 nt, Mycobacterium bovis subsp bovis AF2122/97
cgcggugcggcca

SEQ ID NO: 1109422 - RNA, 17 nt, Mycobacterium bovis subsp bovis AF2122/97
cgcgguggccccgaugg

SEQ ID NO: 1109423 - RNA, 21 nt, Mycobacterium bovis subsp bovis AF2122/97
cgcgguggccagaucgaacgc

SEQ ID NO: 1109424 - RNA, 14 nt, Mycobacterium bovis subsp bovis AF2122/97
cgcgguggaugcga

SEQ ID NO: 1109425 - RNA, 13 nt, Mycobacterium bovis subsp bovis AF2122/97
cgcgguggccaga

SEQ ID NO: 1109426 - RNA, 15 nt, Mycobacterium bovis subsp bovis AF2122/97
cgcgguggcgguguc

SEQ ID NO: 1109427 - RNA, 12 nt, Mycobacterium bovis subsp bovis AF2122/97
cgcgguggcggc

SEQ ID NO: 1109428 - RNA, 13 nt, Mycobacterium bovis subsp bovis AF2122/97
cgcgguggcggcg

SEQ ID NO: 1109429 - RNA, 17 nt, Mycobacterium bovis subsp bovis AF2122/97
cgcgguggcggcgagca

SEQ ID NO: 1109430 - RNA, 20 nt, Mycobacterium bovis subsp bovis AF2122/97
cgcgguggcggcgagcagca

SEQ ID NO: 1109431 - RNA, 17 nt, Mycobacterium bovis subsp bovis AF2122/97
cgcgguggcggucgcca

SEQ ID NO: 1109432 - RNA, 18 nt, Mycobacterium bovis subsp bovis AF2122/97
cgcgguggggucgacgca

SEQ ID NO: 1109433 - RNA, 22 nt, Mycobacterium bovis subsp bovis AF2122/97
cgcgguggggucgacgcagugc

SEQ ID NO: 1109434 - RNA, 13 nt, Mycobacterium bovis subsp bovis AF2122/97
cgcggggcggccu

SEQ ID NO: 1109435 - RNA, 13 nt, Mycobacterium bovis subsp bovis AF2122/97
cgcggggccgccg

SEQ ID NO: 1109436 - RNA, 19 nt, Mycobacterium bovis subsp bovis AF2122/97
cgcggggccgccgcggccg

SEQ ID NO: 1109437 - RNA, 18 nt, Mycobacterium bovis subsp bovis AF2122/97
cgcggggccggccggcaa

SEQ ID NO: 1109438 - RNA, 13 nt, Mycobacterium bovis subsp bovis AF2122/97
cgcgggcggcgug

SEQ ID NO: 1109439 - RNA, 13 nt, Mycobacterium bovis subsp bovis AF2122/97
cgcgggggcggcc

SEQ ID NO: 1109440 - RNA, 15 nt, Mycobacterium bovis subsp bovis AF2122/97
cgcgggggaccgccc

SEQ ID NO: 1109441 - RNA, 14 nt, Mycobacterium bovis subsp bovis AF2122/97
cgcgggggcggccg

SEQ ID NO: 1109442 - RNA, 16 nt, Mycobacterium bovis subsp bovis AF2122/97
cgcggggugcgcgcga

SEQ ID NO: 1109443 - RNA, 12 nt, Mycobacterium bovis subsp bovis AF2122/97
cgcggguguggc

SEQ ID NO: 1109444 - RNA, 16 nt, Mycobacterium bovis subsp bovis AF2122/97
cgcggguguuccacac

SEQ ID NO: 1109445 - RNA, 23 nt, Mycobacterium bovis subsp bovis AF2122/97
cgcggguguuccacaccaggccg

SEQ ID NO: 1109446 - RNA, 19 nt, Mycobacterium bovis subsp bovis AF2122/97
cgcggguuacccgcagcgu

SEQ ID NO: 1109447 - RNA, 24 nt, Mycobacterium bovis subsp bovis AF2122/97
cgcggggugcgcgcgaccauaccc

SEQ ID NO: 1109448 - RNA, 13 nt, Mycobacterium bovis subsp bovis AF2122/97
cgcggguggcggc

SEQ ID NO: 1109449 - RNA, 17 nt, Mycobacterium bovis subsp bovis AF2122/97
cgcggguggcucgggug

SEQ ID NO: 1109450 - RNA, 17 nt, Mycobacterium bovis subsp bovis AF2122/97
cgcggucgagcaggugu

SEQ ID NO: 1109451 - RNA, 22 nt, Mycobacterium bovis subsp bovis AF2122/97
cgcggucgagguccuugaggau

SEQ ID NO: 1109452 - RNA, 18 nt, Mycobacterium bovis subsp bovis AF2122/97
cgcggucgaucaggccgu

SEQ ID NO: 1109453 - RNA, 14 nt, Mycobacterium bovis subsp bovis AF2122/97
cgcggucgccaccg

SEQ ID NO: 1109454 - RNA, 15 nt, Mycobacterium bovis subsp bovis AF2122/97
cgcggucgccaccgu

SEQ ID NO: 1109455 - RNA, 21 nt, Mycobacterium bovis subsp bovis AF2122/97
cgcggucgccaccgugucacg

SEQ ID NO: 1109456 - RNA, 23 nt, Mycobacterium bovis subsp bovis AF2122/97
cgcggucgccaccgugucacgcg

SEQ ID NO: 1109457 - RNA, 15 nt, Mycobacterium bovis subsp bovis AF2122/97
cgcgguacugcgcag

SEQ ID NO: 1109458 - RNA, 21 nt, Mycobacterium bovis subsp bovis AF2122/97
cgcgguccuuguuagccucca

SEQ ID NO: 1109459 - RNA, 15 nt, Mycobacterium bovis subsp bovis AF2122/97
cgcgguccgagcggc

SEQ ID NO: 1109460 - RNA, 19 nt, Mycobacterium bovis subsp bovis AF2122/97
cgcgguacgccggucggug

SEQ ID NO: 1109461 - RNA, 12 nt, Mycobacterium bovis subsp bovis AF2122/97
cgcggguaaccg

SEQ ID NO: 1109462 - RNA, 19 nt, Mycobacterium bovis subsp bovis AF2122/97
cgcgguaccaucaccgcgc

SEQ ID NO: 1109463 - RNA, 24 nt, Mycobacterium bovis subsp bovis AF2122/97
cgcgguaccaucaccgcgccagcc

SEQ ID NO: 1109464 - RNA, 15 nt, Mycobacterium bovis subsp bovis AF2122/97
cgcgguaaccacgcg

SEQ ID NO: 1109465 - RNA, 17 nt, Mycobacterium bovis subsp bovis AF2122/97
cgcgguaaccacgcgga

SEQ ID NO: 1109466 - RNA, 19 nt, Mycobacterium bovis subsp bovis AF2122/97
cgcgguaaccacgcggauc

SEQ ID NO: 1109467 - RNA, 16 nt, Mycobacterium bovis subsp bovis AF2122/97
cgcggguuugcgguag

SEQ ID NO: 1109468 - RNA, 16 nt, Mycobacterium bovis subsp bovis AF2122/97
cgcggcgcgcaggacc

SEQ ID NO: 1109469 - RNA, 13 nt, Mycobacterium bovis subsp bovis AF2122/97
cgcggcgcgcuga

SEQ ID NO: 1109470 - RNA, 14 nt, Mycobacterium bovis subsp bovis AF2122/97
cgcggcgcggccgc

SEQ ID NO: 1109471 - RNA, 15 nt, Mycobacterium bovis subsp bovis AF2122/97
cgcggcgcggccgca

SEQ ID NO: 1109472 - RNA, 16 nt, Mycobacterium bovis subsp bovis AF2122/97
cgcggcgcgcugaaau

SEQ ID NO: 1109473 - RNA, 16 nt, Mycobacterium bovis subsp bovis AF2122/97
cgcggcggccagcgca

SEQ ID NO: 1109474 - RNA, 16 nt, Mycobacterium bovis subsp bovis AF2122/97
cgcggcggcagcggcg

SEQ ID NO: 1109475 - RNA, 19 nt, Mycobacterium bovis subsp bovis AF2122/97
cgcggcggcagcggcgauc

SEQ ID NO: 1109476 - RNA, 13 nt, Mycobacterium bovis subsp bovis AF2122/97
cgcggcggcagca

SEQ ID NO: 1109477 - RNA, 22 nt, Mycobacterium bovis subsp bovis AF2122/97
cgcggcggcaucucgcaccgcg

SEQ ID NO: 1109478 - RNA, 14 nt, Mycobacterium bovis subsp bovis AF2122/97
cgcggcggcgaucc

SEQ ID NO: 1109479 - RNA, 12 nt, Mycobacterium bovis subsp bovis AF2122/97
cgcggcggcgcu

SEQ ID NO: 1109480 - RNA, 12 nt, Mycobacterium bovis subsp bovis AF2122/97
cgcggcggcgcg

SEQ ID NO: 1109481 - RNA, 16 nt, Mycobacterium bovis subsp bovis AF2122/97
cgcggcggcgccggcg

SEQ ID NO: 1109482 - RNA, 13 nt, Mycobacterium bovis subsp bovis AF2122/97
cgcggcggcgucg

SEQ ID NO: 1109483 - RNA, 13 nt, Mycobacterium bovis subsp bovis AF2122/97
cgcggcggcggcc

SEQ ID NO: 1109484 - RNA, 17 nt, Mycobacterium bovis subsp bovis AF2122/97
cgcggcgggcccgauga

SEQ ID NO: 1109485 - RNA, 21 nt, Mycobacterium bovis subsp bovis AF2122/97
cgcggcggucccugaagccag

SEQ ID NO: 1109486 - RNA, 20 nt, Mycobacterium bovis subsp bovis AF2122/97
cgcggcggucagucccguga

SEQ ID NO: 1109487 - RNA, 23 nt, Mycobacterium bovis subsp bovis AF2122/97
cgcggcggucagucccgugacga

SEQ ID NO: 1109488 - RNA, 13 nt, Mycobacterium bovis subsp bovis AF2122/97
cgcggcggugaac

SEQ ID NO: 1109489 - RNA, 22 nt, Mycobacterium bovis subsp bovis AF2122/97
cgcggcggugaacugcuggccg

SEQ ID NO: 1109490 - RNA, 22 nt, Mycobacterium bovis subsp bovis AF2122/97
cgcggcgguuaucgucggguca

SEQ ID NO: 1109491 - RNA, 13 nt, Mycobacterium bovis subsp bovis AF2122/97
cgcggcgugcgcg

SEQ ID NO: 1109492 - RNA, 15 nt, Mycobacterium bovis subsp bovis AF2122/97
cgcggcgugcgcggu

SEQ ID NO: 1109493 - RNA, 17 nt, Mycobacterium bovis subsp bovis AF2122/97
cgcggcgugcgcgguga

SEQ ID NO: 1109494 - RNA, 18 nt, Mycobacterium bovis subsp bovis AF2122/97
cgcggcgucggucgggug

SEQ ID NO: 1109495 - RNA, 12 nt, Mycobacterium bovis subsp bovis AF2122/97
cgcggcgucgcc

SEQ ID NO: 1109496 - RNA, 23 nt, Mycobacterium bovis subsp bovis AF2122/97
cgcggcguguacgucgaucaggu

SEQ ID NO: 1109497 - RNA, 19 nt, Mycobacterium bovis subsp bovis AF2122/97
cgcggcguugugaccgccg

SEQ ID NO: 1109498 - RNA, 19 nt, Mycobacterium bovis subsp bovis AF2122/97
cgcggcguuguugcggauc

SEQ ID NO: 1109499 - RNA, 24 nt, Mycobacterium bovis subsp bovis AF2122/97
cgcggcguuguugcggaucgagca

SEQ ID NO: 1109500 - RNA, 19 nt, Mycobacterium bovis subsp bovis AF2122/97
cgcggcuacaucggcggcg

SEQ ID NO: 1109501 - RNA, 21 nt, Mycobacterium bovis subsp bovis AF2122/97
cgcggcuaggccaagccgcgg

SEQ ID NO: 1109502 - RNA, 16 nt, Mycobacterium bovis subsp bovis AF2122/97
cgcggcuaggccagca

SEQ ID NO: 1109503 - RNA, 21 nt, Mycobacterium bovis subsp bovis AF2122/97
cgcggcuaggccagcacggcg

SEQ ID NO: 1109504 - RNA, 15 nt, Mycobacterium bovis subsp bovis AF2122/97
cgcggcucguuggca

SEQ ID NO: 1109505 - RNA, 12 nt, Mycobacterium bovis subsp bovis AF2122/97
cgcggcuccguu

SEQ ID NO: 1109506 - RNA, 21 nt, Mycobacterium bovis subsp bovis AF2122/97
cgcggaugagcucggccauca

SEQ ID NO: 1109507 - RNA, 19 nt, Mycobacterium bovis subsp bovis AF2122/97
cgcggauuggcacugucga

SEQ ID NO: 1109508 - RNA, 19 nt, Mycobacterium bovis subsp bovis AF2122/97
cgcggauuucucgcccuga

SEQ ID NO: 1109509 - RNA, 18 nt, Mycobacterium bovis subsp bovis AF2122/97
cgcggauuucgccgugau

SEQ ID NO: 1109510 - RNA, 22 nt, Mycobacterium bovis subsp bovis AF2122/97
cgcggcccaugaaggagauccc

SEQ ID NO: 1109511 - RNA, 22 nt, Mycobacterium bovis subsp bovis AF2122/97
cgcggcccagguccgcgugcug

SEQ ID NO: 1109512 - RNA, 23 nt, Mycobacterium bovis subsp bovis AF2122/97
cgcggcccagguccgcgugcugc

SEQ ID NO: 1109513 - RNA, 19 nt, Mycobacterium bovis subsp bovis AF2122/97
cgcggccccgccguugccg

SEQ ID NO: 1109514 - RNA, 22 nt, Mycobacterium bovis subsp bovis AF2122/97
cgcggccccgccguugccgccg

SEQ ID NO: 1109515 - RNA, 12 nt, Mycobacterium bovis subsp bovis AF2122/97
cgcggcccgccg

SEQ ID NO: 1109516 - RNA, 13 nt, Mycobacterium bovis subsp bovis AF2122/97
cgcggcccggccc

SEQ ID NO: 1109517 - RNA, 22 nt, Mycobacterium bovis subsp bovis AF2122/97
cgcggcccggacgucggcggcc

SEQ ID NO: 1109518 - RNA, 20 nt, Mycobacterium bovis subsp bovis AF2122/97
cgcggcccgccucggcggcg

SEQ ID NO: 1109519 - RNA, 15 nt, Mycobacterium bovis subsp bovis AF2122/97
cgcggccgcggugac

SEQ ID NO: 1109520 - RNA, 15 nt, Mycobacterium bovis subsp bovis AF2122/97
cgcggccgcucacau

SEQ ID NO: 1109521 - RNA, 12 nt, Mycobacterium bovis subsp bovis AF2122/97
cgcggccgcugg

SEQ ID NO: 1109522 - RNA, 14 nt, Mycobacterium bovis subsp bovis AF2122/97
cgcggccggccgcu

SEQ ID NO: 1109523 - RNA, 18 nt, Mycobacterium bovis subsp bovis AF2122/97
cgcggccggcgcucgcgg

SEQ ID NO: 1109524 - RNA, 14 nt, Mycobacterium bovis subsp bovis AF2122/97
cgcggccggcggcc

SEQ ID NO: 1109525 - RNA, 15 nt, Mycobacterium bovis subsp bovis AF2122/97
cgcggccggcggccg

SEQ ID NO: 1109526 - RNA, 19 nt, Mycobacterium bovis subsp bovis AF2122/97
cgcggccggcgucggcguc

SEQ ID NO: 1109527 - RNA, 17 nt, Mycobacterium bovis subsp bovis AF2122/97
cgcggccggcgugccag

SEQ ID NO: 1109528 - RNA, 19 nt, Mycobacterium bovis subsp bovis AF2122/97
cgcggccggcgugccagca

SEQ ID NO: 1109529 - RNA, 11 nt, Mycobacterium bovis subsp bovis AF2122/97
cgcggccgggc

SEQ ID NO: 1109530 - RNA, 15 nt, Mycobacterium bovis subsp bovis AF2122/97
cgcggccgggcgccc

SEQ ID NO: 1109531 - RNA, 13 nt, Mycobacterium bovis subsp bovis AF2122/97
cgcggccgggugg

SEQ ID NO: 1109532 - RNA, 14 nt, Mycobacterium bovis subsp bovis AF2122/97
cgcggccggguggc

SEQ ID NO: 1109533 - RNA, 22 nt, Mycobacterium bovis subsp bovis AF2122/97
cgcggccggguggcccggcgaa

SEQ ID NO: 1109534 - RNA, 17 nt, Mycobacterium bovis subsp bovis AF2122/97
cgcggcgcaagcccacc

SEQ ID NO: 1109535 - RNA, 16 nt, Mycobacterium bovis subsp bovis AF2122/97
cgcggcgcacaacccg

SEQ ID NO: 1109536 - RNA, 19 nt, Mycobacterium bovis subsp bovis AF2122/97
cgcggcgcacaacccgucg

SEQ ID NO: 1109537 - RNA, 17 nt, Mycobacterium bovis subsp bovis AF2122/97
cgcggcgcagcaccguc

SEQ ID NO: 1109538 - RNA, 23 nt, Mycobacterium bovis subsp bovis AF2122/97
cgcggcgaucugcgacaagaccg

SEQ ID NO: 1109539 - RNA, 18 nt, Mycobacterium bovis subsp bovis AF2122/97
cgcggcgcauuccggcgc

SEQ ID NO: 1109540 - RNA, 22 nt, Mycobacterium bovis subsp bovis AF2122/97
cgcggcgcaggucgcgcaguug

SEQ ID NO: 1109541 - RNA, 18 nt, Mycobacterium bovis subsp bovis AF2122/97
cgcggcgccguugccacc

SEQ ID NO: 1109542 - RNA, 15 nt, Mycobacterium bovis subsp bovis AF2122/97
cgcggcgcgaucguc

SEQ ID NO: 1109543 - RNA, 17 nt, Mycobacterium bovis subsp bovis AF2122/97
cgcggcgcgaucgucgg

SEQ ID NO: 1109544 - RNA, 15 nt, Mycobacterium bovis subsp bovis AF2122/97
cgcggcgcgacggca

SEQ ID NO: 1109545 - RNA, 15 nt, Mycobacterium bovis subsp bovis AF2122/97
cgcggccguagugca

SEQ ID NO: 1109546 - RNA, 18 nt, Mycobacterium bovis subsp bovis AF2122/97
cgcggccguagugcacgu

SEQ ID NO: 1109547 - RNA, 16 nt, Mycobacterium bovis subsp bovis AF2122/97
cgcggccgucgcggga

SEQ ID NO: 1109548 - RNA, 14 nt, Mycobacterium bovis subsp bovis AF2122/97
cgcggccucccgca

SEQ ID NO: 1109549 - RNA, 12 nt, Mycobacterium bovis subsp bovis AF2122/97
cgcggccucgua

SEQ ID NO: 1109550 - RNA, 14 nt, Mycobacterium bovis subsp bovis AF2122/97
cgcggcgaguggcu

SEQ ID NO: 1109551 - RNA, 20 nt, Mycobacterium bovis subsp bovis AF2122/97
cgcggcgaucgaggugacgg

SEQ ID NO: 1109552 - RNA, 12 nt, Mycobacterium bovis subsp bovis AF2122/97
cgcggcgaucgc

SEQ ID NO: 1109553 - RNA, 21 nt, Mycobacterium bovis subsp bovis AF2122/97
cgcggcgaucgcuccgcggcg

SEQ ID NO: 1109554 - RNA, 23 nt, Mycobacterium bovis subsp bovis AF2122/97
cgcggcgaucgcuccgcggcgca

SEQ ID NO: 1109555 - RNA, 18 nt, Mycobacterium bovis subsp bovis AF2122/97
cgcggcgauuacggccag

SEQ ID NO: 1109556 - RNA, 17 nt, Mycobacterium bovis subsp bovis AF2122/97
cgcggcgaucugcgaca

SEQ ID NO: 1109557 - RNA, 19 nt, Mycobacterium bovis subsp bovis AF2122/97
cgcggcgauuacggccagu

SEQ ID NO: 1109558 - RNA, 12 nt, Mycobacterium bovis subsp bovis AF2122/97
cgcucggcgccg

SEQ ID NO: 1109559 - RNA, 15 nt, Mycobacterium bovis subsp bovis AF2122/97
cgcucggcgagcuca

SEQ ID NO: 1109560 - RNA, 16 nt, Mycobacterium bovis subsp bovis AF2122/97
cgcucguggucgacgu

SEQ ID NO: 1109561 - RNA, 22 nt, Mycobacterium bovis subsp bovis AF2122/97
cgcucguuacgccgagcacacg

SEQ ID NO: 1109562 - RNA, 19 nt, Mycobacterium bovis subsp bovis AF2122/97
cgcucguuagcggcgggca

SEQ ID NO: 1109563 - RNA, 16 nt, Mycobacterium bovis subsp bovis AF2122/97
cgcucggcgcgcgggu

SEQ ID NO: 1109564 - RNA, 18 nt, Mycobacterium bovis subsp bovis AF2122/97
cgcucucauagcgacggc

SEQ ID NO: 1109565 - RNA, 21 nt, Mycobacterium bovis subsp bovis AF2122/97
cgcucguugcguugcaucagc

SEQ ID NO: 1109566 - RNA, 20 nt, Mycobacterium bovis subsp bovis AF2122/97
cgcucguugguucagcucga

SEQ ID NO: 1109567 - RNA, 21 nt, Mycobacterium bovis subsp bovis AF2122/97
cgcucguugguucagcucgag

SEQ ID NO: 1109568 - RNA, 16 nt, Mycobacterium bovis subsp bovis AF2122/97
cgcucguuugcgagca

SEQ ID NO: 1109569 - RNA, 19 nt, Mycobacterium bovis subsp bovis AF2122/97
cgcucguuugcgagcaggg

SEQ ID NO: 1109570 - RNA, 18 nt, Mycobacterium bovis subsp bovis AF2122/97
cgcugaacagacggcuca

SEQ ID NO: 1109571 - RNA, 21 nt, Mycobacterium bovis subsp bovis AF2122/97
cgcugaacagacggcucagcg

SEQ ID NO: 1109572 - RNA, 15 nt, Mycobacterium bovis subsp bovis AF2122/97
cgcugaagccgacga

SEQ ID NO: 1109573 - RNA, 21 nt, Mycobacterium bovis subsp bovis AF2122/97
cgcugaaggccgguagcgcgg

SEQ ID NO: 1109574 - RNA, 23 nt, Mycobacterium bovis subsp bovis AF2122/97
cgcugaaucaccccggcggccau

SEQ ID NO: 1109575 - RNA, 14 nt, Mycobacterium bovis subsp bovis AF2122/97
cgcucgcucaccgg

SEQ ID NO: 1109576 - RNA, 15 nt, Mycobacterium bovis subsp bovis AF2122/97
cgcucgcucaccggc

SEQ ID NO: 1109577 - RNA, 16 nt, Mycobacterium bovis subsp bovis AF2122/97
cgcucgcucaccggcg

SEQ ID NO: 1109578 - RNA, 21 nt, Mycobacterium bovis subsp bovis AF2122/97
cgcucgcucacgccguccggu

SEQ ID NO: 1109579 - RNA, 20 nt, Mycobacterium bovis subsp bovis AF2122/97
cgcucgcgguagcgccguga

SEQ ID NO: 1109580 - RNA, 18 nt, Mycobacterium bovis subsp bovis AF2122/97
cgcucggcagccggcuug

SEQ ID NO: 1109581 - RNA, 20 nt, Mycobacterium bovis subsp bovis AF2122/97
cgcucggaguugagcugucg

SEQ ID NO: 1109582 - RNA, 13 nt, Mycobacterium bovis subsp bovis AF2122/97
cgcucggccguca

SEQ ID NO: 1109583 - RNA, 22 nt, Mycobacterium bovis subsp bovis AF2122/97
cgcucggccauagcgccgcgcc

SEQ ID NO: 1109584 - RNA, 15 nt, Mycobacterium bovis subsp bovis AF2122/97
cgcucggccgccggg

SEQ ID NO: 1109585 - RNA, 16 nt, Mycobacterium bovis subsp bovis AF2122/97
cgcucggccgccgggu

SEQ ID NO: 1109586 - RNA, 17 nt, Mycobacterium bovis subsp bovis AF2122/97
cgcucggccgccggguc

SEQ ID NO: 1109587 - RNA, 19 nt, Mycobacterium bovis subsp bovis AF2122/97
cgcucggccgccggguccg

SEQ ID NO: 1109588 - RNA, 18 nt, Mycobacterium bovis subsp bovis AF2122/97
cgcucggccagcaucagc

SEQ ID NO: 1109589 - RNA, 14 nt, Mycobacterium bovis subsp bovis AF2122/97
cgcucgcgcgcugg

SEQ ID NO: 1109590 - RNA, 14 nt, Mycobacterium bovis subsp bovis AF2122/97
cgcucgcggcggcg

SEQ ID NO: 1109591 - RNA, 20 nt, Mycobacterium bovis subsp bovis AF2122/97
cgcucgcggcggcgcuggcg

SEQ ID NO: 1109592 - RNA, 22 nt, Mycobacterium bovis subsp bovis AF2122/97
cgcucgcggcggcgcuggcggg

SEQ ID NO: 1109593 - RNA, 13 nt, Mycobacterium bovis subsp bovis AF2122/97
cgcucgccguuuc

SEQ ID NO: 1109594 - RNA, 15 nt, Mycobacterium bovis subsp bovis AF2122/97
cgcucgccucgaugg

SEQ ID NO: 1109595 - RNA, 16 nt, Mycobacterium bovis subsp bovis AF2122/97
cgcucgccucgauggc

SEQ ID NO: 1109596 - RNA, 15 nt, Mycobacterium bovis subsp bovis AF2122/97
cgcucgcggauuggc

SEQ ID NO: 1109597 - RNA, 16 nt, Mycobacterium bovis subsp bovis AF2122/97
cgcucaguuuggcggg

SEQ ID NO: 1109598 - RNA, 17 nt, Mycobacterium bovis subsp bovis AF2122/97
cgcucaguuuggcgggu

SEQ ID NO: 1109599 - RNA, 20 nt, Mycobacterium bovis subsp bovis AF2122/97
cgcucgccgguaggcggcca

SEQ ID NO: 1109600 - RNA, 22 nt, Mycobacterium bovis subsp bovis AF2122/97
cgcucgccgguaggcggccagc

SEQ ID NO: 1109601 - RNA, 23 nt, Mycobacterium bovis subsp bovis AF2122/97
cgcucgccgguaggcggccagcg

SEQ ID NO: 1109602 - RNA, 18 nt, Mycobacterium bovis subsp bovis AF2122/97
cgcucaggucaucggcgg

SEQ ID NO: 1109603 - RNA, 16 nt, Mycobacterium bovis subsp bovis AF2122/97
cgcugcaccgggucaa

SEQ ID NO: 1109604 - RNA, 17 nt, Mycobacterium bovis subsp bovis AF2122/97
cgcugcacguggccacg

SEQ ID NO: 1109605 - RNA, 14 nt, Mycobacterium bovis subsp bovis AF2122/97
cgcugcagcacggc

SEQ ID NO: 1109606 - RNA, 20 nt, Mycobacterium bovis subsp bovis AF2122/97
cgcugcacggaaucgcaucu

SEQ ID NO: 1109607 - RNA, 18 nt, Mycobacterium bovis subsp bovis AF2122/97
cgcugcagcugcucgucg

SEQ ID NO: 1109608 - RNA, 16 nt, Mycobacterium bovis subsp bovis AF2122/97
cgcugcaggcggccga

SEQ ID NO: 1109609 - RNA, 19 nt, Mycobacterium bovis subsp bovis AF2122/97
cgcugcagugguaccggcg

SEQ ID NO: 1109610 - RNA, 17 nt, Mycobacterium bovis subsp bovis AF2122/97
cgcugcauacaaccccg

SEQ ID NO: 1109611 - RNA, 23 nt, Mycobacterium bovis subsp bovis AF2122/97
cgcugcauacaaccccgcgcugu

SEQ ID NO: 1109612 - RNA, 20 nt, Mycobacterium bovis subsp bovis AF2122/97
cgcugccacccaucgcacgg

SEQ ID NO: 1109613 - RNA, 12 nt, Mycobacterium bovis subsp bovis AF2122/97
cgcugccaccgc

SEQ ID NO: 1109614 - RNA, 13 nt, Mycobacterium bovis subsp bovis AF2122/97
cgcugccaccgcg

SEQ ID NO: 1109615 - RNA, 17 nt, Mycobacterium bovis subsp bovis AF2122/97
cgcugccaccgcggugg

SEQ ID NO: 1109616 - RNA, 14 nt, Mycobacterium bovis subsp bovis AF2122/97
cgcugccagcggcc

SEQ ID NO: 1109617 - RNA, 15 nt, Mycobacterium bovis subsp bovis AF2122/97
cgcugccagcggccg

SEQ ID NO: 1109618 - RNA, 16 nt, Mycobacterium bovis subsp bovis AF2122/97
cgcugccagcggccgg

SEQ ID NO: 1109619 - RNA, 18 nt, Mycobacterium bovis subsp bovis AF2122/97
cgcugccagggugcgccg

SEQ ID NO: 1109620 - RNA, 19 nt, Mycobacterium bovis subsp bovis AF2122/97
cgcugccagggugcgccgg

SEQ ID NO: 1109621 - RNA, 18 nt, Mycobacterium bovis subsp bovis AF2122/97
cgcugccgccgaucgaca

SEQ ID NO: 1109622 - RNA, 21 nt, Mycobacterium bovis subsp bovis AF2122/97
cgcugccgcccuugccgcccg

SEQ ID NO: 1109623 - RNA, 21 nt, Mycobacterium bovis subsp bovis AF2122/97
cgcugccgccgagcuggcgcg

SEQ ID NO: 1109624 - RNA, 12 nt, Mycobacterium bovis subsp bovis AF2122/97
cgcugccgccgg

SEQ ID NO: 1109625 - RNA, 12 nt, Mycobacterium bovis subsp bovis AF2122/97
cgcugccgccgu

SEQ ID NO: 1109626 - RNA, 13 nt, Mycobacterium bovis subsp bovis AF2122/97
cgcugaccaucac

SEQ ID NO: 1109627 - RNA, 18 nt, Mycobacterium bovis subsp bovis AF2122/97
cgcugaccacaaccguga

SEQ ID NO: 1109628 - RNA, 15 nt, Mycobacterium bovis subsp bovis AF2122/97
cgcugagccagcucc

SEQ ID NO: 1109629 - RNA, 15 nt, Mycobacterium bovis subsp bovis AF2122/97
cgcugagcccugcgc

SEQ ID NO: 1109630 - RNA, 18 nt, Mycobacterium bovis subsp bovis AF2122/97
cgcugagcacucaugaug

SEQ ID NO: 1109631 - RNA, 19 nt, Mycobacterium bovis subsp bovis AF2122/97
cgcugagccguagugucgg

SEQ ID NO: 1109632 - RNA, 13 nt, Mycobacterium bovis subsp bovis AF2122/97
cgcugagcgacug

SEQ ID NO: 1109633 - RNA, 21 nt, Mycobacterium bovis subsp bovis AF2122/97
cgcugagcgacugcagcggcg

SEQ ID NO: 1109634 - RNA, 16 nt, Mycobacterium bovis subsp bovis AF2122/97
cgcugagcccugcgcc

SEQ ID NO: 1109635 - RNA, 17 nt, Mycobacterium bovis subsp bovis AF2122/97
cgcugagccgcucaucg

SEQ ID NO: 1109636 - RNA, 17 nt, Mycobacterium bovis subsp bovis AF2122/97
cgcugagcacgcggauc

SEQ ID NO: 1109637 - RNA, 13 nt, Mycobacterium bovis subsp bovis AF2122/97
cgcugagcacggc

SEQ ID NO: 1109638 - RNA, 22 nt, Mycobacterium bovis subsp bovis AF2122/97
cgcugagcacggcgcggcggag

SEQ ID NO: 1109639 - RNA, 19 nt, Mycobacterium bovis subsp bovis AF2122/97
cgcugaccggaucugacgg

SEQ ID NO: 1109640 - RNA, 14 nt, Mycobacterium bovis subsp bovis AF2122/97
cgcugaccgcguag

SEQ ID NO: 1109641 - RNA, 23 nt, Mycobacterium bovis subsp bovis AF2122/97
cgcugaccgcuaccagcugggcg

SEQ ID NO: 1109642 - RNA, 22 nt, Mycobacterium bovis subsp bovis AF2122/97
cgcugcaaccgccggugccgau

SEQ ID NO: 1109643 - RNA, 22 nt, Mycobacterium bovis subsp bovis AF2122/97
cgcugaugcuggccauguucgg

SEQ ID NO: 1109644 - RNA, 19 nt, Mycobacterium bovis subsp bovis AF2122/97
cgcugauggugcugcggcg

SEQ ID NO: 1109645 - RNA, 23 nt, Mycobacterium bovis subsp bovis AF2122/97
cgcugauggugcugcggcguccg

SEQ ID NO: 1109646 - RNA, 22 nt, Mycobacterium bovis subsp bovis AF2122/97
cgcugaucuuccccucggccgc

SEQ ID NO: 1109647 - RNA, 23 nt, Mycobacterium bovis subsp bovis AF2122/97
cgcugaugagccgcagaugcacc

SEQ ID NO: 1109648 - RNA, 16 nt, Mycobacterium bovis subsp bovis AF2122/97
cgcugaucugccgccg

SEQ ID NO: 1109649 - RNA, 20 nt, Mycobacterium bovis subsp bovis AF2122/97
cgcugaucugccgccgcggc

SEQ ID NO: 1109650 - RNA, 22 nt, Mycobacterium bovis subsp bovis AF2122/97
cgcugaucugccgccgcggcca

SEQ ID NO: 1109651 - RNA, 17 nt, Mycobacterium bovis subsp bovis AF2122/97
cgcuaggcgauccagac

SEQ ID NO: 1109652 - RNA, 13 nt, Mycobacterium bovis subsp bovis AF2122/97
cgcuagcucggcc

SEQ ID NO: 1109653 - RNA, 16 nt, Mycobacterium bovis subsp bovis AF2122/97
cgcuaggucaggugau

SEQ ID NO: 1109654 - RNA, 22 nt, Mycobacterium bovis subsp bovis AF2122/97
cgcuaggucaggugauucgcgc

SEQ ID NO: 1109655 - RNA, 18 nt, Mycobacterium bovis subsp bovis AF2122/97
cgcuaggugacgccgcca

SEQ ID NO: 1109656 - RNA, 23 nt, Mycobacterium bovis subsp bovis AF2122/97
cgcuaggugacgccgccagcacc

SEQ ID NO: 1109657 - RNA, 20 nt, Mycobacterium bovis subsp bovis AF2122/97
cgcuaggugcaacaggcgcg

SEQ ID NO: 1109658 - RNA, 11 nt, Mycobacterium bovis subsp bovis AF2122/97
cgcuaggugcg

SEQ ID NO: 1109659 - RNA, 19 nt, Mycobacterium bovis subsp bovis AF2122/97
cgcuaggaccgcgguggcc

SEQ ID NO: 1109660 - RNA, 12 nt, Mycobacterium bovis subsp bovis AF2122/97
cgcuaucaccgc

SEQ ID NO: 1109661 - RNA, 13 nt, Mycobacterium bovis subsp bovis AF2122/97
cgcuagucgucgg

SEQ ID NO: 1109662 - RNA, 16 nt, Mycobacterium bovis subsp bovis AF2122/97
cgcuauccggcggcca

SEQ ID NO: 1109663 - RNA, 17 nt, Mycobacterium bovis subsp bovis AF2122/97
cgcuaucaugaccaccg

SEQ ID NO: 1109664 - RNA, 18 nt, Mycobacterium bovis subsp bovis AF2122/97
cgcuauccaggccgucag

SEQ ID NO: 1109665 - RNA, 22 nt, Mycobacterium bovis subsp bovis AF2122/97
cgcuauggcauuaccacuucgg

SEQ ID NO: 1109666 - RNA, 22 nt, Mycobacterium bovis subsp bovis AF2122/97
cgcuaucgugcgccgacggugc

SEQ ID NO: 1109667 - RNA, 16 nt, Mycobacterium bovis subsp bovis AF2122/97
cgcuaugaugccgccg

SEQ ID NO: 1109668 - RNA, 23 nt, Mycobacterium bovis subsp bovis AF2122/97
cgcuaccaacgcaacacgggcgc

SEQ ID NO: 1109669 - RNA, 20 nt, Mycobacterium bovis subsp bovis AF2122/97
cgcuacgcaacgggucgggu

SEQ ID NO: 1109670 - RNA, 12 nt, Mycobacterium bovis subsp bovis AF2122/97
cgcuaccgcaca

SEQ ID NO: 1109671 - RNA, 14 nt, Mycobacterium bovis subsp bovis AF2122/97
cgcuaccgccgggg

SEQ ID NO: 1109672 - RNA, 15 nt, Mycobacterium bovis subsp bovis AF2122/97
cgcuacccagcgcgu

SEQ ID NO: 1109673 - RNA, 19 nt, Mycobacterium bovis subsp bovis AF2122/97
cgcuacccggacagggcgg

SEQ ID NO: 1109674 - RNA, 14 nt, Mycobacterium bovis subsp bovis AF2122/97
cgcuacugcgacca

SEQ ID NO: 1109675 - RNA, 13 nt, Mycobacterium bovis subsp bovis AF2122/97
cgcuagccaggga

SEQ ID NO: 1109676 - RNA, 12 nt, Mycobacterium bovis subsp bovis AF2122/97
cgcuagccgaca

SEQ ID NO: 1109677 - RNA, 19 nt, Mycobacterium bovis subsp bovis AF2122/97
cgcuagcgccaaauccggc

SEQ ID NO: 1109678 - RNA, 19 nt, Mycobacterium bovis subsp bovis AF2122/97
cgcuagcgccgcgcuugcg

SEQ ID NO: 1109679 - RNA, 21 nt, Mycobacterium bovis subsp bovis AF2122/97
cgcuagcgccgcgcuugcgau

SEQ ID NO: 1109680 - RNA, 13 nt, Mycobacterium bovis subsp bovis AF2122/97
cgcuacggcagcc

SEQ ID NO: 1109681 - RNA, 18 nt, Mycobacterium bovis subsp bovis AF2122/97
cgcuacgucaagccgugc

SEQ ID NO: 1109682 - RNA, 14 nt, Mycobacterium bovis subsp bovis AF2122/97
cgcuacgucgaccg

SEQ ID NO: 1109683 - RNA, 18 nt, Mycobacterium bovis subsp bovis AF2122/97
cgcuacguuacgccgaga

SEQ ID NO: 1109684 - RNA, 14 nt, Mycobacterium bovis subsp bovis AF2122/97
cgcucagcgcagca

SEQ ID NO: 1109685 - RNA, 16 nt, Mycobacterium bovis subsp bovis AF2122/97
cgcucagcgcggccac

SEQ ID NO: 1109686 - RNA, 18 nt, Mycobacterium bovis subsp bovis AF2122/97
cgcucagcgcggccacgc

SEQ ID NO: 1109687 - RNA, 14 nt, Mycobacterium bovis subsp bovis AF2122/97
cgcucacgcucacc

SEQ ID NO: 1109688 - RNA, 17 nt, Mycobacterium bovis subsp bovis AF2122/97
cgcucaccggcuggugc

SEQ ID NO: 1109689 - RNA, 13 nt, Mycobacterium bovis subsp bovis AF2122/97
cgcucaccggcgu

SEQ ID NO: 1109690 - RNA, 15 nt, Mycobacterium bovis subsp bovis AF2122/97
cgcucaccggcgucg

SEQ ID NO: 1109691 - RNA, 15 nt, Mycobacterium bovis subsp bovis AF2122/97
cgcucacccgccgcg

SEQ ID NO: 1109692 - RNA, 16 nt, Mycobacterium bovis subsp bovis AF2122/97
cgcucacccggucgca

SEQ ID NO: 1109693 - RNA, 16 nt, Mycobacterium bovis subsp bovis AF2122/97
cgcucacccgcccgga

SEQ ID NO: 1109694 - RNA, 18 nt, Mycobacterium bovis subsp bovis AF2122/97
cgcucacccgcccggaac

SEQ ID NO: 1109695 - RNA, 12 nt, Mycobacterium bovis subsp bovis AF2122/97
cgcucaccaccg

SEQ ID NO: 1109696 - RNA, 17 nt, Mycobacterium bovis subsp bovis AF2122/97
cgcucaccaccgaccuc

SEQ ID NO: 1109697 - RNA, 15 nt, Mycobacterium bovis subsp bovis AF2122/97
cgcucaacucaguuu

SEQ ID NO: 1109698 - RNA, 22 nt, Mycobacterium bovis subsp bovis AF2122/97
cgcucaacaaucgguggucgua

SEQ ID NO: 1109699 - RNA, 20 nt, Mycobacterium bovis subsp bovis AF2122/97
cgcuauggcccgggccgaag

SEQ ID NO: 1109700 - RNA, 22 nt, Mycobacterium bovis subsp bovis AF2122/97
cgcgugcagccauugacggucc

SEQ ID NO: 1109701 - RNA, 18 nt, Mycobacterium bovis subsp bovis AF2122/97
cgcgugacguaccacggc

SEQ ID NO: 1109702 - RNA, 19 nt, Mycobacterium bovis subsp bovis AF2122/97
cgcgugcaucgccugcgcc

SEQ ID NO: 1109703 - RNA, 19 nt, Mycobacterium bovis subsp bovis AF2122/97
cgcgugcagcggcgccgcc

SEQ ID NO: 1109704 - RNA, 15 nt, Mycobacterium bovis subsp bovis AF2122/97
cgcgugcccguggug

SEQ ID NO: 1109705 - RNA, 16 nt, Mycobacterium bovis subsp bovis AF2122/97
cgcgugccacucgaug

SEQ ID NO: 1109706 - RNA, 18 nt, Mycobacterium bovis subsp bovis AF2122/97
cgcgugccacucgaugcu

SEQ ID NO: 1109707 - RNA, 14 nt, Mycobacterium bovis subsp bovis AF2122/97
cgcgugcgccgggg

SEQ ID NO: 1109708 - RNA, 18 nt, Mycobacterium bovis subsp bovis AF2122/97
cgcgugcgcaucccgaag

SEQ ID NO: 1109709 - RNA, 20 nt, Mycobacterium bovis subsp bovis AF2122/97
cgcguggcaccaccaaggug

SEQ ID NO: 1109710 - RNA, 22 nt, Mycobacterium bovis subsp bovis AF2122/97
cgcguggcagugcaggcggccg

SEQ ID NO: 1109711 - RNA, 20 nt, Mycobacterium bovis subsp bovis AF2122/97
cgcgugcuggaacagguuga

SEQ ID NO: 1109712 - RNA, 15 nt, Mycobacterium bovis subsp bovis AF2122/97
cgcgugcggcugcca

SEQ ID NO: 1109713 - RNA, 20 nt, Mycobacterium bovis subsp bovis AF2122/97
cgcgugcucgagcaccucgg

SEQ ID NO: 1109714 - RNA, 18 nt, Mycobacterium bovis subsp bovis AF2122/97
cgcgguuaucgccgagau

SEQ ID NO: 1109715 - RNA, 19 nt, Mycobacterium bovis subsp bovis AF2122/97
cgcgguuaucgccgagauc

SEQ ID NO: 1109716 - RNA, 20 nt, Mycobacterium bovis subsp bovis AF2122/97
cgcgguucaacaccaacgcg

SEQ ID NO: 1109717 - RNA, 14 nt, Mycobacterium bovis subsp bovis AF2122/97
cgcgguucaccacg

SEQ ID NO: 1109718 - RNA, 13 nt, Mycobacterium bovis subsp bovis AF2122/97
cgcggugccggga

SEQ ID NO: 1109719 - RNA, 22 nt, Mycobacterium bovis subsp bovis AF2122/97
cgcggugugcagggacccggcg

SEQ ID NO: 1109720 - RNA, 21 nt, Mycobacterium bovis subsp bovis AF2122/97
cgcgguguugcggugaucggg

SEQ ID NO: 1109721 - RNA, 23 nt, Mycobacterium bovis subsp bovis AF2122/97
cgcggugugcgugucacccaaug

SEQ ID NO: 1109722 - RNA, 23 nt, Mycobacterium bovis subsp bovis AF2122/97
cgcggugugcggcagcccgcugg

SEQ ID NO: 1109723 - RNA, 19 nt, Mycobacterium bovis subsp bovis AF2122/97
cgcgguguauccgacgucg

SEQ ID NO: 1109724 - RNA, 20 nt, Mycobacterium bovis subsp bovis AF2122/97
cgcgguguauccgacgucgg

SEQ ID NO: 1109725 - RNA, 20 nt, Mycobacterium bovis subsp bovis AF2122/97
cgcgguguagaagcgggcgu

SEQ ID NO: 1109726 - RNA, 16 nt, Mycobacterium bovis subsp bovis AF2122/97
cgcgugcuuggcagcg

SEQ ID NO: 1109727 - RNA, 19 nt, Mycobacterium bovis subsp bovis AF2122/97
cgcguggcgcaccaccgcc

SEQ ID NO: 1109728 - RNA, 20 nt, Mycobacterium bovis subsp bovis AF2122/97
cgcguggcgcaccaccgccc

SEQ ID NO: 1109729 - RNA, 13 nt, Mycobacterium bovis subsp bovis AF2122/97
cgcguggccgccg

SEQ ID NO: 1109730 - RNA, 17 nt, Mycobacterium bovis subsp bovis AF2122/97
cgcguggccgccggcgc

SEQ ID NO: 1109731 - RNA, 20 nt, Mycobacterium bovis subsp bovis AF2122/97
cgcguggccgccggcgcugg

SEQ ID NO: 1109732 - RNA, 15 nt, Mycobacterium bovis subsp bovis AF2122/97
cgcguggcuggcggc

SEQ ID NO: 1109733 - RNA, 13 nt, Mycobacterium bovis subsp bovis AF2122/97
cgcguucggcgcu

SEQ ID NO: 1109734 - RNA, 22 nt, Mycobacterium bovis subsp bovis AF2122/97
cgcgugguaccgcuuguccacc

SEQ ID NO: 1109735 - RNA, 17 nt, Mycobacterium bovis subsp bovis AF2122/97
cgcguucuccggcaccg

SEQ ID NO: 1109736 - RNA, 18 nt, Mycobacterium bovis subsp bovis AF2122/97
cgcguucggcgagcagcg

SEQ ID NO: 1109737 - RNA, 16 nt, Mycobacterium bovis subsp bovis AF2122/97
cgcguucugcaccagc

SEQ ID NO: 1109738 - RNA, 16 nt, Mycobacterium bovis subsp bovis AF2122/97
cgcguucucggcaccc

SEQ ID NO: 1109739 - RNA, 17 nt, Mycobacterium bovis subsp bovis AF2122/97
cgcguugaaggcgccgg

SEQ ID NO: 1109740 - RNA, 20 nt, Mycobacterium bovis subsp bovis AF2122/97
cgcguugaagucgccgguga

SEQ ID NO: 1109741 - RNA, 14 nt, Mycobacterium bovis subsp bovis AF2122/97
cgcuaaguccccgc

SEQ ID NO: 1109742 - RNA, 20 nt, Mycobacterium bovis subsp bovis AF2122/97
cgcuaaguccccgcuuggcg

SEQ ID NO: 1109743 - RNA, 17 nt, Mycobacterium bovis subsp bovis AF2122/97
cgcuaauugcggccgcc

SEQ ID NO: 1109744 - RNA, 15 nt, Mycobacterium bovis subsp bovis AF2122/97
cgcugguccuugucg

SEQ ID NO: 1109745 - RNA, 19 nt, Mycobacterium bovis subsp bovis AF2122/97
cgcugucacguagcgagcc

SEQ ID NO: 1109746 - RNA, 16 nt, Mycobacterium bovis subsp bovis AF2122/97
cgcugucagccgaccg

SEQ ID NO: 1109747 - RNA, 17 nt, Mycobacterium bovis subsp bovis AF2122/97
cgcugucgagccggugc

SEQ ID NO: 1109748 - RNA, 21 nt, Mycobacterium bovis subsp bovis AF2122/97
cgcugucgagccggugccgcg

SEQ ID NO: 1109749 - RNA, 12 nt, Mycobacterium bovis subsp bovis AF2122/97
cgcugucgaucu

SEQ ID NO: 1109750 - RNA, 20 nt, Mycobacterium bovis subsp bovis AF2122/97
cgcuguccacugccaccgcg

SEQ ID NO: 1109751 - RNA, 18 nt, Mycobacterium bovis subsp bovis AF2122/97
cgcugucccagcccggcc

SEQ ID NO: 1109752 - RNA, 22 nt, Mycobacterium bovis subsp bovis AF2122/97
cgcuguccgacuugucgccauu

SEQ ID NO: 1109753 - RNA, 20 nt, Mycobacterium bovis subsp bovis AF2122/97
cgcuggucaacuccacgcgg

SEQ ID NO: 1109754 - RNA, 23 nt, Mycobacterium bovis subsp bovis AF2122/97
cgcugucgcccucgaucgccacg

SEQ ID NO: 1109755 - RNA, 18 nt, Mycobacterium bovis subsp bovis AF2122/97
cgcugucgcccucgaucg

SEQ ID NO: 1109756 - RNA, 23 nt, Mycobacterium bovis subsp bovis AF2122/97
cgcuggcguuguugacgaucacc

SEQ ID NO: 1109757 - RNA, 13 nt, Mycobacterium bovis subsp bovis AF2122/97
cgcuggcguugag

SEQ ID NO: 1109758 - RNA, 17 nt, Mycobacterium bovis subsp bovis AF2122/97
cgcuggcugacaccgau

SEQ ID NO: 1109759 - RNA, 14 nt, Mycobacterium bovis subsp bovis AF2122/97
cgcuggggcgcccg

SEQ ID NO: 1109760 - RNA, 14 nt, Mycobacterium bovis subsp bovis AF2122/97
cgcuggcuugggcc

SEQ ID NO: 1109761 - RNA, 20 nt, Mycobacterium bovis subsp bovis AF2122/97
cgcuggcuugggccagcgca

SEQ ID NO: 1109762 - RNA, 21 nt, Mycobacterium bovis subsp bovis AF2122/97
cgcuggguggcgggccggaug

SEQ ID NO: 1109763 - RNA, 16 nt, Mycobacterium bovis subsp bovis AF2122/97
cgcugggggcggucgc

SEQ ID NO: 1109764 - RNA, 20 nt, Mycobacterium bovis subsp bovis AF2122/97
cgcugggguccgcgucggcg

SEQ ID NO: 1109765 - RNA, 20 nt, Mycobacterium bovis subsp bovis AF2122/97
cgcugggacaacgugccgaa

SEQ ID NO: 1109766 - RNA, 19 nt, Mycobacterium bovis subsp bovis AF2122/97
cgcuggucgaccggcguug

SEQ ID NO: 1109767 - RNA, 21 nt, Mycobacterium bovis subsp bovis AF2122/97
cgcugguauagcucacggugg

SEQ ID NO: 1109768 - RNA, 19 nt, Mycobacterium bovis subsp bovis AF2122/97
cgcugguaguguucagcuu

SEQ ID NO: 1109769 - RNA, 14 nt, Mycobacterium bovis subsp bovis AF2122/97
cgcugccggcagcg

SEQ ID NO: 1109770 - RNA, 21 nt, Mycobacterium bovis subsp bovis AF2122/97
cgcugccgggauccuccgggu

SEQ ID NO: 1109771 - RNA, 15 nt, Mycobacterium bovis subsp bovis AF2122/97
cgcugccgcugccga

SEQ ID NO: 1109772 - RNA, 17 nt, Mycobacterium bovis subsp bovis AF2122/97
cgcugcgcaccgccgcg

SEQ ID NO: 1109773 - RNA, 13 nt, Mycobacterium bovis subsp bovis AF2122/97
cgcugcgccgagg

SEQ ID NO: 1109774 - RNA, 12 nt, Mycobacterium bovis subsp bovis AF2122/97
cgcugcgcccgg

SEQ ID NO: 1109775 - RNA, 13 nt, Mycobacterium bovis subsp bovis AF2122/97
cgcugcgcccgga

SEQ ID NO: 1109776 - RNA, 19 nt, Mycobacterium bovis subsp bovis AF2122/97
cgcugcgccgucgcagcca

SEQ ID NO: 1109777 - RNA, 17 nt, Mycobacterium bovis subsp bovis AF2122/97
cgcuggcgccggccagc

SEQ ID NO: 1109778 - RNA, 23 nt, Mycobacterium bovis subsp bovis AF2122/97
cgcuggcgccggccagccagcga

SEQ ID NO: 1109779 - RNA, 14 nt, Mycobacterium bovis subsp bovis AF2122/97
cgcuggcgccgccg

SEQ ID NO: 1109780 - RNA, 15 nt, Mycobacterium bovis subsp bovis AF2122/97
cgcuggcgccgccgg

SEQ ID NO: 1109781 - RNA, 21 nt, Mycobacterium bovis subsp bovis AF2122/97
cgcuggcgccgccggugccac

SEQ ID NO: 1109782 - RNA, 15 nt, Mycobacterium bovis subsp bovis AF2122/97
cgcugcgccagguca

SEQ ID NO: 1109783 - RNA, 15 nt, Mycobacterium bovis subsp bovis AF2122/97
cgcuggcgcccccga

SEQ ID NO: 1109784 - RNA, 20 nt, Mycobacterium bovis subsp bovis AF2122/97
cgcuggcgguguagccgcgg

SEQ ID NO: 1109785 - RNA, 19 nt, Mycobacterium bovis subsp bovis AF2122/97
cgcuggcgucgucuucggu

SEQ ID NO: 1109786 - RNA, 16 nt, Mycobacterium bovis subsp bovis AF2122/97
cgcuggcgggcgaucg

SEQ ID NO: 1109787 - RNA, 20 nt, Mycobacterium bovis subsp bovis AF2122/97
cgcuggcgggcgaucgcggc

SEQ ID NO: 1109788 - RNA, 14 nt, Mycobacterium bovis subsp bovis AF2122/97
cgcuggcgggcggc

SEQ ID NO: 1109789 - RNA, 17 nt, Mycobacterium bovis subsp bovis AF2122/97
cgcuggcgggcggcgug

SEQ ID NO: 1109790 - RNA, 13 nt, Mycobacterium bovis subsp bovis AF2122/97
cgcuucggcagcu

SEQ ID NO: 1109791 - RNA, 22 nt, Mycobacterium bovis subsp bovis AF2122/97
cgcuuccugggcacggagaccg

SEQ ID NO: 1109792 - RNA, 22 nt, Mycobacterium bovis subsp bovis AF2122/97
cgcuucccggaagcgccggccc

SEQ ID NO: 1109793 - RNA, 18 nt, Mycobacterium bovis subsp bovis AF2122/97
cgcuucaugagccgcugc

SEQ ID NO: 1109794 - RNA, 15 nt, Mycobacterium bovis subsp bovis AF2122/97
cgcuucacagccacc

SEQ ID NO: 1109795 - RNA, 16 nt, Mycobacterium bovis subsp bovis AF2122/97
cgcuucacagccacca

SEQ ID NO: 1109796 - RNA, 14 nt, Mycobacterium bovis subsp bovis AF2122/97
cgcuucacgggccg

SEQ ID NO: 1109797 - RNA, 19 nt, Mycobacterium bovis subsp bovis AF2122/97
cgcuguuccucgaguucgg

SEQ ID NO: 1109798 - RNA, 15 nt, Mycobacterium bovis subsp bovis AF2122/97
cgcuguugccaucga

SEQ ID NO: 1109799 - RNA, 21 nt, Mycobacterium bovis subsp bovis AF2122/97
cgcuguugccaucgacgccgc

SEQ ID NO: 1109800 - RNA, 21 nt, Mycobacterium bovis subsp bovis AF2122/97
cgcuguuccucgaguucgggc

SEQ ID NO: 1109801 - RNA, 17 nt, Mycobacterium bovis subsp bovis AF2122/97
cgcuguugaagccgccc

SEQ ID NO: 1109802 - RNA, 18 nt, Mycobacterium bovis subsp bovis AF2122/97
cgcuguugaagccgcccg

SEQ ID NO: 1109803 - RNA, 13 nt, Mycobacterium bovis subsp bovis AF2122/97
cgcugugggcgag

SEQ ID NO: 1109804 - RNA, 19 nt, Mycobacterium bovis subsp bovis AF2122/97
cgcuguggcgggagaucgu

SEQ ID NO: 1109805 - RNA, 15 nt, Mycobacterium bovis subsp bovis AF2122/97
cgcuguggcucgacg

SEQ ID NO: 1109806 - RNA, 19 nt, Mycobacterium bovis subsp bovis AF2122/97
cgcugugagcuuggucgcc

SEQ ID NO: 1109807 - RNA, 20 nt, Mycobacterium bovis subsp bovis AF2122/97
cgcuuacgggugucgggcgc

SEQ ID NO: 1109808 - RNA, 14 nt, Mycobacterium bovis subsp bovis AF2122/97
cgcuguuggccggu

SEQ ID NO: 1109809 - RNA, 22 nt, Mycobacterium bovis subsp bovis AF2122/97
cgcuguuguggaacaccgcggc

SEQ ID NO: 1109810 - RNA, 22 nt, Mycobacterium bovis subsp bovis AF2122/97
cgcuugagcgaguugcagucgc

SEQ ID NO: 1109811 - RNA, 14 nt, Mycobacterium bovis subsp bovis AF2122/97
cgcuugcggccgcg

SEQ ID NO: 1109812 - RNA, 14 nt, Mycobacterium bovis subsp bovis AF2122/97
cgcuugcgaucggc

SEQ ID NO: 1109813 - RNA, 21 nt, Mycobacterium bovis subsp bovis AF2122/97
cgcuugcgaccccggcugcgc

SEQ ID NO: 1109814 - RNA, 18 nt, Mycobacterium bovis subsp bovis AF2122/97
cgcuugcggggccgggcg

SEQ ID NO: 1109815 - RNA, 23 nt, Mycobacterium bovis subsp bovis AF2122/97
cgcuugcggggccgggcgaucgc

SEQ ID NO: 1109816 - RNA, 22 nt, Mycobacterium bovis subsp bovis AF2122/97
cgcuucguccagcgaucccggu

SEQ ID NO: 1109817 - RNA, 19 nt, Mycobacterium bovis subsp bovis AF2122/97
cgcuucgucggccggcacc

SEQ ID NO: 1109818 - RNA, 13 nt, Mycobacterium bovis subsp bovis AF2122/97
cgcuucggccacu

SEQ ID NO: 1109819 - RNA, 18 nt, Mycobacterium bovis subsp bovis AF2122/97
cgcuugaccccgccgaac

SEQ ID NO: 1109820 - RNA, 16 nt, Mycobacterium bovis subsp bovis AF2122/97
cgcuugaccccuggcc

SEQ ID NO: 1109821 - RNA, 19 nt, Mycobacterium bovis subsp bovis AF2122/97
cgcuucuuccgcgcgccgg

SEQ ID NO: 1109822 - RNA, 22 nt, Mycobacterium bovis subsp bovis AF2122/97
cgcuugaagguucgaucgcggu

SEQ ID NO: 1109823 - RNA, 22 nt, Mycobacterium bovis subsp bovis AF2122/97
cgcuuggucaaaaagcucggcc

SEQ ID NO: 1109824 - RNA, 22 nt, Mycobacterium bovis subsp bovis AF2122/97
cgcuuggcaaucaucucccgac

SEQ ID NO: 1109825 - RNA, 17 nt, Mycobacterium bovis subsp bovis AF2122/97
cgcuugggguccggaug

SEQ ID NO: 1109826 - RNA, 18 nt, Mycobacterium bovis subsp bovis AF2122/97
cgcuugggguugggcggg

SEQ ID NO: 1109827 - RNA, 22 nt, Mycobacterium bovis subsp bovis AF2122/97
cgcuuggugugauacaacgcca

SEQ ID NO: 1109828 - RNA, 17 nt, Mycobacterium bovis subsp bovis AF2122/97
cgcuuuccggcgguggu

SEQ ID NO: 1109829 - RNA, 18 nt, Mycobacterium bovis subsp bovis AF2122/97
cgcuuucuuggcgggcgc

SEQ ID NO: 1109830 - RNA, 16 nt, Mycobacterium bovis subsp bovis AF2122/97
cgcuuugcacugugga

SEQ ID NO: 1109831 - RNA, 15 nt, Mycobacterium bovis subsp bovis AF2122/97
cgcuuuggucgucgg

SEQ ID NO: 1109832 - RNA, 16 nt, Mycobacterium bovis subsp bovis AF2122/97
cggaacucgucgcugc

SEQ ID NO: 1109833 - RNA, 15 nt, Mycobacterium bovis subsp bovis AF2122/97
cggaacugaccacgu

SEQ ID NO: 1109834 - RNA, 18 nt, Mycobacterium bovis subsp bovis AF2122/97
cggaacugaccacgucgg

SEQ ID NO: 1109835 - RNA, 18 nt, Mycobacterium bovis subsp bovis AF2122/97
cggaagaagugcucacau

SEQ ID NO: 1109836 - RNA, 18 nt, Mycobacterium bovis subsp bovis AF2122/97
cggaagaccgcgggaccu

SEQ ID NO: 1109837 - RNA, 18 nt, Mycobacterium bovis subsp bovis AF2122/97
cggaagacgugguagagg

SEQ ID NO: 1109838 - RNA, 16 nt, Mycobacterium bovis subsp bovis AF2122/97
cggaacggguuggcga

SEQ ID NO: 1109839 - RNA, 22 nt, Mycobacterium bovis subsp bovis AF2122/97
cggaacgugaccgacgccgucg

SEQ ID NO: 1109840 - RNA, 14 nt, Mycobacterium bovis subsp bovis AF2122/97
cggaacgcgucgcc

SEQ ID NO: 1109841 - RNA, 16 nt, Mycobacterium bovis subsp bovis AF2122/97
cggaacgcgucgccga

SEQ ID NO: 1109842 - RNA, 20 nt, Mycobacterium bovis subsp bovis AF2122/97
cggaacgaaugucaccccgc

SEQ ID NO: 1109843 - RNA, 17 nt, Mycobacterium bovis subsp bovis AF2122/97
cggaaccugcucggccg

SEQ ID NO: 1109844 - RNA, 21 nt, Mycobacterium bovis subsp bovis AF2122/97
cggaaccugcucggccgugca

SEQ ID NO: 1109845 - RNA, 15 nt, Mycobacterium bovis subsp bovis AF2122/97
cggaacgagcggccg

SEQ ID NO: 1109846 - RNA, 19 nt, Mycobacterium bovis subsp bovis AF2122/97
cggaacgagcggccgcgcg

SEQ ID NO: 1109847 - RNA, 19 nt, Mycobacterium bovis subsp bovis AF2122/97
cggaacgauggacgcccag

SEQ ID NO: 1109848 - RNA, 13 nt, Mycobacterium bovis subsp bovis AF2122/97
cggaacgccgucg

SEQ ID NO: 1109849 - RNA, 16 nt, Mycobacterium bovis subsp bovis AF2122/97
cggaacgccgucgagc

SEQ ID NO: 1109850 - RNA, 19 nt, Mycobacterium bovis subsp bovis AF2122/97
cggaacgccuaacgcguag

SEQ ID NO: 1109851 - RNA, 15 nt, Mycobacterium bovis subsp bovis AF2122/97
cggaagcggcggccc

SEQ ID NO: 1109852 - RNA, 13 nt, Mycobacterium bovis subsp bovis AF2122/97
cggaagcgccggc

SEQ ID NO: 1109853 - RNA, 16 nt, Mycobacterium bovis subsp bovis AF2122/97
cggaagcgccggccca

SEQ ID NO: 1109854 - RNA, 15 nt, Mycobacterium bovis subsp bovis AF2122/97
cggaagcgccggccg

SEQ ID NO: 1109855 - RNA, 20 nt, Mycobacterium bovis subsp bovis AF2122/97
cggaaggcccggcgcggccg

SEQ ID NO: 1109856 - RNA, 14 nt, Mycobacterium bovis subsp bovis AF2122/97
cggaaggcgucgaa

SEQ ID NO: 1109857 - RNA, 20 nt, Mycobacterium bovis subsp bovis AF2122/97
cggaaggacggcagccacca

SEQ ID NO: 1109858 - RNA, 15 nt, Mycobacterium bovis subsp bovis AF2122/97
cggaaguaucgccgg

SEQ ID NO: 1109859 - RNA, 18 nt, Mycobacterium bovis subsp bovis AF2122/97
cggaaguaucgccggccg

SEQ ID NO: 1109860 - RNA, 19 nt, Mycobacterium bovis subsp bovis AF2122/97
cggaaguaucgccggccgc

SEQ ID NO: 1109861 - RNA, 23 nt, Mycobacterium bovis subsp bovis AF2122/97
cggaaguacuccacccaggccga

SEQ ID NO: 1109862 - RNA, 16 nt, Mycobacterium bovis subsp bovis AF2122/97
cggaacaccgacgaca

SEQ ID NO: 1109863 - RNA, 21 nt, Mycobacterium bovis subsp bovis AF2122/97
cggaacacgaugcgcggugcg

SEQ ID NO: 1109864 - RNA, 16 nt, Mycobacterium bovis subsp bovis AF2122/97
cggaacaccaccaggc

SEQ ID NO: 1109865 - RNA, 15 nt, Mycobacterium bovis subsp bovis AF2122/97
cggaacaccgcccgg

SEQ ID NO: 1109866 - RNA, 19 nt, Mycobacterium bovis subsp bovis AF2122/97
cggaacaccgcccggcccg

SEQ ID NO: 1109867 - RNA, 20 nt, Mycobacterium bovis subsp bovis AF2122/97
cggaacaccgcccggcccgg

SEQ ID NO: 1109868 - RNA, 13 nt, Mycobacterium bovis subsp bovis AF2122/97
cggaaaucggacg

SEQ ID NO: 1109869 - RNA, 21 nt, Mycobacterium bovis subsp bovis AF2122/97
cggaaauuccggcgcggccgg

SEQ ID NO: 1109870 - RNA, 20 nt, Mycobacterium bovis subsp bovis AF2122/97
cggaaauggcgucgccggca

SEQ ID NO: 1109871 - RNA, 23 nt, Mycobacterium bovis subsp bovis AF2122/97
cggaaauggcgucgccggcaccg

SEQ ID NO: 1109872 - RNA, 13 nt, Mycobacterium bovis subsp bovis AF2122/97
cggaaccggcgug

SEQ ID NO: 1109873 - RNA, 14 nt, Mycobacterium bovis subsp bovis AF2122/97
cggaaccggcgugc

SEQ ID NO: 1109874 - RNA, 16 nt, Mycobacterium bovis subsp bovis AF2122/97
cggaaccgagggccgu

SEQ ID NO: 1109875 - RNA, 22 nt, Mycobacterium bovis subsp bovis AF2122/97
cggaaccccuccaccccguugg

SEQ ID NO: 1109876 - RNA, 12 nt, Mycobacterium bovis subsp bovis AF2122/97
cggaacccgaau

SEQ ID NO: 1109877 - RNA, 15 nt, Mycobacterium bovis subsp bovis AF2122/97
cggaacccgagccgg

SEQ ID NO: 1109878 - RNA, 13 nt, Mycobacterium bovis subsp bovis AF2122/97
cggaacaucguca

SEQ ID NO: 1109879 - RNA, 22 nt, Mycobacterium bovis subsp bovis AF2122/97
cggaaccaccaguaccaccggc

SEQ ID NO: 1109880 - RNA, 22 nt, Mycobacterium bovis subsp bovis AF2122/97
cggaaccagcguaucggccggc

SEQ ID NO: 1109881 - RNA, 20 nt, Mycobacterium bovis subsp bovis AF2122/97
cggaaacccggccgccgaga

SEQ ID NO: 1109882 - RNA, 17 nt, Mycobacterium bovis subsp bovis AF2122/97
cggaaaccgccccgugg

SEQ ID NO: 1109883 - RNA, 22 nt, Mycobacterium bovis subsp bovis AF2122/97
cggaaagcucuugcacucggcg

SEQ ID NO: 1109884 - RNA, 14 nt, Mycobacterium bovis subsp bovis AF2122/97
cggaaagaucucgg

SEQ ID NO: 1109885 - RNA, 18 nt, Mycobacterium bovis subsp bovis AF2122/97
cggaaagcccgucgucgg

SEQ ID NO: 1109886 - RNA, 17 nt, Mycobacterium bovis subsp bovis AF2122/97
cggaaaggucggccugc

SEQ ID NO: 1109887 - RNA, 16 nt, Mycobacterium bovis subsp bovis AF2122/97
cggaaaaccgcaccgu

SEQ ID NO: 1109888 - RNA, 14 nt, Mycobacterium bovis subsp bovis AF2122/97
cggaaaaucaccau

SEQ ID NO: 1109889 - RNA, 16 nt, Mycobacterium bovis subsp bovis AF2122/97
cggaaaaucggcuggc

SEQ ID NO: 1109890 - RNA, 17 nt, Mycobacterium bovis subsp bovis AF2122/97
cggaaaccacagcgcca

SEQ ID NO: 1109891 - RNA, 13 nt, Mycobacterium bovis subsp bovis AF2122/97
cggaaacagcaug

SEQ ID NO: 1109892 - RNA, 19 nt, Mycobacterium bovis subsp bovis AF2122/97
cggaaaccaucgccagccg

SEQ ID NO: 1109893 - RNA, 17 nt, Mycobacterium bovis subsp bovis AF2122/97
cggcuugcccuccgggu

SEQ ID NO: 1109894 - RNA, 17 nt, Mycobacterium bovis subsp bovis AF2122/97
cggcuugaucagccgcc

SEQ ID NO: 1109895 - RNA, 15 nt, Mycobacterium bovis subsp bovis AF2122/97
cggcuugcgugaugg

SEQ ID NO: 1109896 - RNA, 12 nt, Mycobacterium bovis subsp bovis AF2122/97
cggcuugcugcc

SEQ ID NO: 1109897 - RNA, 17 nt, Mycobacterium bovis subsp bovis AF2122/97
cggcuuggccgccccgg

SEQ ID NO: 1109898 - RNA, 16 nt, Mycobacterium bovis subsp bovis AF2122/97
cggcuucguggcggcg

SEQ ID NO: 1109899 - RNA, 21 nt, Mycobacterium bovis subsp bovis AF2122/97
cggcuucguggcggcgcgcgc

SEQ ID NO: 1109900 - RNA, 22 nt, Mycobacterium bovis subsp bovis AF2122/97
cggcuucgucgacaucgccaua

SEQ ID NO: 1109901 - RNA, 18 nt, Mycobacterium bovis subsp bovis AF2122/97
cggcuucggugagcgggc

SEQ ID NO: 1109902 - RNA, 15 nt, Mycobacterium bovis subsp bovis AF2122/97
cggcuucgucggcca

SEQ ID NO: 1109903 - RNA, 21 nt, Mycobacterium bovis subsp bovis AF2122/97
cggcuucuucuucuugaccgc

SEQ ID NO: 1109904 - RNA, 21 nt, Mycobacterium bovis subsp bovis AF2122/97
cggcuucgggguaaccggcgg

SEQ ID NO: 1109905 - RNA, 23 nt, Mycobacterium bovis subsp bovis AF2122/97
cggcuucggguguucgcgcgcga

SEQ ID NO: 1109906 - RNA, 18 nt, Mycobacterium bovis subsp bovis AF2122/97
cggcugauuggcccaccg

SEQ ID NO: 1109907 - RNA, 23 nt, Mycobacterium bovis subsp bovis AF2122/97
cggcugauuggcccaccgccguu

SEQ ID NO: 1109908 - RNA, 22 nt, Mycobacterium bovis subsp bovis AF2122/97
cggcuucggcagaccggcaucg

SEQ ID NO: 1109909 - RNA, 19 nt, Mycobacterium bovis subsp bovis AF2122/97
cggcuucggcagccgcaua

SEQ ID NO: 1109910 - RNA, 15 nt, Mycobacterium bovis subsp bovis AF2122/97
cggcuucggcgagcg

SEQ ID NO: 1109911 - RNA, 20 nt, Mycobacterium bovis subsp bovis AF2122/97
cggcuucgcgguuggcggcg

SEQ ID NO: 1109912 - RNA, 21 nt, Mycobacterium bovis subsp bovis AF2122/97
cggcuucgcgguuggcggcga

SEQ ID NO: 1109913 - RNA, 21 nt, Mycobacterium bovis subsp bovis AF2122/97
cggcuucgcuuuugaaccggg

SEQ ID NO: 1109914 - RNA, 19 nt, Mycobacterium bovis subsp bovis AF2122/97
cggcuucgccgcgggacag

SEQ ID NO: 1109915 - RNA, 22 nt, Mycobacterium bovis subsp bovis AF2122/97
cggcugagcgugcggugaucga

SEQ ID NO: 1109916 - RNA, 17 nt, Mycobacterium bovis subsp bovis AF2122/97
cggcugcaaccagcggc

SEQ ID NO: 1109917 - RNA, 18 nt, Mycobacterium bovis subsp bovis AF2122/97
cggcugcaaccagcggca

SEQ ID NO: 1109918 - RNA, 20 nt, Mycobacterium bovis subsp bovis AF2122/97
cggcugauucgagccacaug

SEQ ID NO: 1109919 - RNA, 13 nt, Mycobacterium bovis subsp bovis AF2122/97
cggcucggcggug

SEQ ID NO: 1109920 - RNA, 15 nt, Mycobacterium bovis subsp bovis AF2122/97
cggcucggcgcugac

SEQ ID NO: 1109921 - RNA, 15 nt, Mycobacterium bovis subsp bovis AF2122/97
cggcugaccggggcg

SEQ ID NO: 1109922 - RNA, 17 nt, Mycobacterium bovis subsp bovis AF2122/97
cggcugaccggggcgcc

SEQ ID NO: 1109923 - RNA, 19 nt, Mycobacterium bovis subsp bovis AF2122/97
cggcugaccggggcgcccg

SEQ ID NO: 1109924 - RNA, 20 nt, Mycobacterium bovis subsp bovis AF2122/97
cggcugaccggggcgcccgg

SEQ ID NO: 1109925 - RNA, 19 nt, Mycobacterium bovis subsp bovis AF2122/97
cggcugaccggggucggcc

SEQ ID NO: 1109926 - RNA, 21 nt, Mycobacterium bovis subsp bovis AF2122/97
cggcugaccggggucggccug

SEQ ID NO: 1109927 - RNA, 17 nt, Mycobacterium bovis subsp bovis AF2122/97
cggcucggaaaccgccc

SEQ ID NO: 1109928 - RNA, 13 nt, Mycobacterium bovis subsp bovis AF2122/97
cggcucggcggcg

SEQ ID NO: 1109929 - RNA, 19 nt, Mycobacterium bovis subsp bovis AF2122/97
cggcugaccucccaccccc

SEQ ID NO: 1109930 - RNA, 21 nt, Mycobacterium bovis subsp bovis AF2122/97
cggcugacgaccaaccaccga

SEQ ID NO: 1109931 - RNA, 16 nt, Mycobacterium bovis subsp bovis AF2122/97
cggcugagacagaccg

SEQ ID NO: 1109932 - RNA, 18 nt, Mycobacterium bovis subsp bovis AF2122/97
cggcugagacagaccggg

SEQ ID NO: 1109933 - RNA, 12 nt, Mycobacterium bovis subsp bovis AF2122/97
cgggacagcgcc

SEQ ID NO: 1109934 - RNA, 14 nt, Mycobacterium bovis subsp bovis AF2122/97
cgggacagcgccgg

SEQ ID NO: 1109935 - RNA, 19 nt, Mycobacterium bovis subsp bovis AF2122/97
cgggacaaucucggccgca

SEQ ID NO: 1109936 - RNA, 14 nt, Mycobacterium bovis subsp bovis AF2122/97
cgggacaccaccgc

SEQ ID NO: 1109937 - RNA, 17 nt, Mycobacterium bovis subsp bovis AF2122/97
cgggacaccaccgcccg

SEQ ID NO: 1109938 - RNA, 16 nt, Mycobacterium bovis subsp bovis AF2122/97
cgggaagacgucggga

SEQ ID NO: 1109939 - RNA, 22 nt, Mycobacterium bovis subsp bovis AF2122/97
cgggaaugucuuuggucgccgg

SEQ ID NO: 1109940 - RNA, 19 nt, Mycobacterium bovis subsp bovis AF2122/97
cgggaauuucgucggccau

SEQ ID NO: 1109941 - RNA, 15 nt, Mycobacterium bovis subsp bovis AF2122/97
cgggacaaccgggcg

SEQ ID NO: 1109942 - RNA, 23 nt, Mycobacterium bovis subsp bovis AF2122/97
cgggacaaguucgguagcgaucg

SEQ ID NO: 1109943 - RNA, 15 nt, Mycobacterium bovis subsp bovis AF2122/97
cgggacaaucgucca

SEQ ID NO: 1109944 - RNA, 18 nt, Mycobacterium bovis subsp bovis AF2122/97
cgggaccaggccaacggc

SEQ ID NO: 1109945 - RNA, 15 nt, Mycobacterium bovis subsp bovis AF2122/97
cgggaccauagucgc

SEQ ID NO: 1109946 - RNA, 17 nt, Mycobacterium bovis subsp bovis AF2122/97
cgggaccauagucgccg

SEQ ID NO: 1109947 - RNA, 22 nt, Mycobacterium bovis subsp bovis AF2122/97
cgggacacgucgcgccaggcgc

SEQ ID NO: 1109948 - RNA, 14 nt, Mycobacterium bovis subsp bovis AF2122/97
cgggaccgccccgg

SEQ ID NO: 1109949 - RNA, 18 nt, Mycobacterium bovis subsp bovis AF2122/97
cgggaccgugacguaucg

SEQ ID NO: 1109950 - RNA, 14 nt, Mycobacterium bovis subsp bovis AF2122/97
cgggaccggcuugc

SEQ ID NO: 1109951 - RNA, 19 nt, Mycobacterium bovis subsp bovis AF2122/97
cgggaccggcuugccgccg

SEQ ID NO: 1109952 - RNA, 19 nt, Mycobacterium bovis subsp bovis AF2122/97
cgggacauccagugcggug

SEQ ID NO: 1109953 - RNA, 21 nt, Mycobacterium bovis subsp bovis AF2122/97
cgggacccgugagcucgucga

SEQ ID NO: 1109954 - RNA, 14 nt, Mycobacterium bovis subsp bovis AF2122/97
cggcuugagccgca

SEQ ID NO: 1109955 - RNA, 23 nt, Mycobacterium bovis subsp bovis AF2122/97
cggcuuggccuuugccgucgagg

SEQ ID NO: 1109956 - RNA, 14 nt, Mycobacterium bovis subsp bovis AF2122/97
cggcuuggcggcga

SEQ ID NO: 1109957 - RNA, 24 nt, Mycobacterium bovis subsp bovis AF2122/97
cggcuuggcggcgaucaacucggg

SEQ ID NO: 1109958 - RNA, 19 nt, Mycobacterium bovis subsp bovis AF2122/97
cggcuuggccuagccgcgg

SEQ ID NO: 1109959 - RNA, 21 nt, Mycobacterium bovis subsp bovis AF2122/97
cggcuuggccuagccgcggca

SEQ ID NO: 1109960 - RNA, 21 nt, Mycobacterium bovis subsp bovis AF2122/97
cggcuuggccuuugccgucga

SEQ ID NO: 1109961 - RNA, 17 nt, Mycobacterium bovis subsp bovis AF2122/97
cggcuugggccaggccc

SEQ ID NO: 1109962 - RNA, 19 nt, Mycobacterium bovis subsp bovis AF2122/97
cggcuugggaaacccggcc

SEQ ID NO: 1109963 - RNA, 22 nt, Mycobacterium bovis subsp bovis AF2122/97
cggcuugggaaacccggccagc

SEQ ID NO: 1109964 - RNA, 15 nt, Mycobacterium bovis subsp bovis AF2122/97
cgggaaccaacacca

SEQ ID NO: 1109965 - RNA, 21 nt, Mycobacterium bovis subsp bovis AF2122/97
cgggaaccucgaccgucaccg

SEQ ID NO: 1109966 - RNA, 14 nt, Mycobacterium bovis subsp bovis AF2122/97
cgggaacgccgaac

SEQ ID NO: 1109967 - RNA, 22 nt, Mycobacterium bovis subsp bovis AF2122/97
cgggaacgccucaggggcgccu

SEQ ID NO: 1109968 - RNA, 13 nt, Mycobacterium bovis subsp bovis AF2122/97
cgggaacgaugcc

SEQ ID NO: 1109969 - RNA, 16 nt, Mycobacterium bovis subsp bovis AF2122/97
cgggaacgaugccgcc

SEQ ID NO: 1109970 - RNA, 19 nt, Mycobacterium bovis subsp bovis AF2122/97
cgggaacgaugccgccggc

SEQ ID NO: 1109971 - RNA, 21 nt, Mycobacterium bovis subsp bovis AF2122/97
cgggaacgaugccgccggcgg

SEQ ID NO: 1109972 - RNA, 22 nt, Mycobacterium bovis subsp bovis AF2122/97
cgggaacguccagccguggcgg

SEQ ID NO: 1109973 - RNA, 14 nt, Mycobacterium bovis subsp bovis AF2122/97
cgggaacgcggcgg

SEQ ID NO: 1109974 - RNA, 16 nt, Mycobacterium bovis subsp bovis AF2122/97
cgggaacgcggcggcg

SEQ ID NO: 1109975 - RNA, 17 nt, Mycobacterium bovis subsp bovis AF2122/97
cgggaacuucgccgaag

SEQ ID NO: 1109976 - RNA, 13 nt, Mycobacterium bovis subsp bovis AF2122/97
cgggauccgcgcg

SEQ ID NO: 1109977 - RNA, 17 nt, Mycobacterium bovis subsp bovis AF2122/97
cgggaucccgaucguga

SEQ ID NO: 1109978 - RNA, 21 nt, Mycobacterium bovis subsp bovis AF2122/97
cgggauaucgucgacgcccau

SEQ ID NO: 1109979 - RNA, 18 nt, Mycobacterium bovis subsp bovis AF2122/97
cgggaucccacggcgggc

SEQ ID NO: 1109980 - RNA, 13 nt, Mycobacterium bovis subsp bovis AF2122/97
cgggaucagcgua

SEQ ID NO: 1109981 - RNA, 20 nt, Mycobacterium bovis subsp bovis AF2122/97
cgggauccaggcccagccga

SEQ ID NO: 1109982 - RNA, 15 nt, Mycobacterium bovis subsp bovis AF2122/97
cgggaucgacccgcc

SEQ ID NO: 1109983 - RNA, 17 nt, Mycobacterium bovis subsp bovis AF2122/97
cgggaucgacccgccca

SEQ ID NO: 1109984 - RNA, 13 nt, Mycobacterium bovis subsp bovis AF2122/97
cgggaucgcccag

SEQ ID NO: 1109985 - RNA, 16 nt, Mycobacterium bovis subsp bovis AF2122/97
cgggaucgcccaggcg

SEQ ID NO: 1109986 - RNA, 19 nt, Mycobacterium bovis subsp bovis AF2122/97
cgggaucgcccaggcgcga

SEQ ID NO: 1109987 - RNA, 20 nt, Mycobacterium bovis subsp bovis AF2122/97
cgggaucgccgagaccgcgu

SEQ ID NO: 1109988 - RNA, 12 nt, Mycobacterium bovis subsp bovis AF2122/97
cgggaucggcgu

SEQ ID NO: 1109989 - RNA, 21 nt, Mycobacterium bovis subsp bovis AF2122/97
cgggaucgccguccagcaaua

SEQ ID NO: 1109990 - RNA, 13 nt, Mycobacterium bovis subsp bovis AF2122/97
cgggaucggcguc

SEQ ID NO: 1109991 - RNA, 19 nt, Mycobacterium bovis subsp bovis AF2122/97
cgggaucgcugccagcggc

SEQ ID NO: 1109992 - RNA, 19 nt, Mycobacterium bovis subsp bovis AF2122/97
cgggauagacgaccccggu

SEQ ID NO: 1109993 - RNA, 18 nt, Mycobacterium bovis subsp bovis AF2122/97
cgggauaacccagcacca

SEQ ID NO: 1109994 - RNA, 22 nt, Mycobacterium bovis subsp bovis AF2122/97
cgggagucaccgccgucggguu

SEQ ID NO: 1109995 - RNA, 21 nt, Mycobacterium bovis subsp bovis AF2122/97
cgggauagacgaccccgguga

SEQ ID NO: 1109996 - RNA, 22 nt, Mycobacterium bovis subsp bovis AF2122/97
cgggauaguuuucggccgccag

SEQ ID NO: 1109997 - RNA, 16 nt, Mycobacterium bovis subsp bovis AF2122/97
cgggauauccggucgc

SEQ ID NO: 1109998 - RNA, 14 nt, Mycobacterium bovis subsp bovis AF2122/97
cgggauaucgucga

SEQ ID NO: 1109999 - RNA, 17 nt, Mycobacterium bovis subsp bovis AF2122/97
cgggauaucgucgacgc

SEQ ID NO: 1110000 - RNA, 16 nt, Mycobacterium bovis subsp bovis AF2122/97
cgggaggccaccgcga

SEQ ID NO: 1110001 - RNA, 15 nt, Mycobacterium bovis subsp bovis AF2122/97
cgggaggcagcgcga

SEQ ID NO: 1110002 - RNA, 12 nt, Mycobacterium bovis subsp bovis AF2122/97
cgggagcggcug

SEQ ID NO: 1110003 - RNA, 13 nt, Mycobacterium bovis subsp bovis AF2122/97
cgggagucgacgg

SEQ ID NO: 1110004 - RNA, 16 nt, Mycobacterium bovis subsp bovis AF2122/97
cgggaggcggcgccgc

SEQ ID NO: 1110005 - RNA, 19 nt, Mycobacterium bovis subsp bovis AF2122/97
cgggaguaagggaagcgau

SEQ ID NO: 1110006 - RNA, 19 nt, Mycobacterium bovis subsp bovis AF2122/97
cgggaguacgggagccggc

SEQ ID NO: 1110007 - RNA, 19 nt, Mycobacterium bovis subsp bovis AF2122/97
cgggagucgguaucggcag

SEQ ID NO: 1110008 - RNA, 16 nt, Mycobacterium bovis subsp bovis AF2122/97
cgggagucuucggcga

SEQ ID NO: 1110009 - RNA, 15 nt, Mycobacterium bovis subsp bovis AF2122/97
cgggagugcgccggc

SEQ ID NO: 1110010 - RNA, 20 nt, Mycobacterium bovis subsp bovis AF2122/97
cgggacgccuugaucggcga

SEQ ID NO: 1110011 - RNA, 21 nt, Mycobacterium bovis subsp bovis AF2122/97
cgggacgccuugaucggcgag

SEQ ID NO: 1110012 - RNA, 18 nt, Mycobacterium bovis subsp bovis AF2122/97
cgggacgcgacucggcgg

SEQ ID NO: 1110013 - RNA, 11 nt, Mycobacterium bovis subsp bovis AF2122/97
cgggacgccgu

SEQ ID NO: 1110014 - RNA, 20 nt, Mycobacterium bovis subsp bovis AF2122/97
cgggacgaaucccgcgcccg

SEQ ID NO: 1110015 - RNA, 23 nt, Mycobacterium bovis subsp bovis AF2122/97
cgggacgaaccggccgacgcugg

SEQ ID NO: 1110016 - RNA, 17 nt, Mycobacterium bovis subsp bovis AF2122/97
cgggacgaaaaaaucgu

SEQ ID NO: 1110017 - RNA, 20 nt, Mycobacterium bovis subsp bovis AF2122/97
cgggacgaaaaaaucgugcg

SEQ ID NO: 1110018 - RNA, 19 nt, Mycobacterium bovis subsp bovis AF2122/97
cgggacgcugccggucaua

SEQ ID NO: 1110019 - RNA, 14 nt, Mycobacterium bovis subsp bovis AF2122/97
cgggacgucgucgu

SEQ ID NO: 1110020 - RNA, 17 nt, Mycobacterium bovis subsp bovis AF2122/97
cgggacguuguccaccg

SEQ ID NO: 1110021 - RNA, 15 nt, Mycobacterium bovis subsp bovis AF2122/97
cgggacgucaccguu

SEQ ID NO: 1110022 - RNA, 13 nt, Mycobacterium bovis subsp bovis AF2122/97
cgggacgccgaau

SEQ ID NO: 1110023 - RNA, 18 nt, Mycobacterium bovis subsp bovis AF2122/97
cgggacgcgagugcguga

SEQ ID NO: 1110024 - RNA, 21 nt, Mycobacterium bovis subsp bovis AF2122/97
cgggacgggggcuguccaccg

SEQ ID NO: 1110025 - RNA, 14 nt, Mycobacterium bovis subsp bovis AF2122/97
cgggacggccaaca

SEQ ID NO: 1110026 - RNA, 15 nt, Mycobacterium bovis subsp bovis AF2122/97
cgggagccgcacccg

SEQ ID NO: 1110027 - RNA, 21 nt, Mycobacterium bovis subsp bovis AF2122/97
cgggagcggaauggcgccggc

SEQ ID NO: 1110028 - RNA, 15 nt, Mycobacterium bovis subsp bovis AF2122/97
cgggagcaccgacca

SEQ ID NO: 1110029 - RNA, 21 nt, Mycobacterium bovis subsp bovis AF2122/97
cgggacuggcugaucggcguu

SEQ ID NO: 1110030 - RNA, 21 nt, Mycobacterium bovis subsp bovis AF2122/97
cgggacugacccugaucguga

SEQ ID NO: 1110031 - RNA, 22 nt, Mycobacterium bovis subsp bovis AF2122/97
cgggacugcagcgcggugguca

SEQ ID NO: 1110032 - RNA, 23 nt, Mycobacterium bovis subsp bovis AF2122/97
cgggacguuguccaccgccacca

SEQ ID NO: 1110033 - RNA, 16 nt, Mycobacterium bovis subsp bovis AF2122/97
cgggacuaccacccgc

SEQ ID NO: 1110034 - RNA, 17 nt, Mycobacterium bovis subsp bovis AF2122/97
cgggacuaccacccgca

SEQ ID NO: 1110035 - RNA, 16 nt, Mycobacterium bovis subsp bovis AF2122/97
cgggacuagguccgau

SEQ ID NO: 1110036 - RNA, 14 nt, Mycobacterium bovis subsp bovis AF2122/97
cgggacucggcgag

SEQ ID NO: 1110037 - RNA, 16 nt, Mycobacterium bovis subsp bovis AF2122/97
cgggacugacccugau

SEQ ID NO: 1110038 - RNA, 17 nt, Mycobacterium bovis subsp bovis AF2122/97
cgggacugacccugauc

SEQ ID NO: 1110039 - RNA, 19 nt, Mycobacterium bovis subsp bovis AF2122/97
cgggagaacgugccgaguu

SEQ ID NO: 1110040 - RNA, 17 nt, Mycobacterium bovis subsp bovis AF2122/97
cgggacuugucggggug

SEQ ID NO: 1110041 - RNA, 19 nt, Mycobacterium bovis subsp bovis AF2122/97
cgggagacguaaccgcugg

SEQ ID NO: 1110042 - RNA, 16 nt, Mycobacterium bovis subsp bovis AF2122/97
cgggaugacugggcaa

SEQ ID NO: 1110043 - RNA, 13 nt, Mycobacterium bovis subsp bovis AF2122/97
cgggaugagauca

SEQ ID NO: 1110044 - RNA, 17 nt, Mycobacterium bovis subsp bovis AF2122/97
cgggaucugcgccgcgc

SEQ ID NO: 1110045 - RNA, 14 nt, Mycobacterium bovis subsp bovis AF2122/97
cgggaucugcuccg

SEQ ID NO: 1110046 - RNA, 15 nt, Mycobacterium bovis subsp bovis AF2122/97
cgggaucugcgccgc

SEQ ID NO: 1110047 - RNA, 20 nt, Mycobacterium bovis subsp bovis AF2122/97
cgggaucugagggcucggug

SEQ ID NO: 1110048 - RNA, 19 nt, Mycobacterium bovis subsp bovis AF2122/97
cgggaucgguggcggcacg

SEQ ID NO: 1110049 - RNA, 16 nt, Mycobacterium bovis subsp bovis AF2122/97
cgggaucgucaggccc

SEQ ID NO: 1110050 - RNA, 20 nt, Mycobacterium bovis subsp bovis AF2122/97
cgggaucgggcccuccggcg

SEQ ID NO: 1110051 - RNA, 21 nt, Mycobacterium bovis subsp bovis AF2122/97
cgggaucgggcccuccggcgc

SEQ ID NO: 1110052 - RNA, 15 nt, Mycobacterium bovis subsp bovis AF2122/97
cgggaucggcuccgc

SEQ ID NO: 1110053 - RNA, 22 nt, Mycobacterium bovis subsp bovis AF2122/97
cgggaucugagggcucgguggc

SEQ ID NO: 1110054 - RNA, 13 nt, Mycobacterium bovis subsp bovis AF2122/97
cgggauggccgcc

SEQ ID NO: 1110055 - RNA, 17 nt, Mycobacterium bovis subsp bovis AF2122/97
cgggauggccgccgaca

SEQ ID NO: 1110056 - RNA, 21 nt, Mycobacterium bovis subsp bovis AF2122/97
cgggauggccgccgacaaccc

SEQ ID NO: 1110057 - RNA, 17 nt, Mycobacterium bovis subsp bovis AF2122/97
cgggauggauaccgggg

SEQ ID NO: 1110058 - RNA, 15 nt, Mycobacterium bovis subsp bovis AF2122/97
cgggauggacaccac

SEQ ID NO: 1110059 - RNA, 17 nt, Mycobacterium bovis subsp bovis AF2122/97
cgggauggacaccaccu

SEQ ID NO: 1110060 - RNA, 15 nt, Mycobacterium bovis subsp bovis AF2122/97
cgggaugccggcgaa

SEQ ID NO: 1110061 - RNA, 19 nt, Mycobacterium bovis subsp bovis AF2122/97
cgggaugcagcugcccggc

SEQ ID NO: 1110062 - RNA, 22 nt, Mycobacterium bovis subsp bovis AF2122/97
cgggaugcagcugcccggcgug

SEQ ID NO: 1110063 - RNA, 16 nt, Mycobacterium bovis subsp bovis AF2122/97
cgggaugcgcgcccga

SEQ ID NO: 1110064 - RNA, 19 nt, Mycobacterium bovis subsp bovis AF2122/97
cgggaugcgcgcccgacga

SEQ ID NO: 1110065 - RNA, 16 nt, Mycobacterium bovis subsp bovis AF2122/97
cgggaugcggucgauc

SEQ ID NO: 1110066 - RNA, 17 nt, Mycobacterium bovis subsp bovis AF2122/97
cgggaugcggucgauca

SEQ ID NO: 1110067 - RNA, 19 nt, Mycobacterium bovis subsp bovis AF2122/97
cgggcaaaucaagcacagc

SEQ ID NO: 1110068 - RNA, 17 nt, Mycobacterium bovis subsp bovis AF2122/97
cgggcaaccugccgggc

SEQ ID NO: 1110069 - RNA, 23 nt, Mycobacterium bovis subsp bovis AF2122/97
cgggcaaccugccgggccacggc

SEQ ID NO: 1110070 - RNA, 17 nt, Mycobacterium bovis subsp bovis AF2122/97
cgggcaacgcgaaccgg

SEQ ID NO: 1110071 - RNA, 18 nt, Mycobacterium bovis subsp bovis AF2122/97
cgggcaacgcgaaccggc

SEQ ID NO: 1110072 - RNA, 23 nt, Mycobacterium bovis subsp bovis AF2122/97
cgggcaacgcgaaccggccaucg

SEQ ID NO: 1110073 - RNA, 13 nt, Mycobacterium bovis subsp bovis AF2122/97
cgggcaacacgau

SEQ ID NO: 1110074 - RNA, 19 nt, Mycobacterium bovis subsp bovis AF2122/97
cgggcaaccagcagcaggu

SEQ ID NO: 1110075 - RNA, 14 nt, Mycobacterium bovis subsp bovis AF2122/97
cgggcaaccgauga

SEQ ID NO: 1110076 - RNA, 19 nt, Mycobacterium bovis subsp bovis AF2122/97
cgggauguaccccggcccg

SEQ ID NO: 1110077 - RNA, 17 nt, Mycobacterium bovis subsp bovis AF2122/97
cgggauuaugccggcaa

SEQ ID NO: 1110078 - RNA, 12 nt, Mycobacterium bovis subsp bovis AF2122/97
cgggaugugcgg

SEQ ID NO: 1110079 - RNA, 15 nt, Mycobacterium bovis subsp bovis AF2122/97
cgggauuggugaguu

SEQ ID NO: 1110080 - RNA, 19 nt, Mycobacterium bovis subsp bovis AF2122/97
cgggauucgggcgccgcag

SEQ ID NO: 1110081 - RNA, 14 nt, Mycobacterium bovis subsp bovis AF2122/97
cgggauugcgcgcu

SEQ ID NO: 1110082 - RNA, 16 nt, Mycobacterium bovis subsp bovis AF2122/97
cgggauugccgccacc

SEQ ID NO: 1110083 - RNA, 15 nt, Mycobacterium bovis subsp bovis AF2122/97
cgggcacccuugccg

SEQ ID NO: 1110084 - RNA, 16 nt, Mycobacterium bovis subsp bovis AF2122/97
cgggcacccuugccga

SEQ ID NO: 1110085 - RNA, 22 nt, Mycobacterium bovis subsp bovis AF2122/97
cgggcacgaacaucagaucgcc

SEQ ID NO: 1110086 - RNA, 15 nt, Mycobacterium bovis subsp bovis AF2122/97
cgggcaccgcgcgcu

SEQ ID NO: 1110087 - RNA, 12 nt, Mycobacterium bovis subsp bovis AF2122/97
cgggcaccgguu

SEQ ID NO: 1110088 - RNA, 21 nt, Mycobacterium bovis subsp bovis AF2122/97
cgggcaacggcggggccggcg

SEQ ID NO: 1110089 - RNA, 22 nt, Mycobacterium bovis subsp bovis AF2122/97
cgggcaacggcggggccggcgg

SEQ ID NO: 1110090 - RNA, 15 nt, Mycobacterium bovis subsp bovis AF2122/97
cgggcaacugcagca

SEQ ID NO: 1110091 - RNA, 20 nt, Mycobacterium bovis subsp bovis AF2122/97
cgggcaacugcagcauggcc

SEQ ID NO: 1110092 - RNA, 13 nt, Mycobacterium bovis subsp bovis AF2122/97
cgggcaccagucg

SEQ ID NO: 1110093 - RNA, 15 nt, Mycobacterium bovis subsp bovis AF2122/97
cgggcaccagucgcc

SEQ ID NO: 1110094 - RNA, 17 nt, Mycobacterium bovis subsp bovis AF2122/97
cgggcaauacguagucg

SEQ ID NO: 1110095 - RNA, 13 nt, Mycobacterium bovis subsp bovis AF2122/97
cgggcaaucaccg

SEQ ID NO: 1110096 - RNA, 14 nt, Mycobacterium bovis subsp bovis AF2122/97
cgggcaaucaccgc

SEQ ID NO: 1110097 - RNA, 15 nt, Mycobacterium bovis subsp bovis AF2122/97
cgggcaaucaccgcc

SEQ ID NO: 1110098 - RNA, 19 nt, Mycobacterium bovis subsp bovis AF2122/97
cgggcaagucgcccagccg

SEQ ID NO: 1110099 - RNA, 18 nt, Mycobacterium bovis subsp bovis AF2122/97
cgggcaaggccaccggcg

SEQ ID NO: 1110100 - RNA, 16 nt, Mycobacterium bovis subsp bovis AF2122/97
cgggcaaggccaccgu

SEQ ID NO: 1110101 - RNA, 21 nt, Mycobacterium bovis subsp bovis AF2122/97
cgggcagccccuccgcgccga

SEQ ID NO: 1110102 - RNA, 14 nt, Mycobacterium bovis subsp bovis AF2122/97
cgggcagccgcacg

SEQ ID NO: 1110103 - RNA, 13 nt, Mycobacterium bovis subsp bovis AF2122/97
cgggcagccgccc

SEQ ID NO: 1110104 - RNA, 14 nt, Mycobacterium bovis subsp bovis AF2122/97
cgggcagccgcccg

SEQ ID NO: 1110105 - RNA, 15 nt, Mycobacterium bovis subsp bovis AF2122/97
cgggcagccgcccgc

SEQ ID NO: 1110106 - RNA, 14 nt, Mycobacterium bovis subsp bovis AF2122/97
cgggcagccgcgcc

SEQ ID NO: 1110107 - RNA, 15 nt, Mycobacterium bovis subsp bovis AF2122/97
cgggcagcgcggcca

SEQ ID NO: 1110108 - RNA, 18 nt, Mycobacterium bovis subsp bovis AF2122/97
cgggcagcacgccagccc

SEQ ID NO: 1110109 - RNA, 20 nt, Mycobacterium bovis subsp bovis AF2122/97
cgggcagcacgccagcccca

SEQ ID NO: 1110110 - RNA, 17 nt, Mycobacterium bovis subsp bovis AF2122/97
cgggcagcacccgcgcc

SEQ ID NO: 1110111 - RNA, 20 nt, Mycobacterium bovis subsp bovis AF2122/97
cgggcagcacccgcgccagu

SEQ ID NO: 1110112 - RNA, 21 nt, Mycobacterium bovis subsp bovis AF2122/97
cgggcagcaucaacaccggcu

SEQ ID NO: 1110113 - RNA, 19 nt, Mycobacterium bovis subsp bovis AF2122/97
cgggcaaucaccgccggcg

SEQ ID NO: 1110114 - RNA, 13 nt, Mycobacterium bovis subsp bovis AF2122/97
cgggcacgaucgu

SEQ ID NO: 1110115 - RNA, 16 nt, Mycobacterium bovis subsp bovis AF2122/97
cgggcacgaucgucgc

SEQ ID NO: 1110116 - RNA, 20 nt, Mycobacterium bovis subsp bovis AF2122/97
cgggcagcaccagcgccuug

SEQ ID NO: 1110117 - RNA, 18 nt, Mycobacterium bovis subsp bovis AF2122/97
cgggcaccgguuugacgu

SEQ ID NO: 1110118 - RNA, 21 nt, Mycobacterium bovis subsp bovis AF2122/97
cgggccgccucgaucgacucg

SEQ ID NO: 1110119 - RNA, 13 nt, Mycobacterium bovis subsp bovis AF2122/97
cgggccgcgcggg

SEQ ID NO: 1110120 - RNA, 19 nt, Mycobacterium bovis subsp bovis AF2122/97
cgggccgcgcgggccgccg

SEQ ID NO: 1110121 - RNA, 23 nt, Mycobacterium bovis subsp bovis AF2122/97
cgggccuagccgaagcgcccgga

SEQ ID NO: 1110122 - RNA, 24 nt, Mycobacterium bovis subsp bovis AF2122/97
cgggccucaugcuaggccaccggc

SEQ ID NO: 1110123 - RNA, 15 nt, Mycobacterium bovis subsp bovis AF2122/97
cgggccucccccaaa

SEQ ID NO: 1110124 - RNA, 16 nt, Mycobacterium bovis subsp bovis AF2122/97
cgggccuccugcuggc

SEQ ID NO: 1110125 - RNA, 18 nt, Mycobacterium bovis subsp bovis AF2122/97
cgggcccucgccauggcg

SEQ ID NO: 1110126 - RNA, 16 nt, Mycobacterium bovis subsp bovis AF2122/97
cgggccugcacgccgg

SEQ ID NO: 1110127 - RNA, 18 nt, Mycobacterium bovis subsp bovis AF2122/97
cgggccugcacgccggcg

SEQ ID NO: 1110128 - RNA, 12 nt, Mycobacterium bovis subsp bovis AF2122/97
cgggccugcgcg

SEQ ID NO: 1110129 - RNA, 16 nt, Mycobacterium bovis subsp bovis AF2122/97
cgggccucggcgacca

SEQ ID NO: 1110130 - RNA, 19 nt, Mycobacterium bovis subsp bovis AF2122/97
cgggccucggcgccgucgg

SEQ ID NO: 1110131 - RNA, 13 nt, Mycobacterium bovis subsp bovis AF2122/97
cgggccucggcga

SEQ ID NO: 1110132 - RNA, 22 nt, Mycobacterium bovis subsp bovis AF2122/97
cgggccugcaccacggcggcca

SEQ ID NO: 1110133 - RNA, 19 nt, Mycobacterium bovis subsp bovis AF2122/97
cgggccgccaucucguagg

SEQ ID NO: 1110134 - RNA, 16 nt, Mycobacterium bovis subsp bovis AF2122/97
cgggccgcaucgucgc

SEQ ID NO: 1110135 - RNA, 19 nt, Mycobacterium bovis subsp bovis AF2122/97
cgggccgcaucgucgccgc

SEQ ID NO: 1110136 - RNA, 20 nt, Mycobacterium bovis subsp bovis AF2122/97
cgggccgcaucgucgccgcg

SEQ ID NO: 1110137 - RNA, 12 nt, Mycobacterium bovis subsp bovis AF2122/97
cgggccgccagg

SEQ ID NO: 1110138 - RNA, 15 nt, Mycobacterium bovis subsp bovis AF2122/97
cgggccgccaggcgg

SEQ ID NO: 1110139 - RNA, 16 nt, Mycobacterium bovis subsp bovis AF2122/97
cgggccgccaggcggc

SEQ ID NO: 1110140 - RNA, 13 nt, Mycobacterium bovis subsp bovis AF2122/97
cgggcccggcgaa

SEQ ID NO: 1110141 - RNA, 15 nt, Mycobacterium bovis subsp bovis AF2122/97
cgggcccguagccga

SEQ ID NO: 1110142 - RNA, 18 nt, Mycobacterium bovis subsp bovis AF2122/97
cgggcccgucgucgucga

SEQ ID NO: 1110143 - RNA, 17 nt, Mycobacterium bovis subsp bovis AF2122/97
cgggccgaacacaccgg

SEQ ID NO: 1110144 - RNA, 20 nt, Mycobacterium bovis subsp bovis AF2122/97
cgggcccuccacugcgagcg

SEQ ID NO: 1110145 - RNA, 23 nt, Mycobacterium bovis subsp bovis AF2122/97
cgggccaccgucccugugucgcc

SEQ ID NO: 1110146 - RNA, 22 nt, Mycobacterium bovis subsp bovis AF2122/97
cgggccaccggaauccuggccg

SEQ ID NO: 1110147 - RNA, 23 nt, Mycobacterium bovis subsp bovis AF2122/97
cgggccaccggaauccuggccgc

SEQ ID NO: 1110148 - RNA, 19 nt, Mycobacterium bovis subsp bovis AF2122/97
cgggcaguuuggcggcagg

SEQ ID NO: 1110149 - RNA, 22 nt, Mycobacterium bovis subsp bovis AF2122/97
cgggcaguagcuguggcccgcg

SEQ ID NO: 1110150 - RNA, 20 nt, Mycobacterium bovis subsp bovis AF2122/97
cgggccagcaccucgaccgc

SEQ ID NO: 1110151 - RNA, 13 nt, Mycobacterium bovis subsp bovis AF2122/97
cgggccacgucga

SEQ ID NO: 1110152 - RNA, 21 nt, Mycobacterium bovis subsp bovis AF2122/97
cgggcaguggcagcccgucgg

SEQ ID NO: 1110153 - RNA, 15 nt, Mycobacterium bovis subsp bovis AF2122/97
cgggcagugugguca

SEQ ID NO: 1110154 - RNA, 23 nt, Mycobacterium bovis subsp bovis AF2122/97
cgggcaguucaacgaggccgacg

SEQ ID NO: 1110155 - RNA, 16 nt, Mycobacterium bovis subsp bovis AF2122/97
cgggcaguucacgguu

SEQ ID NO: 1110156 - RNA, 19 nt, Mycobacterium bovis subsp bovis AF2122/97
cgggcaguccaggcacucc

SEQ ID NO: 1110157 - RNA, 20 nt, Mycobacterium bovis subsp bovis AF2122/97
cgggccaggauccgaccccg

SEQ ID NO: 1110158 - RNA, 18 nt, Mycobacterium bovis subsp bovis AF2122/97
cgggccaggcccucgacg

SEQ ID NO: 1110159 - RNA, 19 nt, Mycobacterium bovis subsp bovis AF2122/97
cgggccagucgaaucguca

SEQ ID NO: 1110160 - RNA, 15 nt, Mycobacterium bovis subsp bovis AF2122/97
cgggccacugagcca

SEQ ID NO: 1110161 - RNA, 15 nt, Mycobacterium bovis subsp bovis AF2122/97
cggcgguaugcucgc

SEQ ID NO: 1110162 - RNA, 16 nt, Mycobacterium bovis subsp bovis AF2122/97
cggcgguaugcucgcu

SEQ ID NO: 1110163 - RNA, 22 nt, Mycobacterium bovis subsp bovis AF2122/97
cggcgguaugcucgcuggcgcu

SEQ ID NO: 1110164 - RNA, 21 nt, Mycobacterium bovis subsp bovis AF2122/97
cggcgguaccgccgcugccgg

SEQ ID NO: 1110165 - RNA, 22 nt, Mycobacterium bovis subsp bovis AF2122/97
cggcgguaccgccgcugccggu

SEQ ID NO: 1110166 - RNA, 23 nt, Mycobacterium bovis subsp bovis AF2122/97
cggcgguaugccacaggcugcca

SEQ ID NO: 1110167 - RNA, 15 nt, Mycobacterium bovis subsp bovis AF2122/97
cggcggucagcagcg

SEQ ID NO: 1110168 - RNA, 19 nt, Mycobacterium bovis subsp bovis AF2122/97
cggcggguuugcccauccc

SEQ ID NO: 1110169 - RNA, 13 nt, Mycobacterium bovis subsp bovis AF2122/97
cggcgguagucgg

SEQ ID NO: 1110170 - RNA, 15 nt, Mycobacterium bovis subsp bovis AF2122/97
cggcgguagucggcc

SEQ ID NO: 1110171 - RNA, 19 nt, Mycobacterium bovis subsp bovis AF2122/97
cggcgguagucggccagcu

SEQ ID NO: 1110172 - RNA, 22 nt, Mycobacterium bovis subsp bovis AF2122/97
cggcgguagccgaccagcgcua

SEQ ID NO: 1110173 - RNA, 18 nt, Mycobacterium bovis subsp bovis AF2122/97
cggcggucaccaccgacc

SEQ ID NO: 1110174 - RNA, 14 nt, Mycobacterium bovis subsp bovis AF2122/97
cggcggucagcggc

SEQ ID NO: 1110175 - RNA, 15 nt, Mycobacterium bovis subsp bovis AF2122/97
cggcggucagcggcu

SEQ ID NO: 1110176 - RNA, 21 nt, Mycobacterium bovis subsp bovis AF2122/97
cggcggucagcggcucggcgg

SEQ ID NO: 1110177 - RNA, 17 nt, Mycobacterium bovis subsp bovis AF2122/97
cggcggucagcggcugg

SEQ ID NO: 1110178 - RNA, 22 nt, Mycobacterium bovis subsp bovis AF2122/97
cggcggucccugaagccagcgc

SEQ ID NO: 1110179 - RNA, 12 nt, Mycobacterium bovis subsp bovis AF2122/97
cggcggucgggc

SEQ ID NO: 1110180 - RNA, 15 nt, Mycobacterium bovis subsp bovis AF2122/97
cggcggucugguugu

SEQ ID NO: 1110181 - RNA, 20 nt, Mycobacterium bovis subsp bovis AF2122/97
cggcggucugagacucgucg

SEQ ID NO: 1110182 - RNA, 15 nt, Mycobacterium bovis subsp bovis AF2122/97
cggcggucugcagug

SEQ ID NO: 1110183 - RNA, 14 nt, Mycobacterium bovis subsp bovis AF2122/97
cggcggucguugcc

SEQ ID NO: 1110184 - RNA, 14 nt, Mycobacterium bovis subsp bovis AF2122/97
cggcggucucggcg

SEQ ID NO: 1110185 - RNA, 17 nt, Mycobacterium bovis subsp bovis AF2122/97
cggcggucucggcgucg

SEQ ID NO: 1110186 - RNA, 21 nt, Mycobacterium bovis subsp bovis AF2122/97
cggcggucucggcgucgacca

SEQ ID NO: 1110187 - RNA, 14 nt, Mycobacterium bovis subsp bovis AF2122/97
cggcggucgccucc

SEQ ID NO: 1110188 - RNA, 15 nt, Mycobacterium bovis subsp bovis AF2122/97
cggcggucgagcucg

SEQ ID NO: 1110189 - RNA, 19 nt, Mycobacterium bovis subsp bovis AF2122/97
cggcggucgagcucguagg

SEQ ID NO: 1110190 - RNA, 14 nt, Mycobacterium bovis subsp bovis AF2122/97
cggcggucgcuauc

SEQ ID NO: 1110191 - RNA, 20 nt, Mycobacterium bovis subsp bovis AF2122/97
cggcggucgcuauccggcgg

SEQ ID NO: 1110192 - RNA, 19 nt, Mycobacterium bovis subsp bovis AF2122/97
cggcggugcagcagggcgc

SEQ ID NO: 1110193 - RNA, 23 nt, Mycobacterium bovis subsp bovis AF2122/97
cggcggugaacuucuccaccagc

SEQ ID NO: 1110194 - RNA, 20 nt, Mycobacterium bovis subsp bovis AF2122/97
cggcggucuuggcgcgccca

SEQ ID NO: 1110195 - RNA, 17 nt, Mycobacterium bovis subsp bovis AF2122/97
cggcggugacggcggca

SEQ ID NO: 1110196 - RNA, 18 nt, Mycobacterium bovis subsp bovis AF2122/97
cggcggugacggcggcaa

SEQ ID NO: 1110197 - RNA, 20 nt, Mycobacterium bovis subsp bovis AF2122/97
cggcggugacggcggcaacg

SEQ ID NO: 1110198 - RNA, 14 nt, Mycobacterium bovis subsp bovis AF2122/97
cggcggugacggug

SEQ ID NO: 1110199 - RNA, 15 nt, Mycobacterium bovis subsp bovis AF2122/97
cggcgguggggccgg

SEQ ID NO: 1110200 - RNA, 16 nt, Mycobacterium bovis subsp bovis AF2122/97
cggcgguggggccggc

SEQ ID NO: 1110201 - RNA, 14 nt, Mycobacterium bovis subsp bovis AF2122/97
cggcggugggucgu

SEQ ID NO: 1110202 - RNA, 12 nt, Mycobacterium bovis subsp bovis AF2122/97
cggcgguggggc

SEQ ID NO: 1110203 - RNA, 12 nt, Mycobacterium bovis subsp bovis AF2122/97
cggcgguggcga

SEQ ID NO: 1110204 - RNA, 22 nt, Mycobacterium bovis subsp bovis AF2122/97
cggcggugaagugggcguuggc

SEQ ID NO: 1110205 - RNA, 15 nt, Mycobacterium bovis subsp bovis AF2122/97
cggcgguggccagcg

SEQ ID NO: 1110206 - RNA, 14 nt, Mycobacterium bovis subsp bovis AF2122/97
cggcggugcgggug

SEQ ID NO: 1110207 - RNA, 16 nt, Mycobacterium bovis subsp bovis AF2122/97
cggcggugcggguggu

SEQ ID NO: 1110208 - RNA, 13 nt, Mycobacterium bovis subsp bovis AF2122/97
cggcggugcccag

SEQ ID NO: 1110209 - RNA, 17 nt, Mycobacterium bovis subsp bovis AF2122/97
cggcggugcccagcagc

SEQ ID NO: 1110210 - RNA, 20 nt, Mycobacterium bovis subsp bovis AF2122/97
cggcggugcccagcagcgcg

SEQ ID NO: 1110211 - RNA, 15 nt, Mycobacterium bovis subsp bovis AF2122/97
cggcggugccgacgg

SEQ ID NO: 1110212 - RNA, 16 nt, Mycobacterium bovis subsp bovis AF2122/97
cggcggugccgacggu

SEQ ID NO: 1110213 - RNA, 15 nt, Mycobacterium bovis subsp bovis AF2122/97
cggcggugcaguggc

SEQ ID NO: 1110214 - RNA, 21 nt, Mycobacterium bovis subsp bovis AF2122/97
cggcggugccacgaucggcgg

SEQ ID NO: 1110215 - RNA, 14 nt, Mycobacterium bovis subsp bovis AF2122/97
cggcggugccgucg

SEQ ID NO: 1110216 - RNA, 15 nt, Mycobacterium bovis subsp bovis AF2122/97
cggcggugccgucgc

SEQ ID NO: 1110217 - RNA, 20 nt, Mycobacterium bovis subsp bovis AF2122/97
cggcggugccgucgccgccc

SEQ ID NO: 1110218 - RNA, 19 nt, Mycobacterium bovis subsp bovis AF2122/97
cggcggugccgucagcggc

SEQ ID NO: 1110219 - RNA, 21 nt, Mycobacterium bovis subsp bovis AF2122/97
cggcggugccgucagcggcgg

SEQ ID NO: 1110220 - RNA, 18 nt, Mycobacterium bovis subsp bovis AF2122/97
cggcggugccgacggugg

SEQ ID NO: 1110221 - RNA, 14 nt, Mycobacterium bovis subsp bovis AF2122/97
cggcggugccgcgg

SEQ ID NO: 1110222 - RNA, 15 nt, Mycobacterium bovis subsp bovis AF2122/97
cggcggugccgcggc

SEQ ID NO: 1110223 - RNA, 17 nt, Mycobacterium bovis subsp bovis AF2122/97
cggcgguguugcccgac

SEQ ID NO: 1110224 - RNA, 20 nt, Mycobacterium bovis subsp bovis AF2122/97
cggcggugguaccggcgcca

SEQ ID NO: 1110225 - RNA, 19 nt, Mycobacterium bovis subsp bovis AF2122/97
cggcgguucugcggccgcg

SEQ ID NO: 1110226 - RNA, 16 nt, Mycobacterium bovis subsp bovis AF2122/97
cggcgguuucgguggu

SEQ ID NO: 1110227 - RNA, 24 nt, Mycobacterium bovis subsp bovis AF2122/97
cggcgguuggugcagcgugcagcg

SEQ ID NO: 1110228 - RNA, 15 nt, Mycobacterium bovis subsp bovis AF2122/97
cggcguacgccggac

SEQ ID NO: 1110229 - RNA, 16 nt, Mycobacterium bovis subsp bovis AF2122/97
cggcguaaccggcagc

SEQ ID NO: 1110230 - RNA, 17 nt, Mycobacterium bovis subsp bovis AF2122/97
cggcguaaccggcagcg

SEQ ID NO: 1110231 - RNA, 20 nt, Mycobacterium bovis subsp bovis AF2122/97
cggcguacgccggacccggu

SEQ ID NO: 1110232 - RNA, 23 nt, Mycobacterium bovis subsp bovis AF2122/97
cggcguacgguacggaccguggc

SEQ ID NO: 1110233 - RNA, 17 nt, Mycobacterium bovis subsp bovis AF2122/97
cggcguacucggcaucc

SEQ ID NO: 1110234 - RNA, 22 nt, Mycobacterium bovis subsp bovis AF2122/97
cggcguacucggugaucgcggu

SEQ ID NO: 1110235 - RNA, 23 nt, Mycobacterium bovis subsp bovis AF2122/97
cggcguacccguuaugcgccgcc

SEQ ID NO: 1110236 - RNA, 14 nt, Mycobacterium bovis subsp bovis AF2122/97
cggcgguuucggug

SEQ ID NO: 1110237 - RNA, 12 nt, Mycobacterium bovis subsp bovis AF2122/97
cggcgcggccgg

SEQ ID NO: 1110238 - RNA, 13 nt, Mycobacterium bovis subsp bovis AF2122/97
cggcgcggccggc

SEQ ID NO: 1110239 - RNA, 21 nt, Mycobacterium bovis subsp bovis AF2122/97
cggcgcggccggccgcucacc

SEQ ID NO: 1110240 - RNA, 17 nt, Mycobacterium bovis subsp bovis AF2122/97
cggcgcggcggcgucga

SEQ ID NO: 1110241 - RNA, 15 nt, Mycobacterium bovis subsp bovis AF2122/97
cggcgcggcggaccg

SEQ ID NO: 1110242 - RNA, 16 nt, Mycobacterium bovis subsp bovis AF2122/97
cggcgcggcggaccgu

SEQ ID NO: 1110243 - RNA, 12 nt, Mycobacterium bovis subsp bovis AF2122/97
cggcgcggcggc

SEQ ID NO: 1110244 - RNA, 13 nt, Mycobacterium bovis subsp bovis AF2122/97
cggcgcggccgca

SEQ ID NO: 1110245 - RNA, 16 nt, Mycobacterium bovis subsp bovis AF2122/97
cggcgcggccgcaagc

SEQ ID NO: 1110246 - RNA, 15 nt, Mycobacterium bovis subsp bovis AF2122/97
cggcgcggccgcagc

SEQ ID NO: 1110247 - RNA, 17 nt, Mycobacterium bovis subsp bovis AF2122/97
cggcgcggccgcagcca

SEQ ID NO: 1110248 - RNA, 13 nt, Mycobacterium bovis subsp bovis AF2122/97
cggcgcggagagc

SEQ ID NO: 1110249 - RNA, 13 nt, Mycobacterium bovis subsp bovis AF2122/97
cggcggcggccag

SEQ ID NO: 1110250 - RNA, 15 nt, Mycobacterium bovis subsp bovis AF2122/97
cggcggcggcacgcu

SEQ ID NO: 1110251 - RNA, 15 nt, Mycobacterium bovis subsp bovis AF2122/97
cggcggcgccggugg

SEQ ID NO: 1110252 - RNA, 12 nt, Mycobacterium bovis subsp bovis AF2122/97
cggcggcgccgg

SEQ ID NO: 1110253 - RNA, 21 nt, Mycobacterium bovis subsp bovis AF2122/97
cggcggcgccgcccaacgcga

SEQ ID NO: 1110254 - RNA, 15 nt, Mycobacterium bovis subsp bovis AF2122/97
cggcggcgccggccu

SEQ ID NO: 1110255 - RNA, 14 nt, Mycobacterium bovis subsp bovis AF2122/97
cggcggcgccggcg

SEQ ID NO: 1110256 - RNA, 14 nt, Mycobacterium bovis subsp bovis AF2122/97
cggcggcgccgccc

SEQ ID NO: 1110257 - RNA, 15 nt, Mycobacterium bovis subsp bovis AF2122/97
cggcggcgccgccca

SEQ ID NO: 1110258 - RNA, 13 nt, Mycobacterium bovis subsp bovis AF2122/97
cggcggcgcccgg

SEQ ID NO: 1110259 - RNA, 14 nt, Mycobacterium bovis subsp bovis AF2122/97
cggcggcgcaggua

SEQ ID NO: 1110260 - RNA, 18 nt, Mycobacterium bovis subsp bovis AF2122/97
cggcggcgaugucaacca

SEQ ID NO: 1110261 - RNA, 21 nt, Mycobacterium bovis subsp bovis AF2122/97
cggcggcgaggcgagucaccg

SEQ ID NO: 1110262 - RNA, 21 nt, Mycobacterium bovis subsp bovis AF2122/97
cggcggcgaggcggucgccga

SEQ ID NO: 1110263 - RNA, 12 nt, Mycobacterium bovis subsp bovis AF2122/97
cggcgcggccgu

SEQ ID NO: 1110264 - RNA, 14 nt, Mycobacterium bovis subsp bovis AF2122/97
cggcgcggccguga

SEQ ID NO: 1110265 - RNA, 18 nt, Mycobacterium bovis subsp bovis AF2122/97
cggcggcgacguggcgcc

SEQ ID NO: 1110266 - RNA, 19 nt, Mycobacterium bovis subsp bovis AF2122/97
cggcggcgacguggcgccg

SEQ ID NO: 1110267 - RNA, 21 nt, Mycobacterium bovis subsp bovis AF2122/97
cggcgggaacggugccgaucg

SEQ ID NO: 1110268 - RNA, 21 nt, Mycobacterium bovis subsp bovis AF2122/97
cggcggcuuggccgccccggc

SEQ ID NO: 1110269 - RNA, 23 nt, Mycobacterium bovis subsp bovis AF2122/97
cggcggcuuggccgccccggccg

SEQ ID NO: 1110270 - RNA, 16 nt, Mycobacterium bovis subsp bovis AF2122/97
cggcggcuuuggccgc

SEQ ID NO: 1110271 - RNA, 18 nt, Mycobacterium bovis subsp bovis AF2122/97
cggcggcuuuggccgccg

SEQ ID NO: 1110272 - RNA, 16 nt, Mycobacterium bovis subsp bovis AF2122/97
cggcggcuucgauugc

SEQ ID NO: 1110273 - RNA, 14 nt, Mycobacterium bovis subsp bovis AF2122/97
cggcggcggccgca

SEQ ID NO: 1110274 - RNA, 18 nt, Mycobacterium bovis subsp bovis AF2122/97
cggcggcuguugcggcgg

SEQ ID NO: 1110275 - RNA, 20 nt, Mycobacterium bovis subsp bovis AF2122/97
cggcggcuguugcggcggcg

SEQ ID NO: 1110276 - RNA, 14 nt, Mycobacterium bovis subsp bovis AF2122/97
cggcggcuuggccg

SEQ ID NO: 1110277 - RNA, 16 nt, Mycobacterium bovis subsp bovis AF2122/97
cggcggcuuggccgcc

SEQ ID NO: 1110278 - RNA, 21 nt, Mycobacterium bovis subsp bovis AF2122/97
cggcggcuucguggcggcgcg

SEQ ID NO: 1110279 - RNA, 23 nt, Mycobacterium bovis subsp bovis AF2122/97
cggcggcuucguggcggcgcgcg

SEQ ID NO: 1110280 - RNA, 14 nt, Mycobacterium bovis subsp bovis AF2122/97
cggcggcggugcgc

SEQ ID NO: 1110281 - RNA, 16 nt, Mycobacterium bovis subsp bovis AF2122/97
cggcggcgguggcgaa

SEQ ID NO: 1110282 - RNA, 13 nt, Mycobacterium bovis subsp bovis AF2122/97
cggcggcgguggu

SEQ ID NO: 1110283 - RNA, 21 nt, Mycobacterium bovis subsp bovis AF2122/97
cggcggcggugguaccggcgc

SEQ ID NO: 1110284 - RNA, 15 nt, Mycobacterium bovis subsp bovis AF2122/97
cggcggcguccgggu

SEQ ID NO: 1110285 - RNA, 15 nt, Mycobacterium bovis subsp bovis AF2122/97
cggcggcgucgacgg

SEQ ID NO: 1110286 - RNA, 13 nt, Mycobacterium bovis subsp bovis AF2122/97
cggcggcguccac

SEQ ID NO: 1110287 - RNA, 22 nt, Mycobacterium bovis subsp bovis AF2122/97
cggcggcguccaucgcgcgccg

SEQ ID NO: 1110288 - RNA, 16 nt, Mycobacterium bovis subsp bovis AF2122/97
cggcggcuguggucgc

SEQ ID NO: 1110289 - RNA, 20 nt, Mycobacterium bovis subsp bovis AF2122/97
cggcggcuguggucgcugcu

SEQ ID NO: 1110290 - RNA, 20 nt, Mycobacterium bovis subsp bovis AF2122/97
cggcggcggucaccaccgac

SEQ ID NO: 1110291 - RNA, 16 nt, Mycobacterium bovis subsp bovis AF2122/97
cggcgggcccgccggc

SEQ ID NO: 1110292 - RNA, 18 nt, Mycobacterium bovis subsp bovis AF2122/97
cggcgggcagauggugaa

SEQ ID NO: 1110293 - RNA, 17 nt, Mycobacterium bovis subsp bovis AF2122/97
cggcgggcacaccgcac

SEQ ID NO: 1110294 - RNA, 22 nt, Mycobacterium bovis subsp bovis AF2122/97
cggcgggaugcagcugcccggc

SEQ ID NO: 1110295 - RNA, 12 nt, Mycobacterium bovis subsp bovis AF2122/97
cggcgggcgagu

SEQ ID NO: 1110296 - RNA, 16 nt, Mycobacterium bovis subsp bovis AF2122/97
cggcgggccucggcga

SEQ ID NO: 1110297 - RNA, 18 nt, Mycobacterium bovis subsp bovis AF2122/97
cggcgggccgcgcggcga

SEQ ID NO: 1110298 - RNA, 23 nt, Mycobacterium bovis subsp bovis AF2122/97
cggcgggccgcgcggcgacagcu

SEQ ID NO: 1110299 - RNA, 21 nt, Mycobacterium bovis subsp bovis AF2122/97
cggcgggcgaucuuggcgaca

SEQ ID NO: 1110300 - RNA, 24 nt, Mycobacterium bovis subsp bovis AF2122/97
cggcgggcgaucuuggcgacaugc

SEQ ID NO: 1110301 - RNA, 13 nt, Mycobacterium bovis subsp bovis AF2122/97
cggcucgccgacc

SEQ ID NO: 1110302 - RNA, 20 nt, Mycobacterium bovis subsp bovis AF2122/97
cggcucgccgacccgccgcg

SEQ ID NO: 1110303 - RNA, 22 nt, Mycobacterium bovis subsp bovis AF2122/97
cggcucgccggcgcgcaccccg

SEQ ID NO: 1110304 - RNA, 23 nt, Mycobacterium bovis subsp bovis AF2122/97
cggcucgccggcgcgcaccccgg

SEQ ID NO: 1110305 - RNA, 13 nt, Mycobacterium bovis subsp bovis AF2122/97
cggcucgccggcg

SEQ ID NO: 1110306 - RNA, 14 nt, Mycobacterium bovis subsp bovis AF2122/97
cggcucgccggcga

SEQ ID NO: 1110307 - RNA, 19 nt, Mycobacterium bovis subsp bovis AF2122/97
cggcucgccggcgaccggg

SEQ ID NO: 1110308 - RNA, 19 nt, Mycobacterium bovis subsp bovis AF2122/97
cggcucgccggcggcccgc

SEQ ID NO: 1110309 - RNA, 15 nt, Mycobacterium bovis subsp bovis AF2122/97
cggcucgccggcucg

SEQ ID NO: 1110310 - RNA, 13 nt, Mycobacterium bovis subsp bovis AF2122/97
cggcucggccccc

SEQ ID NO: 1110311 - RNA, 13 nt, Mycobacterium bovis subsp bovis AF2122/97
cggcucggccgga

SEQ ID NO: 1110312 - RNA, 14 nt, Mycobacterium bovis subsp bovis AF2122/97
cggcucggccagcc

SEQ ID NO: 1110313 - RNA, 17 nt, Mycobacterium bovis subsp bovis AF2122/97
cggcucgaauacggugc

SEQ ID NO: 1110314 - RNA, 19 nt, Mycobacterium bovis subsp bovis AF2122/97
cggcucgaauacggugcca

SEQ ID NO: 1110315 - RNA, 19 nt, Mycobacterium bovis subsp bovis AF2122/97
cggcuccgggcgcucgguc

SEQ ID NO: 1110316 - RNA, 17 nt, Mycobacterium bovis subsp bovis AF2122/97
cggcucgagucgcagca

SEQ ID NO: 1110317 - RNA, 19 nt, Mycobacterium bovis subsp bovis AF2122/97
cggcucgaucucguuuucg

SEQ ID NO: 1110318 - RNA, 16 nt, Mycobacterium bovis subsp bovis AF2122/97
cggcuccgguaggcga

SEQ ID NO: 1110319 - RNA, 21 nt, Mycobacterium bovis subsp bovis AF2122/97
cggcucgagucgcagcacggg

SEQ ID NO: 1110320 - RNA, 13 nt, Mycobacterium bovis subsp bovis AF2122/97
cggcuccggcggu

SEQ ID NO: 1110321 - RNA, 19 nt, Mycobacterium bovis subsp bovis AF2122/97
cggcuccggcggugccguc

SEQ ID NO: 1110322 - RNA, 18 nt, Mycobacterium bovis subsp bovis AF2122/97
cggcuccgcccggcgugu

SEQ ID NO: 1110323 - RNA, 16 nt, Mycobacterium bovis subsp bovis AF2122/97
cggcuccgccgcgggc

SEQ ID NO: 1110324 - RNA, 15 nt, Mycobacterium bovis subsp bovis AF2122/97
cggcuccgccguuga

SEQ ID NO: 1110325 - RNA, 16 nt, Mycobacterium bovis subsp bovis AF2122/97
cggcuccgcgacgggc

SEQ ID NO: 1110326 - RNA, 15 nt, Mycobacterium bovis subsp bovis AF2122/97
cggcuccuccccggc

SEQ ID NO: 1110327 - RNA, 19 nt, Mycobacterium bovis subsp bovis AF2122/97
cggcuccuccccggcccgc

SEQ ID NO: 1110328 - RNA, 20 nt, Mycobacterium bovis subsp bovis AF2122/97
cggcuccuccgguaucggcg

SEQ ID NO: 1110329 - RNA, 13 nt, Mycobacterium bovis subsp bovis AF2122/97
cggcuccgccacu

SEQ ID NO: 1110330 - RNA, 22 nt, Mycobacterium bovis subsp bovis AF2122/97
cggcuccgccacuggcgccggu

SEQ ID NO: 1110331 - RNA, 23 nt, Mycobacterium bovis subsp bovis AF2122/97
cggcuccgccacuggcgccggug

SEQ ID NO: 1110332 - RNA, 13 nt, Mycobacterium bovis subsp bovis AF2122/97
cggcucagucacg

SEQ ID NO: 1110333 - RNA, 17 nt, Mycobacterium bovis subsp bovis AF2122/97
cggcucaccgaucccgc

SEQ ID NO: 1110334 - RNA, 19 nt, Mycobacterium bovis subsp bovis AF2122/97
cggcuagcaguuagccggg

SEQ ID NO: 1110335 - RNA, 17 nt, Mycobacterium bovis subsp bovis AF2122/97
cggcuagauaacccaac

SEQ ID NO: 1110336 - RNA, 20 nt, Mycobacterium bovis subsp bovis AF2122/97
cggcuagcaacgggucgaug

SEQ ID NO: 1110337 - RNA, 23 nt, Mycobacterium bovis subsp bovis AF2122/97
cggcuagcaacgggucgaugucg

SEQ ID NO: 1110338 - RNA, 14 nt, Mycobacterium bovis subsp bovis AF2122/97
cggcuacggccagu

SEQ ID NO: 1110339 - RNA, 14 nt, Mycobacterium bovis subsp bovis AF2122/97
cggcuacggcgaca

SEQ ID NO: 1110340 - RNA, 21 nt, Mycobacterium bovis subsp bovis AF2122/97
cggcuaccuaacccgcgccgg

SEQ ID NO: 1110341 - RNA, 22 nt, Mycobacterium bovis subsp bovis AF2122/97
cggcucacagcacagcgcagcc

SEQ ID NO: 1110342 - RNA, 13 nt, Mycobacterium bovis subsp bovis AF2122/97
cggcucacgaccg

SEQ ID NO: 1110343 - RNA, 16 nt, Mycobacterium bovis subsp bovis AF2122/97
cggcucacgacugcgu

SEQ ID NO: 1110344 - RNA, 14 nt, Mycobacterium bovis subsp bovis AF2122/97
cggcucaccgcgca

SEQ ID NO: 1110345 - RNA, 13 nt, Mycobacterium bovis subsp bovis AF2122/97
cggcucagcgugc

SEQ ID NO: 1110346 - RNA, 23 nt, Mycobacterium bovis subsp bovis AF2122/97
cggcucaggugugugacgaucgu

SEQ ID NO: 1110347 - RNA, 15 nt, Mycobacterium bovis subsp bovis AF2122/97
cggcuacaucggcgg

SEQ ID NO: 1110348 - RNA, 21 nt, Mycobacterium bovis subsp bovis AF2122/97
cggcuacaucggcggcgucga

SEQ ID NO: 1110349 - RNA, 15 nt, Mycobacterium bovis subsp bovis AF2122/97
cggcuaccaccgcac

SEQ ID NO: 1110350 - RNA, 21 nt, Mycobacterium bovis subsp bovis AF2122/97
cggcuaccaccgcaccugcga

SEQ ID NO: 1110351 - RNA, 13 nt, Mycobacterium bovis subsp bovis AF2122/97
cggcuaccgccga

SEQ ID NO: 1110352 - RNA, 15 nt, Mycobacterium bovis subsp bovis AF2122/97
cggcuaccgccgacc

SEQ ID NO: 1110353 - RNA, 16 nt, Mycobacterium bovis subsp bovis AF2122/97
cggcuaccgccgaccg

SEQ ID NO: 1110354 - RNA, 16 nt, Mycobacterium bovis subsp bovis AF2122/97
cggcguuacguggugg

SEQ ID NO: 1110355 - RNA, 21 nt, Mycobacterium bovis subsp bovis AF2122/97
cggcguuagcguagcccgagu

SEQ ID NO: 1110356 - RNA, 18 nt, Mycobacterium bovis subsp bovis AF2122/97
cggcguuagucgaucacg

SEQ ID NO: 1110357 - RNA, 22 nt, Mycobacterium bovis subsp bovis AF2122/97
cggcguuaaugcuucgcgucga

SEQ ID NO: 1110358 - RNA, 15 nt, Mycobacterium bovis subsp bovis AF2122/97
cggcguuaccaccgu

SEQ ID NO: 1110359 - RNA, 15 nt, Mycobacterium bovis subsp bovis AF2122/97
cggcguuaucgucgg

SEQ ID NO: 1110360 - RNA, 23 nt, Mycobacterium bovis subsp bovis AF2122/97
cggcguucccgccauugccgccg

SEQ ID NO: 1110361 - RNA, 14 nt, Mycobacterium bovis subsp bovis AF2122/97
cggcguucgaugcc

SEQ ID NO: 1110362 - RNA, 15 nt, Mycobacterium bovis subsp bovis AF2122/97
cggcguucgaugcca

SEQ ID NO: 1110363 - RNA, 24 nt, Mycobacterium bovis subsp bovis AF2122/97
cggcguggcugccuucggcgagcg

SEQ ID NO: 1110364 - RNA, 16 nt, Mycobacterium bovis subsp bovis AF2122/97
cggcgugggagguggc

SEQ ID NO: 1110365 - RNA, 20 nt, Mycobacterium bovis subsp bovis AF2122/97
cggcgugggagguggcgcgg

SEQ ID NO: 1110366 - RNA, 22 nt, Mycobacterium bovis subsp bovis AF2122/97
cggcgugggagguggcgcgggg

SEQ ID NO: 1110367 - RNA, 19 nt, Mycobacterium bovis subsp bovis AF2122/97
cggcguuaccaccgucacc

SEQ ID NO: 1110368 - RNA, 20 nt, Mycobacterium bovis subsp bovis AF2122/97
cggcguuaccaccgucaccg

SEQ ID NO: 1110369 - RNA, 17 nt, Mycobacterium bovis subsp bovis AF2122/97
cggcguggucgcgcggc

SEQ ID NO: 1110370 - RNA, 18 nt, Mycobacterium bovis subsp bovis AF2122/97
cggcguggucgcgcggca

SEQ ID NO: 1110371 - RNA, 14 nt, Mycobacterium bovis subsp bovis AF2122/97
cggcguggucggca

SEQ ID NO: 1110372 - RNA, 16 nt, Mycobacterium bovis subsp bovis AF2122/97
cggcguggucggcaaa

SEQ ID NO: 1110373 - RNA, 18 nt, Mycobacterium bovis subsp bovis AF2122/97
cggcguggcaguacaccg

SEQ ID NO: 1110374 - RNA, 21 nt, Mycobacterium bovis subsp bovis AF2122/97
cggcgugcuuaacacaugcaa

SEQ ID NO: 1110375 - RNA, 15 nt, Mycobacterium bovis subsp bovis AF2122/97
cggcguggcgccggc

SEQ ID NO: 1110376 - RNA, 19 nt, Mycobacterium bovis subsp bovis AF2122/97
cggcguggcgccggccacg

SEQ ID NO: 1110377 - RNA, 21 nt, Mycobacterium bovis subsp bovis AF2122/97
cggcguggcgccggccacgag

SEQ ID NO: 1110378 - RNA, 12 nt, Mycobacterium bovis subsp bovis AF2122/97
cggcgugcuggc

SEQ ID NO: 1110379 - RNA, 14 nt, Mycobacterium bovis subsp bovis AF2122/97
cggcgugcggcgag

SEQ ID NO: 1110380 - RNA, 14 nt, Mycobacterium bovis subsp bovis AF2122/97
cggcguggauccgu

SEQ ID NO: 1110381 - RNA, 17 nt, Mycobacterium bovis subsp bovis AF2122/97
cggcgucuugcaucagc

SEQ ID NO: 1110382 - RNA, 15 nt, Mycobacterium bovis subsp bovis AF2122/97
cggcgucuucgucgg

SEQ ID NO: 1110383 - RNA, 22 nt, Mycobacterium bovis subsp bovis AF2122/97
cggcgucuuccucggccacccg

SEQ ID NO: 1110384 - RNA, 24 nt, Mycobacterium bovis subsp bovis AF2122/97
cggcgucuuccucggccacccgca

SEQ ID NO: 1110385 - RNA, 19 nt, Mycobacterium bovis subsp bovis AF2122/97
cggcgucuguaccacgggc

SEQ ID NO: 1110386 - RNA, 15 nt, Mycobacterium bovis subsp bovis AF2122/97
cggcgucugcggugg

SEQ ID NO: 1110387 - RNA, 18 nt, Mycobacterium bovis subsp bovis AF2122/97
cggcgucuuccucggcca

SEQ ID NO: 1110388 - RNA, 14 nt, Mycobacterium bovis subsp bovis AF2122/97
cggcgucugcccgc

SEQ ID NO: 1110389 - RNA, 15 nt, Mycobacterium bovis subsp bovis AF2122/97
cggcgucugcgccag

SEQ ID NO: 1110390 - RNA, 23 nt, Mycobacterium bovis subsp bovis AF2122/97
cggcgucuccgccggcucgucga

SEQ ID NO: 1110391 - RNA, 15 nt, Mycobacterium bovis subsp bovis AF2122/97
cggcgucucgcagca

SEQ ID NO: 1110392 - RNA, 22 nt, Mycobacterium bovis subsp bovis AF2122/97
cggcgucucgcagcaacggcgg

SEQ ID NO: 1110393 - RNA, 23 nt, Mycobacterium bovis subsp bovis AF2122/97
cggcgucguugaggaagcccgau

SEQ ID NO: 1110394 - RNA, 20 nt, Mycobacterium bovis subsp bovis AF2122/97
cggcgugccagcacacgccu

SEQ ID NO: 1110395 - RNA, 19 nt, Mycobacterium bovis subsp bovis AF2122/97
cggcgugaaaaacgcccgc

SEQ ID NO: 1110396 - RNA, 20 nt, Mycobacterium bovis subsp bovis AF2122/97
cggcgucuugcaucagcggc

SEQ ID NO: 1110397 - RNA, 21 nt, Mycobacterium bovis subsp bovis AF2122/97
cggcgucuugcaucagcggcg

SEQ ID NO: 1110398 - RNA, 23 nt, Mycobacterium bovis subsp bovis AF2122/97
cggcgucuugcaucagcggcgcc

SEQ ID NO: 1110399 - RNA, 16 nt, Mycobacterium bovis subsp bovis AF2122/97
cggcgugccggguggu

SEQ ID NO: 1110400 - RNA, 19 nt, Mycobacterium bovis subsp bovis AF2122/97
cggcguagacguagaaugc

SEQ ID NO: 1110401 - RNA, 23 nt, Mycobacterium bovis subsp bovis AF2122/97
cggcguagacguagaaugcgccg

SEQ ID NO: 1110402 - RNA, 16 nt, Mycobacterium bovis subsp bovis AF2122/97
cggcguagacguccgc

SEQ ID NO: 1110403 - RNA, 22 nt, Mycobacterium bovis subsp bovis AF2122/97
cggcguacuucgacagcggcga

SEQ ID NO: 1110404 - RNA, 23 nt, Mycobacterium bovis subsp bovis AF2122/97
cggcguagaucaucagcgacuug

SEQ ID NO: 1110405 - RNA, 21 nt, Mycobacterium bovis subsp bovis AF2122/97
cggcguagaucaucagcgacu

SEQ ID NO: 1110406 - RNA, 18 nt, Mycobacterium bovis subsp bovis AF2122/97
cggcguagaugcgcccgg

SEQ ID NO: 1110407 - RNA, 22 nt, Mycobacterium bovis subsp bovis AF2122/97
cggcguagcagaaggccgcggu

SEQ ID NO: 1110408 - RNA, 15 nt, Mycobacterium bovis subsp bovis AF2122/97
cggcguagucguugu

SEQ ID NO: 1110409 - RNA, 16 nt, Mycobacterium bovis subsp bovis AF2122/97
cggcguagucguuguc

SEQ ID NO: 1110410 - RNA, 16 nt, Mycobacterium bovis subsp bovis AF2122/97
cggcguaggcgauggc

SEQ ID NO: 1110411 - RNA, 16 nt, Mycobacterium bovis subsp bovis AF2122/97
cggcguauugcaccgc

SEQ ID NO: 1110412 - RNA, 16 nt, Mycobacterium bovis subsp bovis AF2122/97
cggcguauugcggccu

SEQ ID NO: 1110413 - RNA, 17 nt, Mycobacterium bovis subsp bovis AF2122/97
cggcguauugcggccug

SEQ ID NO: 1110414 - RNA, 18 nt, Mycobacterium bovis subsp bovis AF2122/97
cggcguauugcggccugu

SEQ ID NO: 1110415 - RNA, 17 nt, Mycobacterium bovis subsp bovis AF2122/97
cggcgucacccgcaacg

SEQ ID NO: 1110416 - RNA, 21 nt, Mycobacterium bovis subsp bovis AF2122/97
cggcgucacccgcaacgacug

SEQ ID NO: 1110417 - RNA, 23 nt, Mycobacterium bovis subsp bovis AF2122/97
cggcgucacccgcaacgacugau

SEQ ID NO: 1110418 - RNA, 15 nt, Mycobacterium bovis subsp bovis AF2122/97
cggcgucgucgauga

SEQ ID NO: 1110419 - RNA, 13 nt, Mycobacterium bovis subsp bovis AF2122/97
cggcgucguccgc

SEQ ID NO: 1110420 - RNA, 19 nt, Mycobacterium bovis subsp bovis AF2122/97
cggcgucguccgcgccagu

SEQ ID NO: 1110421 - RNA, 23 nt, Mycobacterium bovis subsp bovis AF2122/97
cggcgucgguggaggcguagucg

SEQ ID NO: 1110422 - RNA, 21 nt, Mycobacterium bovis subsp bovis AF2122/97
cggcgucggugagcgcgucgc

SEQ ID NO: 1110423 - RNA, 15 nt, Mycobacterium bovis subsp bovis AF2122/97
cggcgucgucgucga

SEQ ID NO: 1110424 - RNA, 20 nt, Mycobacterium bovis subsp bovis AF2122/97
cggcgucgucgacggcugcg

SEQ ID NO: 1110425 - RNA, 21 nt, Mycobacterium bovis subsp bovis AF2122/97
cggcgucgucgaugaugccgg

SEQ ID NO: 1110426 - RNA, 14 nt, Mycobacterium bovis subsp bovis AF2122/97
cggcgucguggugg

SEQ ID NO: 1110427 - RNA, 14 nt, Mycobacterium bovis subsp bovis AF2122/97
cggcgucggucguc

SEQ ID NO: 1110428 - RNA, 16 nt, Mycobacterium bovis subsp bovis AF2122/97
cggcgucggucgucgg

SEQ ID NO: 1110429 - RNA, 18 nt, Mycobacterium bovis subsp bovis AF2122/97
cggcgucggucgucgggu

SEQ ID NO: 1110430 - RNA, 19 nt, Mycobacterium bovis subsp bovis AF2122/97
cggcgucacggcgugacca

SEQ ID NO: 1110431 - RNA, 20 nt, Mycobacterium bovis subsp bovis AF2122/97
cggcgucacggcgugaccac

SEQ ID NO: 1110432 - RNA, 21 nt, Mycobacterium bovis subsp bovis AF2122/97
cggcgucagccccgacugcgc

SEQ ID NO: 1110433 - RNA, 14 nt, Mycobacterium bovis subsp bovis AF2122/97
cggcgucacggugg

SEQ ID NO: 1110434 - RNA, 12 nt, Mycobacterium bovis subsp bovis AF2122/97
cggcgucacgag

SEQ ID NO: 1110435 - RNA, 22 nt, Mycobacterium bovis subsp bovis AF2122/97
cggggacaacucgcguggcacc

SEQ ID NO: 1110436 - RNA, 23 nt, Mycobacterium bovis subsp bovis AF2122/97
cggggaaugaguguugccgacga

SEQ ID NO: 1110437 - RNA, 18 nt, Mycobacterium bovis subsp bovis AF2122/97
cggggaaggggcucagcg

SEQ ID NO: 1110438 - RNA, 13 nt, Mycobacterium bovis subsp bovis AF2122/97
cggggaacaccgc

SEQ ID NO: 1110439 - RNA, 19 nt, Mycobacterium bovis subsp bovis AF2122/97
cggggaagacgaccgugcu

SEQ ID NO: 1110440 - RNA, 17 nt, Mycobacterium bovis subsp bovis AF2122/97
cggggaagccugcgggc

SEQ ID NO: 1110441 - RNA, 16 nt, Mycobacterium bovis subsp bovis AF2122/97
cggggacgcccucggg

SEQ ID NO: 1110442 - RNA, 16 nt, Mycobacterium bovis subsp bovis AF2122/97
cggggacgccgcggcg

SEQ ID NO: 1110443 - RNA, 21 nt, Mycobacterium bovis subsp bovis AF2122/97
cggggacgccgcggcgccggu

SEQ ID NO: 1110444 - RNA, 16 nt, Mycobacterium bovis subsp bovis AF2122/97
cggggacgcgccccag

SEQ ID NO: 1110445 - RNA, 14 nt, Mycobacterium bovis subsp bovis AF2122/97
cggggaccucggcg

SEQ ID NO: 1110446 - RNA, 21 nt, Mycobacterium bovis subsp bovis AF2122/97
cggggaccgcggucauggcga

SEQ ID NO: 1110447 - RNA, 15 nt, Mycobacterium bovis subsp bovis AF2122/97
cggggacagcccggc

SEQ ID NO: 1110448 - RNA, 18 nt, Mycobacterium bovis subsp bovis AF2122/97
cggggaccacgccgacgu

SEQ ID NO: 1110449 - RNA, 19 nt, Mycobacterium bovis subsp bovis AF2122/97
cggggaaagccgcagccgc

SEQ ID NO: 1110450 - RNA, 19 nt, Mycobacterium bovis subsp bovis AF2122/97
cggggaaccguccaagccg

SEQ ID NO: 1110451 - RNA, 19 nt, Mycobacterium bovis subsp bovis AF2122/97
cggggaaccuugaccgacc

SEQ ID NO: 1110452 - RNA, 21 nt, Mycobacterium bovis subsp bovis AF2122/97
cggggaacguccgcgccgagc

SEQ ID NO: 1110453 - RNA, 20 nt, Mycobacterium bovis subsp bovis AF2122/97
cgggcuuugagcgcccgucg

SEQ ID NO: 1110454 - RNA, 15 nt, Mycobacterium bovis subsp bovis AF2122/97
cgggcuuggcgucga

SEQ ID NO: 1110455 - RNA, 24 nt, Mycobacterium bovis subsp bovis AF2122/97
cgggcuuggcgucgacgucgacgg

SEQ ID NO: 1110456 - RNA, 19 nt, Mycobacterium bovis subsp bovis AF2122/97
cgggcuuggggucccgccg

SEQ ID NO: 1110457 - RNA, 20 nt, Mycobacterium bovis subsp bovis AF2122/97
cgggcuuggggucccgccgg

SEQ ID NO: 1110458 - RNA, 19 nt, Mycobacterium bovis subsp bovis AF2122/97
cgggcugugaacagcgcgu

SEQ ID NO: 1110459 - RNA, 22 nt, Mycobacterium bovis subsp bovis AF2122/97
cgggcuugacccuugggcacca

SEQ ID NO: 1110460 - RNA, 13 nt, Mycobacterium bovis subsp bovis AF2122/97
cgggcugucaggc

SEQ ID NO: 1110461 - RNA, 13 nt, Mycobacterium bovis subsp bovis AF2122/97
cgggcuguucggc

SEQ ID NO: 1110462 - RNA, 16 nt, Mycobacterium bovis subsp bovis AF2122/97
cgggcugugauccgac

SEQ ID NO: 1110463 - RNA, 15 nt, Mycobacterium bovis subsp bovis AF2122/97
cgggcuuaggccgcg

SEQ ID NO: 1110464 - RNA, 14 nt, Mycobacterium bovis subsp bovis AF2122/97
cgggccuggcccac

SEQ ID NO: 1110465 - RNA, 16 nt, Mycobacterium bovis subsp bovis AF2122/97
cgggccuggcccacgc

SEQ ID NO: 1110466 - RNA, 19 nt, Mycobacterium bovis subsp bovis AF2122/97
cgggccuggccugcccagc

SEQ ID NO: 1110467 - RNA, 17 nt, Mycobacterium bovis subsp bovis AF2122/97
cgggccuucagcucacc

SEQ ID NO: 1110468 - RNA, 16 nt, Mycobacterium bovis subsp bovis AF2122/97
cgggccugguggauga

SEQ ID NO: 1110469 - RNA, 18 nt, Mycobacterium bovis subsp bovis AF2122/97
cgggccugggacggcggc

SEQ ID NO: 1110470 - RNA, 23 nt, Mycobacterium bovis subsp bovis AF2122/97
cgggcguucucgauugucgccgc

SEQ ID NO: 1110471 - RNA, 14 nt, Mycobacterium bovis subsp bovis AF2122/97
cgggcguuggccag

SEQ ID NO: 1110472 - RNA, 23 nt, Mycobacterium bovis subsp bovis AF2122/97
cgggcgugguaaccagggcagcc

SEQ ID NO: 1110473 - RNA, 15 nt, Mycobacterium bovis subsp bovis AF2122/97
cgggcgugguaucgc

SEQ ID NO: 1110474 - RNA, 19 nt, Mycobacterium bovis subsp bovis AF2122/97
cgggcgugugcaguccgau

SEQ ID NO: 1110475 - RNA, 18 nt, Mycobacterium bovis subsp bovis AF2122/97
cgggcgugggcaccccgc

SEQ ID NO: 1110476 - RNA, 19 nt, Mycobacterium bovis subsp bovis AF2122/97
cgggcgugggugucggcga

SEQ ID NO: 1110477 - RNA, 14 nt, Mycobacterium bovis subsp bovis AF2122/97
cgggcgugguaacc

SEQ ID NO: 1110478 - RNA, 19 nt, Mycobacterium bovis subsp bovis AF2122/97
cgggcucggugacccccga

SEQ ID NO: 1110479 - RNA, 19 nt, Mycobacterium bovis subsp bovis AF2122/97
cgggcucgguggcggacgg

SEQ ID NO: 1110480 - RNA, 11 nt, Mycobacterium bovis subsp bovis AF2122/97
cgggcucuacu

SEQ ID NO: 1110481 - RNA, 20 nt, Mycobacterium bovis subsp bovis AF2122/97
cgggcucuacucgcggccgg

SEQ ID NO: 1110482 - RNA, 21 nt, Mycobacterium bovis subsp bovis AF2122/97
cgggcucuacucgcggccggc

SEQ ID NO: 1110483 - RNA, 19 nt, Mycobacterium bovis subsp bovis AF2122/97
cgggcucugcugccagccg

SEQ ID NO: 1110484 - RNA, 16 nt, Mycobacterium bovis subsp bovis AF2122/97
cgggcucguguccgcc

SEQ ID NO: 1110485 - RNA, 22 nt, Mycobacterium bovis subsp bovis AF2122/97
cgggcucguguccgccgucacc

SEQ ID NO: 1110486 - RNA, 15 nt, Mycobacterium bovis subsp bovis AF2122/97
cgggcucucggcguc

SEQ ID NO: 1110487 - RNA, 16 nt, Mycobacterium bovis subsp bovis AF2122/97
cgggcugaggcggcga

SEQ ID NO: 1110488 - RNA, 19 nt, Mycobacterium bovis subsp bovis AF2122/97
cgggcugaggcggcgacga

SEQ ID NO: 1110489 - RNA, 17 nt, Mycobacterium bovis subsp bovis AF2122/97
cgggcuggccgacucga

SEQ ID NO: 1110490 - RNA, 20 nt, Mycobacterium bovis subsp bovis AF2122/97
cgggcucgcuucaggcaccg

SEQ ID NO: 1110491 - RNA, 15 nt, Mycobacterium bovis subsp bovis AF2122/97
cgggcucggagauga

SEQ ID NO: 1110492 - RNA, 20 nt, Mycobacterium bovis subsp bovis AF2122/97
cgggcgaaacgcccgggcgg

SEQ ID NO: 1110493 - RNA, 21 nt, Mycobacterium bovis subsp bovis AF2122/97
cgggcucggcgaaacccggga

SEQ ID NO: 1110494 - RNA, 18 nt, Mycobacterium bovis subsp bovis AF2122/97
cgggcucggcgucgccgc

SEQ ID NO: 1110495 - RNA, 20 nt, Mycobacterium bovis subsp bovis AF2122/97
cgggcguugggaucgcgcag

SEQ ID NO: 1110496 - RNA, 19 nt, Mycobacterium bovis subsp bovis AF2122/97
cgggcguuguuaucgaagc

SEQ ID NO: 1110497 - RNA, 22 nt, Mycobacterium bovis subsp bovis AF2122/97
cgggcguuuggacgggcgugcu

SEQ ID NO: 1110498 - RNA, 16 nt, Mycobacterium bovis subsp bovis AF2122/97
cgggcuaggcggcguu

SEQ ID NO: 1110499 - RNA, 20 nt, Mycobacterium bovis subsp bovis AF2122/97
cggggcgccugaugcggccg

SEQ ID NO: 1110500 - RNA, 22 nt, Mycobacterium bovis subsp bovis AF2122/97
cggggcgccugaugcggccggc

SEQ ID NO: 1110501 - RNA, 18 nt, Mycobacterium bovis subsp bovis AF2122/97
cggggcgcccggccaggu

SEQ ID NO: 1110502 - RNA, 15 nt, Mycobacterium bovis subsp bovis AF2122/97
cggggccgcggccca

SEQ ID NO: 1110503 - RNA, 21 nt, Mycobacterium bovis subsp bovis AF2122/97
cggggccgcgccuugcuuccg

SEQ ID NO: 1110504 - RNA, 18 nt, Mycobacterium bovis subsp bovis AF2122/97
cggggccggaugacgauc

SEQ ID NO: 1110505 - RNA, 20 nt, Mycobacterium bovis subsp bovis AF2122/97
cggggcgcucgcgcgcuggg

SEQ ID NO: 1110506 - RNA, 19 nt, Mycobacterium bovis subsp bovis AF2122/97
cggggcggcauuggcggug

SEQ ID NO: 1110507 - RNA, 21 nt, Mycobacterium bovis subsp bovis AF2122/97
cggggcuguacucgcggcgcg

SEQ ID NO: 1110508 - RNA, 23 nt, Mycobacterium bovis subsp bovis AF2122/97
cggggcuguacucgcggcgcggc

SEQ ID NO: 1110509 - RNA, 23 nt, Mycobacterium bovis subsp bovis AF2122/97
cggggcuucaucuggcgccguua

SEQ ID NO: 1110510 - RNA, 21 nt, Mycobacterium bovis subsp bovis AF2122/97
cgggggcgccgccguugccgc

SEQ ID NO: 1110511 - RNA, 13 nt, Mycobacterium bovis subsp bovis AF2122/97
cgggggcgccgga

SEQ ID NO: 1110512 - RNA, 21 nt, Mycobacterium bovis subsp bovis AF2122/97
cggggucaaagcccgacgcga

SEQ ID NO: 1110513 - RNA, 23 nt, Mycobacterium bovis subsp bovis AF2122/97
cggggucaacaggccguggcgga

SEQ ID NO: 1110514 - RNA, 19 nt, Mycobacterium bovis subsp bovis AF2122/97
cggggucaaucccacgccc

SEQ ID NO: 1110515 - RNA, 22 nt, Mycobacterium bovis subsp bovis AF2122/97
cgggguccaucggggccgucgg

SEQ ID NO: 1110516 - RNA, 15 nt, Mycobacterium bovis subsp bovis AF2122/97
cgggggccagcguca

SEQ ID NO: 1110517 - RNA, 16 nt, Mycobacterium bovis subsp bovis AF2122/97
cgggggagcgaacggc

SEQ ID NO: 1110518 - RNA, 14 nt, Mycobacterium bovis subsp bovis AF2122/97
cgggggcagcgcga

SEQ ID NO: 1110519 - RNA, 14 nt, Mycobacterium bovis subsp bovis AF2122/97
cgggggcggccggc

SEQ ID NO: 1110520 - RNA, 15 nt, Mycobacterium bovis subsp bovis AF2122/97
cgggggcggccggcg

SEQ ID NO: 1110521 - RNA, 16 nt, Mycobacterium bovis subsp bovis AF2122/97
cgggggcggccggcgg

SEQ ID NO: 1110522 - RNA, 14 nt, Mycobacterium bovis subsp bovis AF2122/97
cgggggcgccgccg

SEQ ID NO: 1110523 - RNA, 23 nt, Mycobacterium bovis subsp bovis AF2122/97
cgggggccgcgucucggugcagc

SEQ ID NO: 1110524 - RNA, 16 nt, Mycobacterium bovis subsp bovis AF2122/97
cgggggccgagccgac

SEQ ID NO: 1110525 - RNA, 15 nt, Mycobacterium bovis subsp bovis AF2122/97
cggggcagcgggccg

SEQ ID NO: 1110526 - RNA, 17 nt, Mycobacterium bovis subsp bovis AF2122/97
cggggcagcgggccgcc

SEQ ID NO: 1110527 - RNA, 18 nt, Mycobacterium bovis subsp bovis AF2122/97
cggggcagcgggccgccc

SEQ ID NO: 1110528 - RNA, 15 nt, Mycobacterium bovis subsp bovis AF2122/97
cggggccccaugccg

SEQ ID NO: 1110529 - RNA, 17 nt, Mycobacterium bovis subsp bovis AF2122/97
cggggccccaugccgac

SEQ ID NO: 1110530 - RNA, 14 nt, Mycobacterium bovis subsp bovis AF2122/97
cggggcccccgccg

SEQ ID NO: 1110531 - RNA, 22 nt, Mycobacterium bovis subsp bovis AF2122/97
cggggcccccgccggacacgau

SEQ ID NO: 1110532 - RNA, 21 nt, Mycobacterium bovis subsp bovis AF2122/97
cggggccccgcggcgccgcca

SEQ ID NO: 1110533 - RNA, 15 nt, Mycobacterium bovis subsp bovis AF2122/97
cggggcccugggaga

SEQ ID NO: 1110534 - RNA, 17 nt, Mycobacterium bovis subsp bovis AF2122/97
cggggccgaauccgucc

SEQ ID NO: 1110535 - RNA, 22 nt, Mycobacterium bovis subsp bovis AF2122/97
cggggccgcacuguugcguagc

SEQ ID NO: 1110536 - RNA, 18 nt, Mycobacterium bovis subsp bovis AF2122/97
cggggccgccagcugcgc

SEQ ID NO: 1110537 - RNA, 21 nt, Mycobacterium bovis subsp bovis AF2122/97
cggggcccggacaggcucacg

SEQ ID NO: 1110538 - RNA, 16 nt, Mycobacterium bovis subsp bovis AF2122/97
cggggccgccgaugcc

SEQ ID NO: 1110539 - RNA, 23 nt, Mycobacterium bovis subsp bovis AF2122/97
cggggccgccgaugccaccgcuu

SEQ ID NO: 1110540 - RNA, 19 nt, Mycobacterium bovis subsp bovis AF2122/97
cggggccgccgcggccggc

SEQ ID NO: 1110541 - RNA, 22 nt, Mycobacterium bovis subsp bovis AF2122/97
cggggccgccgcggccggcgcu

SEQ ID NO: 1110542 - RNA, 19 nt, Mycobacterium bovis subsp bovis AF2122/97
cggggaugggggagccggu

SEQ ID NO: 1110543 - RNA, 22 nt, Mycobacterium bovis subsp bovis AF2122/97
cggggaugggggagccggugac

SEQ ID NO: 1110544 - RNA, 17 nt, Mycobacterium bovis subsp bovis AF2122/97
cggggaucgcuggccgc

SEQ ID NO: 1110545 - RNA, 21 nt, Mycobacterium bovis subsp bovis AF2122/97
cggggaugccuagguagucgg

SEQ ID NO: 1110546 - RNA, 15 nt, Mycobacterium bovis subsp bovis AF2122/97
cggggaugcgaccgc

SEQ ID NO: 1110547 - RNA, 19 nt, Mycobacterium bovis subsp bovis AF2122/97
cggggauggagccggugac

SEQ ID NO: 1110548 - RNA, 20 nt, Mycobacterium bovis subsp bovis AF2122/97
cggggauuggugcccagcgc

SEQ ID NO: 1110549 - RNA, 19 nt, Mycobacterium bovis subsp bovis AF2122/97
cggggauuuauugagucgg

SEQ ID NO: 1110550 - RNA, 22 nt, Mycobacterium bovis subsp bovis AF2122/97
cggggauuuauugagucggcug

SEQ ID NO: 1110551 - RNA, 15 nt, Mycobacterium bovis subsp bovis AF2122/97
cggggcaccacgcca

SEQ ID NO: 1110552 - RNA, 24 nt, Mycobacterium bovis subsp bovis AF2122/97
cggggcaccacgccagcccguccg

SEQ ID NO: 1110553 - RNA, 23 nt, Mycobacterium bovis subsp bovis AF2122/97
cggggcaccgugcggaucgcgcu

SEQ ID NO: 1110554 - RNA, 14 nt, Mycobacterium bovis subsp bovis AF2122/97
cggggaccuuggcg

SEQ ID NO: 1110555 - RNA, 17 nt, Mycobacterium bovis subsp bovis AF2122/97
cggggauaccggucagc

SEQ ID NO: 1110556 - RNA, 15 nt, Mycobacterium bovis subsp bovis AF2122/97
cggggaggucgagcu

SEQ ID NO: 1110557 - RNA, 23 nt, Mycobacterium bovis subsp bovis AF2122/97
cggggacgucgacuucgcccggg

SEQ ID NO: 1110558 - RNA, 15 nt, Mycobacterium bovis subsp bovis AF2122/97
cggggacggcggcaa

SEQ ID NO: 1110559 - RNA, 15 nt, Mycobacterium bovis subsp bovis AF2122/97
cggggacgggucggc

SEQ ID NO: 1110560 - RNA, 14 nt, Mycobacterium bovis subsp bovis AF2122/97
cggggagcugcggc

SEQ ID NO: 1110561 - RNA, 18 nt, Mycobacterium bovis subsp bovis AF2122/97
cgggugcagaucgcccca

SEQ ID NO: 1110562 - RNA, 20 nt, Mycobacterium bovis subsp bovis AF2122/97
cgggugcagaucgccccagc

SEQ ID NO: 1110563 - RNA, 19 nt, Mycobacterium bovis subsp bovis AF2122/97
cgggugcagcacggcgccg

SEQ ID NO: 1110564 - RNA, 22 nt, Mycobacterium bovis subsp bovis AF2122/97
cgggugcagcacggcgccgcca

SEQ ID NO: 1110565 - RNA, 18 nt, Mycobacterium bovis subsp bovis AF2122/97
cgggugaucuccaccggc

SEQ ID NO: 1110566 - RNA, 15 nt, Mycobacterium bovis subsp bovis AF2122/97
cgggugaucugggcg

SEQ ID NO: 1110567 - RNA, 23 nt, Mycobacterium bovis subsp bovis AF2122/97
cgggugaucuuggcgcccgccgg

SEQ ID NO: 1110568 - RNA, 15 nt, Mycobacterium bovis subsp bovis AF2122/97
cgggugaugacgccg

SEQ ID NO: 1110569 - RNA, 19 nt, Mycobacterium bovis subsp bovis AF2122/97
cgggugaugacgccgucgg

SEQ ID NO: 1110570 - RNA, 23 nt, Mycobacterium bovis subsp bovis AF2122/97
cgggugaugacgccgucggcgcg

SEQ ID NO: 1110571 - RNA, 14 nt, Mycobacterium bovis subsp bovis AF2122/97
cgggucguccgccu

SEQ ID NO: 1110572 - RNA, 13 nt, Mycobacterium bovis subsp bovis AF2122/97
cgggugccagccc

SEQ ID NO: 1110573 - RNA, 23 nt, Mycobacterium bovis subsp bovis AF2122/97
cgggugcaggcgaguuaggccgc

SEQ ID NO: 1110574 - RNA, 13 nt, Mycobacterium bovis subsp bovis AF2122/97
cgggugccgagcu

SEQ ID NO: 1110575 - RNA, 17 nt, Mycobacterium bovis subsp bovis AF2122/97
cgggugccaucgguggu

SEQ ID NO: 1110576 - RNA, 19 nt, Mycobacterium bovis subsp bovis AF2122/97
cgggucgguuuccuccggc

SEQ ID NO: 1110577 - RNA, 12 nt, Mycobacterium bovis subsp bovis AF2122/97
cgggucgggacg

SEQ ID NO: 1110578 - RNA, 20 nt, Mycobacterium bovis subsp bovis AF2122/97
cgggucgucggcgucggugg

SEQ ID NO: 1110579 - RNA, 17 nt, Mycobacterium bovis subsp bovis AF2122/97
cgggucgagccggaccc

SEQ ID NO: 1110580 - RNA, 15 nt, Mycobacterium bovis subsp bovis AF2122/97
cgggucgaccccggc

SEQ ID NO: 1110581 - RNA, 19 nt, Mycobacterium bovis subsp bovis AF2122/97
cgggucgaacuugaucacc

SEQ ID NO: 1110582 - RNA, 23 nt, Mycobacterium bovis subsp bovis AF2122/97
cgggucgaguccgacggggaugg

SEQ ID NO: 1110583 - RNA, 15 nt, Mycobacterium bovis subsp bovis AF2122/97
cgggucgaucaccga

SEQ ID NO: 1110584 - RNA, 20 nt, Mycobacterium bovis subsp bovis AF2122/97
cgggucgaucaccgacaccg

SEQ ID NO: 1110585 - RNA, 22 nt, Mycobacterium bovis subsp bovis AF2122/97
cgggucgaucaccgacaccgug

SEQ ID NO: 1110586 - RNA, 22 nt, Mycobacterium bovis subsp bovis AF2122/97
cgggucgauggguaccgcgggg

SEQ ID NO: 1110587 - RNA, 18 nt, Mycobacterium bovis subsp bovis AF2122/97
cgggucgaugucggcaau

SEQ ID NO: 1110588 - RNA, 13 nt, Mycobacterium bovis subsp bovis AF2122/97
cgggucgaugacg

SEQ ID NO: 1110589 - RNA, 12 nt, Mycobacterium bovis subsp bovis AF2122/97
cgggucggcgcc

SEQ ID NO: 1110590 - RNA, 18 nt, Mycobacterium bovis subsp bovis AF2122/97
cgggucggcgaccgcgcu

SEQ ID NO: 1110591 - RNA, 20 nt, Mycobacterium bovis subsp bovis AF2122/97
cgggucgccgggcccgucgg

SEQ ID NO: 1110592 - RNA, 17 nt, Mycobacterium bovis subsp bovis AF2122/97
cgggucgccgaugacgg

SEQ ID NO: 1110593 - RNA, 14 nt, Mycobacterium bovis subsp bovis AF2122/97
cgggucgcaccccg

SEQ ID NO: 1110594 - RNA, 16 nt, Mycobacterium bovis subsp bovis AF2122/97
cgggucgcaccccggc

SEQ ID NO: 1110595 - RNA, 19 nt, Mycobacterium bovis subsp bovis AF2122/97
cgggucgcaaccgccgcca

SEQ ID NO: 1110596 - RNA, 22 nt, Mycobacterium bovis subsp bovis AF2122/97
cgggucgaugacgccgucagcg

SEQ ID NO: 1110597 - RNA, 15 nt, Mycobacterium bovis subsp bovis AF2122/97
cggggugccggcgau

SEQ ID NO: 1110598 - RNA, 21 nt, Mycobacterium bovis subsp bovis AF2122/97
cggggugcccccggugccgcc

SEQ ID NO: 1110599 - RNA, 23 nt, Mycobacterium bovis subsp bovis AF2122/97
cggggugcccccggugccgcccg

SEQ ID NO: 1110600 - RNA, 16 nt, Mycobacterium bovis subsp bovis AF2122/97
cggggugcccggccgc

SEQ ID NO: 1110601 - RNA, 17 nt, Mycobacterium bovis subsp bovis AF2122/97
cggggugcccggccgcc

SEQ ID NO: 1110602 - RNA, 18 nt, Mycobacterium bovis subsp bovis AF2122/97
cggggugcccggccgcca

SEQ ID NO: 1110603 - RNA, 18 nt, Mycobacterium bovis subsp bovis AF2122/97
cggggucgaacagcucga

SEQ ID NO: 1110604 - RNA, 19 nt, Mycobacterium bovis subsp bovis AF2122/97
cgggguggccaccagcggc

SEQ ID NO: 1110605 - RNA, 14 nt, Mycobacterium bovis subsp bovis AF2122/97
cggggucgccggca

SEQ ID NO: 1110606 - RNA, 19 nt, Mycobacterium bovis subsp bovis AF2122/97
cggggucgccggcaccgga

SEQ ID NO: 1110607 - RNA, 23 nt, Mycobacterium bovis subsp bovis AF2122/97
cgggucaccagcgcaucggccag

SEQ ID NO: 1110608 - RNA, 14 nt, Mycobacterium bovis subsp bovis AF2122/97
cgggucaccagcgc

SEQ ID NO: 1110609 - RNA, 13 nt, Mycobacterium bovis subsp bovis AF2122/97
cgggucacccccg

SEQ ID NO: 1110610 - RNA, 20 nt, Mycobacterium bovis subsp bovis AF2122/97
cgggucacccccggccagcg

SEQ ID NO: 1110611 - RNA, 21 nt, Mycobacterium bovis subsp bovis AF2122/97
cgggucaccgauucggccagc

SEQ ID NO: 1110612 - RNA, 11 nt, Mycobacterium bovis subsp bovis AF2122/97
cgggucagcgc

SEQ ID NO: 1110613 - RNA, 13 nt, Mycobacterium bovis subsp bovis AF2122/97
cgggucagcgccg

SEQ ID NO: 1110614 - RNA, 16 nt, Mycobacterium bovis subsp bovis AF2122/97
cgggucagcgccgaga

SEQ ID NO: 1110615 - RNA, 23 nt, Mycobacterium bovis subsp bovis AF2122/97
cgggucagcgccgagagcaccgc

SEQ ID NO: 1110616 - RNA, 19 nt, Mycobacterium bovis subsp bovis AF2122/97
cgggucgaacaggccggcc

SEQ ID NO: 1110617 - RNA, 22 nt, Mycobacterium bovis subsp bovis AF2122/97
cgggucgaacaggccggccgcg

SEQ ID NO: 1110618 - RNA, 15 nt, Mycobacterium bovis subsp bovis AF2122/97
cggguccgccguugc

SEQ ID NO: 1110619 - RNA, 13 nt, Mycobacterium bovis subsp bovis AF2122/97
cggguccucgcgg

SEQ ID NO: 1110620 - RNA, 13 nt, Mycobacterium bovis subsp bovis AF2122/97
cgggucccggccg

SEQ ID NO: 1110621 - RNA, 22 nt, Mycobacterium bovis subsp bovis AF2122/97
cggguccgaaguacuggccgcc

SEQ ID NO: 1110622 - RNA, 14 nt, Mycobacterium bovis subsp bovis AF2122/97
cggguccgccguug

SEQ ID NO: 1110623 - RNA, 11 nt, Mycobacterium bovis subsp bovis AF2122/97
cggguccgacg

SEQ ID NO: 1110624 - RNA, 16 nt, Mycobacterium bovis subsp bovis AF2122/97
cggguccgacggugua

SEQ ID NO: 1110625 - RNA, 17 nt, Mycobacterium bovis subsp bovis AF2122/97
cggguguggucgguggc

SEQ ID NO: 1110626 - RNA, 19 nt, Mycobacterium bovis subsp bovis AF2122/97
cggguguucgcgcgcgacu

SEQ ID NO: 1110627 - RNA, 16 nt, Mycobacterium bovis subsp bovis AF2122/97
cggguguggucggugg

SEQ ID NO: 1110628 - RNA, 13 nt, Mycobacterium bovis subsp bovis AF2122/97
cggguguucgcgc

SEQ ID NO: 1110629 - RNA, 15 nt, Mycobacterium bovis subsp bovis AF2122/97
cggguguuccacacc

SEQ ID NO: 1110630 - RNA, 22 nt, Mycobacterium bovis subsp bovis AF2122/97
cggguguuccacaccaggccga

SEQ ID NO: 1110631 - RNA, 16 nt, Mycobacterium bovis subsp bovis AF2122/97
cggguguuaucggucg

SEQ ID NO: 1110632 - RNA, 14 nt, Mycobacterium bovis subsp bovis AF2122/97
cggguguggucacc

SEQ ID NO: 1110633 - RNA, 17 nt, Mycobacterium bovis subsp bovis AF2122/97
cggguguggucaccagg

SEQ ID NO: 1110634 - RNA, 18 nt, Mycobacterium bovis subsp bovis AF2122/97
cggguguggucaccaggc

SEQ ID NO: 1110635 - RNA, 14 nt, Mycobacterium bovis subsp bovis AF2122/97
cggguggcgccggu

SEQ ID NO: 1110636 - RNA, 12 nt, Mycobacterium bovis subsp bovis AF2122/97
cggguggccggg

SEQ ID NO: 1110637 - RNA, 13 nt, Mycobacterium bovis subsp bovis AF2122/97
cgggugugcaggc

SEQ ID NO: 1110638 - RNA, 18 nt, Mycobacterium bovis subsp bovis AF2122/97
cgggugugcaggccgcgg

SEQ ID NO: 1110639 - RNA, 20 nt, Mycobacterium bovis subsp bovis AF2122/97
cgggugugcgucgagguggc

SEQ ID NO: 1110640 - RNA, 15 nt, Mycobacterium bovis subsp bovis AF2122/97
cggguggcgucaccg

SEQ ID NO: 1110641 - RNA, 20 nt, Mycobacterium bovis subsp bovis AF2122/97
cggguggcgucaccgccggu

SEQ ID NO: 1110642 - RNA, 16 nt, Mycobacterium bovis subsp bovis AF2122/97
cggguggcccggcgaa

SEQ ID NO: 1110643 - RNA, 20 nt, Mycobacterium bovis subsp bovis AF2122/97
cggguggcccccgccggcca

SEQ ID NO: 1110644 - RNA, 17 nt, Mycobacterium bovis subsp bovis AF2122/97
cgggugcgacgcgaccg

SEQ ID NO: 1110645 - RNA, 12 nt, Mycobacterium bovis subsp bovis AF2122/97
cgggugcgaucg

SEQ ID NO: 1110646 - RNA, 17 nt, Mycobacterium bovis subsp bovis AF2122/97
cgggugcgaucgcaaca

SEQ ID NO: 1110647 - RNA, 14 nt, Mycobacterium bovis subsp bovis AF2122/97
cgggugccgagcug

SEQ ID NO: 1110648 - RNA, 12 nt, Mycobacterium bovis subsp bovis AF2122/97
cgggugcgcacc

SEQ ID NO: 1110649 - RNA, 15 nt, Mycobacterium bovis subsp bovis AF2122/97
cgggugcgccggcgu

SEQ ID NO: 1110650 - RNA, 18 nt, Mycobacterium bovis subsp bovis AF2122/97
cgggugcgccguugccgc

SEQ ID NO: 1110651 - RNA, 14 nt, Mycobacterium bovis subsp bovis AF2122/97
cgggugcgcgaggu

SEQ ID NO: 1110652 - RNA, 15 nt, Mycobacterium bovis subsp bovis AF2122/97
cgggugcgcugcagc

SEQ ID NO: 1110653 - RNA, 14 nt, Mycobacterium bovis subsp bovis AF2122/97
cgggugcgggccga

SEQ ID NO: 1110654 - RNA, 15 nt, Mycobacterium bovis subsp bovis AF2122/97
cgggugcggacaccg

SEQ ID NO: 1110655 - RNA, 18 nt, Mycobacterium bovis subsp bovis AF2122/97
cgggugcgugcgcgucgg

SEQ ID NO: 1110656 - RNA, 20 nt, Mycobacterium bovis subsp bovis AF2122/97
cgggugcgugcgcgucggug

SEQ ID NO: 1110657 - RNA, 23 nt, Mycobacterium bovis subsp bovis AF2122/97
cgggugcgugcgcgucggugucg

SEQ ID NO: 1110658 - RNA, 23 nt, Mycobacterium bovis subsp bovis AF2122/97
cgggugcugaugggucaggccga

SEQ ID NO: 1110659 - RNA, 19 nt, Mycobacterium bovis subsp bovis AF2122/97
cgggugcuggucaacagcg

SEQ ID NO: 1110660 - RNA, 23 nt, Mycobacterium bovis subsp bovis AF2122/97
cgggugcuggucaacagcggcaa

SEQ ID NO: 1110661 - RNA, 19 nt, Mycobacterium bovis subsp bovis AF2122/97
cggguggaguuggcugccg

SEQ ID NO: 1110662 - RNA, 13 nt, Mycobacterium bovis subsp bovis AF2122/97
cggguggccacga

SEQ ID NO: 1110663 - RNA, 19 nt, Mycobacterium bovis subsp bovis AF2122/97
cggguggaucuucaccucg

SEQ ID NO: 1110664 - RNA, 22 nt, Mycobacterium bovis subsp bovis AF2122/97
cggguggaucuucaccucgaug

SEQ ID NO: 1110665 - RNA, 15 nt, Mycobacterium bovis subsp bovis AF2122/97
cgguaaucgccaccg

SEQ ID NO: 1110666 - RNA, 14 nt, Mycobacterium bovis subsp bovis AF2122/97
cgguaauggccgcc

SEQ ID NO: 1110667 - RNA, 19 nt, Mycobacterium bovis subsp bovis AF2122/97
cgguacaacccccaggcgc

SEQ ID NO: 1110668 - RNA, 22 nt, Mycobacterium bovis subsp bovis AF2122/97
cggguuuggccgacagccaccg

SEQ ID NO: 1110669 - RNA, 14 nt, Mycobacterium bovis subsp bovis AF2122/97
cgguaacgaacagc

SEQ ID NO: 1110670 - RNA, 18 nt, Mycobacterium bovis subsp bovis AF2122/97
cgguaacgaacagcguca

SEQ ID NO: 1110671 - RNA, 15 nt, Mycobacterium bovis subsp bovis AF2122/97
cgguaagccggcgug

SEQ ID NO: 1110672 - RNA, 13 nt, Mycobacterium bovis subsp bovis AF2122/97
cgguaagcgaaac

SEQ ID NO: 1110673 - RNA, 17 nt, Mycobacterium bovis subsp bovis AF2122/97
cgguaagcgccaaggcg

SEQ ID NO: 1110674 - RNA, 20 nt, Mycobacterium bovis subsp bovis AF2122/97
cgguaaccggcccgaugacc

SEQ ID NO: 1110675 - RNA, 18 nt, Mycobacterium bovis subsp bovis AF2122/97
cgguaacgccaacaccgg

SEQ ID NO: 1110676 - RNA, 19 nt, Mycobacterium bovis subsp bovis AF2122/97
cgguaacgccaacaccggc

SEQ ID NO: 1110677 - RNA, 18 nt, Mycobacterium bovis subsp bovis AF2122/97
cgguaacgccaucgucgg

SEQ ID NO: 1110678 - RNA, 16 nt, Mycobacterium bovis subsp bovis AF2122/97
cggguucaacgcgcgc

SEQ ID NO: 1110679 - RNA, 20 nt, Mycobacterium bovis subsp bovis AF2122/97
cggguucaccgaggugccgc

SEQ ID NO: 1110680 - RNA, 18 nt, Mycobacterium bovis subsp bovis AF2122/97
cggguucacugccggcca

SEQ ID NO: 1110681 - RNA, 14 nt, Mycobacterium bovis subsp bovis AF2122/97
cggguuguggcacc

SEQ ID NO: 1110682 - RNA, 20 nt, Mycobacterium bovis subsp bovis AF2122/97
cggguuggugggucggggcg

SEQ ID NO: 1110683 - RNA, 17 nt, Mycobacterium bovis subsp bovis AF2122/97
cggguuuauccagucga

SEQ ID NO: 1110684 - RNA, 15 nt, Mycobacterium bovis subsp bovis AF2122/97
cggguuugccgggcg

SEQ ID NO: 1110685 - RNA, 13 nt, Mycobacterium bovis subsp bovis AF2122/97
cggguuuggccga

SEQ ID NO: 1110686 - RNA, 16 nt, Mycobacterium bovis subsp bovis AF2122/97
cggguuuggccgacag

SEQ ID NO: 1110687 - RNA, 21 nt, Mycobacterium bovis subsp bovis AF2122/97
cggguuucgcucgcaccgccc

SEQ ID NO: 1110688 - RNA, 20 nt, Mycobacterium bovis subsp bovis AF2122/97
cggguuuucucgccguuggc

SEQ ID NO: 1110689 - RNA, 19 nt, Mycobacterium bovis subsp bovis AF2122/97
cggguuuugcgcggccacc

SEQ ID NO: 1110690 - RNA, 14 nt, Mycobacterium bovis subsp bovis AF2122/97
cgguaaaccacucg

SEQ ID NO: 1110691 - RNA, 19 nt, Mycobacterium bovis subsp bovis AF2122/97
cggucccggacgugccggg

SEQ ID NO: 1110692 - RNA, 13 nt, Mycobacterium bovis subsp bovis AF2122/97
cggucccggcacg

SEQ ID NO: 1110693 - RNA, 19 nt, Mycobacterium bovis subsp bovis AF2122/97
cggucccggcacgucgacc

SEQ ID NO: 1110694 - RNA, 17 nt, Mycobacterium bovis subsp bovis AF2122/97
cgguccccgcagcucga

SEQ ID NO: 1110695 - RNA, 16 nt, Mycobacterium bovis subsp bovis AF2122/97
cgguccccgccggcgg

SEQ ID NO: 1110696 - RNA, 18 nt, Mycobacterium bovis subsp bovis AF2122/97
cgguccccgccggcgggu

SEQ ID NO: 1110697 - RNA, 16 nt, Mycobacterium bovis subsp bovis AF2122/97
cggucccacggccggc

SEQ ID NO: 1110698 - RNA, 18 nt, Mycobacterium bovis subsp bovis AF2122/97
cggucccacggccggccg

SEQ ID NO: 1110699 - RNA, 15 nt, Mycobacterium bovis subsp bovis AF2122/97
cggucccacucgucg

SEQ ID NO: 1110700 - RNA, 22 nt, Mycobacterium bovis subsp bovis AF2122/97
cggucccacugccggugcugag

SEQ ID NO: 1110701 - RNA, 21 nt, Mycobacterium bovis subsp bovis AF2122/97
cggucccagguuggagcccga

SEQ ID NO: 1110702 - RNA, 19 nt, Mycobacterium bovis subsp bovis AF2122/97
cgguccccccguugccgcc

SEQ ID NO: 1110703 - RNA, 20 nt, Mycobacterium bovis subsp bovis AF2122/97
cgguccccccguugccgccg

SEQ ID NO: 1110704 - RNA, 17 nt, Mycobacterium bovis subsp bovis AF2122/97
cgguccaggccggcacc

SEQ ID NO: 1110705 - RNA, 17 nt, Mycobacterium bovis subsp bovis AF2122/97
cgguccagcccagcgcg

SEQ ID NO: 1110706 - RNA, 16 nt, Mycobacterium bovis subsp bovis AF2122/97
cgguccagggccuguu

SEQ ID NO: 1110707 - RNA, 12 nt, Mycobacterium bovis subsp bovis AF2122/97
cgguccaucagc

SEQ ID NO: 1110708 - RNA, 17 nt, Mycobacterium bovis subsp bovis AF2122/97
cgguccaucagcacggu

SEQ ID NO: 1110709 - RNA, 19 nt, Mycobacterium bovis subsp bovis AF2122/97
cgguccauggacggccagg

SEQ ID NO: 1110710 - RNA, 13 nt, Mycobacterium bovis subsp bovis AF2122/97
cgguccauucguc

SEQ ID NO: 1110711 - RNA, 17 nt, Mycobacterium bovis subsp bovis AF2122/97
cgguccaaucgccgggu

SEQ ID NO: 1110712 - RNA, 13 nt, Mycobacterium bovis subsp bovis AF2122/97
cgguccaacccga

SEQ ID NO: 1110713 - RNA, 19 nt, Mycobacterium bovis subsp bovis AF2122/97
cgguccaaucgccgggugc

SEQ ID NO: 1110714 - RNA, 22 nt, Mycobacterium bovis subsp bovis AF2122/97
cgguccaccgaccuaccgucga

SEQ ID NO: 1110715 - RNA, 17 nt, Mycobacterium bovis subsp bovis AF2122/97
cgguccaacagcgccag

SEQ ID NO: 1110716 - RNA, 17 nt, Mycobacterium bovis subsp bovis AF2122/97
cgguccaaaacaccgcc

SEQ ID NO: 1110717 - RNA, 19 nt, Mycobacterium bovis subsp bovis AF2122/97
cggucaugucggccaccgg

SEQ ID NO: 1110718 - RNA, 19 nt, Mycobacterium bovis subsp bovis AF2122/97
cggucauguccguccgcga

SEQ ID NO: 1110719 - RNA, 14 nt, Mycobacterium bovis subsp bovis AF2122/97
cgguccagcgccgg

SEQ ID NO: 1110720 - RNA, 15 nt, Mycobacterium bovis subsp bovis AF2122/97
cgguccagcgccgga

SEQ ID NO: 1110721 - RNA, 14 nt, Mycobacterium bovis subsp bovis AF2122/97
cgguccagcggccg

SEQ ID NO: 1110722 - RNA, 19 nt, Mycobacterium bovis subsp bovis AF2122/97
cgguccagcggccgccgcg

SEQ ID NO: 1110723 - RNA, 20 nt, Mycobacterium bovis subsp bovis AF2122/97
cgguccagcggccgccgcgg

SEQ ID NO: 1110724 - RNA, 19 nt, Mycobacterium bovis subsp bovis AF2122/97
cgguccagcgucgccgcca

SEQ ID NO: 1110725 - RNA, 14 nt, Mycobacterium bovis subsp bovis AF2122/97
cgguccagccaccg

SEQ ID NO: 1110726 - RNA, 15 nt, Mycobacterium bovis subsp bovis AF2122/97
cgguccagacccagc

SEQ ID NO: 1110727 - RNA, 20 nt, Mycobacterium bovis subsp bovis AF2122/97
cgguccaccggcccucgcca

SEQ ID NO: 1110728 - RNA, 16 nt, Mycobacterium bovis subsp bovis AF2122/97
cgguccacgacgucga

SEQ ID NO: 1110729 - RNA, 22 nt, Mycobacterium bovis subsp bovis AF2122/97
cggucgacagcgaaggcgccga

SEQ ID NO: 1110730 - RNA, 14 nt, Mycobacterium bovis subsp bovis AF2122/97
cggucgacagcgca

SEQ ID NO: 1110731 - RNA, 15 nt, Mycobacterium bovis subsp bovis AF2122/97
cggucgacgaucucg

SEQ ID NO: 1110732 - RNA, 19 nt, Mycobacterium bovis subsp bovis AF2122/97
cgguccggcccaccagcgc

SEQ ID NO: 1110733 - RNA, 17 nt, Mycobacterium bovis subsp bovis AF2122/97
cggucgacgaugacggu

SEQ ID NO: 1110734 - RNA, 16 nt, Mycobacterium bovis subsp bovis AF2122/97
cggucgacgggucggc

SEQ ID NO: 1110735 - RNA, 19 nt, Mycobacterium bovis subsp bovis AF2122/97
cggucgacgggucggcgcc

SEQ ID NO: 1110736 - RNA, 22 nt, Mycobacterium bovis subsp bovis AF2122/97
cggucgacgggucggcgccgag

SEQ ID NO: 1110737 - RNA, 15 nt, Mycobacterium bovis subsp bovis AF2122/97
cggucgacuccagca

SEQ ID NO: 1110738 - RNA, 17 nt, Mycobacterium bovis subsp bovis AF2122/97
cggucgacuccagcacc

SEQ ID NO: 1110739 - RNA, 13 nt, Mycobacterium bovis subsp bovis AF2122/97
cgguccucgaucg

SEQ ID NO: 1110740 - RNA, 18 nt, Mycobacterium bovis subsp bovis AF2122/97
cgguccugggauccggcg

SEQ ID NO: 1110741 - RNA, 12 nt, Mycobacterium bovis subsp bovis AF2122/97
cgguccggucgc

SEQ ID NO: 1110742 - RNA, 13 nt, Mycobacterium bovis subsp bovis AF2122/97
cgguccugcucgc

SEQ ID NO: 1110743 - RNA, 22 nt, Mycobacterium bovis subsp bovis AF2122/97
cgguccggcuucggcgaacccu

SEQ ID NO: 1110744 - RNA, 20 nt, Mycobacterium bovis subsp bovis AF2122/97
cgguccggaaauuccggcgc

SEQ ID NO: 1110745 - RNA, 16 nt, Mycobacterium bovis subsp bovis AF2122/97
cgguccggcccaccag

SEQ ID NO: 1110746 - RNA, 17 nt, Mycobacterium bovis subsp bovis AF2122/97
cgguccggcccaccagc

SEQ ID NO: 1110747 - RNA, 16 nt, Mycobacterium bovis subsp bovis AF2122/97
cgguccggggcaacga

SEQ ID NO: 1110748 - RNA, 22 nt, Mycobacterium bovis subsp bovis AF2122/97
cgguccggggcaacgaucaggu

SEQ ID NO: 1110749 - RNA, 18 nt, Mycobacterium bovis subsp bovis AF2122/97
cgguccgcugccaucggc

SEQ ID NO: 1110750 - RNA, 22 nt, Mycobacterium bovis subsp bovis AF2122/97
cgguccgcugccaucggcacca

SEQ ID NO: 1110751 - RNA, 18 nt, Mycobacterium bovis subsp bovis AF2122/97
cgguccgagcggcaucgg

SEQ ID NO: 1110752 - RNA, 13 nt, Mycobacterium bovis subsp bovis AF2122/97
cgguccgccacgg

SEQ ID NO: 1110753 - RNA, 23 nt, Mycobacterium bovis subsp bovis AF2122/97
cgguccgccacggcgggcgaccc

SEQ ID NO: 1110754 - RNA, 12 nt, Mycobacterium bovis subsp bovis AF2122/97
cgguccgccauu

SEQ ID NO: 1110755 - RNA, 19 nt, Mycobacterium bovis subsp bovis AF2122/97
cggucccgccgugccgcgg

SEQ ID NO: 1110756 - RNA, 16 nt, Mycobacterium bovis subsp bovis AF2122/97
cggucccgcggaccgc

SEQ ID NO: 1110757 - RNA, 15 nt, Mycobacterium bovis subsp bovis AF2122/97
cggucccgccgaccg

SEQ ID NO: 1110758 - RNA, 13 nt, Mycobacterium bovis subsp bovis AF2122/97
cggucccgccgug

SEQ ID NO: 1110759 - RNA, 15 nt, Mycobacterium bovis subsp bovis AF2122/97
cggucccguugccgc

SEQ ID NO: 1110760 - RNA, 15 nt, Mycobacterium bovis subsp bovis AF2122/97
cggucccugcgccgu

SEQ ID NO: 1110761 - RNA, 17 nt, Mycobacterium bovis subsp bovis AF2122/97
cggucccuuuguggggc

SEQ ID NO: 1110762 - RNA, 20 nt, Mycobacterium bovis subsp bovis AF2122/97
cggucccuuuguggggccgg

SEQ ID NO: 1110763 - RNA, 23 nt, Mycobacterium bovis subsp bovis AF2122/97
cggucccuuuguggggccgggcu

SEQ ID NO: 1110764 - RNA, 19 nt, Mycobacterium bovis subsp bovis AF2122/97
cggucagcucggcagcauc

SEQ ID NO: 1110765 - RNA, 15 nt, Mycobacterium bovis subsp bovis AF2122/97
cggucagcucgucgg

SEQ ID NO: 1110766 - RNA, 19 nt, Mycobacterium bovis subsp bovis AF2122/97
cggucaggcucauccgccg

SEQ ID NO: 1110767 - RNA, 13 nt, Mycobacterium bovis subsp bovis AF2122/97
cggucaggauggg

SEQ ID NO: 1110768 - RNA, 15 nt, Mycobacterium bovis subsp bovis AF2122/97
cggucaggccgccgc

SEQ ID NO: 1110769 - RNA, 16 nt, Mycobacterium bovis subsp bovis AF2122/97
cggucaggccgccgcg

SEQ ID NO: 1110770 - RNA, 17 nt, Mycobacterium bovis subsp bovis AF2122/97
cggucaggccgccgcgg

SEQ ID NO: 1110771 - RNA, 21 nt, Mycobacterium bovis subsp bovis AF2122/97
cggucaucccuuucgcgccgc

SEQ ID NO: 1110772 - RNA, 16 nt, Mycobacterium bovis subsp bovis AF2122/97
cggucauccggccguc

SEQ ID NO: 1110773 - RNA, 18 nt, Mycobacterium bovis subsp bovis AF2122/97
cggucauccggccgucgg

SEQ ID NO: 1110774 - RNA, 14 nt, Mycobacterium bovis subsp bovis AF2122/97
cggucauccgggcg

SEQ ID NO: 1110775 - RNA, 22 nt, Mycobacterium bovis subsp bovis AF2122/97
cggucauccgggcgaccaccac

SEQ ID NO: 1110776 - RNA, 14 nt, Mycobacterium bovis subsp bovis AF2122/97
cggucaugccgccg

SEQ ID NO: 1110777 - RNA, 16 nt, Mycobacterium bovis subsp bovis AF2122/97
cggucaugccgccgcc

SEQ ID NO: 1110778 - RNA, 18 nt, Mycobacterium bovis subsp bovis AF2122/97
cggucaugccgccgccga

SEQ ID NO: 1110779 - RNA, 15 nt, Mycobacterium bovis subsp bovis AF2122/97
cggucauggcgacgg

SEQ ID NO: 1110780 - RNA, 17 nt, Mycobacterium bovis subsp bovis AF2122/97
cggucauggcgacgguc

SEQ ID NO: 1110781 - RNA, 16 nt, Mycobacterium bovis subsp bovis AF2122/97
cggucaggucgagguc

SEQ ID NO: 1110782 - RNA, 22 nt, Mycobacterium bovis subsp bovis AF2122/97
cggucaggucugacagaccggg

SEQ ID NO: 1110783 - RNA, 18 nt, Mycobacterium bovis subsp bovis AF2122/97
cggucaguauggcgacga

SEQ ID NO: 1110784 - RNA, 19 nt, Mycobacterium bovis subsp bovis AF2122/97
cggucagguacaucccggu

SEQ ID NO: 1110785 - RNA, 16 nt, Mycobacterium bovis subsp bovis AF2122/97
cggucagugggacggg

SEQ ID NO: 1110786 - RNA, 18 nt, Mycobacterium bovis subsp bovis AF2122/97
cggucaucccuuucgcgc

SEQ ID NO: 1110787 - RNA, 13 nt, Mycobacterium bovis subsp bovis AF2122/97
cggucagcggcca

SEQ ID NO: 1110788 - RNA, 19 nt, Mycobacterium bovis subsp bovis AF2122/97
cggucagcggccaacccau

SEQ ID NO: 1110789 - RNA, 17 nt, Mycobacterium bovis subsp bovis AF2122/97
cggucagcggcucggcg

SEQ ID NO: 1110790 - RNA, 22 nt, Mycobacterium bovis subsp bovis AF2122/97
cggucagcgggcacgccgccga

SEQ ID NO: 1110791 - RNA, 19 nt, Mycobacterium bovis subsp bovis AF2122/97
cggucagcggauccaggcc

SEQ ID NO: 1110792 - RNA, 18 nt, Mycobacterium bovis subsp bovis AF2122/97
cggucagcgcggcgaccu

SEQ ID NO: 1110793 - RNA, 16 nt, Mycobacterium bovis subsp bovis AF2122/97
cggucagcgcggcgca

SEQ ID NO: 1110794 - RNA, 17 nt, Mycobacterium bovis subsp bovis AF2122/97
cggucagcgcggcgcac

SEQ ID NO: 1110795 - RNA, 22 nt, Mycobacterium bovis subsp bovis AF2122/97
cggucagcaccuccaccgcgcc

SEQ ID NO: 1110796 - RNA, 23 nt, Mycobacterium bovis subsp bovis AF2122/97
cgguaggcaggccggcucgccga

SEQ ID NO: 1110797 - RNA, 16 nt, Mycobacterium bovis subsp bovis AF2122/97
cgguaccaucaccgcg

SEQ ID NO: 1110798 - RNA, 17 nt, Mycobacterium bovis subsp bovis AF2122/97
cgguaccccagcgcugu

SEQ ID NO: 1110799 - RNA, 21 nt, Mycobacterium bovis subsp bovis AF2122/97
cgguaccaaccugcgcggcga

SEQ ID NO: 1110800 - RNA, 19 nt, Mycobacterium bovis subsp bovis AF2122/97
cgguagccuggcuguccgc

SEQ ID NO: 1110801 - RNA, 20 nt, Mycobacterium bovis subsp bovis AF2122/97
cgguagcgaucgugcugccc

SEQ ID NO: 1110802 - RNA, 18 nt, Mycobacterium bovis subsp bovis AF2122/97
cgguagcgcggguggcuc

SEQ ID NO: 1110803 - RNA, 14 nt, Mycobacterium bovis subsp bovis AF2122/97
cgguagcucgucga

SEQ ID NO: 1110804 - RNA, 22 nt, Mycobacterium bovis subsp bovis AF2122/97
cgguagcuuccgcgacgcucgc

SEQ ID NO: 1110805 - RNA, 18 nt, Mycobacterium bovis subsp bovis AF2122/97
cgguagcugcccagcguc

SEQ ID NO: 1110806 - RNA, 19 nt, Mycobacterium bovis subsp bovis AF2122/97
cggucgccaccgccggcag

SEQ ID NO: 1110807 - RNA, 21 nt, Mycobacterium bovis subsp bovis AF2122/97
cggucgccaccgccggcagca

SEQ ID NO: 1110808 - RNA, 14 nt, Mycobacterium bovis subsp bovis AF2122/97
cggucgccaccgug

SEQ ID NO: 1110809 - RNA, 20 nt, Mycobacterium bovis subsp bovis AF2122/97
cggucgccaagaucgggugg

SEQ ID NO: 1110810 - RNA, 16 nt, Mycobacterium bovis subsp bovis AF2122/97
cggucgccaccguguc

SEQ ID NO: 1110811 - RNA, 12 nt, Mycobacterium bovis subsp bovis AF2122/97
cggucgccgacc

SEQ ID NO: 1110812 - RNA, 17 nt, Mycobacterium bovis subsp bovis AF2122/97
cggucgccgaccacucg

SEQ ID NO: 1110813 - RNA, 13 nt, Mycobacterium bovis subsp bovis AF2122/97
cggucgccgacgg

SEQ ID NO: 1110814 - RNA, 16 nt, Mycobacterium bovis subsp bovis AF2122/97
cggucgccgacggcga

SEQ ID NO: 1110815 - RNA, 13 nt, Mycobacterium bovis subsp bovis AF2122/97
cggucgccgcgcg

SEQ ID NO: 1110816 - RNA, 20 nt, Mycobacterium bovis subsp bovis AF2122/97
cggucgccggucaucgccga

SEQ ID NO: 1110817 - RNA, 22 nt, Mycobacterium bovis subsp bovis AF2122/97
cggucgccaccgugucacgcga

SEQ ID NO: 1110818 - RNA, 13 nt, Mycobacterium bovis subsp bovis AF2122/97
cggucgccggcug

SEQ ID NO: 1110819 - RNA, 16 nt, Mycobacterium bovis subsp bovis AF2122/97
cggucgaggucggcga

SEQ ID NO: 1110820 - RNA, 21 nt, Mycobacterium bovis subsp bovis AF2122/97
cggucgagguggcgggcgaug

SEQ ID NO: 1110821 - RNA, 23 nt, Mycobacterium bovis subsp bovis AF2122/97
cggucgagugccucgaccuggau

SEQ ID NO: 1110822 - RNA, 22 nt, Mycobacterium bovis subsp bovis AF2122/97
cggucgaguagccguagccgcc

SEQ ID NO: 1110823 - RNA, 16 nt, Mycobacterium bovis subsp bovis AF2122/97
cggucgagccagcgga

SEQ ID NO: 1110824 - RNA, 21 nt, Mycobacterium bovis subsp bovis AF2122/97
cggucgaucacacgguccgcc

SEQ ID NO: 1110825 - RNA, 16 nt, Mycobacterium bovis subsp bovis AF2122/97
cggucgaucaacacca

SEQ ID NO: 1110826 - RNA, 19 nt, Mycobacterium bovis subsp bovis AF2122/97
cggucgaucaacaccaacg

SEQ ID NO: 1110827 - RNA, 18 nt, Mycobacterium bovis subsp bovis AF2122/97
cggucgaugaccucguca

SEQ ID NO: 1110828 - RNA, 12 nt, Mycobacterium bovis subsp bovis AF2122/97
cggucgaugacc

SEQ ID NO: 1110829 - RNA, 20 nt, Mycobacterium bovis subsp bovis AF2122/97
cggucgaucauggcggcagc

SEQ ID NO: 1110830 - RNA, 19 nt, Mycobacterium bovis subsp bovis AF2122/97
cggucgaguccacagcgca

SEQ ID NO: 1110831 - RNA, 18 nt, Mycobacterium bovis subsp bovis AF2122/97
cggucgauguccgcagca

SEQ ID NO: 1110832 - RNA, 22 nt, Mycobacterium bovis subsp bovis AF2122/97
cggucgaugaucucgccccagu

SEQ ID NO: 1110833 - RNA, 16 nt, Mycobacterium bovis subsp bovis AF2122/97
cggucgccaccgccgg

SEQ ID NO: 1110834 - RNA, 20 nt, Mycobacterium bovis subsp bovis AF2122/97
cggucgcauggucgacgaac

SEQ ID NO: 1110835 - RNA, 18 nt, Mycobacterium bovis subsp bovis AF2122/97
cggucgcacuuggccccc

SEQ ID NO: 1110836 - RNA, 18 nt, Mycobacterium bovis subsp bovis AF2122/97
cggucgcauggucgacga

SEQ ID NO: 1110837 - RNA, 13 nt, Mycobacterium bovis subsp bovis AF2122/97
cggucggccacca

SEQ ID NO: 1110838 - RNA, 19 nt, Mycobacterium bovis subsp bovis AF2122/97
cggucggcagcgacgccgg

SEQ ID NO: 1110839 - RNA, 17 nt, Mycobacterium bovis subsp bovis AF2122/97
cggucggcagcuccagc

SEQ ID NO: 1110840 - RNA, 14 nt, Mycobacterium bovis subsp bovis AF2122/97
cggucggcagcuuc

SEQ ID NO: 1110841 - RNA, 19 nt, Mycobacterium bovis subsp bovis AF2122/97
cggucggcagcuucucgcc

SEQ ID NO: 1110842 - RNA, 19 nt, Mycobacterium bovis subsp bovis AF2122/97
cggucggccaccaacucgg

SEQ ID NO: 1110843 - RNA, 23 nt, Mycobacterium bovis subsp bovis AF2122/97
cggucggccaccaacucggcgac

SEQ ID NO: 1110844 - RNA, 15 nt, Mycobacterium bovis subsp bovis AF2122/97
cggucggccaggccg

SEQ ID NO: 1110845 - RNA, 23 nt, Mycobacterium bovis subsp bovis AF2122/97
cggucggacggccaucgccagcc

SEQ ID NO: 1110846 - RNA, 17 nt, Mycobacterium bovis subsp bovis AF2122/97
cggucggaguaagcgau

SEQ ID NO: 1110847 - RNA, 17 nt, Mycobacterium bovis subsp bovis AF2122/97
cggucggaucggcgccg

SEQ ID NO: 1110848 - RNA, 15 nt, Mycobacterium bovis subsp bovis AF2122/97
cggucggcaccacca

SEQ ID NO: 1110849 - RNA, 15 nt, Mycobacterium bovis subsp bovis AF2122/97
cggucggcaccaggu

SEQ ID NO: 1110850 - RNA, 22 nt, Mycobacterium bovis subsp bovis AF2122/97
cggucggagcggugccgacggu

SEQ ID NO: 1110851 - RNA, 13 nt, Mycobacterium bovis subsp bovis AF2122/97
cggucgcggcggu

SEQ ID NO: 1110852 - RNA, 16 nt, Mycobacterium bovis subsp bovis AF2122/97
cggucgcuucagcgcc

SEQ ID NO: 1110853 - RNA, 23 nt, Mycobacterium bovis subsp bovis AF2122/97
cggucggccugcgaacacgcgau

SEQ ID NO: 1110854 - RNA, 21 nt, Mycobacterium bovis subsp bovis AF2122/97
cggucggccugcggcaacggc

SEQ ID NO: 1110855 - RNA, 16 nt, Mycobacterium bovis subsp bovis AF2122/97
cggucggcgaccacca

SEQ ID NO: 1110856 - RNA, 18 nt, Mycobacterium bovis subsp bovis AF2122/97
cggucggcgaccaccagc

SEQ ID NO: 1110857 - RNA, 23 nt, Mycobacterium bovis subsp bovis AF2122/97
cggucggcagcuucucgccgacg

SEQ ID NO: 1110858 - RNA, 24 nt, Mycobacterium bovis subsp bovis AF2122/97
cggucggcagcuucucgccgacga

SEQ ID NO: 1110859 - RNA, 19 nt, Mycobacterium bovis subsp bovis AF2122/97
cggucggccauccaccgca

SEQ ID NO: 1110860 - RNA, 15 nt, Mycobacterium bovis subsp bovis AF2122/97
cggucggccggcucg

SEQ ID NO: 1110861 - RNA, 17 nt, Mycobacterium bovis subsp bovis AF2122/97
cggucgcguaccggugg

SEQ ID NO: 1110862 - RNA, 22 nt, Mycobacterium bovis subsp bovis AF2122/97
cggucgccuggaagaucacgcg

SEQ ID NO: 1110863 - RNA, 20 nt, Mycobacterium bovis subsp bovis AF2122/97
cggucgcgcccucagccgcg

SEQ ID NO: 1110864 - RNA, 19 nt, Mycobacterium bovis subsp bovis AF2122/97
cggucgcgcgacggccggg

SEQ ID NO: 1110865 - RNA, 16 nt, Mycobacterium bovis subsp bovis AF2122/97
cggucgcuauccggcg

SEQ ID NO: 1110866 - RNA, 19 nt, Mycobacterium bovis subsp bovis AF2122/97
cggucgcuauccggcggcc

SEQ ID NO: 1110867 - RNA, 20 nt, Mycobacterium bovis subsp bovis AF2122/97
cggucgcuauccggcggcca

SEQ ID NO: 1110868 - RNA, 20 nt, Mycobacterium bovis subsp bovis AF2122/97
cggucgcugcgaugcugauc

SEQ ID NO: 1110869 - RNA, 20 nt, Mycobacterium bovis subsp bovis AF2122/97
cggucgcggagcgugagcca

SEQ ID NO: 1110870 - RNA, 17 nt, Mycobacterium bovis subsp bovis AF2122/97
cggucgcuguccacugc

SEQ ID NO: 1110871 - RNA, 15 nt, Mycobacterium bovis subsp bovis AF2122/97
cggucgcuugcuguc

SEQ ID NO: 1110872 - RNA, 22 nt, Mycobacterium bovis subsp bovis AF2122/97
cggucguccccgucgcuggccg

SEQ ID NO: 1110873 - RNA, 16 nt, Mycobacterium bovis subsp bovis AF2122/97
cggucguccggaucgg

SEQ ID NO: 1110874 - RNA, 16 nt, Mycobacterium bovis subsp bovis AF2122/97
cggucgguaacggcgg

SEQ ID NO: 1110875 - RNA, 19 nt, Mycobacterium bovis subsp bovis AF2122/97
cggucggugagccgugccg

SEQ ID NO: 1110876 - RNA, 23 nt, Mycobacterium bovis subsp bovis AF2122/97
cggucggcgaccaccagcgccga

SEQ ID NO: 1110877 - RNA, 15 nt, Mycobacterium bovis subsp bovis AF2122/97
cggucggugagccgu

SEQ ID NO: 1110878 - RNA, 13 nt, Mycobacterium bovis subsp bovis AF2122/97
cggucggucucgg

SEQ ID NO: 1110879 - RNA, 16 nt, Mycobacterium bovis subsp bovis AF2122/97
cggucggucucggcga

SEQ ID NO: 1110880 - RNA, 18 nt, Mycobacterium bovis subsp bovis AF2122/97
cggucggugaacccgccg

SEQ ID NO: 1110881 - RNA, 15 nt, Mycobacterium bovis subsp bovis AF2122/97
cggucgggcccggcg

SEQ ID NO: 1110882 - RNA, 22 nt, Mycobacterium bovis subsp bovis AF2122/97
cggucggcgacguauaccgcac

SEQ ID NO: 1110883 - RNA, 21 nt, Mycobacterium bovis subsp bovis AF2122/97
cggucggcgucgagauagucg

SEQ ID NO: 1110884 - RNA, 13 nt, Mycobacterium bovis subsp bovis AF2122/97
cggucggcgggca

SEQ ID NO: 1110885 - RNA, 19 nt, Mycobacterium bovis subsp bovis AF2122/97
cggucggcgguagccgacc

SEQ ID NO: 1110886 - RNA, 17 nt, Mycobacterium bovis subsp bovis AF2122/97
cggucgggggcagcgcc

SEQ ID NO: 1110887 - RNA, 18 nt, Mycobacterium bovis subsp bovis AF2122/97
cggucgugccccgcgguc

SEQ ID NO: 1110888 - RNA, 23 nt, Mycobacterium bovis subsp bovis AF2122/97
cggucgugccggggcugccgaac

SEQ ID NO: 1110889 - RNA, 23 nt, Mycobacterium bovis subsp bovis AF2122/97
cggucguagcuuccgguccagcg

SEQ ID NO: 1110890 - RNA, 17 nt, Mycobacterium bovis subsp bovis AF2122/97
cggucguuggucggggu

SEQ ID NO: 1110891 - RNA, 16 nt, Mycobacterium bovis subsp bovis AF2122/97
cggucguugccgaccg

SEQ ID NO: 1110892 - RNA, 17 nt, Mycobacterium bovis subsp bovis AF2122/97
cggucguugccgaccga

SEQ ID NO: 1110893 - RNA, 17 nt, Mycobacterium bovis subsp bovis AF2122/97
cggucucgcaccagucg

SEQ ID NO: 1110894 - RNA, 18 nt, Mycobacterium bovis subsp bovis AF2122/97
cggucucgacggcggccg

SEQ ID NO: 1110895 - RNA, 15 nt, Mycobacterium bovis subsp bovis AF2122/97
cggucucgaccgcgc

SEQ ID NO: 1110896 - RNA, 16 nt, Mycobacterium bovis subsp bovis AF2122/97
cggucucacggcgcga

SEQ ID NO: 1110897 - RNA, 17 nt, Mycobacterium bovis subsp bovis AF2122/97
cggucucagugcucgcc

SEQ ID NO: 1110898 - RNA, 21 nt, Mycobacterium bovis subsp bovis AF2122/97
cggucucagugcucgcccagu

SEQ ID NO: 1110899 - RNA, 14 nt, Mycobacterium bovis subsp bovis AF2122/97
cggucuccaccacc

SEQ ID NO: 1110900 - RNA, 22 nt, Mycobacterium bovis subsp bovis AF2122/97
cggucugcagaucguagugcgc

SEQ ID NO: 1110901 - RNA, 13 nt, Mycobacterium bovis subsp bovis AF2122/97
cggucugcaugcg

SEQ ID NO: 1110902 - RNA, 18 nt, Mycobacterium bovis subsp bovis AF2122/97
cggucugcuccaggcgcg

SEQ ID NO: 1110903 - RNA, 19 nt, Mycobacterium bovis subsp bovis AF2122/97
cggucugcuccaggcgcgc

SEQ ID NO: 1110904 - RNA, 22 nt, Mycobacterium bovis subsp bovis AF2122/97
cggucugcuccaggcgcgccgc

SEQ ID NO: 1110905 - RNA, 21 nt, Mycobacterium bovis subsp bovis AF2122/97
cggucugcuccuuggcccagc

SEQ ID NO: 1110906 - RNA, 15 nt, Mycobacterium bovis subsp bovis AF2122/97
cggucugcuccaggc

SEQ ID NO: 1110907 - RNA, 16 nt, Mycobacterium bovis subsp bovis AF2122/97
cggucucgucgcgggu

SEQ ID NO: 1110908 - RNA, 23 nt, Mycobacterium bovis subsp bovis AF2122/97
cggucugagacucgucgaugcgg

SEQ ID NO: 1110909 - RNA, 20 nt, Mycobacterium bovis subsp bovis AF2122/97
cggucugcaugcgcuggaau

SEQ ID NO: 1110910 - RNA, 18 nt, Mycobacterium bovis subsp bovis AF2122/97
cggucuuacggucggcuc

SEQ ID NO: 1110911 - RNA, 21 nt, Mycobacterium bovis subsp bovis AF2122/97
cggucugcgccaaaauccgcc

SEQ ID NO: 1110912 - RNA, 15 nt, Mycobacterium bovis subsp bovis AF2122/97
cggucugguggucgg

SEQ ID NO: 1110913 - RNA, 18 nt, Mycobacterium bovis subsp bovis AF2122/97
cggucugguggucggcga

SEQ ID NO: 1110914 - RNA, 15 nt, Mycobacterium bovis subsp bovis AF2122/97
cggugaacccgccgg

SEQ ID NO: 1110915 - RNA, 19 nt, Mycobacterium bovis subsp bovis AF2122/97
cggugaaaucgcacagcgc

SEQ ID NO: 1110916 - RNA, 14 nt, Mycobacterium bovis subsp bovis AF2122/97
cggugaacaccagc

SEQ ID NO: 1110917 - RNA, 18 nt, Mycobacterium bovis subsp bovis AF2122/97
cggugaacaccagcagga

SEQ ID NO: 1110918 - RNA, 21 nt, Mycobacterium bovis subsp bovis AF2122/97
cggugaacgucacguggucgg

SEQ ID NO: 1110919 - RNA, 22 nt, Mycobacterium bovis subsp bovis AF2122/97
cggugaacgucacguggucggc

SEQ ID NO: 1110920 - RNA, 19 nt, Mycobacterium bovis subsp bovis AF2122/97
cggugaacggcagcacggu

SEQ ID NO: 1110921 - RNA, 15 nt, Mycobacterium bovis subsp bovis AF2122/97
cggugaacaccgccu

SEQ ID NO: 1110922 - RNA, 14 nt, Mycobacterium bovis subsp bovis AF2122/97
cggugaacgccgcc

SEQ ID NO: 1110923 - RNA, 21 nt, Mycobacterium bovis subsp bovis AF2122/97
cggugaacuucuccaccagcg

SEQ ID NO: 1110924 - RNA, 22 nt, Mycobacterium bovis subsp bovis AF2122/97
cggucuugcaucgccaaugcgg

SEQ ID NO: 1110925 - RNA, 16 nt, Mycobacterium bovis subsp bovis AF2122/97
cggucuuggcgaucca

SEQ ID NO: 1110926 - RNA, 18 nt, Mycobacterium bovis subsp bovis AF2122/97
cggucuuggcgcgcccau

SEQ ID NO: 1110927 - RNA, 19 nt, Mycobacterium bovis subsp bovis AF2122/97
cggucuuuaauccagcgcc

SEQ ID NO: 1110928 - RNA, 22 nt, Mycobacterium bovis subsp bovis AF2122/97
cggucuuuaauccagcgccgac

SEQ ID NO: 1110929 - RNA, 23 nt, Mycobacterium bovis subsp bovis AF2122/97
cggucugcgccaaaauccgccca

SEQ ID NO: 1110930 - RNA, 17 nt, Mycobacterium bovis subsp bovis AF2122/97
cggucuuugagccggua

SEQ ID NO: 1110931 - RNA, 18 nt, Mycobacterium bovis subsp bovis AF2122/97
cggucuuuguccgucgcg

SEQ ID NO: 1110932 - RNA, 19 nt, Mycobacterium bovis subsp bovis AF2122/97
cggucuuuguccgucgcgu

SEQ ID NO: 1110933 - RNA, 14 nt, Mycobacterium bovis subsp bovis AF2122/97
cggccgucgggacg

SEQ ID NO: 1110934 - RNA, 12 nt, Mycobacterium bovis subsp bovis AF2122/97
cggccgucggga

SEQ ID NO: 1110935 - RNA, 13 nt, Mycobacterium bovis subsp bovis AF2122/97
cggccgucgucgg

SEQ ID NO: 1110936 - RNA, 16 nt, Mycobacterium bovis subsp bovis AF2122/97
cggccgucgucggcca

SEQ ID NO: 1110937 - RNA, 15 nt, Mycobacterium bovis subsp bovis AF2122/97
cggccgucggcgggc

SEQ ID NO: 1110938 - RNA, 13 nt, Mycobacterium bovis subsp bovis AF2122/97
cggccgugccgcc

SEQ ID NO: 1110939 - RNA, 21 nt, Mycobacterium bovis subsp bovis AF2122/97
cggccgugaauucgccgaacg

SEQ ID NO: 1110940 - RNA, 22 nt, Mycobacterium bovis subsp bovis AF2122/97
cggccgugaauucgccgaacgg

SEQ ID NO: 1110941 - RNA, 20 nt, Mycobacterium bovis subsp bovis AF2122/97
cggccgugaccgagccgcga

SEQ ID NO: 1110942 - RNA, 12 nt, Mycobacterium bovis subsp bovis AF2122/97
cggccucgcugc

SEQ ID NO: 1110943 - RNA, 17 nt, Mycobacterium bovis subsp bovis AF2122/97
cggccucgggcucaaac

SEQ ID NO: 1110944 - RNA, 12 nt, Mycobacterium bovis subsp bovis AF2122/97
cggccucgucga

SEQ ID NO: 1110945 - RNA, 22 nt, Mycobacterium bovis subsp bovis AF2122/97
cggccucguagucccacugcca

SEQ ID NO: 1110946 - RNA, 17 nt, Mycobacterium bovis subsp bovis AF2122/97
cggccucgucgaguucc

SEQ ID NO: 1110947 - RNA, 12 nt, Mycobacterium bovis subsp bovis AF2122/97
cggccugcgagu

SEQ ID NO: 1110948 - RNA, 13 nt, Mycobacterium bovis subsp bovis AF2122/97
cggccugcgccgg

SEQ ID NO: 1110949 - RNA, 19 nt, Mycobacterium bovis subsp bovis AF2122/97
cggccugcgcgaccgacca

SEQ ID NO: 1110950 - RNA, 15 nt, Mycobacterium bovis subsp bovis AF2122/97
cggccucggcgagca

SEQ ID NO: 1110951 - RNA, 17 nt, Mycobacterium bovis subsp bovis AF2122/97
cggccugcgccggcgcu

SEQ ID NO: 1110952 - RNA, 12 nt, Mycobacterium bovis subsp bovis AF2122/97
cggccugcgucg

SEQ ID NO: 1110953 - RNA, 13 nt, Mycobacterium bovis subsp bovis AF2122/97
cggccugcgucga

SEQ ID NO: 1110954 - RNA, 14 nt, Mycobacterium bovis subsp bovis AF2122/97
cggccugcgucgaa

SEQ ID NO: 1110955 - RNA, 16 nt, Mycobacterium bovis subsp bovis AF2122/97
cggccugcucgaccau

SEQ ID NO: 1110956 - RNA, 12 nt, Mycobacterium bovis subsp bovis AF2122/97
cggccuggcucg

SEQ ID NO: 1110957 - RNA, 16 nt, Mycobacterium bovis subsp bovis AF2122/97
cggccuggggcagccg

SEQ ID NO: 1110958 - RNA, 17 nt, Mycobacterium bovis subsp bovis AF2122/97
cggccuggggcagccgg

SEQ ID NO: 1110959 - RNA, 21 nt, Mycobacterium bovis subsp bovis AF2122/97
cggccuggggcagccgggcgu

SEQ ID NO: 1110960 - RNA, 14 nt, Mycobacterium bovis subsp bovis AF2122/97
cggccugguacucc

SEQ ID NO: 1110961 - RNA, 16 nt, Mycobacterium bovis subsp bovis AF2122/97
cggccugggccagccg

SEQ ID NO: 1110962 - RNA, 21 nt, Mycobacterium bovis subsp bovis AF2122/97
cggccuggucggccaggucga

SEQ ID NO: 1110963 - RNA, 19 nt, Mycobacterium bovis subsp bovis AF2122/97
cggccuguucggcggcugc

SEQ ID NO: 1110964 - RNA, 21 nt, Mycobacterium bovis subsp bovis AF2122/97
cggccuucaaggaagccgcgg

SEQ ID NO: 1110965 - RNA, 17 nt, Mycobacterium bovis subsp bovis AF2122/97
cggccuuauucacccgg

SEQ ID NO: 1110966 - RNA, 16 nt, Mycobacterium bovis subsp bovis AF2122/97
cggccuguccaccgau

SEQ ID NO: 1110967 - RNA, 15 nt, Mycobacterium bovis subsp bovis AF2122/97
cggccuguccaccga

SEQ ID NO: 1110968 - RNA, 17 nt, Mycobacterium bovis subsp bovis AF2122/97
cggccuggugcucaacg

SEQ ID NO: 1110969 - RNA, 13 nt, Mycobacterium bovis subsp bovis AF2122/97
cggccuguucggc

SEQ ID NO: 1110970 - RNA, 15 nt, Mycobacterium bovis subsp bovis AF2122/97
cggccuguucgccgu

SEQ ID NO: 1110971 - RNA, 16 nt, Mycobacterium bovis subsp bovis AF2122/97
cggccuguucgccguc

SEQ ID NO: 1110972 - RNA, 17 nt, Mycobacterium bovis subsp bovis AF2122/97
cggccuguucgccgucg

SEQ ID NO: 1110973 - RNA, 14 nt, Mycobacterium bovis subsp bovis AF2122/97
cggccuugcgcaca

SEQ ID NO: 1110974 - RNA, 14 nt, Mycobacterium bovis subsp bovis AF2122/97
cggccuugccgggc

SEQ ID NO: 1110975 - RNA, 17 nt, Mycobacterium bovis subsp bovis AF2122/97
cggccuugccgggccgc

SEQ ID NO: 1110976 - RNA, 16 nt, Mycobacterium bovis subsp bovis AF2122/97
cggccuugccaccggu

SEQ ID NO: 1110977 - RNA, 23 nt, Mycobacterium bovis subsp bovis AF2122/97
cggccuugccaccgguaccgccg

SEQ ID NO: 1110978 - RNA, 13 nt, Mycobacterium bovis subsp bovis AF2122/97
cggccuugccgcc

SEQ ID NO: 1110979 - RNA, 15 nt, Mycobacterium bovis subsp bovis AF2122/97
cggccuugccgccgg

SEQ ID NO: 1110980 - RNA, 18 nt, Mycobacterium bovis subsp bovis AF2122/97
cggccuugccgccggccc

SEQ ID NO: 1110981 - RNA, 19 nt, Mycobacterium bovis subsp bovis AF2122/97
cggccuugccgccggcccc

SEQ ID NO: 1110982 - RNA, 17 nt, Mycobacterium bovis subsp bovis AF2122/97
cggccuugccgccggcg

SEQ ID NO: 1110983 - RNA, 14 nt, Mycobacterium bovis subsp bovis AF2122/97
cggccuugcucagc

SEQ ID NO: 1110984 - RNA, 18 nt, Mycobacterium bovis subsp bovis AF2122/97
cggccuugcgggcucucg

SEQ ID NO: 1110985 - RNA, 20 nt, Mycobacterium bovis subsp bovis AF2122/97
cggccuugcucagcacgccg

SEQ ID NO: 1110986 - RNA, 15 nt, Mycobacterium bovis subsp bovis AF2122/97
cggccuugccaccgg

SEQ ID NO: 1110987 - RNA, 22 nt, Mycobacterium bovis subsp bovis AF2122/97
cggccuugaucaccgugcgguc

SEQ ID NO: 1110988 - RNA, 19 nt, Mycobacterium bovis subsp bovis AF2122/97
cggccuucuccaucgucgg

SEQ ID NO: 1110989 - RNA, 20 nt, Mycobacterium bovis subsp bovis AF2122/97
cggcgaagguguccuccagc

SEQ ID NO: 1110990 - RNA, 23 nt, Mycobacterium bovis subsp bovis AF2122/97
cggcgaaggguaagaguucgcgc

SEQ ID NO: 1110991 - RNA, 15 nt, Mycobacterium bovis subsp bovis AF2122/97
cggcgaauccgccgc

SEQ ID NO: 1110992 - RNA, 16 nt, Mycobacterium bovis subsp bovis AF2122/97
cggcgaauccgccgcc

SEQ ID NO: 1110993 - RNA, 20 nt, Mycobacterium bovis subsp bovis AF2122/97
cggcgacagcuuggccgguu

SEQ ID NO: 1110994 - RNA, 17 nt, Mycobacterium bovis subsp bovis AF2122/97
cggcgaagucgagugcc

SEQ ID NO: 1110995 - RNA, 23 nt, Mycobacterium bovis subsp bovis AF2122/97
cggcgaagucgagugccgcguca

SEQ ID NO: 1110996 - RNA, 15 nt, Mycobacterium bovis subsp bovis AF2122/97
cggcgaccaccagcg

SEQ ID NO: 1110997 - RNA, 17 nt, Mycobacterium bovis subsp bovis AF2122/97
cggcgaccaccagcgcc

SEQ ID NO: 1110998 - RNA, 20 nt, Mycobacterium bovis subsp bovis AF2122/97
cggcgacaucggcccgauca

SEQ ID NO: 1110999 - RNA, 19 nt, Mycobacterium bovis subsp bovis AF2122/97
cggcgaccaaggccgaccu

SEQ ID NO: 1111000 - RNA, 17 nt, Mycobacterium bovis subsp bovis AF2122/97
cggcgacauccacaccg

SEQ ID NO: 1111001 - RNA, 16 nt, Mycobacterium bovis subsp bovis AF2122/97
cggcgacauacccgau

SEQ ID NO: 1111002 - RNA, 20 nt, Mycobacterium bovis subsp bovis AF2122/97
cggcgacaggagacgguacg

SEQ ID NO: 1111003 - RNA, 17 nt, Mycobacterium bovis subsp bovis AF2122/97
cggcgacaggccgagca

SEQ ID NO: 1111004 - RNA, 13 nt, Mycobacterium bovis subsp bovis AF2122/97
cggcgaaccacgg

SEQ ID NO: 1111005 - RNA, 19 nt, Mycobacterium bovis subsp bovis AF2122/97
cggcgaaccacggcagcca

SEQ ID NO: 1111006 - RNA, 18 nt, Mycobacterium bovis subsp bovis AF2122/97
cggcgaacaggcgaccgg

SEQ ID NO: 1111007 - RNA, 15 nt, Mycobacterium bovis subsp bovis AF2122/97
cggcgaagcgggcgu

SEQ ID NO: 1111008 - RNA, 18 nt, Mycobacterium bovis subsp bovis AF2122/97
cggcgaagcgugcgccga

SEQ ID NO: 1111009 - RNA, 19 nt, Mycobacterium bovis subsp bovis AF2122/97
cggcgaagcgugcgccgac

SEQ ID NO: 1111010 - RNA, 22 nt, Mycobacterium bovis subsp bovis AF2122/97
cggcgaaggccagcagaaacau

SEQ ID NO: 1111011 - RNA, 17 nt, Mycobacterium bovis subsp bovis AF2122/97
cggcgaaggccgcgcgc

SEQ ID NO: 1111012 - RNA, 19 nt, Mycobacterium bovis subsp bovis AF2122/97
cggcgaaggccgcgcgcag

SEQ ID NO: 1111013 - RNA, 17 nt, Mycobacterium bovis subsp bovis AF2122/97
cggcgaacaaccgccgc

SEQ ID NO: 1111014 - RNA, 19 nt, Mycobacterium bovis subsp bovis AF2122/97
cggcgaacaaccgccgcuc

SEQ ID NO: 1111015 - RNA, 17 nt, Mycobacterium bovis subsp bovis AF2122/97
cggcgaaagcuugggcg

SEQ ID NO: 1111016 - RNA, 23 nt, Mycobacterium bovis subsp bovis AF2122/97
cggcgaaaguccugcagugcggc

SEQ ID NO: 1111017 - RNA, 12 nt, Mycobacterium bovis subsp bovis AF2122/97
cggcgacgacgg

SEQ ID NO: 1111018 - RNA, 15 nt, Mycobacterium bovis subsp bovis AF2122/97
cggcgacgagcgcag

SEQ ID NO: 1111019 - RNA, 15 nt, Mycobacterium bovis subsp bovis AF2122/97
cggcgacgaucucgc

SEQ ID NO: 1111020 - RNA, 18 nt, Mycobacterium bovis subsp bovis AF2122/97
cggcgacgaucucggcgg

SEQ ID NO: 1111021 - RNA, 15 nt, Mycobacterium bovis subsp bovis AF2122/97
cggcgacgcgccggu

SEQ ID NO: 1111022 - RNA, 15 nt, Mycobacterium bovis subsp bovis AF2122/97
cggcgacgccggccu

SEQ ID NO: 1111023 - RNA, 15 nt, Mycobacterium bovis subsp bovis AF2122/97
cggcgacgccgcugg

SEQ ID NO: 1111024 - RNA, 22 nt, Mycobacterium bovis subsp bovis AF2122/97
cggcgacgaugucgacucgugg

SEQ ID NO: 1111025 - RNA, 21 nt, Mycobacterium bovis subsp bovis AF2122/97
cggcgacgaugucgagcgcga

SEQ ID NO: 1111026 - RNA, 13 nt, Mycobacterium bovis subsp bovis AF2122/97
cggcgacgauucg

SEQ ID NO: 1111027 - RNA, 13 nt, Mycobacterium bovis subsp bovis AF2122/97
cggcgacggccgc

SEQ ID NO: 1111028 - RNA, 14 nt, Mycobacterium bovis subsp bovis AF2122/97
cggcgacggccgcu

SEQ ID NO: 1111029 - RNA, 17 nt, Mycobacterium bovis subsp bovis AF2122/97
cggcgacggccgcucgg

SEQ ID NO: 1111030 - RNA, 19 nt, Mycobacterium bovis subsp bovis AF2122/97
cggcgacggccgcucgggc

SEQ ID NO: 1111031 - RNA, 22 nt, Mycobacterium bovis subsp bovis AF2122/97
cggcgacggccgcucgggccag

SEQ ID NO: 1111032 - RNA, 16 nt, Mycobacterium bovis subsp bovis AF2122/97
cggcgacggccagcgc

SEQ ID NO: 1111033 - RNA, 16 nt, Mycobacterium bovis subsp bovis AF2122/97
cggcgaccacgccgcc

SEQ ID NO: 1111034 - RNA, 17 nt, Mycobacterium bovis subsp bovis AF2122/97
cggcgaccacgccgccg

SEQ ID NO: 1111035 - RNA, 19 nt, Mycobacterium bovis subsp bovis AF2122/97
cggcgaccacgccgccggc

SEQ ID NO: 1111036 - RNA, 20 nt, Mycobacterium bovis subsp bovis AF2122/97
cggcgaccacgccgccggcg

SEQ ID NO: 1111037 - RNA, 21 nt, Mycobacterium bovis subsp bovis AF2122/97
cggcgaccacgccgccggcgc

SEQ ID NO: 1111038 - RNA, 12 nt, Mycobacterium bovis subsp bovis AF2122/97
cggcgaccacgg

SEQ ID NO: 1111039 - RNA, 13 nt, Mycobacterium bovis subsp bovis AF2122/97
cggcgaccacggc

SEQ ID NO: 1111040 - RNA, 17 nt, Mycobacterium bovis subsp bovis AF2122/97
cggcgaccacggcaccg

SEQ ID NO: 1111041 - RNA, 16 nt, Mycobacterium bovis subsp bovis AF2122/97
cggcgaccagaaucuc

SEQ ID NO: 1111042 - RNA, 23 nt, Mycobacterium bovis subsp bovis AF2122/97
cggcgaccagaaucucgccgggc

SEQ ID NO: 1111043 - RNA, 20 nt, Mycobacterium bovis subsp bovis AF2122/97
cggcgaccagaggaugucga

SEQ ID NO: 1111044 - RNA, 15 nt, Mycobacterium bovis subsp bovis AF2122/97
cggcgacccagcggu

SEQ ID NO: 1111045 - RNA, 14 nt, Mycobacterium bovis subsp bovis AF2122/97
cggcgaccccgaac

SEQ ID NO: 1111046 - RNA, 20 nt, Mycobacterium bovis subsp bovis AF2122/97
cggcgaccccgaagaugacc

SEQ ID NO: 1111047 - RNA, 19 nt, Mycobacterium bovis subsp bovis AF2122/97
cggcgaccaucugaucggg

SEQ ID NO: 1111048 - RNA, 21 nt, Mycobacterium bovis subsp bovis AF2122/97
cggcgaccaggucggcuucga

SEQ ID NO: 1111049 - RNA, 24 nt, Mycobacterium bovis subsp bovis AF2122/97
cggcgaccaugaugccuaccgggc

SEQ ID NO: 1111050 - RNA, 12 nt, Mycobacterium bovis subsp bovis AF2122/97
cggcgaccaucu

SEQ ID NO: 1111051 - RNA, 15 nt, Mycobacterium bovis subsp bovis AF2122/97
cggccccgcggccag

SEQ ID NO: 1111052 - RNA, 16 nt, Mycobacterium bovis subsp bovis AF2122/97
cggccccgcggccagc

SEQ ID NO: 1111053 - RNA, 14 nt, Mycobacterium bovis subsp bovis AF2122/97
cggccccgccguug

SEQ ID NO: 1111054 - RNA, 22 nt, Mycobacterium bovis subsp bovis AF2122/97
cggccccgccguugccgccgac

SEQ ID NO: 1111055 - RNA, 14 nt, Mycobacterium bovis subsp bovis AF2122/97
cggccccgccguuu

SEQ ID NO: 1111056 - RNA, 23 nt, Mycobacterium bovis subsp bovis AF2122/97
cggccccgccguuuccgccgccg

SEQ ID NO: 1111057 - RNA, 17 nt, Mycobacterium bovis subsp bovis AF2122/97
cggcccccggucgagcu

SEQ ID NO: 1111058 - RNA, 21 nt, Mycobacterium bovis subsp bovis AF2122/97
cggccccgccgucgccgccgg

SEQ ID NO: 1111059 - RNA, 14 nt, Mycobacterium bovis subsp bovis AF2122/97
cggccccgccguua

SEQ ID NO: 1111060 - RNA, 13 nt, Mycobacterium bovis subsp bovis AF2122/97
cggccgcacccgu

SEQ ID NO: 1111061 - RNA, 13 nt, Mycobacterium bovis subsp bovis AF2122/97
cggccgcaccagc

SEQ ID NO: 1111062 - RNA, 15 nt, Mycobacterium bovis subsp bovis AF2122/97
cggccgcaccagcau

SEQ ID NO: 1111063 - RNA, 13 nt, Mycobacterium bovis subsp bovis AF2122/97
cggccgcacauga

SEQ ID NO: 1111064 - RNA, 15 nt, Mycobacterium bovis subsp bovis AF2122/97
cggccgaugcgaccc

SEQ ID NO: 1111065 - RNA, 24 nt, Mycobacterium bovis subsp bovis AF2122/97
cggccgcaaucaugucagcgcuga

SEQ ID NO: 1111066 - RNA, 16 nt, Mycobacterium bovis subsp bovis AF2122/97
cggccgcaagccgcga

SEQ ID NO: 1111067 - RNA, 13 nt, Mycobacterium bovis subsp bovis AF2122/97
cggccgcaaggcg

SEQ ID NO: 1111068 - RNA, 22 nt, Mycobacterium bovis subsp bovis AF2122/97
cggccgcaaggcgccgauaccg

SEQ ID NO: 1111069 - RNA, 18 nt, Mycobacterium bovis subsp bovis AF2122/97
cggccgcaggcuugccga

SEQ ID NO: 1111070 - RNA, 17 nt, Mycobacterium bovis subsp bovis AF2122/97
cggccgcaucgcccaac

SEQ ID NO: 1111071 - RNA, 18 nt, Mycobacterium bovis subsp bovis AF2122/97
cggccgcagcggccagcc

SEQ ID NO: 1111072 - RNA, 14 nt, Mycobacterium bovis subsp bovis AF2122/97
cggccgcagccagc

SEQ ID NO: 1111073 - RNA, 15 nt, Mycobacterium bovis subsp bovis AF2122/97
cggccgcacccguug

SEQ ID NO: 1111074 - RNA, 19 nt, Mycobacterium bovis subsp bovis AF2122/97
cggccgcacgccgaccagc

SEQ ID NO: 1111075 - RNA, 19 nt, Mycobacterium bovis subsp bovis AF2122/97
cggccgcacgccggccagc

SEQ ID NO: 1111076 - RNA, 13 nt, Mycobacterium bovis subsp bovis AF2122/97
cggccgcagcggc

SEQ ID NO: 1111077 - RNA, 12 nt, Mycobacterium bovis subsp bovis AF2122/97
cggccgcacugg

SEQ ID NO: 1111078 - RNA, 14 nt, Mycobacterium bovis subsp bovis AF2122/97
cggccgccagcccc

SEQ ID NO: 1111079 - RNA, 20 nt, Mycobacterium bovis subsp bovis AF2122/97
cggccgccagccccacccgc

SEQ ID NO: 1111080 - RNA, 19 nt, Mycobacterium bovis subsp bovis AF2122/97
cggccgccgaucugcugca

SEQ ID NO: 1111081 - RNA, 21 nt, Mycobacterium bovis subsp bovis AF2122/97
cggccgccgacagggacccga

SEQ ID NO: 1111082 - RNA, 22 nt, Mycobacterium bovis subsp bovis AF2122/97
cggccgccgacagggacccgag

SEQ ID NO: 1111083 - RNA, 12 nt, Mycobacterium bovis subsp bovis AF2122/97
cggccgccgacg

SEQ ID NO: 1111084 - RNA, 18 nt, Mycobacterium bovis subsp bovis AF2122/97
cggccgccgacuccccgc

SEQ ID NO: 1111085 - RNA, 13 nt, Mycobacterium bovis subsp bovis AF2122/97
cggccgccgcagc

SEQ ID NO: 1111086 - RNA, 23 nt, Mycobacterium bovis subsp bovis AF2122/97
cggccgcgaccagcgccgcaccc

SEQ ID NO: 1111087 - RNA, 15 nt, Mycobacterium bovis subsp bovis AF2122/97
cggccgcgaccgcga

SEQ ID NO: 1111088 - RNA, 14 nt, Mycobacterium bovis subsp bovis AF2122/97
cggccgcgauggug

SEQ ID NO: 1111089 - RNA, 20 nt, Mycobacterium bovis subsp bovis AF2122/97
cggccgcgauggugcgccgg

SEQ ID NO: 1111090 - RNA, 21 nt, Mycobacterium bovis subsp bovis AF2122/97
cggccgcgauggugcgccggg

SEQ ID NO: 1111091 - RNA, 20 nt, Mycobacterium bovis subsp bovis AF2122/97
cggccgcgauccagcgcuga

SEQ ID NO: 1111092 - RNA, 12 nt, Mycobacterium bovis subsp bovis AF2122/97
cggccgcgacgg

SEQ ID NO: 1111093 - RNA, 14 nt, Mycobacterium bovis subsp bovis AF2122/97
cggccgccgcggcu

SEQ ID NO: 1111094 - RNA, 14 nt, Mycobacterium bovis subsp bovis AF2122/97
cggccgcgcacccg

SEQ ID NO: 1111095 - RNA, 16 nt, Mycobacterium bovis subsp bovis AF2122/97
cggccgcgccggcccc

SEQ ID NO: 1111096 - RNA, 13 nt, Mycobacterium bovis subsp bovis AF2122/97
cggccgcgggcgu

SEQ ID NO: 1111097 - RNA, 14 nt, Mycobacterium bovis subsp bovis AF2122/97
cggccgcgccccau

SEQ ID NO: 1111098 - RNA, 17 nt, Mycobacterium bovis subsp bovis AF2122/97
cggccgcgggucgcugc

SEQ ID NO: 1111099 - RNA, 18 nt, Mycobacterium bovis subsp bovis AF2122/97
cggccgcggggcaucggu

SEQ ID NO: 1111100 - RNA, 20 nt, Mycobacterium bovis subsp bovis AF2122/97
cggccgcguaaaccggcuga

SEQ ID NO: 1111101 - RNA, 19 nt, Mycobacterium bovis subsp bovis AF2122/97
cggccgcggugcccgucgg

SEQ ID NO: 1111102 - RNA, 21 nt, Mycobacterium bovis subsp bovis AF2122/97
cggccgcggucggccaccaac

SEQ ID NO: 1111103 - RNA, 22 nt, Mycobacterium bovis subsp bovis AF2122/97
cggccgcggucggccaccaacu

SEQ ID NO: 1111104 - RNA, 13 nt, Mycobacterium bovis subsp bovis AF2122/97
cggccgcggucgg

SEQ ID NO: 1111105 - RNA, 18 nt, Mycobacterium bovis subsp bovis AF2122/97
cggccgcggucggccacc

SEQ ID NO: 1111106 - RNA, 19 nt, Mycobacterium bovis subsp bovis AF2122/97
cggccgcggucggccacca

SEQ ID NO: 1111107 - RNA, 15 nt, Mycobacterium bovis subsp bovis AF2122/97
cggccgcgucgucga

SEQ ID NO: 1111108 - RNA, 21 nt, Mycobacterium bovis subsp bovis AF2122/97
cggccgcgucacggaccugga

SEQ ID NO: 1111109 - RNA, 15 nt, Mycobacterium bovis subsp bovis AF2122/97
cggccggagccgccg

SEQ ID NO: 1111110 - RNA, 17 nt, Mycobacterium bovis subsp bovis AF2122/97
cggccggagccgccggc

SEQ ID NO: 1111111 - RNA, 19 nt, Mycobacterium bovis subsp bovis AF2122/97
cggccggagccgccggccc

SEQ ID NO: 1111112 - RNA, 18 nt, Mycobacterium bovis subsp bovis AF2122/97
cggccgcgugccgcccgc

SEQ ID NO: 1111113 - RNA, 13 nt, Mycobacterium bovis subsp bovis AF2122/97
cggccggaguccg

SEQ ID NO: 1111114 - RNA, 15 nt, Mycobacterium bovis subsp bovis AF2122/97
cggccggaguccguc

SEQ ID NO: 1111115 - RNA, 20 nt, Mycobacterium bovis subsp bovis AF2122/97
cggccggauacggcgacacc

SEQ ID NO: 1111116 - RNA, 18 nt, Mycobacterium bovis subsp bovis AF2122/97
cggccggcaacgugcggu

SEQ ID NO: 1111117 - RNA, 23 nt, Mycobacterium bovis subsp bovis AF2122/97
cggccgcguaaaccggcugaccg

SEQ ID NO: 1111118 - RNA, 20 nt, Mycobacterium bovis subsp bovis AF2122/97
cggccggauacgggcugacg

SEQ ID NO: 1111119 - RNA, 19 nt, Mycobacterium bovis subsp bovis AF2122/97
cggccggcacgaccgcucc

SEQ ID NO: 1111120 - RNA, 14 nt, Mycobacterium bovis subsp bovis AF2122/97
cggccggcacccca

SEQ ID NO: 1111121 - RNA, 20 nt, Mycobacterium bovis subsp bovis AF2122/97
cggccggcaccccacggcca

SEQ ID NO: 1111122 - RNA, 12 nt, Mycobacterium bovis subsp bovis AF2122/97
cggccggcaccc

SEQ ID NO: 1111123 - RNA, 21 nt, Mycobacterium bovis subsp bovis AF2122/97
cggccggcaaugccgcggcca

SEQ ID NO: 1111124 - RNA, 14 nt, Mycobacterium bovis subsp bovis AF2122/97
cggccggccgcccg

SEQ ID NO: 1111125 - RNA, 15 nt, Mycobacterium bovis subsp bovis AF2122/97
cggccggccuagccg

SEQ ID NO: 1111126 - RNA, 16 nt, Mycobacterium bovis subsp bovis AF2122/97
cggccggccuagccga

SEQ ID NO: 1111127 - RNA, 13 nt, Mycobacterium bovis subsp bovis AF2122/97
cggccggccgcgg

SEQ ID NO: 1111128 - RNA, 12 nt, Mycobacterium bovis subsp bovis AF2122/97
cggccggccgcu

SEQ ID NO: 1111129 - RNA, 19 nt, Mycobacterium bovis subsp bovis AF2122/97
cggccggauguugaccggc

SEQ ID NO: 1111130 - RNA, 12 nt, Mycobacterium bovis subsp bovis AF2122/97
cggccgggccgu

SEQ ID NO: 1111131 - RNA, 15 nt, Mycobacterium bovis subsp bovis AF2122/97
cggccgggccugcac

SEQ ID NO: 1111132 - RNA, 20 nt, Mycobacterium bovis subsp bovis AF2122/97
cggccgggccugcaccacgg

SEQ ID NO: 1111133 - RNA, 22 nt, Mycobacterium bovis subsp bovis AF2122/97
cggccgggccugcaccacggcg

SEQ ID NO: 1111134 - RNA, 14 nt, Mycobacterium bovis subsp bovis AF2122/97
cggccgggcggcca

SEQ ID NO: 1111135 - RNA, 15 nt, Mycobacterium bovis subsp bovis AF2122/97
cggccgggcggccag

SEQ ID NO: 1111136 - RNA, 21 nt, Mycobacterium bovis subsp bovis AF2122/97
cggccgggcggccaggcgcga

SEQ ID NO: 1111137 - RNA, 15 nt, Mycobacterium bovis subsp bovis AF2122/97
cggccggggccaccc

SEQ ID NO: 1111138 - RNA, 16 nt, Mycobacterium bovis subsp bovis AF2122/97
cggccggggccacccg

SEQ ID NO: 1111139 - RNA, 18 nt, Mycobacterium bovis subsp bovis AF2122/97
cggccggggccacccgca

SEQ ID NO: 1111140 - RNA, 15 nt, Mycobacterium bovis subsp bovis AF2122/97
cggccgggcguccuc

SEQ ID NO: 1111141 - RNA, 19 nt, Mycobacterium bovis subsp bovis AF2122/97
cggccgggcguccucgucg

SEQ ID NO: 1111142 - RNA, 22 nt, Mycobacterium bovis subsp bovis AF2122/97
cggccgggcguccucgucgaga

SEQ ID NO: 1111143 - RNA, 15 nt, Mycobacterium bovis subsp bovis AF2122/97
cggccgggucauccg

SEQ ID NO: 1111144 - RNA, 22 nt, Mycobacterium bovis subsp bovis AF2122/97
cggccgggucgaacaggccggc

SEQ ID NO: 1111145 - RNA, 17 nt, Mycobacterium bovis subsp bovis AF2122/97
cggccggcgcagugcga

SEQ ID NO: 1111146 - RNA, 21 nt, Mycobacterium bovis subsp bovis AF2122/97
cggccggggcgaacggcaccg

SEQ ID NO: 1111147 - RNA, 22 nt, Mycobacterium bovis subsp bovis AF2122/97
cggccggguguagcucggaccc

SEQ ID NO: 1111148 - RNA, 18 nt, Mycobacterium bovis subsp bovis AF2122/97
cggccggguuaucggcag

SEQ ID NO: 1111149 - RNA, 14 nt, Mycobacterium bovis subsp bovis AF2122/97
cggccgggucgcgc

SEQ ID NO: 1111150 - RNA, 15 nt, Mycobacterium bovis subsp bovis AF2122/97
cggccgggucgguga

SEQ ID NO: 1111151 - RNA, 19 nt, Mycobacterium bovis subsp bovis AF2122/97
cggccgggucgagugcgga

SEQ ID NO: 1111152 - RNA, 17 nt, Mycobacterium bovis subsp bovis AF2122/97
cggccggguucgcgucu

SEQ ID NO: 1111153 - RNA, 18 nt, Mycobacterium bovis subsp bovis AF2122/97
cggccgguauuucggcga

SEQ ID NO: 1111154 - RNA, 16 nt, Mycobacterium bovis subsp bovis AF2122/97
cggccggugcccgggc

SEQ ID NO: 1111155 - RNA, 20 nt, Mycobacterium bovis subsp bovis AF2122/97
cggccgguggaaaccgggcg

SEQ ID NO: 1111156 - RNA, 21 nt, Mycobacterium bovis subsp bovis AF2122/97
cggccgguggaaaccgggcga

SEQ ID NO: 1111157 - RNA, 18 nt, Mycobacterium bovis subsp bovis AF2122/97
cggccgguggccagcacg

SEQ ID NO: 1111158 - RNA, 20 nt, Mycobacterium bovis subsp bovis AF2122/97
cggccgucccgcgagcagcc

SEQ ID NO: 1111159 - RNA, 18 nt, Mycobacterium bovis subsp bovis AF2122/97
cggccgucaggguguugc

SEQ ID NO: 1111160 - RNA, 21 nt, Mycobacterium bovis subsp bovis AF2122/97
cggccgucauggcccgaucga

SEQ ID NO: 1111161 - RNA, 22 nt, Mycobacterium bovis subsp bovis AF2122/97
cggccgucgcgggacaacagca

SEQ ID NO: 1111162 - RNA, 15 nt, Mycobacterium bovis subsp bovis AF2122/97
cggccgucgccggga

SEQ ID NO: 1111163 - RNA, 15 nt, Mycobacterium bovis subsp bovis AF2122/97
cggccgucgaugguc

SEQ ID NO: 1111164 - RNA, 17 nt, Mycobacterium bovis subsp bovis AF2122/97
cggccgucgauggucag

SEQ ID NO: 1111165 - RNA, 12 nt, Mycobacterium bovis subsp bovis AF2122/97
cggccgucgacg

SEQ ID NO: 1111166 - RNA, 14 nt, Mycobacterium bovis subsp bovis AF2122/97
cggccgucgacgau

SEQ ID NO: 1111167 - RNA, 13 nt, Mycobacterium bovis subsp bovis AF2122/97
cggccgucgaucu

SEQ ID NO: 1111168 - RNA, 18 nt, Mycobacterium bovis subsp bovis AF2122/97
cggccgguuggccagcca

SEQ ID NO: 1111169 - RNA, 14 nt, Mycobacterium bovis subsp bovis AF2122/97
cggccgucagcaca

SEQ ID NO: 1111170 - RNA, 20 nt, Mycobacterium bovis subsp bovis AF2122/97
cggccgucaccggucggcca

SEQ ID NO: 1111171 - RNA, 22 nt, Mycobacterium bovis subsp bovis AF2122/97
cggccguagugcacgucggcgg

SEQ ID NO: 1111172 - RNA, 24 nt, Mycobacterium bovis subsp bovis AF2122/97
cggccgguuggccagccacagccg

SEQ ID NO: 1111173 - RNA, 20 nt, Mycobacterium bovis subsp bovis AF2122/97
cggcgccaccgccgcugccg

SEQ ID NO: 1111174 - RNA, 21 nt, Mycobacterium bovis subsp bovis AF2122/97
cggcgccaccgccgcugccgg

SEQ ID NO: 1111175 - RNA, 22 nt, Mycobacterium bovis subsp bovis AF2122/97
cggcgccaccgccgcugccggu

SEQ ID NO: 1111176 - RNA, 12 nt, Mycobacterium bovis subsp bovis AF2122/97
cggcgccaccgu

SEQ ID NO: 1111177 - RNA, 19 nt, Mycobacterium bovis subsp bovis AF2122/97
cggcgccaccggcgccgcc

SEQ ID NO: 1111178 - RNA, 16 nt, Mycobacterium bovis subsp bovis AF2122/97
cggcgccaccgucacc

SEQ ID NO: 1111179 - RNA, 17 nt, Mycobacterium bovis subsp bovis AF2122/97
cggcgccaccgucaccg

SEQ ID NO: 1111180 - RNA, 19 nt, Mycobacterium bovis subsp bovis AF2122/97
cggcgccaccgucaccgcc

SEQ ID NO: 1111181 - RNA, 20 nt, Mycobacterium bovis subsp bovis AF2122/97
cggcgccaccgucaccgccg

SEQ ID NO: 1111182 - RNA, 22 nt, Mycobacterium bovis subsp bovis AF2122/97
cggcgccaccgucaccgccguu

SEQ ID NO: 1111183 - RNA, 19 nt, Mycobacterium bovis subsp bovis AF2122/97
cggcgccaccgucgccgua

SEQ ID NO: 1111184 - RNA, 20 nt, Mycobacterium bovis subsp bovis AF2122/97
cggcgccaccguugccgaac

SEQ ID NO: 1111185 - RNA, 14 nt, Mycobacterium bovis subsp bovis AF2122/97
cggcgccagaucga

SEQ ID NO: 1111186 - RNA, 13 nt, Mycobacterium bovis subsp bovis AF2122/97
cggcgccagcaga

SEQ ID NO: 1111187 - RNA, 13 nt, Mycobacterium bovis subsp bovis AF2122/97
cggcgccagcgcc

SEQ ID NO: 1111188 - RNA, 19 nt, Mycobacterium bovis subsp bovis AF2122/97
cggcgcccagcgccucgau

SEQ ID NO: 1111189 - RNA, 14 nt, Mycobacterium bovis subsp bovis AF2122/97
cggcgcccacaucg

SEQ ID NO: 1111190 - RNA, 14 nt, Mycobacterium bovis subsp bovis AF2122/97
cggcgcccagcucg

SEQ ID NO: 1111191 - RNA, 15 nt, Mycobacterium bovis subsp bovis AF2122/97
cggcgcccagcucga

SEQ ID NO: 1111192 - RNA, 15 nt, Mycobacterium bovis subsp bovis AF2122/97
cggcgcccagcgcua

SEQ ID NO: 1111193 - RNA, 17 nt, Mycobacterium bovis subsp bovis AF2122/97
cggcgcccaggccgauc

SEQ ID NO: 1111194 - RNA, 14 nt, Mycobacterium bovis subsp bovis AF2122/97
cggcgcccaggccg

SEQ ID NO: 1111195 - RNA, 16 nt, Mycobacterium bovis subsp bovis AF2122/97
cggcgcccaggccgau

SEQ ID NO: 1111196 - RNA, 19 nt, Mycobacterium bovis subsp bovis AF2122/97
cggcgcccaucgcgacggc

SEQ ID NO: 1111197 - RNA, 20 nt, Mycobacterium bovis subsp bovis AF2122/97
cggcgcccaggccgaucagc

SEQ ID NO: 1111198 - RNA, 23 nt, Mycobacterium bovis subsp bovis AF2122/97
cggcgcccgagauccccaaaucg

SEQ ID NO: 1111199 - RNA, 13 nt, Mycobacterium bovis subsp bovis AF2122/97
cggcgcccgccac

SEQ ID NO: 1111200 - RNA, 14 nt, Mycobacterium bovis subsp bovis AF2122/97
cggcgcccgccacc

SEQ ID NO: 1111201 - RNA, 17 nt, Mycobacterium bovis subsp bovis AF2122/97
cggcgcccgccaccgga

SEQ ID NO: 1111202 - RNA, 14 nt, Mycobacterium bovis subsp bovis AF2122/97
cggcgcccgcccga

SEQ ID NO: 1111203 - RNA, 14 nt, Mycobacterium bovis subsp bovis AF2122/97
cggcgcccgcucgg

SEQ ID NO: 1111204 - RNA, 17 nt, Mycobacterium bovis subsp bovis AF2122/97
cggcgcccgcucggccg

SEQ ID NO: 1111205 - RNA, 12 nt, Mycobacterium bovis subsp bovis AF2122/97
cggcgcccgccg

SEQ ID NO: 1111206 - RNA, 13 nt, Mycobacterium bovis subsp bovis AF2122/97
cggcgcccgccgc

SEQ ID NO: 1111207 - RNA, 15 nt, Mycobacterium bovis subsp bovis AF2122/97
cggcgcccgccgcga

SEQ ID NO: 1111208 - RNA, 18 nt, Mycobacterium bovis subsp bovis AF2122/97
cggcgcccagcucgucga

SEQ ID NO: 1111209 - RNA, 19 nt, Mycobacterium bovis subsp bovis AF2122/97
cggcgcccgcucggccgca

SEQ ID NO: 1111210 - RNA, 23 nt, Mycobacterium bovis subsp bovis AF2122/97
cggcgcccggggcggugggcgcu

SEQ ID NO: 1111211 - RNA, 17 nt, Mycobacterium bovis subsp bovis AF2122/97
cggcgcccggucgagcc

SEQ ID NO: 1111212 - RNA, 16 nt, Mycobacterium bovis subsp bovis AF2122/97
cggcgcccuggccgcc

SEQ ID NO: 1111213 - RNA, 23 nt, Mycobacterium bovis subsp bovis AF2122/97
cggcgccgaagagucgugccgcc

SEQ ID NO: 1111214 - RNA, 22 nt, Mycobacterium bovis subsp bovis AF2122/97
cggcgccgaacaccucggcacg

SEQ ID NO: 1111215 - RNA, 16 nt, Mycobacterium bovis subsp bovis AF2122/97
cggcgccgaacccggu

SEQ ID NO: 1111216 - RNA, 19 nt, Mycobacterium bovis subsp bovis AF2122/97
cggcgccgacccgaucacc

SEQ ID NO: 1111217 - RNA, 13 nt, Mycobacterium bovis subsp bovis AF2122/97
cggcgccgccacg

SEQ ID NO: 1111218 - RNA, 11 nt, Mycobacterium bovis subsp bovis AF2122/97
cggcgccgcca

SEQ ID NO: 1111219 - RNA, 12 nt, Mycobacterium bovis subsp bovis AF2122/97
cggcgccgccac

SEQ ID NO: 1111220 - RNA, 21 nt, Mycobacterium bovis subsp bovis AF2122/97
cggcgccgcauaccaguaccg

SEQ ID NO: 1111221 - RNA, 21 nt, Mycobacterium bovis subsp bovis AF2122/97
cggcgccgcagaucaccgcca

SEQ ID NO: 1111222 - RNA, 23 nt, Mycobacterium bovis subsp bovis AF2122/97
cggcgccgcagaucaccgccagc

SEQ ID NO: 1111223 - RNA, 23 nt, Mycobacterium bovis subsp bovis AF2122/97
cggcgccgcaaugacgucgucgg

SEQ ID NO: 1111224 - RNA, 13 nt, Mycobacterium bovis subsp bovis AF2122/97
cggcgccgcacca

SEQ ID NO: 1111225 - RNA, 16 nt, Mycobacterium bovis subsp bovis AF2122/97
cggcgccgcaccaagc

SEQ ID NO: 1111226 - RNA, 18 nt, Mycobacterium bovis subsp bovis AF2122/97
cggcgccgcagaucaccg

SEQ ID NO: 1111227 - RNA, 20 nt, Mycobacterium bovis subsp bovis AF2122/97
cggcgccgcagaucaccgcc

SEQ ID NO: 1111228 - RNA, 14 nt, Mycobacterium bovis subsp bovis AF2122/97
cggcgacggcggca

SEQ ID NO: 1111229 - RNA, 15 nt, Mycobacterium bovis subsp bovis AF2122/97
cggcgacggcggcac

SEQ ID NO: 1111230 - RNA, 21 nt, Mycobacterium bovis subsp bovis AF2122/97
cggcgacggcggcacgggcgg

SEQ ID NO: 1111231 - RNA, 15 nt, Mycobacterium bovis subsp bovis AF2122/97
cggcgacguagacgg

SEQ ID NO: 1111232 - RNA, 19 nt, Mycobacterium bovis subsp bovis AF2122/97
cggcgacguagacgguccg

SEQ ID NO: 1111233 - RNA, 13 nt, Mycobacterium bovis subsp bovis AF2122/97
cggcgacggugag

SEQ ID NO: 1111234 - RNA, 12 nt, Mycobacterium bovis subsp bovis AF2122/97
cggcgacggugc

SEQ ID NO: 1111235 - RNA, 18 nt, Mycobacterium bovis subsp bovis AF2122/97
cggcgacggugccaccgc

SEQ ID NO: 1111236 - RNA, 16 nt, Mycobacterium bovis subsp bovis AF2122/97
cggcgacguggcgccg

SEQ ID NO: 1111237 - RNA, 21 nt, Mycobacterium bovis subsp bovis AF2122/97
cggcgacguggcgccgacagg

SEQ ID NO: 1111238 - RNA, 14 nt, Mycobacterium bovis subsp bovis AF2122/97
cggcgacgggucgg

SEQ ID NO: 1111239 - RNA, 16 nt, Mycobacterium bovis subsp bovis AF2122/97
cggcgacgggucgggc

SEQ ID NO: 1111240 - RNA, 19 nt, Mycobacterium bovis subsp bovis AF2122/97
cggcgacgucgcgcaggua

SEQ ID NO: 1111241 - RNA, 15 nt, Mycobacterium bovis subsp bovis AF2122/97
cggcgacgucggcgg

SEQ ID NO: 1111242 - RNA, 13 nt, Mycobacterium bovis subsp bovis AF2122/97
cggcgaucaccgu

SEQ ID NO: 1111243 - RNA, 24 nt, Mycobacterium bovis subsp bovis AF2122/97
cggcgacuacccagccagccgcga

SEQ ID NO: 1111244 - RNA, 17 nt, Mycobacterium bovis subsp bovis AF2122/97
cggcgacggcgcccaua

SEQ ID NO: 1111245 - RNA, 19 nt, Mycobacterium bovis subsp bovis AF2122/97
cggcgauccagaacaacgg

SEQ ID NO: 1111246 - RNA, 14 nt, Mycobacterium bovis subsp bovis AF2122/97
cggcgaucugcgac

SEQ ID NO: 1111247 - RNA, 20 nt, Mycobacterium bovis subsp bovis AF2122/97
cggcgaucugcgacaagacc

SEQ ID NO: 1111248 - RNA, 14 nt, Mycobacterium bovis subsp bovis AF2122/97
cggcgaucugcucg

SEQ ID NO: 1111249 - RNA, 17 nt, Mycobacterium bovis subsp bovis AF2122/97
cggcgaucugcuguguc

SEQ ID NO: 1111250 - RNA, 14 nt, Mycobacterium bovis subsp bovis AF2122/97
cggcgauccgacga

SEQ ID NO: 1111251 - RNA, 21 nt, Mycobacterium bovis subsp bovis AF2122/97
cggcgaugaacagcgacgcca

SEQ ID NO: 1111252 - RNA, 17 nt, Mycobacterium bovis subsp bovis AF2122/97
cggcgaugacaucaccg

SEQ ID NO: 1111253 - RNA, 21 nt, Mycobacterium bovis subsp bovis AF2122/97
cggcgaugacaucaccgacca

SEQ ID NO: 1111254 - RNA, 16 nt, Mycobacterium bovis subsp bovis AF2122/97
cggcgaugaccagaug

SEQ ID NO: 1111255 - RNA, 14 nt, Mycobacterium bovis subsp bovis AF2122/97
cggcgaugcgcggg

SEQ ID NO: 1111256 - RNA, 18 nt, Mycobacterium bovis subsp bovis AF2122/97
cggcgaugcgcggguggu

SEQ ID NO: 1111257 - RNA, 16 nt, Mycobacterium bovis subsp bovis AF2122/97
cggcgaugaauagguc

SEQ ID NO: 1111258 - RNA, 14 nt, Mycobacterium bovis subsp bovis AF2122/97
cggcgaugaucacc

SEQ ID NO: 1111259 - RNA, 16 nt, Mycobacterium bovis subsp bovis AF2122/97
cggcgaugcggucggc

SEQ ID NO: 1111260 - RNA, 20 nt, Mycobacterium bovis subsp bovis AF2122/97
cggcgaugcggucggccaca

SEQ ID NO: 1111261 - RNA, 21 nt, Mycobacterium bovis subsp bovis AF2122/97
cggcgaugcggucggccacau

SEQ ID NO: 1111262 - RNA, 16 nt, Mycobacterium bovis subsp bovis AF2122/97
cggcgaugcugagccg

SEQ ID NO: 1111263 - RNA, 17 nt, Mycobacterium bovis subsp bovis AF2122/97
cggcgaugguaucgccg

SEQ ID NO: 1111264 - RNA, 15 nt, Mycobacterium bovis subsp bovis AF2122/97
cggcgauggcgcgca

SEQ ID NO: 1111265 - RNA, 23 nt, Mycobacterium bovis subsp bovis AF2122/97
cggcgauggcgcgcaacguagcc

SEQ ID NO: 1111266 - RNA, 20 nt, Mycobacterium bovis subsp bovis AF2122/97
cggcgaucuuggaucgguug

SEQ ID NO: 1111267 - RNA, 17 nt, Mycobacterium bovis subsp bovis AF2122/97
cggcgauggcggcaucg

SEQ ID NO: 1111268 - RNA, 16 nt, Mycobacterium bovis subsp bovis AF2122/97
cggcgauggcggcauc

SEQ ID NO: 1111269 - RNA, 19 nt, Mycobacterium bovis subsp bovis AF2122/97
cggcgaugguaucgccgcu

SEQ ID NO: 1111270 - RNA, 20 nt, Mycobacterium bovis subsp bovis AF2122/97
cggcgaugguaucgccgcua

SEQ ID NO: 1111271 - RNA, 21 nt, Mycobacterium bovis subsp bovis AF2122/97
cggcgaugguaucgccgcuag

SEQ ID NO: 1111272 - RNA, 16 nt, Mycobacterium bovis subsp bovis AF2122/97
cggcgcaacaaccggu

SEQ ID NO: 1111273 - RNA, 17 nt, Mycobacterium bovis subsp bovis AF2122/97
cggcgcaacaccucgua

SEQ ID NO: 1111274 - RNA, 18 nt, Mycobacterium bovis subsp bovis AF2122/97
cggcgcaccaucgcggcc

SEQ ID NO: 1111275 - RNA, 19 nt, Mycobacterium bovis subsp bovis AF2122/97
cggcgcaccaucgcggccg

SEQ ID NO: 1111276 - RNA, 13 nt, Mycobacterium bovis subsp bovis AF2122/97
cggcgcagcaccg

SEQ ID NO: 1111277 - RNA, 17 nt, Mycobacterium bovis subsp bovis AF2122/97
cggcgcagcacggcggc

SEQ ID NO: 1111278 - RNA, 16 nt, Mycobacterium bovis subsp bovis AF2122/97
cggcgcagcgacgcga

SEQ ID NO: 1111279 - RNA, 21 nt, Mycobacterium bovis subsp bovis AF2122/97
cggcgcagcgacgcgauuucg

SEQ ID NO: 1111280 - RNA, 16 nt, Mycobacterium bovis subsp bovis AF2122/97
cggcgcagcgaccggu

SEQ ID NO: 1111281 - RNA, 15 nt, Mycobacterium bovis subsp bovis AF2122/97
cggcgcacaacccgu

SEQ ID NO: 1111282 - RNA, 12 nt, Mycobacterium bovis subsp bovis AF2122/97
cggcgcaccaca

SEQ ID NO: 1111283 - RNA, 19 nt, Mycobacterium bovis subsp bovis AF2122/97
cggcgcaccacaccacggu

SEQ ID NO: 1111284 - RNA, 14 nt, Mycobacterium bovis subsp bovis AF2122/97
cggcgccgccgaug

SEQ ID NO: 1111285 - RNA, 20 nt, Mycobacterium bovis subsp bovis AF2122/97
cggcgccgcccuugccgccg

SEQ ID NO: 1111286 - RNA, 21 nt, Mycobacterium bovis subsp bovis AF2122/97
cggcgccgcccuugccgccgg

SEQ ID NO: 1111287 - RNA, 22 nt, Mycobacterium bovis subsp bovis AF2122/97
cggcgccgcccuugccgccggc

SEQ ID NO: 1111288 - RNA, 11 nt, Mycobacterium bovis subsp bovis AF2122/97
cggcgccgccg

SEQ ID NO: 1111289 - RNA, 12 nt, Mycobacterium bovis subsp bovis AF2122/97
cggcgccgccga

SEQ ID NO: 1111290 - RNA, 20 nt, Mycobacterium bovis subsp bovis AF2122/97
cggcgccgcccuaaggggca

SEQ ID NO: 1111291 - RNA, 13 nt, Mycobacterium bovis subsp bovis AF2122/97
cggcgccgcccuu

SEQ ID NO: 1111292 - RNA, 14 nt, Mycobacterium bovis subsp bovis AF2122/97
cggcgccgcccuug

SEQ ID NO: 1111293 - RNA, 17 nt, Mycobacterium bovis subsp bovis AF2122/97
cggcgccgcccuugccg

SEQ ID NO: 1111294 - RNA, 13 nt, Mycobacterium bovis subsp bovis AF2122/97
cggcgccgccacu

SEQ ID NO: 1111295 - RNA, 16 nt, Mycobacterium bovis subsp bovis AF2122/97
cggcgccgccacugcc

SEQ ID NO: 1111296 - RNA, 23 nt, Mycobacterium bovis subsp bovis AF2122/97
cggcgccgccacugccggcagcg

SEQ ID NO: 1111297 - RNA, 13 nt, Mycobacterium bovis subsp bovis AF2122/97
cggcgccgccagc

SEQ ID NO: 1111298 - RNA, 16 nt, Mycobacterium bovis subsp bovis AF2122/97
cggcgccgccagcacc

SEQ ID NO: 1111299 - RNA, 17 nt, Mycobacterium bovis subsp bovis AF2122/97
cggcgccgccagcacca

SEQ ID NO: 1111300 - RNA, 20 nt, Mycobacterium bovis subsp bovis AF2122/97
cggcgccgccagcaccaccg

SEQ ID NO: 1111301 - RNA, 23 nt, Mycobacterium bovis subsp bovis AF2122/97
cggcgccgccagcaccaccggcu

SEQ ID NO: 1111302 - RNA, 14 nt, Mycobacterium bovis subsp bovis AF2122/97
cggcgccgcccaau

SEQ ID NO: 1111303 - RNA, 13 nt, Mycobacterium bovis subsp bovis AF2122/97
cggcgccgcccgc

SEQ ID NO: 1111304 - RNA, 21 nt, Mycobacterium bovis subsp bovis AF2122/97
cggcgccgcccgcgccgccgc

SEQ ID NO: 1111305 - RNA, 20 nt, Mycobacterium bovis subsp bovis AF2122/97
cggcgccgccggcacccgcc

SEQ ID NO: 1111306 - RNA, 17 nt, Mycobacterium bovis subsp bovis AF2122/97
cggcgccgccggcaccg

SEQ ID NO: 1111307 - RNA, 18 nt, Mycobacterium bovis subsp bovis AF2122/97
cggcgccgccggcgccgc

SEQ ID NO: 1111308 - RNA, 19 nt, Mycobacterium bovis subsp bovis AF2122/97
cggcgccgccggcgccgcc

SEQ ID NO: 1111309 - RNA, 12 nt, Mycobacterium bovis subsp bovis AF2122/97
cggcgccgccgu

SEQ ID NO: 1111310 - RNA, 15 nt, Mycobacterium bovis subsp bovis AF2122/97
cggcgccgccgucca

SEQ ID NO: 1111311 - RNA, 22 nt, Mycobacterium bovis subsp bovis AF2122/97
cggcgccgccguccagcgccgc

SEQ ID NO: 1111312 - RNA, 13 nt, Mycobacterium bovis subsp bovis AF2122/97
cggcgccgccggu

SEQ ID NO: 1111313 - RNA, 21 nt, Mycobacterium bovis subsp bovis AF2122/97
cggcgccgccggugccaccgg

SEQ ID NO: 1111314 - RNA, 14 nt, Mycobacterium bovis subsp bovis AF2122/97
cggcgccgccguuc

SEQ ID NO: 1111315 - RNA, 22 nt, Mycobacterium bovis subsp bovis AF2122/97
cggcgccgccguucccgccggc

SEQ ID NO: 1111316 - RNA, 15 nt, Mycobacterium bovis subsp bovis AF2122/97
cggcgccgccgucgc

SEQ ID NO: 1111317 - RNA, 18 nt, Mycobacterium bovis subsp bovis AF2122/97
cggcgccgccgucgccgc

SEQ ID NO: 1111318 - RNA, 19 nt, Mycobacterium bovis subsp bovis AF2122/97
cggcgccgccgugcggguu

SEQ ID NO: 1111319 - RNA, 14 nt, Mycobacterium bovis subsp bovis AF2122/97
cggcgccgccguua

SEQ ID NO: 1111320 - RNA, 20 nt, Mycobacterium bovis subsp bovis AF2122/97
cggcgccgccguuaccgccg

SEQ ID NO: 1111321 - RNA, 18 nt, Mycobacterium bovis subsp bovis AF2122/97
cggcgccgcgggugcggc

SEQ ID NO: 1111322 - RNA, 19 nt, Mycobacterium bovis subsp bovis AF2122/97
cggcgccgcgggugcggca

SEQ ID NO: 1111323 - RNA, 14 nt, Mycobacterium bovis subsp bovis AF2122/97
cggcgccgcgccgu

SEQ ID NO: 1111324 - RNA, 23 nt, Mycobacterium bovis subsp bovis AF2122/97
cggcgccgccuggacgccgccgg

SEQ ID NO: 1111325 - RNA, 23 nt, Mycobacterium bovis subsp bovis AF2122/97
cggcgccggaggcggcgcuuucg

SEQ ID NO: 1111326 - RNA, 16 nt, Mycobacterium bovis subsp bovis AF2122/97
cggcgccggaguugaa

SEQ ID NO: 1111327 - RNA, 14 nt, Mycobacterium bovis subsp bovis AF2122/97
cggcgccggcaucg

SEQ ID NO: 1111328 - RNA, 14 nt, Mycobacterium bovis subsp bovis AF2122/97
cggcgccggcgcug

SEQ ID NO: 1111329 - RNA, 14 nt, Mycobacterium bovis subsp bovis AF2122/97
cggcgccggcgccu

SEQ ID NO: 1111330 - RNA, 14 nt, Mycobacterium bovis subsp bovis AF2122/97
cggcgccggcgucg

SEQ ID NO: 1111331 - RNA, 18 nt, Mycobacterium bovis subsp bovis AF2122/97
cggcgccggcgcugcugc

SEQ ID NO: 1111332 - RNA, 17 nt, Mycobacterium bovis subsp bovis AF2122/97
cggcgccggcggccgcg

SEQ ID NO: 1111333 - RNA, 15 nt, Mycobacterium bovis subsp bovis AF2122/97
cggcgccggcgucgg

SEQ ID NO: 1111334 - RNA, 18 nt, Mycobacterium bovis subsp bovis AF2122/97
cggcgccgggucgauggg

SEQ ID NO: 1111335 - RNA, 15 nt, Mycobacterium bovis subsp bovis AF2122/97
cggcgccggugccgc

SEQ ID NO: 1111336 - RNA, 19 nt, Mycobacterium bovis subsp bovis AF2122/97
cggcgccguagccgaucaa

SEQ ID NO: 1111337 - RNA, 16 nt, Mycobacterium bovis subsp bovis AF2122/97
cggcgccggugguaac

SEQ ID NO: 1111338 - RNA, 22 nt, Mycobacterium bovis subsp bovis AF2122/97
cggcgccggugguaacggcggc

SEQ ID NO: 1111339 - RNA, 23 nt, Mycobacterium bovis subsp bovis AF2122/97
cggcgccggugguaccggcggcg

SEQ ID NO: 1111340 - RNA, 23 nt, Mycobacterium bovis subsp bovis AF2122/97
cggcgccgucggagccggccacc

SEQ ID NO: 1111341 - RNA, 14 nt, Mycobacterium bovis subsp bovis AF2122/97
cggcgccgugauca

SEQ ID NO: 1111342 - RNA, 23 nt, Mycobacterium bovis subsp bovis AF2122/97
cggcgccguugccaccguugccg

SEQ ID NO: 1111343 - RNA, 14 nt, Mycobacterium bovis subsp bovis AF2122/97
cggcgccgucguca

SEQ ID NO: 1111344 - RNA, 15 nt, Mycobacterium bovis subsp bovis AF2122/97
cggcgccgugucacc

SEQ ID NO: 1111345 - RNA, 23 nt, Mycobacterium bovis subsp bovis AF2122/97
cggcgccucaucggacagcgccu

SEQ ID NO: 1111346 - RNA, 19 nt, Mycobacterium bovis subsp bovis AF2122/97
cggcgccuacaccggcgcu

SEQ ID NO: 1111347 - RNA, 14 nt, Mycobacterium bovis subsp bovis AF2122/97
cggcgccucggacc

SEQ ID NO: 1111348 - RNA, 15 nt, Mycobacterium bovis subsp bovis AF2122/97
cggcgccucguugcc

SEQ ID NO: 1111349 - RNA, 15 nt, Mycobacterium bovis subsp bovis AF2122/97
cggcgccuccgcucg

SEQ ID NO: 1111350 - RNA, 17 nt, Mycobacterium bovis subsp bovis AF2122/97
cggcgccuccgcucggu

SEQ ID NO: 1111351 - RNA, 16 nt, Mycobacterium bovis subsp bovis AF2122/97
cggcgccuccggcacc

SEQ ID NO: 1111352 - RNA, 17 nt, Mycobacterium bovis subsp bovis AF2122/97
cggcgccuuggucgccg

SEQ ID NO: 1111353 - RNA, 14 nt, Mycobacterium bovis subsp bovis AF2122/97
cggcgcgcagcgau

SEQ ID NO: 1111354 - RNA, 21 nt, Mycobacterium bovis subsp bovis AF2122/97
cggcgcgcagcgauucgccua

SEQ ID NO: 1111355 - RNA, 15 nt, Mycobacterium bovis subsp bovis AF2122/97
cggcgcgccccaccg

SEQ ID NO: 1111356 - RNA, 16 nt, Mycobacterium bovis subsp bovis AF2122/97
cggcgcgccccaccgc

SEQ ID NO: 1111357 - RNA, 16 nt, Mycobacterium bovis subsp bovis AF2122/97
cggcgcgccccgccgc

SEQ ID NO: 1111358 - RNA, 14 nt, Mycobacterium bovis subsp bovis AF2122/97
cggcgcgccgggcg

SEQ ID NO: 1111359 - RNA, 16 nt, Mycobacterium bovis subsp bovis AF2122/97
cggcgcgccgggcggc

SEQ ID NO: 1111360 - RNA, 20 nt, Mycobacterium bovis subsp bovis AF2122/97
cggcgcgccguugccggcca

SEQ ID NO: 1111361 - RNA, 16 nt, Mycobacterium bovis subsp bovis AF2122/97
cggcgcgcgcgccggc

SEQ ID NO: 1111362 - RNA, 18 nt, Mycobacterium bovis subsp bovis AF2122/97
cggcgcgcggguugucgg

SEQ ID NO: 1111363 - RNA, 21 nt, Mycobacterium bovis subsp bovis AF2122/97
cggcgcgcggguugucggcga

SEQ ID NO: 1111364 - RNA, 21 nt, Mycobacterium bovis subsp bovis AF2122/97
cggcgcggaacgcgucgccga

SEQ ID NO: 1111365 - RNA, 23 nt, Mycobacterium bovis subsp bovis AF2122/97
cggcgcggaacgcgucgccgacg

SEQ ID NO: 1111366 - RNA, 19 nt, Mycobacterium bovis subsp bovis AF2122/97
cggcgcgaggaggcuuaca

SEQ ID NO: 1111367 - RNA, 22 nt, Mycobacterium bovis subsp bovis AF2122/97
cggcgcgaucagguaccggcgg

SEQ ID NO: 1111368 - RNA, 15 nt, Mycobacterium bovis subsp bovis AF2122/97
cggcgcgagcagaca

SEQ ID NO: 1111369 - RNA, 16 nt, Mycobacterium bovis subsp bovis AF2122/97
cggcgcgagcagacac

SEQ ID NO: 1111370 - RNA, 13 nt, Mycobacterium bovis subsp bovis AF2122/97
cggcgcgagccgc

SEQ ID NO: 1111371 - RNA, 14 nt, Mycobacterium bovis subsp bovis AF2122/97
cggcgcgagccgca

SEQ ID NO: 1111372 - RNA, 16 nt, Mycobacterium bovis subsp bovis AF2122/97
cggcgcgaggaacgcc

SEQ ID NO: 1111373 - RNA, 16 nt, Mycobacterium bovis subsp bovis AF2122/97
cggcgcgagcagacgc

SEQ ID NO: 1111374 - RNA, 18 nt, Mycobacterium bovis subsp bovis AF2122/97
cggcgcgaggaacgccgg

SEQ ID NO: 1111375 - RNA, 14 nt, Mycobacterium bovis subsp bovis AF2122/97
cggcgcgaccgcgg

SEQ ID NO: 1111376 - RNA, 23 nt, Mycobacterium bovis subsp bovis AF2122/97
cggcgcgacagacagcaccgccg

SEQ ID NO: 1111377 - RNA, 22 nt, Mycobacterium bovis subsp bovis AF2122/97
cggcgcgaccagaaucgggccg

SEQ ID NO: 1111378 - RNA, 19 nt, Mycobacterium bovis subsp bovis AF2122/97
cggcgccugacucaucacc

SEQ ID NO: 1111379 - RNA, 18 nt, Mycobacterium bovis subsp bovis AF2122/97
cggcgcgcaccucggcga

SEQ ID NO: 1111380 - RNA, 16 nt, Mycobacterium bovis subsp bovis AF2122/97
cggcgcgcaccccggc

SEQ ID NO: 1111381 - RNA, 14 nt, Mycobacterium bovis subsp bovis AF2122/97
cggcgcgcaccccg

SEQ ID NO: 1111382 - RNA, 15 nt, Mycobacterium bovis subsp bovis AF2122/97
cggcgcgaucgucgg

SEQ ID NO: 1111383 - RNA, 19 nt, Mycobacterium bovis subsp bovis AF2122/97
cggcgcgaucgacgcucgg

SEQ ID NO: 1111384 - RNA, 18 nt, Mycobacterium bovis subsp bovis AF2122/97
cggcaggcuggcgagggc

SEQ ID NO: 1111385 - RNA, 18 nt, Mycobacterium bovis subsp bovis AF2122/97
cggcaucgaucaacacca

SEQ ID NO: 1111386 - RNA, 12 nt, Mycobacterium bovis subsp bovis AF2122/97
cggcaucgauca

SEQ ID NO: 1111387 - RNA, 15 nt, Mycobacterium bovis subsp bovis AF2122/97
cggcaggcggccgcc

SEQ ID NO: 1111388 - RNA, 13 nt, Mycobacterium bovis subsp bovis AF2122/97
cggcaggccggcc

SEQ ID NO: 1111389 - RNA, 18 nt, Mycobacterium bovis subsp bovis AF2122/97
cggcaggccggcgucgau

SEQ ID NO: 1111390 - RNA, 15 nt, Mycobacterium bovis subsp bovis AF2122/97
cggcaggccuggcga

SEQ ID NO: 1111391 - RNA, 15 nt, Mycobacterium bovis subsp bovis AF2122/97
cggcaucggcgacga

SEQ ID NO: 1111392 - RNA, 17 nt, Mycobacterium bovis subsp bovis AF2122/97
cggcaucgcgggcggcg

SEQ ID NO: 1111393 - RNA, 20 nt, Mycobacterium bovis subsp bovis AF2122/97
cggcaucggucaccgcggca

SEQ ID NO: 1111394 - RNA, 21 nt, Mycobacterium bovis subsp bovis AF2122/97
cggcaucgguucguagcgggc

SEQ ID NO: 1111395 - RNA, 15 nt, Mycobacterium bovis subsp bovis AF2122/97
cggcaucggcggcaa

SEQ ID NO: 1111396 - RNA, 15 nt, Mycobacterium bovis subsp bovis AF2122/97
cggcaucgucggguc

SEQ ID NO: 1111397 - RNA, 14 nt, Mycobacterium bovis subsp bovis AF2122/97
cggcaucuccaccg

SEQ ID NO: 1111398 - RNA, 17 nt, Mycobacterium bovis subsp bovis AF2122/97
cggcaucgccgcgggug

SEQ ID NO: 1111399 - RNA, 15 nt, Mycobacterium bovis subsp bovis AF2122/97
cggcaucgccgagcu

SEQ ID NO: 1111400 - RNA, 16 nt, Mycobacterium bovis subsp bovis AF2122/97
cggcaucgccgagcuc

SEQ ID NO: 1111401 - RNA, 23 nt, Mycobacterium bovis subsp bovis AF2122/97
cggcaucgcgaucggggcgacga

SEQ ID NO: 1111402 - RNA, 20 nt, Mycobacterium bovis subsp bovis AF2122/97
cggcaucggagauacgggcc

SEQ ID NO: 1111403 - RNA, 16 nt, Mycobacterium bovis subsp bovis AF2122/97
cggcauguucagcccg

SEQ ID NO: 1111404 - RNA, 17 nt, Mycobacterium bovis subsp bovis AF2122/97
cggcauguuccuugcgg

SEQ ID NO: 1111405 - RNA, 21 nt, Mycobacterium bovis subsp bovis AF2122/97
cggcauguuccuugcggccgc

SEQ ID NO: 1111406 - RNA, 21 nt, Mycobacterium bovis subsp bovis AF2122/97
cggcaugugacaucgggccgc

SEQ ID NO: 1111407 - RNA, 20 nt, Mycobacterium bovis subsp bovis AF2122/97
cggcauguaccgaccgcguu

SEQ ID NO: 1111408 - RNA, 17 nt, Mycobacterium bovis subsp bovis AF2122/97
cggcauguaccgaccgc

SEQ ID NO: 1111409 - RNA, 17 nt, Mycobacterium bovis subsp bovis AF2122/97
cggcaugaucuuccgga

SEQ ID NO: 1111410 - RNA, 20 nt, Mycobacterium bovis subsp bovis AF2122/97
cggcaugacgaaugcgggug

SEQ ID NO: 1111411 - RNA, 14 nt, Mycobacterium bovis subsp bovis AF2122/97
cggcaugggccggc

SEQ ID NO: 1111412 - RNA, 16 nt, Mycobacterium bovis subsp bovis AF2122/97
cggcaugggccggcgc

SEQ ID NO: 1111413 - RNA, 21 nt, Mycobacterium bovis subsp bovis AF2122/97
cggcaugggccggcgccgcac

SEQ ID NO: 1111414 - RNA, 20 nt, Mycobacterium bovis subsp bovis AF2122/97
cggcaucgucgacgcccgau

SEQ ID NO: 1111415 - RNA, 19 nt, Mycobacterium bovis subsp bovis AF2122/97
cggcaucuccaccgucgcc

SEQ ID NO: 1111416 - RNA, 23 nt, Mycobacterium bovis subsp bovis AF2122/97
cggcaucuccaccgucgccgccg

SEQ ID NO: 1111417 - RNA, 16 nt, Mycobacterium bovis subsp bovis AF2122/97
cggcaucucgcaccgc

SEQ ID NO: 1111418 - RNA, 18 nt, Mycobacterium bovis subsp bovis AF2122/97
cggccaauugcgccgcca

SEQ ID NO: 1111419 - RNA, 20 nt, Mycobacterium bovis subsp bovis AF2122/97
cggccaauugcgccgccaac

SEQ ID NO: 1111420 - RNA, 18 nt, Mycobacterium bovis subsp bovis AF2122/97
cggccaauggccgcggca

SEQ ID NO: 1111421 - RNA, 23 nt, Mycobacterium bovis subsp bovis AF2122/97
cggccaauggccgcggcacccag

SEQ ID NO: 1111422 - RNA, 12 nt, Mycobacterium bovis subsp bovis AF2122/97
cggccacaaccu

SEQ ID NO: 1111423 - RNA, 18 nt, Mycobacterium bovis subsp bovis AF2122/97
cggccacaaccucgucgu

SEQ ID NO: 1111424 - RNA, 15 nt, Mycobacterium bovis subsp bovis AF2122/97
cggccaauggccugc

SEQ ID NO: 1111425 - RNA, 17 nt, Mycobacterium bovis subsp bovis AF2122/97
cggccaauggugggcga

SEQ ID NO: 1111426 - RNA, 20 nt, Mycobacterium bovis subsp bovis AF2122/97
cggccaauggugggcgagcu

SEQ ID NO: 1111427 - RNA, 14 nt, Mycobacterium bovis subsp bovis AF2122/97
cggccaagucacca

SEQ ID NO: 1111428 - RNA, 15 nt, Mycobacterium bovis subsp bovis AF2122/97
cggccaagucaccau

SEQ ID NO: 1111429 - RNA, 17 nt, Mycobacterium bovis subsp bovis AF2122/97
cggccaaucagcccgcc

SEQ ID NO: 1111430 - RNA, 19 nt, Mycobacterium bovis subsp bovis AF2122/97
cggccaagggugcuugucg

SEQ ID NO: 1111431 - RNA, 12 nt, Mycobacterium bovis subsp bovis AF2122/97
cggccaaggucg

SEQ ID NO: 1111432 - RNA, 14 nt, Mycobacterium bovis subsp bovis AF2122/97
cggcauucaccgcg

SEQ ID NO: 1111433 - RNA, 15 nt, Mycobacterium bovis subsp bovis AF2122/97
cggcauucaccgcgg

SEQ ID NO: 1111434 - RNA, 14 nt, Mycobacterium bovis subsp bovis AF2122/97
cggcauuccacagg

SEQ ID NO: 1111435 - RNA, 12 nt, Mycobacterium bovis subsp bovis AF2122/97
cggccacaccgu

SEQ ID NO: 1111436 - RNA, 18 nt, Mycobacterium bovis subsp bovis AF2122/97
cggccacaaugcggccgu

SEQ ID NO: 1111437 - RNA, 16 nt, Mycobacterium bovis subsp bovis AF2122/97
cggccacaccgucacg

SEQ ID NO: 1111438 - RNA, 21 nt, Mycobacterium bovis subsp bovis AF2122/97
cggccacaccgucacgccacc

SEQ ID NO: 1111439 - RNA, 19 nt, Mycobacterium bovis subsp bovis AF2122/97
cggccacaccuuggccgcc

SEQ ID NO: 1111440 - RNA, 22 nt, Mycobacterium bovis subsp bovis AF2122/97
cggccacaccuuggccgccggc

SEQ ID NO: 1111441 - RNA, 21 nt, Mycobacterium bovis subsp bovis AF2122/97
cggccaccaacucggcgaccu

SEQ ID NO: 1111442 - RNA, 20 nt, Mycobacterium bovis subsp bovis AF2122/97
cggccacaucgccagcagca

SEQ ID NO: 1111443 - RNA, 17 nt, Mycobacterium bovis subsp bovis AF2122/97
cggccacaugccacagc

SEQ ID NO: 1111444 - RNA, 22 nt, Mycobacterium bovis subsp bovis AF2122/97
cggccacagugcauacgguuga

SEQ ID NO: 1111445 - RNA, 18 nt, Mycobacterium bovis subsp bovis AF2122/97
cggccacauaccaccacg

SEQ ID NO: 1111446 - RNA, 19 nt, Mycobacterium bovis subsp bovis AF2122/97
cggccacauccagcgcuuc

SEQ ID NO: 1111447 - RNA, 12 nt, Mycobacterium bovis subsp bovis AF2122/97
cggccaccaccg

SEQ ID NO: 1111448 - RNA, 13 nt, Mycobacterium bovis subsp bovis AF2122/97
cggccaccaccgc

SEQ ID NO: 1111449 - RNA, 14 nt, Mycobacterium bovis subsp bovis AF2122/97
cggccaccaccgcc

SEQ ID NO: 1111450 - RNA, 19 nt, Mycobacterium bovis subsp bovis AF2122/97
cggccaccaccgccgccgg

SEQ ID NO: 1111451 - RNA, 21 nt, Mycobacterium bovis subsp bovis AF2122/97
cggccaccaccgccgccggca

SEQ ID NO: 1111452 - RNA, 22 nt, Mycobacterium bovis subsp bovis AF2122/97
cggccaccaccgccgccggcac

SEQ ID NO: 1111453 - RNA, 12 nt, Mycobacterium bovis subsp bovis AF2122/97
cggccaccagcc

SEQ ID NO: 1111454 - RNA, 18 nt, Mycobacterium bovis subsp bovis AF2122/97
cggccaccaccgcgccgu

SEQ ID NO: 1111455 - RNA, 20 nt, Mycobacterium bovis subsp bovis AF2122/97
cggccaccaccgcgccgucg

SEQ ID NO: 1111456 - RNA, 14 nt, Mycobacterium bovis subsp bovis AF2122/97
cggccaccagcaug

SEQ ID NO: 1111457 - RNA, 15 nt, Mycobacterium bovis subsp bovis AF2122/97
cggccaccgccgccg

SEQ ID NO: 1111458 - RNA, 17 nt, Mycobacterium bovis subsp bovis AF2122/97
cggccaccgccgccgcc

SEQ ID NO: 1111459 - RNA, 18 nt, Mycobacterium bovis subsp bovis AF2122/97
cggccaccgccgccgcca

SEQ ID NO: 1111460 - RNA, 22 nt, Mycobacterium bovis subsp bovis AF2122/97
cggccacacucgccagggccau

SEQ ID NO: 1111461 - RNA, 20 nt, Mycobacterium bovis subsp bovis AF2122/97
cggccaccgccgccgccacc

SEQ ID NO: 1111462 - RNA, 19 nt, Mycobacterium bovis subsp bovis AF2122/97
cggccaccgccgccgccga

SEQ ID NO: 1111463 - RNA, 21 nt, Mycobacterium bovis subsp bovis AF2122/97
cggccaccgccgccgccgacg

SEQ ID NO: 1111464 - RNA, 13 nt, Mycobacterium bovis subsp bovis AF2122/97
cggccaccgccgc

SEQ ID NO: 1111465 - RNA, 15 nt, Mycobacterium bovis subsp bovis AF2122/97
cggccaccgcggcgu

SEQ ID NO: 1111466 - RNA, 17 nt, Mycobacterium bovis subsp bovis AF2122/97
cggccaccgucagcgcg

SEQ ID NO: 1111467 - RNA, 12 nt, Mycobacterium bovis subsp bovis AF2122/97
cggccaccgccu

SEQ ID NO: 1111468 - RNA, 14 nt, Mycobacterium bovis subsp bovis AF2122/97
cggccacgguccgg

SEQ ID NO: 1111469 - RNA, 17 nt, Mycobacterium bovis subsp bovis AF2122/97
cggccacgguggcgcaa

SEQ ID NO: 1111470 - RNA, 18 nt, Mycobacterium bovis subsp bovis AF2122/97
cggccacggcgucggcca

SEQ ID NO: 1111471 - RNA, 23 nt, Mycobacterium bovis subsp bovis AF2122/97
cggccacggcgucggccacccgg

SEQ ID NO: 1111472 - RNA, 18 nt, Mycobacterium bovis subsp bovis AF2122/97
cggccacguuguccgcga

SEQ ID NO: 1111473 - RNA, 20 nt, Mycobacterium bovis subsp bovis AF2122/97
cggccacguuguccgcgacg

SEQ ID NO: 1111474 - RNA, 21 nt, Mycobacterium bovis subsp bovis AF2122/97
cggccacucgcccgauccgga

SEQ ID NO: 1111475 - RNA, 15 nt, Mycobacterium bovis subsp bovis AF2122/97
cggccacuacggccu

SEQ ID NO: 1111476 - RNA, 15 nt, Mycobacterium bovis subsp bovis AF2122/97
cggccacgucgaugu

SEQ ID NO: 1111477 - RNA, 21 nt, Mycobacterium bovis subsp bovis AF2122/97
cggccacgucgaugugcgccc

SEQ ID NO: 1111478 - RNA, 19 nt, Mycobacterium bovis subsp bovis AF2122/97
cggccacgcgcacucgacg

SEQ ID NO: 1111479 - RNA, 12 nt, Mycobacterium bovis subsp bovis AF2122/97
cggccacgucga

SEQ ID NO: 1111480 - RNA, 16 nt, Mycobacterium bovis subsp bovis AF2122/97
cggccacguuguccgc

SEQ ID NO: 1111481 - RNA, 14 nt, Mycobacterium bovis subsp bovis AF2122/97
cggccacguggucg

SEQ ID NO: 1111482 - RNA, 18 nt, Mycobacterium bovis subsp bovis AF2122/97
cggccagcacgccgccgg

SEQ ID NO: 1111483 - RNA, 19 nt, Mycobacterium bovis subsp bovis AF2122/97
cggccagcacgccgccggc

SEQ ID NO: 1111484 - RNA, 23 nt, Mycobacterium bovis subsp bovis AF2122/97
cggccagcacgccgccggccgcc

SEQ ID NO: 1111485 - RNA, 17 nt, Mycobacterium bovis subsp bovis AF2122/97
cggccagcacuccgcgg

SEQ ID NO: 1111486 - RNA, 21 nt, Mycobacterium bovis subsp bovis AF2122/97
cggccagcagcaacgacccga

SEQ ID NO: 1111487 - RNA, 13 nt, Mycobacterium bovis subsp bovis AF2122/97
cggccagcagcag

SEQ ID NO: 1111488 - RNA, 16 nt, Mycobacterium bovis subsp bovis AF2122/97
cggccagcagcagaug

SEQ ID NO: 1111489 - RNA, 14 nt, Mycobacterium bovis subsp bovis AF2122/97
cggccagcaggaug

SEQ ID NO: 1111490 - RNA, 17 nt, Mycobacterium bovis subsp bovis AF2122/97
cggccagccagcgaucc

SEQ ID NO: 1111491 - RNA, 20 nt, Mycobacterium bovis subsp bovis AF2122/97
cggccagcaucagcucgaug

SEQ ID NO: 1111492 - RNA, 18 nt, Mycobacterium bovis subsp bovis AF2122/97
cggccagcaucgcggugg

SEQ ID NO: 1111493 - RNA, 22 nt, Mycobacterium bovis subsp bovis AF2122/97
cggccacucgcccgauccggau

SEQ ID NO: 1111494 - RNA, 20 nt, Mycobacterium bovis subsp bovis AF2122/97
cggccagaugguggcaugcu

SEQ ID NO: 1111495 - RNA, 13 nt, Mycobacterium bovis subsp bovis AF2122/97
cggccagcacguc

SEQ ID NO: 1111496 - RNA, 22 nt, Mycobacterium bovis subsp bovis AF2122/97
cggccagauagguuccaccggg

SEQ ID NO: 1111497 - RNA, 16 nt, Mycobacterium bovis subsp bovis AF2122/97
cggccagagccgcgcg

SEQ ID NO: 1111498 - RNA, 14 nt, Mycobacterium bovis subsp bovis AF2122/97
cggccagacggugc

SEQ ID NO: 1111499 - RNA, 17 nt, Mycobacterium bovis subsp bovis AF2122/97
cggccagacucgcgguc

SEQ ID NO: 1111500 - RNA, 18 nt, Mycobacterium bovis subsp bovis AF2122/97
cggccagacucgcggucg

SEQ ID NO: 1111501 - RNA, 19 nt, Mycobacterium bovis subsp bovis AF2122/97
cggccagacucgcggucga

SEQ ID NO: 1111502 - RNA, 14 nt, Mycobacterium bovis subsp bovis AF2122/97
cggccagagccgcg

SEQ ID NO: 1111503 - RNA, 17 nt, Mycobacterium bovis subsp bovis AF2122/97
cggccagacccuggccg

SEQ ID NO: 1111504 - RNA, 16 nt, Mycobacterium bovis subsp bovis AF2122/97
cggccagaaacccggc

SEQ ID NO: 1111505 - RNA, 21 nt, Mycobacterium bovis subsp bovis AF2122/97
cggccagaaacccggcgacca

SEQ ID NO: 1111506 - RNA, 22 nt, Mycobacterium bovis subsp bovis AF2122/97
cggccagaaacccggcgaccac

SEQ ID NO: 1111507 - RNA, 17 nt, Mycobacterium bovis subsp bovis AF2122/97
cggccagcgcgucggga

SEQ ID NO: 1111508 - RNA, 13 nt, Mycobacterium bovis subsp bovis AF2122/97
cggccagcgcugc

SEQ ID NO: 1111509 - RNA, 17 nt, Mycobacterium bovis subsp bovis AF2122/97
cggccagcgcugcugcc

SEQ ID NO: 1111510 - RNA, 21 nt, Mycobacterium bovis subsp bovis AF2122/97
cggccagcgggugaaucgaca

SEQ ID NO: 1111511 - RNA, 15 nt, Mycobacterium bovis subsp bovis AF2122/97
cggccagcuccgccu

SEQ ID NO: 1111512 - RNA, 14 nt, Mycobacterium bovis subsp bovis AF2122/97
cggccagcgugucc

SEQ ID NO: 1111513 - RNA, 21 nt, Mycobacterium bovis subsp bovis AF2122/97
cggccagcgugucccaacgcc

SEQ ID NO: 1111514 - RNA, 17 nt, Mycobacterium bovis subsp bovis AF2122/97
cggccagcguguccgcc

SEQ ID NO: 1111515 - RNA, 23 nt, Mycobacterium bovis subsp bovis AF2122/97
cggccagcgucagcuguuugccg

SEQ ID NO: 1111516 - RNA, 17 nt, Mycobacterium bovis subsp bovis AF2122/97
cggccagcgucaacagc

SEQ ID NO: 1111517 - RNA, 20 nt, Mycobacterium bovis subsp bovis AF2122/97
cggccagcucgcgggccgcg

SEQ ID NO: 1111518 - RNA, 14 nt, Mycobacterium bovis subsp bovis AF2122/97
cggccagcucggcc

SEQ ID NO: 1111519 - RNA, 17 nt, Mycobacterium bovis subsp bovis AF2122/97
cggccagcucggccagc

SEQ ID NO: 1111520 - RNA, 18 nt, Mycobacterium bovis subsp bovis AF2122/97
cggccagcucggccagcu

SEQ ID NO: 1111521 - RNA, 20 nt, Mycobacterium bovis subsp bovis AF2122/97
cggccagcugcguggcgaac

SEQ ID NO: 1111522 - RNA, 21 nt, Mycobacterium bovis subsp bovis AF2122/97
cggccagcuccucagccaccg

SEQ ID NO: 1111523 - RNA, 22 nt, Mycobacterium bovis subsp bovis AF2122/97
cggccagcuccucagccaccgc

SEQ ID NO: 1111524 - RNA, 14 nt, Mycobacterium bovis subsp bovis AF2122/97
cggccagcuguucg

SEQ ID NO: 1111525 - RNA, 18 nt, Mycobacterium bovis subsp bovis AF2122/97
cggccagcuguucgagcc

SEQ ID NO: 1111526 - RNA, 23 nt, Mycobacterium bovis subsp bovis AF2122/97
cggccagcuugcggagccgccgc

SEQ ID NO: 1111527 - RNA, 20 nt, Mycobacterium bovis subsp bovis AF2122/97
cggccagcuugagguccguc

SEQ ID NO: 1111528 - RNA, 15 nt, Mycobacterium bovis subsp bovis AF2122/97
cggccaggacaacgc

SEQ ID NO: 1111529 - RNA, 18 nt, Mycobacterium bovis subsp bovis AF2122/97
cggccaggacaacgcacc

SEQ ID NO: 1111530 - RNA, 20 nt, Mycobacterium bovis subsp bovis AF2122/97
cggccaggaguuugaccacc

SEQ ID NO: 1111531 - RNA, 15 nt, Mycobacterium bovis subsp bovis AF2122/97
cggccagccgcucca

SEQ ID NO: 1111532 - RNA, 20 nt, Mycobacterium bovis subsp bovis AF2122/97
cggccagccauggcagcgcc

SEQ ID NO: 1111533 - RNA, 24 nt, Mycobacterium bovis subsp bovis AF2122/97
cggccagccauggcagcgccgcag

SEQ ID NO: 1111534 - RNA, 18 nt, Mycobacterium bovis subsp bovis AF2122/97
cggccagccgacgcggcg

SEQ ID NO: 1111535 - RNA, 14 nt, Mycobacterium bovis subsp bovis AF2122/97
cggccagccgcggc

SEQ ID NO: 1111536 - RNA, 15 nt, Mycobacterium bovis subsp bovis AF2122/97
cggccagccgcggcc

SEQ ID NO: 1111537 - RNA, 17 nt, Mycobacterium bovis subsp bovis AF2122/97
cggccagccuaccggcu

SEQ ID NO: 1111538 - RNA, 20 nt, Mycobacterium bovis subsp bovis AF2122/97
cggccagcgaaaguguggaa

SEQ ID NO: 1111539 - RNA, 12 nt, Mycobacterium bovis subsp bovis AF2122/97
cggccagcgcgg

SEQ ID NO: 1111540 - RNA, 19 nt, Mycobacterium bovis subsp bovis AF2122/97
cggccagcgcgcgcgggug

SEQ ID NO: 1111541 - RNA, 17 nt, Mycobacterium bovis subsp bovis AF2122/97
cggccagcgcaccgccg

SEQ ID NO: 1111542 - RNA, 13 nt, Mycobacterium bovis subsp bovis AF2122/97
cggccagcgcacc

SEQ ID NO: 1111543 - RNA, 14 nt, Mycobacterium bovis subsp bovis AF2122/97
cggccaggccggcg

SEQ ID NO: 1111544 - RNA, 12 nt, Mycobacterium bovis subsp bovis AF2122/97
cggccaggccga

SEQ ID NO: 1111545 - RNA, 13 nt, Mycobacterium bovis subsp bovis AF2122/97
cggccaggccgac

SEQ ID NO: 1111546 - RNA, 15 nt, Mycobacterium bovis subsp bovis AF2122/97
cggccaggccggcgg

SEQ ID NO: 1111547 - RNA, 17 nt, Mycobacterium bovis subsp bovis AF2122/97
cggccaggccggcggcg

SEQ ID NO: 1111548 - RNA, 21 nt, Mycobacterium bovis subsp bovis AF2122/97
cggccaggccggcggcggcgc

SEQ ID NO: 1111549 - RNA, 18 nt, Mycobacterium bovis subsp bovis AF2122/97
cggccaggccgucggcgu

SEQ ID NO: 1111550 - RNA, 14 nt, Mycobacterium bovis subsp bovis AF2122/97
cggccaggcuggcc

SEQ ID NO: 1111551 - RNA, 12 nt, Mycobacterium bovis subsp bovis AF2122/97
cggccaggcggu

SEQ ID NO: 1111552 - RNA, 20 nt, Mycobacterium bovis subsp bovis AF2122/97
cggccauaucgcccaccacg

SEQ ID NO: 1111553 - RNA, 22 nt, Mycobacterium bovis subsp bovis AF2122/97
cggccauaucgcccaccacgaa

SEQ ID NO: 1111554 - RNA, 14 nt, Mycobacterium bovis subsp bovis AF2122/97
cggccauccaccgc

SEQ ID NO: 1111555 - RNA, 18 nt, Mycobacterium bovis subsp bovis AF2122/97
cggccaucccgcguucga

SEQ ID NO: 1111556 - RNA, 19 nt, Mycobacterium bovis subsp bovis AF2122/97
cggccagggcacccauccc

SEQ ID NO: 1111557 - RNA, 16 nt, Mycobacterium bovis subsp bovis AF2122/97
cggccaugguguucgg

SEQ ID NO: 1111558 - RNA, 19 nt, Mycobacterium bovis subsp bovis AF2122/97
cggccauggcgcgcaaccg

SEQ ID NO: 1111559 - RNA, 22 nt, Mycobacterium bovis subsp bovis AF2122/97
cggccauggcgcgcaaccgcug

SEQ ID NO: 1111560 - RNA, 19 nt, Mycobacterium bovis subsp bovis AF2122/97
cggccaugucagcggccug

SEQ ID NO: 1111561 - RNA, 20 nt, Mycobacterium bovis subsp bovis AF2122/97
cggccaugucagcggccugc

SEQ ID NO: 1111562 - RNA, 15 nt, Mycobacterium bovis subsp bovis AF2122/97
cggccauggcggcgc

SEQ ID NO: 1111563 - RNA, 18 nt, Mycobacterium bovis subsp bovis AF2122/97
cggccauggcggcgccgg

SEQ ID NO: 1111564 - RNA, 21 nt, Mycobacterium bovis subsp bovis AF2122/97
cggccauggcggcgccggugg

SEQ ID NO: 1111565 - RNA, 22 nt, Mycobacterium bovis subsp bovis AF2122/97
cggccauggcggcgccgguggu

SEQ ID NO: 1111566 - RNA, 13 nt, Mycobacterium bovis subsp bovis AF2122/97
cggccauggcggg

SEQ ID NO: 1111567 - RNA, 17 nt, Mycobacterium bovis subsp bovis AF2122/97
cggccauggcgggucgg

SEQ ID NO: 1111568 - RNA, 22 nt, Mycobacterium bovis subsp bovis AF2122/97
cggccauggcgggucggucggu

SEQ ID NO: 1111569 - RNA, 15 nt, Mycobacterium bovis subsp bovis AF2122/97
cggccaucgcccgau

SEQ ID NO: 1111570 - RNA, 17 nt, Mycobacterium bovis subsp bovis AF2122/97
cggccaucgaccguccg

SEQ ID NO: 1111571 - RNA, 21 nt, Mycobacterium bovis subsp bovis AF2122/97
cggccaucgaccguccggguc

SEQ ID NO: 1111572 - RNA, 13 nt, Mycobacterium bovis subsp bovis AF2122/97
cggccauggugag

SEQ ID NO: 1111573 - RNA, 24 nt, Mycobacterium bovis subsp bovis AF2122/97
cggccaugucuccgacauuggccg

SEQ ID NO: 1111574 - RNA, 18 nt, Mycobacterium bovis subsp bovis AF2122/97
cggccauuagcagcaccc

SEQ ID NO: 1111575 - RNA, 19 nt, Mycobacterium bovis subsp bovis AF2122/97
cggccauuagcagcacccg

SEQ ID NO: 1111576 - RNA, 22 nt, Mycobacterium bovis subsp bovis AF2122/97
cggccauuagcagcacccgggc

SEQ ID NO: 1111577 - RNA, 16 nt, Mycobacterium bovis subsp bovis AF2122/97
cggccauugcgggcuc

SEQ ID NO: 1111578 - RNA, 19 nt, Mycobacterium bovis subsp bovis AF2122/97
cggccauucuuggugaucg

SEQ ID NO: 1111579 - RNA, 16 nt, Mycobacterium bovis subsp bovis AF2122/97
cggccauugcccgggc

SEQ ID NO: 1111580 - RNA, 18 nt, Mycobacterium bovis subsp bovis AF2122/97
cggccauugcccgggcgg

SEQ ID NO: 1111581 - RNA, 22 nt, Mycobacterium bovis subsp bovis AF2122/97
cggcccacucacacaaccgacg

SEQ ID NO: 1111582 - RNA, 20 nt, Mycobacterium bovis subsp bovis AF2122/97
cggcccacggugucccgcga

SEQ ID NO: 1111583 - RNA, 16 nt, Mycobacterium bovis subsp bovis AF2122/97
cggccaucgccagccu

SEQ ID NO: 1111584 - RNA, 15 nt, Mycobacterium bovis subsp bovis AF2122/97
cggcccagcgcgcca

SEQ ID NO: 1111585 - RNA, 16 nt, Mycobacterium bovis subsp bovis AF2122/97
cggcccagcgcgccag

SEQ ID NO: 1111586 - RNA, 13 nt, Mycobacterium bovis subsp bovis AF2122/97
cggcccagcgcgc

SEQ ID NO: 1111587 - RNA, 19 nt, Mycobacterium bovis subsp bovis AF2122/97
cggccccgccagcgccgcc

SEQ ID NO: 1111588 - RNA, 20 nt, Mycobacterium bovis subsp bovis AF2122/97
cggccccgccagcgccgccg

SEQ ID NO: 1111589 - RNA, 21 nt, Mycobacterium bovis subsp bovis AF2122/97
cggccccgccagcgccgccga

SEQ ID NO: 1111590 - RNA, 22 nt, Mycobacterium bovis subsp bovis AF2122/97
cggccccgccagcgccgccgga

SEQ ID NO: 1111591 - RNA, 12 nt, Mycobacterium bovis subsp bovis AF2122/97
cggccccgccag

SEQ ID NO: 1111592 - RNA, 14 nt, Mycobacterium bovis subsp bovis AF2122/97
cggccccgccgccg

SEQ ID NO: 1111593 - RNA, 13 nt, Mycobacterium bovis subsp bovis AF2122/97
cggccccgccgcu

SEQ ID NO: 1111594 - RNA, 17 nt, Mycobacterium bovis subsp bovis AF2122/97
cggccccgccgcuaccg

SEQ ID NO: 1111595 - RNA, 20 nt, Mycobacterium bovis subsp bovis AF2122/97
cggccccgccgcuaccgaac

SEQ ID NO: 1111596 - RNA, 15 nt, Mycobacterium bovis subsp bovis AF2122/97
cggccccgccggccc

SEQ ID NO: 1111597 - RNA, 16 nt, Mycobacterium bovis subsp bovis AF2122/97
cggccccgccggcgcc

SEQ ID NO: 1111598 - RNA, 18 nt, Mycobacterium bovis subsp bovis AF2122/97
cggccccgccgucaccgc

SEQ ID NO: 1111599 - RNA, 21 nt, Mycobacterium bovis subsp bovis AF2122/97
cggccccgaaacgauggccgg

SEQ ID NO: 1111600 - RNA, 15 nt, Mycobacterium bovis subsp bovis AF2122/97
cggccccgacacagc

SEQ ID NO: 1111601 - RNA, 20 nt, Mycobacterium bovis subsp bovis AF2122/97
cggccccgacacagcggcgg

SEQ ID NO: 1111602 - RNA, 22 nt, Mycobacterium bovis subsp bovis AF2122/97
cggccccgacacagcggcgggu

SEQ ID NO: 1111603 - RNA, 15 nt, Mycobacterium bovis subsp bovis AF2122/97
cggccccgacugccg

SEQ ID NO: 1111604 - RNA, 17 nt, Mycobacterium bovis subsp bovis AF2122/97
cggcccccgacuccggc

SEQ ID NO: 1111605 - RNA, 18 nt, Mycobacterium bovis subsp bovis AF2122/97
cggcccccgaggcuggca

SEQ ID NO: 1111606 - RNA, 14 nt, Mycobacterium bovis subsp bovis AF2122/97
cggccccccccagg

SEQ ID NO: 1111607 - RNA, 14 nt, Mycobacterium bovis subsp bovis AF2122/97
cggccccaccggug

SEQ ID NO: 1111608 - RNA, 19 nt, Mycobacterium bovis subsp bovis AF2122/97
cggccccaccggugccgcc

SEQ ID NO: 1111609 - RNA, 23 nt, Mycobacterium bovis subsp bovis AF2122/97
cggccccaccggugccgccguug

SEQ ID NO: 1111610 - RNA, 22 nt, Mycobacterium bovis subsp bovis AF2122/97
cggcaccggugcccaccaccga

SEQ ID NO: 1111611 - RNA, 19 nt, Mycobacterium bovis subsp bovis AF2122/97
cggcaccggccgugccgcc

SEQ ID NO: 1111612 - RNA, 15 nt, Mycobacterium bovis subsp bovis AF2122/97
cggcaccggccuugc

SEQ ID NO: 1111613 - RNA, 12 nt, Mycobacterium bovis subsp bovis AF2122/97
cggcaccgcccc

SEQ ID NO: 1111614 - RNA, 14 nt, Mycobacterium bovis subsp bovis AF2122/97
cggcaccggcccag

SEQ ID NO: 1111615 - RNA, 15 nt, Mycobacterium bovis subsp bovis AF2122/97
cggcaccggcccaga

SEQ ID NO: 1111616 - RNA, 13 nt, Mycobacterium bovis subsp bovis AF2122/97
cggcaccggccgu

SEQ ID NO: 1111617 - RNA, 15 nt, Mycobacterium bovis subsp bovis AF2122/97
cggcaccggccgugc

SEQ ID NO: 1111618 - RNA, 16 nt, Mycobacterium bovis subsp bovis AF2122/97
cggcaccgccagugcc

SEQ ID NO: 1111619 - RNA, 22 nt, Mycobacterium bovis subsp bovis AF2122/97
cggcaccguagagcaugccgcc

SEQ ID NO: 1111620 - RNA, 19 nt, Mycobacterium bovis subsp bovis AF2122/97
cggcaccgguuuucgccgg

SEQ ID NO: 1111621 - RNA, 23 nt, Mycobacterium bovis subsp bovis AF2122/97
cggcaccgguuuucgccggcucc

SEQ ID NO: 1111622 - RNA, 21 nt, Mycobacterium bovis subsp bovis AF2122/97
cggcaccguagagcaugccgc

SEQ ID NO: 1111623 - RNA, 16 nt, Mycobacterium bovis subsp bovis AF2122/97
cggcaccuccagcacc

SEQ ID NO: 1111624 - RNA, 17 nt, Mycobacterium bovis subsp bovis AF2122/97
cggcaccuccagcacca

SEQ ID NO: 1111625 - RNA, 15 nt, Mycobacterium bovis subsp bovis AF2122/97
cggcaccgugcgggg

SEQ ID NO: 1111626 - RNA, 16 nt, Mycobacterium bovis subsp bovis AF2122/97
cggcacgccgaccggu

SEQ ID NO: 1111627 - RNA, 16 nt, Mycobacterium bovis subsp bovis AF2122/97
cggcacgccggcggcg

SEQ ID NO: 1111628 - RNA, 20 nt, Mycobacterium bovis subsp bovis AF2122/97
cggcacgccggcggcggagg

SEQ ID NO: 1111629 - RNA, 22 nt, Mycobacterium bovis subsp bovis AF2122/97
cggcacgcgcaguuuggcggcg

SEQ ID NO: 1111630 - RNA, 13 nt, Mycobacterium bovis subsp bovis AF2122/97
cggcaccacgucg

SEQ ID NO: 1111631 - RNA, 14 nt, Mycobacterium bovis subsp bovis AF2122/97
cggcacccgacucg

SEQ ID NO: 1111632 - RNA, 18 nt, Mycobacterium bovis subsp bovis AF2122/97
cggcacccgcacggccuc

SEQ ID NO: 1111633 - RNA, 13 nt, Mycobacterium bovis subsp bovis AF2122/97
cggcacccgcacg

SEQ ID NO: 1111634 - RNA, 14 nt, Mycobacterium bovis subsp bovis AF2122/97
cggcacccgcacgg

SEQ ID NO: 1111635 - RNA, 15 nt, Mycobacterium bovis subsp bovis AF2122/97
cggcacccgcuggcg

SEQ ID NO: 1111636 - RNA, 21 nt, Mycobacterium bovis subsp bovis AF2122/97
cggcacccgcuggcgguaagc

SEQ ID NO: 1111637 - RNA, 14 nt, Mycobacterium bovis subsp bovis AF2122/97
cggcacccggucgg

SEQ ID NO: 1111638 - RNA, 24 nt, Mycobacterium bovis subsp bovis AF2122/97
cggcacccggucggccauccaccg

SEQ ID NO: 1111639 - RNA, 14 nt, Mycobacterium bovis subsp bovis AF2122/97
cggcacccucggcg

SEQ ID NO: 1111640 - RNA, 14 nt, Mycobacterium bovis subsp bovis AF2122/97
cggcacccgccgug

SEQ ID NO: 1111641 - RNA, 14 nt, Mycobacterium bovis subsp bovis AF2122/97
cggcacccgcggcg

SEQ ID NO: 1111642 - RNA, 14 nt, Mycobacterium bovis subsp bovis AF2122/97
cggcaccgauggcg

SEQ ID NO: 1111643 - RNA, 23 nt, Mycobacterium bovis subsp bovis AF2122/97
cggcaccgauggcgcaccggcgu

SEQ ID NO: 1111644 - RNA, 21 nt, Mycobacterium bovis subsp bovis AF2122/97
cggcaccaaugcggugacaac

SEQ ID NO: 1111645 - RNA, 11 nt, Mycobacterium bovis subsp bovis AF2122/97
cggcaccacca

SEQ ID NO: 1111646 - RNA, 23 nt, Mycobacterium bovis subsp bovis AF2122/97
cggcaccaccaagcucggccagc

SEQ ID NO: 1111647 - RNA, 15 nt, Mycobacterium bovis subsp bovis AF2122/97
cggcaccaccgcgac

SEQ ID NO: 1111648 - RNA, 19 nt, Mycobacterium bovis subsp bovis AF2122/97
cggcaccaccgcgaccucg

SEQ ID NO: 1111649 - RNA, 22 nt, Mycobacterium bovis subsp bovis AF2122/97
cggcaccaccgcgaccucgcgg

SEQ ID NO: 1111650 - RNA, 21 nt, Mycobacterium bovis subsp bovis AF2122/97
cggcaccagaucaacaucauc

SEQ ID NO: 1111651 - RNA, 21 nt, Mycobacterium bovis subsp bovis AF2122/97
cggcaacgaucgacaccaggg

SEQ ID NO: 1111652 - RNA, 23 nt, Mycobacterium bovis subsp bovis AF2122/97
cggcaacgaucgacaccagggcg

SEQ ID NO: 1111653 - RNA, 17 nt, Mycobacterium bovis subsp bovis AF2122/97
cggcaacgcggccuugc

SEQ ID NO: 1111654 - RNA, 21 nt, Mycobacterium bovis subsp bovis AF2122/97
cggcaacgggggcgccggagc

SEQ ID NO: 1111655 - RNA, 17 nt, Mycobacterium bovis subsp bovis AF2122/97
cggcaacgguggcaacg

SEQ ID NO: 1111656 - RNA, 14 nt, Mycobacterium bovis subsp bovis AF2122/97
cggcaacggcggcg

SEQ ID NO: 1111657 - RNA, 15 nt, Mycobacterium bovis subsp bovis AF2122/97
cggcaacggcggcga

SEQ ID NO: 1111658 - RNA, 16 nt, Mycobacterium bovis subsp bovis AF2122/97
cggcaacggcggcgac

SEQ ID NO: 1111659 - RNA, 17 nt, Mycobacterium bovis subsp bovis AF2122/97
cggcaacggcggcgacg

SEQ ID NO: 1111660 - RNA, 21 nt, Mycobacterium bovis subsp bovis AF2122/97
cggcaacggcggcgacggcgg

SEQ ID NO: 1111661 - RNA, 16 nt, Mycobacterium bovis subsp bovis AF2122/97
cggcaacggcgcgccg

SEQ ID NO: 1111662 - RNA, 17 nt, Mycobacterium bovis subsp bovis AF2122/97
cggcaacggcgcgccga

SEQ ID NO: 1111663 - RNA, 14 nt, Mycobacterium bovis subsp bovis AF2122/97
cggcaacggcggca

SEQ ID NO: 1111664 - RNA, 16 nt, Mycobacterium bovis subsp bovis AF2122/97
cggcaacggcggcauc

SEQ ID NO: 1111665 - RNA, 16 nt, Mycobacterium bovis subsp bovis AF2122/97
cggcaaccaaccgcgc

SEQ ID NO: 1111666 - RNA, 19 nt, Mycobacterium bovis subsp bovis AF2122/97
cggcaaccagcgagcccag

SEQ ID NO: 1111667 - RNA, 18 nt, Mycobacterium bovis subsp bovis AF2122/97
cggcaacccacacgcccu

SEQ ID NO: 1111668 - RNA, 16 nt, Mycobacterium bovis subsp bovis AF2122/97
cggcaaccccgagcgg

SEQ ID NO: 1111669 - RNA, 14 nt, Mycobacterium bovis subsp bovis AF2122/97
cggcaaccgccgug

SEQ ID NO: 1111670 - RNA, 21 nt, Mycobacterium bovis subsp bovis AF2122/97
cggcaaccgggaggccaccgc

SEQ ID NO: 1111671 - RNA, 13 nt, Mycobacterium bovis subsp bovis AF2122/97
cggcaaccgggau

SEQ ID NO: 1111672 - RNA, 22 nt, Mycobacterium bovis subsp bovis AF2122/97
cggcaaccgggaucugcuccgc

SEQ ID NO: 1111673 - RNA, 16 nt, Mycobacterium bovis subsp bovis AF2122/97
cggcaaccugcgacca

SEQ ID NO: 1111674 - RNA, 16 nt, Mycobacterium bovis subsp bovis AF2122/97
cggcaaccugaaucca

SEQ ID NO: 1111675 - RNA, 20 nt, Mycobacterium bovis subsp bovis AF2122/97
cggcaaccugaauccagacc

SEQ ID NO: 1111676 - RNA, 21 nt, Mycobacterium bovis subsp bovis AF2122/97
cggcaaccugaauccagacca

SEQ ID NO: 1111677 - RNA, 21 nt, Mycobacterium bovis subsp bovis AF2122/97
cggcacacgaguacagaucga

SEQ ID NO: 1111678 - RNA, 16 nt, Mycobacterium bovis subsp bovis AF2122/97
cggcacacggccuugc

SEQ ID NO: 1111679 - RNA, 14 nt, Mycobacterium bovis subsp bovis AF2122/97
cggcacaaucggcg

SEQ ID NO: 1111680 - RNA, 13 nt, Mycobacterium bovis subsp bovis AF2122/97
cggcacaggcggc

SEQ ID NO: 1111681 - RNA, 16 nt, Mycobacterium bovis subsp bovis AF2122/97
cggcacaggcggccag

SEQ ID NO: 1111682 - RNA, 17 nt, Mycobacterium bovis subsp bovis AF2122/97
cggcacaggcggccagc

SEQ ID NO: 1111683 - RNA, 23 nt, Mycobacterium bovis subsp bovis AF2122/97
cggcacaggcggccagcaucgcg

SEQ ID NO: 1111684 - RNA, 15 nt, Mycobacterium bovis subsp bovis AF2122/97
cggcaccaaccaccg

SEQ ID NO: 1111685 - RNA, 18 nt, Mycobacterium bovis subsp bovis AF2122/97
cggcaccaacgccaccgu

SEQ ID NO: 1111686 - RNA, 20 nt, Mycobacterium bovis subsp bovis AF2122/97
cggcacaugcgcguccagcu

SEQ ID NO: 1111687 - RNA, 22 nt, Mycobacterium bovis subsp bovis AF2122/97
cggcacaucaugggcgcugcca

SEQ ID NO: 1111688 - RNA, 21 nt, Mycobacterium bovis subsp bovis AF2122/97
cggcacacccaucaccgccag

SEQ ID NO: 1111689 - RNA, 21 nt, Mycobacterium bovis subsp bovis AF2122/97
cggcaacguuuacgaugcuca

SEQ ID NO: 1111690 - RNA, 17 nt, Mycobacterium bovis subsp bovis AF2122/97
cggcacacccaucaccg

SEQ ID NO: 1111691 - RNA, 20 nt, Mycobacterium bovis subsp bovis AF2122/97
cggcacacccaucaccgcca

SEQ ID NO: 1111692 - RNA, 23 nt, Mycobacterium bovis subsp bovis AF2122/97
cggcacaaucggauagccgugcu

SEQ ID NO: 1111693 - RNA, 16 nt, Mycobacterium bovis subsp bovis AF2122/97
cggcaauugugcugcg

SEQ ID NO: 1111694 - RNA, 20 nt, Mycobacterium bovis subsp bovis AF2122/97
cggcagccaccagcgacgac

SEQ ID NO: 1111695 - RNA, 12 nt, Mycobacterium bovis subsp bovis AF2122/97
cggcagccaccg

SEQ ID NO: 1111696 - RNA, 17 nt, Mycobacterium bovis subsp bovis AF2122/97
cggcagccagccaccgg

SEQ ID NO: 1111697 - RNA, 15 nt, Mycobacterium bovis subsp bovis AF2122/97
cggcagcauccucga

SEQ ID NO: 1111698 - RNA, 16 nt, Mycobacterium bovis subsp bovis AF2122/97
cggcagcaucggcacc

SEQ ID NO: 1111699 - RNA, 21 nt, Mycobacterium bovis subsp bovis AF2122/97
cggcagcaucggcaccccggc

SEQ ID NO: 1111700 - RNA, 16 nt, Mycobacterium bovis subsp bovis AF2122/97
cggcagccaaccggcg

SEQ ID NO: 1111701 - RNA, 18 nt, Mycobacterium bovis subsp bovis AF2122/97
cggcagccaaccggcgca

SEQ ID NO: 1111702 - RNA, 14 nt, Mycobacterium bovis subsp bovis AF2122/97
cggcagccaccagc

SEQ ID NO: 1111703 - RNA, 15 nt, Mycobacterium bovis subsp bovis AF2122/97
cggcagccaccagcg

SEQ ID NO: 1111704 - RNA, 17 nt, Mycobacterium bovis subsp bovis AF2122/97
cggcagccaccagcgac

SEQ ID NO: 1111705 - RNA, 19 nt, Mycobacterium bovis subsp bovis AF2122/97
cggcagccaccagcgacga

SEQ ID NO: 1111706 - RNA, 14 nt, Mycobacterium bovis subsp bovis AF2122/97
cggcagccaugcgg

SEQ ID NO: 1111707 - RNA, 17 nt, Mycobacterium bovis subsp bovis AF2122/97
cggcagccaugcggcug

SEQ ID NO: 1111708 - RNA, 13 nt, Mycobacterium bovis subsp bovis AF2122/97
cggcagcccccgg

SEQ ID NO: 1111709 - RNA, 23 nt, Mycobacterium bovis subsp bovis AF2122/97
cggcagcgagacuucgacgcggc

SEQ ID NO: 1111710 - RNA, 19 nt, Mycobacterium bovis subsp bovis AF2122/97
cggcagcccaaagcgccag

SEQ ID NO: 1111711 - RNA, 13 nt, Mycobacterium bovis subsp bovis AF2122/97
cggcagcgaggcc

SEQ ID NO: 1111712 - RNA, 17 nt, Mycobacterium bovis subsp bovis AF2122/97
cggcagcgaggcucgca

SEQ ID NO: 1111713 - RNA, 15 nt, Mycobacterium bovis subsp bovis AF2122/97
cggcagcgagucgac

SEQ ID NO: 1111714 - RNA, 19 nt, Mycobacterium bovis subsp bovis AF2122/97
cggcagcgagucgacgucg

SEQ ID NO: 1111715 - RNA, 11 nt, Mycobacterium bovis subsp bovis AF2122/97
cggcagcgcgg

SEQ ID NO: 1111716 - RNA, 14 nt, Mycobacterium bovis subsp bovis AF2122/97
cggcagcgcggcac

SEQ ID NO: 1111717 - RNA, 17 nt, Mycobacterium bovis subsp bovis AF2122/97
cggcagcgcggcaccca

SEQ ID NO: 1111718 - RNA, 22 nt, Mycobacterium bovis subsp bovis AF2122/97
cggcagcgcggcacccaaccag

SEQ ID NO: 1111719 - RNA, 13 nt, Mycobacterium bovis subsp bovis AF2122/97
cggcagcgcggcc

SEQ ID NO: 1111720 - RNA, 22 nt, Mycobacterium bovis subsp bovis AF2122/97
cggcaggaagaaaccgcagucg

SEQ ID NO: 1111721 - RNA, 20 nt, Mycobacterium bovis subsp bovis AF2122/97
cggcagcgaugcggugucgg

SEQ ID NO: 1111722 - RNA, 15 nt, Mycobacterium bovis subsp bovis AF2122/97
cggcagcgccggucg

SEQ ID NO: 1111723 - RNA, 12 nt, Mycobacterium bovis subsp bovis AF2122/97
cggcagcgccca

SEQ ID NO: 1111724 - RNA, 13 nt, Mycobacterium bovis subsp bovis AF2122/97
cggcagcgcccag

SEQ ID NO: 1111725 - RNA, 15 nt, Mycobacterium bovis subsp bovis AF2122/97
cggcagcgcccccgg

SEQ ID NO: 1111726 - RNA, 23 nt, Mycobacterium bovis subsp bovis AF2122/97
cggcaggaaucgggucagcacca

SEQ ID NO: 1111727 - RNA, 17 nt, Mycobacterium bovis subsp bovis AF2122/97
cggcaggaaugccgcgg

SEQ ID NO: 1111728 - RNA, 17 nt, Mycobacterium bovis subsp bovis AF2122/97
cggcaggauucccucga

SEQ ID NO: 1111729 - RNA, 20 nt, Mycobacterium bovis subsp bovis AF2122/97
cggcaggauucccucgacag

SEQ ID NO: 1111730 - RNA, 23 nt, Mycobacterium bovis subsp bovis AF2122/97
cggcagcacccacaucagccgca

SEQ ID NO: 1111731 - RNA, 20 nt, Mycobacterium bovis subsp bovis AF2122/97
cggcagaugagucaaaaucc

SEQ ID NO: 1111732 - RNA, 17 nt, Mycobacterium bovis subsp bovis AF2122/97
cggcagauugucgcuga

SEQ ID NO: 1111733 - RNA, 23 nt, Mycobacterium bovis subsp bovis AF2122/97
cggcagaccggugcugucgacgu

SEQ ID NO: 1111734 - RNA, 13 nt, Mycobacterium bovis subsp bovis AF2122/97
cggcagacgcguu

SEQ ID NO: 1111735 - RNA, 18 nt, Mycobacterium bovis subsp bovis AF2122/97
cggcagagcacgcgcggc

SEQ ID NO: 1111736 - RNA, 14 nt, Mycobacterium bovis subsp bovis AF2122/97
cggcagaccggcau

SEQ ID NO: 1111737 - RNA, 16 nt, Mycobacterium bovis subsp bovis AF2122/97
cggcagaccggcaucg

SEQ ID NO: 1111738 - RNA, 22 nt, Mycobacterium bovis subsp bovis AF2122/97
cggcagaccaagcccgucgucg

SEQ ID NO: 1111739 - RNA, 18 nt, Mycobacterium bovis subsp bovis AF2122/97
cggcagaucccacgccag

SEQ ID NO: 1111740 - RNA, 17 nt, Mycobacterium bovis subsp bovis AF2122/97
cggcacgcugaccggau

SEQ ID NO: 1111741 - RNA, 15 nt, Mycobacterium bovis subsp bovis AF2122/97
cggcacgcugaccgg

SEQ ID NO: 1111742 - RNA, 16 nt, Mycobacterium bovis subsp bovis AF2122/97
cggcacuggauccggg

SEQ ID NO: 1111743 - RNA, 17 nt, Mycobacterium bovis subsp bovis AF2122/97
cggcacuggguccacgc

SEQ ID NO: 1111744 - RNA, 22 nt, Mycobacterium bovis subsp bovis AF2122/97
cggcacggaccgcgucgcgggu

SEQ ID NO: 1111745 - RNA, 23 nt, Mycobacterium bovis subsp bovis AF2122/97
cggcacggaccgcgucgcggguc

SEQ ID NO: 1111746 - RNA, 12 nt, Mycobacterium bovis subsp bovis AF2122/97
cggcagaccgac

SEQ ID NO: 1111747 - RNA, 19 nt, Mycobacterium bovis subsp bovis AF2122/97
cggcagaauccggucgaug

SEQ ID NO: 1111748 - RNA, 17 nt, Mycobacterium bovis subsp bovis AF2122/97
cggcagaauccggucga

SEQ ID NO: 1111749 - RNA, 21 nt, Mycobacterium bovis subsp bovis AF2122/97
cggcacuugggaaggaugguc

SEQ ID NO: 1111750 - RNA, 23 nt, Mycobacterium bovis subsp bovis AF2122/97
cggcacuugggaaggauggucga

SEQ ID NO: 1111751 - RNA, 18 nt, Mycobacterium bovis subsp bovis AF2122/97
cggcacugugcguccgca

SEQ ID NO: 1111752 - RNA, 20 nt, Mycobacterium bovis subsp bovis AF2122/97
cggcacuuagcccgauggug

SEQ ID NO: 1111753 - RNA, 23 nt, Mycobacterium bovis subsp bovis AF2122/97
cggcacuuagcccgauggugccg

SEQ ID NO: 1111754 - RNA, 16 nt, Mycobacterium bovis subsp bovis AF2122/97
cggcacuuagcccgau

SEQ ID NO: 1111755 - RNA, 22 nt, Mycobacterium bovis subsp bovis AF2122/97
cggcacggaugcgauggccgac

SEQ ID NO: 1111756 - RNA, 18 nt, Mycobacterium bovis subsp bovis AF2122/97
cggcacggaugcgauggc

SEQ ID NO: 1111757 - RNA, 20 nt, Mycobacterium bovis subsp bovis AF2122/97
cggcacggaugcgauggccg

SEQ ID NO: 1111758 - RNA, 16 nt, Mycobacterium bovis subsp bovis AF2122/97
cggaugagcucggcca

SEQ ID NO: 1111759 - RNA, 17 nt, Mycobacterium bovis subsp bovis AF2122/97
cggaugagcucggccau

SEQ ID NO: 1111760 - RNA, 15 nt, Mycobacterium bovis subsp bovis AF2122/97
cggaugaaaugacgg

SEQ ID NO: 1111761 - RNA, 16 nt, Mycobacterium bovis subsp bovis AF2122/97
cggaugacaccgaccg

SEQ ID NO: 1111762 - RNA, 17 nt, Mycobacterium bovis subsp bovis AF2122/97
cggaugacaccgaccgg

SEQ ID NO: 1111763 - RNA, 22 nt, Mycobacterium bovis subsp bovis AF2122/97
cggaugacgcccagggcgucgg

SEQ ID NO: 1111764 - RNA, 17 nt, Mycobacterium bovis subsp bovis AF2122/97
cggaugcaacccgguga

SEQ ID NO: 1111765 - RNA, 17 nt, Mycobacterium bovis subsp bovis AF2122/97
cggauggaacuggacac

SEQ ID NO: 1111766 - RNA, 13 nt, Mycobacterium bovis subsp bovis AF2122/97
cggauggcggcca

SEQ ID NO: 1111767 - RNA, 20 nt, Mycobacterium bovis subsp bovis AF2122/97
cggauggccucgaacgccgc

SEQ ID NO: 1111768 - RNA, 22 nt, Mycobacterium bovis subsp bovis AF2122/97
cggaugucgugcgggcgcacca

SEQ ID NO: 1111769 - RNA, 18 nt, Mycobacterium bovis subsp bovis AF2122/97
cggaugucgacgagcacc

SEQ ID NO: 1111770 - RNA, 20 nt, Mycobacterium bovis subsp bovis AF2122/97
cggauggguacgacaccgca

SEQ ID NO: 1111771 - RNA, 16 nt, Mycobacterium bovis subsp bovis AF2122/97
cggauggugugucggg

SEQ ID NO: 1111772 - RNA, 18 nt, Mycobacterium bovis subsp bovis AF2122/97
cggauguauuccaggcgu

SEQ ID NO: 1111773 - RNA, 21 nt, Mycobacterium bovis subsp bovis AF2122/97
cggauguccaggagugcgggc

SEQ ID NO: 1111774 - RNA, 16 nt, Mycobacterium bovis subsp bovis AF2122/97
cggaugggaccuugau

SEQ ID NO: 1111775 - RNA, 14 nt, Mycobacterium bovis subsp bovis AF2122/97
cggaugggcgucga

SEQ ID NO: 1111776 - RNA, 19 nt, Mycobacterium bovis subsp bovis AF2122/97
cggaugucucggcaccaca

SEQ ID NO: 1111777 - RNA, 18 nt, Mycobacterium bovis subsp bovis AF2122/97
cggauguugaccggcucg

SEQ ID NO: 1111778 - RNA, 19 nt, Mycobacterium bovis subsp bovis AF2122/97
cggauguugaccggcucga

SEQ ID NO: 1111779 - RNA, 14 nt, Mycobacterium bovis subsp bovis AF2122/97
cggaugugucggcg

SEQ ID NO: 1111780 - RNA, 19 nt, Mycobacterium bovis subsp bovis AF2122/97
cggauuaagucggcggccu

SEQ ID NO: 1111781 - RNA, 14 nt, Mycobacterium bovis subsp bovis AF2122/97
cggcaacagcacca

SEQ ID NO: 1111782 - RNA, 14 nt, Mycobacterium bovis subsp bovis AF2122/97
cggcaacaccaccu

SEQ ID NO: 1111783 - RNA, 16 nt, Mycobacterium bovis subsp bovis AF2122/97
cggcaaauaggucuga

SEQ ID NO: 1111784 - RNA, 20 nt, Mycobacterium bovis subsp bovis AF2122/97
cggcaaaguuggccgcccga

SEQ ID NO: 1111785 - RNA, 19 nt, Mycobacterium bovis subsp bovis AF2122/97
cggcaacagcgccaagacg

SEQ ID NO: 1111786 - RNA, 17 nt, Mycobacterium bovis subsp bovis AF2122/97
cggcaacagcggggugu

SEQ ID NO: 1111787 - RNA, 20 nt, Mycobacterium bovis subsp bovis AF2122/97
cggcaacaucagcaggacca

SEQ ID NO: 1111788 - RNA, 18 nt, Mycobacterium bovis subsp bovis AF2122/97
cggcaaccaccggccgcg

SEQ ID NO: 1111789 - RNA, 20 nt, Mycobacterium bovis subsp bovis AF2122/97
cggcaaccaccggccgcgca

SEQ ID NO: 1111790 - RNA, 17 nt, Mycobacterium bovis subsp bovis AF2122/97
cggcaaccaccucgugg

SEQ ID NO: 1111791 - RNA, 17 nt, Mycobacterium bovis subsp bovis AF2122/97
cggcaacaugagcgucg

SEQ ID NO: 1111792 - RNA, 23 nt, Mycobacterium bovis subsp bovis AF2122/97
cggcaaagaaggcgacccgcugg

SEQ ID NO: 1111793 - RNA, 14 nt, Mycobacterium bovis subsp bovis AF2122/97
cggcaaaccgucgg

SEQ ID NO: 1111794 - RNA, 17 nt, Mycobacterium bovis subsp bovis AF2122/97
cggauuccgguggcauc

SEQ ID NO: 1111795 - RNA, 18 nt, Mycobacterium bovis subsp bovis AF2122/97
cggauuccggcucgucag

SEQ ID NO: 1111796 - RNA, 23 nt, Mycobacterium bovis subsp bovis AF2122/97
cggauuccgccaauccaccggug

SEQ ID NO: 1111797 - RNA, 16 nt, Mycobacterium bovis subsp bovis AF2122/97
cggauucuucggugaa

SEQ ID NO: 1111798 - RNA, 15 nt, Mycobacterium bovis subsp bovis AF2122/97
cggauuccagcgcgu

SEQ ID NO: 1111799 - RNA, 18 nt, Mycobacterium bovis subsp bovis AF2122/97
cggauucaucacgggacg

SEQ ID NO: 1111800 - RNA, 22 nt, Mycobacterium bovis subsp bovis AF2122/97
cggauucaucacgggacgacgg

SEQ ID NO: 1111801 - RNA, 16 nt, Mycobacterium bovis subsp bovis AF2122/97
cggauucggcugccac

SEQ ID NO: 1111802 - RNA, 12 nt, Mycobacterium bovis subsp bovis AF2122/97
cggauucgggcg

SEQ ID NO: 1111803 - RNA, 18 nt, Mycobacterium bovis subsp bovis AF2122/97
cggauuugggucagugcg

SEQ ID NO: 1111804 - RNA, 14 nt, Mycobacterium bovis subsp bovis AF2122/97
cggauuggcgauga

SEQ ID NO: 1111805 - RNA, 17 nt, Mycobacterium bovis subsp bovis AF2122/97
cggauugcucgaucugu

SEQ ID NO: 1111806 - RNA, 16 nt, Mycobacterium bovis subsp bovis AF2122/97
cggaucccaccaccgc

SEQ ID NO: 1111807 - RNA, 23 nt, Mycobacterium bovis subsp bovis AF2122/97
cggaucauuccgacgaacccgac

SEQ ID NO: 1111808 - RNA, 18 nt, Mycobacterium bovis subsp bovis AF2122/97
cggaucauucugcggccu

SEQ ID NO: 1111809 - RNA, 13 nt, Mycobacterium bovis subsp bovis AF2122/97
cggauccaccacg

SEQ ID NO: 1111810 - RNA, 18 nt, Mycobacterium bovis subsp bovis AF2122/97
cggaucaggucuggcgcg

SEQ ID NO: 1111811 - RNA, 19 nt, Mycobacterium bovis subsp bovis AF2122/97
cggaucaggucuggcgcgg

SEQ ID NO: 1111812 - RNA, 22 nt, Mycobacterium bovis subsp bovis AF2122/97
cggauaggacgaacaacgcgac

SEQ ID NO: 1111813 - RNA, 21 nt, Mycobacterium bovis subsp bovis AF2122/97
cggauagcgucuggcgacauc

SEQ ID NO: 1111814 - RNA, 20 nt, Mycobacterium bovis subsp bovis AF2122/97
cggauagcuguugaccgugu

SEQ ID NO: 1111815 - RNA, 16 nt, Mycobacterium bovis subsp bovis AF2122/97
cggauagccucggcgg

SEQ ID NO: 1111816 - RNA, 22 nt, Mycobacterium bovis subsp bovis AF2122/97
cggauagcgucgucccagcgcg

SEQ ID NO: 1111817 - RNA, 23 nt, Mycobacterium bovis subsp bovis AF2122/97
cggauagcgucgucccagcgcgg

SEQ ID NO: 1111818 - RNA, 20 nt, Mycobacterium bovis subsp bovis AF2122/97
cggauagcgucuggcgacau

SEQ ID NO: 1111819 - RNA, 14 nt, Mycobacterium bovis subsp bovis AF2122/97
cggauagcaccggc

SEQ ID NO: 1111820 - RNA, 20 nt, Mycobacterium bovis subsp bovis AF2122/97
cggauagcaccggcacccgc

SEQ ID NO: 1111821 - RNA, 21 nt, Mycobacterium bovis subsp bovis AF2122/97
cggauacccuuugcacggugg

SEQ ID NO: 1111822 - RNA, 17 nt, Mycobacterium bovis subsp bovis AF2122/97
cggauacgucagcccga

SEQ ID NO: 1111823 - RNA, 15 nt, Mycobacterium bovis subsp bovis AF2122/97
cggaucgcggucagc

SEQ ID NO: 1111824 - RNA, 21 nt, Mycobacterium bovis subsp bovis AF2122/97
cggaucgcgcugaucagccca

SEQ ID NO: 1111825 - RNA, 12 nt, Mycobacterium bovis subsp bovis AF2122/97
cggauccgggcg

SEQ ID NO: 1111826 - RNA, 22 nt, Mycobacterium bovis subsp bovis AF2122/97
cggaucgccuuggcgcccgcga

SEQ ID NO: 1111827 - RNA, 19 nt, Mycobacterium bovis subsp bovis AF2122/97
cggaucgcgagcgccgcua

SEQ ID NO: 1111828 - RNA, 13 nt, Mycobacterium bovis subsp bovis AF2122/97
cggauccgucgcg

SEQ ID NO: 1111829 - RNA, 19 nt, Mycobacterium bovis subsp bovis AF2122/97
cggauccgugucgcagauc

SEQ ID NO: 1111830 - RNA, 12 nt, Mycobacterium bovis subsp bovis AF2122/97
cggauccgccag

SEQ ID NO: 1111831 - RNA, 19 nt, Mycobacterium bovis subsp bovis AF2122/97
cggauccgccagaccgcgg

SEQ ID NO: 1111832 - RNA, 16 nt, Mycobacterium bovis subsp bovis AF2122/97
cggaucccagugccag

SEQ ID NO: 1111833 - RNA, 21 nt, Mycobacterium bovis subsp bovis AF2122/97
cggauccacggagaccggccg

SEQ ID NO: 1111834 - RNA, 16 nt, Mycobacterium bovis subsp bovis AF2122/97
cggaucggcaccccac

SEQ ID NO: 1111835 - RNA, 16 nt, Mycobacterium bovis subsp bovis AF2122/97
cggaucgcggcggcgu

SEQ ID NO: 1111836 - RNA, 15 nt, Mycobacterium bovis subsp bovis AF2122/97
cggaucggacaacac

SEQ ID NO: 1111837 - RNA, 16 nt, Mycobacterium bovis subsp bovis AF2122/97
cggaucgggcaccccg

SEQ ID NO: 1111838 - RNA, 17 nt, Mycobacterium bovis subsp bovis AF2122/97
cggaucgggcaccccga

SEQ ID NO: 1111839 - RNA, 13 nt, Mycobacterium bovis subsp bovis AF2122/97
cggaucgggaccg

SEQ ID NO: 1111840 - RNA, 15 nt, Mycobacterium bovis subsp bovis AF2122/97
cggaucgggaccggg

SEQ ID NO: 1111841 - RNA, 17 nt, Mycobacterium bovis subsp bovis AF2122/97
cggaucggccuguccac

SEQ ID NO: 1111842 - RNA, 17 nt, Mycobacterium bovis subsp bovis AF2122/97
cggaucggcgccgcaua

SEQ ID NO: 1111843 - RNA, 14 nt, Mycobacterium bovis subsp bovis AF2122/97
cggaucggcggccg

SEQ ID NO: 1111844 - RNA, 15 nt, Mycobacterium bovis subsp bovis AF2122/97
cggaucggcggccgc

SEQ ID NO: 1111845 - RNA, 17 nt, Mycobacterium bovis subsp bovis AF2122/97
cggaucggcggccgcga

SEQ ID NO: 1111846 - RNA, 16 nt, Mycobacterium bovis subsp bovis AF2122/97
cggaucggcggccggc

SEQ ID NO: 1111847 - RNA, 17 nt, Mycobacterium bovis subsp bovis AF2122/97
cggaucggcggccggca

SEQ ID NO: 1111848 - RNA, 19 nt, Mycobacterium bovis subsp bovis AF2122/97
cggaguccgucgacaccgc

SEQ ID NO: 1111849 - RNA, 21 nt, Mycobacterium bovis subsp bovis AF2122/97
cggagucgacccugcccagca

SEQ ID NO: 1111850 - RNA, 15 nt, Mycobacterium bovis subsp bovis AF2122/97
cggagucgacgacgu

SEQ ID NO: 1111851 - RNA, 14 nt, Mycobacterium bovis subsp bovis AF2122/97
cggagucaccagca

SEQ ID NO: 1111852 - RNA, 15 nt, Mycobacterium bovis subsp bovis AF2122/97
cggagucacgcagcc

SEQ ID NO: 1111853 - RNA, 17 nt, Mycobacterium bovis subsp bovis AF2122/97
cggagucacgcagccgc

SEQ ID NO: 1111854 - RNA, 19 nt, Mycobacterium bovis subsp bovis AF2122/97
cggagucacgcagccgcgc

SEQ ID NO: 1111855 - RNA, 21 nt, Mycobacterium bovis subsp bovis AF2122/97
cggagucacgcagccgcgcgg

SEQ ID NO: 1111856 - RNA, 12 nt, Mycobacterium bovis subsp bovis AF2122/97
cggaguagccgc

SEQ ID NO: 1111857 - RNA, 14 nt, Mycobacterium bovis subsp bovis AF2122/97
cggaguaccgcgcg

SEQ ID NO: 1111858 - RNA, 22 nt, Mycobacterium bovis subsp bovis AF2122/97
cggaguacaagggaauugucga

SEQ ID NO: 1111859 - RNA, 20 nt, Mycobacterium bovis subsp bovis AF2122/97
cggaguaaacaaacccaaca

SEQ ID NO: 1111860 - RNA, 21 nt, Mycobacterium bovis subsp bovis AF2122/97
cggaguaaacaaacccaacac

SEQ ID NO: 1111861 - RNA, 22 nt, Mycobacterium bovis subsp bovis AF2122/97
cggaguaaacaaacccaacacc

SEQ ID NO: 1111862 - RNA, 15 nt, Mycobacterium bovis subsp bovis AF2122/97
cggaguaccgcgcgu

SEQ ID NO: 1111863 - RNA, 16 nt, Mycobacterium bovis subsp bovis AF2122/97
cggaaucgcaucggcg

SEQ ID NO: 1111864 - RNA, 16 nt, Mycobacterium bovis subsp bovis AF2122/97
cggaaucgcccgggcg

SEQ ID NO: 1111865 - RNA, 18 nt, Mycobacterium bovis subsp bovis AF2122/97
cggaauccuggccgccgc

SEQ ID NO: 1111866 - RNA, 22 nt, Mycobacterium bovis subsp bovis AF2122/97
cggaauccuggccgccgccccg

SEQ ID NO: 1111867 - RNA, 21 nt, Mycobacterium bovis subsp bovis AF2122/97
cggaaucgcgagcuuggccgg

SEQ ID NO: 1111868 - RNA, 14 nt, Mycobacterium bovis subsp bovis AF2122/97
cggaauauggcggc

SEQ ID NO: 1111869 - RNA, 16 nt, Mycobacterium bovis subsp bovis AF2122/97
cggaauauggcggccg

SEQ ID NO: 1111870 - RNA, 17 nt, Mycobacterium bovis subsp bovis AF2122/97
cggaauauggcggccgg

SEQ ID NO: 1111871 - RNA, 18 nt, Mycobacterium bovis subsp bovis AF2122/97
cggaauccccccugucgc

SEQ ID NO: 1111872 - RNA, 22 nt, Mycobacterium bovis subsp bovis AF2122/97
cggaauacgcgccgccggcucg

SEQ ID NO: 1111873 - RNA, 14 nt, Mycobacterium bovis subsp bovis AF2122/97
cggaaucagcaccc

SEQ ID NO: 1111874 - RNA, 14 nt, Mycobacterium bovis subsp bovis AF2122/97
cggaguggccaguu

SEQ ID NO: 1111875 - RNA, 18 nt, Mycobacterium bovis subsp bovis AF2122/97
cggagugcauguccgacc

SEQ ID NO: 1111876 - RNA, 23 nt, Mycobacterium bovis subsp bovis AF2122/97
cggaguggccaguuggccggcca

SEQ ID NO: 1111877 - RNA, 21 nt, Mycobacterium bovis subsp bovis AF2122/97
cggagugucgaugcgcgccgg

SEQ ID NO: 1111878 - RNA, 17 nt, Mycobacterium bovis subsp bovis AF2122/97
cggagucuucgucgucg

SEQ ID NO: 1111879 - RNA, 18 nt, Mycobacterium bovis subsp bovis AF2122/97
cggagucuucgucgucgg

SEQ ID NO: 1111880 - RNA, 18 nt, Mycobacterium bovis subsp bovis AF2122/97
cggagucuucaacgucga

SEQ ID NO: 1111881 - RNA, 22 nt, Mycobacterium bovis subsp bovis AF2122/97
cggagucgcccgguccgccgca

SEQ ID NO: 1111882 - RNA, 21 nt, Mycobacterium bovis subsp bovis AF2122/97
cggagucgcgcagggcgacau

SEQ ID NO: 1111883 - RNA, 13 nt, Mycobacterium bovis subsp bovis AF2122/97
cggaguucgcuga

SEQ ID NO: 1111884 - RNA, 18 nt, Mycobacterium bovis subsp bovis AF2122/97
cggaguucugcgaucacg

SEQ ID NO: 1111885 - RNA, 17 nt, Mycobacterium bovis subsp bovis AF2122/97
cggaguuggcccgacgc

SEQ ID NO: 1111886 - RNA, 22 nt, Mycobacterium bovis subsp bovis AF2122/97
cggaguuuuucgggguggcggc

SEQ ID NO: 1111887 - RNA, 16 nt, Mycobacterium bovis subsp bovis AF2122/97
cggauacagccgccgc

SEQ ID NO: 1111888 - RNA, 19 nt, Mycobacterium bovis subsp bovis AF2122/97
cggauacagccgccgccgg

SEQ ID NO: 1111889 - RNA, 20 nt, Mycobacterium bovis subsp bovis AF2122/97
cggauacaugguccggccgc

SEQ ID NO: 1111890 - RNA, 16 nt, Mycobacterium bovis subsp bovis AF2122/97
gaucaccucggugccg

SEQ ID NO: 1111891 - RNA, 21 nt, Mycobacterium bovis subsp bovis AF2122/97
gaucaccucggugccggccgc

SEQ ID NO: 1111892 - RNA, 13 nt, Mycobacterium bovis subsp bovis AF2122/97
gaucaccugcagc

SEQ ID NO: 1111893 - RNA, 16 nt, Mycobacterium bovis subsp bovis AF2122/97
gaucaccucgcgggug

SEQ ID NO: 1111894 - RNA, 20 nt, Mycobacterium bovis subsp bovis AF2122/97
gaucaccucccgcggcaccu

SEQ ID NO: 1111895 - RNA, 18 nt, Mycobacterium bovis subsp bovis AF2122/97
gaucaccucccgcggcac

SEQ ID NO: 1111896 - RNA, 16 nt, Mycobacterium bovis subsp bovis AF2122/97
gaucaccgguucggug

SEQ ID NO: 1111897 - RNA, 21 nt, Mycobacterium bovis subsp bovis AF2122/97
gaucaccgucguacucggcgg

SEQ ID NO: 1111898 - RNA, 22 nt, Mycobacterium bovis subsp bovis AF2122/97
gaucaccggcaucccggaacgc

SEQ ID NO: 1111899 - RNA, 12 nt, Mycobacterium bovis subsp bovis AF2122/97
gaucaccggcau

SEQ ID NO: 1111900 - RNA, 23 nt, Mycobacterium bovis subsp bovis AF2122/97
gaucaccgcguaguccaggccgu

SEQ ID NO: 1111901 - RNA, 21 nt, Mycobacterium bovis subsp bovis AF2122/97
gauauuggacgcgcaugcccc

SEQ ID NO: 1111902 - RNA, 16 nt, Mycobacterium bovis subsp bovis AF2122/97
gauauggaccgccgcc

SEQ ID NO: 1111903 - RNA, 18 nt, Mycobacterium bovis subsp bovis AF2122/97
gauauggaccgccgccga

SEQ ID NO: 1111904 - RNA, 17 nt, Mycobacterium bovis subsp bovis AF2122/97
gauauggguugccagcg

SEQ ID NO: 1111905 - RNA, 18 nt, Mycobacterium bovis subsp bovis AF2122/97
gauaugcacccgcaccgg

SEQ ID NO: 1111906 - RNA, 12 nt, Mycobacterium bovis subsp bovis AF2122/97
gauaucacgacg

SEQ ID NO: 1111907 - RNA, 16 nt, Mycobacterium bovis subsp bovis AF2122/97
gauaucacgacgccga

SEQ ID NO: 1111908 - RNA, 15 nt, Mycobacterium bovis subsp bovis AF2122/97
gauagugguugcggc

SEQ ID NO: 1111909 - RNA, 16 nt, Mycobacterium bovis subsp bovis AF2122/97
gauaguuuucggccgc

SEQ ID NO: 1111910 - RNA, 17 nt, Mycobacterium bovis subsp bovis AF2122/97
gauaguuuucggccgcc

SEQ ID NO: 1111911 - RNA, 14 nt, Mycobacterium bovis subsp bovis AF2122/97
gauauagccgccgg

SEQ ID NO: 1111912 - RNA, 15 nt, Mycobacterium bovis subsp bovis AF2122/97
gauauagccgccggu

SEQ ID NO: 1111913 - RNA, 22 nt, Mycobacterium bovis subsp bovis AF2122/97
gaucagcaugcccucgcuguug

SEQ ID NO: 1111914 - RNA, 21 nt, Mycobacterium bovis subsp bovis AF2122/97
gaucagcaugcggccaugguc

SEQ ID NO: 1111915 - RNA, 13 nt, Mycobacterium bovis subsp bovis AF2122/97
gaucagccgccgc

SEQ ID NO: 1111916 - RNA, 14 nt, Mycobacterium bovis subsp bovis AF2122/97
gaucagccgccgcc

SEQ ID NO: 1111917 - RNA, 15 nt, Mycobacterium bovis subsp bovis AF2122/97
gaucagccgccgccu

SEQ ID NO: 1111918 - RNA, 17 nt, Mycobacterium bovis subsp bovis AF2122/97
gaucagccgugcgggcc

SEQ ID NO: 1111919 - RNA, 19 nt, Mycobacterium bovis subsp bovis AF2122/97
gaucagcgacuugcuggcg

SEQ ID NO: 1111920 - RNA, 17 nt, Mycobacterium bovis subsp bovis AF2122/97
gaucagcgaaccaccgg

SEQ ID NO: 1111921 - RNA, 18 nt, Mycobacterium bovis subsp bovis AF2122/97
gaucagcagcuguuggcg

SEQ ID NO: 1111922 - RNA, 14 nt, Mycobacterium bovis subsp bovis AF2122/97
gaucagcaggacga

SEQ ID NO: 1111923 - RNA, 17 nt, Mycobacterium bovis subsp bovis AF2122/97
gaucagcaggaucggca

SEQ ID NO: 1111924 - RNA, 18 nt, Mycobacterium bovis subsp bovis AF2122/97
gaucagcagccgccgaug

SEQ ID NO: 1111925 - RNA, 12 nt, Mycobacterium bovis subsp bovis AF2122/97
gaucagcagcgu

SEQ ID NO: 1111926 - RNA, 14 nt, Mycobacterium bovis subsp bovis AF2122/97
gaucagcagcgucg

SEQ ID NO: 1111927 - RNA, 12 nt, Mycobacterium bovis subsp bovis AF2122/97
gaucagcagcgg

SEQ ID NO: 1111928 - RNA, 14 nt, Mycobacterium bovis subsp bovis AF2122/97
gaucagcagcggcg

SEQ ID NO: 1111929 - RNA, 17 nt, Mycobacterium bovis subsp bovis AF2122/97
gaucagcagcggcgacc

SEQ ID NO: 1111930 - RNA, 23 nt, Mycobacterium bovis subsp bovis AF2122/97
gaucagcaccgacagcccgaacg

SEQ ID NO: 1111931 - RNA, 14 nt, Mycobacterium bovis subsp bovis AF2122/97
gaucaccucggcga

SEQ ID NO: 1111932 - RNA, 15 nt, Mycobacterium bovis subsp bovis AF2122/97
gaucagacccagcgc

SEQ ID NO: 1111933 - RNA, 19 nt, Mycobacterium bovis subsp bovis AF2122/97
gaucagcaacucggccacg

SEQ ID NO: 1111934 - RNA, 13 nt, Mycobacterium bovis subsp bovis AF2122/97
gaucagaucguca

SEQ ID NO: 1111935 - RNA, 16 nt, Mycobacterium bovis subsp bovis AF2122/97
gaucagacgcucgacc

SEQ ID NO: 1111936 - RNA, 16 nt, Mycobacterium bovis subsp bovis AF2122/97
gaucagaacgcggccu

SEQ ID NO: 1111937 - RNA, 17 nt, Mycobacterium bovis subsp bovis AF2122/97
gauaccggcggcgagcg

SEQ ID NO: 1111938 - RNA, 23 nt, Mycobacterium bovis subsp bovis AF2122/97
gauaccggcggcgagcggccucc

SEQ ID NO: 1111939 - RNA, 15 nt, Mycobacterium bovis subsp bovis AF2122/97
gauaccggucagcac

SEQ ID NO: 1111940 - RNA, 19 nt, Mycobacterium bovis subsp bovis AF2122/97
gauaccgaccaucgggacg

SEQ ID NO: 1111941 - RNA, 15 nt, Mycobacterium bovis subsp bovis AF2122/97
gauaccgcaccaaag

SEQ ID NO: 1111942 - RNA, 23 nt, Mycobacterium bovis subsp bovis AF2122/97
gauaccgguugcggucaucggcg

SEQ ID NO: 1111943 - RNA, 12 nt, Mycobacterium bovis subsp bovis AF2122/97
gauaccgcuggg

SEQ ID NO: 1111944 - RNA, 19 nt, Mycobacterium bovis subsp bovis AF2122/97
gauaccugcccacgcggau

SEQ ID NO: 1111945 - RNA, 19 nt, Mycobacterium bovis subsp bovis AF2122/97
gauacccgcggcagcacga

SEQ ID NO: 1111946 - RNA, 17 nt, Mycobacterium bovis subsp bovis AF2122/97
gauacccagcgggucgc

SEQ ID NO: 1111947 - RNA, 23 nt, Mycobacterium bovis subsp bovis AF2122/97
gauacccaccguuugggcgccgg

SEQ ID NO: 1111948 - RNA, 16 nt, Mycobacterium bovis subsp bovis AF2122/97
gauaaacugccgcggc

SEQ ID NO: 1111949 - RNA, 14 nt, Mycobacterium bovis subsp bovis AF2122/97
gauaaacccggcga

SEQ ID NO: 1111950 - RNA, 15 nt, Mycobacterium bovis subsp bovis AF2122/97
gauaaagcccggcgg

SEQ ID NO: 1111951 - RNA, 16 nt, Mycobacterium bovis subsp bovis AF2122/97
gauacaccgacgggau

SEQ ID NO: 1111952 - RNA, 16 nt, Mycobacterium bovis subsp bovis AF2122/97
gauacagccgccgccg

SEQ ID NO: 1111953 - RNA, 19 nt, Mycobacterium bovis subsp bovis AF2122/97
gauacagccgccgccggca

SEQ ID NO: 1111954 - RNA, 19 nt, Mycobacterium bovis subsp bovis AF2122/97
gauacagcucggugcacgg

SEQ ID NO: 1111955 - RNA, 21 nt, Mycobacterium bovis subsp bovis AF2122/97
gauacagcucggugcacggcg

SEQ ID NO: 1111956 - RNA, 17 nt, Mycobacterium bovis subsp bovis AF2122/97
gauaguggcgcgcggcg

SEQ ID NO: 1111957 - RNA, 19 nt, Mycobacterium bovis subsp bovis AF2122/97
gauagcggcccgaucacca

SEQ ID NO: 1111958 - RNA, 20 nt, Mycobacterium bovis subsp bovis AF2122/97
gauagcggcccgaucaccag

SEQ ID NO: 1111959 - RNA, 13 nt, Mycobacterium bovis subsp bovis AF2122/97
gauagcggcgccu

SEQ ID NO: 1111960 - RNA, 18 nt, Mycobacterium bovis subsp bovis AF2122/97
gauagcggcggcggcacg

SEQ ID NO: 1111961 - RNA, 20 nt, Mycobacterium bovis subsp bovis AF2122/97
gauagugcuccacguccggc

SEQ ID NO: 1111962 - RNA, 23 nt, Mycobacterium bovis subsp bovis AF2122/97
gauagugcuccacguccggcgga

SEQ ID NO: 1111963 - RNA, 14 nt, Mycobacterium bovis subsp bovis AF2122/97
gauagcgccguaca

SEQ ID NO: 1111964 - RNA, 23 nt, Mycobacterium bovis subsp bovis AF2122/97
gauagcggauucacgcaccggcg

SEQ ID NO: 1111965 - RNA, 18 nt, Mycobacterium bovis subsp bovis AF2122/97
gauagcggcaaagccggg

SEQ ID NO: 1111966 - RNA, 21 nt, Mycobacterium bovis subsp bovis AF2122/97
gauagcggcaaagccggguga

SEQ ID NO: 1111967 - RNA, 15 nt, Mycobacterium bovis subsp bovis AF2122/97
gauagccguucggca

SEQ ID NO: 1111968 - RNA, 19 nt, Mycobacterium bovis subsp bovis AF2122/97
gauagccucggcggcgccg

SEQ ID NO: 1111969 - RNA, 13 nt, Mycobacterium bovis subsp bovis AF2122/97
gauagcgaccgcg

SEQ ID NO: 1111970 - RNA, 16 nt, Mycobacterium bovis subsp bovis AF2122/97
gauacuguucugcugg

SEQ ID NO: 1111971 - RNA, 16 nt, Mycobacterium bovis subsp bovis AF2122/97
gauagacuagccgauc

SEQ ID NO: 1111972 - RNA, 20 nt, Mycobacterium bovis subsp bovis AF2122/97
gauagcaacgaagccggcgc

SEQ ID NO: 1111973 - RNA, 14 nt, Mycobacterium bovis subsp bovis AF2122/97
gauagcaccggaau

SEQ ID NO: 1111974 - RNA, 20 nt, Mycobacterium bovis subsp bovis AF2122/97
gauagcaccggcacccgcac

SEQ ID NO: 1111975 - RNA, 19 nt, Mycobacterium bovis subsp bovis AF2122/97
gauagcagugcagcaacac

SEQ ID NO: 1111976 - RNA, 19 nt, Mycobacterium bovis subsp bovis AF2122/97
gagggcaaggacaagccgc

SEQ ID NO: 1111977 - RNA, 14 nt, Mycobacterium bovis subsp bovis AF2122/97
gaggcggucgccga

SEQ ID NO: 1111978 - RNA, 21 nt, Mycobacterium bovis subsp bovis AF2122/97
gaggcggugacgaagccgacc

SEQ ID NO: 1111979 - RNA, 15 nt, Mycobacterium bovis subsp bovis AF2122/97
gaggcgucaccccgg

SEQ ID NO: 1111980 - RNA, 23 nt, Mycobacterium bovis subsp bovis AF2122/97
gaggcgucaccccggucccgccg

SEQ ID NO: 1111981 - RNA, 13 nt, Mycobacterium bovis subsp bovis AF2122/97
gaggcgcucucgu

SEQ ID NO: 1111982 - RNA, 23 nt, Mycobacterium bovis subsp bovis AF2122/97
gaggccggugaacggcagcacgg

SEQ ID NO: 1111983 - RNA, 19 nt, Mycobacterium bovis subsp bovis AF2122/97
gaggcgcucacccgccgcg

SEQ ID NO: 1111984 - RNA, 18 nt, Mycobacterium bovis subsp bovis AF2122/97
gaggccgucgaacgguag

SEQ ID NO: 1111985 - RNA, 15 nt, Mycobacterium bovis subsp bovis AF2122/97
gaggcggcgacgacc

SEQ ID NO: 1111986 - RNA, 15 nt, Mycobacterium bovis subsp bovis AF2122/97
gaggcggcgccgcac

SEQ ID NO: 1111987 - RNA, 13 nt, Mycobacterium bovis subsp bovis AF2122/97
gaggcggcgccug

SEQ ID NO: 1111988 - RNA, 17 nt, Mycobacterium bovis subsp bovis AF2122/97
gagggcccggccggacg

SEQ ID NO: 1111989 - RNA, 18 nt, Mycobacterium bovis subsp bovis AF2122/97
gagggcccggccggacgg

SEQ ID NO: 1111990 - RNA, 21 nt, Mycobacterium bovis subsp bovis AF2122/97
gagggccgcgguuuggcgacg

SEQ ID NO: 1111991 - RNA, 19 nt, Mycobacterium bovis subsp bovis AF2122/97
gagggccugacgcgucagc

SEQ ID NO: 1111992 - RNA, 16 nt, Mycobacterium bovis subsp bovis AF2122/97
gagggcgagcaacucg

SEQ ID NO: 1111993 - RNA, 22 nt, Mycobacterium bovis subsp bovis AF2122/97
gagggcgccgggggcgccgccg

SEQ ID NO: 1111994 - RNA, 18 nt, Mycobacterium bovis subsp bovis AF2122/97
gagggcggucagcggcca

SEQ ID NO: 1111995 - RNA, 22 nt, Mycobacterium bovis subsp bovis AF2122/97
gagggcggaauaucggccgaau

SEQ ID NO: 1111996 - RNA, 14 nt, Mycobacterium bovis subsp bovis AF2122/97
gaggucaccggcga

SEQ ID NO: 1111997 - RNA, 22 nt, Mycobacterium bovis subsp bovis AF2122/97
gagguauucguggucggccucg

SEQ ID NO: 1111998 - RNA, 19 nt, Mycobacterium bovis subsp bovis AF2122/97
gaggucaccggcgaccggu

SEQ ID NO: 1111999 - RNA, 19 nt, Mycobacterium bovis subsp bovis AF2122/97
gagguauaaacgcggcgcg

SEQ ID NO: 1112000 - RNA, 17 nt, Mycobacterium bovis subsp bovis AF2122/97
gagguaggucgccgccg

SEQ ID NO: 1112001 - RNA, 13 nt, Mycobacterium bovis subsp bovis AF2122/97
gagguagucggcg

SEQ ID NO: 1112002 - RNA, 20 nt, Mycobacterium bovis subsp bovis AF2122/97
gagguagcugcgcgggucgu

SEQ ID NO: 1112003 - RNA, 14 nt, Mycobacterium bovis subsp bovis AF2122/97
gagguagccgacga

SEQ ID NO: 1112004 - RNA, 14 nt, Mycobacterium bovis subsp bovis AF2122/97
gagggcgucgucga

SEQ ID NO: 1112005 - RNA, 15 nt, Mycobacterium bovis subsp bovis AF2122/97
gagggcuaccggcgc

SEQ ID NO: 1112006 - RNA, 14 nt, Mycobacterium bovis subsp bovis AF2122/97
gagggcgucgccgc

SEQ ID NO: 1112007 - RNA, 19 nt, Mycobacterium bovis subsp bovis AF2122/97
gagggcgucgccgccguug

SEQ ID NO: 1112008 - RNA, 16 nt, Mycobacterium bovis subsp bovis AF2122/97
gaggcagcgucgucga

SEQ ID NO: 1112009 - RNA, 19 nt, Mycobacterium bovis subsp bovis AF2122/97
gaggcaggccucggcgccg

SEQ ID NO: 1112010 - RNA, 21 nt, Mycobacterium bovis subsp bovis AF2122/97
gaggcaggccucggcgccgcc

SEQ ID NO: 1112011 - RNA, 20 nt, Mycobacterium bovis subsp bovis AF2122/97
gaggcacaaucaccgccgcg

SEQ ID NO: 1112012 - RNA, 21 nt, Mycobacterium bovis subsp bovis AF2122/97
gaggcacaaucaccgccgcga

SEQ ID NO: 1112013 - RNA, 22 nt, Mycobacterium bovis subsp bovis AF2122/97
gaggcacaaucaccgccgcgac

SEQ ID NO: 1112014 - RNA, 16 nt, Mycobacterium bovis subsp bovis AF2122/97
gaggccaagauggcgc

SEQ ID NO: 1112015 - RNA, 23 nt, Mycobacterium bovis subsp bovis AF2122/97
gaggccaaacgccaucauggccg

SEQ ID NO: 1112016 - RNA, 14 nt, Mycobacterium bovis subsp bovis AF2122/97
gaggcacgucgaaa

SEQ ID NO: 1112017 - RNA, 20 nt, Mycobacterium bovis subsp bovis AF2122/97
gagcagacgcgaaauccccc

SEQ ID NO: 1112018 - RNA, 13 nt, Mycobacterium bovis subsp bovis AF2122/97
gagcagacgcgga

SEQ ID NO: 1112019 - RNA, 21 nt, Mycobacterium bovis subsp bovis AF2122/97
gagcagacgcggaaucgcacc

SEQ ID NO: 1112020 - RNA, 22 nt, Mycobacterium bovis subsp bovis AF2122/97
gagcagacgcggaaucgcaucg

SEQ ID NO: 1112021 - RNA, 21 nt, Mycobacterium bovis subsp bovis AF2122/97
gagcagacgcuaaagcccccg

SEQ ID NO: 1112022 - RNA, 19 nt, Mycobacterium bovis subsp bovis AF2122/97
gagcagacgcagaagcccc

SEQ ID NO: 1112023 - RNA, 24 nt, Mycobacterium bovis subsp bovis AF2122/97
gagcagacgcagaaucgcacgcgg

SEQ ID NO: 1112024 - RNA, 21 nt, Mycobacterium bovis subsp bovis AF2122/97
gagcagacgcagaaucgcaug

SEQ ID NO: 1112025 - RNA, 21 nt, Mycobacterium bovis subsp bovis AF2122/97
gagcagacgcagaaucgccca

SEQ ID NO: 1112026 - RNA, 20 nt, Mycobacterium bovis subsp bovis AF2122/97
gagcagacgcagaaucgccu

SEQ ID NO: 1112027 - RNA, 18 nt, Mycobacterium bovis subsp bovis AF2122/97
gagcagacgcauaagccc

SEQ ID NO: 1112028 - RNA, 19 nt, Mycobacterium bovis subsp bovis AF2122/97
gagcagacgcauaagcccc

SEQ ID NO: 1112029 - RNA, 21 nt, Mycobacterium bovis subsp bovis AF2122/97
gagcagacgcauaagcccccg

SEQ ID NO: 1112030 - RNA, 18 nt, Mycobacterium bovis subsp bovis AF2122/97
gagcagcaagaccgcgcc

SEQ ID NO: 1112031 - RNA, 18 nt, Mycobacterium bovis subsp bovis AF2122/97
gagcagcaagccgccggu

SEQ ID NO: 1112032 - RNA, 23 nt, Mycobacterium bovis subsp bovis AF2122/97
gagcagcacagcauuguccggcg

SEQ ID NO: 1112033 - RNA, 17 nt, Mycobacterium bovis subsp bovis AF2122/97
gagcagagaaaccgcga

SEQ ID NO: 1112034 - RNA, 22 nt, Mycobacterium bovis subsp bovis AF2122/97
gagcagagaacuccgccaccau

SEQ ID NO: 1112035 - RNA, 15 nt, Mycobacterium bovis subsp bovis AF2122/97
gagcagacgccgcgu

SEQ ID NO: 1112036 - RNA, 20 nt, Mycobacterium bovis subsp bovis AF2122/97
gagcagacgcaaaagccacc

SEQ ID NO: 1112037 - RNA, 12 nt, Mycobacterium bovis subsp bovis AF2122/97
gagcagacgcga

SEQ ID NO: 1112038 - RNA, 17 nt, Mycobacterium bovis subsp bovis AF2122/97
gagcagacguaaaagcc

SEQ ID NO: 1112039 - RNA, 19 nt, Mycobacterium bovis subsp bovis AF2122/97
gagcagacguaaaagcccc

SEQ ID NO: 1112040 - RNA, 21 nt, Mycobacterium bovis subsp bovis AF2122/97
gagcagacguaaaagccccca

SEQ ID NO: 1112041 - RNA, 21 nt, Mycobacterium bovis subsp bovis AF2122/97
gagcagacguaaaagcccccg

SEQ ID NO: 1112042 - RNA, 13 nt, Mycobacterium bovis subsp bovis AF2122/97
gaggccgccgcgc

SEQ ID NO: 1112043 - RNA, 15 nt, Mycobacterium bovis subsp bovis AF2122/97
gaggccgccgcgccg

SEQ ID NO: 1112044 - RNA, 12 nt, Mycobacterium bovis subsp bovis AF2122/97
gaggccgccauc

SEQ ID NO: 1112045 - RNA, 24 nt, Mycobacterium bovis subsp bovis AF2122/97
gaggccgccaucgccgccaaccac

SEQ ID NO: 1112046 - RNA, 19 nt, Mycobacterium bovis subsp bovis AF2122/97
gaggccggcgggcucgccc

SEQ ID NO: 1112047 - RNA, 18 nt, Mycobacterium bovis subsp bovis AF2122/97
gaggcccugcggccacgg

SEQ ID NO: 1112048 - RNA, 18 nt, Mycobacterium bovis subsp bovis AF2122/97
gaggccgaccagcacacc

SEQ ID NO: 1112049 - RNA, 13 nt, Mycobacterium bovis subsp bovis AF2122/97
gaggccgaccucg

SEQ ID NO: 1112050 - RNA, 15 nt, Mycobacterium bovis subsp bovis AF2122/97
gaggccgcacgucga

SEQ ID NO: 1112051 - RNA, 21 nt, Mycobacterium bovis subsp bovis AF2122/97
gaggccgcacgucgaccucgg

SEQ ID NO: 1112052 - RNA, 24 nt, Mycobacterium bovis subsp bovis AF2122/97
gaggccgcacgucgaccucggcaa

SEQ ID NO: 1112053 - RNA, 12 nt, Mycobacterium bovis subsp bovis AF2122/97
gaggcccgaaau

SEQ ID NO: 1112054 - RNA, 19 nt, Mycobacterium bovis subsp bovis AF2122/97
gaggcccgaaaugccgggc

SEQ ID NO: 1112055 - RNA, 15 nt, Mycobacterium bovis subsp bovis AF2122/97
gaggcccgcggugga

SEQ ID NO: 1112056 - RNA, 15 nt, Mycobacterium bovis subsp bovis AF2122/97
gaguuugcgauaccc

SEQ ID NO: 1112057 - RNA, 14 nt, Mycobacterium bovis subsp bovis AF2122/97
gaguuggccguggc

SEQ ID NO: 1112058 - RNA, 14 nt, Mycobacterium bovis subsp bovis AF2122/97
gaguuggcugccgg

SEQ ID NO: 1112059 - RNA, 18 nt, Mycobacterium bovis subsp bovis AF2122/97
gaguuccuugaugcggcc

SEQ ID NO: 1112060 - RNA, 20 nt, Mycobacterium bovis subsp bovis AF2122/97
gaguuccgcaucggccccca

SEQ ID NO: 1112061 - RNA, 22 nt, Mycobacterium bovis subsp bovis AF2122/97
gaguuguggacgcccgaguuga

SEQ ID NO: 1112062 - RNA, 23 nt, Mycobacterium bovis subsp bovis AF2122/97
gaguucacguucggcgcugccag

SEQ ID NO: 1112063 - RNA, 19 nt, Mycobacterium bovis subsp bovis AF2122/97
gaguggaugcgccgcacgg

SEQ ID NO: 1112064 - RNA, 20 nt, Mycobacterium bovis subsp bovis AF2122/97
gaguggaugcgccgcacggc

SEQ ID NO: 1112065 - RNA, 13 nt, Mycobacterium bovis subsp bovis AF2122/97
gagugcggcgacc

SEQ ID NO: 1112066 - RNA, 17 nt, Mycobacterium bovis subsp bovis AF2122/97
gagugcgggcaugccgg

SEQ ID NO: 1112067 - RNA, 15 nt, Mycobacterium bovis subsp bovis AF2122/97
gagugcucagcgcgc

SEQ ID NO: 1112068 - RNA, 16 nt, Mycobacterium bovis subsp bovis AF2122/97
gagugcccagggccga

SEQ ID NO: 1112069 - RNA, 15 nt, Mycobacterium bovis subsp bovis AF2122/97
gagugcccauagccg

SEQ ID NO: 1112070 - RNA, 15 nt, Mycobacterium bovis subsp bovis AF2122/97
gagugccgccaccgc

SEQ ID NO: 1112071 - RNA, 19 nt, Mycobacterium bovis subsp bovis AF2122/97
gaguguccccggcugccag

SEQ ID NO: 1112072 - RNA, 20 nt, Mycobacterium bovis subsp bovis AF2122/97
gagugucgaugcgcgccggc

SEQ ID NO: 1112073 - RNA, 23 nt, Mycobacterium bovis subsp bovis AF2122/97
gagugucuuagccagcagcacau

SEQ ID NO: 1112074 - RNA, 22 nt, Mycobacterium bovis subsp bovis AF2122/97
gagugguacggcucggcgcuga

SEQ ID NO: 1112075 - RNA, 20 nt, Mycobacterium bovis subsp bovis AF2122/97
gagugugaaucgcacgacgc

SEQ ID NO: 1112076 - RNA, 21 nt, Mycobacterium bovis subsp bovis AF2122/97
gaguggcgauuucggcgccug

SEQ ID NO: 1112077 - RNA, 11 nt, Mycobacterium bovis subsp bovis AF2122/97
gaguggccggg

SEQ ID NO: 1112078 - RNA, 12 nt, Mycobacterium bovis subsp bovis AF2122/97
gaguggccgggc

SEQ ID NO: 1112079 - RNA, 14 nt, Mycobacterium bovis subsp bovis AF2122/97
gaguggccucgucc

SEQ ID NO: 1112080 - RNA, 22 nt, Mycobacterium bovis subsp bovis AF2122/97
gaguuagugacguagaccacgc

SEQ ID NO: 1112081 - RNA, 15 nt, Mycobacterium bovis subsp bovis AF2122/97
gaguguugccgacga

SEQ ID NO: 1112082 - RNA, 22 nt, Mycobacterium bovis subsp bovis AF2122/97
gagugugaaucgcacgacgcga

SEQ ID NO: 1112083 - RNA, 17 nt, Mycobacterium bovis subsp bovis AF2122/97
gaggucccggccgagcg

SEQ ID NO: 1112084 - RNA, 17 nt, Mycobacterium bovis subsp bovis AF2122/97
gagguccucagcgaugc

SEQ ID NO: 1112085 - RNA, 14 nt, Mycobacterium bovis subsp bovis AF2122/97
gagguccucgacga

SEQ ID NO: 1112086 - RNA, 19 nt, Mycobacterium bovis subsp bovis AF2122/97
gaggucacgcagcacccug

SEQ ID NO: 1112087 - RNA, 20 nt, Mycobacterium bovis subsp bovis AF2122/97
gaggugcucggaucggcucg

SEQ ID NO: 1112088 - RNA, 21 nt, Mycobacterium bovis subsp bovis AF2122/97
gaggugcucggaucggcucgc

SEQ ID NO: 1112089 - RNA, 14 nt, Mycobacterium bovis subsp bovis AF2122/97
gaggugccggcgcc

SEQ ID NO: 1112090 - RNA, 15 nt, Mycobacterium bovis subsp bovis AF2122/97
gaggugccggcgcca

SEQ ID NO: 1112091 - RNA, 15 nt, Mycobacterium bovis subsp bovis AF2122/97
gagguggcugcgccg

SEQ ID NO: 1112092 - RNA, 17 nt, Mycobacterium bovis subsp bovis AF2122/97
gaggugccgcgcagcug

SEQ ID NO: 1112093 - RNA, 22 nt, Mycobacterium bovis subsp bovis AF2122/97
gaggugccgcgcagcugccgca

SEQ ID NO: 1112094 - RNA, 19 nt, Mycobacterium bovis subsp bovis AF2122/97
gaggugcuuggggucaccc

SEQ ID NO: 1112095 - RNA, 17 nt, Mycobacterium bovis subsp bovis AF2122/97
gagguggcgcggggccg

SEQ ID NO: 1112096 - RNA, 16 nt, Mycobacterium bovis subsp bovis AF2122/97
gagguggucacgcagu

SEQ ID NO: 1112097 - RNA, 15 nt, Mycobacterium bovis subsp bovis AF2122/97
gagguggucagccgg

SEQ ID NO: 1112098 - RNA, 15 nt, Mycobacterium bovis subsp bovis AF2122/97
gagguucgccgucgg

SEQ ID NO: 1112099 - RNA, 14 nt, Mycobacterium bovis subsp bovis AF2122/97
gagguucugccgcg

SEQ ID NO: 1112100 - RNA, 20 nt, Mycobacterium bovis subsp bovis AF2122/97
gagguuguuggagaugucga

SEQ ID NO: 1112101 - RNA, 13 nt, Mycobacterium bovis subsp bovis AF2122/97
gagucgcccgcac

SEQ ID NO: 1112102 - RNA, 14 nt, Mycobacterium bovis subsp bovis AF2122/97
gagucgcccgcaca

SEQ ID NO: 1112103 - RNA, 22 nt, Mycobacterium bovis subsp bovis AF2122/97
gagucgccgaggacgccggcgc

SEQ ID NO: 1112104 - RNA, 14 nt, Mycobacterium bovis subsp bovis AF2122/97
gagucgggcuccgu

SEQ ID NO: 1112105 - RNA, 17 nt, Mycobacterium bovis subsp bovis AF2122/97
gagucgcgcagggcgac

SEQ ID NO: 1112106 - RNA, 17 nt, Mycobacterium bovis subsp bovis AF2122/97
gagucgugccgccgcau

SEQ ID NO: 1112107 - RNA, 22 nt, Mycobacterium bovis subsp bovis AF2122/97
gagucgguucagccacgcagca

SEQ ID NO: 1112108 - RNA, 22 nt, Mycobacterium bovis subsp bovis AF2122/97
gagucgucggcaugggccggcg

SEQ ID NO: 1112109 - RNA, 14 nt, Mycobacterium bovis subsp bovis AF2122/97
gagugaggcgcugg

SEQ ID NO: 1112110 - RNA, 17 nt, Mycobacterium bovis subsp bovis AF2122/97
gagucugcugaucgagc

SEQ ID NO: 1112111 - RNA, 13 nt, Mycobacterium bovis subsp bovis AF2122/97
gagugaauccggc

SEQ ID NO: 1112112 - RNA, 16 nt, Mycobacterium bovis subsp bovis AF2122/97
gagugaccacgcugcu

SEQ ID NO: 1112113 - RNA, 13 nt, Mycobacterium bovis subsp bovis AF2122/97
gaucagcgcggcg

SEQ ID NO: 1112114 - RNA, 16 nt, Mycobacterium bovis subsp bovis AF2122/97
gaucagcggcagcacc

SEQ ID NO: 1112115 - RNA, 17 nt, Mycobacterium bovis subsp bovis AF2122/97
gaucagcggcagcaccg

SEQ ID NO: 1112116 - RNA, 23 nt, Mycobacterium bovis subsp bovis AF2122/97
gaucagcguauuggacgcugccg

SEQ ID NO: 1112117 - RNA, 18 nt, Mycobacterium bovis subsp bovis AF2122/97
gaucagcgucccggucgc

SEQ ID NO: 1112118 - RNA, 20 nt, Mycobacterium bovis subsp bovis AF2122/97
gaucagcgcaucgccgcugg

SEQ ID NO: 1112119 - RNA, 15 nt, Mycobacterium bovis subsp bovis AF2122/97
gaucagcgccggauc

SEQ ID NO: 1112120 - RNA, 15 nt, Mycobacterium bovis subsp bovis AF2122/97
gaucagcgcgcacac

SEQ ID NO: 1112121 - RNA, 22 nt, Mycobacterium bovis subsp bovis AF2122/97
gaucagcucgcgcacgucgacg

SEQ ID NO: 1112122 - RNA, 19 nt, Mycobacterium bovis subsp bovis AF2122/97
gaucagcuugggcagcagc

SEQ ID NO: 1112123 - RNA, 19 nt, Mycobacterium bovis subsp bovis AF2122/97
gaucagcgugucgccgaua

SEQ ID NO: 1112124 - RNA, 24 nt, Mycobacterium bovis subsp bovis AF2122/97
gaucagcguggcgcccgugccgcc

SEQ ID NO: 1112125 - RNA, 17 nt, Mycobacterium bovis subsp bovis AF2122/97
gaucaggccgucgccgg

SEQ ID NO: 1112126 - RNA, 18 nt, Mycobacterium bovis subsp bovis AF2122/97
gaucaggccgacgucgac

SEQ ID NO: 1112127 - RNA, 15 nt, Mycobacterium bovis subsp bovis AF2122/97
gaucaggguggcgcg

SEQ ID NO: 1112128 - RNA, 23 nt, Mycobacterium bovis subsp bovis AF2122/97
gaucagggugucgaagagcaggc

SEQ ID NO: 1112129 - RNA, 15 nt, Mycobacterium bovis subsp bovis AF2122/97
gaucagggcucgcuc

SEQ ID NO: 1112130 - RNA, 19 nt, Mycobacterium bovis subsp bovis AF2122/97
gaucagggucagcgccgcg

SEQ ID NO: 1112131 - RNA, 22 nt, Mycobacterium bovis subsp bovis AF2122/97
gaucagguacgccaggugcagc

SEQ ID NO: 1112132 - RNA, 19 nt, Mycobacterium bovis subsp bovis AF2122/97
gaucaggucuggcgcggag

SEQ ID NO: 1112133 - RNA, 18 nt, Mycobacterium bovis subsp bovis AF2122/97
gaucaggucuucgauggc

SEQ ID NO: 1112134 - RNA, 15 nt, Mycobacterium bovis subsp bovis AF2122/97
gaucaucggccccga

SEQ ID NO: 1112135 - RNA, 20 nt, Mycobacterium bovis subsp bovis AF2122/97
gaucauccuucgccggcgcc

SEQ ID NO: 1112136 - RNA, 14 nt, Mycobacterium bovis subsp bovis AF2122/97
gaucaucccggcgc

SEQ ID NO: 1112137 - RNA, 16 nt, Mycobacterium bovis subsp bovis AF2122/97
gaucaucccgaccagc

SEQ ID NO: 1112138 - RNA, 21 nt, Mycobacterium bovis subsp bovis AF2122/97
gaucagugcaagaccgcaucg

SEQ ID NO: 1112139 - RNA, 15 nt, Mycobacterium bovis subsp bovis AF2122/97
gaucaucaccggcau

SEQ ID NO: 1112140 - RNA, 21 nt, Mycobacterium bovis subsp bovis AF2122/97
gaucaguuugccaucgggacc

SEQ ID NO: 1112141 - RNA, 17 nt, Mycobacterium bovis subsp bovis AF2122/97
gaucauauggccgccga

SEQ ID NO: 1112142 - RNA, 17 nt, Mycobacterium bovis subsp bovis AF2122/97
gaucaucaugucggcgc

SEQ ID NO: 1112143 - RNA, 16 nt, Mycobacterium bovis subsp bovis AF2122/97
gaucauguucggccac

SEQ ID NO: 1112144 - RNA, 17 nt, Mycobacterium bovis subsp bovis AF2122/97
gaucauguucggccacc

SEQ ID NO: 1112145 - RNA, 16 nt, Mycobacterium bovis subsp bovis AF2122/97
gaucauggcggcagca

SEQ ID NO: 1112146 - RNA, 18 nt, Mycobacterium bovis subsp bovis AF2122/97
gaucaugacgagccgagc

SEQ ID NO: 1112147 - RNA, 13 nt, Mycobacterium bovis subsp bovis AF2122/97
gaucaugccggcg

SEQ ID NO: 1112148 - RNA, 19 nt, Mycobacterium bovis subsp bovis AF2122/97
gaucaugccggcgaacucg

SEQ ID NO: 1112149 - RNA, 17 nt, Mycobacterium bovis subsp bovis AF2122/97
gauccacgccagagcgg

SEQ ID NO: 1112150 - RNA, 13 nt, Mycobacterium bovis subsp bovis AF2122/97
gauccacgccgac

SEQ ID NO: 1112151 - RNA, 14 nt, Mycobacterium bovis subsp bovis AF2122/97
gauccacccgacga

SEQ ID NO: 1112152 - RNA, 19 nt, Mycobacterium bovis subsp bovis AF2122/97
gauccacccgacgacguau

SEQ ID NO: 1112153 - RNA, 23 nt, Mycobacterium bovis subsp bovis AF2122/97
gauccaccacgcuggccucgucg

SEQ ID NO: 1112154 - RNA, 17 nt, Mycobacterium bovis subsp bovis AF2122/97
gauccaaguacgcuccg

SEQ ID NO: 1112155 - RNA, 21 nt, Mycobacterium bovis subsp bovis AF2122/97
gauccaccaagcucgcaaccg

SEQ ID NO: 1112156 - RNA, 17 nt, Mycobacterium bovis subsp bovis AF2122/97
gaucauucugcggccua

SEQ ID NO: 1112157 - RNA, 19 nt, Mycobacterium bovis subsp bovis AF2122/97
gaucauugcacccaccccg

SEQ ID NO: 1112158 - RNA, 16 nt, Mycobacterium bovis subsp bovis AF2122/97
gauccacaacagcccg

SEQ ID NO: 1112159 - RNA, 22 nt, Mycobacterium bovis subsp bovis AF2122/97
gaucauuucgguaauggccgcc

SEQ ID NO: 1112160 - RNA, 21 nt, Mycobacterium bovis subsp bovis AF2122/97
gauccaggccaguuuggcgcu

SEQ ID NO: 1112161 - RNA, 22 nt, Mycobacterium bovis subsp bovis AF2122/97
gauccagcggguauguaccgaa

SEQ ID NO: 1112162 - RNA, 15 nt, Mycobacterium bovis subsp bovis AF2122/97
gauccagcguuugcu

SEQ ID NO: 1112163 - RNA, 19 nt, Mycobacterium bovis subsp bovis AF2122/97
gauccagcguuugcuggcg

SEQ ID NO: 1112164 - RNA, 17 nt, Mycobacterium bovis subsp bovis AF2122/97
gauccagcgcaccggcg

SEQ ID NO: 1112165 - RNA, 18 nt, Mycobacterium bovis subsp bovis AF2122/97
gauccaggcccagccgag

SEQ ID NO: 1112166 - RNA, 17 nt, Mycobacterium bovis subsp bovis AF2122/97
gauccagggagcggcug

SEQ ID NO: 1112167 - RNA, 18 nt, Mycobacterium bovis subsp bovis AF2122/97
gauccaggcgucggugac

SEQ ID NO: 1112168 - RNA, 21 nt, Mycobacterium bovis subsp bovis AF2122/97
gauccgauaaauggccgauga

SEQ ID NO: 1112169 - RNA, 15 nt, Mycobacterium bovis subsp bovis AF2122/97
gauccgcaacaacgc

SEQ ID NO: 1112170 - RNA, 23 nt, Mycobacterium bovis subsp bovis AF2122/97
gauccgcaacaacgccgcgacgu

SEQ ID NO: 1112171 - RNA, 15 nt, Mycobacterium bovis subsp bovis AF2122/97
gauccgcaccacgcc

SEQ ID NO: 1112172 - RNA, 19 nt, Mycobacterium bovis subsp bovis AF2122/97
gauccgcaucaugucgaag

SEQ ID NO: 1112173 - RNA, 19 nt, Mycobacterium bovis subsp bovis AF2122/97
gauccgccagaccgcggcg

SEQ ID NO: 1112174 - RNA, 22 nt, Mycobacterium bovis subsp bovis AF2122/97
gauccgcaccccauacucggcg

SEQ ID NO: 1112175 - RNA, 16 nt, Mycobacterium bovis subsp bovis AF2122/97
gauccagccgucggcg

SEQ ID NO: 1112176 - RNA, 14 nt, Mycobacterium bovis subsp bovis AF2122/97
gauccagcgcaccg

SEQ ID NO: 1112177 - RNA, 13 nt, Mycobacterium bovis subsp bovis AF2122/97
gauccagcccgac

SEQ ID NO: 1112178 - RNA, 17 nt, Mycobacterium bovis subsp bovis AF2122/97
gauccacuccggcgauc

SEQ ID NO: 1112179 - RNA, 16 nt, Mycobacterium bovis subsp bovis AF2122/97
gauccacucggcgauc

SEQ ID NO: 1112180 - RNA, 21 nt, Mycobacterium bovis subsp bovis AF2122/97
gauccagcaacgcgguggacc

SEQ ID NO: 1112181 - RNA, 20 nt, Mycobacterium bovis subsp bovis AF2122/97
gauccgccgacagcccacga

SEQ ID NO: 1112182 - RNA, 19 nt, Mycobacterium bovis subsp bovis AF2122/97
gauccgcgauucgaccggu

SEQ ID NO: 1112183 - RNA, 14 nt, Mycobacterium bovis subsp bovis AF2122/97
gauccgccugccga

SEQ ID NO: 1112184 - RNA, 17 nt, Mycobacterium bovis subsp bovis AF2122/97
gauccgccugccgacgg

SEQ ID NO: 1112185 - RNA, 17 nt, Mycobacterium bovis subsp bovis AF2122/97
gauccgcacccggccgc

SEQ ID NO: 1112186 - RNA, 17 nt, Mycobacterium bovis subsp bovis AF2122/97
gauccgcgcgcuggacc

SEQ ID NO: 1112187 - RNA, 17 nt, Mycobacterium bovis subsp bovis AF2122/97
gauccggcagcagccgg

SEQ ID NO: 1112188 - RNA, 20 nt, Mycobacterium bovis subsp bovis AF2122/97
gauccggcagcagccggcgg

SEQ ID NO: 1112189 - RNA, 14 nt, Mycobacterium bovis subsp bovis AF2122/97
gauccggccaccac

SEQ ID NO: 1112190 - RNA, 16 nt, Mycobacterium bovis subsp bovis AF2122/97
gauccggccaccacgu

SEQ ID NO: 1112191 - RNA, 14 nt, Mycobacterium bovis subsp bovis AF2122/97
gauccggccgccga

SEQ ID NO: 1112192 - RNA, 13 nt, Mycobacterium bovis subsp bovis AF2122/97
gauccgcuagccc

SEQ ID NO: 1112193 - RNA, 18 nt, Mycobacterium bovis subsp bovis AF2122/97
gauccgcuagccccgauc

SEQ ID NO: 1112194 - RNA, 19 nt, Mycobacterium bovis subsp bovis AF2122/97
gauccggaucccaccaccg

SEQ ID NO: 1112195 - RNA, 20 nt, Mycobacterium bovis subsp bovis AF2122/97
gauccggaucccaccaccgc

SEQ ID NO: 1112196 - RNA, 14 nt, Mycobacterium bovis subsp bovis AF2122/97
gauccgcucacccg

SEQ ID NO: 1112197 - RNA, 17 nt, Mycobacterium bovis subsp bovis AF2122/97
gauccgcucacccgccc

SEQ ID NO: 1112198 - RNA, 19 nt, Mycobacterium bovis subsp bovis AF2122/97
gauccgcucacccgcccgg

SEQ ID NO: 1112199 - RNA, 18 nt, Mycobacterium bovis subsp bovis AF2122/97
gaucgacacccgcucggc

SEQ ID NO: 1112200 - RNA, 19 nt, Mycobacterium bovis subsp bovis AF2122/97
gaucgacacccgcucggcc

SEQ ID NO: 1112201 - RNA, 14 nt, Mycobacterium bovis subsp bovis AF2122/97
gaucgacaccgacg

SEQ ID NO: 1112202 - RNA, 20 nt, Mycobacterium bovis subsp bovis AF2122/97
gaucgaagaaacggcgucga

SEQ ID NO: 1112203 - RNA, 16 nt, Mycobacterium bovis subsp bovis AF2122/97
gaucgacaccagggcg

SEQ ID NO: 1112204 - RNA, 14 nt, Mycobacterium bovis subsp bovis AF2122/97
gaucgacacccgcu

SEQ ID NO: 1112205 - RNA, 15 nt, Mycobacterium bovis subsp bovis AF2122/97
gaucgaauacaccug

SEQ ID NO: 1112206 - RNA, 20 nt, Mycobacterium bovis subsp bovis AF2122/97
gauccugcaguacggccaac

SEQ ID NO: 1112207 - RNA, 14 nt, Mycobacterium bovis subsp bovis AF2122/97
gauccggcugcggg

SEQ ID NO: 1112208 - RNA, 17 nt, Mycobacterium bovis subsp bovis AF2122/97
gauccuggccgauggcg

SEQ ID NO: 1112209 - RNA, 16 nt, Mycobacterium bovis subsp bovis AF2122/97
gauccuggccgguggu

SEQ ID NO: 1112210 - RNA, 19 nt, Mycobacterium bovis subsp bovis AF2122/97
gaucgaacgcagccagcgc

SEQ ID NO: 1112211 - RNA, 16 nt, Mycobacterium bovis subsp bovis AF2122/97
gauccugggugucgcg

SEQ ID NO: 1112212 - RNA, 12 nt, Mycobacterium bovis subsp bovis AF2122/97
gaucgccaccgg

SEQ ID NO: 1112213 - RNA, 16 nt, Mycobacterium bovis subsp bovis AF2122/97
gaucgccaccggcgcc

SEQ ID NO: 1112214 - RNA, 19 nt, Mycobacterium bovis subsp bovis AF2122/97
gaucgccaccggcgccacc

SEQ ID NO: 1112215 - RNA, 17 nt, Mycobacterium bovis subsp bovis AF2122/97
gaucgccaacgacucac

SEQ ID NO: 1112216 - RNA, 18 nt, Mycobacterium bovis subsp bovis AF2122/97
gaucgccaacgacucacc

SEQ ID NO: 1112217 - RNA, 23 nt, Mycobacterium bovis subsp bovis AF2122/97
gaucgccaacgacucacccaccc

SEQ ID NO: 1112218 - RNA, 22 nt, Mycobacterium bovis subsp bovis AF2122/97
gaucgaucagcaacucggccac

SEQ ID NO: 1112219 - RNA, 14 nt, Mycobacterium bovis subsp bovis AF2122/97
gaucgaucgcggcg

SEQ ID NO: 1112220 - RNA, 16 nt, Mycobacterium bovis subsp bovis AF2122/97
gaucgauucgucgcgg

SEQ ID NO: 1112221 - RNA, 21 nt, Mycobacterium bovis subsp bovis AF2122/97
gaucgcacaccaacaccgcgg

SEQ ID NO: 1112222 - RNA, 22 nt, Mycobacterium bovis subsp bovis AF2122/97
gaucgcaagcgcggcgaagccg

SEQ ID NO: 1112223 - RNA, 21 nt, Mycobacterium bovis subsp bovis AF2122/97
gaucgcaccgagguugcgcgg

SEQ ID NO: 1112224 - RNA, 19 nt, Mycobacterium bovis subsp bovis AF2122/97
gaucgcaucgacgugcgcg

SEQ ID NO: 1112225 - RNA, 14 nt, Mycobacterium bovis subsp bovis AF2122/97
gaucggcgcgucga

SEQ ID NO: 1112226 - RNA, 17 nt, Mycobacterium bovis subsp bovis AF2122/97
gaucggcaccccacgcc

SEQ ID NO: 1112227 - RNA, 22 nt, Mycobacterium bovis subsp bovis AF2122/97
gaucggcaccccacgccugccg

SEQ ID NO: 1112228 - RNA, 13 nt, Mycobacterium bovis subsp bovis AF2122/97
gaucggcggccgc

SEQ ID NO: 1112229 - RNA, 14 nt, Mycobacterium bovis subsp bovis AF2122/97
gaucggcggccgcg

SEQ ID NO: 1112230 - RNA, 16 nt, Mycobacterium bovis subsp bovis AF2122/97
gaucggcggccgcgac

SEQ ID NO: 1112231 - RNA, 21 nt, Mycobacterium bovis subsp bovis AF2122/97
gaucggcggaccgcagcguga

SEQ ID NO: 1112232 - RNA, 23 nt, Mycobacterium bovis subsp bovis AF2122/97
gaucggcaggguggccagcaggc

SEQ ID NO: 1112233 - RNA, 20 nt, Mycobacterium bovis subsp bovis AF2122/97
gaucggcauguucagcccga

SEQ ID NO: 1112234 - RNA, 16 nt, Mycobacterium bovis subsp bovis AF2122/97
gaucggcggccggcac

SEQ ID NO: 1112235 - RNA, 18 nt, Mycobacterium bovis subsp bovis AF2122/97
gaucggcggccgcgacca

SEQ ID NO: 1112236 - RNA, 13 nt, Mycobacterium bovis subsp bovis AF2122/97
gaucggccaccau

SEQ ID NO: 1112237 - RNA, 19 nt, Mycobacterium bovis subsp bovis AF2122/97
gaucggcggauagucgcgg

SEQ ID NO: 1112238 - RNA, 20 nt, Mycobacterium bovis subsp bovis AF2122/97
gaucggcggcaaccgccgcc

SEQ ID NO: 1112239 - RNA, 13 nt, Mycobacterium bovis subsp bovis AF2122/97
gaucggcucacga

SEQ ID NO: 1112240 - RNA, 21 nt, Mycobacterium bovis subsp bovis AF2122/97
gaucggcucaccgaacgcgau

SEQ ID NO: 1112241 - RNA, 11 nt, Mycobacterium bovis subsp bovis AF2122/97
gaucggcguca

SEQ ID NO: 1112242 - RNA, 11 nt, Mycobacterium bovis subsp bovis AF2122/97
gaucggcgucc

SEQ ID NO: 1112243 - RNA, 21 nt, Mycobacterium bovis subsp bovis AF2122/97
gaucggggaagccugcgggcc

SEQ ID NO: 1112244 - RNA, 17 nt, Mycobacterium bovis subsp bovis AF2122/97
gaucggucaacucgaac

SEQ ID NO: 1112245 - RNA, 18 nt, Mycobacterium bovis subsp bovis AF2122/97
gaucggucaacucgaacg

SEQ ID NO: 1112246 - RNA, 13 nt, Mycobacterium bovis subsp bovis AF2122/97
gaucgggcuucgg

SEQ ID NO: 1112247 - RNA, 16 nt, Mycobacterium bovis subsp bovis AF2122/97
gaucgggccggccgcc

SEQ ID NO: 1112248 - RNA, 13 nt, Mycobacterium bovis subsp bovis AF2122/97
gaucgggccggcg

SEQ ID NO: 1112249 - RNA, 14 nt, Mycobacterium bovis subsp bovis AF2122/97
gaucgggccggcgc

SEQ ID NO: 1112250 - RNA, 22 nt, Mycobacterium bovis subsp bovis AF2122/97
gaucgggccggcgcggucucgg

SEQ ID NO: 1112251 - RNA, 21 nt, Mycobacterium bovis subsp bovis AF2122/97
gaucgggcagcacgccagccc

SEQ ID NO: 1112252 - RNA, 21 nt, Mycobacterium bovis subsp bovis AF2122/97
gaucggcuugccugcgccgag

SEQ ID NO: 1112253 - RNA, 13 nt, Mycobacterium bovis subsp bovis AF2122/97
gaucggcucgcca

SEQ ID NO: 1112254 - RNA, 20 nt, Mycobacterium bovis subsp bovis AF2122/97
gaucggcuaccuaacccgcg

SEQ ID NO: 1112255 - RNA, 15 nt, Mycobacterium bovis subsp bovis AF2122/97
gaucggcucgccacc

SEQ ID NO: 1112256 - RNA, 13 nt, Mycobacterium bovis subsp bovis AF2122/97
gaucggcugcgcg

SEQ ID NO: 1112257 - RNA, 22 nt, Mycobacterium bovis subsp bovis AF2122/97
gaucggcugcgcgcucggccag

SEQ ID NO: 1112258 - RNA, 23 nt, Mycobacterium bovis subsp bovis AF2122/97
gaucggcugcgcgcucggccagc

SEQ ID NO: 1112259 - RNA, 19 nt, Mycobacterium bovis subsp bovis AF2122/97
gaucggcuucuucuucuug

SEQ ID NO: 1112260 - RNA, 15 nt, Mycobacterium bovis subsp bovis AF2122/97
gaucgccaggccguc

SEQ ID NO: 1112261 - RNA, 12 nt, Mycobacterium bovis subsp bovis AF2122/97
gaucgccaggcc

SEQ ID NO: 1112262 - RNA, 20 nt, Mycobacterium bovis subsp bovis AF2122/97
gaucgcccgguucagcgcug

SEQ ID NO: 1112263 - RNA, 16 nt, Mycobacterium bovis subsp bovis AF2122/97
gaucgccccagccaug

SEQ ID NO: 1112264 - RNA, 17 nt, Mycobacterium bovis subsp bovis AF2122/97
gaucgccgagcgugaac

SEQ ID NO: 1112265 - RNA, 16 nt, Mycobacterium bovis subsp bovis AF2122/97
gaucgccgaggccucg

SEQ ID NO: 1112266 - RNA, 22 nt, Mycobacterium bovis subsp bovis AF2122/97
gaucgccgaggccucggccagc

SEQ ID NO: 1112267 - RNA, 22 nt, Mycobacterium bovis subsp bovis AF2122/97
gaucgcgguggcggugucggcg

SEQ ID NO: 1112268 - RNA, 13 nt, Mycobacterium bovis subsp bovis AF2122/97
gaucgcggucagc

SEQ ID NO: 1112269 - RNA, 22 nt, Mycobacterium bovis subsp bovis AF2122/97
gaucgcggucagcgggucgacc

SEQ ID NO: 1112270 - RNA, 21 nt, Mycobacterium bovis subsp bovis AF2122/97
gaucgcgguccaacagcgcca

SEQ ID NO: 1112271 - RNA, 16 nt, Mycobacterium bovis subsp bovis AF2122/97
gaucgcggcggcgugc

SEQ ID NO: 1112272 - RNA, 13 nt, Mycobacterium bovis subsp bovis AF2122/97
gaucgcggcgccg

SEQ ID NO: 1112273 - RNA, 13 nt, Mycobacterium bovis subsp bovis AF2122/97
gaucgccgccggc

SEQ ID NO: 1112274 - RNA, 17 nt, Mycobacterium bovis subsp bovis AF2122/97
gaucgcggcgacccggu

SEQ ID NO: 1112275 - RNA, 13 nt, Mycobacterium bovis subsp bovis AF2122/97
gaucgcggcgagc

SEQ ID NO: 1112276 - RNA, 14 nt, Mycobacterium bovis subsp bovis AF2122/97
gaucgcggcggcgu

SEQ ID NO: 1112277 - RNA, 21 nt, Mycobacterium bovis subsp bovis AF2122/97
gaucggcagcguggacaucgg

SEQ ID NO: 1112278 - RNA, 14 nt, Mycobacterium bovis subsp bovis AF2122/97
gaucgcgguccgag

SEQ ID NO: 1112279 - RNA, 23 nt, Mycobacterium bovis subsp bovis AF2122/97
gaucgcgguccgagcggcaucgg

SEQ ID NO: 1112280 - RNA, 16 nt, Mycobacterium bovis subsp bovis AF2122/97
gaucggcaaucgacuc

SEQ ID NO: 1112281 - RNA, 19 nt, Mycobacterium bovis subsp bovis AF2122/97
gaucggaucgaaguccaca

SEQ ID NO: 1112282 - RNA, 16 nt, Mycobacterium bovis subsp bovis AF2122/97
gaucggaucggcaccc

SEQ ID NO: 1112283 - RNA, 14 nt, Mycobacterium bovis subsp bovis AF2122/97
gaucggauggcggc

SEQ ID NO: 1112284 - RNA, 17 nt, Mycobacterium bovis subsp bovis AF2122/97
gaucggauggcggccac

SEQ ID NO: 1112285 - RNA, 22 nt, Mycobacterium bovis subsp bovis AF2122/97
gaucggauggugugucggguug

SEQ ID NO: 1112286 - RNA, 20 nt, Mycobacterium bovis subsp bovis AF2122/97
gaucggauugccuccgggua

SEQ ID NO: 1112287 - RNA, 17 nt, Mycobacterium bovis subsp bovis AF2122/97
gaucucgaccagcgccg

SEQ ID NO: 1112288 - RNA, 16 nt, Mycobacterium bovis subsp bovis AF2122/97
gaucucgagccgcggc

SEQ ID NO: 1112289 - RNA, 19 nt, Mycobacterium bovis subsp bovis AF2122/97
gaucucgagccgcggcaac

SEQ ID NO: 1112290 - RNA, 22 nt, Mycobacterium bovis subsp bovis AF2122/97
gaucucgaucaucaugucggcg

SEQ ID NO: 1112291 - RNA, 17 nt, Mycobacterium bovis subsp bovis AF2122/97
gaucucggugguuuggc

SEQ ID NO: 1112292 - RNA, 21 nt, Mycobacterium bovis subsp bovis AF2122/97
gaucucggugguuuggcgcgc

SEQ ID NO: 1112293 - RNA, 17 nt, Mycobacterium bovis subsp bovis AF2122/97
gaucucguagccgccgu

SEQ ID NO: 1112294 - RNA, 19 nt, Mycobacterium bovis subsp bovis AF2122/97
gaucucgacggccucgucg

SEQ ID NO: 1112295 - RNA, 16 nt, Mycobacterium bovis subsp bovis AF2122/97
gaucucgaccggcuug

SEQ ID NO: 1112296 - RNA, 17 nt, Mycobacterium bovis subsp bovis AF2122/97
gaucucgucgcggucga

SEQ ID NO: 1112297 - RNA, 23 nt, Mycobacterium bovis subsp bovis AF2122/97
gaucucuccuggaaaggacggcc

SEQ ID NO: 1112298 - RNA, 21 nt, Mycobacterium bovis subsp bovis AF2122/97
gaucgucgucaacccgguguc

SEQ ID NO: 1112299 - RNA, 15 nt, Mycobacterium bovis subsp bovis AF2122/97
gaucgucgugcacgg

SEQ ID NO: 1112300 - RNA, 20 nt, Mycobacterium bovis subsp bovis AF2122/97
gaucuccccgaccgcgcccg

SEQ ID NO: 1112301 - RNA, 17 nt, Mycobacterium bovis subsp bovis AF2122/97
gaucuccaggcccggcg

SEQ ID NO: 1112302 - RNA, 13 nt, Mycobacterium bovis subsp bovis AF2122/97
gaucucgaccagc

SEQ ID NO: 1112303 - RNA, 15 nt, Mycobacterium bovis subsp bovis AF2122/97
gaucucgaccagcgc

SEQ ID NO: 1112304 - RNA, 21 nt, Mycobacterium bovis subsp bovis AF2122/97
gaucuccuuggccguucggcg

SEQ ID NO: 1112305 - RNA, 20 nt, Mycobacterium bovis subsp bovis AF2122/97
gaucuccgugagccggaccg

SEQ ID NO: 1112306 - RNA, 12 nt, Mycobacterium bovis subsp bovis AF2122/97
gaucguccaccg

SEQ ID NO: 1112307 - RNA, 14 nt, Mycobacterium bovis subsp bovis AF2122/97
gaucguccaccgcc

SEQ ID NO: 1112308 - RNA, 17 nt, Mycobacterium bovis subsp bovis AF2122/97
gaucguccaccgccgac

SEQ ID NO: 1112309 - RNA, 19 nt, Mycobacterium bovis subsp bovis AF2122/97
gaucgucaguuacgcaucg

SEQ ID NO: 1112310 - RNA, 14 nt, Mycobacterium bovis subsp bovis AF2122/97
gaucguccagccca

SEQ ID NO: 1112311 - RNA, 16 nt, Mycobacterium bovis subsp bovis AF2122/97
gaucgucgaacagcac

SEQ ID NO: 1112312 - RNA, 20 nt, Mycobacterium bovis subsp bovis AF2122/97
gaucgucgaacagcaccgcc

SEQ ID NO: 1112313 - RNA, 16 nt, Mycobacterium bovis subsp bovis AF2122/97
gaucgucaacgacgac

SEQ ID NO: 1112314 - RNA, 19 nt, Mycobacterium bovis subsp bovis AF2122/97
gaucgucgacucggcggcg

SEQ ID NO: 1112315 - RNA, 12 nt, Mycobacterium bovis subsp bovis AF2122/97
gaucgucgacgc

SEQ ID NO: 1112316 - RNA, 15 nt, Mycobacterium bovis subsp bovis AF2122/97
gaucgucgcgaccuu

SEQ ID NO: 1112317 - RNA, 19 nt, Mycobacterium bovis subsp bovis AF2122/97
gaucgucgagccgaucgcc

SEQ ID NO: 1112318 - RNA, 16 nt, Mycobacterium bovis subsp bovis AF2122/97
gaucgucgccgaucau

SEQ ID NO: 1112319 - RNA, 17 nt, Mycobacterium bovis subsp bovis AF2122/97
gaucguagggacgccga

SEQ ID NO: 1112320 - RNA, 15 nt, Mycobacterium bovis subsp bovis AF2122/97
gaucguaggacucgg

SEQ ID NO: 1112321 - RNA, 17 nt, Mycobacterium bovis subsp bovis AF2122/97
gaucguaggacucggcg

SEQ ID NO: 1112322 - RNA, 19 nt, Mycobacterium bovis subsp bovis AF2122/97
gaucguaggacucggcgga

SEQ ID NO: 1112323 - RNA, 23 nt, Mycobacterium bovis subsp bovis AF2122/97
gaucgucacaccaguagcaccag

SEQ ID NO: 1112324 - RNA, 19 nt, Mycobacterium bovis subsp bovis AF2122/97
gaucguagggacgccgagc

SEQ ID NO: 1112325 - RNA, 14 nt, Mycobacterium bovis subsp bovis AF2122/97
gaucggugccggcc

SEQ ID NO: 1112326 - RNA, 22 nt, Mycobacterium bovis subsp bovis AF2122/97
gaucggugccagcacuccaccg

SEQ ID NO: 1112327 - RNA, 21 nt, Mycobacterium bovis subsp bovis AF2122/97
gaucggugcccaacccacucg

SEQ ID NO: 1112328 - RNA, 14 nt, Mycobacterium bovis subsp bovis AF2122/97
gaucgguggcggca

SEQ ID NO: 1112329 - RNA, 17 nt, Mycobacterium bovis subsp bovis AF2122/97
gaucgguggcggcacgc

SEQ ID NO: 1112330 - RNA, 18 nt, Mycobacterium bovis subsp bovis AF2122/97
gaucgguucgggacgcga

SEQ ID NO: 1112331 - RNA, 18 nt, Mycobacterium bovis subsp bovis AF2122/97
gaugacaccgaccggguc

SEQ ID NO: 1112332 - RNA, 16 nt, Mycobacterium bovis subsp bovis AF2122/97
gaugaacucggcgauc

SEQ ID NO: 1112333 - RNA, 22 nt, Mycobacterium bovis subsp bovis AF2122/97
gaugaacgggaucgacccgccc

SEQ ID NO: 1112334 - RNA, 14 nt, Mycobacterium bovis subsp bovis AF2122/97
gaugaacagcgacg

SEQ ID NO: 1112335 - RNA, 21 nt, Mycobacterium bovis subsp bovis AF2122/97
gaugaaagugccagugcgcag

SEQ ID NO: 1112336 - RNA, 14 nt, Mycobacterium bovis subsp bovis AF2122/97
gaucuucgccgaga

SEQ ID NO: 1112337 - RNA, 23 nt, Mycobacterium bovis subsp bovis AF2122/97
gaucuucgcgcuguacugcccca

SEQ ID NO: 1112338 - RNA, 19 nt, Mycobacterium bovis subsp bovis AF2122/97
gaucuucgagccggcggcc

SEQ ID NO: 1112339 - RNA, 17 nt, Mycobacterium bovis subsp bovis AF2122/97
gaucuucgagcgcauca

SEQ ID NO: 1112340 - RNA, 17 nt, Mycobacterium bovis subsp bovis AF2122/97
gaucuggucggcggccu

SEQ ID NO: 1112341 - RNA, 18 nt, Mycobacterium bovis subsp bovis AF2122/97
gaucuggucggcggccuc

SEQ ID NO: 1112342 - RNA, 17 nt, Mycobacterium bovis subsp bovis AF2122/97
gaucuggugggugcggc

SEQ ID NO: 1112343 - RNA, 23 nt, Mycobacterium bovis subsp bovis AF2122/97
gaucuggguaagggacaccagcu

SEQ ID NO: 1112344 - RNA, 14 nt, Mycobacterium bovis subsp bovis AF2122/97
gaucugucagcgcg

SEQ ID NO: 1112345 - RNA, 19 nt, Mycobacterium bovis subsp bovis AF2122/97
gaucuguuccucggugacu

SEQ ID NO: 1112346 - RNA, 18 nt, Mycobacterium bovis subsp bovis AF2122/97
gaucuuccccucggccgc

SEQ ID NO: 1112347 - RNA, 21 nt, Mycobacterium bovis subsp bovis AF2122/97
gaucuuccccucggccgcccg

SEQ ID NO: 1112348 - RNA, 19 nt, Mycobacterium bovis subsp bovis AF2122/97
gaucuucaccggccggugc

SEQ ID NO: 1112349 - RNA, 19 nt, Mycobacterium bovis subsp bovis AF2122/97
gaucugccgccgcggccac

SEQ ID NO: 1112350 - RNA, 23 nt, Mycobacterium bovis subsp bovis AF2122/97
gaucugcagcgcggauucgguua

SEQ ID NO: 1112351 - RNA, 15 nt, Mycobacterium bovis subsp bovis AF2122/97
gaucugccaccgcgg

SEQ ID NO: 1112352 - RNA, 18 nt, Mycobacterium bovis subsp bovis AF2122/97
gaucugggugccgguguu

SEQ ID NO: 1112353 - RNA, 14 nt, Mycobacterium bovis subsp bovis AF2122/97
gaucugagcgcggg

SEQ ID NO: 1112354 - RNA, 18 nt, Mycobacterium bovis subsp bovis AF2122/97
gaucugagcgcggguggc

SEQ ID NO: 1112355 - RNA, 17 nt, Mycobacterium bovis subsp bovis AF2122/97
gaucugagggcucggug

SEQ ID NO: 1112356 - RNA, 18 nt, Mycobacterium bovis subsp bovis AF2122/97
gaucugaucggcgcggcc

SEQ ID NO: 1112357 - RNA, 18 nt, Mycobacterium bovis subsp bovis AF2122/97
gaucucuaccagccgccc

SEQ ID NO: 1112358 - RNA, 22 nt, Mycobacterium bovis subsp bovis AF2122/97
gaucugaagagcggagccggcg

SEQ ID NO: 1112359 - RNA, 15 nt, Mycobacterium bovis subsp bovis AF2122/97
gaugccucggcggcc

SEQ ID NO: 1112360 - RNA, 14 nt, Mycobacterium bovis subsp bovis AF2122/97
gaugccugacacga

SEQ ID NO: 1112361 - RNA, 16 nt, Mycobacterium bovis subsp bovis AF2122/97
gaugccguuggcgugc

SEQ ID NO: 1112362 - RNA, 14 nt, Mycobacterium bovis subsp bovis AF2122/97
gaugcgacccgcag

SEQ ID NO: 1112363 - RNA, 16 nt, Mycobacterium bovis subsp bovis AF2122/97
gaugccuuccucggca

SEQ ID NO: 1112364 - RNA, 14 nt, Mycobacterium bovis subsp bovis AF2122/97
gaugccuuccgacg

SEQ ID NO: 1112365 - RNA, 20 nt, Mycobacterium bovis subsp bovis AF2122/97
gaugccuucguagcggccgc

SEQ ID NO: 1112366 - RNA, 14 nt, Mycobacterium bovis subsp bovis AF2122/97
gaugccgugcccgg

SEQ ID NO: 1112367 - RNA, 23 nt, Mycobacterium bovis subsp bovis AF2122/97
gaugccgucuuugucacgcaccg

SEQ ID NO: 1112368 - RNA, 19 nt, Mycobacterium bovis subsp bovis AF2122/97
gaugccggcgaaggccagc

SEQ ID NO: 1112369 - RNA, 13 nt, Mycobacterium bovis subsp bovis AF2122/97
gaugccggcaagc

SEQ ID NO: 1112370 - RNA, 18 nt, Mycobacterium bovis subsp bovis AF2122/97
gaugccggacagcucgcg

SEQ ID NO: 1112371 - RNA, 24 nt, Mycobacterium bovis subsp bovis AF2122/97
gaugccggacgccaugcccgcacg

SEQ ID NO: 1112372 - RNA, 12 nt, Mycobacterium bovis subsp bovis AF2122/97
gaugccgccgga

SEQ ID NO: 1112373 - RNA, 12 nt, Mycobacterium bovis subsp bovis AF2122/97
gaugccgccggc

SEQ ID NO: 1112374 - RNA, 13 nt, Mycobacterium bovis subsp bovis AF2122/97
gaugccgccggcc

SEQ ID NO: 1112375 - RNA, 17 nt, Mycobacterium bovis subsp bovis AF2122/97
gaugaccagggucugcu

SEQ ID NO: 1112376 - RNA, 18 nt, Mycobacterium bovis subsp bovis AF2122/97
gaugaccagggucugcuc

SEQ ID NO: 1112377 - RNA, 17 nt, Mycobacterium bovis subsp bovis AF2122/97
gaugaauucgcuugcag

SEQ ID NO: 1112378 - RNA, 13 nt, Mycobacterium bovis subsp bovis AF2122/97
gaugaccacgccg

SEQ ID NO: 1112379 - RNA, 16 nt, Mycobacterium bovis subsp bovis AF2122/97
gaugaccacgccgacg

SEQ ID NO: 1112380 - RNA, 18 nt, Mycobacterium bovis subsp bovis AF2122/97
gaugaccagcacaccgcc

SEQ ID NO: 1112381 - RNA, 17 nt, Mycobacterium bovis subsp bovis AF2122/97
gaugacccacugcaggc

SEQ ID NO: 1112382 - RNA, 19 nt, Mycobacterium bovis subsp bovis AF2122/97
gaugaccgccuugggcaga

SEQ ID NO: 1112383 - RNA, 19 nt, Mycobacterium bovis subsp bovis AF2122/97
gaugaccaugaugaccggc

SEQ ID NO: 1112384 - RNA, 15 nt, Mycobacterium bovis subsp bovis AF2122/97
gaugcgcgcccgacg

SEQ ID NO: 1112385 - RNA, 22 nt, Mycobacterium bovis subsp bovis AF2122/97
gaugcggccaugaaaaucggca

SEQ ID NO: 1112386 - RNA, 21 nt, Mycobacterium bovis subsp bovis AF2122/97
gaugcggccccaugcgccagc

SEQ ID NO: 1112387 - RNA, 22 nt, Mycobacterium bovis subsp bovis AF2122/97
gaugcggccccaugcgccagcg

SEQ ID NO: 1112388 - RNA, 13 nt, Mycobacterium bovis subsp bovis AF2122/97
gaugcgcggcggg

SEQ ID NO: 1112389 - RNA, 18 nt, Mycobacterium bovis subsp bovis AF2122/97
gaugcgccgcacggcgac

SEQ ID NO: 1112390 - RNA, 20 nt, Mycobacterium bovis subsp bovis AF2122/97
gaugcgccgcacggcgacgc

SEQ ID NO: 1112391 - RNA, 13 nt, Mycobacterium bovis subsp bovis AF2122/97
gaugcgcgccccg

SEQ ID NO: 1112392 - RNA, 22 nt, Mycobacterium bovis subsp bovis AF2122/97
gaugcgacccgcagaccgccac

SEQ ID NO: 1112393 - RNA, 16 nt, Mycobacterium bovis subsp bovis AF2122/97
gaugcgcccggcgugg

SEQ ID NO: 1112394 - RNA, 14 nt, Mycobacterium bovis subsp bovis AF2122/97
gaugcgauaacccg

SEQ ID NO: 1112395 - RNA, 16 nt, Mycobacterium bovis subsp bovis AF2122/97
gaugcgaucgacgauc

SEQ ID NO: 1112396 - RNA, 20 nt, Mycobacterium bovis subsp bovis AF2122/97
gaugcucacuacccgcaacg

SEQ ID NO: 1112397 - RNA, 21 nt, Mycobacterium bovis subsp bovis AF2122/97
gaugcucaggucaccggccgc

SEQ ID NO: 1112398 - RNA, 19 nt, Mycobacterium bovis subsp bovis AF2122/97
gaugcucccuauugcugcg

SEQ ID NO: 1112399 - RNA, 17 nt, Mycobacterium bovis subsp bovis AF2122/97
gaugcguucggccgggc

SEQ ID NO: 1112400 - RNA, 17 nt, Mycobacterium bovis subsp bovis AF2122/97
gaugcgggccgccaggc

SEQ ID NO: 1112401 - RNA, 19 nt, Mycobacterium bovis subsp bovis AF2122/97
gaugcgggccgccaggcgg

SEQ ID NO: 1112402 - RNA, 20 nt, Mycobacterium bovis subsp bovis AF2122/97
gaugcgggccgccaggcggc

SEQ ID NO: 1112403 - RNA, 23 nt, Mycobacterium bovis subsp bovis AF2122/97
gaugcgggcggcaagcucgacga

SEQ ID NO: 1112404 - RNA, 19 nt, Mycobacterium bovis subsp bovis AF2122/97
gaugcggcugaauucggcg

SEQ ID NO: 1112405 - RNA, 16 nt, Mycobacterium bovis subsp bovis AF2122/97
gaugcggcgaccaccg

SEQ ID NO: 1112406 - RNA, 17 nt, Mycobacterium bovis subsp bovis AF2122/97
gaugcggcgcagcgacg

SEQ ID NO: 1112407 - RNA, 15 nt, Mycobacterium bovis subsp bovis AF2122/97
gauggauuggcguca

SEQ ID NO: 1112408 - RNA, 16 nt, Mycobacterium bovis subsp bovis AF2122/97
gauggagccggugacg

SEQ ID NO: 1112409 - RNA, 19 nt, Mycobacterium bovis subsp bovis AF2122/97
gauggaugggucgaccgga

SEQ ID NO: 1112410 - RNA, 12 nt, Mycobacterium bovis subsp bovis AF2122/97
gauggauuggcg

SEQ ID NO: 1112411 - RNA, 17 nt, Mycobacterium bovis subsp bovis AF2122/97
gaugcugagcgccaggc

SEQ ID NO: 1112412 - RNA, 14 nt, Mycobacterium bovis subsp bovis AF2122/97
gauggcaucggcca

SEQ ID NO: 1112413 - RNA, 17 nt, Mycobacterium bovis subsp bovis AF2122/97
gauggccgcgcccgccu

SEQ ID NO: 1112414 - RNA, 19 nt, Mycobacterium bovis subsp bovis AF2122/97
gauggccgcgcccgccucg

SEQ ID NO: 1112415 - RNA, 15 nt, Mycobacterium bovis subsp bovis AF2122/97
gauggcaucggccau

SEQ ID NO: 1112416 - RNA, 16 nt, Mycobacterium bovis subsp bovis AF2122/97
gauggcaucggccauc

SEQ ID NO: 1112417 - RNA, 19 nt, Mycobacterium bovis subsp bovis AF2122/97
gauggcaauauccgggagu

SEQ ID NO: 1112418 - RNA, 13 nt, Mycobacterium bovis subsp bovis AF2122/97
gauggcaccgccc

SEQ ID NO: 1112419 - RNA, 16 nt, Mycobacterium bovis subsp bovis AF2122/97
gauggcaccgcccccg

SEQ ID NO: 1112420 - RNA, 21 nt, Mycobacterium bovis subsp bovis AF2122/97
gauggcaccgcccccgucggc

SEQ ID NO: 1112421 - RNA, 11 nt, Mycobacterium bovis subsp bovis AF2122/97
gauggccucga

SEQ ID NO: 1112422 - RNA, 14 nt, Mycobacterium bovis subsp bovis AF2122/97
gauggccucggcga

SEQ ID NO: 1112423 - RNA, 14 nt, Mycobacterium bovis subsp bovis AF2122/97
gauggccgucagcc

SEQ ID NO: 1112424 - RNA, 18 nt, Mycobacterium bovis subsp bovis AF2122/97
gauggccguccgaccgau

SEQ ID NO: 1112425 - RNA, 12 nt, Mycobacterium bovis subsp bovis AF2122/97
gauggccgucga

SEQ ID NO: 1112426 - RNA, 22 nt, Mycobacterium bovis subsp bovis AF2122/97
gauggcgauacgcgcgucgggu

SEQ ID NO: 1112427 - RNA, 16 nt, Mycobacterium bovis subsp bovis AF2122/97
gauggcgcccugcgcc

SEQ ID NO: 1112428 - RNA, 18 nt, Mycobacterium bovis subsp bovis AF2122/97
gauggcgaugcgcgcccc

SEQ ID NO: 1112429 - RNA, 21 nt, Mycobacterium bovis subsp bovis AF2122/97
gauggcgaucaugagcagcac

SEQ ID NO: 1112430 - RNA, 20 nt, Mycobacterium bovis subsp bovis AF2122/97
gauggcgcaccggcgucggc

SEQ ID NO: 1112431 - RNA, 20 nt, Mycobacterium bovis subsp bovis AF2122/97
gauggcgcacugguugggcg

SEQ ID NO: 1112432 - RNA, 12 nt, Mycobacterium bovis subsp bovis AF2122/97
gauggcgcgauc

SEQ ID NO: 1112433 - RNA, 14 nt, Mycobacterium bovis subsp bovis AF2122/97
gauggcgcgcaacg

SEQ ID NO: 1112434 - RNA, 15 nt, Mycobacterium bovis subsp bovis AF2122/97
gauggcuccggccgc

SEQ ID NO: 1112435 - RNA, 12 nt, Mycobacterium bovis subsp bovis AF2122/97
gauggcucgccg

SEQ ID NO: 1112436 - RNA, 15 nt, Mycobacterium bovis subsp bovis AF2122/97
gaugggccuccaccg

SEQ ID NO: 1112437 - RNA, 15 nt, Mycobacterium bovis subsp bovis AF2122/97
gaugggcgucgguca

SEQ ID NO: 1112438 - RNA, 18 nt, Mycobacterium bovis subsp bovis AF2122/97
gauggguacccgaucacu

SEQ ID NO: 1112439 - RNA, 22 nt, Mycobacterium bovis subsp bovis AF2122/97
gaugggguuaggaguggccggg

SEQ ID NO: 1112440 - RNA, 18 nt, Mycobacterium bovis subsp bovis AF2122/97
gaugggagcccggcggcc

SEQ ID NO: 1112441 - RNA, 17 nt, Mycobacterium bovis subsp bovis AF2122/97
gaugggcuacuugguca

SEQ ID NO: 1112442 - RNA, 18 nt, Mycobacterium bovis subsp bovis AF2122/97
gauggugacuucgguggc

SEQ ID NO: 1112443 - RNA, 15 nt, Mycobacterium bovis subsp bovis AF2122/97
gauggucuccaccag

SEQ ID NO: 1112444 - RNA, 17 nt, Mycobacterium bovis subsp bovis AF2122/97
gauggucuccaccaggu

SEQ ID NO: 1112445 - RNA, 13 nt, Mycobacterium bovis subsp bovis AF2122/97
gauggucggccac

SEQ ID NO: 1112446 - RNA, 17 nt, Mycobacterium bovis subsp bovis AF2122/97
gauggucggccacgcgc

SEQ ID NO: 1112447 - RNA, 22 nt, Mycobacterium bovis subsp bovis AF2122/97
gauggucacugugacgccgggc

SEQ ID NO: 1112448 - RNA, 17 nt, Mycobacterium bovis subsp bovis AF2122/97
gauggucagcagcucca

SEQ ID NO: 1112449 - RNA, 16 nt, Mycobacterium bovis subsp bovis AF2122/97
gauggucaaugccggc

SEQ ID NO: 1112450 - RNA, 19 nt, Mycobacterium bovis subsp bovis AF2122/97
gauggucaaugccggccgc

SEQ ID NO: 1112451 - RNA, 17 nt, Mycobacterium bovis subsp bovis AF2122/97
gauggucaaugcgcugg

SEQ ID NO: 1112452 - RNA, 18 nt, Mycobacterium bovis subsp bovis AF2122/97
gauggucaaugcgcuggc

SEQ ID NO: 1112453 - RNA, 14 nt, Mycobacterium bovis subsp bovis AF2122/97
gaugggcucgacgu

SEQ ID NO: 1112454 - RNA, 22 nt, Mycobacterium bovis subsp bovis AF2122/97
gaugggcugaggaacgccggca

SEQ ID NO: 1112455 - RNA, 23 nt, Mycobacterium bovis subsp bovis AF2122/97
gaugggucugguguccaccgcaa

SEQ ID NO: 1112456 - RNA, 16 nt, Mycobacterium bovis subsp bovis AF2122/97
gaugggugacccgcua

SEQ ID NO: 1112457 - RNA, 15 nt, Mycobacterium bovis subsp bovis AF2122/97
gaugggucaggccga

SEQ ID NO: 1112458 - RNA, 16 nt, Mycobacterium bovis subsp bovis AF2122/97
gaugguacccgcgccg

SEQ ID NO: 1112459 - RNA, 19 nt, Mycobacterium bovis subsp bovis AF2122/97
gaugguacccgcgccgcgc

SEQ ID NO: 1112460 - RNA, 16 nt, Mycobacterium bovis subsp bovis AF2122/97
gaugguaccgccacug

SEQ ID NO: 1112461 - RNA, 18 nt, Mycobacterium bovis subsp bovis AF2122/97
gauucgucgcggaucagc

SEQ ID NO: 1112462 - RNA, 19 nt, Mycobacterium bovis subsp bovis AF2122/97
gauucgucgcggaucagcc

SEQ ID NO: 1112463 - RNA, 18 nt, Mycobacterium bovis subsp bovis AF2122/97
gauucguugucgagcacg

SEQ ID NO: 1112464 - RNA, 14 nt, Mycobacterium bovis subsp bovis AF2122/97
gauucgggcgucgg

SEQ ID NO: 1112465 - RNA, 14 nt, Mycobacterium bovis subsp bovis AF2122/97
gauucggcggucgc

SEQ ID NO: 1112466 - RNA, 15 nt, Mycobacterium bovis subsp bovis AF2122/97
gauucggccgccgac

SEQ ID NO: 1112467 - RNA, 21 nt, Mycobacterium bovis subsp bovis AF2122/97
gauucggccugagcggccauc

SEQ ID NO: 1112468 - RNA, 18 nt, Mycobacterium bovis subsp bovis AF2122/97
gauucgggaggcaaccca

SEQ ID NO: 1112469 - RNA, 18 nt, Mycobacterium bovis subsp bovis AF2122/97
gauucgccuagcgagcgc

SEQ ID NO: 1112470 - RNA, 17 nt, Mycobacterium bovis subsp bovis AF2122/97
gauucggacucgccgac

SEQ ID NO: 1112471 - RNA, 14 nt, Mycobacterium bovis subsp bovis AF2122/97
gauucggcacgccg

SEQ ID NO: 1112472 - RNA, 24 nt, Mycobacterium bovis subsp bovis AF2122/97
gauucggcacgccgggcaucggcg

SEQ ID NO: 1112473 - RNA, 18 nt, Mycobacterium bovis subsp bovis AF2122/97
gauucgauguccucgaca

SEQ ID NO: 1112474 - RNA, 15 nt, Mycobacterium bovis subsp bovis AF2122/97
gauucgcgcagcgcg

SEQ ID NO: 1112475 - RNA, 13 nt, Mycobacterium bovis subsp bovis AF2122/97
gauucgcggcagc

SEQ ID NO: 1112476 - RNA, 15 nt, Mycobacterium bovis subsp bovis AF2122/97
gauuccgggucggcg

SEQ ID NO: 1112477 - RNA, 16 nt, Mycobacterium bovis subsp bovis AF2122/97
gauucugacgaccggc

SEQ ID NO: 1112478 - RNA, 15 nt, Mycobacterium bovis subsp bovis AF2122/97
gauucgugucggugc

SEQ ID NO: 1112479 - RNA, 17 nt, Mycobacterium bovis subsp bovis AF2122/97
gauucugauaucgucgg

SEQ ID NO: 1112480 - RNA, 20 nt, Mycobacterium bovis subsp bovis AF2122/97
gauucugcgucugcucgcgc

SEQ ID NO: 1112481 - RNA, 19 nt, Mycobacterium bovis subsp bovis AF2122/97
gauucugcgucugcucgcc

SEQ ID NO: 1112482 - RNA, 20 nt, Mycobacterium bovis subsp bovis AF2122/97
gauucugcgucugcucgcca

SEQ ID NO: 1112483 - RNA, 20 nt, Mycobacterium bovis subsp bovis AF2122/97
gauucugcgucugcucgccg

SEQ ID NO: 1112484 - RNA, 19 nt, Mycobacterium bovis subsp bovis AF2122/97
gauucugugucugcucgcg

SEQ ID NO: 1112485 - RNA, 20 nt, Mycobacterium bovis subsp bovis AF2122/97
gauucugugucugcucggcg

SEQ ID NO: 1112486 - RNA, 15 nt, Mycobacterium bovis subsp bovis AF2122/97
gauucuucagcgcgg

SEQ ID NO: 1112487 - RNA, 14 nt, Mycobacterium bovis subsp bovis AF2122/97
gauugucggggccg

SEQ ID NO: 1112488 - RNA, 23 nt, Mycobacterium bovis subsp bovis AF2122/97
gauugucggggccgcaggccagu

SEQ ID NO: 1112489 - RNA, 13 nt, Mycobacterium bovis subsp bovis AF2122/97
gauuguggccagc

SEQ ID NO: 1112490 - RNA, 20 nt, Mycobacterium bovis subsp bovis AF2122/97
gauuguguuccaccagcgcc

SEQ ID NO: 1112491 - RNA, 16 nt, Mycobacterium bovis subsp bovis AF2122/97
gauguugaccggcucg

SEQ ID NO: 1112492 - RNA, 15 nt, Mycobacterium bovis subsp bovis AF2122/97
gauguucgaucagcg

SEQ ID NO: 1112493 - RNA, 17 nt, Mycobacterium bovis subsp bovis AF2122/97
gauuaccgaagcccgac

SEQ ID NO: 1112494 - RNA, 16 nt, Mycobacterium bovis subsp bovis AF2122/97
gauggugcggcccaac

SEQ ID NO: 1112495 - RNA, 20 nt, Mycobacterium bovis subsp bovis AF2122/97
gauggugaugggggagccgg

SEQ ID NO: 1112496 - RNA, 23 nt, Mycobacterium bovis subsp bovis AF2122/97
gauggugaugggggagccgguga

SEQ ID NO: 1112497 - RNA, 14 nt, Mycobacterium bovis subsp bovis AF2122/97
gauggugccgaacc

SEQ ID NO: 1112498 - RNA, 17 nt, Mycobacterium bovis subsp bovis AF2122/97
gauggugccgacccgcc

SEQ ID NO: 1112499 - RNA, 21 nt, Mycobacterium bovis subsp bovis AF2122/97
gauggugccgacccgccgcgc

SEQ ID NO: 1112500 - RNA, 16 nt, Mycobacterium bovis subsp bovis AF2122/97
gauggugcgcccgccg

SEQ ID NO: 1112501 - RNA, 18 nt, Mycobacterium bovis subsp bovis AF2122/97
gauggugcgcccgccggc

SEQ ID NO: 1112502 - RNA, 15 nt, Mycobacterium bovis subsp bovis AF2122/97
gauggugcgccgggc

SEQ ID NO: 1112503 - RNA, 15 nt, Mycobacterium bovis subsp bovis AF2122/97
gaugguggcaacggg

SEQ ID NO: 1112504 - RNA, 21 nt, Mycobacterium bovis subsp bovis AF2122/97
gauggugcucaaggcuucggc

SEQ ID NO: 1112505 - RNA, 22 nt, Mycobacterium bovis subsp bovis AF2122/97
gauggugcucaaggcuucggcg

SEQ ID NO: 1112506 - RNA, 23 nt, Mycobacterium bovis subsp bovis AF2122/97
gaugguggcgaucaucggccccg

SEQ ID NO: 1112507 - RNA, 23 nt, Mycobacterium bovis subsp bovis AF2122/97
gaugguggucaccaccaucacgg

SEQ ID NO: 1112508 - RNA, 19 nt, Mycobacterium bovis subsp bovis AF2122/97
gaugguguacugcugcuug

SEQ ID NO: 1112509 - RNA, 17 nt, Mycobacterium bovis subsp bovis AF2122/97
gaugguguccucgucga

SEQ ID NO: 1112510 - RNA, 13 nt, Mycobacterium bovis subsp bovis AF2122/97
gaugugcgccacc

SEQ ID NO: 1112511 - RNA, 20 nt, Mycobacterium bovis subsp bovis AF2122/97
gaugugcucaggucgcagac

SEQ ID NO: 1112512 - RNA, 15 nt, Mycobacterium bovis subsp bovis AF2122/97
gauguggucggacag

SEQ ID NO: 1112513 - RNA, 15 nt, Mycobacterium bovis subsp bovis AF2122/97
gaugugucgaugagg

SEQ ID NO: 1112514 - RNA, 23 nt, Mycobacterium bovis subsp bovis AF2122/97
gaugugucggcgagggcgcgccg

SEQ ID NO: 1112515 - RNA, 19 nt, Mycobacterium bovis subsp bovis AF2122/97
gauguuacacuaaccgaau

SEQ ID NO: 1112516 - RNA, 14 nt, Mycobacterium bovis subsp bovis AF2122/97
gauguggccggcga

SEQ ID NO: 1112517 - RNA, 16 nt, Mycobacterium bovis subsp bovis AF2122/97
gaugugggcgcucgca

SEQ ID NO: 1112518 - RNA, 21 nt, Mycobacterium bovis subsp bovis AF2122/97
gcaaaucaagcacagcccggc

SEQ ID NO: 1112519 - RNA, 17 nt, Mycobacterium bovis subsp bovis AF2122/97
gcaaauaggacugcgcc

SEQ ID NO: 1112520 - RNA, 19 nt, Mycobacterium bovis subsp bovis AF2122/97
gcaaauaggacugcgccac

SEQ ID NO: 1112521 - RNA, 19 nt, Mycobacterium bovis subsp bovis AF2122/97
gcaacaacgccgcgacgug

SEQ ID NO: 1112522 - RNA, 20 nt, Mycobacterium bovis subsp bovis AF2122/97
gcaacaacgccgcgacgugg

SEQ ID NO: 1112523 - RNA, 14 nt, Mycobacterium bovis subsp bovis AF2122/97
gcaacaacguucgg

SEQ ID NO: 1112524 - RNA, 16 nt, Mycobacterium bovis subsp bovis AF2122/97
gcaaagccagcgcagc

SEQ ID NO: 1112525 - RNA, 20 nt, Mycobacterium bovis subsp bovis AF2122/97
gcaaacuucgcgcacgcccu

SEQ ID NO: 1112526 - RNA, 16 nt, Mycobacterium bovis subsp bovis AF2122/97
gcaaagacagcgcggg

SEQ ID NO: 1112527 - RNA, 14 nt, Mycobacterium bovis subsp bovis AF2122/97
gcaaaggcgccguc

SEQ ID NO: 1112528 - RNA, 18 nt, Mycobacterium bovis subsp bovis AF2122/97
gcaaaggccccggugacg

SEQ ID NO: 1112529 - RNA, 13 nt, Mycobacterium bovis subsp bovis AF2122/97
gcaaaggacgucg

SEQ ID NO: 1112530 - RNA, 15 nt, Mycobacterium bovis subsp bovis AF2122/97
gcaaaggacgucgac

SEQ ID NO: 1112531 - RNA, 18 nt, Mycobacterium bovis subsp bovis AF2122/97
gcaaaggagccguuggca

SEQ ID NO: 1112532 - RNA, 19 nt, Mycobacterium bovis subsp bovis AF2122/97
gcaaaggagccguuggcaa

SEQ ID NO: 1112533 - RNA, 20 nt, Mycobacterium bovis subsp bovis AF2122/97
gcaaacacgccucgccgaag

SEQ ID NO: 1112534 - RNA, 13 nt, Mycobacterium bovis subsp bovis AF2122/97
gcaaaauggccac

SEQ ID NO: 1112535 - RNA, 15 nt, Mycobacterium bovis subsp bovis AF2122/97
gcaaaccaagcgcgc

SEQ ID NO: 1112536 - RNA, 14 nt, Mycobacterium bovis subsp bovis AF2122/97
gcaaaccacccgca

SEQ ID NO: 1112537 - RNA, 17 nt, Mycobacterium bovis subsp bovis AF2122/97
gcaaacugggcaccggc

SEQ ID NO: 1112538 - RNA, 14 nt, Mycobacterium bovis subsp bovis AF2122/97
gcaaacccgccgac

SEQ ID NO: 1112539 - RNA, 20 nt, Mycobacterium bovis subsp bovis AF2122/97
gcaaacccgccgacaaaagc

SEQ ID NO: 1112540 - RNA, 16 nt, Mycobacterium bovis subsp bovis AF2122/97
gauuucggcggcgaug

SEQ ID NO: 1112541 - RNA, 23 nt, Mycobacterium bovis subsp bovis AF2122/97
gauuucggcggcgaugaccgggc

SEQ ID NO: 1112542 - RNA, 20 nt, Mycobacterium bovis subsp bovis AF2122/97
gauuucggcgaccggccggc

SEQ ID NO: 1112543 - RNA, 13 nt, Mycobacterium bovis subsp bovis AF2122/97
gauuucggcgccg

SEQ ID NO: 1112544 - RNA, 14 nt, Mycobacterium bovis subsp bovis AF2122/97
gauuucggcggcga

SEQ ID NO: 1112545 - RNA, 16 nt, Mycobacterium bovis subsp bovis AF2122/97
gcaacgggacgucacc

SEQ ID NO: 1112546 - RNA, 23 nt, Mycobacterium bovis subsp bovis AF2122/97
gcaacggguacacccgcucgccc

SEQ ID NO: 1112547 - RNA, 17 nt, Mycobacterium bovis subsp bovis AF2122/97
gcaacgggacgucaccg

SEQ ID NO: 1112548 - RNA, 19 nt, Mycobacterium bovis subsp bovis AF2122/97
gcaacggguccgacggugu

SEQ ID NO: 1112549 - RNA, 22 nt, Mycobacterium bovis subsp bovis AF2122/97
gcaacgggucgaugucggcaau

SEQ ID NO: 1112550 - RNA, 16 nt, Mycobacterium bovis subsp bovis AF2122/97
gcaacgguuggucgaa

SEQ ID NO: 1112551 - RNA, 17 nt, Mycobacterium bovis subsp bovis AF2122/97
gcaacgguagcggcggg

SEQ ID NO: 1112552 - RNA, 18 nt, Mycobacterium bovis subsp bovis AF2122/97
gcaacgguuggucgaaca

SEQ ID NO: 1112553 - RNA, 14 nt, Mycobacterium bovis subsp bovis AF2122/97
gcaacuaucgcacc

SEQ ID NO: 1112554 - RNA, 15 nt, Mycobacterium bovis subsp bovis AF2122/97
gcaacuaucgcaccu

SEQ ID NO: 1112555 - RNA, 23 nt, Mycobacterium bovis subsp bovis AF2122/97
gcaacguuuguaucugcugccga

SEQ ID NO: 1112556 - RNA, 13 nt, Mycobacterium bovis subsp bovis AF2122/97
gcaacgucgcuga

SEQ ID NO: 1112557 - RNA, 17 nt, Mycobacterium bovis subsp bovis AF2122/97
gcaacguguuaaccggg

SEQ ID NO: 1112558 - RNA, 21 nt, Mycobacterium bovis subsp bovis AF2122/97
gcaacguguuaaccgggcacg

SEQ ID NO: 1112559 - RNA, 20 nt, Mycobacterium bovis subsp bovis AF2122/97
gcaacgcgaaccggccaucg

SEQ ID NO: 1112560 - RNA, 21 nt, Mycobacterium bovis subsp bovis AF2122/97
gcaacgcgaaccggccaucga

SEQ ID NO: 1112561 - RNA, 17 nt, Mycobacterium bovis subsp bovis AF2122/97
gcaacgcgaccaucucg

SEQ ID NO: 1112562 - RNA, 13 nt, Mycobacterium bovis subsp bovis AF2122/97
gcaacgcgaaccg

SEQ ID NO: 1112563 - RNA, 20 nt, Mycobacterium bovis subsp bovis AF2122/97
gcaacgcguauucggcaucg

SEQ ID NO: 1112564 - RNA, 14 nt, Mycobacterium bovis subsp bovis AF2122/97
gcaacgcggccuug

SEQ ID NO: 1112565 - RNA, 23 nt, Mycobacterium bovis subsp bovis AF2122/97
gcaacgcggccuugcgcacaggc

SEQ ID NO: 1112566 - RNA, 21 nt, Mycobacterium bovis subsp bovis AF2122/97
gcaacgcuucggcagcucccg

SEQ ID NO: 1112567 - RNA, 20 nt, Mycobacterium bovis subsp bovis AF2122/97
gcaacggcagcccguggucg

SEQ ID NO: 1112568 - RNA, 21 nt, Mycobacterium bovis subsp bovis AF2122/97
gcaacggcguuggcgccguua

SEQ ID NO: 1112569 - RNA, 19 nt, Mycobacterium bovis subsp bovis AF2122/97
gcaacggcggggccggcgg

SEQ ID NO: 1112570 - RNA, 13 nt, Mycobacterium bovis subsp bovis AF2122/97
gcaacggcggcaa

SEQ ID NO: 1112571 - RNA, 24 nt, Mycobacterium bovis subsp bovis AF2122/97
gcaacggcggcaggccggccaccg

SEQ ID NO: 1112572 - RNA, 14 nt, Mycobacterium bovis subsp bovis AF2122/97
gcaacggcggcauc

SEQ ID NO: 1112573 - RNA, 15 nt, Mycobacterium bovis subsp bovis AF2122/97
gcaacggcggcaucg

SEQ ID NO: 1112574 - RNA, 19 nt, Mycobacterium bovis subsp bovis AF2122/97
gcaacggcggcaucggcgg

SEQ ID NO: 1112575 - RNA, 15 nt, Mycobacterium bovis subsp bovis AF2122/97
gcaacggcggcgacg

SEQ ID NO: 1112576 - RNA, 18 nt, Mycobacterium bovis subsp bovis AF2122/97
gcaacggcggcgacggcg

SEQ ID NO: 1112577 - RNA, 14 nt, Mycobacterium bovis subsp bovis AF2122/97
gcaacggcgcgccg

SEQ ID NO: 1112578 - RNA, 15 nt, Mycobacterium bovis subsp bovis AF2122/97
gcaacggcgcgccga

SEQ ID NO: 1112579 - RNA, 16 nt, Mycobacterium bovis subsp bovis AF2122/97
gcaacggcgcgccgac

SEQ ID NO: 1112580 - RNA, 12 nt, Mycobacterium bovis subsp bovis AF2122/97
gcaacgccgcgc

SEQ ID NO: 1112581 - RNA, 13 nt, Mycobacterium bovis subsp bovis AF2122/97
gcaacgccgcgcc

SEQ ID NO: 1112582 - RNA, 15 nt, Mycobacterium bovis subsp bovis AF2122/97
gcaacgcgaaccggc

SEQ ID NO: 1112583 - RNA, 17 nt, Mycobacterium bovis subsp bovis AF2122/97
gcaacgcgaaccggcca

SEQ ID NO: 1112584 - RNA, 18 nt, Mycobacterium bovis subsp bovis AF2122/97
gcaacgcgaaccggccau

SEQ ID NO: 1112585 - RNA, 15 nt, Mycobacterium bovis subsp bovis AF2122/97
gcaacgccgauggcu

SEQ ID NO: 1112586 - RNA, 12 nt, Mycobacterium bovis subsp bovis AF2122/97
gcaacgcccaac

SEQ ID NO: 1112587 - RNA, 14 nt, Mycobacterium bovis subsp bovis AF2122/97
gcaacgcccaacgu

SEQ ID NO: 1112588 - RNA, 23 nt, Mycobacterium bovis subsp bovis AF2122/97
gcaacgauugaacucuggugacg

SEQ ID NO: 1112589 - RNA, 19 nt, Mycobacterium bovis subsp bovis AF2122/97
gcaacgauuuuagcggcug

SEQ ID NO: 1112590 - RNA, 15 nt, Mycobacterium bovis subsp bovis AF2122/97
gcaacgaucgacacc

SEQ ID NO: 1112591 - RNA, 14 nt, Mycobacterium bovis subsp bovis AF2122/97
gcaaccgguggaug

SEQ ID NO: 1112592 - RNA, 21 nt, Mycobacterium bovis subsp bovis AF2122/97
gcaaccgggaggccaccgcga

SEQ ID NO: 1112593 - RNA, 18 nt, Mycobacterium bovis subsp bovis AF2122/97
gcaaccgguaucgccgcu

SEQ ID NO: 1112594 - RNA, 15 nt, Mycobacterium bovis subsp bovis AF2122/97
gcaaccucaugcacg

SEQ ID NO: 1112595 - RNA, 16 nt, Mycobacterium bovis subsp bovis AF2122/97
gcaaccucaugcacgc

SEQ ID NO: 1112596 - RNA, 17 nt, Mycobacterium bovis subsp bovis AF2122/97
gcaaccgugccgcauca

SEQ ID NO: 1112597 - RNA, 21 nt, Mycobacterium bovis subsp bovis AF2122/97
gcaaccugaauccagaccaug

SEQ ID NO: 1112598 - RNA, 22 nt, Mycobacterium bovis subsp bovis AF2122/97
gcaaccugaauccagaccaugc

SEQ ID NO: 1112599 - RNA, 14 nt, Mycobacterium bovis subsp bovis AF2122/97
gcaaccugccgggc

SEQ ID NO: 1112600 - RNA, 15 nt, Mycobacterium bovis subsp bovis AF2122/97
gcaaccugccgggcc

SEQ ID NO: 1112601 - RNA, 18 nt, Mycobacterium bovis subsp bovis AF2122/97
gcaaccuugggcgccguc

SEQ ID NO: 1112602 - RNA, 20 nt, Mycobacterium bovis subsp bovis AF2122/97
gcaacgaagagggcgccgcg

SEQ ID NO: 1112603 - RNA, 21 nt, Mycobacterium bovis subsp bovis AF2122/97
gcaacgaagagggcgccgcgc

SEQ ID NO: 1112604 - RNA, 23 nt, Mycobacterium bovis subsp bovis AF2122/97
gcaacgaagagggcgccgcgcgc

SEQ ID NO: 1112605 - RNA, 15 nt, Mycobacterium bovis subsp bovis AF2122/97
gcaacgaagccggcg

SEQ ID NO: 1112606 - RNA, 16 nt, Mycobacterium bovis subsp bovis AF2122/97
gcaacgaagccggcgc

SEQ ID NO: 1112607 - RNA, 20 nt, Mycobacterium bovis subsp bovis AF2122/97
gcaacgacaaaccgggcgug

SEQ ID NO: 1112608 - RNA, 15 nt, Mycobacterium bovis subsp bovis AF2122/97
gcaacgacugcauga

SEQ ID NO: 1112609 - RNA, 19 nt, Mycobacterium bovis subsp bovis AF2122/97
gcaacgacuuucaucgcga

SEQ ID NO: 1112610 - RNA, 21 nt, Mycobacterium bovis subsp bovis AF2122/97
gcaacgacccgaagccgaccg

SEQ ID NO: 1112611 - RNA, 22 nt, Mycobacterium bovis subsp bovis AF2122/97
gcaacgacgucgucgccgccga

SEQ ID NO: 1112612 - RNA, 19 nt, Mycobacterium bovis subsp bovis AF2122/97
gcaacgacggccgucgccc

SEQ ID NO: 1112613 - RNA, 14 nt, Mycobacterium bovis subsp bovis AF2122/97
gcaacaucgggucg

SEQ ID NO: 1112614 - RNA, 22 nt, Mycobacterium bovis subsp bovis AF2122/97
gcaacaugagcgucgcugaccg

SEQ ID NO: 1112615 - RNA, 21 nt, Mycobacterium bovis subsp bovis AF2122/97
gcaacaucagcaggaccaacg

SEQ ID NO: 1112616 - RNA, 20 nt, Mycobacterium bovis subsp bovis AF2122/97
gcaacauccccaugucggug

SEQ ID NO: 1112617 - RNA, 12 nt, Mycobacterium bovis subsp bovis AF2122/97
gcaacagcgcca

SEQ ID NO: 1112618 - RNA, 17 nt, Mycobacterium bovis subsp bovis AF2122/97
gcaacaggcccacggcg

SEQ ID NO: 1112619 - RNA, 21 nt, Mycobacterium bovis subsp bovis AF2122/97
gcaacaggcccacggcgacca

SEQ ID NO: 1112620 - RNA, 14 nt, Mycobacterium bovis subsp bovis AF2122/97
gcaacagcgagcgg

SEQ ID NO: 1112621 - RNA, 17 nt, Mycobacterium bovis subsp bovis AF2122/97
gcaacacgccggcccgg

SEQ ID NO: 1112622 - RNA, 19 nt, Mycobacterium bovis subsp bovis AF2122/97
gcaacacgauaucgggcuc

SEQ ID NO: 1112623 - RNA, 15 nt, Mycobacterium bovis subsp bovis AF2122/97
gcaacagcaccagug

SEQ ID NO: 1112624 - RNA, 23 nt, Mycobacterium bovis subsp bovis AF2122/97
gcaacaccggugucggccagcaa

SEQ ID NO: 1112625 - RNA, 15 nt, Mycobacterium bovis subsp bovis AF2122/97
gcaacaccucgucgg

SEQ ID NO: 1112626 - RNA, 17 nt, Mycobacterium bovis subsp bovis AF2122/97
gcaacaccucgucggcu

SEQ ID NO: 1112627 - RNA, 23 nt, Mycobacterium bovis subsp bovis AF2122/97
gcaacaccccccguccaccguca

SEQ ID NO: 1112628 - RNA, 16 nt, Mycobacterium bovis subsp bovis AF2122/97
gcaacaccccgagccg

SEQ ID NO: 1112629 - RNA, 16 nt, Mycobacterium bovis subsp bovis AF2122/97
gcaacaccgcaccggc

SEQ ID NO: 1112630 - RNA, 13 nt, Mycobacterium bovis subsp bovis AF2122/97
gcaacacaccgaa

SEQ ID NO: 1112631 - RNA, 13 nt, Mycobacterium bovis subsp bovis AF2122/97
gcaacacaccgcg

SEQ ID NO: 1112632 - RNA, 23 nt, Mycobacterium bovis subsp bovis AF2122/97
gcaacacaccgcggaaggccagc

SEQ ID NO: 1112633 - RNA, 23 nt, Mycobacterium bovis subsp bovis AF2122/97
gcaaccgcgcuuggagcgggucc

SEQ ID NO: 1112634 - RNA, 13 nt, Mycobacterium bovis subsp bovis AF2122/97
gcaaccgcggccc

SEQ ID NO: 1112635 - RNA, 14 nt, Mycobacterium bovis subsp bovis AF2122/97
gcaaccgcggcccc

SEQ ID NO: 1112636 - RNA, 15 nt, Mycobacterium bovis subsp bovis AF2122/97
gcaaccgcggccccg

SEQ ID NO: 1112637 - RNA, 15 nt, Mycobacterium bovis subsp bovis AF2122/97
gcaaccgccgugugc

SEQ ID NO: 1112638 - RNA, 19 nt, Mycobacterium bovis subsp bovis AF2122/97
gcaaccgccgugugccacg

SEQ ID NO: 1112639 - RNA, 19 nt, Mycobacterium bovis subsp bovis AF2122/97
gcaaccggauuucgucggg

SEQ ID NO: 1112640 - RNA, 16 nt, Mycobacterium bovis subsp bovis AF2122/97
gcaaccgcucggcgau

SEQ ID NO: 1112641 - RNA, 23 nt, Mycobacterium bovis subsp bovis AF2122/97
gcaaccgggccucaugcuaggcc

SEQ ID NO: 1112642 - RNA, 15 nt, Mycobacterium bovis subsp bovis AF2122/97
gcaaccgcucggcga

SEQ ID NO: 1112643 - RNA, 17 nt, Mycobacterium bovis subsp bovis AF2122/97
gcaaccgagggcauucc

SEQ ID NO: 1112644 - RNA, 13 nt, Mycobacterium bovis subsp bovis AF2122/97
gcaaccgccaucg

SEQ ID NO: 1112645 - RNA, 13 nt, Mycobacterium bovis subsp bovis AF2122/97
gcaaccgccgcca

SEQ ID NO: 1112646 - RNA, 21 nt, Mycobacterium bovis subsp bovis AF2122/97
gcaaccgccgccaccagggcg

SEQ ID NO: 1112647 - RNA, 20 nt, Mycobacterium bovis subsp bovis AF2122/97
gcaacccggccuggagcagc

SEQ ID NO: 1112648 - RNA, 14 nt, Mycobacterium bovis subsp bovis AF2122/97
gcaacccgccguug

SEQ ID NO: 1112649 - RNA, 15 nt, Mycobacterium bovis subsp bovis AF2122/97
gcaacccugcccggc

SEQ ID NO: 1112650 - RNA, 15 nt, Mycobacterium bovis subsp bovis AF2122/97
gcaacccugccgcga

SEQ ID NO: 1112651 - RNA, 14 nt, Mycobacterium bovis subsp bovis AF2122/97
gcaacccugcggug

SEQ ID NO: 1112652 - RNA, 19 nt, Mycobacterium bovis subsp bovis AF2122/97
gcaacccacacgcccucga

SEQ ID NO: 1112653 - RNA, 17 nt, Mycobacterium bovis subsp bovis AF2122/97
gcaaccauggcggcucc

SEQ ID NO: 1112654 - RNA, 22 nt, Mycobacterium bovis subsp bovis AF2122/97
gcaaccaggaugguugcgacgg

SEQ ID NO: 1112655 - RNA, 14 nt, Mycobacterium bovis subsp bovis AF2122/97
gcaaccagcgagcc

SEQ ID NO: 1112656 - RNA, 15 nt, Mycobacterium bovis subsp bovis AF2122/97
gcaacccagccgcgc

SEQ ID NO: 1112657 - RNA, 14 nt, Mycobacterium bovis subsp bovis AF2122/97
gcaaccacguccgc

SEQ ID NO: 1112658 - RNA, 13 nt, Mycobacterium bovis subsp bovis AF2122/97
gcaaccagcagca

SEQ ID NO: 1112659 - RNA, 19 nt, Mycobacterium bovis subsp bovis AF2122/97
gcaaccacgccccgaucgg

SEQ ID NO: 1112660 - RNA, 15 nt, Mycobacterium bovis subsp bovis AF2122/97
gcaaccaccggccgc

SEQ ID NO: 1112661 - RNA, 16 nt, Mycobacterium bovis subsp bovis AF2122/97
gcaaccaaagcgacga

SEQ ID NO: 1112662 - RNA, 14 nt, Mycobacterium bovis subsp bovis AF2122/97
gcaaccaaccgcgc

SEQ ID NO: 1112663 - RNA, 19 nt, Mycobacterium bovis subsp bovis AF2122/97
gcaagccguugcacggccg

SEQ ID NO: 1112664 - RNA, 22 nt, Mycobacterium bovis subsp bovis AF2122/97
gcaagccuaaaaccccgagccg

SEQ ID NO: 1112665 - RNA, 14 nt, Mycobacterium bovis subsp bovis AF2122/97
gcaagcugaccgcc

SEQ ID NO: 1112666 - RNA, 20 nt, Mycobacterium bovis subsp bovis AF2122/97
gcaagcugaccgccagcggc

SEQ ID NO: 1112667 - RNA, 22 nt, Mycobacterium bovis subsp bovis AF2122/97
gcaagcgugacccgccggcgac

SEQ ID NO: 1112668 - RNA, 13 nt, Mycobacterium bovis subsp bovis AF2122/97
gcaagcggaugug

SEQ ID NO: 1112669 - RNA, 13 nt, Mycobacterium bovis subsp bovis AF2122/97
gcaagcgccgcgc

SEQ ID NO: 1112670 - RNA, 15 nt, Mycobacterium bovis subsp bovis AF2122/97
gcaaggcauccaacg

SEQ ID NO: 1112671 - RNA, 14 nt, Mycobacterium bovis subsp bovis AF2122/97
gcaaggcauucgag

SEQ ID NO: 1112672 - RNA, 15 nt, Mycobacterium bovis subsp bovis AF2122/97
gcaaggcccgcaccg

SEQ ID NO: 1112673 - RNA, 13 nt, Mycobacterium bovis subsp bovis AF2122/97
gcaaggccaccgg

SEQ ID NO: 1112674 - RNA, 17 nt, Mycobacterium bovis subsp bovis AF2122/97
gcaaggccaccgucgcg

SEQ ID NO: 1112675 - RNA, 22 nt, Mycobacterium bovis subsp bovis AF2122/97
gcaaggacguggcgcuggaccg

SEQ ID NO: 1112676 - RNA, 16 nt, Mycobacterium bovis subsp bovis AF2122/97
gcaagcugucgucgcc

SEQ ID NO: 1112677 - RNA, 18 nt, Mycobacterium bovis subsp bovis AF2122/97
gcaaggaauuccggcugc

SEQ ID NO: 1112678 - RNA, 16 nt, Mycobacterium bovis subsp bovis AF2122/97
gcaaggcggcggccag

SEQ ID NO: 1112679 - RNA, 21 nt, Mycobacterium bovis subsp bovis AF2122/97
gcaaggcgccgauaccggcgg

SEQ ID NO: 1112680 - RNA, 20 nt, Mycobacterium bovis subsp bovis AF2122/97
gcaaggcguguagccugcgg

SEQ ID NO: 1112681 - RNA, 15 nt, Mycobacterium bovis subsp bovis AF2122/97
gcaagggcggcaacg

SEQ ID NO: 1112682 - RNA, 17 nt, Mycobacterium bovis subsp bovis AF2122/97
gcaagggcggcaacggg

SEQ ID NO: 1112683 - RNA, 15 nt, Mycobacterium bovis subsp bovis AF2122/97
gcaacuccucgaccg

SEQ ID NO: 1112684 - RNA, 16 nt, Mycobacterium bovis subsp bovis AF2122/97
gcaacuccucgaccgu

SEQ ID NO: 1112685 - RNA, 21 nt, Mycobacterium bovis subsp bovis AF2122/97
gcaacucgccacggucgccga

SEQ ID NO: 1112686 - RNA, 14 nt, Mycobacterium bovis subsp bovis AF2122/97
gcaacucggccacg

SEQ ID NO: 1112687 - RNA, 17 nt, Mycobacterium bovis subsp bovis AF2122/97
gcaacugccgcacccgg

SEQ ID NO: 1112688 - RNA, 17 nt, Mycobacterium bovis subsp bovis AF2122/97
gcaacuucagcaacggc

SEQ ID NO: 1112689 - RNA, 15 nt, Mycobacterium bovis subsp bovis AF2122/97
gcaagcacgcgacgg

SEQ ID NO: 1112690 - RNA, 23 nt, Mycobacterium bovis subsp bovis AF2122/97
gcaagcacggcgucgaugucguc

SEQ ID NO: 1112691 - RNA, 19 nt, Mycobacterium bovis subsp bovis AF2122/97
gcaagcacgguggccgagc

SEQ ID NO: 1112692 - RNA, 21 nt, Mycobacterium bovis subsp bovis AF2122/97
gcaagcacgguggccgagccg

SEQ ID NO: 1112693 - RNA, 21 nt, Mycobacterium bovis subsp bovis AF2122/97
gcaagaucaccuucgucgcgg

SEQ ID NO: 1112694 - RNA, 17 nt, Mycobacterium bovis subsp bovis AF2122/97
gcaagcagcgcgaucug

SEQ ID NO: 1112695 - RNA, 14 nt, Mycobacterium bovis subsp bovis AF2122/97
gcaagccacgccgg

SEQ ID NO: 1112696 - RNA, 23 nt, Mycobacterium bovis subsp bovis AF2122/97
gcaagaaaguuccacgacaaccg

SEQ ID NO: 1112697 - RNA, 15 nt, Mycobacterium bovis subsp bovis AF2122/97
gcaagaaugccgccg

SEQ ID NO: 1112698 - RNA, 16 nt, Mycobacterium bovis subsp bovis AF2122/97
gcaagaaugccgccga

SEQ ID NO: 1112699 - RNA, 17 nt, Mycobacterium bovis subsp bovis AF2122/97
gcaagaaugccgccgac

SEQ ID NO: 1112700 - RNA, 19 nt, Mycobacterium bovis subsp bovis AF2122/97
gcaagaaugccgccgacgg

SEQ ID NO: 1112701 - RNA, 18 nt, Mycobacterium bovis subsp bovis AF2122/97
gcaaugcaucgcggcggc

SEQ ID NO: 1112702 - RNA, 16 nt, Mycobacterium bovis subsp bovis AF2122/97
gcaaugaccugcagcg

SEQ ID NO: 1112703 - RNA, 19 nt, Mycobacterium bovis subsp bovis AF2122/97
gcaaugacguacggggucg

SEQ ID NO: 1112704 - RNA, 23 nt, Mycobacterium bovis subsp bovis AF2122/97
gcaaugacguacggggucgccgg

SEQ ID NO: 1112705 - RNA, 17 nt, Mycobacterium bovis subsp bovis AF2122/97
gcaaugacgucgucggc

SEQ ID NO: 1112706 - RNA, 15 nt, Mycobacterium bovis subsp bovis AF2122/97
gcaaugacggccugc

SEQ ID NO: 1112707 - RNA, 14 nt, Mycobacterium bovis subsp bovis AF2122/97
gcaauuccgccgag

SEQ ID NO: 1112708 - RNA, 15 nt, Mycobacterium bovis subsp bovis AF2122/97
gcaauuccgccgagc

SEQ ID NO: 1112709 - RNA, 18 nt, Mycobacterium bovis subsp bovis AF2122/97
gcaauuccggugaucgcg

SEQ ID NO: 1112710 - RNA, 17 nt, Mycobacterium bovis subsp bovis AF2122/97
gcaauuaggucgaccac

SEQ ID NO: 1112711 - RNA, 20 nt, Mycobacterium bovis subsp bovis AF2122/97
gcaauuccaccgccgagaug

SEQ ID NO: 1112712 - RNA, 17 nt, Mycobacterium bovis subsp bovis AF2122/97
gcacaaguggucgauga

SEQ ID NO: 1112713 - RNA, 15 nt, Mycobacterium bovis subsp bovis AF2122/97
gcacaaucaccgccg

SEQ ID NO: 1112714 - RNA, 17 nt, Mycobacterium bovis subsp bovis AF2122/97
gcacaaucaccgccgcg

SEQ ID NO: 1112715 - RNA, 14 nt, Mycobacterium bovis subsp bovis AF2122/97
gcaauugccugcgc

SEQ ID NO: 1112716 - RNA, 17 nt, Mycobacterium bovis subsp bovis AF2122/97
gcaauuguucgcggccg

SEQ ID NO: 1112717 - RNA, 20 nt, Mycobacterium bovis subsp bovis AF2122/97
gcacaccaacaccgcggcgc

SEQ ID NO: 1112718 - RNA, 15 nt, Mycobacterium bovis subsp bovis AF2122/97
gcacaccaccgccga

SEQ ID NO: 1112719 - RNA, 13 nt, Mycobacterium bovis subsp bovis AF2122/97
gcacacagaccgu

SEQ ID NO: 1112720 - RNA, 19 nt, Mycobacterium bovis subsp bovis AF2122/97
gcacacaacacccaacgca

SEQ ID NO: 1112721 - RNA, 20 nt, Mycobacterium bovis subsp bovis AF2122/97
gcacaaucggauagccgugc

SEQ ID NO: 1112722 - RNA, 22 nt, Mycobacterium bovis subsp bovis AF2122/97
gcacaaucgguugcacccgcgc

SEQ ID NO: 1112723 - RNA, 17 nt, Mycobacterium bovis subsp bovis AF2122/97
gcacaauggcggcgccg

SEQ ID NO: 1112724 - RNA, 20 nt, Mycobacterium bovis subsp bovis AF2122/97
gcaauccccuggaaagggcc

SEQ ID NO: 1112725 - RNA, 11 nt, Mycobacterium bovis subsp bovis AF2122/97
gcaauccgcaa

SEQ ID NO: 1112726 - RNA, 20 nt, Mycobacterium bovis subsp bovis AF2122/97
gcaaucauccgaucgccgcg

SEQ ID NO: 1112727 - RNA, 22 nt, Mycobacterium bovis subsp bovis AF2122/97
gcaaucaucucccgaccgccga

SEQ ID NO: 1112728 - RNA, 13 nt, Mycobacterium bovis subsp bovis AF2122/97
gcaaggucgcugc

SEQ ID NO: 1112729 - RNA, 20 nt, Mycobacterium bovis subsp bovis AF2122/97
gcaaggguggggccggcggu

SEQ ID NO: 1112730 - RNA, 13 nt, Mycobacterium bovis subsp bovis AF2122/97
gcaagucgccgag

SEQ ID NO: 1112731 - RNA, 13 nt, Mycobacterium bovis subsp bovis AF2122/97
gcaagucaaacgc

SEQ ID NO: 1112732 - RNA, 21 nt, Mycobacterium bovis subsp bovis AF2122/97
gcaagucaaacgccgucacgg

SEQ ID NO: 1112733 - RNA, 21 nt, Mycobacterium bovis subsp bovis AF2122/97
gcaagucgagauagaccuugg

SEQ ID NO: 1112734 - RNA, 16 nt, Mycobacterium bovis subsp bovis AF2122/97
gcaagucgauggagaa

SEQ ID NO: 1112735 - RNA, 19 nt, Mycobacterium bovis subsp bovis AF2122/97
gcaagucgcccagccgagc

SEQ ID NO: 1112736 - RNA, 12 nt, Mycobacterium bovis subsp bovis AF2122/97
gcaagucgccga

SEQ ID NO: 1112737 - RNA, 22 nt, Mycobacterium bovis subsp bovis AF2122/97
gcaaggucgcugcuugcgggcu

SEQ ID NO: 1112738 - RNA, 20 nt, Mycobacterium bovis subsp bovis AF2122/97
gcaagugggcgcgaacggcg

SEQ ID NO: 1112739 - RNA, 19 nt, Mycobacterium bovis subsp bovis AF2122/97
gcaagugggugccggcacc

SEQ ID NO: 1112740 - RNA, 20 nt, Mycobacterium bovis subsp bovis AF2122/97
gcaagugggugccggcaccc

SEQ ID NO: 1112741 - RNA, 21 nt, Mycobacterium bovis subsp bovis AF2122/97
gcaagugucuccggcaacagc

SEQ ID NO: 1112742 - RNA, 19 nt, Mycobacterium bovis subsp bovis AF2122/97
gcacguugugaucgucagu

SEQ ID NO: 1112743 - RNA, 16 nt, Mycobacterium bovis subsp bovis AF2122/97
gcacuccagcggcggg

SEQ ID NO: 1112744 - RNA, 23 nt, Mycobacterium bovis subsp bovis AF2122/97
gcacucagcaggggaucguccgg

SEQ ID NO: 1112745 - RNA, 22 nt, Mycobacterium bovis subsp bovis AF2122/97
gcacuccacgaucggcccagcc

SEQ ID NO: 1112746 - RNA, 18 nt, Mycobacterium bovis subsp bovis AF2122/97
gcacucagcaggggaucg

SEQ ID NO: 1112747 - RNA, 18 nt, Mycobacterium bovis subsp bovis AF2122/97
gcacucaucgccggaccg

SEQ ID NO: 1112748 - RNA, 20 nt, Mycobacterium bovis subsp bovis AF2122/97
gcacuccaccgcuggcccgg

SEQ ID NO: 1112749 - RNA, 15 nt, Mycobacterium bovis subsp bovis AF2122/97
gcacuccacgaucgg

SEQ ID NO: 1112750 - RNA, 16 nt, Mycobacterium bovis subsp bovis AF2122/97
gcacuccacgaucggc

SEQ ID NO: 1112751 - RNA, 13 nt, Mycobacterium bovis subsp bovis AF2122/97
gcacguugccgaa

SEQ ID NO: 1112752 - RNA, 17 nt, Mycobacterium bovis subsp bovis AF2122/97
gcacguugacguccaac

SEQ ID NO: 1112753 - RNA, 15 nt, Mycobacterium bovis subsp bovis AF2122/97
gcacguugccgaacg

SEQ ID NO: 1112754 - RNA, 16 nt, Mycobacterium bovis subsp bovis AF2122/97
gcacguucaccgcgcg

SEQ ID NO: 1112755 - RNA, 20 nt, Mycobacterium bovis subsp bovis AF2122/97
gcacguucaccgcgcgcucg

SEQ ID NO: 1112756 - RNA, 22 nt, Mycobacterium bovis subsp bovis AF2122/97
gcacguucaccgcgcgcucgcc

SEQ ID NO: 1112757 - RNA, 23 nt, Mycobacterium bovis subsp bovis AF2122/97
gcacguucaccgcgcgcucgccc

SEQ ID NO: 1112758 - RNA, 18 nt, Mycobacterium bovis subsp bovis AF2122/97
gcacguucacgcgcggau

SEQ ID NO: 1112759 - RNA, 16 nt, Mycobacterium bovis subsp bovis AF2122/97
gcacguucggcgcaca

SEQ ID NO: 1112760 - RNA, 18 nt, Mycobacterium bovis subsp bovis AF2122/97
gcacggugaacaauccga

SEQ ID NO: 1112761 - RNA, 17 nt, Mycobacterium bovis subsp bovis AF2122/97
gcacguggaccggcacg

SEQ ID NO: 1112762 - RNA, 12 nt, Mycobacterium bovis subsp bovis AF2122/97
gcacguggcgac

SEQ ID NO: 1112763 - RNA, 20 nt, Mycobacterium bovis subsp bovis AF2122/97
gcacggucgcccgaucggcg

SEQ ID NO: 1112764 - RNA, 15 nt, Mycobacterium bovis subsp bovis AF2122/97
gcacggucaacgauc

SEQ ID NO: 1112765 - RNA, 22 nt, Mycobacterium bovis subsp bovis AF2122/97
gcacggucgcccgaucggcgga

SEQ ID NO: 1112766 - RNA, 19 nt, Mycobacterium bovis subsp bovis AF2122/97
gcacggguaaucaccgaau

SEQ ID NO: 1112767 - RNA, 14 nt, Mycobacterium bovis subsp bovis AF2122/97
gcacgguaucggug

SEQ ID NO: 1112768 - RNA, 21 nt, Mycobacterium bovis subsp bovis AF2122/97
gcacgggugagcaccacgugc

SEQ ID NO: 1112769 - RNA, 18 nt, Mycobacterium bovis subsp bovis AF2122/97
gcacggucaugccgccgc

SEQ ID NO: 1112770 - RNA, 19 nt, Mycobacterium bovis subsp bovis AF2122/97
gcacggucaugccgccgcc

SEQ ID NO: 1112771 - RNA, 13 nt, Mycobacterium bovis subsp bovis AF2122/97
gcacggucaacgu

SEQ ID NO: 1112772 - RNA, 21 nt, Mycobacterium bovis subsp bovis AF2122/97
gcacggucaauugugcggccc

SEQ ID NO: 1112773 - RNA, 23 nt, Mycobacterium bovis subsp bovis AF2122/97
gcacggucaauugugcggccccg

SEQ ID NO: 1112774 - RNA, 20 nt, Mycobacterium bovis subsp bovis AF2122/97
gcacggucacacgccagccg

SEQ ID NO: 1112775 - RNA, 21 nt, Mycobacterium bovis subsp bovis AF2122/97
gcacuggauccgggagucgac

SEQ ID NO: 1112776 - RNA, 13 nt, Mycobacterium bovis subsp bovis AF2122/97
gcacuggccccgg

SEQ ID NO: 1112777 - RNA, 13 nt, Mycobacterium bovis subsp bovis AF2122/97
gcacugcgaaccc

SEQ ID NO: 1112778 - RNA, 14 nt, Mycobacterium bovis subsp bovis AF2122/97
gcacugcggcagcg

SEQ ID NO: 1112779 - RNA, 16 nt, Mycobacterium bovis subsp bovis AF2122/97
gcacugcggcagcgaa

SEQ ID NO: 1112780 - RNA, 12 nt, Mycobacterium bovis subsp bovis AF2122/97
gcacugcgccgg

SEQ ID NO: 1112781 - RNA, 13 nt, Mycobacterium bovis subsp bovis AF2122/97
gcacugcgccggc

SEQ ID NO: 1112782 - RNA, 18 nt, Mycobacterium bovis subsp bovis AF2122/97
gcacugcgccggccggcg

SEQ ID NO: 1112783 - RNA, 16 nt, Mycobacterium bovis subsp bovis AF2122/97
gcacugcgcgugcucg

SEQ ID NO: 1112784 - RNA, 20 nt, Mycobacterium bovis subsp bovis AF2122/97
gcacugcgcgugcucgacgc

SEQ ID NO: 1112785 - RNA, 13 nt, Mycobacterium bovis subsp bovis AF2122/97
gcacugccgccgg

SEQ ID NO: 1112786 - RNA, 14 nt, Mycobacterium bovis subsp bovis AF2122/97
gcacugccggcacg

SEQ ID NO: 1112787 - RNA, 14 nt, Mycobacterium bovis subsp bovis AF2122/97
gcacugccgagcac

SEQ ID NO: 1112788 - RNA, 18 nt, Mycobacterium bovis subsp bovis AF2122/97
gcacugcccagcagacca

SEQ ID NO: 1112789 - RNA, 16 nt, Mycobacterium bovis subsp bovis AF2122/97
gcacugccccgcaucg

SEQ ID NO: 1112790 - RNA, 16 nt, Mycobacterium bovis subsp bovis AF2122/97
gcacugaccgcgauga

SEQ ID NO: 1112791 - RNA, 17 nt, Mycobacterium bovis subsp bovis AF2122/97
gcacugacgggccguca

SEQ ID NO: 1112792 - RNA, 20 nt, Mycobacterium bovis subsp bovis AF2122/97
gcacuucggugccgugaucg

SEQ ID NO: 1112793 - RNA, 21 nt, Mycobacterium bovis subsp bovis AF2122/97
gcacuucgucgaaccugucga

SEQ ID NO: 1112794 - RNA, 23 nt, Mycobacterium bovis subsp bovis AF2122/97
gcacuucguuuuccagccgacgu

SEQ ID NO: 1112795 - RNA, 20 nt, Mycobacterium bovis subsp bovis AF2122/97
gcacuuccaagccgaccugc

SEQ ID NO: 1112796 - RNA, 22 nt, Mycobacterium bovis subsp bovis AF2122/97
gcacuggguccacgcgcucggu

SEQ ID NO: 1112797 - RNA, 22 nt, Mycobacterium bovis subsp bovis AF2122/97
gcacugucgagguggucgaccc

SEQ ID NO: 1112798 - RNA, 22 nt, Mycobacterium bovis subsp bovis AF2122/97
gcacuggugcccgacccgccga

SEQ ID NO: 1112799 - RNA, 13 nt, Mycobacterium bovis subsp bovis AF2122/97
gcacugguggcga

SEQ ID NO: 1112800 - RNA, 17 nt, Mycobacterium bovis subsp bovis AF2122/97
gcacugguggcgauccg

SEQ ID NO: 1112801 - RNA, 15 nt, Mycobacterium bovis subsp bovis AF2122/97
gcacuuaccgagccg

SEQ ID NO: 1112802 - RNA, 19 nt, Mycobacterium bovis subsp bovis AF2122/97
gcacugugcccucaacguc

SEQ ID NO: 1112803 - RNA, 18 nt, Mycobacterium bovis subsp bovis AF2122/97
gcacugugcguccgcaac

SEQ ID NO: 1112804 - RNA, 19 nt, Mycobacterium bovis subsp bovis AF2122/97
gcacggccgggacggcgau

SEQ ID NO: 1112805 - RNA, 13 nt, Mycobacterium bovis subsp bovis AF2122/97
gcacggccggguc

SEQ ID NO: 1112806 - RNA, 13 nt, Mycobacterium bovis subsp bovis AF2122/97
gcacggccgucga

SEQ ID NO: 1112807 - RNA, 17 nt, Mycobacterium bovis subsp bovis AF2122/97
gcacggcgacgaucucg

SEQ ID NO: 1112808 - RNA, 18 nt, Mycobacterium bovis subsp bovis AF2122/97
gcacggcgaggccgaacu

SEQ ID NO: 1112809 - RNA, 16 nt, Mycobacterium bovis subsp bovis AF2122/97
gcacggccgucgacga

SEQ ID NO: 1112810 - RNA, 20 nt, Mycobacterium bovis subsp bovis AF2122/97
gcacggccgucgacgaucag

SEQ ID NO: 1112811 - RNA, 21 nt, Mycobacterium bovis subsp bovis AF2122/97
gcacgggcggggacggcggca

SEQ ID NO: 1112812 - RNA, 22 nt, Mycobacterium bovis subsp bovis AF2122/97
gcacgggcggggacggcggcaa

SEQ ID NO: 1112813 - RNA, 17 nt, Mycobacterium bovis subsp bovis AF2122/97
gcacggggaccgggcug

SEQ ID NO: 1112814 - RNA, 18 nt, Mycobacterium bovis subsp bovis AF2122/97
gcacgggcggccauggca

SEQ ID NO: 1112815 - RNA, 19 nt, Mycobacterium bovis subsp bovis AF2122/97
gcacggggaccuuggcgac

SEQ ID NO: 1112816 - RNA, 13 nt, Mycobacterium bovis subsp bovis AF2122/97
gcacggcgccgcc

SEQ ID NO: 1112817 - RNA, 15 nt, Mycobacterium bovis subsp bovis AF2122/97
gcacggcgccgccac

SEQ ID NO: 1112818 - RNA, 16 nt, Mycobacterium bovis subsp bovis AF2122/97
gcacggcgccgccacg

SEQ ID NO: 1112819 - RNA, 19 nt, Mycobacterium bovis subsp bovis AF2122/97
gcacggcgauugcccgugc

SEQ ID NO: 1112820 - RNA, 20 nt, Mycobacterium bovis subsp bovis AF2122/97
gcacggcgaaugcauuggcg

SEQ ID NO: 1112821 - RNA, 13 nt, Mycobacterium bovis subsp bovis AF2122/97
gcacggcgaucgg

SEQ ID NO: 1112822 - RNA, 16 nt, Mycobacterium bovis subsp bovis AF2122/97
gcacggcgaucgguga

SEQ ID NO: 1112823 - RNA, 20 nt, Mycobacterium bovis subsp bovis AF2122/97
gcacggccccugccacgacg

SEQ ID NO: 1112824 - RNA, 21 nt, Mycobacterium bovis subsp bovis AF2122/97
gcacggccccugccacgacga

SEQ ID NO: 1112825 - RNA, 21 nt, Mycobacterium bovis subsp bovis AF2122/97
gcacggccaugaucacaccgc

SEQ ID NO: 1112826 - RNA, 22 nt, Mycobacterium bovis subsp bovis AF2122/97
gcacggccaugaucacaccgcu

SEQ ID NO: 1112827 - RNA, 18 nt, Mycobacterium bovis subsp bovis AF2122/97
gcacggccaccgcgcaac

SEQ ID NO: 1112828 - RNA, 19 nt, Mycobacterium bovis subsp bovis AF2122/97
gcacggccaccgcgcaacc

SEQ ID NO: 1112829 - RNA, 22 nt, Mycobacterium bovis subsp bovis AF2122/97
gcacggcacccacccguucggc

SEQ ID NO: 1112830 - RNA, 16 nt, Mycobacterium bovis subsp bovis AF2122/97
gcacgcuggaacuugg

SEQ ID NO: 1112831 - RNA, 16 nt, Mycobacterium bovis subsp bovis AF2122/97
gcacgcugcucgacgg

SEQ ID NO: 1112832 - RNA, 15 nt, Mycobacterium bovis subsp bovis AF2122/97
gcacgcugcugcggg

SEQ ID NO: 1112833 - RNA, 21 nt, Mycobacterium bovis subsp bovis AF2122/97
gcacgcugaccacaaccguga

SEQ ID NO: 1112834 - RNA, 15 nt, Mycobacterium bovis subsp bovis AF2122/97
gcacgcugaccggau

SEQ ID NO: 1112835 - RNA, 14 nt, Mycobacterium bovis subsp bovis AF2122/97
gcacgccgaccggc

SEQ ID NO: 1112836 - RNA, 17 nt, Mycobacterium bovis subsp bovis AF2122/97
gcacgccgaccaauucg

SEQ ID NO: 1112837 - RNA, 22 nt, Mycobacterium bovis subsp bovis AF2122/97
gcacgcgaggcgcucacccgcc

SEQ ID NO: 1112838 - RNA, 14 nt, Mycobacterium bovis subsp bovis AF2122/97
gcacgcgacggcgc

SEQ ID NO: 1112839 - RNA, 16 nt, Mycobacterium bovis subsp bovis AF2122/97
gcacgccuugagccga

SEQ ID NO: 1112840 - RNA, 22 nt, Mycobacterium bovis subsp bovis AF2122/97
gcacgcgaaaugccugcgcgau

SEQ ID NO: 1112841 - RNA, 14 nt, Mycobacterium bovis subsp bovis AF2122/97
gcacgcucggcacg

SEQ ID NO: 1112842 - RNA, 13 nt, Mycobacterium bovis subsp bovis AF2122/97
gcacgcucggcgg

SEQ ID NO: 1112843 - RNA, 13 nt, Mycobacterium bovis subsp bovis AF2122/97
gcacgcucggcgu

SEQ ID NO: 1112844 - RNA, 21 nt, Mycobacterium bovis subsp bovis AF2122/97
gcacgcgcaguuuggcggcgc

SEQ ID NO: 1112845 - RNA, 14 nt, Mycobacterium bovis subsp bovis AF2122/97
gcacgcucggcgcc

SEQ ID NO: 1112846 - RNA, 16 nt, Mycobacterium bovis subsp bovis AF2122/97
gcacgcucugcgccac

SEQ ID NO: 1112847 - RNA, 21 nt, Mycobacterium bovis subsp bovis AF2122/97
gcacgcccucgacgcgcucgg

SEQ ID NO: 1112848 - RNA, 15 nt, Mycobacterium bovis subsp bovis AF2122/97
gcacgcccucgucga

SEQ ID NO: 1112849 - RNA, 20 nt, Mycobacterium bovis subsp bovis AF2122/97
gcacgcccucgucgaucgcc

SEQ ID NO: 1112850 - RNA, 15 nt, Mycobacterium bovis subsp bovis AF2122/97
gcacgcccucgacgc

SEQ ID NO: 1112851 - RNA, 15 nt, Mycobacterium bovis subsp bovis AF2122/97
gcacgcccaggcgac

SEQ ID NO: 1112852 - RNA, 19 nt, Mycobacterium bovis subsp bovis AF2122/97
gcacgcccaggcgaccgcu

SEQ ID NO: 1112853 - RNA, 23 nt, Mycobacterium bovis subsp bovis AF2122/97
gcacgaccagcugagcuggcagc

SEQ ID NO: 1112854 - RNA, 20 nt, Mycobacterium bovis subsp bovis AF2122/97
gcacgaccgcucccgguguu

SEQ ID NO: 1112855 - RNA, 13 nt, Mycobacterium bovis subsp bovis AF2122/97
gcacgaccugguu

SEQ ID NO: 1112856 - RNA, 17 nt, Mycobacterium bovis subsp bovis AF2122/97
gcacgaacgaguccaac

SEQ ID NO: 1112857 - RNA, 13 nt, Mycobacterium bovis subsp bovis AF2122/97
gcacgaacgccug

SEQ ID NO: 1112858 - RNA, 21 nt, Mycobacterium bovis subsp bovis AF2122/97
gcacgaacgccugcucgucgg

SEQ ID NO: 1112859 - RNA, 21 nt, Mycobacterium bovis subsp bovis AF2122/97
gcacgaacaucagaucgccga

SEQ ID NO: 1112860 - RNA, 20 nt, Mycobacterium bovis subsp bovis AF2122/97
gcacgaaaccgcagcgcgaa

SEQ ID NO: 1112861 - RNA, 15 nt, Mycobacterium bovis subsp bovis AF2122/97
gcacgaccaccggau

SEQ ID NO: 1112862 - RNA, 21 nt, Mycobacterium bovis subsp bovis AF2122/97
gcacgacaucgucgcgacgac

SEQ ID NO: 1112863 - RNA, 22 nt, Mycobacterium bovis subsp bovis AF2122/97
gcacgacaucgucgcgacgacg

SEQ ID NO: 1112864 - RNA, 20 nt, Mycobacterium bovis subsp bovis AF2122/97
gcacgacccgggaaggaacc

SEQ ID NO: 1112865 - RNA, 16 nt, Mycobacterium bovis subsp bovis AF2122/97
gcacgaaguccuggca

SEQ ID NO: 1112866 - RNA, 15 nt, Mycobacterium bovis subsp bovis AF2122/97
gcacgaaucccccgg

SEQ ID NO: 1112867 - RNA, 23 nt, Mycobacterium bovis subsp bovis AF2122/97
gcaccugcgaugaugugcgacca

SEQ ID NO: 1112868 - RNA, 14 nt, Mycobacterium bovis subsp bovis AF2122/97
gcaccuggccgccc

SEQ ID NO: 1112869 - RNA, 17 nt, Mycobacterium bovis subsp bovis AF2122/97
gcaccuggauccaccag

SEQ ID NO: 1112870 - RNA, 15 nt, Mycobacterium bovis subsp bovis AF2122/97
gcaccugaucgguca

SEQ ID NO: 1112871 - RNA, 20 nt, Mycobacterium bovis subsp bovis AF2122/97
gcaccucgcccucccgggcc

SEQ ID NO: 1112872 - RNA, 17 nt, Mycobacterium bovis subsp bovis AF2122/97
gcaccugcgcgcggccg

SEQ ID NO: 1112873 - RNA, 18 nt, Mycobacterium bovis subsp bovis AF2122/97
gcaccugcgcgcggccgc

SEQ ID NO: 1112874 - RNA, 15 nt, Mycobacterium bovis subsp bovis AF2122/97
gcaccggaucggcua

SEQ ID NO: 1112875 - RNA, 15 nt, Mycobacterium bovis subsp bovis AF2122/97
gcaccgcggccagcg

SEQ ID NO: 1112876 - RNA, 20 nt, Mycobacterium bovis subsp bovis AF2122/97
gcaccgcggccagcgggaac

SEQ ID NO: 1112877 - RNA, 13 nt, Mycobacterium bovis subsp bovis AF2122/97
gcaccgcggccgc

SEQ ID NO: 1112878 - RNA, 18 nt, Mycobacterium bovis subsp bovis AF2122/97
gcaccgcuggcagcgacu

SEQ ID NO: 1112879 - RNA, 21 nt, Mycobacterium bovis subsp bovis AF2122/97
gcaccgcuguugcaucgccgc

SEQ ID NO: 1112880 - RNA, 22 nt, Mycobacterium bovis subsp bovis AF2122/97
gcaccgcuguugcaucgccgcg

SEQ ID NO: 1112881 - RNA, 21 nt, Mycobacterium bovis subsp bovis AF2122/97
gcaccggcaauaccggcaucg

SEQ ID NO: 1112882 - RNA, 19 nt, Mycobacterium bovis subsp bovis AF2122/97
gcaccggcacccgcacggc

SEQ ID NO: 1112883 - RNA, 14 nt, Mycobacterium bovis subsp bovis AF2122/97
gcaccggcaggcgg

SEQ ID NO: 1112884 - RNA, 15 nt, Mycobacterium bovis subsp bovis AF2122/97
gcaccggccgugccg

SEQ ID NO: 1112885 - RNA, 17 nt, Mycobacterium bovis subsp bovis AF2122/97
gcaccggccgugccgcc

SEQ ID NO: 1112886 - RNA, 17 nt, Mycobacterium bovis subsp bovis AF2122/97
gcaccgugacagcggca

SEQ ID NO: 1112887 - RNA, 20 nt, Mycobacterium bovis subsp bovis AF2122/97
gcaccggccgaaggcgcugc

SEQ ID NO: 1112888 - RNA, 16 nt, Mycobacterium bovis subsp bovis AF2122/97
gcaccgugccgacgcc

SEQ ID NO: 1112889 - RNA, 17 nt, Mycobacterium bovis subsp bovis AF2122/97
gcaccgugcggaucgcg

SEQ ID NO: 1112890 - RNA, 22 nt, Mycobacterium bovis subsp bovis AF2122/97
gcaccgugcggaucgcgcugcg

SEQ ID NO: 1112891 - RNA, 13 nt, Mycobacterium bovis subsp bovis AF2122/97
gcaccucgaccgc

SEQ ID NO: 1112892 - RNA, 22 nt, Mycobacterium bovis subsp bovis AF2122/97
gcaccuccugcgagugcggcac

SEQ ID NO: 1112893 - RNA, 18 nt, Mycobacterium bovis subsp bovis AF2122/97
gcaccuccgacggccgcg

SEQ ID NO: 1112894 - RNA, 22 nt, Mycobacterium bovis subsp bovis AF2122/97
gcaccucgaugaugcgcucggc

SEQ ID NO: 1112895 - RNA, 19 nt, Mycobacterium bovis subsp bovis AF2122/97
gcaccucgagcguggcaac

SEQ ID NO: 1112896 - RNA, 21 nt, Mycobacterium bovis subsp bovis AF2122/97
gcaccguuguaugcugcgcgc

SEQ ID NO: 1112897 - RNA, 20 nt, Mycobacterium bovis subsp bovis AF2122/97
gcaccguuuccggcgcuccg

SEQ ID NO: 1112898 - RNA, 14 nt, Mycobacterium bovis subsp bovis AF2122/97
gcaccgugucgacg

SEQ ID NO: 1112899 - RNA, 18 nt, Mycobacterium bovis subsp bovis AF2122/97
gcaccguggcggaucgcg

SEQ ID NO: 1112900 - RNA, 22 nt, Mycobacterium bovis subsp bovis AF2122/97
gcaccgugggcccuucacuguu

SEQ ID NO: 1112901 - RNA, 13 nt, Mycobacterium bovis subsp bovis AF2122/97
gcaccuacccugc

SEQ ID NO: 1112902 - RNA, 17 nt, Mycobacterium bovis subsp bovis AF2122/97
gcaccuagucgcggccg

SEQ ID NO: 1112903 - RNA, 21 nt, Mycobacterium bovis subsp bovis AF2122/97
gcaccuauggucaaccgcgcc

SEQ ID NO: 1112904 - RNA, 16 nt, Mycobacterium bovis subsp bovis AF2122/97
gcaccuccaccgcgcc

SEQ ID NO: 1112905 - RNA, 19 nt, Mycobacterium bovis subsp bovis AF2122/97
gcaccuccaccgcgccggc

SEQ ID NO: 1112906 - RNA, 23 nt, Mycobacterium bovis subsp bovis AF2122/97
gcaccuccacugggucgcugccg

SEQ ID NO: 1112907 - RNA, 20 nt, Mycobacterium bovis subsp bovis AF2122/97
gcaccuccagcaccaccgga

SEQ ID NO: 1112908 - RNA, 15 nt, Mycobacterium bovis subsp bovis AF2122/97
gcacacccgcaccgg

SEQ ID NO: 1112909 - RNA, 17 nt, Mycobacterium bovis subsp bovis AF2122/97
gcacaccgcaccugggc

SEQ ID NO: 1112910 - RNA, 13 nt, Mycobacterium bovis subsp bovis AF2122/97
gcacaccgccagc

SEQ ID NO: 1112911 - RNA, 14 nt, Mycobacterium bovis subsp bovis AF2122/97
gcacaccgccagcg

SEQ ID NO: 1112912 - RNA, 20 nt, Mycobacterium bovis subsp bovis AF2122/97
gcacacccgucaugcccacc

SEQ ID NO: 1112913 - RNA, 22 nt, Mycobacterium bovis subsp bovis AF2122/97
gcacacccgucaugcccaccgc

SEQ ID NO: 1112914 - RNA, 21 nt, Mycobacterium bovis subsp bovis AF2122/97
gcacacccuccacagcggcca

SEQ ID NO: 1112915 - RNA, 18 nt, Mycobacterium bovis subsp bovis AF2122/97
gcacacccaucaccgcca

SEQ ID NO: 1112916 - RNA, 22 nt, Mycobacterium bovis subsp bovis AF2122/97
gcacacccgcaaugaccgcgga

SEQ ID NO: 1112917 - RNA, 14 nt, Mycobacterium bovis subsp bovis AF2122/97
gcacacccgcaccg

SEQ ID NO: 1112918 - RNA, 16 nt, Mycobacterium bovis subsp bovis AF2122/97
gcacacccaucaccgc

SEQ ID NO: 1112919 - RNA, 13 nt, Mycobacterium bovis subsp bovis AF2122/97
gcacccggccacc

SEQ ID NO: 1112920 - RNA, 13 nt, Mycobacterium bovis subsp bovis AF2122/97
gcacccgcugguc

SEQ ID NO: 1112921 - RNA, 16 nt, Mycobacterium bovis subsp bovis AF2122/97
gcacccgcuggucgag

SEQ ID NO: 1112922 - RNA, 19 nt, Mycobacterium bovis subsp bovis AF2122/97
gcacaccgggcaccagucg

SEQ ID NO: 1112923 - RNA, 14 nt, Mycobacterium bovis subsp bovis AF2122/97
gcacccgcucgucg

SEQ ID NO: 1112924 - RNA, 13 nt, Mycobacterium bovis subsp bovis AF2122/97
gcacaccggcacu

SEQ ID NO: 1112925 - RNA, 16 nt, Mycobacterium bovis subsp bovis AF2122/97
gcacaccgucgcaccc

SEQ ID NO: 1112926 - RNA, 20 nt, Mycobacterium bovis subsp bovis AF2122/97
gcacccgcucggcgcgcggg

SEQ ID NO: 1112927 - RNA, 12 nt, Mycobacterium bovis subsp bovis AF2122/97
gcacccgcucgu

SEQ ID NO: 1112928 - RNA, 12 nt, Mycobacterium bovis subsp bovis AF2122/97
gcacaccggugg

SEQ ID NO: 1112929 - RNA, 13 nt, Mycobacterium bovis subsp bovis AF2122/97
gcacaccggugga

SEQ ID NO: 1112930 - RNA, 21 nt, Mycobacterium bovis subsp bovis AF2122/97
gcacaccgguggacccggcgg

SEQ ID NO: 1112931 - RNA, 18 nt, Mycobacterium bovis subsp bovis AF2122/97
gcacaccgucgacgacau

SEQ ID NO: 1112932 - RNA, 12 nt, Mycobacterium bovis subsp bovis AF2122/97
gcacaccgucgc

SEQ ID NO: 1112933 - RNA, 17 nt, Mycobacterium bovis subsp bovis AF2122/97
gcacccggggggccucg

SEQ ID NO: 1112934 - RNA, 20 nt, Mycobacterium bovis subsp bovis AF2122/97
gcacccggggggccucguug

SEQ ID NO: 1112935 - RNA, 18 nt, Mycobacterium bovis subsp bovis AF2122/97
gcacccgggccugggacg

SEQ ID NO: 1112936 - RNA, 16 nt, Mycobacterium bovis subsp bovis AF2122/97
gcacccggccaccgga

SEQ ID NO: 1112937 - RNA, 18 nt, Mycobacterium bovis subsp bovis AF2122/97
gcacccggcuucgccgcg

SEQ ID NO: 1112938 - RNA, 22 nt, Mycobacterium bovis subsp bovis AF2122/97
gcacccgggccacgucgagcac

SEQ ID NO: 1112939 - RNA, 22 nt, Mycobacterium bovis subsp bovis AF2122/97
gcacccggcuguucucgccgaa

SEQ ID NO: 1112940 - RNA, 13 nt, Mycobacterium bovis subsp bovis AF2122/97
gcacccggcuucg

SEQ ID NO: 1112941 - RNA, 21 nt, Mycobacterium bovis subsp bovis AF2122/97
gcacccggcuguucucgccga

SEQ ID NO: 1112942 - RNA, 18 nt, Mycobacterium bovis subsp bovis AF2122/97
gcacccgguugugcgcgc

SEQ ID NO: 1112943 - RNA, 21 nt, Mycobacterium bovis subsp bovis AF2122/97
gcacccggucggccauccacc

SEQ ID NO: 1112944 - RNA, 22 nt, Mycobacterium bovis subsp bovis AF2122/97
gcacccggucggccauccaccg

SEQ ID NO: 1112945 - RNA, 17 nt, Mycobacterium bovis subsp bovis AF2122/97
gcacccggucggcggca

SEQ ID NO: 1112946 - RNA, 14 nt, Mycobacterium bovis subsp bovis AF2122/97
gcacccggucggcc

SEQ ID NO: 1112947 - RNA, 21 nt, Mycobacterium bovis subsp bovis AF2122/97
gcacccguucgugagcggcca

SEQ ID NO: 1112948 - RNA, 17 nt, Mycobacterium bovis subsp bovis AF2122/97
gcacccguugcgacacc

SEQ ID NO: 1112949 - RNA, 14 nt, Mycobacterium bovis subsp bovis AF2122/97
gcacccguccgccg

SEQ ID NO: 1112950 - RNA, 13 nt, Mycobacterium bovis subsp bovis AF2122/97
gcacccguccggc

SEQ ID NO: 1112951 - RNA, 12 nt, Mycobacterium bovis subsp bovis AF2122/97
gcacccgucggg

SEQ ID NO: 1112952 - RNA, 19 nt, Mycobacterium bovis subsp bovis AF2122/97
gcaccgcgaaagaacaucu

SEQ ID NO: 1112953 - RNA, 13 nt, Mycobacterium bovis subsp bovis AF2122/97
gcaccgccggugc

SEQ ID NO: 1112954 - RNA, 13 nt, Mycobacterium bovis subsp bovis AF2122/97
gcaccgccugcgc

SEQ ID NO: 1112955 - RNA, 15 nt, Mycobacterium bovis subsp bovis AF2122/97
gcaccgcgccgugga

SEQ ID NO: 1112956 - RNA, 15 nt, Mycobacterium bovis subsp bovis AF2122/97
gcaccgcgccgcgcc

SEQ ID NO: 1112957 - RNA, 19 nt, Mycobacterium bovis subsp bovis AF2122/97
gcaccgcggauaggccgcg

SEQ ID NO: 1112958 - RNA, 20 nt, Mycobacterium bovis subsp bovis AF2122/97
gcaccgcggauaggccgcgc

SEQ ID NO: 1112959 - RNA, 14 nt, Mycobacterium bovis subsp bovis AF2122/97
gcaccgcgcgcucc

SEQ ID NO: 1112960 - RNA, 13 nt, Mycobacterium bovis subsp bovis AF2122/97
gcaccgcgccgaa

SEQ ID NO: 1112961 - RNA, 15 nt, Mycobacterium bovis subsp bovis AF2122/97
gcaccgcgccgaaca

SEQ ID NO: 1112962 - RNA, 21 nt, Mycobacterium bovis subsp bovis AF2122/97
gcaccgccugcgccgcccgcg

SEQ ID NO: 1112963 - RNA, 20 nt, Mycobacterium bovis subsp bovis AF2122/97
gcaccgccugcucggcgacc

SEQ ID NO: 1112964 - RNA, 21 nt, Mycobacterium bovis subsp bovis AF2122/97
gcaccgcgcccaccagcggcg

SEQ ID NO: 1112965 - RNA, 19 nt, Mycobacterium bovis subsp bovis AF2122/97
gcaccgccggcaccgccgg

SEQ ID NO: 1112966 - RNA, 15 nt, Mycobacterium bovis subsp bovis AF2122/97
gcaccgccggccuug

SEQ ID NO: 1112967 - RNA, 14 nt, Mycobacterium bovis subsp bovis AF2122/97
gcaccgccggcgac

SEQ ID NO: 1112968 - RNA, 16 nt, Mycobacterium bovis subsp bovis AF2122/97
gcaccgccggcgccac

SEQ ID NO: 1112969 - RNA, 18 nt, Mycobacterium bovis subsp bovis AF2122/97
gcaccgccggcgccaccg

SEQ ID NO: 1112970 - RNA, 13 nt, Mycobacterium bovis subsp bovis AF2122/97
gcaccgccggcaa

SEQ ID NO: 1112971 - RNA, 15 nt, Mycobacterium bovis subsp bovis AF2122/97
gcaccgaugcugacg

SEQ ID NO: 1112972 - RNA, 18 nt, Mycobacterium bovis subsp bovis AF2122/97
gcaccgaugcugacgaug

SEQ ID NO: 1112973 - RNA, 17 nt, Mycobacterium bovis subsp bovis AF2122/97
gcaccgcagcgaccacc

SEQ ID NO: 1112974 - RNA, 22 nt, Mycobacterium bovis subsp bovis AF2122/97
gcaccgcauaacgcgaacccgc

SEQ ID NO: 1112975 - RNA, 23 nt, Mycobacterium bovis subsp bovis AF2122/97
gcaccgcauaacgcgaacccgcg

SEQ ID NO: 1112976 - RNA, 17 nt, Mycobacterium bovis subsp bovis AF2122/97
gcaccgauggcgcaccg

SEQ ID NO: 1112977 - RNA, 18 nt, Mycobacterium bovis subsp bovis AF2122/97
gcaccgauuuuggcaagc

SEQ ID NO: 1112978 - RNA, 19 nt, Mycobacterium bovis subsp bovis AF2122/97
gcacccucaggcaaucgcg

SEQ ID NO: 1112979 - RNA, 15 nt, Mycobacterium bovis subsp bovis AF2122/97
gcaccgauccuggac

SEQ ID NO: 1112980 - RNA, 16 nt, Mycobacterium bovis subsp bovis AF2122/97
gcaccgaucggugccg

SEQ ID NO: 1112981 - RNA, 21 nt, Mycobacterium bovis subsp bovis AF2122/97
gcaccgaucggugccggccug

SEQ ID NO: 1112982 - RNA, 15 nt, Mycobacterium bovis subsp bovis AF2122/97
gcaccgaugccgaag

SEQ ID NO: 1112983 - RNA, 22 nt, Mycobacterium bovis subsp bovis AF2122/97
gcaccgaugccgaagcccccga

SEQ ID NO: 1112984 - RNA, 22 nt, Mycobacterium bovis subsp bovis AF2122/97
gcaccgaugccuugaccgcggu

SEQ ID NO: 1112985 - RNA, 17 nt, Mycobacterium bovis subsp bovis AF2122/97
gcagacgaaguagccga

SEQ ID NO: 1112986 - RNA, 15 nt, Mycobacterium bovis subsp bovis AF2122/97
gcagaccuguccggc

SEQ ID NO: 1112987 - RNA, 20 nt, Mycobacterium bovis subsp bovis AF2122/97
gcagacgcaaaagcccccua

SEQ ID NO: 1112988 - RNA, 21 nt, Mycobacterium bovis subsp bovis AF2122/97
gcagacgcaaaagcccccuaa

SEQ ID NO: 1112989 - RNA, 18 nt, Mycobacterium bovis subsp bovis AF2122/97
gcagacgcaaaauccccu

SEQ ID NO: 1112990 - RNA, 20 nt, Mycobacterium bovis subsp bovis AF2122/97
gcagacgcaaaaucgcccaa

SEQ ID NO: 1112991 - RNA, 20 nt, Mycobacterium bovis subsp bovis AF2122/97
gcagacgcagaagcccccaa

SEQ ID NO: 1112992 - RNA, 19 nt, Mycobacterium bovis subsp bovis AF2122/97
gcagacgcagaaucgcacg

SEQ ID NO: 1112993 - RNA, 20 nt, Mycobacterium bovis subsp bovis AF2122/97
gcagacgcagaaucgcacgc

SEQ ID NO: 1112994 - RNA, 20 nt, Mycobacterium bovis subsp bovis AF2122/97
gcagacgcagaaucgcauga

SEQ ID NO: 1112995 - RNA, 20 nt, Mycobacterium bovis subsp bovis AF2122/97
gcagacgcagaaucgcauug

SEQ ID NO: 1112996 - RNA, 20 nt, Mycobacterium bovis subsp bovis AF2122/97
gcagacgcagaaucgcccaa

SEQ ID NO: 1112997 - RNA, 18 nt, Mycobacterium bovis subsp bovis AF2122/97
gcagacgcagaaucgccu

SEQ ID NO: 1112998 - RNA, 20 nt, Mycobacterium bovis subsp bovis AF2122/97
gcagacgcagagucgcacug

SEQ ID NO: 1112999 - RNA, 21 nt, Mycobacterium bovis subsp bovis AF2122/97
gcagacgcagccacgucucgc

SEQ ID NO: 1113000 - RNA, 19 nt, Mycobacterium bovis subsp bovis AF2122/97
gcagacguaaaagccccca

SEQ ID NO: 1113001 - RNA, 19 nt, Mycobacterium bovis subsp bovis AF2122/97
gcagacgguccgcuacggc

SEQ ID NO: 1113002 - RNA, 19 nt, Mycobacterium bovis subsp bovis AF2122/97
gcagacgcgaaaucccccg

SEQ ID NO: 1113003 - RNA, 20 nt, Mycobacterium bovis subsp bovis AF2122/97
gcagacgcgaaaucccccga

SEQ ID NO: 1113004 - RNA, 20 nt, Mycobacterium bovis subsp bovis AF2122/97
gcagacgcggaaucgcaccg

SEQ ID NO: 1113005 - RNA, 20 nt, Mycobacterium bovis subsp bovis AF2122/97
gcagacgcggaaucgcaucg

SEQ ID NO: 1113006 - RNA, 21 nt, Mycobacterium bovis subsp bovis AF2122/97
gcagacgcguuucgucgaccg

SEQ ID NO: 1113007 - RNA, 14 nt, Mycobacterium bovis subsp bovis AF2122/97
gcagacgccguagc

SEQ ID NO: 1113008 - RNA, 17 nt, Mycobacterium bovis subsp bovis AF2122/97
gcagacgccguagccgg

SEQ ID NO: 1113009 - RNA, 20 nt, Mycobacterium bovis subsp bovis AF2122/97
gcagacgccguagccggccg

SEQ ID NO: 1113010 - RNA, 21 nt, Mycobacterium bovis subsp bovis AF2122/97
gcagaccgguuucuucggcca

SEQ ID NO: 1113011 - RNA, 18 nt, Mycobacterium bovis subsp bovis AF2122/97
gcagaccggugagcaccg

SEQ ID NO: 1113012 - RNA, 13 nt, Mycobacterium bovis subsp bovis AF2122/97
gcagaccaccgcc

SEQ ID NO: 1113013 - RNA, 15 nt, Mycobacterium bovis subsp bovis AF2122/97
gcagaccgaucggca

SEQ ID NO: 1113014 - RNA, 17 nt, Mycobacterium bovis subsp bovis AF2122/97
gcagaccgaucggcagg

SEQ ID NO: 1113015 - RNA, 14 nt, Mycobacterium bovis subsp bovis AF2122/97
gcagaccgccaccg

SEQ ID NO: 1113016 - RNA, 18 nt, Mycobacterium bovis subsp bovis AF2122/97
gcagaccacaacgccucg

SEQ ID NO: 1113017 - RNA, 22 nt, Mycobacterium bovis subsp bovis AF2122/97
gcagaccacaacgccucgccau

SEQ ID NO: 1113018 - RNA, 23 nt, Mycobacterium bovis subsp bovis AF2122/97
gcagacccguucgccgucgguga

SEQ ID NO: 1113019 - RNA, 12 nt, Mycobacterium bovis subsp bovis AF2122/97
gcagacccgugc

SEQ ID NO: 1113020 - RNA, 15 nt, Mycobacterium bovis subsp bovis AF2122/97
gcagaccaaguccgg

SEQ ID NO: 1113021 - RNA, 13 nt, Mycobacterium bovis subsp bovis AF2122/97
gcagacaggcggc

SEQ ID NO: 1113022 - RNA, 16 nt, Mycobacterium bovis subsp bovis AF2122/97
gcagacaggcggcggc

SEQ ID NO: 1113023 - RNA, 19 nt, Mycobacterium bovis subsp bovis AF2122/97
gcagacacagaaucgcacg

SEQ ID NO: 1113024 - RNA, 20 nt, Mycobacterium bovis subsp bovis AF2122/97
gcagacacagaaucgcacga

SEQ ID NO: 1113025 - RNA, 20 nt, Mycobacterium bovis subsp bovis AF2122/97
gcagacacagaaucgcccau

SEQ ID NO: 1113026 - RNA, 22 nt, Mycobacterium bovis subsp bovis AF2122/97
gcagaauguucuccacgagguu

SEQ ID NO: 1113027 - RNA, 13 nt, Mycobacterium bovis subsp bovis AF2122/97
gcagaaucgccua

SEQ ID NO: 1113028 - RNA, 17 nt, Mycobacterium bovis subsp bovis AF2122/97
gcagacacgagucgcca

SEQ ID NO: 1113029 - RNA, 22 nt, Mycobacterium bovis subsp bovis AF2122/97
gcagacacgcugcaggcggccg

SEQ ID NO: 1113030 - RNA, 20 nt, Mycobacterium bovis subsp bovis AF2122/97
gcagacacugcugcggcagc

SEQ ID NO: 1113031 - RNA, 22 nt, Mycobacterium bovis subsp bovis AF2122/97
gcagacacugcugcggcagcgc

SEQ ID NO: 1113032 - RNA, 19 nt, Mycobacterium bovis subsp bovis AF2122/97
gcagaaguccucggcggac

SEQ ID NO: 1113033 - RNA, 20 nt, Mycobacterium bovis subsp bovis AF2122/97
gcagaauccggcaaccaccg

SEQ ID NO: 1113034 - RNA, 23 nt, Mycobacterium bovis subsp bovis AF2122/97
gcagaauccggcaaccaccggcc

SEQ ID NO: 1113035 - RNA, 14 nt, Mycobacterium bovis subsp bovis AF2122/97
gcagaaucgcacgc

SEQ ID NO: 1113036 - RNA, 15 nt, Mycobacterium bovis subsp bovis AF2122/97
gcagaaucgcacgcg

SEQ ID NO: 1113037 - RNA, 12 nt, Mycobacterium bovis subsp bovis AF2122/97
gcagaaucgccu

SEQ ID NO: 1113038 - RNA, 20 nt, Mycobacterium bovis subsp bovis AF2122/97
gcagaaggccagcgaaucgc

SEQ ID NO: 1113039 - RNA, 20 nt, Mycobacterium bovis subsp bovis AF2122/97
gcagaagcccccaaaccggc

SEQ ID NO: 1113040 - RNA, 15 nt, Mycobacterium bovis subsp bovis AF2122/97
gcagaagaguguccc

SEQ ID NO: 1113041 - RNA, 14 nt, Mycobacterium bovis subsp bovis AF2122/97
gcagaacgaucgcg

SEQ ID NO: 1113042 - RNA, 18 nt, Mycobacterium bovis subsp bovis AF2122/97
gcagaacaguaucgccgg

SEQ ID NO: 1113043 - RNA, 16 nt, Mycobacterium bovis subsp bovis AF2122/97
gcagaaaccauucggc

SEQ ID NO: 1113044 - RNA, 17 nt, Mycobacterium bovis subsp bovis AF2122/97
gcagaaagucgcgcgcg

SEQ ID NO: 1113045 - RNA, 20 nt, Mycobacterium bovis subsp bovis AF2122/97
gcagaaacaacgucgccgcg

SEQ ID NO: 1113046 - RNA, 22 nt, Mycobacterium bovis subsp bovis AF2122/97
gcagaaacaacgucgccgcggc

SEQ ID NO: 1113047 - RNA, 19 nt, Mycobacterium bovis subsp bovis AF2122/97
gcagaaacagccgcagcgg

SEQ ID NO: 1113048 - RNA, 13 nt, Mycobacterium bovis subsp bovis AF2122/97
gcagaaaacccuc

SEQ ID NO: 1113049 - RNA, 18 nt, Mycobacterium bovis subsp bovis AF2122/97
gcagaaaacccucgcugc

SEQ ID NO: 1113050 - RNA, 16 nt, Mycobacterium bovis subsp bovis AF2122/97
gcacuuuugcguggug

SEQ ID NO: 1113051 - RNA, 20 nt, Mycobacterium bovis subsp bovis AF2122/97
gcacuuuugcgugguggacg

SEQ ID NO: 1113052 - RNA, 22 nt, Mycobacterium bovis subsp bovis AF2122/97
gcacuugaaauugagccggccc

SEQ ID NO: 1113053 - RNA, 17 nt, Mycobacterium bovis subsp bovis AF2122/97
gcacuugauguucgacg

SEQ ID NO: 1113054 - RNA, 23 nt, Mycobacterium bovis subsp bovis AF2122/97
gcacuugauguucgacgggccgg

SEQ ID NO: 1113055 - RNA, 19 nt, Mycobacterium bovis subsp bovis AF2122/97
gcacuugcccgucggcgcc

SEQ ID NO: 1113056 - RNA, 20 nt, Mycobacterium bovis subsp bovis AF2122/97
gcacuugcguggcguuggug

SEQ ID NO: 1113057 - RNA, 22 nt, Mycobacterium bovis subsp bovis AF2122/97
gcacuuggacccggccggcccg

SEQ ID NO: 1113058 - RNA, 23 nt, Mycobacterium bovis subsp bovis AF2122/97
gcacuuggcugcgagagcaccga

SEQ ID NO: 1113059 - RNA, 13 nt, Mycobacterium bovis subsp bovis AF2122/97
gcagcaagccgcc

SEQ ID NO: 1113060 - RNA, 14 nt, Mycobacterium bovis subsp bovis AF2122/97
gcagcaagaccgcg

SEQ ID NO: 1113061 - RNA, 17 nt, Mycobacterium bovis subsp bovis AF2122/97
gcagcaagccgccggug

SEQ ID NO: 1113062 - RNA, 15 nt, Mycobacterium bovis subsp bovis AF2122/97
gcagcacgaccuggu

SEQ ID NO: 1113063 - RNA, 19 nt, Mycobacterium bovis subsp bovis AF2122/97
gcagcacgacgugcgucgg

SEQ ID NO: 1113064 - RNA, 15 nt, Mycobacterium bovis subsp bovis AF2122/97
gcagcaccucggucc

SEQ ID NO: 1113065 - RNA, 15 nt, Mycobacterium bovis subsp bovis AF2122/97
gcagcaccucgucga

SEQ ID NO: 1113066 - RNA, 14 nt, Mycobacterium bovis subsp bovis AF2122/97
gcagcaccugcacc

SEQ ID NO: 1113067 - RNA, 15 nt, Mycobacterium bovis subsp bovis AF2122/97
gcagcaccugcaccg

SEQ ID NO: 1113068 - RNA, 14 nt, Mycobacterium bovis subsp bovis AF2122/97
gcagcacggcgccg

SEQ ID NO: 1113069 - RNA, 13 nt, Mycobacterium bovis subsp bovis AF2122/97
gcagcacggcggc

SEQ ID NO: 1113070 - RNA, 14 nt, Mycobacterium bovis subsp bovis AF2122/97
gcagcagcgggcgc

SEQ ID NO: 1113071 - RNA, 17 nt, Mycobacterium bovis subsp bovis AF2122/97
gcagcagcgggcuggcg

SEQ ID NO: 1113072 - RNA, 19 nt, Mycobacterium bovis subsp bovis AF2122/97
gcagcagcgggcuggcgaa

SEQ ID NO: 1113073 - RNA, 14 nt, Mycobacterium bovis subsp bovis AF2122/97
gcagcagcggcggc

SEQ ID NO: 1113074 - RNA, 15 nt, Mycobacterium bovis subsp bovis AF2122/97
gcagcagcggcggcg

SEQ ID NO: 1113075 - RNA, 19 nt, Mycobacterium bovis subsp bovis AF2122/97
gcagcagcggugcagcccg

SEQ ID NO: 1113076 - RNA, 16 nt, Mycobacterium bovis subsp bovis AF2122/97
gcagcagcgcuucggc

SEQ ID NO: 1113077 - RNA, 15 nt, Mycobacterium bovis subsp bovis AF2122/97
gcagcagcgcgcgga

SEQ ID NO: 1113078 - RNA, 23 nt, Mycobacterium bovis subsp bovis AF2122/97
gcagcagcgccgcguggcuggcg

SEQ ID NO: 1113079 - RNA, 14 nt, Mycobacterium bovis subsp bovis AF2122/97
gcagcagcgccgcg

SEQ ID NO: 1113080 - RNA, 15 nt, Mycobacterium bovis subsp bovis AF2122/97
gcagcagcgccgcgu

SEQ ID NO: 1113081 - RNA, 13 nt, Mycobacterium bovis subsp bovis AF2122/97
gcagcagcccgac

SEQ ID NO: 1113082 - RNA, 17 nt, Mycobacterium bovis subsp bovis AF2122/97
gcagcagccggcgggcc

SEQ ID NO: 1113083 - RNA, 13 nt, Mycobacterium bovis subsp bovis AF2122/97
gcagcagcaucgg

SEQ ID NO: 1113084 - RNA, 15 nt, Mycobacterium bovis subsp bovis AF2122/97
gcagacgugguagcc

SEQ ID NO: 1113085 - RNA, 20 nt, Mycobacterium bovis subsp bovis AF2122/97
gcagacgugguagccggcga

SEQ ID NO: 1113086 - RNA, 16 nt, Mycobacterium bovis subsp bovis AF2122/97
gcagacucgccaccgc

SEQ ID NO: 1113087 - RNA, 14 nt, Mycobacterium bovis subsp bovis AF2122/97
gcagacucggcgau

SEQ ID NO: 1113088 - RNA, 18 nt, Mycobacterium bovis subsp bovis AF2122/97
gcagagaccaagguccgc

SEQ ID NO: 1113089 - RNA, 12 nt, Mycobacterium bovis subsp bovis AF2122/97
gcagacugccga

SEQ ID NO: 1113090 - RNA, 23 nt, Mycobacterium bovis subsp bovis AF2122/97
gcagauggcauugcgcccaccga

SEQ ID NO: 1113091 - RNA, 20 nt, Mycobacterium bovis subsp bovis AF2122/97
gcagauggcgaggucgguga

SEQ ID NO: 1113092 - RNA, 20 nt, Mycobacterium bovis subsp bovis AF2122/97
gcagagcacgcgcggcgucg

SEQ ID NO: 1113093 - RNA, 19 nt, Mycobacterium bovis subsp bovis AF2122/97
gcagcaacugggcggccug

SEQ ID NO: 1113094 - RNA, 20 nt, Mycobacterium bovis subsp bovis AF2122/97
gcagcaacggcggcgucgcg

SEQ ID NO: 1113095 - RNA, 21 nt, Mycobacterium bovis subsp bovis AF2122/97
gcagcaacggcggcgucgcgg

SEQ ID NO: 1113096 - RNA, 15 nt, Mycobacterium bovis subsp bovis AF2122/97
gcagcaacgcggugc

SEQ ID NO: 1113097 - RNA, 14 nt, Mycobacterium bovis subsp bovis AF2122/97
gcagcaacgacccg

SEQ ID NO: 1113098 - RNA, 12 nt, Mycobacterium bovis subsp bovis AF2122/97
gcagcaacggcg

SEQ ID NO: 1113099 - RNA, 17 nt, Mycobacterium bovis subsp bovis AF2122/97
gcagauucuucacccaa

SEQ ID NO: 1113100 - RNA, 16 nt, Mycobacterium bovis subsp bovis AF2122/97
gcagauuggcggcuuc

SEQ ID NO: 1113101 - RNA, 17 nt, Mycobacterium bovis subsp bovis AF2122/97
gcagauuccucuucagg

SEQ ID NO: 1113102 - RNA, 14 nt, Mycobacterium bovis subsp bovis AF2122/97
gcagaugggcgucg

SEQ ID NO: 1113103 - RNA, 18 nt, Mycobacterium bovis subsp bovis AF2122/97
gcagcaaaacccgagccu

SEQ ID NO: 1113104 - RNA, 19 nt, Mycobacterium bovis subsp bovis AF2122/97
gcagcaacaccucgucacc

SEQ ID NO: 1113105 - RNA, 15 nt, Mycobacterium bovis subsp bovis AF2122/97
gcagcgggacaucca

SEQ ID NO: 1113106 - RNA, 19 nt, Mycobacterium bovis subsp bovis AF2122/97
gcagcgggacugcggaagc

SEQ ID NO: 1113107 - RNA, 18 nt, Mycobacterium bovis subsp bovis AF2122/97
gcagcggcuaacgaagcc

SEQ ID NO: 1113108 - RNA, 22 nt, Mycobacterium bovis subsp bovis AF2122/97
gcagcgggaucaugaccaucga

SEQ ID NO: 1113109 - RNA, 12 nt, Mycobacterium bovis subsp bovis AF2122/97
gcagcggcgucg

SEQ ID NO: 1113110 - RNA, 20 nt, Mycobacterium bovis subsp bovis AF2122/97
gcagcggcucuauccggcgc

SEQ ID NO: 1113111 - RNA, 23 nt, Mycobacterium bovis subsp bovis AF2122/97
gcagcggcggaaggacggcagcc

SEQ ID NO: 1113112 - RNA, 21 nt, Mycobacterium bovis subsp bovis AF2122/97
gcagcggcggaaggacggcag

SEQ ID NO: 1113113 - RNA, 13 nt, Mycobacterium bovis subsp bovis AF2122/97
gcagcggcgcgcu

SEQ ID NO: 1113114 - RNA, 14 nt, Mycobacterium bovis subsp bovis AF2122/97
gcagcggcgcucgg

SEQ ID NO: 1113115 - RNA, 14 nt, Mycobacterium bovis subsp bovis AF2122/97
gcagcgcggccagu

SEQ ID NO: 1113116 - RNA, 12 nt, Mycobacterium bovis subsp bovis AF2122/97
gcagcgcggccg

SEQ ID NO: 1113117 - RNA, 21 nt, Mycobacterium bovis subsp bovis AF2122/97
gcagcgcgguggucagcaccg

SEQ ID NO: 1113118 - RNA, 14 nt, Mycobacterium bovis subsp bovis AF2122/97
gcagcgcgucgccg

SEQ ID NO: 1113119 - RNA, 20 nt, Mycobacterium bovis subsp bovis AF2122/97
gcagcgcucguuccggcggu

SEQ ID NO: 1113120 - RNA, 14 nt, Mycobacterium bovis subsp bovis AF2122/97
gcagcggccuccgg

SEQ ID NO: 1113121 - RNA, 20 nt, Mycobacterium bovis subsp bovis AF2122/97
gcagcggccugaccggcucg

SEQ ID NO: 1113122 - RNA, 15 nt, Mycobacterium bovis subsp bovis AF2122/97
gcagcgcucguuccg

SEQ ID NO: 1113123 - RNA, 13 nt, Mycobacterium bovis subsp bovis AF2122/97
gcagcgcgucgcc

SEQ ID NO: 1113124 - RNA, 14 nt, Mycobacterium bovis subsp bovis AF2122/97
gcagcggcgccgcc

SEQ ID NO: 1113125 - RNA, 23 nt, Mycobacterium bovis subsp bovis AF2122/97
gcagcggcgcauaggcggccauc

SEQ ID NO: 1113126 - RNA, 11 nt, Mycobacterium bovis subsp bovis AF2122/97
gcagcggcgau

SEQ ID NO: 1113127 - RNA, 17 nt, Mycobacterium bovis subsp bovis AF2122/97
gcagcggcgaccgcggu

SEQ ID NO: 1113128 - RNA, 20 nt, Mycobacterium bovis subsp bovis AF2122/97
gcagcggcgaccgcggucgc

SEQ ID NO: 1113129 - RNA, 13 nt, Mycobacterium bovis subsp bovis AF2122/97
gcagcgccacccg

SEQ ID NO: 1113130 - RNA, 14 nt, Mycobacterium bovis subsp bovis AF2122/97
gcagcgccacccga

SEQ ID NO: 1113131 - RNA, 21 nt, Mycobacterium bovis subsp bovis AF2122/97
gcagcgccacccgcgucaguc

SEQ ID NO: 1113132 - RNA, 22 nt, Mycobacterium bovis subsp bovis AF2122/97
gcagcgcaggauucugcugacc

SEQ ID NO: 1113133 - RNA, 15 nt, Mycobacterium bovis subsp bovis AF2122/97
gcagcgcgaggcucg

SEQ ID NO: 1113134 - RNA, 14 nt, Mycobacterium bovis subsp bovis AF2122/97
gcagcgccugcggc

SEQ ID NO: 1113135 - RNA, 19 nt, Mycobacterium bovis subsp bovis AF2122/97
gcagcgcgaaggucagcga

SEQ ID NO: 1113136 - RNA, 19 nt, Mycobacterium bovis subsp bovis AF2122/97
gcagcgcgacaaaguucga

SEQ ID NO: 1113137 - RNA, 14 nt, Mycobacterium bovis subsp bovis AF2122/97
gcagcgcgaucgcg

SEQ ID NO: 1113138 - RNA, 18 nt, Mycobacterium bovis subsp bovis AF2122/97
gcagcgcgaucgcgguca

SEQ ID NO: 1113139 - RNA, 22 nt, Mycobacterium bovis subsp bovis AF2122/97
gcagcgcggccacccgcgacga

SEQ ID NO: 1113140 - RNA, 13 nt, Mycobacterium bovis subsp bovis AF2122/97
gcagcgcgaucgc

SEQ ID NO: 1113141 - RNA, 14 nt, Mycobacterium bovis subsp bovis AF2122/97
gcagcgcggccaga

SEQ ID NO: 1113142 - RNA, 18 nt, Mycobacterium bovis subsp bovis AF2122/97
gcagcgaagaccagcggc

SEQ ID NO: 1113143 - RNA, 20 nt, Mycobacterium bovis subsp bovis AF2122/97
gcagcgaagaccagcggcgg

SEQ ID NO: 1113144 - RNA, 20 nt, Mycobacterium bovis subsp bovis AF2122/97
gcagcgaaaaccgucgcaga

SEQ ID NO: 1113145 - RNA, 21 nt, Mycobacterium bovis subsp bovis AF2122/97
gcagcgaaacaccggccagcg

SEQ ID NO: 1113146 - RNA, 16 nt, Mycobacterium bovis subsp bovis AF2122/97
gcagcgaaacgagccg

SEQ ID NO: 1113147 - RNA, 18 nt, Mycobacterium bovis subsp bovis AF2122/97
gcagcgaaacgagccggu

SEQ ID NO: 1113148 - RNA, 20 nt, Mycobacterium bovis subsp bovis AF2122/97
gcagcgaaacgagccggugc

SEQ ID NO: 1113149 - RNA, 17 nt, Mycobacterium bovis subsp bovis AF2122/97
gcagcgacacguuggcg

SEQ ID NO: 1113150 - RNA, 21 nt, Mycobacterium bovis subsp bovis AF2122/97
gcagcgacacguuggcggaug

SEQ ID NO: 1113151 - RNA, 15 nt, Mycobacterium bovis subsp bovis AF2122/97
gcagcgacgcugccg

SEQ ID NO: 1113152 - RNA, 19 nt, Mycobacterium bovis subsp bovis AF2122/97
gcagcgaucuugguggccu

SEQ ID NO: 1113153 - RNA, 14 nt, Mycobacterium bovis subsp bovis AF2122/97
gcagcgaccgucgu

SEQ ID NO: 1113154 - RNA, 14 nt, Mycobacterium bovis subsp bovis AF2122/97
gcagcgacgccggc

SEQ ID NO: 1113155 - RNA, 15 nt, Mycobacterium bovis subsp bovis AF2122/97
gcagcgaugacgacc

SEQ ID NO: 1113156 - RNA, 14 nt, Mycobacterium bovis subsp bovis AF2122/97
gcagcgcaaccacg

SEQ ID NO: 1113157 - RNA, 14 nt, Mycobacterium bovis subsp bovis AF2122/97
gcagcgcacgcagc

SEQ ID NO: 1113158 - RNA, 14 nt, Mycobacterium bovis subsp bovis AF2122/97
gcagcgcaccaacu

SEQ ID NO: 1113159 - RNA, 20 nt, Mycobacterium bovis subsp bovis AF2122/97
gcagcgcaccaacucucgcg

SEQ ID NO: 1113160 - RNA, 17 nt, Mycobacterium bovis subsp bovis AF2122/97
gcagcgaugacgaccaa

SEQ ID NO: 1113161 - RNA, 14 nt, Mycobacterium bovis subsp bovis AF2122/97
gcagccgcgccgcg

SEQ ID NO: 1113162 - RNA, 23 nt, Mycobacterium bovis subsp bovis AF2122/97
gcagccgcgcggugauggucacc

SEQ ID NO: 1113163 - RNA, 13 nt, Mycobacterium bovis subsp bovis AF2122/97
gcagccgcgcggu

SEQ ID NO: 1113164 - RNA, 14 nt, Mycobacterium bovis subsp bovis AF2122/97
gcagccgcaggcca

SEQ ID NO: 1113165 - RNA, 13 nt, Mycobacterium bovis subsp bovis AF2122/97
gcagccgcgacgc

SEQ ID NO: 1113166 - RNA, 13 nt, Mycobacterium bovis subsp bovis AF2122/97
gcagccgccgcgc

SEQ ID NO: 1113167 - RNA, 11 nt, Mycobacterium bovis subsp bovis AF2122/97
gcagccgccgg

SEQ ID NO: 1113168 - RNA, 15 nt, Mycobacterium bovis subsp bovis AF2122/97
gcagccgccgcgccc

SEQ ID NO: 1113169 - RNA, 17 nt, Mycobacterium bovis subsp bovis AF2122/97
gcagccgccgcgccccg

SEQ ID NO: 1113170 - RNA, 13 nt, Mycobacterium bovis subsp bovis AF2122/97
gcagccgcccgcc

SEQ ID NO: 1113171 - RNA, 20 nt, Mycobacterium bovis subsp bovis AF2122/97
gcagccgcccgcccaccucg

SEQ ID NO: 1113172 - RNA, 21 nt, Mycobacterium bovis subsp bovis AF2122/97
gcagccgcccgcccaccucga

SEQ ID NO: 1113173 - RNA, 17 nt, Mycobacterium bovis subsp bovis AF2122/97
gcagccgggcggcagcg

SEQ ID NO: 1113174 - RNA, 22 nt, Mycobacterium bovis subsp bovis AF2122/97
gcagccggcggagaaggcgacc

SEQ ID NO: 1113175 - RNA, 12 nt, Mycobacterium bovis subsp bovis AF2122/97
gcagccgggcac

SEQ ID NO: 1113176 - RNA, 14 nt, Mycobacterium bovis subsp bovis AF2122/97
gcagccgggcacca

SEQ ID NO: 1113177 - RNA, 16 nt, Mycobacterium bovis subsp bovis AF2122/97
gcagccgggcaccacc

SEQ ID NO: 1113178 - RNA, 18 nt, Mycobacterium bovis subsp bovis AF2122/97
gcagccgggcaccgaacu

SEQ ID NO: 1113179 - RNA, 16 nt, Mycobacterium bovis subsp bovis AF2122/97
gcagccgggccaaccg

SEQ ID NO: 1113180 - RNA, 20 nt, Mycobacterium bovis subsp bovis AF2122/97
gcagccgggcgucgcuggug

SEQ ID NO: 1113181 - RNA, 13 nt, Mycobacterium bovis subsp bovis AF2122/97
gcagccuucucgc

SEQ ID NO: 1113182 - RNA, 20 nt, Mycobacterium bovis subsp bovis AF2122/97
gcagcgaaaacccggucggc

SEQ ID NO: 1113183 - RNA, 23 nt, Mycobacterium bovis subsp bovis AF2122/97
gcagcgaaaacccggucggcgaa

SEQ ID NO: 1113184 - RNA, 17 nt, Mycobacterium bovis subsp bovis AF2122/97
gcagccggaccguguac

SEQ ID NO: 1113185 - RNA, 11 nt, Mycobacterium bovis subsp bovis AF2122/97
gcagccggcau

SEQ ID NO: 1113186 - RNA, 23 nt, Mycobacterium bovis subsp bovis AF2122/97
gcagccgccucaaugaccaccgg

SEQ ID NO: 1113187 - RNA, 13 nt, Mycobacterium bovis subsp bovis AF2122/97
gcagcccgccggg

SEQ ID NO: 1113188 - RNA, 16 nt, Mycobacterium bovis subsp bovis AF2122/97
gcagcccgccgcugaa

SEQ ID NO: 1113189 - RNA, 16 nt, Mycobacterium bovis subsp bovis AF2122/97
gcagcccgucggaccc

SEQ ID NO: 1113190 - RNA, 13 nt, Mycobacterium bovis subsp bovis AF2122/97
gcagcccgucggc

SEQ ID NO: 1113191 - RNA, 15 nt, Mycobacterium bovis subsp bovis AF2122/97
gcagcccgucggugg

SEQ ID NO: 1113192 - RNA, 14 nt, Mycobacterium bovis subsp bovis AF2122/97
gcagcccgggcagc

SEQ ID NO: 1113193 - RNA, 18 nt, Mycobacterium bovis subsp bovis AF2122/97
gcagcccgggcagcacca

SEQ ID NO: 1113194 - RNA, 16 nt, Mycobacterium bovis subsp bovis AF2122/97
gcagcccgggcagccc

SEQ ID NO: 1113195 - RNA, 18 nt, Mycobacterium bovis subsp bovis AF2122/97
gcagccgaucgucucggc

SEQ ID NO: 1113196 - RNA, 15 nt, Mycobacterium bovis subsp bovis AF2122/97
gcagccgaugucgcg

SEQ ID NO: 1113197 - RNA, 16 nt, Mycobacterium bovis subsp bovis AF2122/97
gcagccgaugucgcgc

SEQ ID NO: 1113198 - RNA, 18 nt, Mycobacterium bovis subsp bovis AF2122/97
gcagccgaugucgcgcgc

SEQ ID NO: 1113199 - RNA, 14 nt, Mycobacterium bovis subsp bovis AF2122/97
gcagccgaugcucg

SEQ ID NO: 1113200 - RNA, 21 nt, Mycobacterium bovis subsp bovis AF2122/97
gcagccgaugcucgucccaga

SEQ ID NO: 1113201 - RNA, 23 nt, Mycobacterium bovis subsp bovis AF2122/97
gcagccgaugcugcgggcggucc

SEQ ID NO: 1113202 - RNA, 23 nt, Mycobacterium bovis subsp bovis AF2122/97
gcagcccggcgaauacgaccguc

SEQ ID NO: 1113203 - RNA, 23 nt, Mycobacterium bovis subsp bovis AF2122/97
gcagccgaccgaaucagcacggu

SEQ ID NO: 1113204 - RNA, 13 nt, Mycobacterium bovis subsp bovis AF2122/97
gcagccgaaccgg

SEQ ID NO: 1113205 - RNA, 16 nt, Mycobacterium bovis subsp bovis AF2122/97
gcagccgaaguggcgc

SEQ ID NO: 1113206 - RNA, 15 nt, Mycobacterium bovis subsp bovis AF2122/97
gcagcccugcgcagc

SEQ ID NO: 1113207 - RNA, 16 nt, Mycobacterium bovis subsp bovis AF2122/97
gcagcccugcgcagcc

SEQ ID NO: 1113208 - RNA, 18 nt, Mycobacterium bovis subsp bovis AF2122/97
gcagcagcgugaccaccg

SEQ ID NO: 1113209 - RNA, 22 nt, Mycobacterium bovis subsp bovis AF2122/97
gcagcagcgugaccaccgccga

SEQ ID NO: 1113210 - RNA, 21 nt, Mycobacterium bovis subsp bovis AF2122/97
gcagcagcgugcacacccgca

SEQ ID NO: 1113211 - RNA, 17 nt, Mycobacterium bovis subsp bovis AF2122/97
gcagcaggcccacccgg

SEQ ID NO: 1113212 - RNA, 15 nt, Mycobacterium bovis subsp bovis AF2122/97
gcagcccaugggcga

SEQ ID NO: 1113213 - RNA, 21 nt, Mycobacterium bovis subsp bovis AF2122/97
gcagcccaaagcgccagcagc

SEQ ID NO: 1113214 - RNA, 17 nt, Mycobacterium bovis subsp bovis AF2122/97
gcagcgugaccaccgcc

SEQ ID NO: 1113215 - RNA, 21 nt, Mycobacterium bovis subsp bovis AF2122/97
gcagcgugggaagagccgggc

SEQ ID NO: 1113216 - RNA, 22 nt, Mycobacterium bovis subsp bovis AF2122/97
gcagcgucuccuugagcuucuc

SEQ ID NO: 1113217 - RNA, 23 nt, Mycobacterium bovis subsp bovis AF2122/97
gcagcgugcagcggcgggcgaug

SEQ ID NO: 1113218 - RNA, 21 nt, Mycobacterium bovis subsp bovis AF2122/97
gcagcguggacaucgggcggc

SEQ ID NO: 1113219 - RNA, 15 nt, Mycobacterium bovis subsp bovis AF2122/97
gcagcgugaccaccg

SEQ ID NO: 1113220 - RNA, 22 nt, Mycobacterium bovis subsp bovis AF2122/97
gcagcgugagugcagcacgauc

SEQ ID NO: 1113221 - RNA, 18 nt, Mycobacterium bovis subsp bovis AF2122/97
gcagcgugaucuggccac

SEQ ID NO: 1113222 - RNA, 14 nt, Mycobacterium bovis subsp bovis AF2122/97
gcagcgugaccacc

SEQ ID NO: 1113223 - RNA, 11 nt, Mycobacterium bovis subsp bovis AF2122/97
gcagcgucggu

SEQ ID NO: 1113224 - RNA, 14 nt, Mycobacterium bovis subsp bovis AF2122/97
gcagcgucgucgac

SEQ ID NO: 1113225 - RNA, 16 nt, Mycobacterium bovis subsp bovis AF2122/97
gcagcgggcugcgcua

SEQ ID NO: 1113226 - RNA, 15 nt, Mycobacterium bovis subsp bovis AF2122/97
gcagcgggccgcccu

SEQ ID NO: 1113227 - RNA, 17 nt, Mycobacterium bovis subsp bovis AF2122/97
gcaggcauucccgcggc

SEQ ID NO: 1113228 - RNA, 16 nt, Mycobacterium bovis subsp bovis AF2122/97
gcaggcccuuggcgau

SEQ ID NO: 1113229 - RNA, 16 nt, Mycobacterium bovis subsp bovis AF2122/97
gcaggcccuggccacc

SEQ ID NO: 1113230 - RNA, 18 nt, Mycobacterium bovis subsp bovis AF2122/97
gcaggcagggcagcccgg

SEQ ID NO: 1113231 - RNA, 20 nt, Mycobacterium bovis subsp bovis AF2122/97
gcaggcagggcagcccggcg

SEQ ID NO: 1113232 - RNA, 19 nt, Mycobacterium bovis subsp bovis AF2122/97
gcaggcagguuggccaccg

SEQ ID NO: 1113233 - RNA, 21 nt, Mycobacterium bovis subsp bovis AF2122/97
gcaggcagguuggccaccgcc

SEQ ID NO: 1113234 - RNA, 13 nt, Mycobacterium bovis subsp bovis AF2122/97
gcaggcauucccg

SEQ ID NO: 1113235 - RNA, 13 nt, Mycobacterium bovis subsp bovis AF2122/97
gcaggccgccggc

SEQ ID NO: 1113236 - RNA, 16 nt, Mycobacterium bovis subsp bovis AF2122/97
gcaggccgcguucgug

SEQ ID NO: 1113237 - RNA, 17 nt, Mycobacterium bovis subsp bovis AF2122/97
gcaggccgcguucgugg

SEQ ID NO: 1113238 - RNA, 14 nt, Mycobacterium bovis subsp bovis AF2122/97
gcaggccgccgcca

SEQ ID NO: 1113239 - RNA, 18 nt, Mycobacterium bovis subsp bovis AF2122/97
gcaggccgcgcucgucga

SEQ ID NO: 1113240 - RNA, 12 nt, Mycobacterium bovis subsp bovis AF2122/97
gcaggccgcgga

SEQ ID NO: 1113241 - RNA, 14 nt, Mycobacterium bovis subsp bovis AF2122/97
gcaggccggccacc

SEQ ID NO: 1113242 - RNA, 15 nt, Mycobacterium bovis subsp bovis AF2122/97
gcaggccggccaccg

SEQ ID NO: 1113243 - RNA, 20 nt, Mycobacterium bovis subsp bovis AF2122/97
gcaggccggccaccgagucg

SEQ ID NO: 1113244 - RNA, 14 nt, Mycobacterium bovis subsp bovis AF2122/97
gcaggccggcgucg

SEQ ID NO: 1113245 - RNA, 15 nt, Mycobacterium bovis subsp bovis AF2122/97
gcaggccggcgucga

SEQ ID NO: 1113246 - RNA, 14 nt, Mycobacterium bovis subsp bovis AF2122/97
gcaggccggcucgc

SEQ ID NO: 1113247 - RNA, 19 nt, Mycobacterium bovis subsp bovis AF2122/97
gcaggccggcucgccgacc

SEQ ID NO: 1113248 - RNA, 13 nt, Mycobacterium bovis subsp bovis AF2122/97
gcaggccgggcgc

SEQ ID NO: 1113249 - RNA, 18 nt, Mycobacterium bovis subsp bovis AF2122/97
gcagguacaucaccacga

SEQ ID NO: 1113250 - RNA, 13 nt, Mycobacterium bovis subsp bovis AF2122/97
gcagguaggcgcg

SEQ ID NO: 1113251 - RNA, 16 nt, Mycobacterium bovis subsp bovis AF2122/97
gcagguacucgcccca

SEQ ID NO: 1113252 - RNA, 17 nt, Mycobacterium bovis subsp bovis AF2122/97
gcagguccaucuggcgc

SEQ ID NO: 1113253 - RNA, 13 nt, Mycobacterium bovis subsp bovis AF2122/97
gcagguccgcggc

SEQ ID NO: 1113254 - RNA, 17 nt, Mycobacterium bovis subsp bovis AF2122/97
gcagguccgcggccgcg

SEQ ID NO: 1113255 - RNA, 13 nt, Mycobacterium bovis subsp bovis AF2122/97
gcaggucgcacca

SEQ ID NO: 1113256 - RNA, 23 nt, Mycobacterium bovis subsp bovis AF2122/97
gcaggucgaugcugccagccaug

SEQ ID NO: 1113257 - RNA, 17 nt, Mycobacterium bovis subsp bovis AF2122/97
gcaggucguccaucgcg

SEQ ID NO: 1113258 - RNA, 19 nt, Mycobacterium bovis subsp bovis AF2122/97
gcaggucgucggcgucgcg

SEQ ID NO: 1113259 - RNA, 20 nt, Mycobacterium bovis subsp bovis AF2122/97
gcaggucgucggcgucgcgg

SEQ ID NO: 1113260 - RNA, 13 nt, Mycobacterium bovis subsp bovis AF2122/97
gcaggucgucggc

SEQ ID NO: 1113261 - RNA, 21 nt, Mycobacterium bovis subsp bovis AF2122/97
gcaggcucgggcaaggccacc

SEQ ID NO: 1113262 - RNA, 22 nt, Mycobacterium bovis subsp bovis AF2122/97
gcaggcucgggcaaggccaccg

SEQ ID NO: 1113263 - RNA, 12 nt, Mycobacterium bovis subsp bovis AF2122/97
gcaggccgucga

SEQ ID NO: 1113264 - RNA, 16 nt, Mycobacterium bovis subsp bovis AF2122/97
gcaggcucgaaccgac

SEQ ID NO: 1113265 - RNA, 17 nt, Mycobacterium bovis subsp bovis AF2122/97
gcagggccucggucgcc

SEQ ID NO: 1113266 - RNA, 13 nt, Mycobacterium bovis subsp bovis AF2122/97
gcagggcgucggc

SEQ ID NO: 1113267 - RNA, 13 nt, Mycobacterium bovis subsp bovis AF2122/97
gcagggcggugcc

SEQ ID NO: 1113268 - RNA, 14 nt, Mycobacterium bovis subsp bovis AF2122/97
gcagggcggcgaac

SEQ ID NO: 1113269 - RNA, 15 nt, Mycobacterium bovis subsp bovis AF2122/97
gcaggguggggcggu

SEQ ID NO: 1113270 - RNA, 19 nt, Mycobacterium bovis subsp bovis AF2122/97
gcaggguggggcgguggcc

SEQ ID NO: 1113271 - RNA, 22 nt, Mycobacterium bovis subsp bovis AF2122/97
gcaggguggggcgguggccggc

SEQ ID NO: 1113272 - RNA, 19 nt, Mycobacterium bovis subsp bovis AF2122/97
gcaggguguuuauggcccu

SEQ ID NO: 1113273 - RNA, 18 nt, Mycobacterium bovis subsp bovis AF2122/97
gcaggguuccggauccga

SEQ ID NO: 1113274 - RNA, 16 nt, Mycobacterium bovis subsp bovis AF2122/97
gcaggguucgucggga

SEQ ID NO: 1113275 - RNA, 15 nt, Mycobacterium bovis subsp bovis AF2122/97
gcagggcgucggcga

SEQ ID NO: 1113276 - RNA, 19 nt, Mycobacterium bovis subsp bovis AF2122/97
gcaggggaguugcuugcag

SEQ ID NO: 1113277 - RNA, 15 nt, Mycobacterium bovis subsp bovis AF2122/97
gcaggguggccagca

SEQ ID NO: 1113278 - RNA, 22 nt, Mycobacterium bovis subsp bovis AF2122/97
gcagggcuucgugcaccacauu

SEQ ID NO: 1113279 - RNA, 15 nt, Mycobacterium bovis subsp bovis AF2122/97
gcaggggacgggcgg

SEQ ID NO: 1113280 - RNA, 15 nt, Mycobacterium bovis subsp bovis AF2122/97
gcauaggccgcgucg

SEQ ID NO: 1113281 - RNA, 21 nt, Mycobacterium bovis subsp bovis AF2122/97
gcauaggccccgccagcgccg

SEQ ID NO: 1113282 - RNA, 20 nt, Mycobacterium bovis subsp bovis AF2122/97
gcauagggccaccgccgccu

SEQ ID NO: 1113283 - RNA, 19 nt, Mycobacterium bovis subsp bovis AF2122/97
gcauagguaguugcucggc

SEQ ID NO: 1113284 - RNA, 22 nt, Mycobacterium bovis subsp bovis AF2122/97
gcaucacccgggaugaccaccg

SEQ ID NO: 1113285 - RNA, 18 nt, Mycobacterium bovis subsp bovis AF2122/97
gcaucaccgacgcgucgg

SEQ ID NO: 1113286 - RNA, 23 nt, Mycobacterium bovis subsp bovis AF2122/97
gcaucaccgacgcgucggcgacg

SEQ ID NO: 1113287 - RNA, 16 nt, Mycobacterium bovis subsp bovis AF2122/97
gcaucacaagggugcc

SEQ ID NO: 1113288 - RNA, 19 nt, Mycobacterium bovis subsp bovis AF2122/97
gcaucacaagggugcccgg

SEQ ID NO: 1113289 - RNA, 16 nt, Mycobacterium bovis subsp bovis AF2122/97
gcaucaccgccgcggc

SEQ ID NO: 1113290 - RNA, 17 nt, Mycobacterium bovis subsp bovis AF2122/97
gcaucaccgccgcggcc

SEQ ID NO: 1113291 - RNA, 15 nt, Mycobacterium bovis subsp bovis AF2122/97
gcauccgcgguuggc

SEQ ID NO: 1113292 - RNA, 18 nt, Mycobacterium bovis subsp bovis AF2122/97
gcaucccgaauggccgau

SEQ ID NO: 1113293 - RNA, 16 nt, Mycobacterium bovis subsp bovis AF2122/97
gcaucccgggcagucc

SEQ ID NO: 1113294 - RNA, 12 nt, Mycobacterium bovis subsp bovis AF2122/97
gcauccgcagcc

SEQ ID NO: 1113295 - RNA, 13 nt, Mycobacterium bovis subsp bovis AF2122/97
gcaucgagcccgg

SEQ ID NO: 1113296 - RNA, 17 nt, Mycobacterium bovis subsp bovis AF2122/97
gcaucgagacgcacggc

SEQ ID NO: 1113297 - RNA, 20 nt, Mycobacterium bovis subsp bovis AF2122/97
gcaucgagacgcacggccac

SEQ ID NO: 1113298 - RNA, 14 nt, Mycobacterium bovis subsp bovis AF2122/97
gcaucgacgcggcc

SEQ ID NO: 1113299 - RNA, 14 nt, Mycobacterium bovis subsp bovis AF2122/97
gcaucgcacgggcc

SEQ ID NO: 1113300 - RNA, 17 nt, Mycobacterium bovis subsp bovis AF2122/97
gcaucgcacgggccacc

SEQ ID NO: 1113301 - RNA, 15 nt, Mycobacterium bovis subsp bovis AF2122/97
gcaucgccaccauca

SEQ ID NO: 1113302 - RNA, 21 nt, Mycobacterium bovis subsp bovis AF2122/97
gcaucgauucgauguccucga

SEQ ID NO: 1113303 - RNA, 21 nt, Mycobacterium bovis subsp bovis AF2122/97
gcaucgcgauuccggcggcca

SEQ ID NO: 1113304 - RNA, 23 nt, Mycobacterium bovis subsp bovis AF2122/97
gcaucgcgccuuugagcccgcga

SEQ ID NO: 1113305 - RNA, 16 nt, Mycobacterium bovis subsp bovis AF2122/97
gcaucgcgaacucggg

SEQ ID NO: 1113306 - RNA, 21 nt, Mycobacterium bovis subsp bovis AF2122/97
gcaucgcggaagcgggcgaug

SEQ ID NO: 1113307 - RNA, 15 nt, Mycobacterium bovis subsp bovis AF2122/97
gcaucgcggcaucga

SEQ ID NO: 1113308 - RNA, 20 nt, Mycobacterium bovis subsp bovis AF2122/97
gcaucgccgcgggugaucug

SEQ ID NO: 1113309 - RNA, 16 nt, Mycobacterium bovis subsp bovis AF2122/97
gcaucgccgacagcgc

SEQ ID NO: 1113310 - RNA, 18 nt, Mycobacterium bovis subsp bovis AF2122/97
gcaucgccgacagcgccu

SEQ ID NO: 1113311 - RNA, 13 nt, Mycobacterium bovis subsp bovis AF2122/97
gcaucgccgcugg

SEQ ID NO: 1113312 - RNA, 14 nt, Mycobacterium bovis subsp bovis AF2122/97
gcaucgccgcuggc

SEQ ID NO: 1113313 - RNA, 14 nt, Mycobacterium bovis subsp bovis AF2122/97
gcagugccgugcgg

SEQ ID NO: 1113314 - RNA, 13 nt, Mycobacterium bovis subsp bovis AF2122/97
gcagugccucggc

SEQ ID NO: 1113315 - RNA, 19 nt, Mycobacterium bovis subsp bovis AF2122/97
gcagugccucggcgauggg

SEQ ID NO: 1113316 - RNA, 13 nt, Mycobacterium bovis subsp bovis AF2122/97
gcagugcgccagc

SEQ ID NO: 1113317 - RNA, 13 nt, Mycobacterium bovis subsp bovis AF2122/97
gcagugcgacccg

SEQ ID NO: 1113318 - RNA, 16 nt, Mycobacterium bovis subsp bovis AF2122/97
gcagugcgacccgggc

SEQ ID NO: 1113319 - RNA, 23 nt, Mycobacterium bovis subsp bovis AF2122/97
gcagugcacccgggccgccucga

SEQ ID NO: 1113320 - RNA, 17 nt, Mycobacterium bovis subsp bovis AF2122/97
gcagugcagcgaucccg

SEQ ID NO: 1113321 - RNA, 17 nt, Mycobacterium bovis subsp bovis AF2122/97
gcagguucuugaccagc

SEQ ID NO: 1113322 - RNA, 14 nt, Mycobacterium bovis subsp bovis AF2122/97
gcagguuccacggc

SEQ ID NO: 1113323 - RNA, 15 nt, Mycobacterium bovis subsp bovis AF2122/97
gcaggugagugcggc

SEQ ID NO: 1113324 - RNA, 22 nt, Mycobacterium bovis subsp bovis AF2122/97
gcaggugacgaucaggucgccg

SEQ ID NO: 1113325 - RNA, 13 nt, Mycobacterium bovis subsp bovis AF2122/97
gcaggugcaucgc

SEQ ID NO: 1113326 - RNA, 20 nt, Mycobacterium bovis subsp bovis AF2122/97
gcaggugccaaccgcggcga

SEQ ID NO: 1113327 - RNA, 15 nt, Mycobacterium bovis subsp bovis AF2122/97
gcagguggccgucgc

SEQ ID NO: 1113328 - RNA, 18 nt, Mycobacterium bovis subsp bovis AF2122/97
gcagguggccgucgccga

SEQ ID NO: 1113329 - RNA, 17 nt, Mycobacterium bovis subsp bovis AF2122/97
gcagguggugacacgac

SEQ ID NO: 1113330 - RNA, 15 nt, Mycobacterium bovis subsp bovis AF2122/97
gcagguguuggugcg

SEQ ID NO: 1113331 - RNA, 13 nt, Mycobacterium bovis subsp bovis AF2122/97
gcagugccgccgg

SEQ ID NO: 1113332 - RNA, 22 nt, Mycobacterium bovis subsp bovis AF2122/97
gcagugcgggggcgaccuggug

SEQ ID NO: 1113333 - RNA, 18 nt, Mycobacterium bovis subsp bovis AF2122/97
gcagugcugcagacccgu

SEQ ID NO: 1113334 - RNA, 14 nt, Mycobacterium bovis subsp bovis AF2122/97
gcaguggccgccgg

SEQ ID NO: 1113335 - RNA, 12 nt, Mycobacterium bovis subsp bovis AF2122/97
gcaguggcgcgg

SEQ ID NO: 1113336 - RNA, 15 nt, Mycobacterium bovis subsp bovis AF2122/97
gcaguggcgcggcga

SEQ ID NO: 1113337 - RNA, 17 nt, Mycobacterium bovis subsp bovis AF2122/97
gcaguucucggucccgc

SEQ ID NO: 1113338 - RNA, 18 nt, Mycobacterium bovis subsp bovis AF2122/97
gcaguugaacucgaccac

SEQ ID NO: 1113339 - RNA, 20 nt, Mycobacterium bovis subsp bovis AF2122/97
gcaguugaacucgaccaccg

SEQ ID NO: 1113340 - RNA, 22 nt, Mycobacterium bovis subsp bovis AF2122/97
gcaguugaacucgaccaccgcc

SEQ ID NO: 1113341 - RNA, 16 nt, Mycobacterium bovis subsp bovis AF2122/97
gcaguuguggcgcugc

SEQ ID NO: 1113342 - RNA, 15 nt, Mycobacterium bovis subsp bovis AF2122/97
gcaguuggcaccagc

SEQ ID NO: 1113343 - RNA, 15 nt, Mycobacterium bovis subsp bovis AF2122/97
gcauaacccgcaccg

SEQ ID NO: 1113344 - RNA, 16 nt, Mycobacterium bovis subsp bovis AF2122/97
gcauagccgaacagcg

SEQ ID NO: 1113345 - RNA, 18 nt, Mycobacterium bovis subsp bovis AF2122/97
gcauagcucagaccggcg

SEQ ID NO: 1113346 - RNA, 21 nt, Mycobacterium bovis subsp bovis AF2122/97
gcauagcggcccaucgggcgc

SEQ ID NO: 1113347 - RNA, 14 nt, Mycobacterium bovis subsp bovis AF2122/97
gcauacaaccccgc

SEQ ID NO: 1113348 - RNA, 21 nt, Mycobacterium bovis subsp bovis AF2122/97
gcauaacgccagucccggcgc

SEQ ID NO: 1113349 - RNA, 18 nt, Mycobacterium bovis subsp bovis AF2122/97
gcauaagcccccgcacgc

SEQ ID NO: 1113350 - RNA, 21 nt, Mycobacterium bovis subsp bovis AF2122/97
gccaacccgucuuaucggcgu

SEQ ID NO: 1113351 - RNA, 13 nt, Mycobacterium bovis subsp bovis AF2122/97
gccaacccgggcc

SEQ ID NO: 1113352 - RNA, 17 nt, Mycobacterium bovis subsp bovis AF2122/97
gccaacccgggccgcca

SEQ ID NO: 1113353 - RNA, 21 nt, Mycobacterium bovis subsp bovis AF2122/97
gccaacaccuguuugagcgca

SEQ ID NO: 1113354 - RNA, 23 nt, Mycobacterium bovis subsp bovis AF2122/97
gccaacccgauuuauccggaucg

SEQ ID NO: 1113355 - RNA, 14 nt, Mycobacterium bovis subsp bovis AF2122/97
gccaaccgcggcga

SEQ ID NO: 1113356 - RNA, 16 nt, Mycobacterium bovis subsp bovis AF2122/97
gccaaccgcggcgauc

SEQ ID NO: 1113357 - RNA, 14 nt, Mycobacterium bovis subsp bovis AF2122/97
gccaaccggcgcag

SEQ ID NO: 1113358 - RNA, 14 nt, Mycobacterium bovis subsp bovis AF2122/97
gccaaccgggugug

SEQ ID NO: 1113359 - RNA, 17 nt, Mycobacterium bovis subsp bovis AF2122/97
gccaaccguccggggcc

SEQ ID NO: 1113360 - RNA, 17 nt, Mycobacterium bovis subsp bovis AF2122/97
gccaaccgguucgucga

SEQ ID NO: 1113361 - RNA, 16 nt, Mycobacterium bovis subsp bovis AF2122/97
gccaaccgugcgcacu

SEQ ID NO: 1113362 - RNA, 14 nt, Mycobacterium bovis subsp bovis AF2122/97
gccaacgagcgcgc

SEQ ID NO: 1113363 - RNA, 19 nt, Mycobacterium bovis subsp bovis AF2122/97
gccaacgacaggcgcccac

SEQ ID NO: 1113364 - RNA, 23 nt, Mycobacterium bovis subsp bovis AF2122/97
gccaacgacgccaugagcgcgcc

SEQ ID NO: 1113365 - RNA, 23 nt, Mycobacterium bovis subsp bovis AF2122/97
gccaaccugaagccagcgcagca

SEQ ID NO: 1113366 - RNA, 11 nt, Mycobacterium bovis subsp bovis AF2122/97
gccaaccuggg

SEQ ID NO: 1113367 - RNA, 14 nt, Mycobacterium bovis subsp bovis AF2122/97
gccaacccugcggc

SEQ ID NO: 1113368 - RNA, 12 nt, Mycobacterium bovis subsp bovis AF2122/97
gccaaccugggc

SEQ ID NO: 1113369 - RNA, 15 nt, Mycobacterium bovis subsp bovis AF2122/97
gccaacgagcgcgcu

SEQ ID NO: 1113370 - RNA, 19 nt, Mycobacterium bovis subsp bovis AF2122/97
gccaacgccaaaacggucg

SEQ ID NO: 1113371 - RNA, 20 nt, Mycobacterium bovis subsp bovis AF2122/97
gccaacgccaaaacggucga

SEQ ID NO: 1113372 - RNA, 12 nt, Mycobacterium bovis subsp bovis AF2122/97
gccaacgccagc

SEQ ID NO: 1113373 - RNA, 14 nt, Mycobacterium bovis subsp bovis AF2122/97
gccaacgccagcgg

SEQ ID NO: 1113374 - RNA, 13 nt, Mycobacterium bovis subsp bovis AF2122/97
gccaacgcccacg

SEQ ID NO: 1113375 - RNA, 17 nt, Mycobacterium bovis subsp bovis AF2122/97
gccaacgcccguguuga

SEQ ID NO: 1113376 - RNA, 15 nt, Mycobacterium bovis subsp bovis AF2122/97
gccaacagguccacc

SEQ ID NO: 1113377 - RNA, 18 nt, Mycobacterium bovis subsp bovis AF2122/97
gccaacaacaucagcgac

SEQ ID NO: 1113378 - RNA, 23 nt, Mycobacterium bovis subsp bovis AF2122/97
gccaacaacaucagcgacagcgg

SEQ ID NO: 1113379 - RNA, 21 nt, Mycobacterium bovis subsp bovis AF2122/97
gccaacaacccaacaaaaggc

SEQ ID NO: 1113380 - RNA, 22 nt, Mycobacterium bovis subsp bovis AF2122/97
gccaacaacccaacaaaaggcc

SEQ ID NO: 1113381 - RNA, 15 nt, Mycobacterium bovis subsp bovis AF2122/97
gccaaccagucgcac

SEQ ID NO: 1113382 - RNA, 19 nt, Mycobacterium bovis subsp bovis AF2122/97
gccaaccagucgcacgacg

SEQ ID NO: 1113383 - RNA, 15 nt, Mycobacterium bovis subsp bovis AF2122/97
gccaaccccaacauc

SEQ ID NO: 1113384 - RNA, 16 nt, Mycobacterium bovis subsp bovis AF2122/97
gccaaccacuuuccgg

SEQ ID NO: 1113385 - RNA, 19 nt, Mycobacterium bovis subsp bovis AF2122/97
gccaacagguccaccggcc

SEQ ID NO: 1113386 - RNA, 21 nt, Mycobacterium bovis subsp bovis AF2122/97
gccaacaucuccgcgucgguc

SEQ ID NO: 1113387 - RNA, 19 nt, Mycobacterium bovis subsp bovis AF2122/97
gccaaaugcgcugucgccc

SEQ ID NO: 1113388 - RNA, 21 nt, Mycobacterium bovis subsp bovis AF2122/97
gccaaauccggugcccgcacc

SEQ ID NO: 1113389 - RNA, 14 nt, Mycobacterium bovis subsp bovis AF2122/97
gccaaauaccguga

SEQ ID NO: 1113390 - RNA, 16 nt, Mycobacterium bovis subsp bovis AF2122/97
gccaaagcgcgggcgg

SEQ ID NO: 1113391 - RNA, 23 nt, Mycobacterium bovis subsp bovis AF2122/97
gcauuuccugauccgccugccga

SEQ ID NO: 1113392 - RNA, 17 nt, Mycobacterium bovis subsp bovis AF2122/97
gcauuuguugcugcugc

SEQ ID NO: 1113393 - RNA, 23 nt, Mycobacterium bovis subsp bovis AF2122/97
gcauuggcggugccgguagcggc

SEQ ID NO: 1113394 - RNA, 13 nt, Mycobacterium bovis subsp bovis AF2122/97
gcauuggcgucga

SEQ ID NO: 1113395 - RNA, 15 nt, Mycobacterium bovis subsp bovis AF2122/97
gcauuggcgucgucg

SEQ ID NO: 1113396 - RNA, 23 nt, Mycobacterium bovis subsp bovis AF2122/97
gcauuguccugaaaacaccgcac

SEQ ID NO: 1113397 - RNA, 20 nt, Mycobacterium bovis subsp bovis AF2122/97
gcauugcuccgguuggcgcg

SEQ ID NO: 1113398 - RNA, 21 nt, Mycobacterium bovis subsp bovis AF2122/97
gcauugcugguugcgcucacc

SEQ ID NO: 1113399 - RNA, 18 nt, Mycobacterium bovis subsp bovis AF2122/97
gcauugcuguguugcacc

SEQ ID NO: 1113400 - RNA, 21 nt, Mycobacterium bovis subsp bovis AF2122/97
gccaaaauggugccguccggc

SEQ ID NO: 1113401 - RNA, 19 nt, Mycobacterium bovis subsp bovis AF2122/97
gccaaaauuuugucggccg

SEQ ID NO: 1113402 - RNA, 15 nt, Mycobacterium bovis subsp bovis AF2122/97
gccaaaagggcggca

SEQ ID NO: 1113403 - RNA, 23 nt, Mycobacterium bovis subsp bovis AF2122/97
gccaaaaguacuggcguugccac

SEQ ID NO: 1113404 - RNA, 19 nt, Mycobacterium bovis subsp bovis AF2122/97
gccaaaaaggaucccgccg

SEQ ID NO: 1113405 - RNA, 16 nt, Mycobacterium bovis subsp bovis AF2122/97
gccaaaaacgcugccg

SEQ ID NO: 1113406 - RNA, 20 nt, Mycobacterium bovis subsp bovis AF2122/97
gccaaaaacgcugccgccgu

SEQ ID NO: 1113407 - RNA, 22 nt, Mycobacterium bovis subsp bovis AF2122/97
gccaaaaacgcugccgccguuc

SEQ ID NO: 1113408 - RNA, 13 nt, Mycobacterium bovis subsp bovis AF2122/97
gccaaagcccgac

SEQ ID NO: 1113409 - RNA, 18 nt, Mycobacterium bovis subsp bovis AF2122/97
gccaaagacccggcaccc

SEQ ID NO: 1113410 - RNA, 19 nt, Mycobacterium bovis subsp bovis AF2122/97
gccaaagacccggcaccca

SEQ ID NO: 1113411 - RNA, 12 nt, Mycobacterium bovis subsp bovis AF2122/97
gccaaagcgcgg

SEQ ID NO: 1113412 - RNA, 17 nt, Mycobacterium bovis subsp bovis AF2122/97
gccaaacgccgcccgcc

SEQ ID NO: 1113413 - RNA, 18 nt, Mycobacterium bovis subsp bovis AF2122/97
gccaaacgccgcccgccg

SEQ ID NO: 1113414 - RNA, 22 nt, Mycobacterium bovis subsp bovis AF2122/97
gccaaacccggcgggcccgccg

SEQ ID NO: 1113415 - RNA, 15 nt, Mycobacterium bovis subsp bovis AF2122/97
gccaaaccgauggga

SEQ ID NO: 1113416 - RNA, 13 nt, Mycobacterium bovis subsp bovis AF2122/97
gccaaaccugggu

SEQ ID NO: 1113417 - RNA, 18 nt, Mycobacterium bovis subsp bovis AF2122/97
gccaaacgccaucauggc

SEQ ID NO: 1113418 - RNA, 21 nt, Mycobacterium bovis subsp bovis AF2122/97
gccaaacgccaucauggccgu

SEQ ID NO: 1113419 - RNA, 15 nt, Mycobacterium bovis subsp bovis AF2122/97
gccaaacuacccgcc

SEQ ID NO: 1113420 - RNA, 22 nt, Mycobacterium bovis subsp bovis AF2122/97
gccaaacuacccgcccacggca

SEQ ID NO: 1113421 - RNA, 18 nt, Mycobacterium bovis subsp bovis AF2122/97
gcaugguccacagccggc

SEQ ID NO: 1113422 - RNA, 19 nt, Mycobacterium bovis subsp bovis AF2122/97
gcaugguccacagccggcg

SEQ ID NO: 1113423 - RNA, 15 nt, Mycobacterium bovis subsp bovis AF2122/97
gcaugggccggcgcc

SEQ ID NO: 1113424 - RNA, 13 nt, Mycobacterium bovis subsp bovis AF2122/97
gcauggucgccgg

SEQ ID NO: 1113425 - RNA, 19 nt, Mycobacterium bovis subsp bovis AF2122/97
gcaugguggacgaggcggu

SEQ ID NO: 1113426 - RNA, 17 nt, Mycobacterium bovis subsp bovis AF2122/97
gcaugguggcgccgacc

SEQ ID NO: 1113427 - RNA, 22 nt, Mycobacterium bovis subsp bovis AF2122/97
gcauggugggugccggcgucgc

SEQ ID NO: 1113428 - RNA, 21 nt, Mycobacterium bovis subsp bovis AF2122/97
gcauggcuugcucugcgcauc

SEQ ID NO: 1113429 - RNA, 15 nt, Mycobacterium bovis subsp bovis AF2122/97
gcaugggacauccag

SEQ ID NO: 1113430 - RNA, 12 nt, Mycobacterium bovis subsp bovis AF2122/97
gcauggcggcgu

SEQ ID NO: 1113431 - RNA, 19 nt, Mycobacterium bovis subsp bovis AF2122/97
gcauguccauguuuugcug

SEQ ID NO: 1113432 - RNA, 22 nt, Mycobacterium bovis subsp bovis AF2122/97
gcauguagaguaucgaauccgu

SEQ ID NO: 1113433 - RNA, 13 nt, Mycobacterium bovis subsp bovis AF2122/97
gcaugucgccgaa

SEQ ID NO: 1113434 - RNA, 18 nt, Mycobacterium bovis subsp bovis AF2122/97
gcaugucgggccgcucga

SEQ ID NO: 1113435 - RNA, 23 nt, Mycobacterium bovis subsp bovis AF2122/97
gcaugugaaagacaacccgcucg

SEQ ID NO: 1113436 - RNA, 14 nt, Mycobacterium bovis subsp bovis AF2122/97
gcauguggccgccg

SEQ ID NO: 1113437 - RNA, 18 nt, Mycobacterium bovis subsp bovis AF2122/97
gcauguucuccacgccga

SEQ ID NO: 1113438 - RNA, 19 nt, Mycobacterium bovis subsp bovis AF2122/97
gcauguucuccacgccgau

SEQ ID NO: 1113439 - RNA, 17 nt, Mycobacterium bovis subsp bovis AF2122/97
gcauguucaucgcaguc

SEQ ID NO: 1113440 - RNA, 20 nt, Mycobacterium bovis subsp bovis AF2122/97
gcauuccuugauaacgaccc

SEQ ID NO: 1113441 - RNA, 14 nt, Mycobacterium bovis subsp bovis AF2122/97
gcauucccgcggca

SEQ ID NO: 1113442 - RNA, 11 nt, Mycobacterium bovis subsp bovis AF2122/97
gcauucccgcu

SEQ ID NO: 1113443 - RNA, 15 nt, Mycobacterium bovis subsp bovis AF2122/97
gcauucccgcucgca

SEQ ID NO: 1113444 - RNA, 15 nt, Mycobacterium bovis subsp bovis AF2122/97
gcauucgccgggcgg

SEQ ID NO: 1113445 - RNA, 17 nt, Mycobacterium bovis subsp bovis AF2122/97
gcauucgccgggcggca

SEQ ID NO: 1113446 - RNA, 13 nt, Mycobacterium bovis subsp bovis AF2122/97
gcauucgauaccg

SEQ ID NO: 1113447 - RNA, 17 nt, Mycobacterium bovis subsp bovis AF2122/97
gcauucgauaccgcacc

SEQ ID NO: 1113448 - RNA, 14 nt, Mycobacterium bovis subsp bovis AF2122/97
gcauugccgacgcg

SEQ ID NO: 1113449 - RNA, 22 nt, Mycobacterium bovis subsp bovis AF2122/97
gcauugccgacgcgcggccagc

SEQ ID NO: 1113450 - RNA, 15 nt, Mycobacterium bovis subsp bovis AF2122/97
gcauugcggcccgcg

SEQ ID NO: 1113451 - RNA, 13 nt, Mycobacterium bovis subsp bovis AF2122/97
gcauugccgccgu

SEQ ID NO: 1113452 - RNA, 17 nt, Mycobacterium bovis subsp bovis AF2122/97
gcauugcggcgcgggug

SEQ ID NO: 1113453 - RNA, 14 nt, Mycobacterium bovis subsp bovis AF2122/97
gcauugaguucggc

SEQ ID NO: 1113454 - RNA, 21 nt, Mycobacterium bovis subsp bovis AF2122/97
gcauugagccgggcuauccgc

SEQ ID NO: 1113455 - RNA, 16 nt, Mycobacterium bovis subsp bovis AF2122/97
gcauugagcuggcgcc

SEQ ID NO: 1113456 - RNA, 22 nt, Mycobacterium bovis subsp bovis AF2122/97
gcauugagcuggcgcccggguc

SEQ ID NO: 1113457 - RNA, 13 nt, Mycobacterium bovis subsp bovis AF2122/97
gcauugaucggug

SEQ ID NO: 1113458 - RNA, 20 nt, Mycobacterium bovis subsp bovis AF2122/97
gcauggacaacagcuuggag

SEQ ID NO: 1113459 - RNA, 18 nt, Mycobacterium bovis subsp bovis AF2122/97
gcaugcuugaaacccagg

SEQ ID NO: 1113460 - RNA, 19 nt, Mycobacterium bovis subsp bovis AF2122/97
gcaugcuugaaacccaggc

SEQ ID NO: 1113461 - RNA, 14 nt, Mycobacterium bovis subsp bovis AF2122/97
gcauggcagcggcg

SEQ ID NO: 1113462 - RNA, 17 nt, Mycobacterium bovis subsp bovis AF2122/97
gcauggcaggcgaaggc

SEQ ID NO: 1113463 - RNA, 19 nt, Mycobacterium bovis subsp bovis AF2122/97
gcauggcgaacacgucggc

SEQ ID NO: 1113464 - RNA, 20 nt, Mycobacterium bovis subsp bovis AF2122/97
gcauggcgaacacgucggcc

SEQ ID NO: 1113465 - RNA, 13 nt, Mycobacterium bovis subsp bovis AF2122/97
gcauggccugggu

SEQ ID NO: 1113466 - RNA, 19 nt, Mycobacterium bovis subsp bovis AF2122/97
gcaugcgaggggcggcaau

SEQ ID NO: 1113467 - RNA, 17 nt, Mycobacterium bovis subsp bovis AF2122/97
gcaugcgauacacggcg

SEQ ID NO: 1113468 - RNA, 16 nt, Mycobacterium bovis subsp bovis AF2122/97
gcaugcgaggggcggc

SEQ ID NO: 1113469 - RNA, 18 nt, Mycobacterium bovis subsp bovis AF2122/97
gcaugcgaggggcggcaa

SEQ ID NO: 1113470 - RNA, 14 nt, Mycobacterium bovis subsp bovis AF2122/97
gcaugcgacgucag

SEQ ID NO: 1113471 - RNA, 17 nt, Mycobacterium bovis subsp bovis AF2122/97
gcaugccggucuucgcg

SEQ ID NO: 1113472 - RNA, 21 nt, Mycobacterium bovis subsp bovis AF2122/97
gcaugccugcgaaacgcuggc

SEQ ID NO: 1113473 - RNA, 16 nt, Mycobacterium bovis subsp bovis AF2122/97
gcaugcggaucggcgg

SEQ ID NO: 1113474 - RNA, 18 nt, Mycobacterium bovis subsp bovis AF2122/97
gcaugcguaugcccacga

SEQ ID NO: 1113475 - RNA, 14 nt, Mycobacterium bovis subsp bovis AF2122/97
gcaugcgugccggc

SEQ ID NO: 1113476 - RNA, 12 nt, Mycobacterium bovis subsp bovis AF2122/97
gcaugcucacga

SEQ ID NO: 1113477 - RNA, 21 nt, Mycobacterium bovis subsp bovis AF2122/97
gcaugcucgaucgcguucugc

SEQ ID NO: 1113478 - RNA, 14 nt, Mycobacterium bovis subsp bovis AF2122/97
gcaugcucgaucgc

SEQ ID NO: 1113479 - RNA, 19 nt, Mycobacterium bovis subsp bovis AF2122/97
gcaugccgccaugcgcacc

SEQ ID NO: 1113480 - RNA, 13 nt, Mycobacterium bovis subsp bovis AF2122/97
gcaugccgacccg

SEQ ID NO: 1113481 - RNA, 14 nt, Mycobacterium bovis subsp bovis AF2122/97
gcaugccgcccgcg

SEQ ID NO: 1113482 - RNA, 15 nt, Mycobacterium bovis subsp bovis AF2122/97
gcaugccgcccgcgc

SEQ ID NO: 1113483 - RNA, 20 nt, Mycobacterium bovis subsp bovis AF2122/97
gcaugccgcccgcgccgccg

SEQ ID NO: 1113484 - RNA, 21 nt, Mycobacterium bovis subsp bovis AF2122/97
gcaugccgcccgcgccgccgg

SEQ ID NO: 1113485 - RNA, 23 nt, Mycobacterium bovis subsp bovis AF2122/97
gcaugccgcccgcuccugcucgu

SEQ ID NO: 1113486 - RNA, 12 nt, Mycobacterium bovis subsp bovis AF2122/97
gcaugccguuga

SEQ ID NO: 1113487 - RNA, 12 nt, Mycobacterium bovis subsp bovis AF2122/97
gcaugccguugc

SEQ ID NO: 1113488 - RNA, 13 nt, Mycobacterium bovis subsp bovis AF2122/97
gcaugccggcgca

SEQ ID NO: 1113489 - RNA, 17 nt, Mycobacterium bovis subsp bovis AF2122/97
gcaugccggcgcaccac

SEQ ID NO: 1113490 - RNA, 18 nt, Mycobacterium bovis subsp bovis AF2122/97
gcaugccggcgcaccaca

SEQ ID NO: 1113491 - RNA, 14 nt, Mycobacterium bovis subsp bovis AF2122/97
gcaugcccucgcug

SEQ ID NO: 1113492 - RNA, 16 nt, Mycobacterium bovis subsp bovis AF2122/97
gcaugccccgaccgcg

SEQ ID NO: 1113493 - RNA, 18 nt, Mycobacterium bovis subsp bovis AF2122/97
gcaugcccuggaccagcg

SEQ ID NO: 1113494 - RNA, 14 nt, Mycobacterium bovis subsp bovis AF2122/97
gcaugcaugccggc

SEQ ID NO: 1113495 - RNA, 15 nt, Mycobacterium bovis subsp bovis AF2122/97
gcaugccaccgagca

SEQ ID NO: 1113496 - RNA, 17 nt, Mycobacterium bovis subsp bovis AF2122/97
gcaugcccagcgcacgg

SEQ ID NO: 1113497 - RNA, 20 nt, Mycobacterium bovis subsp bovis AF2122/97
gcaugauguugaaacaccgc

SEQ ID NO: 1113498 - RNA, 17 nt, Mycobacterium bovis subsp bovis AF2122/97
gcaugaucacacugccc

SEQ ID NO: 1113499 - RNA, 23 nt, Mycobacterium bovis subsp bovis AF2122/97
gcaugaagucccggauacgggcg

SEQ ID NO: 1113500 - RNA, 16 nt, Mycobacterium bovis subsp bovis AF2122/97
gcaugacaccggccac

SEQ ID NO: 1113501 - RNA, 17 nt, Mycobacterium bovis subsp bovis AF2122/97
gcaugacaccggccacc

SEQ ID NO: 1113502 - RNA, 20 nt, Mycobacterium bovis subsp bovis AF2122/97
gcaugaacugcucgccgagg

SEQ ID NO: 1113503 - RNA, 16 nt, Mycobacterium bovis subsp bovis AF2122/97
gcaucuucgcgcagcc

SEQ ID NO: 1113504 - RNA, 22 nt, Mycobacterium bovis subsp bovis AF2122/97
gcaucuucgcgcagccgccgcg

SEQ ID NO: 1113505 - RNA, 24 nt, Mycobacterium bovis subsp bovis AF2122/97
gcaucuggggguagccgccggcgc

SEQ ID NO: 1113506 - RNA, 19 nt, Mycobacterium bovis subsp bovis AF2122/97
gcaucugggguccggugac

SEQ ID NO: 1113507 - RNA, 15 nt, Mycobacterium bovis subsp bovis AF2122/97
gcaucuggccggcgg

SEQ ID NO: 1113508 - RNA, 16 nt, Mycobacterium bovis subsp bovis AF2122/97
gcaucuggccggcggu

SEQ ID NO: 1113509 - RNA, 21 nt, Mycobacterium bovis subsp bovis AF2122/97
gcaucugcgggucggcaucgg

SEQ ID NO: 1113510 - RNA, 17 nt, Mycobacterium bovis subsp bovis AF2122/97
gcaucugcucggcaucg

SEQ ID NO: 1113511 - RNA, 18 nt, Mycobacterium bovis subsp bovis AF2122/97
gcaucugcucggcaucga

SEQ ID NO: 1113512 - RNA, 18 nt, Mycobacterium bovis subsp bovis AF2122/97
gcaucgucgucgcugccg

SEQ ID NO: 1113513 - RNA, 14 nt, Mycobacterium bovis subsp bovis AF2122/97
gcaucgucgccgcg

SEQ ID NO: 1113514 - RNA, 18 nt, Mycobacterium bovis subsp bovis AF2122/97
gcaucgucgacgcccgau

SEQ ID NO: 1113515 - RNA, 14 nt, Mycobacterium bovis subsp bovis AF2122/97
gcaucgucgccgag

SEQ ID NO: 1113516 - RNA, 16 nt, Mycobacterium bovis subsp bovis AF2122/97
gcaucgucgccgagcg

SEQ ID NO: 1113517 - RNA, 21 nt, Mycobacterium bovis subsp bovis AF2122/97
gcaucguuuucgccgaucccg

SEQ ID NO: 1113518 - RNA, 16 nt, Mycobacterium bovis subsp bovis AF2122/97
gcaucguuuucgccga

SEQ ID NO: 1113519 - RNA, 17 nt, Mycobacterium bovis subsp bovis AF2122/97
gcaucguuuucgccgau

SEQ ID NO: 1113520 - RNA, 20 nt, Mycobacterium bovis subsp bovis AF2122/97
gcaucuccgucggccaggcc

SEQ ID NO: 1113521 - RNA, 15 nt, Mycobacterium bovis subsp bovis AF2122/97
gcaucucggcggcca

SEQ ID NO: 1113522 - RNA, 17 nt, Mycobacterium bovis subsp bovis AF2122/97
gcaucucgucgaucucg

SEQ ID NO: 1113523 - RNA, 15 nt, Mycobacterium bovis subsp bovis AF2122/97
gcaucucgacaucgg

SEQ ID NO: 1113524 - RNA, 15 nt, Mycobacterium bovis subsp bovis AF2122/97
gcaucuccgucggcc

SEQ ID NO: 1113525 - RNA, 22 nt, Mycobacterium bovis subsp bovis AF2122/97
gcaucuagguucaguuccaccg

SEQ ID NO: 1113526 - RNA, 22 nt, Mycobacterium bovis subsp bovis AF2122/97
gcaucggagauacgggccaccg

SEQ ID NO: 1113527 - RNA, 14 nt, Mycobacterium bovis subsp bovis AF2122/97
gcaucgcggcggcg

SEQ ID NO: 1113528 - RNA, 22 nt, Mycobacterium bovis subsp bovis AF2122/97
gcaucgcugggcacucggcccg

SEQ ID NO: 1113529 - RNA, 15 nt, Mycobacterium bovis subsp bovis AF2122/97
gcaucggaaucgcga

SEQ ID NO: 1113530 - RNA, 15 nt, Mycobacterium bovis subsp bovis AF2122/97
gcaucggcagcagcg

SEQ ID NO: 1113531 - RNA, 16 nt, Mycobacterium bovis subsp bovis AF2122/97
gcaucggcagcagcgc

SEQ ID NO: 1113532 - RNA, 12 nt, Mycobacterium bovis subsp bovis AF2122/97
gcaucggcagcc

SEQ ID NO: 1113533 - RNA, 21 nt, Mycobacterium bovis subsp bovis AF2122/97
gcaucgcgggcggcgcuggcg

SEQ ID NO: 1113534 - RNA, 13 nt, Mycobacterium bovis subsp bovis AF2122/97
gcaucgcggccga

SEQ ID NO: 1113535 - RNA, 18 nt, Mycobacterium bovis subsp bovis AF2122/97
gcaucggcggcaacggcg

SEQ ID NO: 1113536 - RNA, 15 nt, Mycobacterium bovis subsp bovis AF2122/97
gcaucggcggcaagg

SEQ ID NO: 1113537 - RNA, 14 nt, Mycobacterium bovis subsp bovis AF2122/97
gcaucggcgguucc

SEQ ID NO: 1113538 - RNA, 21 nt, Mycobacterium bovis subsp bovis AF2122/97
gcaucggcggcgucuucgucg

SEQ ID NO: 1113539 - RNA, 22 nt, Mycobacterium bovis subsp bovis AF2122/97
gcaucggcggcgucuucgucgg

SEQ ID NO: 1113540 - RNA, 16 nt, Mycobacterium bovis subsp bovis AF2122/97
gcaucggcggggccca

SEQ ID NO: 1113541 - RNA, 14 nt, Mycobacterium bovis subsp bovis AF2122/97
gcaucggcggugaa

SEQ ID NO: 1113542 - RNA, 16 nt, Mycobacterium bovis subsp bovis AF2122/97
gcaucggccagcagcg

SEQ ID NO: 1113543 - RNA, 15 nt, Mycobacterium bovis subsp bovis AF2122/97
gcaucggccaucucg

SEQ ID NO: 1113544 - RNA, 14 nt, Mycobacterium bovis subsp bovis AF2122/97
gcaucggcgacgaa

SEQ ID NO: 1113545 - RNA, 19 nt, Mycobacterium bovis subsp bovis AF2122/97
gcaucgguucguagcgggc

SEQ ID NO: 1113546 - RNA, 15 nt, Mycobacterium bovis subsp bovis AF2122/97
gcaucgguggggcgc

SEQ ID NO: 1113547 - RNA, 21 nt, Mycobacterium bovis subsp bovis AF2122/97
gcaucggugguaacaccggcg

SEQ ID NO: 1113548 - RNA, 18 nt, Mycobacterium bovis subsp bovis AF2122/97
gcaucgucagcgaccacg

SEQ ID NO: 1113549 - RNA, 23 nt, Mycobacterium bovis subsp bovis AF2122/97
gcaucggugcgguucgcugcggc

SEQ ID NO: 1113550 - RNA, 13 nt, Mycobacterium bovis subsp bovis AF2122/97
gcaucguccacgc

SEQ ID NO: 1113551 - RNA, 14 nt, Mycobacterium bovis subsp bovis AF2122/97
gcaucguccacgca

SEQ ID NO: 1113552 - RNA, 19 nt, Mycobacterium bovis subsp bovis AF2122/97
gcaucgucgaauccucgcg

SEQ ID NO: 1113553 - RNA, 20 nt, Mycobacterium bovis subsp bovis AF2122/97
gcaucgucgaauccucgcga

SEQ ID NO: 1113554 - RNA, 20 nt, Mycobacterium bovis subsp bovis AF2122/97
gcaucgucgacgaugucggc

SEQ ID NO: 1113555 - RNA, 12 nt, Mycobacterium bovis subsp bovis AF2122/97
gcaucgucgccg

SEQ ID NO: 1113556 - RNA, 13 nt, Mycobacterium bovis subsp bovis AF2122/97
gcaucgucgccga

SEQ ID NO: 1113557 - RNA, 19 nt, Mycobacterium bovis subsp bovis AF2122/97
gcaucgggcgagcucgucg

SEQ ID NO: 1113558 - RNA, 15 nt, Mycobacterium bovis subsp bovis AF2122/97
gcaucggucaccgcg

SEQ ID NO: 1113559 - RNA, 14 nt, Mycobacterium bovis subsp bovis AF2122/97
gcaucggugcagcc

SEQ ID NO: 1113560 - RNA, 17 nt, Mycobacterium bovis subsp bovis AF2122/97
gcaucggucagcgccga

SEQ ID NO: 1113561 - RNA, 22 nt, Mycobacterium bovis subsp bovis AF2122/97
gcaucggugccacggcaccgaa

SEQ ID NO: 1113562 - RNA, 17 nt, Mycobacterium bovis subsp bovis AF2122/97
gcaucggucaccgcggc

SEQ ID NO: 1113563 - RNA, 18 nt, Mycobacterium bovis subsp bovis AF2122/97
gcaucggucagcgccgac

SEQ ID NO: 1113564 - RNA, 15 nt, Mycobacterium bovis subsp bovis AF2122/97
gcaucggucagcgcg

SEQ ID NO: 1113565 - RNA, 17 nt, Mycobacterium bovis subsp bovis AF2122/97
gcaucggucucgcacca

SEQ ID NO: 1113566 - RNA, 18 nt, Mycobacterium bovis subsp bovis AF2122/97
gcaucggucucgcaccag

SEQ ID NO: 1113567 - RNA, 14 nt, Mycobacterium bovis subsp bovis AF2122/97
gccggcgccggagc

SEQ ID NO: 1113568 - RNA, 21 nt, Mycobacterium bovis subsp bovis AF2122/97
gccggcgcgcaagugcuggcc

SEQ ID NO: 1113569 - RNA, 14 nt, Mycobacterium bovis subsp bovis AF2122/97
gccggcgcgcaccc

SEQ ID NO: 1113570 - RNA, 14 nt, Mycobacterium bovis subsp bovis AF2122/97
gccggcgcgagccg

SEQ ID NO: 1113571 - RNA, 17 nt, Mycobacterium bovis subsp bovis AF2122/97
gccggcgcgcaccccgg

SEQ ID NO: 1113572 - RNA, 13 nt, Mycobacterium bovis subsp bovis AF2122/97
gccggcgcgcccc

SEQ ID NO: 1113573 - RNA, 15 nt, Mycobacterium bovis subsp bovis AF2122/97
gccggcgcgccccac

SEQ ID NO: 1113574 - RNA, 16 nt, Mycobacterium bovis subsp bovis AF2122/97
gccggcgcgccccacc

SEQ ID NO: 1113575 - RNA, 12 nt, Mycobacterium bovis subsp bovis AF2122/97
gccggcgcggcg

SEQ ID NO: 1113576 - RNA, 16 nt, Mycobacterium bovis subsp bovis AF2122/97
gccggcgcggcggcgu

SEQ ID NO: 1113577 - RNA, 16 nt, Mycobacterium bovis subsp bovis AF2122/97
gccggcgcggcguaac

SEQ ID NO: 1113578 - RNA, 15 nt, Mycobacterium bovis subsp bovis AF2122/97
gccggcgcggcggcg

SEQ ID NO: 1113579 - RNA, 19 nt, Mycobacterium bovis subsp bovis AF2122/97
gccggcgcgccccaccgcg

SEQ ID NO: 1113580 - RNA, 13 nt, Mycobacterium bovis subsp bovis AF2122/97
gccggcgcgccgg

SEQ ID NO: 1113581 - RNA, 14 nt, Mycobacterium bovis subsp bovis AF2122/97
gccggcgcgccgga

SEQ ID NO: 1113582 - RNA, 21 nt, Mycobacterium bovis subsp bovis AF2122/97
gccggcgcguaguaaugcucg

SEQ ID NO: 1113583 - RNA, 15 nt, Mycobacterium bovis subsp bovis AF2122/97
gccggcgcggucucg

SEQ ID NO: 1113584 - RNA, 12 nt, Mycobacterium bovis subsp bovis AF2122/97
gccggcgcucgc

SEQ ID NO: 1113585 - RNA, 13 nt, Mycobacterium bovis subsp bovis AF2122/97
gccggcgcucgca

SEQ ID NO: 1113586 - RNA, 20 nt, Mycobacterium bovis subsp bovis AF2122/97
gccggcgcucgcggcggcgc

SEQ ID NO: 1113587 - RNA, 23 nt, Mycobacterium bovis subsp bovis AF2122/97
gccggcgcuggcgggcgaucgcg

SEQ ID NO: 1113588 - RNA, 22 nt, Mycobacterium bovis subsp bovis AF2122/97
gccggcggaaauggcgucgccg

SEQ ID NO: 1113589 - RNA, 21 nt, Mycobacterium bovis subsp bovis AF2122/97
gccggcggaagcggcggcccu

SEQ ID NO: 1113590 - RNA, 20 nt, Mycobacterium bovis subsp bovis AF2122/97
gccggcgcgcaccccggcau

SEQ ID NO: 1113591 - RNA, 19 nt, Mycobacterium bovis subsp bovis AF2122/97
gccggcgcugcccgggcug

SEQ ID NO: 1113592 - RNA, 22 nt, Mycobacterium bovis subsp bovis AF2122/97
gccggcggcaaagaacagccgg

SEQ ID NO: 1113593 - RNA, 18 nt, Mycobacterium bovis subsp bovis AF2122/97
gccggcggacgcccggcg

SEQ ID NO: 1113594 - RNA, 14 nt, Mycobacterium bovis subsp bovis AF2122/97
gccggcggccgcgg

SEQ ID NO: 1113595 - RNA, 15 nt, Mycobacterium bovis subsp bovis AF2122/97
gccggcggccgcggu

SEQ ID NO: 1113596 - RNA, 23 nt, Mycobacterium bovis subsp bovis AF2122/97
gccggcggccgcccagaugucuu

SEQ ID NO: 1113597 - RNA, 13 nt, Mycobacterium bovis subsp bovis AF2122/97
gccggcggcgacc

SEQ ID NO: 1113598 - RNA, 12 nt, Mycobacterium bovis subsp bovis AF2122/97
gccggcggcgac

SEQ ID NO: 1113599 - RNA, 13 nt, Mycobacterium bovis subsp bovis AF2122/97
gccggcggcgccc

SEQ ID NO: 1113600 - RNA, 15 nt, Mycobacterium bovis subsp bovis AF2122/97
gccggcggcgcccau

SEQ ID NO: 1113601 - RNA, 20 nt, Mycobacterium bovis subsp bovis AF2122/97
gccggcggcgcccaucgcga

SEQ ID NO: 1113602 - RNA, 18 nt, Mycobacterium bovis subsp bovis AF2122/97
gccggcggcggccgcagc

SEQ ID NO: 1113603 - RNA, 12 nt, Mycobacterium bovis subsp bovis AF2122/97
gccggcggcggc

SEQ ID NO: 1113604 - RNA, 14 nt, Mycobacterium bovis subsp bovis AF2122/97
gccggcggcgguac

SEQ ID NO: 1113605 - RNA, 17 nt, Mycobacterium bovis subsp bovis AF2122/97
gccggcggcggugcgcc

SEQ ID NO: 1113606 - RNA, 21 nt, Mycobacterium bovis subsp bovis AF2122/97
gccggcggcuguggucgcugc

SEQ ID NO: 1113607 - RNA, 18 nt, Mycobacterium bovis subsp bovis AF2122/97
gccggcgguagucggcca

SEQ ID NO: 1113608 - RNA, 19 nt, Mycobacterium bovis subsp bovis AF2122/97
gccggcgguagucggccag

SEQ ID NO: 1113609 - RNA, 15 nt, Mycobacterium bovis subsp bovis AF2122/97
gccggcgggccaccg

SEQ ID NO: 1113610 - RNA, 18 nt, Mycobacterium bovis subsp bovis AF2122/97
gccggcgggccugcccgg

SEQ ID NO: 1113611 - RNA, 23 nt, Mycobacterium bovis subsp bovis AF2122/97
gccggcgggcgagugucagcaga

SEQ ID NO: 1113612 - RNA, 17 nt, Mycobacterium bovis subsp bovis AF2122/97
gccggcggucagcagcg

SEQ ID NO: 1113613 - RNA, 14 nt, Mycobacterium bovis subsp bovis AF2122/97
gccggcgggcucgc

SEQ ID NO: 1113614 - RNA, 24 nt, Mycobacterium bovis subsp bovis AF2122/97
gccggcgggcucgcccgcuacggc

SEQ ID NO: 1113615 - RNA, 20 nt, Mycobacterium bovis subsp bovis AF2122/97
gccggcgguguuagcgcgaa

SEQ ID NO: 1113616 - RNA, 21 nt, Mycobacterium bovis subsp bovis AF2122/97
gccggcgguguuagcgcgaac

SEQ ID NO: 1113617 - RNA, 12 nt, Mycobacterium bovis subsp bovis AF2122/97
gccggcggucgc

SEQ ID NO: 1113618 - RNA, 23 nt, Mycobacterium bovis subsp bovis AF2122/97
gccggcgguagucggccagcucg

SEQ ID NO: 1113619 - RNA, 22 nt, Mycobacterium bovis subsp bovis AF2122/97
gccggcggugacggcggcaacg

SEQ ID NO: 1113620 - RNA, 15 nt, Mycobacterium bovis subsp bovis AF2122/97
gccggcguagaucau

SEQ ID NO: 1113621 - RNA, 13 nt, Mycobacterium bovis subsp bovis AF2122/97
gccggcgguggcc

SEQ ID NO: 1113622 - RNA, 13 nt, Mycobacterium bovis subsp bovis AF2122/97
gccggcggucgcg

SEQ ID NO: 1113623 - RNA, 15 nt, Mycobacterium bovis subsp bovis AF2122/97
gccggcguagcggcg

SEQ ID NO: 1113624 - RNA, 13 nt, Mycobacterium bovis subsp bovis AF2122/97
gccggcgucagcc

SEQ ID NO: 1113625 - RNA, 14 nt, Mycobacterium bovis subsp bovis AF2122/97
gccggcgucgauga

SEQ ID NO: 1113626 - RNA, 16 nt, Mycobacterium bovis subsp bovis AF2122/97
gccggcgucgagccgg

SEQ ID NO: 1113627 - RNA, 13 nt, Mycobacterium bovis subsp bovis AF2122/97
gccggcgucgagc

SEQ ID NO: 1113628 - RNA, 16 nt, Mycobacterium bovis subsp bovis AF2122/97
gccggcgucagccccg

SEQ ID NO: 1113629 - RNA, 14 nt, Mycobacterium bovis subsp bovis AF2122/97
gccggcgucggcgc

SEQ ID NO: 1113630 - RNA, 17 nt, Mycobacterium bovis subsp bovis AF2122/97
gccggcgucgcuggcca

SEQ ID NO: 1113631 - RNA, 12 nt, Mycobacterium bovis subsp bovis AF2122/97
gccggcgucggc

SEQ ID NO: 1113632 - RNA, 13 nt, Mycobacterium bovis subsp bovis AF2122/97
gccggcgucggcg

SEQ ID NO: 1113633 - RNA, 14 nt, Mycobacterium bovis subsp bovis AF2122/97
gccggcgucggcgu

SEQ ID NO: 1113634 - RNA, 17 nt, Mycobacterium bovis subsp bovis AF2122/97
gccggcgucggucgucg

SEQ ID NO: 1113635 - RNA, 15 nt, Mycobacterium bovis subsp bovis AF2122/97
gccggcgugccagca

SEQ ID NO: 1113636 - RNA, 13 nt, Mycobacterium bovis subsp bovis AF2122/97
gccggcgugcgcg

SEQ ID NO: 1113637 - RNA, 13 nt, Mycobacterium bovis subsp bovis AF2122/97
gccggcgugcggc

SEQ ID NO: 1113638 - RNA, 15 nt, Mycobacterium bovis subsp bovis AF2122/97
gccggcgugucgcgu

SEQ ID NO: 1113639 - RNA, 20 nt, Mycobacterium bovis subsp bovis AF2122/97
gccggcgugucgcgucgugc

SEQ ID NO: 1113640 - RNA, 15 nt, Mycobacterium bovis subsp bovis AF2122/97
gccggcguugccgaa

SEQ ID NO: 1113641 - RNA, 21 nt, Mycobacterium bovis subsp bovis AF2122/97
gccggcguugccgaaacccga

SEQ ID NO: 1113642 - RNA, 17 nt, Mycobacterium bovis subsp bovis AF2122/97
gccggcguugccgccgu

SEQ ID NO: 1113643 - RNA, 15 nt, Mycobacterium bovis subsp bovis AF2122/97
gccggcuaccgcgcu

SEQ ID NO: 1113644 - RNA, 21 nt, Mycobacterium bovis subsp bovis AF2122/97
gccggcuaccgcgcucccggc

SEQ ID NO: 1113645 - RNA, 22 nt, Mycobacterium bovis subsp bovis AF2122/97
gccggcuaccgcgcucccggcg

SEQ ID NO: 1113646 - RNA, 12 nt, Mycobacterium bovis subsp bovis AF2122/97
gccggcguuggc

SEQ ID NO: 1113647 - RNA, 22 nt, Mycobacterium bovis subsp bovis AF2122/97
gccggcguagcggcgauaccgg

SEQ ID NO: 1113648 - RNA, 22 nt, Mycobacterium bovis subsp bovis AF2122/97
gccggcuagggcagcagcccgg

SEQ ID NO: 1113649 - RNA, 19 nt, Mycobacterium bovis subsp bovis AF2122/97
gccggcuagggcccuggcg

SEQ ID NO: 1113650 - RNA, 21 nt, Mycobacterium bovis subsp bovis AF2122/97
gccggcuagggcccuggcggc

SEQ ID NO: 1113651 - RNA, 20 nt, Mycobacterium bovis subsp bovis AF2122/97
gccggcucaggugugugacg

SEQ ID NO: 1113652 - RNA, 19 nt, Mycobacterium bovis subsp bovis AF2122/97
gccggcuccgccacuggcg

SEQ ID NO: 1113653 - RNA, 13 nt, Mycobacterium bovis subsp bovis AF2122/97
gccggcuccgccg

SEQ ID NO: 1113654 - RNA, 16 nt, Mycobacterium bovis subsp bovis AF2122/97
gccggcuccgccguug

SEQ ID NO: 1113655 - RNA, 15 nt, Mycobacterium bovis subsp bovis AF2122/97
gccggcuccggauug

SEQ ID NO: 1113656 - RNA, 22 nt, Mycobacterium bovis subsp bovis AF2122/97
gccggcuccggauugcuguacu

SEQ ID NO: 1113657 - RNA, 15 nt, Mycobacterium bovis subsp bovis AF2122/97
gccggcuccggcggu

SEQ ID NO: 1113658 - RNA, 15 nt, Mycobacterium bovis subsp bovis AF2122/97
gccggcucgccggcg

SEQ ID NO: 1113659 - RNA, 16 nt, Mycobacterium bovis subsp bovis AF2122/97
gccggcucgccggcga

SEQ ID NO: 1113660 - RNA, 17 nt, Mycobacterium bovis subsp bovis AF2122/97
gccggcucgccggcgac

SEQ ID NO: 1113661 - RNA, 18 nt, Mycobacterium bovis subsp bovis AF2122/97
gccggcugacaacgacaa

SEQ ID NO: 1113662 - RNA, 20 nt, Mycobacterium bovis subsp bovis AF2122/97
gccggcugacaacgacaaca

SEQ ID NO: 1113663 - RNA, 17 nt, Mycobacterium bovis subsp bovis AF2122/97
gccggcugacgaccaac

SEQ ID NO: 1113664 - RNA, 23 nt, Mycobacterium bovis subsp bovis AF2122/97
gccggcugacgaccaaccaccga

SEQ ID NO: 1113665 - RNA, 19 nt, Mycobacterium bovis subsp bovis AF2122/97
gccgggaaaguuguaucgc

SEQ ID NO: 1113666 - RNA, 20 nt, Mycobacterium bovis subsp bovis AF2122/97
gccggcuuugagccgcucga

SEQ ID NO: 1113667 - RNA, 22 nt, Mycobacterium bovis subsp bovis AF2122/97
gccggcuuuuccacgaguccgc

SEQ ID NO: 1113668 - RNA, 17 nt, Mycobacterium bovis subsp bovis AF2122/97
gccgggaaccaacacca

SEQ ID NO: 1113669 - RNA, 19 nt, Mycobacterium bovis subsp bovis AF2122/97
gccgggaacgcugacgccc

SEQ ID NO: 1113670 - RNA, 15 nt, Mycobacterium bovis subsp bovis AF2122/97
gccgggaaacaccgg

SEQ ID NO: 1113671 - RNA, 13 nt, Mycobacterium bovis subsp bovis AF2122/97
gccgggaagccgc

SEQ ID NO: 1113672 - RNA, 16 nt, Mycobacterium bovis subsp bovis AF2122/97
gccggcuuugagccgc

SEQ ID NO: 1113673 - RNA, 21 nt, Mycobacterium bovis subsp bovis AF2122/97
gccggcuuggccuuugccguc

SEQ ID NO: 1113674 - RNA, 15 nt, Mycobacterium bovis subsp bovis AF2122/97
gccggcuugucgacc

SEQ ID NO: 1113675 - RNA, 24 nt, Mycobacterium bovis subsp bovis AF2122/97
gccggcuugucgaccacgaccguc

SEQ ID NO: 1113676 - RNA, 15 nt, Mycobacterium bovis subsp bovis AF2122/97
gccggcuggcggccu

SEQ ID NO: 1113677 - RNA, 15 nt, Mycobacterium bovis subsp bovis AF2122/97
gccggcuucggcgag

SEQ ID NO: 1113678 - RNA, 16 nt, Mycobacterium bovis subsp bovis AF2122/97
gccggcuucggcgagc

SEQ ID NO: 1113679 - RNA, 14 nt, Mycobacterium bovis subsp bovis AF2122/97
gccggcuucgguga

SEQ ID NO: 1113680 - RNA, 20 nt, Mycobacterium bovis subsp bovis AF2122/97
gccggcuucggugagcgggc

SEQ ID NO: 1113681 - RNA, 12 nt, Mycobacterium bovis subsp bovis AF2122/97
gccggcuucggc

SEQ ID NO: 1113682 - RNA, 21 nt, Mycobacterium bovis subsp bovis AF2122/97
gccggcuuaaggcccuggccg

SEQ ID NO: 1113683 - RNA, 12 nt, Mycobacterium bovis subsp bovis AF2122/97
gccggcccgcaa

SEQ ID NO: 1113684 - RNA, 20 nt, Mycobacterium bovis subsp bovis AF2122/97
gccggccccgccguuaccgc

SEQ ID NO: 1113685 - RNA, 21 nt, Mycobacterium bovis subsp bovis AF2122/97
gccggccacgucgaugugcgc

SEQ ID NO: 1113686 - RNA, 22 nt, Mycobacterium bovis subsp bovis AF2122/97
gccggcccggguaucgccagug

SEQ ID NO: 1113687 - RNA, 14 nt, Mycobacterium bovis subsp bovis AF2122/97
gccggcccgucgcg

SEQ ID NO: 1113688 - RNA, 15 nt, Mycobacterium bovis subsp bovis AF2122/97
gccggcccugcucgc

SEQ ID NO: 1113689 - RNA, 16 nt, Mycobacterium bovis subsp bovis AF2122/97
gccggcccugcucggc

SEQ ID NO: 1113690 - RNA, 18 nt, Mycobacterium bovis subsp bovis AF2122/97
gccggcccugcucggcca

SEQ ID NO: 1113691 - RNA, 21 nt, Mycobacterium bovis subsp bovis AF2122/97
gccggccgcacgccggccagc

SEQ ID NO: 1113692 - RNA, 13 nt, Mycobacterium bovis subsp bovis AF2122/97
gccggccgccgcg

SEQ ID NO: 1113693 - RNA, 14 nt, Mycobacterium bovis subsp bovis AF2122/97
gccggccgcgccgg

SEQ ID NO: 1113694 - RNA, 15 nt, Mycobacterium bovis subsp bovis AF2122/97
gccggccgcgccggc

SEQ ID NO: 1113695 - RNA, 15 nt, Mycobacterium bovis subsp bovis AF2122/97
gccggccgcggcggc

SEQ ID NO: 1113696 - RNA, 16 nt, Mycobacterium bovis subsp bovis AF2122/97
gccggccgcggcggcc

SEQ ID NO: 1113697 - RNA, 13 nt, Mycobacterium bovis subsp bovis AF2122/97
gccggccgcugcc

SEQ ID NO: 1113698 - RNA, 16 nt, Mycobacterium bovis subsp bovis AF2122/97
gccggccgcugccacu

SEQ ID NO: 1113699 - RNA, 20 nt, Mycobacterium bovis subsp bovis AF2122/97
gccggccgcgggucgcugcg

SEQ ID NO: 1113700 - RNA, 20 nt, Mycobacterium bovis subsp bovis AF2122/97
gccggccgcuuggccgcugc

SEQ ID NO: 1113701 - RNA, 18 nt, Mycobacterium bovis subsp bovis AF2122/97
gccggccggaacgcccgg

SEQ ID NO: 1113702 - RNA, 11 nt, Mycobacterium bovis subsp bovis AF2122/97
gccggccggcg

SEQ ID NO: 1113703 - RNA, 15 nt, Mycobacterium bovis subsp bovis AF2122/97
gccggccggcgcggu

SEQ ID NO: 1113704 - RNA, 14 nt, Mycobacterium bovis subsp bovis AF2122/97
gccggccggucagg

SEQ ID NO: 1113705 - RNA, 14 nt, Mycobacterium bovis subsp bovis AF2122/97
gccggccgucgauc

SEQ ID NO: 1113706 - RNA, 19 nt, Mycobacterium bovis subsp bovis AF2122/97
gccggccgucagcacaaac

SEQ ID NO: 1113707 - RNA, 17 nt, Mycobacterium bovis subsp bovis AF2122/97
gccggccguucgugggc

SEQ ID NO: 1113708 - RNA, 14 nt, Mycobacterium bovis subsp bovis AF2122/97
gccggccgucggcc

SEQ ID NO: 1113709 - RNA, 16 nt, Mycobacterium bovis subsp bovis AF2122/97
gccggccuaccgagcu

SEQ ID NO: 1113710 - RNA, 19 nt, Mycobacterium bovis subsp bovis AF2122/97
gccggccuaccgagcuacg

SEQ ID NO: 1113711 - RNA, 18 nt, Mycobacterium bovis subsp bovis AF2122/97
gccggccuagccgauggc

SEQ ID NO: 1113712 - RNA, 19 nt, Mycobacterium bovis subsp bovis AF2122/97
gccggccucgccgaagcgg

SEQ ID NO: 1113713 - RNA, 24 nt, Mycobacterium bovis subsp bovis AF2122/97
gccggccuccucgacgagucggcg

SEQ ID NO: 1113714 - RNA, 14 nt, Mycobacterium bovis subsp bovis AF2122/97
gccggccugcucgg

SEQ ID NO: 1113715 - RNA, 21 nt, Mycobacterium bovis subsp bovis AF2122/97
gccggccugucccgcacccgg

SEQ ID NO: 1113716 - RNA, 18 nt, Mycobacterium bovis subsp bovis AF2122/97
gccggccuugagcacccg

SEQ ID NO: 1113717 - RNA, 14 nt, Mycobacterium bovis subsp bovis AF2122/97
gccggccuggccgc

SEQ ID NO: 1113718 - RNA, 12 nt, Mycobacterium bovis subsp bovis AF2122/97
gccggcgauggc

SEQ ID NO: 1113719 - RNA, 14 nt, Mycobacterium bovis subsp bovis AF2122/97
gccggcgcaccaca

SEQ ID NO: 1113720 - RNA, 20 nt, Mycobacterium bovis subsp bovis AF2122/97
gccggcgcaccacaccacgg

SEQ ID NO: 1113721 - RNA, 21 nt, Mycobacterium bovis subsp bovis AF2122/97
gccggcgauguuggccagcgc

SEQ ID NO: 1113722 - RNA, 20 nt, Mycobacterium bovis subsp bovis AF2122/97
gccggcgauuaccggcacgc

SEQ ID NO: 1113723 - RNA, 12 nt, Mycobacterium bovis subsp bovis AF2122/97
gccggcgccacc

SEQ ID NO: 1113724 - RNA, 16 nt, Mycobacterium bovis subsp bovis AF2122/97
gccggcgccaccccca

SEQ ID NO: 1113725 - RNA, 22 nt, Mycobacterium bovis subsp bovis AF2122/97
gccggcgccacccccaccgucg

SEQ ID NO: 1113726 - RNA, 13 nt, Mycobacterium bovis subsp bovis AF2122/97
gccggcgccaccg

SEQ ID NO: 1113727 - RNA, 14 nt, Mycobacterium bovis subsp bovis AF2122/97
gccggcgccaccgu

SEQ ID NO: 1113728 - RNA, 20 nt, Mycobacterium bovis subsp bovis AF2122/97
gccggcgccaccgucgccgu

SEQ ID NO: 1113729 - RNA, 20 nt, Mycobacterium bovis subsp bovis AF2122/97
gccggcgccaccguugccga

SEQ ID NO: 1113730 - RNA, 17 nt, Mycobacterium bovis subsp bovis AF2122/97
gccggcgcccgccgcga

SEQ ID NO: 1113731 - RNA, 19 nt, Mycobacterium bovis subsp bovis AF2122/97
gccggcgcccgccgcgaac

SEQ ID NO: 1113732 - RNA, 19 nt, Mycobacterium bovis subsp bovis AF2122/97
gccggcgccagcgccgcca

SEQ ID NO: 1113733 - RNA, 20 nt, Mycobacterium bovis subsp bovis AF2122/97
gccggcgccagcgccgccac

SEQ ID NO: 1113734 - RNA, 19 nt, Mycobacterium bovis subsp bovis AF2122/97
gccggcgccagcagaucuc

SEQ ID NO: 1113735 - RNA, 12 nt, Mycobacterium bovis subsp bovis AF2122/97
gccggcgccgca

SEQ ID NO: 1113736 - RNA, 13 nt, Mycobacterium bovis subsp bovis AF2122/97
gccggcgccgcac

SEQ ID NO: 1113737 - RNA, 14 nt, Mycobacterium bovis subsp bovis AF2122/97
gccggcgccgccac

SEQ ID NO: 1113738 - RNA, 24 nt, Mycobacterium bovis subsp bovis AF2122/97
gccggcgccgccacugccggcagc

SEQ ID NO: 1113739 - RNA, 16 nt, Mycobacterium bovis subsp bovis AF2122/97
gccggcgccgccagca

SEQ ID NO: 1113740 - RNA, 17 nt, Mycobacterium bovis subsp bovis AF2122/97
gccggcgccgccagcac

SEQ ID NO: 1113741 - RNA, 21 nt, Mycobacterium bovis subsp bovis AF2122/97
gccggcgccgccagcaccacc

SEQ ID NO: 1113742 - RNA, 14 nt, Mycobacterium bovis subsp bovis AF2122/97
gccggcgccgccau

SEQ ID NO: 1113743 - RNA, 16 nt, Mycobacterium bovis subsp bovis AF2122/97
gccggcgcccggggcg

SEQ ID NO: 1113744 - RNA, 20 nt, Mycobacterium bovis subsp bovis AF2122/97
gccggcgcccggggcggugg

SEQ ID NO: 1113745 - RNA, 14 nt, Mycobacterium bovis subsp bovis AF2122/97
gccggcgcccaggc

SEQ ID NO: 1113746 - RNA, 20 nt, Mycobacterium bovis subsp bovis AF2122/97
gccggcgcccaggccgauca

SEQ ID NO: 1113747 - RNA, 13 nt, Mycobacterium bovis subsp bovis AF2122/97
gccggcgccgaac

SEQ ID NO: 1113748 - RNA, 14 nt, Mycobacterium bovis subsp bovis AF2122/97
gccggcgccgaaca

SEQ ID NO: 1113749 - RNA, 23 nt, Mycobacterium bovis subsp bovis AF2122/97
gccggcgccgaacaccucggcac

SEQ ID NO: 1113750 - RNA, 14 nt, Mycobacterium bovis subsp bovis AF2122/97
gccggcgccgccgg

SEQ ID NO: 1113751 - RNA, 16 nt, Mycobacterium bovis subsp bovis AF2122/97
gccggcgccgccgaug

SEQ ID NO: 1113752 - RNA, 13 nt, Mycobacterium bovis subsp bovis AF2122/97
gccggcgccgccc

SEQ ID NO: 1113753 - RNA, 16 nt, Mycobacterium bovis subsp bovis AF2122/97
gccggcgccgcccgcg

SEQ ID NO: 1113754 - RNA, 23 nt, Mycobacterium bovis subsp bovis AF2122/97
gccggcgccgcccgcgccgccgc

SEQ ID NO: 1113755 - RNA, 23 nt, Mycobacterium bovis subsp bovis AF2122/97
gccggcgccgcccuugccgccgg

SEQ ID NO: 1113756 - RNA, 14 nt, Mycobacterium bovis subsp bovis AF2122/97
gccggcgccgccga

SEQ ID NO: 1113757 - RNA, 15 nt, Mycobacterium bovis subsp bovis AF2122/97
gccggcgccgccggc

SEQ ID NO: 1113758 - RNA, 18 nt, Mycobacterium bovis subsp bovis AF2122/97
gccggcgccgccggugcc

SEQ ID NO: 1113759 - RNA, 21 nt, Mycobacterium bovis subsp bovis AF2122/97
gccggcgccgccggugccacc

SEQ ID NO: 1113760 - RNA, 14 nt, Mycobacterium bovis subsp bovis AF2122/97
gccggcgccgccgu

SEQ ID NO: 1113761 - RNA, 23 nt, Mycobacterium bovis subsp bovis AF2122/97
gccggcgccgccguuaccgccgg

SEQ ID NO: 1113762 - RNA, 16 nt, Mycobacterium bovis subsp bovis AF2122/97
gccggcgccgccguuc

SEQ ID NO: 1113763 - RNA, 14 nt, Mycobacterium bovis subsp bovis AF2122/97
gccggcgccggcgc

SEQ ID NO: 1113764 - RNA, 15 nt, Mycobacterium bovis subsp bovis AF2122/97
gccggcgccggugcc

SEQ ID NO: 1113765 - RNA, 16 nt, Mycobacterium bovis subsp bovis AF2122/97
gccggcgacgcuaccg

SEQ ID NO: 1113766 - RNA, 17 nt, Mycobacterium bovis subsp bovis AF2122/97
gccggcgacgcuaccgc

SEQ ID NO: 1113767 - RNA, 17 nt, Mycobacterium bovis subsp bovis AF2122/97
gccggcgaccgggaucg

SEQ ID NO: 1113768 - RNA, 23 nt, Mycobacterium bovis subsp bovis AF2122/97
gccggcgaccgggaucggcuccg

SEQ ID NO: 1113769 - RNA, 14 nt, Mycobacterium bovis subsp bovis AF2122/97
gccggcgacaccgc

SEQ ID NO: 1113770 - RNA, 15 nt, Mycobacterium bovis subsp bovis AF2122/97
gccggcgacaccgca

SEQ ID NO: 1113771 - RNA, 21 nt, Mycobacterium bovis subsp bovis AF2122/97
gccggcgaaugcgguccucga

SEQ ID NO: 1113772 - RNA, 22 nt, Mycobacterium bovis subsp bovis AF2122/97
gccggcgacaccgcaggugccg

SEQ ID NO: 1113773 - RNA, 15 nt, Mycobacterium bovis subsp bovis AF2122/97
gccggcgaccaaggc

SEQ ID NO: 1113774 - RNA, 20 nt, Mycobacterium bovis subsp bovis AF2122/97
gccggccuugugcucgaugc

SEQ ID NO: 1113775 - RNA, 13 nt, Mycobacterium bovis subsp bovis AF2122/97
gccggcgaacucg

SEQ ID NO: 1113776 - RNA, 21 nt, Mycobacterium bovis subsp bovis AF2122/97
gccggcgaacucgcgccgagc

SEQ ID NO: 1113777 - RNA, 16 nt, Mycobacterium bovis subsp bovis AF2122/97
gccggcgaaggccagc

SEQ ID NO: 1113778 - RNA, 20 nt, Mycobacterium bovis subsp bovis AF2122/97
gccggcgaagaccgccggga

SEQ ID NO: 1113779 - RNA, 18 nt, Mycobacterium bovis subsp bovis AF2122/97
gccggcgacggcgucacc

SEQ ID NO: 1113780 - RNA, 20 nt, Mycobacterium bovis subsp bovis AF2122/97
gccggcgacgggucgggcaa

SEQ ID NO: 1113781 - RNA, 18 nt, Mycobacterium bovis subsp bovis AF2122/97
gccggcgagagcgucaac

SEQ ID NO: 1113782 - RNA, 17 nt, Mycobacterium bovis subsp bovis AF2122/97
gccggcgagcaggccgu

SEQ ID NO: 1113783 - RNA, 18 nt, Mycobacterium bovis subsp bovis AF2122/97
gccggcgagggccacggc

SEQ ID NO: 1113784 - RNA, 17 nt, Mycobacterium bovis subsp bovis AF2122/97
gccggcgagggcgcgga

SEQ ID NO: 1113785 - RNA, 20 nt, Mycobacterium bovis subsp bovis AF2122/97
gccggcgagggugagcaugg

SEQ ID NO: 1113786 - RNA, 22 nt, Mycobacterium bovis subsp bovis AF2122/97
gccggcgagggugagcauggcu

SEQ ID NO: 1113787 - RNA, 14 nt, Mycobacterium bovis subsp bovis AF2122/97
gccgcgcucgccga

SEQ ID NO: 1113788 - RNA, 19 nt, Mycobacterium bovis subsp bovis AF2122/97
gccgcgcucgacgagcacg

SEQ ID NO: 1113789 - RNA, 23 nt, Mycobacterium bovis subsp bovis AF2122/97
gccgcgcucgacgagcacgccga

SEQ ID NO: 1113790 - RNA, 16 nt, Mycobacterium bovis subsp bovis AF2122/97
gccgcgcucgacgagc

SEQ ID NO: 1113791 - RNA, 21 nt, Mycobacterium bovis subsp bovis AF2122/97
gccgcgcucgaacuccccggu

SEQ ID NO: 1113792 - RNA, 13 nt, Mycobacterium bovis subsp bovis AF2122/97
gccgcgcucgacg

SEQ ID NO: 1113793 - RNA, 14 nt, Mycobacterium bovis subsp bovis AF2122/97
gccgcgcucgacga

SEQ ID NO: 1113794 - RNA, 17 nt, Mycobacterium bovis subsp bovis AF2122/97
gccgcggaggcggccag

SEQ ID NO: 1113795 - RNA, 18 nt, Mycobacterium bovis subsp bovis AF2122/97
gccgcggaggcggccagc

SEQ ID NO: 1113796 - RNA, 16 nt, Mycobacterium bovis subsp bovis AF2122/97
gccgcggagaaggcgc

SEQ ID NO: 1113797 - RNA, 16 nt, Mycobacterium bovis subsp bovis AF2122/97
gccgcggacguggucg

SEQ ID NO: 1113798 - RNA, 16 nt, Mycobacterium bovis subsp bovis AF2122/97
gccgcggacucgggca

SEQ ID NO: 1113799 - RNA, 21 nt, Mycobacterium bovis subsp bovis AF2122/97
gccgcggacucgggcaggccc

SEQ ID NO: 1113800 - RNA, 21 nt, Mycobacterium bovis subsp bovis AF2122/97
gccgcggacugguauucguuc

SEQ ID NO: 1113801 - RNA, 15 nt, Mycobacterium bovis subsp bovis AF2122/97
gccgcggacaccagg

SEQ ID NO: 1113802 - RNA, 21 nt, Mycobacterium bovis subsp bovis AF2122/97
gccgcggaucauccuucgccg

SEQ ID NO: 1113803 - RNA, 22 nt, Mycobacterium bovis subsp bovis AF2122/97
gccgcggaucauccuucgccgg

SEQ ID NO: 1113804 - RNA, 19 nt, Mycobacterium bovis subsp bovis AF2122/97
gccgcggaggcggccagcc

SEQ ID NO: 1113805 - RNA, 15 nt, Mycobacterium bovis subsp bovis AF2122/97
gccgcggagaaggcg

SEQ ID NO: 1113806 - RNA, 21 nt, Mycobacterium bovis subsp bovis AF2122/97
gccgcggcgccuccgcucggu

SEQ ID NO: 1113807 - RNA, 13 nt, Mycobacterium bovis subsp bovis AF2122/97
gccgcggcgccgg

SEQ ID NO: 1113808 - RNA, 17 nt, Mycobacterium bovis subsp bovis AF2122/97
gccgcggcgcccggcgg

SEQ ID NO: 1113809 - RNA, 18 nt, Mycobacterium bovis subsp bovis AF2122/97
gccgcggcgcccggcgga

SEQ ID NO: 1113810 - RNA, 18 nt, Mycobacterium bovis subsp bovis AF2122/97
gccgcggcggcagcggcg

SEQ ID NO: 1113811 - RNA, 15 nt, Mycobacterium bovis subsp bovis AF2122/97
gccgcggcggcagca

SEQ ID NO: 1113812 - RNA, 19 nt, Mycobacterium bovis subsp bovis AF2122/97
gccgcggcggaaggcgucg

SEQ ID NO: 1113813 - RNA, 19 nt, Mycobacterium bovis subsp bovis AF2122/97
gccgcggcggauggcgucg

SEQ ID NO: 1113814 - RNA, 17 nt, Mycobacterium bovis subsp bovis AF2122/97
gccgcgcgcucgagcag

SEQ ID NO: 1113815 - RNA, 18 nt, Mycobacterium bovis subsp bovis AF2122/97
gccgcgcgcugccgcugc

SEQ ID NO: 1113816 - RNA, 16 nt, Mycobacterium bovis subsp bovis AF2122/97
gccgcgcggaacaccg

SEQ ID NO: 1113817 - RNA, 15 nt, Mycobacterium bovis subsp bovis AF2122/97
gccgcgauccagcgc

SEQ ID NO: 1113818 - RNA, 23 nt, Mycobacterium bovis subsp bovis AF2122/97
gccgcgaucaguugcucguugug

SEQ ID NO: 1113819 - RNA, 14 nt, Mycobacterium bovis subsp bovis AF2122/97
gccgcgcggcgaca

SEQ ID NO: 1113820 - RNA, 15 nt, Mycobacterium bovis subsp bovis AF2122/97
gccgcgcggcgacag

SEQ ID NO: 1113821 - RNA, 23 nt, Mycobacterium bovis subsp bovis AF2122/97
gccgcgcggcgacagcuuggccg

SEQ ID NO: 1113822 - RNA, 13 nt, Mycobacterium bovis subsp bovis AF2122/97
gccgcgcggcgag

SEQ ID NO: 1113823 - RNA, 17 nt, Mycobacterium bovis subsp bovis AF2122/97
gccgcgcggacccagca

SEQ ID NO: 1113824 - RNA, 14 nt, Mycobacterium bovis subsp bovis AF2122/97
gccgcgcggcuugu

SEQ ID NO: 1113825 - RNA, 19 nt, Mycobacterium bovis subsp bovis AF2122/97
gccgcgcggcuuguaccgc

SEQ ID NO: 1113826 - RNA, 15 nt, Mycobacterium bovis subsp bovis AF2122/97
gccgcgcgggccgcc

SEQ ID NO: 1113827 - RNA, 18 nt, Mycobacterium bovis subsp bovis AF2122/97
gccgcgcggcggcgccgg

SEQ ID NO: 1113828 - RNA, 14 nt, Mycobacterium bovis subsp bovis AF2122/97
gccgcgcguucggc

SEQ ID NO: 1113829 - RNA, 18 nt, Mycobacterium bovis subsp bovis AF2122/97
gccgcgcuacgucaagcc

SEQ ID NO: 1113830 - RNA, 22 nt, Mycobacterium bovis subsp bovis AF2122/97
gccgcgcuacgucaagccgugc

SEQ ID NO: 1113831 - RNA, 23 nt, Mycobacterium bovis subsp bovis AF2122/97
gccgcgcuacgucaagccgugcu

SEQ ID NO: 1113832 - RNA, 16 nt, Mycobacterium bovis subsp bovis AF2122/97
gccgcgcuagcucggc

SEQ ID NO: 1113833 - RNA, 21 nt, Mycobacterium bovis subsp bovis AF2122/97
gccgcgcucaucgcggcgaac

SEQ ID NO: 1113834 - RNA, 21 nt, Mycobacterium bovis subsp bovis AF2122/97
gccgcgcggugauggucaccg

SEQ ID NO: 1113835 - RNA, 21 nt, Mycobacterium bovis subsp bovis AF2122/97
gccgcgcguccgggcagccgc

SEQ ID NO: 1113836 - RNA, 14 nt, Mycobacterium bovis subsp bovis AF2122/97
gccgcgcgucgcga

SEQ ID NO: 1113837 - RNA, 23 nt, Mycobacterium bovis subsp bovis AF2122/97
gccgcgcggggugcgcgcgacca

SEQ ID NO: 1113838 - RNA, 20 nt, Mycobacterium bovis subsp bovis AF2122/97
gccgcgcgguacugcgcagc

SEQ ID NO: 1113839 - RNA, 15 nt, Mycobacterium bovis subsp bovis AF2122/97
gccgcggcggccagc

SEQ ID NO: 1113840 - RNA, 19 nt, Mycobacterium bovis subsp bovis AF2122/97
gccgcggcuacaucggcgg

SEQ ID NO: 1113841 - RNA, 15 nt, Mycobacterium bovis subsp bovis AF2122/97
gccgcggcuaggcca

SEQ ID NO: 1113842 - RNA, 21 nt, Mycobacterium bovis subsp bovis AF2122/97
gccgcggcuaggccagcacgg

SEQ ID NO: 1113843 - RNA, 19 nt, Mycobacterium bovis subsp bovis AF2122/97
gccgcgggugaucugggcg

SEQ ID NO: 1113844 - RNA, 13 nt, Mycobacterium bovis subsp bovis AF2122/97
gccgcggcugggg

SEQ ID NO: 1113845 - RNA, 21 nt, Mycobacterium bovis subsp bovis AF2122/97
gccgcggcugggggauaccgc

SEQ ID NO: 1113846 - RNA, 20 nt, Mycobacterium bovis subsp bovis AF2122/97
gccgcggcuuccccgguagc

SEQ ID NO: 1113847 - RNA, 20 nt, Mycobacterium bovis subsp bovis AF2122/97
gccgcggcuugucgccccau

SEQ ID NO: 1113848 - RNA, 17 nt, Mycobacterium bovis subsp bovis AF2122/97
gccgcggcuccgagggc

SEQ ID NO: 1113849 - RNA, 22 nt, Mycobacterium bovis subsp bovis AF2122/97
gccgcggcuccgagggcugcgu

SEQ ID NO: 1113850 - RNA, 22 nt, Mycobacterium bovis subsp bovis AF2122/97
gccgcggcugccaucccgaucc

SEQ ID NO: 1113851 - RNA, 16 nt, Mycobacterium bovis subsp bovis AF2122/97
gccgcggucggccacc

SEQ ID NO: 1113852 - RNA, 19 nt, Mycobacterium bovis subsp bovis AF2122/97
gccgcggucggccaccaac

SEQ ID NO: 1113853 - RNA, 20 nt, Mycobacterium bovis subsp bovis AF2122/97
gccgcggucggccaccaacu

SEQ ID NO: 1113854 - RNA, 22 nt, Mycobacterium bovis subsp bovis AF2122/97
gccgcggucggccaccaacucg

SEQ ID NO: 1113855 - RNA, 14 nt, Mycobacterium bovis subsp bovis AF2122/97
gccgcggucggcga

SEQ ID NO: 1113856 - RNA, 21 nt, Mycobacterium bovis subsp bovis AF2122/97
gccgcggucgauguccgcagc

SEQ ID NO: 1113857 - RNA, 20 nt, Mycobacterium bovis subsp bovis AF2122/97
gccgcggucggcgacguaga

SEQ ID NO: 1113858 - RNA, 16 nt, Mycobacterium bovis subsp bovis AF2122/97
gccgcggguugggugu

SEQ ID NO: 1113859 - RNA, 14 nt, Mycobacterium bovis subsp bovis AF2122/97
gccgcggucggcgu

SEQ ID NO: 1113860 - RNA, 19 nt, Mycobacterium bovis subsp bovis AF2122/97
gccgcguagguggccagcg

SEQ ID NO: 1113861 - RNA, 21 nt, Mycobacterium bovis subsp bovis AF2122/97
gccgcguaggccuugcucagc

SEQ ID NO: 1113862 - RNA, 13 nt, Mycobacterium bovis subsp bovis AF2122/97
gccgcgucaaccg

SEQ ID NO: 1113863 - RNA, 14 nt, Mycobacterium bovis subsp bovis AF2122/97
gccgcgucaaccga

SEQ ID NO: 1113864 - RNA, 16 nt, Mycobacterium bovis subsp bovis AF2122/97
gccgcgucaaccgauc

SEQ ID NO: 1113865 - RNA, 18 nt, Mycobacterium bovis subsp bovis AF2122/97
gccgcgucaaccgaucgg

SEQ ID NO: 1113866 - RNA, 21 nt, Mycobacterium bovis subsp bovis AF2122/97
gccgcguugccggucgcaugg

SEQ ID NO: 1113867 - RNA, 18 nt, Mycobacterium bovis subsp bovis AF2122/97
gccgcugaauuggcgccg

SEQ ID NO: 1113868 - RNA, 16 nt, Mycobacterium bovis subsp bovis AF2122/97
gccgcugaauuggcgc

SEQ ID NO: 1113869 - RNA, 16 nt, Mycobacterium bovis subsp bovis AF2122/97
gccgcucuagcgucgu

SEQ ID NO: 1113870 - RNA, 19 nt, Mycobacterium bovis subsp bovis AF2122/97
gccgcugacuccugcggca

SEQ ID NO: 1113871 - RNA, 17 nt, Mycobacterium bovis subsp bovis AF2122/97
gccgcucgauggccuga

SEQ ID NO: 1113872 - RNA, 17 nt, Mycobacterium bovis subsp bovis AF2122/97
gccgcucgcacagccgc

SEQ ID NO: 1113873 - RNA, 14 nt, Mycobacterium bovis subsp bovis AF2122/97
gccgcucgauggcc

SEQ ID NO: 1113874 - RNA, 15 nt, Mycobacterium bovis subsp bovis AF2122/97
gccgcuccacguacg

SEQ ID NO: 1113875 - RNA, 24 nt, Mycobacterium bovis subsp bovis AF2122/97
gccgcuccacguacgcggcugcgu

SEQ ID NO: 1113876 - RNA, 21 nt, Mycobacterium bovis subsp bovis AF2122/97
gccgcucccgcacaagcccag

SEQ ID NO: 1113877 - RNA, 23 nt, Mycobacterium bovis subsp bovis AF2122/97
gccgcucccgcacaagcccagcc

SEQ ID NO: 1113878 - RNA, 13 nt, Mycobacterium bovis subsp bovis AF2122/97
gccgcuccaccac

SEQ ID NO: 1113879 - RNA, 15 nt, Mycobacterium bovis subsp bovis AF2122/97
gccgcuccaccacga

SEQ ID NO: 1113880 - RNA, 17 nt, Mycobacterium bovis subsp bovis AF2122/97
gccgcuagcggauucag

SEQ ID NO: 1113881 - RNA, 20 nt, Mycobacterium bovis subsp bovis AF2122/97
gccgcuccaaaagccucagc

SEQ ID NO: 1113882 - RNA, 15 nt, Mycobacterium bovis subsp bovis AF2122/97
gccgcuacgccggcc

SEQ ID NO: 1113883 - RNA, 21 nt, Mycobacterium bovis subsp bovis AF2122/97
gccgcuaccccagccggcagc

SEQ ID NO: 1113884 - RNA, 23 nt, Mycobacterium bovis subsp bovis AF2122/97
gccgcuaccccagccggcagcag

SEQ ID NO: 1113885 - RNA, 14 nt, Mycobacterium bovis subsp bovis AF2122/97
gccgcuacccccga

SEQ ID NO: 1113886 - RNA, 21 nt, Mycobacterium bovis subsp bovis AF2122/97
gccgcuaccgcccgcgccacc

SEQ ID NO: 1113887 - RNA, 20 nt, Mycobacterium bovis subsp bovis AF2122/97
gccgcguagugcuccguccg

SEQ ID NO: 1113888 - RNA, 13 nt, Mycobacterium bovis subsp bovis AF2122/97
gccgcuaccgaac

SEQ ID NO: 1113889 - RNA, 16 nt, Mycobacterium bovis subsp bovis AF2122/97
gccgcuaccgcccgcg

SEQ ID NO: 1113890 - RNA, 18 nt, Mycobacterium bovis subsp bovis AF2122/97
gccgcuaccgcccgcgcc

SEQ ID NO: 1113891 - RNA, 21 nt, Mycobacterium bovis subsp bovis AF2122/97
gccgcuaauggauccagcccg

SEQ ID NO: 1113892 - RNA, 20 nt, Mycobacterium bovis subsp bovis AF2122/97
gccggcaggaaacucagguc

SEQ ID NO: 1113893 - RNA, 15 nt, Mycobacterium bovis subsp bovis AF2122/97
gccggcagcggcgag

SEQ ID NO: 1113894 - RNA, 16 nt, Mycobacterium bovis subsp bovis AF2122/97
gccggauucuccgccc

SEQ ID NO: 1113895 - RNA, 12 nt, Mycobacterium bovis subsp bovis AF2122/97
gccggcaggguu

SEQ ID NO: 1113896 - RNA, 18 nt, Mycobacterium bovis subsp bovis AF2122/97
gccggcauaaaccgcguc

SEQ ID NO: 1113897 - RNA, 21 nt, Mycobacterium bovis subsp bovis AF2122/97
gccggcauaaaccgcguccgc

SEQ ID NO: 1113898 - RNA, 17 nt, Mycobacterium bovis subsp bovis AF2122/97
gccggcauacaccguga

SEQ ID NO: 1113899 - RNA, 14 nt, Mycobacterium bovis subsp bovis AF2122/97
gccggccaccagcc

SEQ ID NO: 1113900 - RNA, 16 nt, Mycobacterium bovis subsp bovis AF2122/97
gccggccaccagccgg

SEQ ID NO: 1113901 - RNA, 14 nt, Mycobacterium bovis subsp bovis AF2122/97
gccggccaccaccg

SEQ ID NO: 1113902 - RNA, 16 nt, Mycobacterium bovis subsp bovis AF2122/97
gccggccaccaccgcg

SEQ ID NO: 1113903 - RNA, 12 nt, Mycobacterium bovis subsp bovis AF2122/97
gccggccaccag

SEQ ID NO: 1113904 - RNA, 21 nt, Mycobacterium bovis subsp bovis AF2122/97
gccggccaacugggccgagcg

SEQ ID NO: 1113905 - RNA, 19 nt, Mycobacterium bovis subsp bovis AF2122/97
gccggcauagaucgggucg

SEQ ID NO: 1113906 - RNA, 14 nt, Mycobacterium bovis subsp bovis AF2122/97
gccggccaccaguc

SEQ ID NO: 1113907 - RNA, 14 nt, Mycobacterium bovis subsp bovis AF2122/97
gccggccaccguca

SEQ ID NO: 1113908 - RNA, 14 nt, Mycobacterium bovis subsp bovis AF2122/97
gccggccacgaguc

SEQ ID NO: 1113909 - RNA, 18 nt, Mycobacterium bovis subsp bovis AF2122/97
gccggccaccucggugcg

SEQ ID NO: 1113910 - RNA, 22 nt, Mycobacterium bovis subsp bovis AF2122/97
gccggccaccaguccgauggga

SEQ ID NO: 1113911 - RNA, 17 nt, Mycobacterium bovis subsp bovis AF2122/97
gccggccaccgucaccc

SEQ ID NO: 1113912 - RNA, 21 nt, Mycobacterium bovis subsp bovis AF2122/97
gccggccaccucggugcggaa

SEQ ID NO: 1113913 - RNA, 14 nt, Mycobacterium bovis subsp bovis AF2122/97
gccggccacgucga

SEQ ID NO: 1113914 - RNA, 22 nt, Mycobacterium bovis subsp bovis AF2122/97
gccggccaggcuauggugccgg

SEQ ID NO: 1113915 - RNA, 20 nt, Mycobacterium bovis subsp bovis AF2122/97
gccggccaggugacguucga

SEQ ID NO: 1113916 - RNA, 15 nt, Mycobacterium bovis subsp bovis AF2122/97
gccggccagucguac

SEQ ID NO: 1113917 - RNA, 18 nt, Mycobacterium bovis subsp bovis AF2122/97
gccggccauacgcgcgcg

SEQ ID NO: 1113918 - RNA, 15 nt, Mycobacterium bovis subsp bovis AF2122/97
gccggccaucgcccg

SEQ ID NO: 1113919 - RNA, 19 nt, Mycobacterium bovis subsp bovis AF2122/97
gccggcaaaggacgucgac

SEQ ID NO: 1113920 - RNA, 22 nt, Mycobacterium bovis subsp bovis AF2122/97
gccggcaaaggacgucgaccug

SEQ ID NO: 1113921 - RNA, 16 nt, Mycobacterium bovis subsp bovis AF2122/97
gccggcaccgccggcg

SEQ ID NO: 1113922 - RNA, 23 nt, Mycobacterium bovis subsp bovis AF2122/97
gccggcaccgccggcgccaccgu

SEQ ID NO: 1113923 - RNA, 20 nt, Mycobacterium bovis subsp bovis AF2122/97
gccggcaccgccggcgccca

SEQ ID NO: 1113924 - RNA, 20 nt, Mycobacterium bovis subsp bovis AF2122/97
gccggcaccgccgguggcgc

SEQ ID NO: 1113925 - RNA, 13 nt, Mycobacterium bovis subsp bovis AF2122/97
gccggcaccggcc

SEQ ID NO: 1113926 - RNA, 14 nt, Mycobacterium bovis subsp bovis AF2122/97
gccggcaccggggc

SEQ ID NO: 1113927 - RNA, 17 nt, Mycobacterium bovis subsp bovis AF2122/97
gccggcaccggggcugc

SEQ ID NO: 1113928 - RNA, 12 nt, Mycobacterium bovis subsp bovis AF2122/97
gccggcaccgua

SEQ ID NO: 1113929 - RNA, 13 nt, Mycobacterium bovis subsp bovis AF2122/97
gccggcaccguga

SEQ ID NO: 1113930 - RNA, 17 nt, Mycobacterium bovis subsp bovis AF2122/97
gccggcacgcaugccgg

SEQ ID NO: 1113931 - RNA, 15 nt, Mycobacterium bovis subsp bovis AF2122/97
gccggcacgcgcgcu

SEQ ID NO: 1113932 - RNA, 13 nt, Mycobacterium bovis subsp bovis AF2122/97
gccggcacgccga

SEQ ID NO: 1113933 - RNA, 16 nt, Mycobacterium bovis subsp bovis AF2122/97
gccggcacgccgaccg

SEQ ID NO: 1113934 - RNA, 17 nt, Mycobacterium bovis subsp bovis AF2122/97
gccggcacgccgaccgg

SEQ ID NO: 1113935 - RNA, 21 nt, Mycobacterium bovis subsp bovis AF2122/97
gccggcacgccgaccgguggc

SEQ ID NO: 1113936 - RNA, 13 nt, Mycobacterium bovis subsp bovis AF2122/97
gccggcagcgucc

SEQ ID NO: 1113937 - RNA, 16 nt, Mycobacterium bovis subsp bovis AF2122/97
gccggcagcggcgcgc

SEQ ID NO: 1113938 - RNA, 16 nt, Mycobacterium bovis subsp bovis AF2122/97
gccggauggucggcca

SEQ ID NO: 1113939 - RNA, 17 nt, Mycobacterium bovis subsp bovis AF2122/97
gccggaugucgacgagc

SEQ ID NO: 1113940 - RNA, 18 nt, Mycobacterium bovis subsp bovis AF2122/97
gccggaugucgacgagca

SEQ ID NO: 1113941 - RNA, 15 nt, Mycobacterium bovis subsp bovis AF2122/97
gccggauucgcccgg

SEQ ID NO: 1113942 - RNA, 22 nt, Mycobacterium bovis subsp bovis AF2122/97
gccggaucccugugccagcagc

SEQ ID NO: 1113943 - RNA, 15 nt, Mycobacterium bovis subsp bovis AF2122/97
gccggauccgauccg

SEQ ID NO: 1113944 - RNA, 19 nt, Mycobacterium bovis subsp bovis AF2122/97
gccggauacggcgacaccc

SEQ ID NO: 1113945 - RNA, 15 nt, Mycobacterium bovis subsp bovis AF2122/97
gccggauagcaccgg

SEQ ID NO: 1113946 - RNA, 20 nt, Mycobacterium bovis subsp bovis AF2122/97
gccggauagcaccggcaccc

SEQ ID NO: 1113947 - RNA, 14 nt, Mycobacterium bovis subsp bovis AF2122/97
gccggagagucggg

SEQ ID NO: 1113948 - RNA, 22 nt, Mycobacterium bovis subsp bovis AF2122/97
gccggacaacagagucaccgcg

SEQ ID NO: 1113949 - RNA, 15 nt, Mycobacterium bovis subsp bovis AF2122/97
gccggacaaccuggg

SEQ ID NO: 1113950 - RNA, 16 nt, Mycobacterium bovis subsp bovis AF2122/97
gccggacaaccugggg

SEQ ID NO: 1113951 - RNA, 23 nt, Mycobacterium bovis subsp bovis AF2122/97
gccggacaaccuggggccaccag

SEQ ID NO: 1113952 - RNA, 12 nt, Mycobacterium bovis subsp bovis AF2122/97
gccggagccggu

SEQ ID NO: 1113953 - RNA, 23 nt, Mycobacterium bovis subsp bovis AF2122/97
gccggagccggugccgacggcgc

SEQ ID NO: 1113954 - RNA, 23 nt, Mycobacterium bovis subsp bovis AF2122/97
gccggagccgcccaagccgccgg

SEQ ID NO: 1113955 - RNA, 16 nt, Mycobacterium bovis subsp bovis AF2122/97
gccggagccgccggcc

SEQ ID NO: 1113956 - RNA, 13 nt, Mycobacterium bovis subsp bovis AF2122/97
gccggagcgcacc

SEQ ID NO: 1113957 - RNA, 15 nt, Mycobacterium bovis subsp bovis AF2122/97
gccggagcgcaccug

SEQ ID NO: 1113958 - RNA, 15 nt, Mycobacterium bovis subsp bovis AF2122/97
gccggauacggcgac

SEQ ID NO: 1113959 - RNA, 20 nt, Mycobacterium bovis subsp bovis AF2122/97
gccggaaucgagacgguagc

SEQ ID NO: 1113960 - RNA, 14 nt, Mycobacterium bovis subsp bovis AF2122/97
gccggaauacccgc

SEQ ID NO: 1113961 - RNA, 15 nt, Mycobacterium bovis subsp bovis AF2122/97
gccggaauacaccag

SEQ ID NO: 1113962 - RNA, 15 nt, Mycobacterium bovis subsp bovis AF2122/97
gccggaacgcccggc

SEQ ID NO: 1113963 - RNA, 13 nt, Mycobacterium bovis subsp bovis AF2122/97
gccggaagcgccg

SEQ ID NO: 1113964 - RNA, 14 nt, Mycobacterium bovis subsp bovis AF2122/97
gccggaagcgccgg

SEQ ID NO: 1113965 - RNA, 15 nt, Mycobacterium bovis subsp bovis AF2122/97
gccggaagcgccggc

SEQ ID NO: 1113966 - RNA, 16 nt, Mycobacterium bovis subsp bovis AF2122/97
gccggaagcgccggcc

SEQ ID NO: 1113967 - RNA, 13 nt, Mycobacterium bovis subsp bovis AF2122/97
gccggaacgcccg

SEQ ID NO: 1113968 - RNA, 13 nt, Mycobacterium bovis subsp bovis AF2122/97
gccgcugcggcac

SEQ ID NO: 1113969 - RNA, 14 nt, Mycobacterium bovis subsp bovis AF2122/97
gccgcugcggcacc

SEQ ID NO: 1113970 - RNA, 16 nt, Mycobacterium bovis subsp bovis AF2122/97
gccgcuguugaucgac

SEQ ID NO: 1113971 - RNA, 14 nt, Mycobacterium bovis subsp bovis AF2122/97
gccgcugugggcga

SEQ ID NO: 1113972 - RNA, 20 nt, Mycobacterium bovis subsp bovis AF2122/97
gccgcugugggucgauccgg

SEQ ID NO: 1113973 - RNA, 18 nt, Mycobacterium bovis subsp bovis AF2122/97
gccgcugcgccgucgcag

SEQ ID NO: 1113974 - RNA, 14 nt, Mycobacterium bovis subsp bovis AF2122/97
gccgcugcgccagg

SEQ ID NO: 1113975 - RNA, 23 nt, Mycobacterium bovis subsp bovis AF2122/97
gccgcugagcccugcgccucggc

SEQ ID NO: 1113976 - RNA, 16 nt, Mycobacterium bovis subsp bovis AF2122/97
gccgcugccuuggcgc

SEQ ID NO: 1113977 - RNA, 21 nt, Mycobacterium bovis subsp bovis AF2122/97
gccgcugccuuggcgcggcac

SEQ ID NO: 1113978 - RNA, 23 nt, Mycobacterium bovis subsp bovis AF2122/97
gccgcugcgaaagcacgugcacg

SEQ ID NO: 1113979 - RNA, 11 nt, Mycobacterium bovis subsp bovis AF2122/97
gccgcugauca

SEQ ID NO: 1113980 - RNA, 19 nt, Mycobacterium bovis subsp bovis AF2122/97
gccgcugaucugccgccgc

SEQ ID NO: 1113981 - RNA, 22 nt, Mycobacterium bovis subsp bovis AF2122/97
gccgcugccgguggcggcggcg

SEQ ID NO: 1113982 - RNA, 15 nt, Mycobacterium bovis subsp bovis AF2122/97
gccgcugccuggccg

SEQ ID NO: 1113983 - RNA, 20 nt, Mycobacterium bovis subsp bovis AF2122/97
gccgcuguugaucgacaccg

SEQ ID NO: 1113984 - RNA, 22 nt, Mycobacterium bovis subsp bovis AF2122/97
gccgcuguugaucgacaccgag

SEQ ID NO: 1113985 - RNA, 17 nt, Mycobacterium bovis subsp bovis AF2122/97
gccgcuuagcaaucggc

SEQ ID NO: 1113986 - RNA, 15 nt, Mycobacterium bovis subsp bovis AF2122/97
gccgcuucaccccac

SEQ ID NO: 1113987 - RNA, 14 nt, Mycobacterium bovis subsp bovis AF2122/97
gccgcuuucgccgg

SEQ ID NO: 1113988 - RNA, 16 nt, Mycobacterium bovis subsp bovis AF2122/97
gccgcuuucgccggcg

SEQ ID NO: 1113989 - RNA, 20 nt, Mycobacterium bovis subsp bovis AF2122/97
gccgcuuucgccggcgccaa

SEQ ID NO: 1113990 - RNA, 18 nt, Mycobacterium bovis subsp bovis AF2122/97
gccgcuuucuuggcgggc

SEQ ID NO: 1113991 - RNA, 19 nt, Mycobacterium bovis subsp bovis AF2122/97
gccgcuuucuuggcgggcg

SEQ ID NO: 1113992 - RNA, 22 nt, Mycobacterium bovis subsp bovis AF2122/97
gccgcuuucuuggcgggcgccu

SEQ ID NO: 1113993 - RNA, 23 nt, Mycobacterium bovis subsp bovis AF2122/97
gccgcuuuucgauggugucgcgc

SEQ ID NO: 1113994 - RNA, 14 nt, Mycobacterium bovis subsp bovis AF2122/97
gccgcaggcgaaca

SEQ ID NO: 1113995 - RNA, 20 nt, Mycobacterium bovis subsp bovis AF2122/97
gccgcaggcuugccgauggc

SEQ ID NO: 1113996 - RNA, 21 nt, Mycobacterium bovis subsp bovis AF2122/97
gccgcaggcuugccgauggcg

SEQ ID NO: 1113997 - RNA, 22 nt, Mycobacterium bovis subsp bovis AF2122/97
gccgcaggcuugccgauggcgg

SEQ ID NO: 1113998 - RNA, 13 nt, Mycobacterium bovis subsp bovis AF2122/97
gccgcagggccgc

SEQ ID NO: 1113999 - RNA, 19 nt, Mycobacterium bovis subsp bovis AF2122/97
gccgcagcuuggccucagc

SEQ ID NO: 1114000 - RNA, 15 nt, Mycobacterium bovis subsp bovis AF2122/97
gccgcagcggcggca

SEQ ID NO: 1114001 - RNA, 17 nt, Mycobacterium bovis subsp bovis AF2122/97
gccgcagcggcggcaac

SEQ ID NO: 1114002 - RNA, 14 nt, Mycobacterium bovis subsp bovis AF2122/97
gccgcagcggcggc

SEQ ID NO: 1114003 - RNA, 13 nt, Mycobacterium bovis subsp bovis AF2122/97
gccgcagcggccu

SEQ ID NO: 1114004 - RNA, 12 nt, Mycobacterium bovis subsp bovis AF2122/97
gccgcagcggcg

SEQ ID NO: 1114005 - RNA, 18 nt, Mycobacterium bovis subsp bovis AF2122/97
gccgcagcgucguaaccg

SEQ ID NO: 1114006 - RNA, 18 nt, Mycobacterium bovis subsp bovis AF2122/97
gccgcagcggcggcaacc

SEQ ID NO: 1114007 - RNA, 14 nt, Mycobacterium bovis subsp bovis AF2122/97
gccgcaggugggcg

SEQ ID NO: 1114008 - RNA, 22 nt, Mycobacterium bovis subsp bovis AF2122/97
gccgcaggugggcguuggcgac

SEQ ID NO: 1114009 - RNA, 20 nt, Mycobacterium bovis subsp bovis AF2122/97
gccgcauaccaguaccguca

SEQ ID NO: 1114010 - RNA, 20 nt, Mycobacterium bovis subsp bovis AF2122/97
gccgcauccagccgugcggc

SEQ ID NO: 1114011 - RNA, 17 nt, Mycobacterium bovis subsp bovis AF2122/97
gccgcauaggccccgcc

SEQ ID NO: 1114012 - RNA, 22 nt, Mycobacterium bovis subsp bovis AF2122/97
gccgcauaggccccgccagcgc

SEQ ID NO: 1114013 - RNA, 14 nt, Mycobacterium bovis subsp bovis AF2122/97
gccgcaucacccgg

SEQ ID NO: 1114014 - RNA, 21 nt, Mycobacterium bovis subsp bovis AF2122/97
gccgcauccccgguacgucga

SEQ ID NO: 1114015 - RNA, 15 nt, Mycobacterium bovis subsp bovis AF2122/97
gccgcaucgcccaac

SEQ ID NO: 1114016 - RNA, 19 nt, Mycobacterium bovis subsp bovis AF2122/97
gccgccaacuccagcaccc

SEQ ID NO: 1114017 - RNA, 20 nt, Mycobacterium bovis subsp bovis AF2122/97
gccgccaacuccagcacccg

SEQ ID NO: 1114018 - RNA, 19 nt, Mycobacterium bovis subsp bovis AF2122/97
gccgccaacuucaccaccc

SEQ ID NO: 1114019 - RNA, 21 nt, Mycobacterium bovis subsp bovis AF2122/97
gccgccaacuucaccacccug

SEQ ID NO: 1114020 - RNA, 20 nt, Mycobacterium bovis subsp bovis AF2122/97
gccgccaagcucggccacca

SEQ ID NO: 1114021 - RNA, 15 nt, Mycobacterium bovis subsp bovis AF2122/97
gccgccaagcucggc

SEQ ID NO: 1114022 - RNA, 19 nt, Mycobacterium bovis subsp bovis AF2122/97
gccgccaagcucggccacc

SEQ ID NO: 1114023 - RNA, 12 nt, Mycobacterium bovis subsp bovis AF2122/97
gccgccacagca

SEQ ID NO: 1114024 - RNA, 17 nt, Mycobacterium bovis subsp bovis AF2122/97
gccgccacaaacccgau

SEQ ID NO: 1114025 - RNA, 18 nt, Mycobacterium bovis subsp bovis AF2122/97
gccgccacaccgccgcca

SEQ ID NO: 1114026 - RNA, 13 nt, Mycobacterium bovis subsp bovis AF2122/97
gccgccaccgcca

SEQ ID NO: 1114027 - RNA, 15 nt, Mycobacterium bovis subsp bovis AF2122/97
gccgccaccgccacc

SEQ ID NO: 1114028 - RNA, 11 nt, Mycobacterium bovis subsp bovis AF2122/97
gccgccaccgc

SEQ ID NO: 1114029 - RNA, 14 nt, Mycobacterium bovis subsp bovis AF2122/97
gccgccaccgcacg

SEQ ID NO: 1114030 - RNA, 18 nt, Mycobacterium bovis subsp bovis AF2122/97
gccgccaccgcacgcacg

SEQ ID NO: 1114031 - RNA, 15 nt, Mycobacterium bovis subsp bovis AF2122/97
gccgccacccgcaac

SEQ ID NO: 1114032 - RNA, 21 nt, Mycobacterium bovis subsp bovis AF2122/97
gccgccacccggcgggcggug

SEQ ID NO: 1114033 - RNA, 20 nt, Mycobacterium bovis subsp bovis AF2122/97
gccgccaccgaagccgccgg

SEQ ID NO: 1114034 - RNA, 19 nt, Mycobacterium bovis subsp bovis AF2122/97
gccgccaccacccaacagc

SEQ ID NO: 1114035 - RNA, 13 nt, Mycobacterium bovis subsp bovis AF2122/97
gccgccaccaccg

SEQ ID NO: 1114036 - RNA, 22 nt, Mycobacterium bovis subsp bovis AF2122/97
gccgccaccaccgcugccggcg

SEQ ID NO: 1114037 - RNA, 23 nt, Mycobacterium bovis subsp bovis AF2122/97
gccgccaccaccgcugccggcgc

SEQ ID NO: 1114038 - RNA, 21 nt, Mycobacterium bovis subsp bovis AF2122/97
gccgccaccaccggcgccucc

SEQ ID NO: 1114039 - RNA, 13 nt, Mycobacterium bovis subsp bovis AF2122/97
gccgccaccaggg

SEQ ID NO: 1114040 - RNA, 13 nt, Mycobacterium bovis subsp bovis AF2122/97
gccgccaccagcu

SEQ ID NO: 1114041 - RNA, 15 nt, Mycobacterium bovis subsp bovis AF2122/97
gccgccaccagcgca

SEQ ID NO: 1114042 - RNA, 16 nt, Mycobacterium bovis subsp bovis AF2122/97
gccgccaccagcgcac

SEQ ID NO: 1114043 - RNA, 23 nt, Mycobacterium bovis subsp bovis AF2122/97
gccgccaccagcgcacgcucggc

SEQ ID NO: 1114044 - RNA, 23 nt, Mycobacterium bovis subsp bovis AF2122/97
gccgcaugccaccgagcaaacac

SEQ ID NO: 1114045 - RNA, 15 nt, Mycobacterium bovis subsp bovis AF2122/97
gccgcaucgucgccg

SEQ ID NO: 1114046 - RNA, 21 nt, Mycobacterium bovis subsp bovis AF2122/97
gccgcaucguuuucgccgauc

SEQ ID NO: 1114047 - RNA, 13 nt, Mycobacterium bovis subsp bovis AF2122/97
gccgcaucggcga

SEQ ID NO: 1114048 - RNA, 13 nt, Mycobacterium bovis subsp bovis AF2122/97
gccgcaucggcgg

SEQ ID NO: 1114049 - RNA, 15 nt, Mycobacterium bovis subsp bovis AF2122/97
gccgcaucggcggug

SEQ ID NO: 1114050 - RNA, 18 nt, Mycobacterium bovis subsp bovis AF2122/97
gccgcaucggcggugaac

SEQ ID NO: 1114051 - RNA, 16 nt, Mycobacterium bovis subsp bovis AF2122/97
gccgcaucggauggcc

SEQ ID NO: 1114052 - RNA, 13 nt, Mycobacterium bovis subsp bovis AF2122/97
gccgcaucgguca

SEQ ID NO: 1114053 - RNA, 14 nt, Mycobacterium bovis subsp bovis AF2122/97
gccgcauucgcgac

SEQ ID NO: 1114054 - RNA, 19 nt, Mycobacterium bovis subsp bovis AF2122/97
gccgcauggugggugccgg

SEQ ID NO: 1114055 - RNA, 15 nt, Mycobacterium bovis subsp bovis AF2122/97
gccgcaugcgcuccg

SEQ ID NO: 1114056 - RNA, 20 nt, Mycobacterium bovis subsp bovis AF2122/97
gccgcaugcucagcaucguc

SEQ ID NO: 1114057 - RNA, 22 nt, Mycobacterium bovis subsp bovis AF2122/97
gccgcaucuggccggcgguguu

SEQ ID NO: 1114058 - RNA, 19 nt, Mycobacterium bovis subsp bovis AF2122/97
gccgcaucuugucgagcac

SEQ ID NO: 1114059 - RNA, 20 nt, Mycobacterium bovis subsp bovis AF2122/97
gccgcaucuugucgagcacc

SEQ ID NO: 1114060 - RNA, 15 nt, Mycobacterium bovis subsp bovis AF2122/97
gccgccaaagccggg

SEQ ID NO: 1114061 - RNA, 15 nt, Mycobacterium bovis subsp bovis AF2122/97
gccgcauucgcgaca

SEQ ID NO: 1114062 - RNA, 17 nt, Mycobacterium bovis subsp bovis AF2122/97
gccgcauucgcgacaac

SEQ ID NO: 1114063 - RNA, 20 nt, Mycobacterium bovis subsp bovis AF2122/97
gccgcauugcagaaccgcca

SEQ ID NO: 1114064 - RNA, 14 nt, Mycobacterium bovis subsp bovis AF2122/97
gccgcauuggcgac

SEQ ID NO: 1114065 - RNA, 18 nt, Mycobacterium bovis subsp bovis AF2122/97
gccgccagguccgccggu

SEQ ID NO: 1114066 - RNA, 11 nt, Mycobacterium bovis subsp bovis AF2122/97
gccgccaggcg

SEQ ID NO: 1114067 - RNA, 22 nt, Mycobacterium bovis subsp bovis AF2122/97
gccgccaguccgaucgccgagg

SEQ ID NO: 1114068 - RNA, 13 nt, Mycobacterium bovis subsp bovis AF2122/97
gccgccaguccgg

SEQ ID NO: 1114069 - RNA, 22 nt, Mycobacterium bovis subsp bovis AF2122/97
gccgccaguccggacggcagcc

SEQ ID NO: 1114070 - RNA, 14 nt, Mycobacterium bovis subsp bovis AF2122/97
gccgccagucgucc

SEQ ID NO: 1114071 - RNA, 15 nt, Mycobacterium bovis subsp bovis AF2122/97
gccgccagccccacc

SEQ ID NO: 1114072 - RNA, 20 nt, Mycobacterium bovis subsp bovis AF2122/97
gccgccagcccgucaucgcg

SEQ ID NO: 1114073 - RNA, 16 nt, Mycobacterium bovis subsp bovis AF2122/97
gccgccagcaccaccg

SEQ ID NO: 1114074 - RNA, 13 nt, Mycobacterium bovis subsp bovis AF2122/97
gccgccaccggcg

SEQ ID NO: 1114075 - RNA, 15 nt, Mycobacterium bovis subsp bovis AF2122/97
gccgccaccggcgac

SEQ ID NO: 1114076 - RNA, 14 nt, Mycobacterium bovis subsp bovis AF2122/97
gccgccaccggcgc

SEQ ID NO: 1114077 - RNA, 13 nt, Mycobacterium bovis subsp bovis AF2122/97
gccgccaccguca

SEQ ID NO: 1114078 - RNA, 17 nt, Mycobacterium bovis subsp bovis AF2122/97
gccgccaccgcugucga

SEQ ID NO: 1114079 - RNA, 13 nt, Mycobacterium bovis subsp bovis AF2122/97
gccgccaccgcga

SEQ ID NO: 1114080 - RNA, 12 nt, Mycobacterium bovis subsp bovis AF2122/97
gccgccaccgcg

SEQ ID NO: 1114081 - RNA, 18 nt, Mycobacterium bovis subsp bovis AF2122/97
gccgccaccgccaccgcg

SEQ ID NO: 1114082 - RNA, 23 nt, Mycobacterium bovis subsp bovis AF2122/97
gccgccaccgccaccgcggccug

SEQ ID NO: 1114083 - RNA, 16 nt, Mycobacterium bovis subsp bovis AF2122/97
gccgccacggaucgcg

SEQ ID NO: 1114084 - RNA, 21 nt, Mycobacterium bovis subsp bovis AF2122/97
gccgccacggaucgcggcggc

SEQ ID NO: 1114085 - RNA, 22 nt, Mycobacterium bovis subsp bovis AF2122/97
gccgccacggaucgcggcggcg

SEQ ID NO: 1114086 - RNA, 22 nt, Mycobacterium bovis subsp bovis AF2122/97
gccgccacgggcggccaccgca

SEQ ID NO: 1114087 - RNA, 20 nt, Mycobacterium bovis subsp bovis AF2122/97
gccgccaccgucaccgccgu

SEQ ID NO: 1114088 - RNA, 13 nt, Mycobacterium bovis subsp bovis AF2122/97
gccgccacgggcg

SEQ ID NO: 1114089 - RNA, 18 nt, Mycobacterium bovis subsp bovis AF2122/97
gccgccacgggcggccac

SEQ ID NO: 1114090 - RNA, 13 nt, Mycobacterium bovis subsp bovis AF2122/97
gccgccacgugug

SEQ ID NO: 1114091 - RNA, 21 nt, Mycobacterium bovis subsp bovis AF2122/97
gccgccacucgcccgcugccg

SEQ ID NO: 1114092 - RNA, 22 nt, Mycobacterium bovis subsp bovis AF2122/97
gccgccccgauaaaaaccaccc

SEQ ID NO: 1114093 - RNA, 15 nt, Mycobacterium bovis subsp bovis AF2122/97
gccgccccgcucggu

SEQ ID NO: 1114094 - RNA, 17 nt, Mycobacterium bovis subsp bovis AF2122/97
gccgcccccggcacagc

SEQ ID NO: 1114095 - RNA, 14 nt, Mycobacterium bovis subsp bovis AF2122/97
gccgcccccgccgg

SEQ ID NO: 1114096 - RNA, 22 nt, Mycobacterium bovis subsp bovis AF2122/97
gccgcccccgccggccgcgccg

SEQ ID NO: 1114097 - RNA, 17 nt, Mycobacterium bovis subsp bovis AF2122/97
gccgccccugcgcggcc

SEQ ID NO: 1114098 - RNA, 14 nt, Mycobacterium bovis subsp bovis AF2122/97
gccgccccggcgcu

SEQ ID NO: 1114099 - RNA, 22 nt, Mycobacterium bovis subsp bovis AF2122/97
gccgccccggcgcuggugcgcc

SEQ ID NO: 1114100 - RNA, 16 nt, Mycobacterium bovis subsp bovis AF2122/97
gccgcccgcccggacg

SEQ ID NO: 1114101 - RNA, 18 nt, Mycobacterium bovis subsp bovis AF2122/97
gccgcccgcccaccucga

SEQ ID NO: 1114102 - RNA, 21 nt, Mycobacterium bovis subsp bovis AF2122/97
gccgcccgcaucgcggcaucg

SEQ ID NO: 1114103 - RNA, 15 nt, Mycobacterium bovis subsp bovis AF2122/97
gccgcccgcagggcc

SEQ ID NO: 1114104 - RNA, 17 nt, Mycobacterium bovis subsp bovis AF2122/97
gccgcccaauccaccga

SEQ ID NO: 1114105 - RNA, 16 nt, Mycobacterium bovis subsp bovis AF2122/97
gccgccauugccauac

SEQ ID NO: 1114106 - RNA, 20 nt, Mycobacterium bovis subsp bovis AF2122/97
gccgcccaacgcgagcuuga

SEQ ID NO: 1114107 - RNA, 21 nt, Mycobacterium bovis subsp bovis AF2122/97
gccgccauugacgccguugcc

SEQ ID NO: 1114108 - RNA, 22 nt, Mycobacterium bovis subsp bovis AF2122/97
gccgccauugacgccguugccg

SEQ ID NO: 1114109 - RNA, 22 nt, Mycobacterium bovis subsp bovis AF2122/97
gccgccauugagcucccgcaac

SEQ ID NO: 1114110 - RNA, 22 nt, Mycobacterium bovis subsp bovis AF2122/97
gccgccauugccgccggugccg

SEQ ID NO: 1114111 - RNA, 18 nt, Mycobacterium bovis subsp bovis AF2122/97
gccgccauuggacagcgc

SEQ ID NO: 1114112 - RNA, 22 nt, Mycobacterium bovis subsp bovis AF2122/97
gccgccauuggacagcgcgaga

SEQ ID NO: 1114113 - RNA, 23 nt, Mycobacterium bovis subsp bovis AF2122/97
gccgccauuggcaggcauggcgc

SEQ ID NO: 1114114 - RNA, 18 nt, Mycobacterium bovis subsp bovis AF2122/97
gccgccauuccagccggu

SEQ ID NO: 1114115 - RNA, 19 nt, Mycobacterium bovis subsp bovis AF2122/97
gccgccauuccagccggug

SEQ ID NO: 1114116 - RNA, 22 nt, Mycobacterium bovis subsp bovis AF2122/97
gccgccauuccagccggugccg

SEQ ID NO: 1114117 - RNA, 15 nt, Mycobacterium bovis subsp bovis AF2122/97
gccgccauugacgaa

SEQ ID NO: 1114118 - RNA, 16 nt, Mycobacterium bovis subsp bovis AF2122/97
gccgccauugacgccg

SEQ ID NO: 1114119 - RNA, 19 nt, Mycobacterium bovis subsp bovis AF2122/97
gccgccauugacgccguug

SEQ ID NO: 1114120 - RNA, 16 nt, Mycobacterium bovis subsp bovis AF2122/97
gccgccaucucguagg

SEQ ID NO: 1114121 - RNA, 20 nt, Mycobacterium bovis subsp bovis AF2122/97
gccgccaugaaaucacccau

SEQ ID NO: 1114122 - RNA, 18 nt, Mycobacterium bovis subsp bovis AF2122/97
gccgccauaccucggcga

SEQ ID NO: 1114123 - RNA, 19 nt, Mycobacterium bovis subsp bovis AF2122/97
gccgccauaccucggcgac

SEQ ID NO: 1114124 - RNA, 23 nt, Mycobacterium bovis subsp bovis AF2122/97
gccgccauaccucggcgaccucc

SEQ ID NO: 1114125 - RNA, 19 nt, Mycobacterium bovis subsp bovis AF2122/97
gccgcccgcgccaccagca

SEQ ID NO: 1114126 - RNA, 16 nt, Mycobacterium bovis subsp bovis AF2122/97
gccgcccgcgccaccg

SEQ ID NO: 1114127 - RNA, 19 nt, Mycobacterium bovis subsp bovis AF2122/97
gccgcccgcgccaccgaua

SEQ ID NO: 1114128 - RNA, 15 nt, Mycobacterium bovis subsp bovis AF2122/97
gccgcccgcgccgcc

SEQ ID NO: 1114129 - RNA, 19 nt, Mycobacterium bovis subsp bovis AF2122/97
gccgcccgcgccgccgcca

SEQ ID NO: 1114130 - RNA, 15 nt, Mycobacterium bovis subsp bovis AF2122/97
gccgcccgcuccgcc

SEQ ID NO: 1114131 - RNA, 14 nt, Mycobacterium bovis subsp bovis AF2122/97
gccgcccucaccgc

SEQ ID NO: 1114132 - RNA, 16 nt, Mycobacterium bovis subsp bovis AF2122/97
gccgcccucaccgccu

SEQ ID NO: 1114133 - RNA, 18 nt, Mycobacterium bovis subsp bovis AF2122/97
gccgcccuggacgucggc

SEQ ID NO: 1114134 - RNA, 18 nt, Mycobacterium bovis subsp bovis AF2122/97
gccgcccuggccgccggc

SEQ ID NO: 1114135 - RNA, 19 nt, Mycobacterium bovis subsp bovis AF2122/97
gccgcccugguccaggccc

SEQ ID NO: 1114136 - RNA, 20 nt, Mycobacterium bovis subsp bovis AF2122/97
gccgcccuugauguccgcga

SEQ ID NO: 1114137 - RNA, 17 nt, Mycobacterium bovis subsp bovis AF2122/97
gccgcccuugccgccgg

SEQ ID NO: 1114138 - RNA, 17 nt, Mycobacterium bovis subsp bovis AF2122/97
gccgccgaugccaccgc

SEQ ID NO: 1114139 - RNA, 14 nt, Mycobacterium bovis subsp bovis AF2122/97
gccgccgaugccga

SEQ ID NO: 1114140 - RNA, 18 nt, Mycobacterium bovis subsp bovis AF2122/97
gccgccgcagcuccccga

SEQ ID NO: 1114141 - RNA, 15 nt, Mycobacterium bovis subsp bovis AF2122/97
gccgccgccaccacc

SEQ ID NO: 1114142 - RNA, 16 nt, Mycobacterium bovis subsp bovis AF2122/97
gccgccgccaccaccc

SEQ ID NO: 1114143 - RNA, 17 nt, Mycobacterium bovis subsp bovis AF2122/97
gccgccgccaccggcgc

SEQ ID NO: 1114144 - RNA, 19 nt, Mycobacterium bovis subsp bovis AF2122/97
gccgccgccuccgccgagg

SEQ ID NO: 1114145 - RNA, 15 nt, Mycobacterium bovis subsp bovis AF2122/97
gccgccgcgccggug

SEQ ID NO: 1114146 - RNA, 11 nt, Mycobacterium bovis subsp bovis AF2122/97
gccgccgcggc

SEQ ID NO: 1114147 - RNA, 19 nt, Mycobacterium bovis subsp bovis AF2122/97
gccgccgcggcagggcggu

SEQ ID NO: 1114148 - RNA, 22 nt, Mycobacterium bovis subsp bovis AF2122/97
gccgccgcuguugaucgacacc

SEQ ID NO: 1114149 - RNA, 24 nt, Mycobacterium bovis subsp bovis AF2122/97
gccgccggaagcgccggccgaucg

SEQ ID NO: 1114150 - RNA, 13 nt, Mycobacterium bovis subsp bovis AF2122/97
gccgccggaaucg

SEQ ID NO: 1114151 - RNA, 23 nt, Mycobacterium bovis subsp bovis AF2122/97
gccgccggcaacccagugucagc

SEQ ID NO: 1114152 - RNA, 13 nt, Mycobacterium bovis subsp bovis AF2122/97
gccgccggagauc

SEQ ID NO: 1114153 - RNA, 14 nt, Mycobacterium bovis subsp bovis AF2122/97
gccgccggacccgu

SEQ ID NO: 1114154 - RNA, 18 nt, Mycobacterium bovis subsp bovis AF2122/97
gccgccggaucgccacgg

SEQ ID NO: 1114155 - RNA, 19 nt, Mycobacterium bovis subsp bovis AF2122/97
gccgccggaucgccgguga

SEQ ID NO: 1114156 - RNA, 13 nt, Mycobacterium bovis subsp bovis AF2122/97
gccgccggcaccc

SEQ ID NO: 1114157 - RNA, 14 nt, Mycobacterium bovis subsp bovis AF2122/97
gccgccggcacccg

SEQ ID NO: 1114158 - RNA, 15 nt, Mycobacterium bovis subsp bovis AF2122/97
gccgccggcaccgcc

SEQ ID NO: 1114159 - RNA, 17 nt, Mycobacterium bovis subsp bovis AF2122/97
gccgccggcaccgccgg

SEQ ID NO: 1114160 - RNA, 15 nt, Mycobacterium bovis subsp bovis AF2122/97
gccgccggcaccggg

SEQ ID NO: 1114161 - RNA, 15 nt, Mycobacterium bovis subsp bovis AF2122/97
gccgccggcgcguag

SEQ ID NO: 1114162 - RNA, 13 nt, Mycobacterium bovis subsp bovis AF2122/97
gccgccggcgcug

SEQ ID NO: 1114163 - RNA, 19 nt, Mycobacterium bovis subsp bovis AF2122/97
gccgccggcgcugaucgcg

SEQ ID NO: 1114164 - RNA, 21 nt, Mycobacterium bovis subsp bovis AF2122/97
gccgccggcgcugaucgcgaa

SEQ ID NO: 1114165 - RNA, 16 nt, Mycobacterium bovis subsp bovis AF2122/97
gccgccggcgcuggcg

SEQ ID NO: 1114166 - RNA, 14 nt, Mycobacterium bovis subsp bovis AF2122/97
gccgccggcgccga

SEQ ID NO: 1114167 - RNA, 19 nt, Mycobacterium bovis subsp bovis AF2122/97
gccgccggcgccgcccgcg

SEQ ID NO: 1114168 - RNA, 16 nt, Mycobacterium bovis subsp bovis AF2122/97
gccgccggcgccgccg

SEQ ID NO: 1114169 - RNA, 17 nt, Mycobacterium bovis subsp bovis AF2122/97
gccgccggcgccgccgg

SEQ ID NO: 1114170 - RNA, 14 nt, Mycobacterium bovis subsp bovis AF2122/97
gccgccggcgccgg

SEQ ID NO: 1114171 - RNA, 15 nt, Mycobacterium bovis subsp bovis AF2122/97
gccgccggcgccgga

SEQ ID NO: 1114172 - RNA, 15 nt, Mycobacterium bovis subsp bovis AF2122/97
gccgccggcggcggu

SEQ ID NO: 1114173 - RNA, 23 nt, Mycobacterium bovis subsp bovis AF2122/97
gccgccgggaaauaucucgguga

SEQ ID NO: 1114174 - RNA, 15 nt, Mycobacterium bovis subsp bovis AF2122/97
gccgccggcuccacc

SEQ ID NO: 1114175 - RNA, 12 nt, Mycobacterium bovis subsp bovis AF2122/97
gccgccggcucg

SEQ ID NO: 1114176 - RNA, 22 nt, Mycobacterium bovis subsp bovis AF2122/97
gccgccggcucgccggcgaccg

SEQ ID NO: 1114177 - RNA, 21 nt, Mycobacterium bovis subsp bovis AF2122/97
gccgccgggaaauaucucggu

SEQ ID NO: 1114178 - RNA, 17 nt, Mycobacterium bovis subsp bovis AF2122/97
gccgccgggugcgccgu

SEQ ID NO: 1114179 - RNA, 13 nt, Mycobacterium bovis subsp bovis AF2122/97
gccgccggucauc

SEQ ID NO: 1114180 - RNA, 15 nt, Mycobacterium bovis subsp bovis AF2122/97
gccgccggugccgcc

SEQ ID NO: 1114181 - RNA, 21 nt, Mycobacterium bovis subsp bovis AF2122/97
gccgccggugccaccgacgcc

SEQ ID NO: 1114182 - RNA, 17 nt, Mycobacterium bovis subsp bovis AF2122/97
gccgccggugccaccgg

SEQ ID NO: 1114183 - RNA, 16 nt, Mycobacterium bovis subsp bovis AF2122/97
gccgccggugccaccc

SEQ ID NO: 1114184 - RNA, 17 nt, Mycobacterium bovis subsp bovis AF2122/97
gccgccggugccaccga

SEQ ID NO: 1114185 - RNA, 20 nt, Mycobacterium bovis subsp bovis AF2122/97
gccgccggugccaccgacgc

SEQ ID NO: 1114186 - RNA, 19 nt, Mycobacterium bovis subsp bovis AF2122/97
gccgccggugaggaucagc

SEQ ID NO: 1114187 - RNA, 21 nt, Mycobacterium bovis subsp bovis AF2122/97
gccgccgggugcgccguugcc

SEQ ID NO: 1114188 - RNA, 19 nt, Mycobacterium bovis subsp bovis AF2122/97
gccgccggugccgcccgag

SEQ ID NO: 1114189 - RNA, 17 nt, Mycobacterium bovis subsp bovis AF2122/97
gccgccggugccgccgg

SEQ ID NO: 1114190 - RNA, 21 nt, Mycobacterium bovis subsp bovis AF2122/97
gccgccgguguuagccccgaa

SEQ ID NO: 1114191 - RNA, 21 nt, Mycobacterium bovis subsp bovis AF2122/97
gccgccgguggugccggcgcc

SEQ ID NO: 1114192 - RNA, 22 nt, Mycobacterium bovis subsp bovis AF2122/97
gccgccgguggugccggcgccg

SEQ ID NO: 1114193 - RNA, 20 nt, Mycobacterium bovis subsp bovis AF2122/97
gccgccgguguaacccucga

SEQ ID NO: 1114194 - RNA, 21 nt, Mycobacterium bovis subsp bovis AF2122/97
gccgccguaacggucgcuguc

SEQ ID NO: 1114195 - RNA, 17 nt, Mycobacterium bovis subsp bovis AF2122/97
gccgccgucaccgccgu

SEQ ID NO: 1114196 - RNA, 14 nt, Mycobacterium bovis subsp bovis AF2122/97
gccgccgucgccgc

SEQ ID NO: 1114197 - RNA, 13 nt, Mycobacterium bovis subsp bovis AF2122/97
gccgccgucgccg

SEQ ID NO: 1114198 - RNA, 14 nt, Mycobacterium bovis subsp bovis AF2122/97
gccgccgucgccga

SEQ ID NO: 1114199 - RNA, 12 nt, Mycobacterium bovis subsp bovis AF2122/97
gccgccgucgcc

SEQ ID NO: 1114200 - RNA, 14 nt, Mycobacterium bovis subsp bovis AF2122/97
gccgccguccccgc

SEQ ID NO: 1114201 - RNA, 19 nt, Mycobacterium bovis subsp bovis AF2122/97
gccgccguccccgccgucg

SEQ ID NO: 1114202 - RNA, 20 nt, Mycobacterium bovis subsp bovis AF2122/97
gccgccguccccgccgucgc

SEQ ID NO: 1114203 - RNA, 16 nt, Mycobacterium bovis subsp bovis AF2122/97
gccgccguccagcgcc

SEQ ID NO: 1114204 - RNA, 15 nt, Mycobacterium bovis subsp bovis AF2122/97
gccgccguucccgcc

SEQ ID NO: 1114205 - RNA, 20 nt, Mycobacterium bovis subsp bovis AF2122/97
gccgccguucccgccggcgc

SEQ ID NO: 1114206 - RNA, 17 nt, Mycobacterium bovis subsp bovis AF2122/97
gccgccgucgccggugc

SEQ ID NO: 1114207 - RNA, 17 nt, Mycobacterium bovis subsp bovis AF2122/97
gccgccguucccaccac

SEQ ID NO: 1114208 - RNA, 18 nt, Mycobacterium bovis subsp bovis AF2122/97
gccgccguucccaccacc

SEQ ID NO: 1114209 - RNA, 19 nt, Mycobacterium bovis subsp bovis AF2122/97
gccgccguucccaccacca

SEQ ID NO: 1114210 - RNA, 15 nt, Mycobacterium bovis subsp bovis AF2122/97
gccgccguggugauc

SEQ ID NO: 1114211 - RNA, 17 nt, Mycobacterium bovis subsp bovis AF2122/97
gccgccguuaccgccgc

SEQ ID NO: 1114212 - RNA, 18 nt, Mycobacterium bovis subsp bovis AF2122/97
gccgccguuaccgccggc

SEQ ID NO: 1114213 - RNA, 20 nt, Mycobacterium bovis subsp bovis AF2122/97
gccgccguuaccgccggcgc

SEQ ID NO: 1114214 - RNA, 21 nt, Mycobacterium bovis subsp bovis AF2122/97
gccgccguuaccgccggcgcc

SEQ ID NO: 1114215 - RNA, 16 nt, Mycobacterium bovis subsp bovis AF2122/97
gccgcgacgcggcguc

SEQ ID NO: 1114216 - RNA, 14 nt, Mycobacterium bovis subsp bovis AF2122/97
gccgcgacgggcac

SEQ ID NO: 1114217 - RNA, 17 nt, Mycobacterium bovis subsp bovis AF2122/97
gccgcgacgggcacccg

SEQ ID NO: 1114218 - RNA, 21 nt, Mycobacterium bovis subsp bovis AF2122/97
gccgcgacgcacugccccgca

SEQ ID NO: 1114219 - RNA, 13 nt, Mycobacterium bovis subsp bovis AF2122/97
gccgcgacgacac

SEQ ID NO: 1114220 - RNA, 16 nt, Mycobacterium bovis subsp bovis AF2122/97
gccgcgacgacacgcc

SEQ ID NO: 1114221 - RNA, 12 nt, Mycobacterium bovis subsp bovis AF2122/97
gccgcgagcgcc

SEQ ID NO: 1114222 - RNA, 16 nt, Mycobacterium bovis subsp bovis AF2122/97
gccgcgagcgccggcc

SEQ ID NO: 1114223 - RNA, 19 nt, Mycobacterium bovis subsp bovis AF2122/97
gccgcgagcgccggccgcg

SEQ ID NO: 1114224 - RNA, 22 nt, Mycobacterium bovis subsp bovis AF2122/97
gccgcgagcgccggccgcggcg

SEQ ID NO: 1114225 - RNA, 17 nt, Mycobacterium bovis subsp bovis AF2122/97
gccgcgagccggugauc

SEQ ID NO: 1114226 - RNA, 15 nt, Mycobacterium bovis subsp bovis AF2122/97
gccgcgagcacgucg

SEQ ID NO: 1114227 - RNA, 16 nt, Mycobacterium bovis subsp bovis AF2122/97
gccgcgagcacgucgg

SEQ ID NO: 1114228 - RNA, 14 nt, Mycobacterium bovis subsp bovis AF2122/97
gccgcgagagccgg

SEQ ID NO: 1114229 - RNA, 12 nt, Mycobacterium bovis subsp bovis AF2122/97
gccgcgagcacg

SEQ ID NO: 1114230 - RNA, 22 nt, Mycobacterium bovis subsp bovis AF2122/97
gccgcgacgaugccucggcggc

SEQ ID NO: 1114231 - RNA, 20 nt, Mycobacterium bovis subsp bovis AF2122/97
gccgcgaggaugcugagcgc

SEQ ID NO: 1114232 - RNA, 18 nt, Mycobacterium bovis subsp bovis AF2122/97
gccgcgaguccaggcuga

SEQ ID NO: 1114233 - RNA, 22 nt, Mycobacterium bovis subsp bovis AF2122/97
gccgcgagguacccaucgucga

SEQ ID NO: 1114234 - RNA, 16 nt, Mycobacterium bovis subsp bovis AF2122/97
gccgccuccgccgagg

SEQ ID NO: 1114235 - RNA, 22 nt, Mycobacterium bovis subsp bovis AF2122/97
gccgccuccgccgaggccgccg

SEQ ID NO: 1114236 - RNA, 18 nt, Mycobacterium bovis subsp bovis AF2122/97
gccgccucgaucgacucg

SEQ ID NO: 1114237 - RNA, 23 nt, Mycobacterium bovis subsp bovis AF2122/97
gccgcgaccgcgaccgcauugag

SEQ ID NO: 1114238 - RNA, 23 nt, Mycobacterium bovis subsp bovis AF2122/97
gccgccguugccgucgucgccgu

SEQ ID NO: 1114239 - RNA, 22 nt, Mycobacterium bovis subsp bovis AF2122/97
gccgccguuggcucgagccgcc

SEQ ID NO: 1114240 - RNA, 20 nt, Mycobacterium bovis subsp bovis AF2122/97
gccgccucaaugaccaccgg

SEQ ID NO: 1114241 - RNA, 20 nt, Mycobacterium bovis subsp bovis AF2122/97
gccgccguugccgaucacca

SEQ ID NO: 1114242 - RNA, 14 nt, Mycobacterium bovis subsp bovis AF2122/97
gccgccguugccgc

SEQ ID NO: 1114243 - RNA, 15 nt, Mycobacterium bovis subsp bovis AF2122/97
gccgccguugccgcc

SEQ ID NO: 1114244 - RNA, 20 nt, Mycobacterium bovis subsp bovis AF2122/97
gccgccguugccgccaucac

SEQ ID NO: 1114245 - RNA, 17 nt, Mycobacterium bovis subsp bovis AF2122/97
gccgccguugccgccga

SEQ ID NO: 1114246 - RNA, 18 nt, Mycobacterium bovis subsp bovis AF2122/97
gccgccguugccgccggc

SEQ ID NO: 1114247 - RNA, 19 nt, Mycobacterium bovis subsp bovis AF2122/97
gccgccguugccgccggcg

SEQ ID NO: 1114248 - RNA, 22 nt, Mycobacterium bovis subsp bovis AF2122/97
gccgccguugccgccggcgccg

SEQ ID NO: 1114249 - RNA, 20 nt, Mycobacterium bovis subsp bovis AF2122/97
gccgccguugccgccguugc

SEQ ID NO: 1114250 - RNA, 21 nt, Mycobacterium bovis subsp bovis AF2122/97
gccgccguugccgccguugcc

SEQ ID NO: 1114251 - RNA, 22 nt, Mycobacterium bovis subsp bovis AF2122/97
gccgccguugccggcuuggccu

SEQ ID NO: 1114252 - RNA, 16 nt, Mycobacterium bovis subsp bovis AF2122/97
gccgccguugccgucg

SEQ ID NO: 1114253 - RNA, 21 nt, Mycobacterium bovis subsp bovis AF2122/97
gccgccguugccgucgucgcc

SEQ ID NO: 1114254 - RNA, 17 nt, Mycobacterium bovis subsp bovis AF2122/97
gccgagcuugucgagca

SEQ ID NO: 1114255 - RNA, 18 nt, Mycobacterium bovis subsp bovis AF2122/97
gccgagcuugucgagcag

SEQ ID NO: 1114256 - RNA, 20 nt, Mycobacterium bovis subsp bovis AF2122/97
gccgagcggaccaccgcucg

SEQ ID NO: 1114257 - RNA, 21 nt, Mycobacterium bovis subsp bovis AF2122/97
gccgagcggaccaccgcucgc

SEQ ID NO: 1114258 - RNA, 22 nt, Mycobacterium bovis subsp bovis AF2122/97
gccgagcggaccaccgcucgcc

SEQ ID NO: 1114259 - RNA, 21 nt, Mycobacterium bovis subsp bovis AF2122/97
gccgagcuugucgagcaggcc

SEQ ID NO: 1114260 - RNA, 14 nt, Mycobacterium bovis subsp bovis AF2122/97
gccgagcggcggca

SEQ ID NO: 1114261 - RNA, 23 nt, Mycobacterium bovis subsp bovis AF2122/97
gccgaggaaaucgcccucgucgc

SEQ ID NO: 1114262 - RNA, 23 nt, Mycobacterium bovis subsp bovis AF2122/97
gccgaggacuggaaagcagcagc

SEQ ID NO: 1114263 - RNA, 17 nt, Mycobacterium bovis subsp bovis AF2122/97
gccgaggaccagaggcg

SEQ ID NO: 1114264 - RNA, 16 nt, Mycobacterium bovis subsp bovis AF2122/97
gccgaggacgccggcg

SEQ ID NO: 1114265 - RNA, 21 nt, Mycobacterium bovis subsp bovis AF2122/97
gccgaggacuggaaagcagca

SEQ ID NO: 1114266 - RNA, 23 nt, Mycobacterium bovis subsp bovis AF2122/97
gccgaggaauacucucgcgacau

SEQ ID NO: 1114267 - RNA, 15 nt, Mycobacterium bovis subsp bovis AF2122/97
gccgagggcuugcac

SEQ ID NO: 1114268 - RNA, 14 nt, Mycobacterium bovis subsp bovis AF2122/97
gccgaggucgcccg

SEQ ID NO: 1114269 - RNA, 14 nt, Mycobacterium bovis subsp bovis AF2122/97
gccgagugcccagc

SEQ ID NO: 1114270 - RNA, 17 nt, Mycobacterium bovis subsp bovis AF2122/97
gccgaguggccgcauua

SEQ ID NO: 1114271 - RNA, 21 nt, Mycobacterium bovis subsp bovis AF2122/97
gccgagugugacuaccgagac

SEQ ID NO: 1114272 - RNA, 22 nt, Mycobacterium bovis subsp bovis AF2122/97
gccgagugugacuaccgagacg

SEQ ID NO: 1114273 - RNA, 16 nt, Mycobacterium bovis subsp bovis AF2122/97
gccgaguucgucagcg

SEQ ID NO: 1114274 - RNA, 14 nt, Mycobacterium bovis subsp bovis AF2122/97
gccgaguugaccgc

SEQ ID NO: 1114275 - RNA, 15 nt, Mycobacterium bovis subsp bovis AF2122/97
gccgaguugaccgcc

SEQ ID NO: 1114276 - RNA, 22 nt, Mycobacterium bovis subsp bovis AF2122/97
gccgaguugcccgggucggccg

SEQ ID NO: 1114277 - RNA, 23 nt, Mycobacterium bovis subsp bovis AF2122/97
gccgaguugcccgggucggccgg

SEQ ID NO: 1114278 - RNA, 20 nt, Mycobacterium bovis subsp bovis AF2122/97
gccgaggucgaaccgccggc

SEQ ID NO: 1114279 - RNA, 15 nt, Mycobacterium bovis subsp bovis AF2122/97
gccgagggcgccggg

SEQ ID NO: 1114280 - RNA, 18 nt, Mycobacterium bovis subsp bovis AF2122/97
gccgagggcgccgggggc

SEQ ID NO: 1114281 - RNA, 18 nt, Mycobacterium bovis subsp bovis AF2122/97
gccgaucgcggcggccuc

SEQ ID NO: 1114282 - RNA, 15 nt, Mycobacterium bovis subsp bovis AF2122/97
gccgaucgcuccggc

SEQ ID NO: 1114283 - RNA, 14 nt, Mycobacterium bovis subsp bovis AF2122/97
gccgaucggcaccg

SEQ ID NO: 1114284 - RNA, 16 nt, Mycobacterium bovis subsp bovis AF2122/97
gccgaucggcaccgug

SEQ ID NO: 1114285 - RNA, 23 nt, Mycobacterium bovis subsp bovis AF2122/97
gccgaucggcaccgugucgacgg

SEQ ID NO: 1114286 - RNA, 13 nt, Mycobacterium bovis subsp bovis AF2122/97
gccgaucggccgg

SEQ ID NO: 1114287 - RNA, 17 nt, Mycobacterium bovis subsp bovis AF2122/97
gccgaucgggcucacuc

SEQ ID NO: 1114288 - RNA, 15 nt, Mycobacterium bovis subsp bovis AF2122/97
gccgaucgucucggc

SEQ ID NO: 1114289 - RNA, 13 nt, Mycobacterium bovis subsp bovis AF2122/97
gccgaucggugcc

SEQ ID NO: 1114290 - RNA, 12 nt, Mycobacterium bovis subsp bovis AF2122/97
gccgaucggugc

SEQ ID NO: 1114291 - RNA, 16 nt, Mycobacterium bovis subsp bovis AF2122/97
gccgaucugcucgccg

SEQ ID NO: 1114292 - RNA, 22 nt, Mycobacterium bovis subsp bovis AF2122/97
gccgaucugcucgccgagcucg

SEQ ID NO: 1114293 - RNA, 20 nt, Mycobacterium bovis subsp bovis AF2122/97
gccgaucucgcccagcgagc

SEQ ID NO: 1114294 - RNA, 15 nt, Mycobacterium bovis subsp bovis AF2122/97
gccgaucugcugcag

SEQ ID NO: 1114295 - RNA, 17 nt, Mycobacterium bovis subsp bovis AF2122/97
gccgaucucuccggcgg

SEQ ID NO: 1114296 - RNA, 14 nt, Mycobacterium bovis subsp bovis AF2122/97
gccgaucugcucgc

SEQ ID NO: 1114297 - RNA, 13 nt, Mycobacterium bovis subsp bovis AF2122/97
gccgaugaucgaa

SEQ ID NO: 1114298 - RNA, 17 nt, Mycobacterium bovis subsp bovis AF2122/97
gccgaugaugcggcgca

SEQ ID NO: 1114299 - RNA, 18 nt, Mycobacterium bovis subsp bovis AF2122/97
gccgaugaugcggcgcag

SEQ ID NO: 1114300 - RNA, 19 nt, Mycobacterium bovis subsp bovis AF2122/97
gccgaugaugcggcgcagc

SEQ ID NO: 1114301 - RNA, 19 nt, Mycobacterium bovis subsp bovis AF2122/97
gccgaugaugugcggugac

SEQ ID NO: 1114302 - RNA, 14 nt, Mycobacterium bovis subsp bovis AF2122/97
gccgaucacggcac

SEQ ID NO: 1114303 - RNA, 16 nt, Mycobacterium bovis subsp bovis AF2122/97
gccgaucacggcaccg

SEQ ID NO: 1114304 - RNA, 13 nt, Mycobacterium bovis subsp bovis AF2122/97
gccgaucacgggc

SEQ ID NO: 1114305 - RNA, 21 nt, Mycobacterium bovis subsp bovis AF2122/97
gccgaucacggugggcgccga

SEQ ID NO: 1114306 - RNA, 17 nt, Mycobacterium bovis subsp bovis AF2122/97
gccgaucagcaguggga

SEQ ID NO: 1114307 - RNA, 15 nt, Mycobacterium bovis subsp bovis AF2122/97
gccgaucagcccggc

SEQ ID NO: 1114308 - RNA, 19 nt, Mycobacterium bovis subsp bovis AF2122/97
gccgaucagcccggccuug

SEQ ID NO: 1114309 - RNA, 14 nt, Mycobacterium bovis subsp bovis AF2122/97
gccgaucagcgaac

SEQ ID NO: 1114310 - RNA, 21 nt, Mycobacterium bovis subsp bovis AF2122/97
gccgaucagcgaaccaccggc

SEQ ID NO: 1114311 - RNA, 21 nt, Mycobacterium bovis subsp bovis AF2122/97
gccgaucaccgcaucggugcc

SEQ ID NO: 1114312 - RNA, 16 nt, Mycobacterium bovis subsp bovis AF2122/97
gccgauaccggcggcg

SEQ ID NO: 1114313 - RNA, 20 nt, Mycobacterium bovis subsp bovis AF2122/97
gccgauaccggcggcgagcg

SEQ ID NO: 1114314 - RNA, 19 nt, Mycobacterium bovis subsp bovis AF2122/97
gccgauacgaagccgccgc

SEQ ID NO: 1114315 - RNA, 13 nt, Mycobacterium bovis subsp bovis AF2122/97
gccgaggucgcgg

SEQ ID NO: 1114316 - RNA, 14 nt, Mycobacterium bovis subsp bovis AF2122/97
gccgauaccgccgg

SEQ ID NO: 1114317 - RNA, 17 nt, Mycobacterium bovis subsp bovis AF2122/97
gccgauaccgccggccc

SEQ ID NO: 1114318 - RNA, 16 nt, Mycobacterium bovis subsp bovis AF2122/97
gccgauuccaccgccg

SEQ ID NO: 1114319 - RNA, 13 nt, Mycobacterium bovis subsp bovis AF2122/97
gccgauuccgcgc

SEQ ID NO: 1114320 - RNA, 22 nt, Mycobacterium bovis subsp bovis AF2122/97
gccgauuccgcgcguccgucgg

SEQ ID NO: 1114321 - RNA, 21 nt, Mycobacterium bovis subsp bovis AF2122/97
gccgauuacggugaucgccgg

SEQ ID NO: 1114322 - RNA, 14 nt, Mycobacterium bovis subsp bovis AF2122/97
gccgauucgccguc

SEQ ID NO: 1114323 - RNA, 15 nt, Mycobacterium bovis subsp bovis AF2122/97
gccgcaaacgcggcg

SEQ ID NO: 1114324 - RNA, 17 nt, Mycobacterium bovis subsp bovis AF2122/97
gccgcaaccggcgaucg

SEQ ID NO: 1114325 - RNA, 22 nt, Mycobacterium bovis subsp bovis AF2122/97
gccgcaacaccccccguccacc

SEQ ID NO: 1114326 - RNA, 23 nt, Mycobacterium bovis subsp bovis AF2122/97
gccgcaacaccccccguccaccg

SEQ ID NO: 1114327 - RNA, 15 nt, Mycobacterium bovis subsp bovis AF2122/97
gccgcaaccggcgau

SEQ ID NO: 1114328 - RNA, 17 nt, Mycobacterium bovis subsp bovis AF2122/97
gccgauguggucggcug

SEQ ID NO: 1114329 - RNA, 19 nt, Mycobacterium bovis subsp bovis AF2122/97
gccgauguggucggcuguc

SEQ ID NO: 1114330 - RNA, 15 nt, Mycobacterium bovis subsp bovis AF2122/97
gccgaugugggcgga

SEQ ID NO: 1114331 - RNA, 13 nt, Mycobacterium bovis subsp bovis AF2122/97
gccgaugccggcg

SEQ ID NO: 1114332 - RNA, 15 nt, Mycobacterium bovis subsp bovis AF2122/97
gccgaugccggcgag

SEQ ID NO: 1114333 - RNA, 18 nt, Mycobacterium bovis subsp bovis AF2122/97
gccgaugccggcgagggc

SEQ ID NO: 1114334 - RNA, 19 nt, Mycobacterium bovis subsp bovis AF2122/97
gccgauguggccggcgaug

SEQ ID NO: 1114335 - RNA, 12 nt, Mycobacterium bovis subsp bovis AF2122/97
gccgaugccgau

SEQ ID NO: 1114336 - RNA, 23 nt, Mycobacterium bovis subsp bovis AF2122/97
gccgauguguggaacauccgcac

SEQ ID NO: 1114337 - RNA, 22 nt, Mycobacterium bovis subsp bovis AF2122/97
gccgauguuguugacgcccgag

SEQ ID NO: 1114338 - RNA, 16 nt, Mycobacterium bovis subsp bovis AF2122/97
gccgauuacggugauc

SEQ ID NO: 1114339 - RNA, 17 nt, Mycobacterium bovis subsp bovis AF2122/97
gccgauuacggugaucg

SEQ ID NO: 1114340 - RNA, 21 nt, Mycobacterium bovis subsp bovis AF2122/97
gccgaugcccaucacgcccca

SEQ ID NO: 1114341 - RNA, 18 nt, Mycobacterium bovis subsp bovis AF2122/97
gccgaugcccgacaccgc

SEQ ID NO: 1114342 - RNA, 12 nt, Mycobacterium bovis subsp bovis AF2122/97
gccgaugccacc

SEQ ID NO: 1114343 - RNA, 20 nt, Mycobacterium bovis subsp bovis AF2122/97
gccgaugcccaggaucacgg

SEQ ID NO: 1114344 - RNA, 13 nt, Mycobacterium bovis subsp bovis AF2122/97
gccgcagaugggc

SEQ ID NO: 1114345 - RNA, 14 nt, Mycobacterium bovis subsp bovis AF2122/97
gccgcagcgcucgc

SEQ ID NO: 1114346 - RNA, 14 nt, Mycobacterium bovis subsp bovis AF2122/97
gccgcagcggccag

SEQ ID NO: 1114347 - RNA, 15 nt, Mycobacterium bovis subsp bovis AF2122/97
gccgcagcggccagc

SEQ ID NO: 1114348 - RNA, 22 nt, Mycobacterium bovis subsp bovis AF2122/97
gccgcacugggcgaugacgcca

SEQ ID NO: 1114349 - RNA, 14 nt, Mycobacterium bovis subsp bovis AF2122/97
gccgcacguucggc

SEQ ID NO: 1114350 - RNA, 18 nt, Mycobacterium bovis subsp bovis AF2122/97
gccgcacguucggcgaug

SEQ ID NO: 1114351 - RNA, 14 nt, Mycobacterium bovis subsp bovis AF2122/97
gccgcagacgccga

SEQ ID NO: 1114352 - RNA, 14 nt, Mycobacterium bovis subsp bovis AF2122/97
gccgcagacgcggc

SEQ ID NO: 1114353 - RNA, 17 nt, Mycobacterium bovis subsp bovis AF2122/97
gccgcagagcaccgcga

SEQ ID NO: 1114354 - RNA, 23 nt, Mycobacterium bovis subsp bovis AF2122/97
gccgcagagcaccgcgaacagca

SEQ ID NO: 1114355 - RNA, 13 nt, Mycobacterium bovis subsp bovis AF2122/97
gccgcaccagucg

SEQ ID NO: 1114356 - RNA, 16 nt, Mycobacterium bovis subsp bovis AF2122/97
gccgcaccaagcagcg

SEQ ID NO: 1114357 - RNA, 23 nt, Mycobacterium bovis subsp bovis AF2122/97
gccgcaccaagcagcgaccagca

SEQ ID NO: 1114358 - RNA, 13 nt, Mycobacterium bovis subsp bovis AF2122/97
gccgcaccaaggc

SEQ ID NO: 1114359 - RNA, 16 nt, Mycobacterium bovis subsp bovis AF2122/97
gccgcaccaucggcga

SEQ ID NO: 1114360 - RNA, 17 nt, Mycobacterium bovis subsp bovis AF2122/97
gccgcaccaucggcgag

SEQ ID NO: 1114361 - RNA, 18 nt, Mycobacterium bovis subsp bovis AF2122/97
gccgcaccaucggcgagg

SEQ ID NO: 1114362 - RNA, 19 nt, Mycobacterium bovis subsp bovis AF2122/97
gccgcaccaucggcgaggc

SEQ ID NO: 1114363 - RNA, 20 nt, Mycobacterium bovis subsp bovis AF2122/97
gccgcacccccuccgcgaug

SEQ ID NO: 1114364 - RNA, 17 nt, Mycobacterium bovis subsp bovis AF2122/97
gccgcacgucgaccucg

SEQ ID NO: 1114365 - RNA, 15 nt, Mycobacterium bovis subsp bovis AF2122/97
gccgcacccggucga

SEQ ID NO: 1114366 - RNA, 21 nt, Mycobacterium bovis subsp bovis AF2122/97
gccgcaccgccugcucggcga

SEQ ID NO: 1114367 - RNA, 22 nt, Mycobacterium bovis subsp bovis AF2122/97
gccgcacccgaucgacggucgu

SEQ ID NO: 1114368 - RNA, 13 nt, Mycobacterium bovis subsp bovis AF2122/97
gccgcaccgccac

SEQ ID NO: 1114369 - RNA, 16 nt, Mycobacterium bovis subsp bovis AF2122/97
gccgacacguugcagc

SEQ ID NO: 1114370 - RNA, 16 nt, Mycobacterium bovis subsp bovis AF2122/97
gccgacagccaccgcg

SEQ ID NO: 1114371 - RNA, 15 nt, Mycobacterium bovis subsp bovis AF2122/97
gccgacagcccacga

SEQ ID NO: 1114372 - RNA, 13 nt, Mycobacterium bovis subsp bovis AF2122/97
gccgacagccgau

SEQ ID NO: 1114373 - RNA, 18 nt, Mycobacterium bovis subsp bovis AF2122/97
gccgacagccgauccgau

SEQ ID NO: 1114374 - RNA, 13 nt, Mycobacterium bovis subsp bovis AF2122/97
gccgacagcgccu

SEQ ID NO: 1114375 - RNA, 17 nt, Mycobacterium bovis subsp bovis AF2122/97
gccgaauuggcggaacu

SEQ ID NO: 1114376 - RNA, 17 nt, Mycobacterium bovis subsp bovis AF2122/97
gccgaaucucaccguca

SEQ ID NO: 1114377 - RNA, 21 nt, Mycobacterium bovis subsp bovis AF2122/97
gccgaaucgcgggcugaccaa

SEQ ID NO: 1114378 - RNA, 15 nt, Mycobacterium bovis subsp bovis AF2122/97
gccgaaucgcugacc

SEQ ID NO: 1114379 - RNA, 20 nt, Mycobacterium bovis subsp bovis AF2122/97
gccgaaucggcaguugaacu

SEQ ID NO: 1114380 - RNA, 16 nt, Mycobacterium bovis subsp bovis AF2122/97
gcccucaguucacgcu

SEQ ID NO: 1114381 - RNA, 16 nt, Mycobacterium bovis subsp bovis AF2122/97
gcccucagccgcggcc

SEQ ID NO: 1114382 - RNA, 18 nt, Mycobacterium bovis subsp bovis AF2122/97
gcccucagccgcggccac

SEQ ID NO: 1114383 - RNA, 21 nt, Mycobacterium bovis subsp bovis AF2122/97
gcccuaucguuaucgacacca

SEQ ID NO: 1114384 - RNA, 15 nt, Mycobacterium bovis subsp bovis AF2122/97
gcccucacaacgauu

SEQ ID NO: 1114385 - RNA, 12 nt, Mycobacterium bovis subsp bovis AF2122/97
gccgaaucccgc

SEQ ID NO: 1114386 - RNA, 14 nt, Mycobacterium bovis subsp bovis AF2122/97
gccgaauaccacac

SEQ ID NO: 1114387 - RNA, 19 nt, Mycobacterium bovis subsp bovis AF2122/97
gccgaauaccacaccguga

SEQ ID NO: 1114388 - RNA, 20 nt, Mycobacterium bovis subsp bovis AF2122/97
gccgaauaccacaccgugac

SEQ ID NO: 1114389 - RNA, 22 nt, Mycobacterium bovis subsp bovis AF2122/97
gccgaauaccgguggcagccug

SEQ ID NO: 1114390 - RNA, 13 nt, Mycobacterium bovis subsp bovis AF2122/97
gcccuagcuggug

SEQ ID NO: 1114391 - RNA, 13 nt, Mycobacterium bovis subsp bovis AF2122/97
gcccuagcagcaa

SEQ ID NO: 1114392 - RNA, 14 nt, Mycobacterium bovis subsp bovis AF2122/97
gcccuagccggcgc

SEQ ID NO: 1114393 - RNA, 17 nt, Mycobacterium bovis subsp bovis AF2122/97
gcccuagcgagcggcac

SEQ ID NO: 1114394 - RNA, 16 nt, Mycobacterium bovis subsp bovis AF2122/97
gcccgucgucgucgac

SEQ ID NO: 1114395 - RNA, 17 nt, Mycobacterium bovis subsp bovis AF2122/97
gcccuacgcagcgcggc

SEQ ID NO: 1114396 - RNA, 18 nt, Mycobacterium bovis subsp bovis AF2122/97
gcccuacgcagcgcggcu

SEQ ID NO: 1114397 - RNA, 15 nt, Mycobacterium bovis subsp bovis AF2122/97
gcccucaacgaucgc

SEQ ID NO: 1114398 - RNA, 18 nt, Mycobacterium bovis subsp bovis AF2122/97
gcccucaacgaucgcgcc

SEQ ID NO: 1114399 - RNA, 21 nt, Mycobacterium bovis subsp bovis AF2122/97
gcccucaacgaucgcgccguc

SEQ ID NO: 1114400 - RNA, 16 nt, Mycobacterium bovis subsp bovis AF2122/97
gcccucaacggcggca

SEQ ID NO: 1114401 - RNA, 18 nt, Mycobacterium bovis subsp bovis AF2122/97
gcccucaacggcggcaac

SEQ ID NO: 1114402 - RNA, 21 nt, Mycobacterium bovis subsp bovis AF2122/97
gcccucaacggcggcaacggc

SEQ ID NO: 1114403 - RNA, 12 nt, Mycobacterium bovis subsp bovis AF2122/97
gccgaccgcgac

SEQ ID NO: 1114404 - RNA, 17 nt, Mycobacterium bovis subsp bovis AF2122/97
gccgaccgcgccgcauc

SEQ ID NO: 1114405 - RNA, 14 nt, Mycobacterium bovis subsp bovis AF2122/97
gccgaccgcgaccc

SEQ ID NO: 1114406 - RNA, 18 nt, Mycobacterium bovis subsp bovis AF2122/97
gccgaccgcgacccggcc

SEQ ID NO: 1114407 - RNA, 18 nt, Mycobacterium bovis subsp bovis AF2122/97
gccgaccaucucaccggg

SEQ ID NO: 1114408 - RNA, 20 nt, Mycobacterium bovis subsp bovis AF2122/97
gccgaccaucucaccgggcc

SEQ ID NO: 1114409 - RNA, 19 nt, Mycobacterium bovis subsp bovis AF2122/97
gccgaccugcgcgacggcg

SEQ ID NO: 1114410 - RNA, 23 nt, Mycobacterium bovis subsp bovis AF2122/97
gccgaccuggacaaccucgucga

SEQ ID NO: 1114411 - RNA, 16 nt, Mycobacterium bovis subsp bovis AF2122/97
gccgaccugcgcgacg

SEQ ID NO: 1114412 - RNA, 17 nt, Mycobacterium bovis subsp bovis AF2122/97
gccgaccugcgcgacgg

SEQ ID NO: 1114413 - RNA, 19 nt, Mycobacterium bovis subsp bovis AF2122/97
gccgaccuguaugccgcgg

SEQ ID NO: 1114414 - RNA, 20 nt, Mycobacterium bovis subsp bovis AF2122/97
gccgaccuguaugccgcggu

SEQ ID NO: 1114415 - RNA, 23 nt, Mycobacterium bovis subsp bovis AF2122/97
gccgaccuguaugccgcggugga

SEQ ID NO: 1114416 - RNA, 19 nt, Mycobacterium bovis subsp bovis AF2122/97
gccgaccuguccgauaacg

SEQ ID NO: 1114417 - RNA, 12 nt, Mycobacterium bovis subsp bovis AF2122/97
gccgaccaggac

SEQ ID NO: 1114418 - RNA, 17 nt, Mycobacterium bovis subsp bovis AF2122/97
gccgaccaggaccaccg

SEQ ID NO: 1114419 - RNA, 19 nt, Mycobacterium bovis subsp bovis AF2122/97
gccgaccaggaccaccgca

SEQ ID NO: 1114420 - RNA, 20 nt, Mycobacterium bovis subsp bovis AF2122/97
gccgaccauaaaacucgggg

SEQ ID NO: 1114421 - RNA, 16 nt, Mycobacterium bovis subsp bovis AF2122/97
gccgaccaucucaccg

SEQ ID NO: 1114422 - RNA, 19 nt, Mycobacterium bovis subsp bovis AF2122/97
gccgaccgauacaccgacg

SEQ ID NO: 1114423 - RNA, 18 nt, Mycobacterium bovis subsp bovis AF2122/97
gccgaccgauggcucacc

SEQ ID NO: 1114424 - RNA, 22 nt, Mycobacterium bovis subsp bovis AF2122/97
gccgaccgauggcucaccagcu

SEQ ID NO: 1114425 - RNA, 17 nt, Mycobacterium bovis subsp bovis AF2122/97
gccgaccagcgcuagcg

SEQ ID NO: 1114426 - RNA, 15 nt, Mycobacterium bovis subsp bovis AF2122/97
gccgaccagcgcgcu

SEQ ID NO: 1114427 - RNA, 18 nt, Mycobacterium bovis subsp bovis AF2122/97
gccgaccagcgcgcugcg

SEQ ID NO: 1114428 - RNA, 23 nt, Mycobacterium bovis subsp bovis AF2122/97
gccgaccagcgcgcugcgcgacu

SEQ ID NO: 1114429 - RNA, 12 nt, Mycobacterium bovis subsp bovis AF2122/97
gccgaccagcac

SEQ ID NO: 1114430 - RNA, 20 nt, Mycobacterium bovis subsp bovis AF2122/97
gccgaccagcacccgcucgg

SEQ ID NO: 1114431 - RNA, 13 nt, Mycobacterium bovis subsp bovis AF2122/97
gccgagcagcccg

SEQ ID NO: 1114432 - RNA, 14 nt, Mycobacterium bovis subsp bovis AF2122/97
gccgagcagcccgc

SEQ ID NO: 1114433 - RNA, 15 nt, Mycobacterium bovis subsp bovis AF2122/97
gccgagcacgccgag

SEQ ID NO: 1114434 - RNA, 16 nt, Mycobacterium bovis subsp bovis AF2122/97
gccgagcacgccgagc

SEQ ID NO: 1114435 - RNA, 13 nt, Mycobacterium bovis subsp bovis AF2122/97
gccgagcacucgg

SEQ ID NO: 1114436 - RNA, 14 nt, Mycobacterium bovis subsp bovis AF2122/97
gccgagcacucggc

SEQ ID NO: 1114437 - RNA, 20 nt, Mycobacterium bovis subsp bovis AF2122/97
gccgagcacucggccacgac

SEQ ID NO: 1114438 - RNA, 17 nt, Mycobacterium bovis subsp bovis AF2122/97
gccgagaccgccgcugc

SEQ ID NO: 1114439 - RNA, 19 nt, Mycobacterium bovis subsp bovis AF2122/97
gccgagaccgccgcugccg

SEQ ID NO: 1114440 - RNA, 23 nt, Mycobacterium bovis subsp bovis AF2122/97
gccgagaccgcguggucggcgaa

SEQ ID NO: 1114441 - RNA, 15 nt, Mycobacterium bovis subsp bovis AF2122/97
gccgagaccggccag

SEQ ID NO: 1114442 - RNA, 14 nt, Mycobacterium bovis subsp bovis AF2122/97
gccgagcacgacga

SEQ ID NO: 1114443 - RNA, 19 nt, Mycobacterium bovis subsp bovis AF2122/97
gccgagcacgacgacgucg

SEQ ID NO: 1114444 - RNA, 15 nt, Mycobacterium bovis subsp bovis AF2122/97
gccgagcacgggcag

SEQ ID NO: 1114445 - RNA, 15 nt, Mycobacterium bovis subsp bovis AF2122/97
gccgagagcagccag

SEQ ID NO: 1114446 - RNA, 22 nt, Mycobacterium bovis subsp bovis AF2122/97
gccgagauagcaacgaagccgg

SEQ ID NO: 1114447 - RNA, 14 nt, Mycobacterium bovis subsp bovis AF2122/97
gccgagaucacgcc

SEQ ID NO: 1114448 - RNA, 14 nt, Mycobacterium bovis subsp bovis AF2122/97
gccgagccagcucc

SEQ ID NO: 1114449 - RNA, 18 nt, Mycobacterium bovis subsp bovis AF2122/97
gccgagccagcuccggcg

SEQ ID NO: 1114450 - RNA, 18 nt, Mycobacterium bovis subsp bovis AF2122/97
gccgagcgcaccgcugac

SEQ ID NO: 1114451 - RNA, 18 nt, Mycobacterium bovis subsp bovis AF2122/97
gccgagcgcaccacggcg

SEQ ID NO: 1114452 - RNA, 16 nt, Mycobacterium bovis subsp bovis AF2122/97
gccgagcgcgccgaag

SEQ ID NO: 1114453 - RNA, 15 nt, Mycobacterium bovis subsp bovis AF2122/97
gccgagcccgccggg

SEQ ID NO: 1114454 - RNA, 15 nt, Mycobacterium bovis subsp bovis AF2122/97
gccgagcccggugcu

SEQ ID NO: 1114455 - RNA, 16 nt, Mycobacterium bovis subsp bovis AF2122/97
gccgagcccgucgauc

SEQ ID NO: 1114456 - RNA, 17 nt, Mycobacterium bovis subsp bovis AF2122/97
gccgagcagggccggca

SEQ ID NO: 1114457 - RNA, 19 nt, Mycobacterium bovis subsp bovis AF2122/97
gccgacgccgccggcgcca

SEQ ID NO: 1114458 - RNA, 17 nt, Mycobacterium bovis subsp bovis AF2122/97
gccgaccuuuugcggca

SEQ ID NO: 1114459 - RNA, 18 nt, Mycobacterium bovis subsp bovis AF2122/97
gccgaccuuuugcggcaa

SEQ ID NO: 1114460 - RNA, 19 nt, Mycobacterium bovis subsp bovis AF2122/97
gccgaccuuggcgucgauc

SEQ ID NO: 1114461 - RNA, 23 nt, Mycobacterium bovis subsp bovis AF2122/97
gccgaccuuccguuggcggcucg

SEQ ID NO: 1114462 - RNA, 13 nt, Mycobacterium bovis subsp bovis AF2122/97
gccgaccuucggc

SEQ ID NO: 1114463 - RNA, 17 nt, Mycobacterium bovis subsp bovis AF2122/97
gccgaccuuggcgucga

SEQ ID NO: 1114464 - RNA, 21 nt, Mycobacterium bovis subsp bovis AF2122/97
gccgacgccgccggcgccacc

SEQ ID NO: 1114465 - RNA, 21 nt, Mycobacterium bovis subsp bovis AF2122/97
gccgacgaacgaaccgccgcc

SEQ ID NO: 1114466 - RNA, 23 nt, Mycobacterium bovis subsp bovis AF2122/97
gccgacgaacgaaccgccgccgc

SEQ ID NO: 1114467 - RNA, 20 nt, Mycobacterium bovis subsp bovis AF2122/97
gccgacgcguucgagugcgg

SEQ ID NO: 1114468 - RNA, 13 nt, Mycobacterium bovis subsp bovis AF2122/97
gccgacgcgcggc

SEQ ID NO: 1114469 - RNA, 13 nt, Mycobacterium bovis subsp bovis AF2122/97
gccgacgcugcug

SEQ ID NO: 1114470 - RNA, 20 nt, Mycobacterium bovis subsp bovis AF2122/97
gccgaccaugguagcgcccc

SEQ ID NO: 1114471 - RNA, 13 nt, Mycobacterium bovis subsp bovis AF2122/97
gccgacgguuacc

SEQ ID NO: 1114472 - RNA, 12 nt, Mycobacterium bovis subsp bovis AF2122/97
gccgacggccag

SEQ ID NO: 1114473 - RNA, 22 nt, Mycobacterium bovis subsp bovis AF2122/97
gccgacggcaagggcauacagc

SEQ ID NO: 1114474 - RNA, 15 nt, Mycobacterium bovis subsp bovis AF2122/97
gccgacggaucgccc

SEQ ID NO: 1114475 - RNA, 23 nt, Mycobacterium bovis subsp bovis AF2122/97
gccgacgucugguuggcuggcgg

SEQ ID NO: 1114476 - RNA, 11 nt, Mycobacterium bovis subsp bovis AF2122/97
gccgacgugac

SEQ ID NO: 1114477 - RNA, 13 nt, Mycobacterium bovis subsp bovis AF2122/97
gccgacgugacaa

SEQ ID NO: 1114478 - RNA, 22 nt, Mycobacterium bovis subsp bovis AF2122/97
gccgacgugacaacugcgccgg

SEQ ID NO: 1114479 - RNA, 15 nt, Mycobacterium bovis subsp bovis AF2122/97
gccgacgugaccagc

SEQ ID NO: 1114480 - RNA, 17 nt, Mycobacterium bovis subsp bovis AF2122/97
gccgacgucgccgacgg

SEQ ID NO: 1114481 - RNA, 13 nt, Mycobacterium bovis subsp bovis AF2122/97
gccgacgucggca

SEQ ID NO: 1114482 - RNA, 17 nt, Mycobacterium bovis subsp bovis AF2122/97
gccgacggcaccgaaau

SEQ ID NO: 1114483 - RNA, 17 nt, Mycobacterium bovis subsp bovis AF2122/97
gccgacggcaucaacgc

SEQ ID NO: 1114484 - RNA, 18 nt, Mycobacterium bovis subsp bovis AF2122/97
gccgacggcaucaacgcg

SEQ ID NO: 1114485 - RNA, 14 nt, Mycobacterium bovis subsp bovis AF2122/97
gccgacgucgccga

SEQ ID NO: 1114486 - RNA, 16 nt, Mycobacterium bovis subsp bovis AF2122/97
gccgagaaccagcgaa

SEQ ID NO: 1114487 - RNA, 20 nt, Mycobacterium bovis subsp bovis AF2122/97
gccgagaauuccccagccgc

SEQ ID NO: 1114488 - RNA, 13 nt, Mycobacterium bovis subsp bovis AF2122/97
gccgagaccacgc

SEQ ID NO: 1114489 - RNA, 18 nt, Mycobacterium bovis subsp bovis AF2122/97
gccgagaccacgcgcguc

SEQ ID NO: 1114490 - RNA, 20 nt, Mycobacterium bovis subsp bovis AF2122/97
gccgacuacgaagacguucg

SEQ ID NO: 1114491 - RNA, 16 nt, Mycobacterium bovis subsp bovis AF2122/97
gccgacggaucgcccu

SEQ ID NO: 1114492 - RNA, 22 nt, Mycobacterium bovis subsp bovis AF2122/97
gccgacgucuaggccaaacccc

SEQ ID NO: 1114493 - RNA, 16 nt, Mycobacterium bovis subsp bovis AF2122/97
gccgacuuugucgcgg

SEQ ID NO: 1114494 - RNA, 14 nt, Mycobacterium bovis subsp bovis AF2122/97
gccgagaacaccgg

SEQ ID NO: 1114495 - RNA, 18 nt, Mycobacterium bovis subsp bovis AF2122/97
gccaggcccucgacggcg

SEQ ID NO: 1114496 - RNA, 15 nt, Mycobacterium bovis subsp bovis AF2122/97
gccaggccgaccgcg

SEQ ID NO: 1114497 - RNA, 16 nt, Mycobacterium bovis subsp bovis AF2122/97
gccaggccgaccgcgc

SEQ ID NO: 1114498 - RNA, 17 nt, Mycobacterium bovis subsp bovis AF2122/97
gccaggccgaccgcgca

SEQ ID NO: 1114499 - RNA, 15 nt, Mycobacterium bovis subsp bovis AF2122/97
gccaggccgcgcgac

SEQ ID NO: 1114500 - RNA, 14 nt, Mycobacterium bovis subsp bovis AF2122/97
gccaggccgucggc

SEQ ID NO: 1114501 - RNA, 16 nt, Mycobacterium bovis subsp bovis AF2122/97
gccaggccgucggcgu

SEQ ID NO: 1114502 - RNA, 13 nt, Mycobacterium bovis subsp bovis AF2122/97
gccaggccgucgg

SEQ ID NO: 1114503 - RNA, 21 nt, Mycobacterium bovis subsp bovis AF2122/97
gccaggccguaguggccggcu

SEQ ID NO: 1114504 - RNA, 22 nt, Mycobacterium bovis subsp bovis AF2122/97
gccaggcgauugcccgcgcucg

SEQ ID NO: 1114505 - RNA, 12 nt, Mycobacterium bovis subsp bovis AF2122/97
gccaggcgcagc

SEQ ID NO: 1114506 - RNA, 19 nt, Mycobacterium bovis subsp bovis AF2122/97
gccaggcgaagucgacucg

SEQ ID NO: 1114507 - RNA, 20 nt, Mycobacterium bovis subsp bovis AF2122/97
gccaggccuuggugcggccg

SEQ ID NO: 1114508 - RNA, 21 nt, Mycobacterium bovis subsp bovis AF2122/97
gccaggccuuggugcggccgg

SEQ ID NO: 1114509 - RNA, 16 nt, Mycobacterium bovis subsp bovis AF2122/97
gccaggcgcgaucgcg

SEQ ID NO: 1114510 - RNA, 13 nt, Mycobacterium bovis subsp bovis AF2122/97
gccaggcggcaag

SEQ ID NO: 1114511 - RNA, 14 nt, Mycobacterium bovis subsp bovis AF2122/97
gccaggcggcaagg

SEQ ID NO: 1114512 - RNA, 16 nt, Mycobacterium bovis subsp bovis AF2122/97
gccagcucgcgggccg

SEQ ID NO: 1114513 - RNA, 16 nt, Mycobacterium bovis subsp bovis AF2122/97
gccagcucggcacccg

SEQ ID NO: 1114514 - RNA, 17 nt, Mycobacterium bovis subsp bovis AF2122/97
gccagcucggcacccgc

SEQ ID NO: 1114515 - RNA, 13 nt, Mycobacterium bovis subsp bovis AF2122/97
gccagcucggcca

SEQ ID NO: 1114516 - RNA, 15 nt, Mycobacterium bovis subsp bovis AF2122/97
gccagcucggcggca

SEQ ID NO: 1114517 - RNA, 23 nt, Mycobacterium bovis subsp bovis AF2122/97
gccagcucggcggcagcggcggu

SEQ ID NO: 1114518 - RNA, 13 nt, Mycobacterium bovis subsp bovis AF2122/97
gccaggaucgcgg

SEQ ID NO: 1114519 - RNA, 15 nt, Mycobacterium bovis subsp bovis AF2122/97
gccaggaucgcggcg

SEQ ID NO: 1114520 - RNA, 16 nt, Mycobacterium bovis subsp bovis AF2122/97
gccaggaucgcggcgc

SEQ ID NO: 1114521 - RNA, 22 nt, Mycobacterium bovis subsp bovis AF2122/97
gccaggaucgcuacgucgaccg

SEQ ID NO: 1114522 - RNA, 21 nt, Mycobacterium bovis subsp bovis AF2122/97
gccaggauaaguccggacauc

SEQ ID NO: 1114523 - RNA, 13 nt, Mycobacterium bovis subsp bovis AF2122/97
gccaggaugaaga

SEQ ID NO: 1114524 - RNA, 13 nt, Mycobacterium bovis subsp bovis AF2122/97
gccaggcccgugc

SEQ ID NO: 1114525 - RNA, 12 nt, Mycobacterium bovis subsp bovis AF2122/97
gccaggcccagc

SEQ ID NO: 1114526 - RNA, 17 nt, Mycobacterium bovis subsp bovis AF2122/97
gccaggccagugccacc

SEQ ID NO: 1114527 - RNA, 20 nt, Mycobacterium bovis subsp bovis AF2122/97
gccaggcccaagccguggcc

SEQ ID NO: 1114528 - RNA, 16 nt, Mycobacterium bovis subsp bovis AF2122/97
gccaggcacguccgau

SEQ ID NO: 1114529 - RNA, 20 nt, Mycobacterium bovis subsp bovis AF2122/97
gccaggcacguccgaucggc

SEQ ID NO: 1114530 - RNA, 19 nt, Mycobacterium bovis subsp bovis AF2122/97
gccaggucgcgauagccgc

SEQ ID NO: 1114531 - RNA, 20 nt, Mycobacterium bovis subsp bovis AF2122/97
gccaggucgcgauagccgcc

SEQ ID NO: 1114532 - RNA, 22 nt, Mycobacterium bovis subsp bovis AF2122/97
gccaggucgauaccggcgugca

SEQ ID NO: 1114533 - RNA, 14 nt, Mycobacterium bovis subsp bovis AF2122/97
gccaggucggcgau

SEQ ID NO: 1114534 - RNA, 21 nt, Mycobacterium bovis subsp bovis AF2122/97
gccaggucggccaccguggau

SEQ ID NO: 1114535 - RNA, 18 nt, Mycobacterium bovis subsp bovis AF2122/97
gccaggugcagcaccagc

SEQ ID NO: 1114536 - RNA, 15 nt, Mycobacterium bovis subsp bovis AF2122/97
gccaggugaugccgc

SEQ ID NO: 1114537 - RNA, 18 nt, Mycobacterium bovis subsp bovis AF2122/97
gccaggugaugccgccgu

SEQ ID NO: 1114538 - RNA, 19 nt, Mycobacterium bovis subsp bovis AF2122/97
gccaggucggugggcggcg

SEQ ID NO: 1114539 - RNA, 15 nt, Mycobacterium bovis subsp bovis AF2122/97
gccaggugucgucga

SEQ ID NO: 1114540 - RNA, 16 nt, Mycobacterium bovis subsp bovis AF2122/97
gccaggugcucgucga

SEQ ID NO: 1114541 - RNA, 17 nt, Mycobacterium bovis subsp bovis AF2122/97
gccagguggccgcaucg

SEQ ID NO: 1114542 - RNA, 21 nt, Mycobacterium bovis subsp bovis AF2122/97
gccagguguucgccggagacc

SEQ ID NO: 1114543 - RNA, 19 nt, Mycobacterium bovis subsp bovis AF2122/97
gccaguagcacguugacgu

SEQ ID NO: 1114544 - RNA, 18 nt, Mycobacterium bovis subsp bovis AF2122/97
gccaggucgacaccgcgg

SEQ ID NO: 1114545 - RNA, 22 nt, Mycobacterium bovis subsp bovis AF2122/97
gccaggucgacaccgcggugcc

SEQ ID NO: 1114546 - RNA, 15 nt, Mycobacterium bovis subsp bovis AF2122/97
gccaggucgacaccg

SEQ ID NO: 1114547 - RNA, 14 nt, Mycobacterium bovis subsp bovis AF2122/97
gccaggucagcucg

SEQ ID NO: 1114548 - RNA, 14 nt, Mycobacterium bovis subsp bovis AF2122/97
gccagguccgccgg

SEQ ID NO: 1114549 - RNA, 23 nt, Mycobacterium bovis subsp bovis AF2122/97
gccagguccgccggugccgccgu

SEQ ID NO: 1114550 - RNA, 18 nt, Mycobacterium bovis subsp bovis AF2122/97
gccagggucccgccgccu

SEQ ID NO: 1114551 - RNA, 15 nt, Mycobacterium bovis subsp bovis AF2122/97
gccagggugaccagg

SEQ ID NO: 1114552 - RNA, 23 nt, Mycobacterium bovis subsp bovis AF2122/97
gccagggugcccucggccgccug

SEQ ID NO: 1114553 - RNA, 21 nt, Mycobacterium bovis subsp bovis AF2122/97
gccagggugaccaggccgagc

SEQ ID NO: 1114554 - RNA, 14 nt, Mycobacterium bovis subsp bovis AF2122/97
gccagggugcgccg

SEQ ID NO: 1114555 - RNA, 20 nt, Mycobacterium bovis subsp bovis AF2122/97
gccagggcccuagccggcgc

SEQ ID NO: 1114556 - RNA, 17 nt, Mycobacterium bovis subsp bovis AF2122/97
gccagggccgccgaagc

SEQ ID NO: 1114557 - RNA, 14 nt, Mycobacterium bovis subsp bovis AF2122/97
gccagggcgccgaa

SEQ ID NO: 1114558 - RNA, 13 nt, Mycobacterium bovis subsp bovis AF2122/97
gccagggcgggcg

SEQ ID NO: 1114559 - RNA, 17 nt, Mycobacterium bovis subsp bovis AF2122/97
gccaggggacccggggc

SEQ ID NO: 1114560 - RNA, 21 nt, Mycobacterium bovis subsp bovis AF2122/97
gccagggcgguggccacccgg

SEQ ID NO: 1114561 - RNA, 21 nt, Mycobacterium bovis subsp bovis AF2122/97
gccaggggugugccguggucg

SEQ ID NO: 1114562 - RNA, 23 nt, Mycobacterium bovis subsp bovis AF2122/97
gccaggggugugccguggucgaa

SEQ ID NO: 1114563 - RNA, 21 nt, Mycobacterium bovis subsp bovis AF2122/97
gccagggucacaaacccagca

SEQ ID NO: 1114564 - RNA, 22 nt, Mycobacterium bovis subsp bovis AF2122/97
gccaggcgguacgggucgccgg

SEQ ID NO: 1114565 - RNA, 19 nt, Mycobacterium bovis subsp bovis AF2122/97
gccaggcgguagucgucga

SEQ ID NO: 1114566 - RNA, 23 nt, Mycobacterium bovis subsp bovis AF2122/97
gccaggcgcauagggccaccgcc

SEQ ID NO: 1114567 - RNA, 13 nt, Mycobacterium bovis subsp bovis AF2122/97
gccaggcggccgg

SEQ ID NO: 1114568 - RNA, 15 nt, Mycobacterium bovis subsp bovis AF2122/97
gccaggcuggcguca

SEQ ID NO: 1114569 - RNA, 18 nt, Mycobacterium bovis subsp bovis AF2122/97
gccaggcuugcggcaccc

SEQ ID NO: 1114570 - RNA, 13 nt, Mycobacterium bovis subsp bovis AF2122/97
gccaggcuggcca

SEQ ID NO: 1114571 - RNA, 15 nt, Mycobacterium bovis subsp bovis AF2122/97
gccaggcuggccaac

SEQ ID NO: 1114572 - RNA, 18 nt, Mycobacterium bovis subsp bovis AF2122/97
gccagggaucagccgugc

SEQ ID NO: 1114573 - RNA, 20 nt, Mycobacterium bovis subsp bovis AF2122/97
gccagggaucagccgugcgg

SEQ ID NO: 1114574 - RNA, 16 nt, Mycobacterium bovis subsp bovis AF2122/97
gccagggcacguggcg

SEQ ID NO: 1114575 - RNA, 13 nt, Mycobacterium bovis subsp bovis AF2122/97
gcccaaccuggga

SEQ ID NO: 1114576 - RNA, 12 nt, Mycobacterium bovis subsp bovis AF2122/97
gcccaacgucgc

SEQ ID NO: 1114577 - RNA, 13 nt, Mycobacterium bovis subsp bovis AF2122/97
gcccaacgcgaug

SEQ ID NO: 1114578 - RNA, 17 nt, Mycobacterium bovis subsp bovis AF2122/97
gcccaagcccucgacgu

SEQ ID NO: 1114579 - RNA, 20 nt, Mycobacterium bovis subsp bovis AF2122/97
gcccaacucccagaacgccg

SEQ ID NO: 1114580 - RNA, 18 nt, Mycobacterium bovis subsp bovis AF2122/97
gcccaacggaagaccgcg

SEQ ID NO: 1114581 - RNA, 17 nt, Mycobacterium bovis subsp bovis AF2122/97
gcccaacgacggcaaca

SEQ ID NO: 1114582 - RNA, 22 nt, Mycobacterium bovis subsp bovis AF2122/97
gcccaacggaagaccgcgggac

SEQ ID NO: 1114583 - RNA, 15 nt, Mycobacterium bovis subsp bovis AF2122/97
gcccaaacggcgugu

SEQ ID NO: 1114584 - RNA, 15 nt, Mycobacterium bovis subsp bovis AF2122/97
gcccaacaggcggga

SEQ ID NO: 1114585 - RNA, 17 nt, Mycobacterium bovis subsp bovis AF2122/97
gcccaacagcaacccgc

SEQ ID NO: 1114586 - RNA, 18 nt, Mycobacterium bovis subsp bovis AF2122/97
gcccaacagcaacccgcc

SEQ ID NO: 1114587 - RNA, 18 nt, Mycobacterium bovis subsp bovis AF2122/97
gcccaaaagcgcggcaac

SEQ ID NO: 1114588 - RNA, 21 nt, Mycobacterium bovis subsp bovis AF2122/97
gcccaaaaggaagaccucggc

SEQ ID NO: 1114589 - RNA, 19 nt, Mycobacterium bovis subsp bovis AF2122/97
gcccaaaaagaccgccgcu

SEQ ID NO: 1114590 - RNA, 21 nt, Mycobacterium bovis subsp bovis AF2122/97
gcccaaaaagaccgccgcugg

SEQ ID NO: 1114591 - RNA, 15 nt, Mycobacterium bovis subsp bovis AF2122/97
gcccaaaaccgcgaa

SEQ ID NO: 1114592 - RNA, 11 nt, Mycobacterium bovis subsp bovis AF2122/97
gccauuggcag

SEQ ID NO: 1114593 - RNA, 14 nt, Mycobacterium bovis subsp bovis AF2122/97
gccauuggcgccgc

SEQ ID NO: 1114594 - RNA, 18 nt, Mycobacterium bovis subsp bovis AF2122/97
gccauuggcgccgccgau

SEQ ID NO: 1114595 - RNA, 15 nt, Mycobacterium bovis subsp bovis AF2122/97
gccauuggcgguggu

SEQ ID NO: 1114596 - RNA, 15 nt, Mycobacterium bovis subsp bovis AF2122/97
gccauugcgggaacg

SEQ ID NO: 1114597 - RNA, 18 nt, Mycobacterium bovis subsp bovis AF2122/97
gccauugcccgggcggga

SEQ ID NO: 1114598 - RNA, 14 nt, Mycobacterium bovis subsp bovis AF2122/97
gccauugccgccgg

SEQ ID NO: 1114599 - RNA, 15 nt, Mycobacterium bovis subsp bovis AF2122/97
gccauugccgccggu

SEQ ID NO: 1114600 - RNA, 14 nt, Mycobacterium bovis subsp bovis AF2122/97
gccauugccgccgu

SEQ ID NO: 1114601 - RNA, 16 nt, Mycobacterium bovis subsp bovis AF2122/97
gccauugccgccgucg

SEQ ID NO: 1114602 - RNA, 18 nt, Mycobacterium bovis subsp bovis AF2122/97
gccauugccgccgucgcc

SEQ ID NO: 1114603 - RNA, 21 nt, Mycobacterium bovis subsp bovis AF2122/97
gccauugccucccgcgccggc

SEQ ID NO: 1114604 - RNA, 23 nt, Mycobacterium bovis subsp bovis AF2122/97
gccauugccucccgcgccggcgu

SEQ ID NO: 1114605 - RNA, 20 nt, Mycobacterium bovis subsp bovis AF2122/97
gccauugccugggcgaccgg

SEQ ID NO: 1114606 - RNA, 19 nt, Mycobacterium bovis subsp bovis AF2122/97
gccauucgguguggccgug

SEQ ID NO: 1114607 - RNA, 18 nt, Mycobacterium bovis subsp bovis AF2122/97
gccauucuucgaucagcg

SEQ ID NO: 1114608 - RNA, 20 nt, Mycobacterium bovis subsp bovis AF2122/97
gccauucuuggugaucgcga

SEQ ID NO: 1114609 - RNA, 23 nt, Mycobacterium bovis subsp bovis AF2122/97
gccauucuuggugaucgcgaacu

SEQ ID NO: 1114610 - RNA, 21 nt, Mycobacterium bovis subsp bovis AF2122/97
gccaugaacucgaacuggguc

SEQ ID NO: 1114611 - RNA, 15 nt, Mycobacterium bovis subsp bovis AF2122/97
gccaugaagccgggc

SEQ ID NO: 1114612 - RNA, 17 nt, Mycobacterium bovis subsp bovis AF2122/97
gccaugaagccgggcgc

SEQ ID NO: 1114613 - RNA, 19 nt, Mycobacterium bovis subsp bovis AF2122/97
gccaugggaguucaucgca

SEQ ID NO: 1114614 - RNA, 22 nt, Mycobacterium bovis subsp bovis AF2122/97
gccaugggaguucaucgcacga

SEQ ID NO: 1114615 - RNA, 15 nt, Mycobacterium bovis subsp bovis AF2122/97
gccauggcguucugc

SEQ ID NO: 1114616 - RNA, 19 nt, Mycobacterium bovis subsp bovis AF2122/97
gccauggcggcgccggugg

SEQ ID NO: 1114617 - RNA, 13 nt, Mycobacterium bovis subsp bovis AF2122/97
gccauggcggcgc

SEQ ID NO: 1114618 - RNA, 16 nt, Mycobacterium bovis subsp bovis AF2122/97
gccaugaucacaccgc

SEQ ID NO: 1114619 - RNA, 22 nt, Mycobacterium bovis subsp bovis AF2122/97
gccaugguguucggcagcgcgg

SEQ ID NO: 1114620 - RNA, 15 nt, Mycobacterium bovis subsp bovis AF2122/97
gccaugguguucggc

SEQ ID NO: 1114621 - RNA, 14 nt, Mycobacterium bovis subsp bovis AF2122/97
gccaugucgauguc

SEQ ID NO: 1114622 - RNA, 15 nt, Mycobacterium bovis subsp bovis AF2122/97
gccaugucgaugucc

SEQ ID NO: 1114623 - RNA, 20 nt, Mycobacterium bovis subsp bovis AF2122/97
gccaugucgauguccacgcc

SEQ ID NO: 1114624 - RNA, 23 nt, Mycobacterium bovis subsp bovis AF2122/97
gccauguggcgucgcucgucguc

SEQ ID NO: 1114625 - RNA, 19 nt, Mycobacterium bovis subsp bovis AF2122/97
gccauguagccguugccgc

SEQ ID NO: 1114626 - RNA, 22 nt, Mycobacterium bovis subsp bovis AF2122/97
gccauguagccguugccgccga

SEQ ID NO: 1114627 - RNA, 15 nt, Mycobacterium bovis subsp bovis AF2122/97
gccauguccaccagc

SEQ ID NO: 1114628 - RNA, 15 nt, Mycobacterium bovis subsp bovis AF2122/97
gccauguggcgucgc

SEQ ID NO: 1114629 - RNA, 21 nt, Mycobacterium bovis subsp bovis AF2122/97
gccauuaaaaagcccagcgau

SEQ ID NO: 1114630 - RNA, 14 nt, Mycobacterium bovis subsp bovis AF2122/97
gccauuccagccgg

SEQ ID NO: 1114631 - RNA, 23 nt, Mycobacterium bovis subsp bovis AF2122/97
gccauuccagccggugccgccgu

SEQ ID NO: 1114632 - RNA, 20 nt, Mycobacterium bovis subsp bovis AF2122/97
gccauuccaucgcgcaccgc

SEQ ID NO: 1114633 - RNA, 14 nt, Mycobacterium bovis subsp bovis AF2122/97
gccaucgcgagcgg

SEQ ID NO: 1114634 - RNA, 14 nt, Mycobacterium bovis subsp bovis AF2122/97
gccaucgcgcggac

SEQ ID NO: 1114635 - RNA, 16 nt, Mycobacterium bovis subsp bovis AF2122/97
gccaucgcgcggacca

SEQ ID NO: 1114636 - RNA, 15 nt, Mycobacterium bovis subsp bovis AF2122/97
gccaucgcggaaccg

SEQ ID NO: 1114637 - RNA, 19 nt, Mycobacterium bovis subsp bovis AF2122/97
gccaucgccuccagccggc

SEQ ID NO: 1114638 - RNA, 20 nt, Mycobacterium bovis subsp bovis AF2122/97
gccaucgccuccagccggcg

SEQ ID NO: 1114639 - RNA, 21 nt, Mycobacterium bovis subsp bovis AF2122/97
gccaucgccuccagccggcga

SEQ ID NO: 1114640 - RNA, 16 nt, Mycobacterium bovis subsp bovis AF2122/97
gccaucgccuccagcc

SEQ ID NO: 1114641 - RNA, 14 nt, Mycobacterium bovis subsp bovis AF2122/97
gccaucgcccgaug

SEQ ID NO: 1114642 - RNA, 12 nt, Mycobacterium bovis subsp bovis AF2122/97
gccaucuggguc

SEQ ID NO: 1114643 - RNA, 18 nt, Mycobacterium bovis subsp bovis AF2122/97
gccaucuggguccgucga

SEQ ID NO: 1114644 - RNA, 13 nt, Mycobacterium bovis subsp bovis AF2122/97
gccaucugcucgu

SEQ ID NO: 1114645 - RNA, 12 nt, Mycobacterium bovis subsp bovis AF2122/97
gccaucuggccg

SEQ ID NO: 1114646 - RNA, 24 nt, Mycobacterium bovis subsp bovis AF2122/97
gccaucggcaccagcgcgcgccga

SEQ ID NO: 1114647 - RNA, 14 nt, Mycobacterium bovis subsp bovis AF2122/97
gccaucccgccgcc

SEQ ID NO: 1114648 - RNA, 19 nt, Mycobacterium bovis subsp bovis AF2122/97
gccauccccuggccagcag

SEQ ID NO: 1114649 - RNA, 14 nt, Mycobacterium bovis subsp bovis AF2122/97
gccauccccgccgg

SEQ ID NO: 1114650 - RNA, 15 nt, Mycobacterium bovis subsp bovis AF2122/97
gccauccccgccggc

SEQ ID NO: 1114651 - RNA, 20 nt, Mycobacterium bovis subsp bovis AF2122/97
gccauccccgccggcgccac

SEQ ID NO: 1114652 - RNA, 13 nt, Mycobacterium bovis subsp bovis AF2122/97
gccaucauggcgg

SEQ ID NO: 1114653 - RNA, 19 nt, Mycobacterium bovis subsp bovis AF2122/97
gccaucaucgcccugggcg

SEQ ID NO: 1114654 - RNA, 17 nt, Mycobacterium bovis subsp bovis AF2122/97
gccaucagcccggcgcg

SEQ ID NO: 1114655 - RNA, 15 nt, Mycobacterium bovis subsp bovis AF2122/97
gccaucagccgcugc

SEQ ID NO: 1114656 - RNA, 14 nt, Mycobacterium bovis subsp bovis AF2122/97
gccaucagcccggc

SEQ ID NO: 1114657 - RNA, 21 nt, Mycobacterium bovis subsp bovis AF2122/97
gccaguccggacggcagccgg

SEQ ID NO: 1114658 - RNA, 13 nt, Mycobacterium bovis subsp bovis AF2122/97
gccauagcgggcg

SEQ ID NO: 1114659 - RNA, 15 nt, Mycobacterium bovis subsp bovis AF2122/97
gccauagcgggcggu

SEQ ID NO: 1114660 - RNA, 13 nt, Mycobacterium bovis subsp bovis AF2122/97
gccaguccagcgc

SEQ ID NO: 1114661 - RNA, 15 nt, Mycobacterium bovis subsp bovis AF2122/97
gccauagcgccgcgc

SEQ ID NO: 1114662 - RNA, 16 nt, Mycobacterium bovis subsp bovis AF2122/97
gccauagcgccgcgcc

SEQ ID NO: 1114663 - RNA, 21 nt, Mycobacterium bovis subsp bovis AF2122/97
gccaguccgcagcguccagcg

SEQ ID NO: 1114664 - RNA, 19 nt, Mycobacterium bovis subsp bovis AF2122/97
gccaguccgaaagccgccg

SEQ ID NO: 1114665 - RNA, 20 nt, Mycobacterium bovis subsp bovis AF2122/97
gccaguccgaaagccgccga

SEQ ID NO: 1114666 - RNA, 20 nt, Mycobacterium bovis subsp bovis AF2122/97
gccagucaggaaaccggcgc

SEQ ID NO: 1114667 - RNA, 18 nt, Mycobacterium bovis subsp bovis AF2122/97
gccaguaugcggugcccg

SEQ ID NO: 1114668 - RNA, 13 nt, Mycobacterium bovis subsp bovis AF2122/97
gccaguauggccg

SEQ ID NO: 1114669 - RNA, 23 nt, Mycobacterium bovis subsp bovis AF2122/97
gccaguauggccgccaccgcgac

SEQ ID NO: 1114670 - RNA, 14 nt, Mycobacterium bovis subsp bovis AF2122/97
gccagucccggcgc

SEQ ID NO: 1114671 - RNA, 16 nt, Mycobacterium bovis subsp bovis AF2122/97
gccagucccggcgcac

SEQ ID NO: 1114672 - RNA, 12 nt, Mycobacterium bovis subsp bovis AF2122/97
gccaucacgcac

SEQ ID NO: 1114673 - RNA, 15 nt, Mycobacterium bovis subsp bovis AF2122/97
gccaucacgcgcuca

SEQ ID NO: 1114674 - RNA, 22 nt, Mycobacterium bovis subsp bovis AF2122/97
gccaucacggucagcucgcuga

SEQ ID NO: 1114675 - RNA, 21 nt, Mycobacterium bovis subsp bovis AF2122/97
gccaucaacaggccucgaccg

SEQ ID NO: 1114676 - RNA, 17 nt, Mycobacterium bovis subsp bovis AF2122/97
gccauagugaggccgac

SEQ ID NO: 1114677 - RNA, 15 nt, Mycobacterium bovis subsp bovis AF2122/97
gccagcccagccgcc

SEQ ID NO: 1114678 - RNA, 14 nt, Mycobacterium bovis subsp bovis AF2122/97
gccagcccagcacg

SEQ ID NO: 1114679 - RNA, 15 nt, Mycobacterium bovis subsp bovis AF2122/97
gccagcccagcacgc

SEQ ID NO: 1114680 - RNA, 14 nt, Mycobacterium bovis subsp bovis AF2122/97
gccagccgcgagcc

SEQ ID NO: 1114681 - RNA, 20 nt, Mycobacterium bovis subsp bovis AF2122/97
gccagccgcgagccggugau

SEQ ID NO: 1114682 - RNA, 20 nt, Mycobacterium bovis subsp bovis AF2122/97
gccagccccauugccgucgc

SEQ ID NO: 1114683 - RNA, 13 nt, Mycobacterium bovis subsp bovis AF2122/97
gccagccgcggcc

SEQ ID NO: 1114684 - RNA, 15 nt, Mycobacterium bovis subsp bovis AF2122/97
gccagccgcggcccu

SEQ ID NO: 1114685 - RNA, 14 nt, Mycobacterium bovis subsp bovis AF2122/97
gccagccgcucacc

SEQ ID NO: 1114686 - RNA, 16 nt, Mycobacterium bovis subsp bovis AF2122/97
gccagccaccgaucga

SEQ ID NO: 1114687 - RNA, 15 nt, Mycobacterium bovis subsp bovis AF2122/97
gccagccacuccucg

SEQ ID NO: 1114688 - RNA, 21 nt, Mycobacterium bovis subsp bovis AF2122/97
gccagccaggcgaaguacccg

SEQ ID NO: 1114689 - RNA, 15 nt, Mycobacterium bovis subsp bovis AF2122/97
gccagccagcgggcg

SEQ ID NO: 1114690 - RNA, 15 nt, Mycobacterium bovis subsp bovis AF2122/97
gccagccagcgggug

SEQ ID NO: 1114691 - RNA, 16 nt, Mycobacterium bovis subsp bovis AF2122/97
gccagcaugacaccgg

SEQ ID NO: 1114692 - RNA, 17 nt, Mycobacterium bovis subsp bovis AF2122/97
gccagcaugacaccggc

SEQ ID NO: 1114693 - RNA, 18 nt, Mycobacterium bovis subsp bovis AF2122/97
gccagcaugacaccggcc

SEQ ID NO: 1114694 - RNA, 15 nt, Mycobacterium bovis subsp bovis AF2122/97
gccagccacagccga

SEQ ID NO: 1114695 - RNA, 15 nt, Mycobacterium bovis subsp bovis AF2122/97
gccagccaaccgucc

SEQ ID NO: 1114696 - RNA, 20 nt, Mycobacterium bovis subsp bovis AF2122/97
gccagccaaccguccggggc

SEQ ID NO: 1114697 - RNA, 17 nt, Mycobacterium bovis subsp bovis AF2122/97
gccagcauugacccgac

SEQ ID NO: 1114698 - RNA, 14 nt, Mycobacterium bovis subsp bovis AF2122/97
gccagcagugcggu

SEQ ID NO: 1114699 - RNA, 21 nt, Mycobacterium bovis subsp bovis AF2122/97
gccagcagguauuugccgugc

SEQ ID NO: 1114700 - RNA, 16 nt, Mycobacterium bovis subsp bovis AF2122/97
gccagcaagacgauga

SEQ ID NO: 1114701 - RNA, 14 nt, Mycobacterium bovis subsp bovis AF2122/97
gccagcaucggcag

SEQ ID NO: 1114702 - RNA, 18 nt, Mycobacterium bovis subsp bovis AF2122/97
gccagcaucggcagcagc

SEQ ID NO: 1114703 - RNA, 19 nt, Mycobacterium bovis subsp bovis AF2122/97
gccagcaucggcagcagcg

SEQ ID NO: 1114704 - RNA, 21 nt, Mycobacterium bovis subsp bovis AF2122/97
gccagcaucggcagcagcgca

SEQ ID NO: 1114705 - RNA, 21 nt, Mycobacterium bovis subsp bovis AF2122/97
gccagcaccacggccagcggg

SEQ ID NO: 1114706 - RNA, 17 nt, Mycobacterium bovis subsp bovis AF2122/97
gccagcaggggacgggc

SEQ ID NO: 1114707 - RNA, 15 nt, Mycobacterium bovis subsp bovis AF2122/97
gccagcaccacggcc

SEQ ID NO: 1114708 - RNA, 17 nt, Mycobacterium bovis subsp bovis AF2122/97
gccagcaccacggccag

SEQ ID NO: 1114709 - RNA, 19 nt, Mycobacterium bovis subsp bovis AF2122/97
gccagcaccacggccagcg

SEQ ID NO: 1114710 - RNA, 16 nt, Mycobacterium bovis subsp bovis AF2122/97
gccagcacaccgucga

SEQ ID NO: 1114711 - RNA, 18 nt, Mycobacterium bovis subsp bovis AF2122/97
gccagcaaugcccgcacc

SEQ ID NO: 1114712 - RNA, 20 nt, Mycobacterium bovis subsp bovis AF2122/97
gccagcaaugcccgcaccgc

SEQ ID NO: 1114713 - RNA, 23 nt, Mycobacterium bovis subsp bovis AF2122/97
gccagcggcaauggccagcacca

SEQ ID NO: 1114714 - RNA, 15 nt, Mycobacterium bovis subsp bovis AF2122/97
gccagcggcacaccc

SEQ ID NO: 1114715 - RNA, 15 nt, Mycobacterium bovis subsp bovis AF2122/97
gccagcggcagccug

SEQ ID NO: 1114716 - RNA, 22 nt, Mycobacterium bovis subsp bovis AF2122/97
gccagcggcccgucaccgcggg

SEQ ID NO: 1114717 - RNA, 16 nt, Mycobacterium bovis subsp bovis AF2122/97
gccagcggccgggcgg

SEQ ID NO: 1114718 - RNA, 20 nt, Mycobacterium bovis subsp bovis AF2122/97
gccagcggcaauggccagca

SEQ ID NO: 1114719 - RNA, 19 nt, Mycobacterium bovis subsp bovis AF2122/97
gccagcgcuucgucggccg

SEQ ID NO: 1114720 - RNA, 22 nt, Mycobacterium bovis subsp bovis AF2122/97
gccagcgcuucgucggccggca

SEQ ID NO: 1114721 - RNA, 17 nt, Mycobacterium bovis subsp bovis AF2122/97
gccagcggaguaaacaa

SEQ ID NO: 1114722 - RNA, 22 nt, Mycobacterium bovis subsp bovis AF2122/97
gccagcgucgcgauugccgcgg

SEQ ID NO: 1114723 - RNA, 15 nt, Mycobacterium bovis subsp bovis AF2122/97
gccagcgucgaccaa

SEQ ID NO: 1114724 - RNA, 13 nt, Mycobacterium bovis subsp bovis AF2122/97
gccagcgccggcc

SEQ ID NO: 1114725 - RNA, 17 nt, Mycobacterium bovis subsp bovis AF2122/97
gccagcgccucggcauc

SEQ ID NO: 1114726 - RNA, 18 nt, Mycobacterium bovis subsp bovis AF2122/97
gccagcgccucggcaucg

SEQ ID NO: 1114727 - RNA, 12 nt, Mycobacterium bovis subsp bovis AF2122/97
gccagcgcgaac

SEQ ID NO: 1114728 - RNA, 16 nt, Mycobacterium bovis subsp bovis AF2122/97
gccagcgcgaccaaug

SEQ ID NO: 1114729 - RNA, 13 nt, Mycobacterium bovis subsp bovis AF2122/97
gccagcgcggcgu

SEQ ID NO: 1114730 - RNA, 14 nt, Mycobacterium bovis subsp bovis AF2122/97
gccagcgcgguguc

SEQ ID NO: 1114731 - RNA, 23 nt, Mycobacterium bovis subsp bovis AF2122/97
gccagccuuggacgugcgcgcca

SEQ ID NO: 1114732 - RNA, 24 nt, Mycobacterium bovis subsp bovis AF2122/97
gccagccggauguuggucggcuga

SEQ ID NO: 1114733 - RNA, 21 nt, Mycobacterium bovis subsp bovis AF2122/97
gccagcgaaucgcuggugaag

SEQ ID NO: 1114734 - RNA, 17 nt, Mycobacterium bovis subsp bovis AF2122/97
gccagcgagcauaccgc

SEQ ID NO: 1114735 - RNA, 14 nt, Mycobacterium bovis subsp bovis AF2122/97
gccagccggccgcg

SEQ ID NO: 1114736 - RNA, 20 nt, Mycobacterium bovis subsp bovis AF2122/97
gccagccggccgcgaccgcg

SEQ ID NO: 1114737 - RNA, 21 nt, Mycobacterium bovis subsp bovis AF2122/97
gccagccgcucacccggucgc

SEQ ID NO: 1114738 - RNA, 14 nt, Mycobacterium bovis subsp bovis AF2122/97
gccagccggccuca

SEQ ID NO: 1114739 - RNA, 23 nt, Mycobacterium bovis subsp bovis AF2122/97
gccagccgcugccacaggugacc

SEQ ID NO: 1114740 - RNA, 21 nt, Mycobacterium bovis subsp bovis AF2122/97
gccagccugugcugccaacgg

SEQ ID NO: 1114741 - RNA, 15 nt, Mycobacterium bovis subsp bovis AF2122/97
gccagccugcuggcc

SEQ ID NO: 1114742 - RNA, 19 nt, Mycobacterium bovis subsp bovis AF2122/97
gccagccugcuggccgcgg

SEQ ID NO: 1114743 - RNA, 12 nt, Mycobacterium bovis subsp bovis AF2122/97
gccagccggcgc

SEQ ID NO: 1114744 - RNA, 16 nt, Mycobacterium bovis subsp bovis AF2122/97
gccaacggcuccgggc

SEQ ID NO: 1114745 - RNA, 20 nt, Mycobacterium bovis subsp bovis AF2122/97
gccaacgcgucccgccgcac

SEQ ID NO: 1114746 - RNA, 23 nt, Mycobacterium bovis subsp bovis AF2122/97
gccaacggcacccugcggcaccu

SEQ ID NO: 1114747 - RNA, 22 nt, Mycobacterium bovis subsp bovis AF2122/97
gccaacgguaguugcgcggcau

SEQ ID NO: 1114748 - RNA, 16 nt, Mycobacterium bovis subsp bovis AF2122/97
gccaacgcgcagagcg

SEQ ID NO: 1114749 - RNA, 22 nt, Mycobacterium bovis subsp bovis AF2122/97
gccaacgcgcagagcguuccgc

SEQ ID NO: 1114750 - RNA, 19 nt, Mycobacterium bovis subsp bovis AF2122/97
gccaacggcacccugcggc

SEQ ID NO: 1114751 - RNA, 14 nt, Mycobacterium bovis subsp bovis AF2122/97
gccacgaccgccga

SEQ ID NO: 1114752 - RNA, 20 nt, Mycobacterium bovis subsp bovis AF2122/97
gccacgagcaacgggcgaac

SEQ ID NO: 1114753 - RNA, 14 nt, Mycobacterium bovis subsp bovis AF2122/97
gccacgacgaacac

SEQ ID NO: 1114754 - RNA, 16 nt, Mycobacterium bovis subsp bovis AF2122/97
gccacgacgaacacca

SEQ ID NO: 1114755 - RNA, 14 nt, Mycobacterium bovis subsp bovis AF2122/97
gccacgacgcccac

SEQ ID NO: 1114756 - RNA, 14 nt, Mycobacterium bovis subsp bovis AF2122/97
gccacgacccagca

SEQ ID NO: 1114757 - RNA, 16 nt, Mycobacterium bovis subsp bovis AF2122/97
gccaacgugacgccgg

SEQ ID NO: 1114758 - RNA, 23 nt, Mycobacterium bovis subsp bovis AF2122/97
gccaacgguaguugcgcggcauc

SEQ ID NO: 1114759 - RNA, 15 nt, Mycobacterium bovis subsp bovis AF2122/97
gccacgaugauccca

SEQ ID NO: 1114760 - RNA, 22 nt, Mycobacterium bovis subsp bovis AF2122/97
gccacgaggacccgucgagcgu

SEQ ID NO: 1114761 - RNA, 16 nt, Mycobacterium bovis subsp bovis AF2122/97
gccacgagucgcacgu

SEQ ID NO: 1114762 - RNA, 18 nt, Mycobacterium bovis subsp bovis AF2122/97
gccacgaggacccgucga

SEQ ID NO: 1114763 - RNA, 16 nt, Mycobacterium bovis subsp bovis AF2122/97
gccacgaugucgucga

SEQ ID NO: 1114764 - RNA, 17 nt, Mycobacterium bovis subsp bovis AF2122/97
gccacgaugucgucgau

SEQ ID NO: 1114765 - RNA, 20 nt, Mycobacterium bovis subsp bovis AF2122/97
gccacgaugucgucgaugaa

SEQ ID NO: 1114766 - RNA, 17 nt, Mycobacterium bovis subsp bovis AF2122/97
gccacgcacccggcaau

SEQ ID NO: 1114767 - RNA, 15 nt, Mycobacterium bovis subsp bovis AF2122/97
gccacgcagcacggc

SEQ ID NO: 1114768 - RNA, 19 nt, Mycobacterium bovis subsp bovis AF2122/97
gccacgcagcacggcaccc

SEQ ID NO: 1114769 - RNA, 18 nt, Mycobacterium bovis subsp bovis AF2122/97
gccacgccagccaggcga

SEQ ID NO: 1114770 - RNA, 12 nt, Mycobacterium bovis subsp bovis AF2122/97
gccacgccagcg

SEQ ID NO: 1114771 - RNA, 14 nt, Mycobacterium bovis subsp bovis AF2122/97
gccacgccaccgcg

SEQ ID NO: 1114772 - RNA, 13 nt, Mycobacterium bovis subsp bovis AF2122/97
gccacgucgccgg

SEQ ID NO: 1114773 - RNA, 19 nt, Mycobacterium bovis subsp bovis AF2122/97
gccacgucgccggcuaccg

SEQ ID NO: 1114774 - RNA, 15 nt, Mycobacterium bovis subsp bovis AF2122/97
gccacgucgagcacc

SEQ ID NO: 1114775 - RNA, 16 nt, Mycobacterium bovis subsp bovis AF2122/97
gccacguagcagcgcc

SEQ ID NO: 1114776 - RNA, 19 nt, Mycobacterium bovis subsp bovis AF2122/97
gccacguagcagcgccggc

SEQ ID NO: 1114777 - RNA, 22 nt, Mycobacterium bovis subsp bovis AF2122/97
gccacguagcagcgccggcacc

SEQ ID NO: 1114778 - RNA, 16 nt, Mycobacterium bovis subsp bovis AF2122/97
gccacggcuucgccgc

SEQ ID NO: 1114779 - RNA, 19 nt, Mycobacterium bovis subsp bovis AF2122/97
gccacggcgucggccaccc

SEQ ID NO: 1114780 - RNA, 19 nt, Mycobacterium bovis subsp bovis AF2122/97
gccacggcuuugcggcgcg

SEQ ID NO: 1114781 - RNA, 23 nt, Mycobacterium bovis subsp bovis AF2122/97
gccacggcugaccggggucggcc

SEQ ID NO: 1114782 - RNA, 14 nt, Mycobacterium bovis subsp bovis AF2122/97
gccacggcugcgga

SEQ ID NO: 1114783 - RNA, 14 nt, Mycobacterium bovis subsp bovis AF2122/97
gccacggcgucggc

SEQ ID NO: 1114784 - RNA, 14 nt, Mycobacterium bovis subsp bovis AF2122/97
gccacggcgccuac

SEQ ID NO: 1114785 - RNA, 20 nt, Mycobacterium bovis subsp bovis AF2122/97
gccacggcgccuacaccggc

SEQ ID NO: 1114786 - RNA, 13 nt, Mycobacterium bovis subsp bovis AF2122/97
gccacgccgccgg

SEQ ID NO: 1114787 - RNA, 23 nt, Mycobacterium bovis subsp bovis AF2122/97
gccacgccgccggugaacgucac

SEQ ID NO: 1114788 - RNA, 16 nt, Mycobacterium bovis subsp bovis AF2122/97
gccacgccaccgcggu

SEQ ID NO: 1114789 - RNA, 17 nt, Mycobacterium bovis subsp bovis AF2122/97
gccacgccaccgcgguc

SEQ ID NO: 1114790 - RNA, 20 nt, Mycobacterium bovis subsp bovis AF2122/97
gccacgcaugggccagguca

SEQ ID NO: 1114791 - RNA, 17 nt, Mycobacterium bovis subsp bovis AF2122/97
gccacgucuccuucggc

SEQ ID NO: 1114792 - RNA, 15 nt, Mycobacterium bovis subsp bovis AF2122/97
gccacgucgaugugc

SEQ ID NO: 1114793 - RNA, 16 nt, Mycobacterium bovis subsp bovis AF2122/97
gccacgucgucgccca

SEQ ID NO: 1114794 - RNA, 14 nt, Mycobacterium bovis subsp bovis AF2122/97
gccacgucucgcga

SEQ ID NO: 1114795 - RNA, 17 nt, Mycobacterium bovis subsp bovis AF2122/97
gccacguggucgagcag

SEQ ID NO: 1114796 - RNA, 19 nt, Mycobacterium bovis subsp bovis AF2122/97
gccacguugaucccgaacc

SEQ ID NO: 1114797 - RNA, 22 nt, Mycobacterium bovis subsp bovis AF2122/97
gccacguguggugugucaccgg

SEQ ID NO: 1114798 - RNA, 16 nt, Mycobacterium bovis subsp bovis AF2122/97
gccacguucgcggcca

SEQ ID NO: 1114799 - RNA, 18 nt, Mycobacterium bovis subsp bovis AF2122/97
gccacguucgcggccaac

SEQ ID NO: 1114800 - RNA, 21 nt, Mycobacterium bovis subsp bovis AF2122/97
gccacguccaucaccggcggc

SEQ ID NO: 1114801 - RNA, 19 nt, Mycobacterium bovis subsp bovis AF2122/97
gccacuagcauugucgccg

SEQ ID NO: 1114802 - RNA, 23 nt, Mycobacterium bovis subsp bovis AF2122/97
gccacuagcauugucgccggaug

SEQ ID NO: 1114803 - RNA, 19 nt, Mycobacterium bovis subsp bovis AF2122/97
gccacuagcccugagcgaa

SEQ ID NO: 1114804 - RNA, 22 nt, Mycobacterium bovis subsp bovis AF2122/97
gccacucaagauuuccaucgca

SEQ ID NO: 1114805 - RNA, 19 nt, Mycobacterium bovis subsp bovis AF2122/97
gccacucagcccgacaccg

SEQ ID NO: 1114806 - RNA, 20 nt, Mycobacterium bovis subsp bovis AF2122/97
gccacuccaugagccguagu

SEQ ID NO: 1114807 - RNA, 12 nt, Mycobacterium bovis subsp bovis AF2122/97
gccacucgauca

SEQ ID NO: 1114808 - RNA, 17 nt, Mycobacterium bovis subsp bovis AF2122/97
gccacucgaucaccggc

SEQ ID NO: 1114809 - RNA, 18 nt, Mycobacterium bovis subsp bovis AF2122/97
gccacucgaucaccggca

SEQ ID NO: 1114810 - RNA, 15 nt, Mycobacterium bovis subsp bovis AF2122/97
gccagaacggcgucg

SEQ ID NO: 1114811 - RNA, 17 nt, Mycobacterium bovis subsp bovis AF2122/97
gccagaacggcgucgaa

SEQ ID NO: 1114812 - RNA, 14 nt, Mycobacterium bovis subsp bovis AF2122/97
gccagaaacccggc

SEQ ID NO: 1114813 - RNA, 19 nt, Mycobacterium bovis subsp bovis AF2122/97
gccagaaacccggcgacca

SEQ ID NO: 1114814 - RNA, 16 nt, Mycobacterium bovis subsp bovis AF2122/97
gccagaagaccuggcg

SEQ ID NO: 1114815 - RNA, 17 nt, Mycobacterium bovis subsp bovis AF2122/97
gccagaauugccggcga

SEQ ID NO: 1114816 - RNA, 18 nt, Mycobacterium bovis subsp bovis AF2122/97
gccagaauugccggcgau

SEQ ID NO: 1114817 - RNA, 14 nt, Mycobacterium bovis subsp bovis AF2122/97
gccagacggugcag

SEQ ID NO: 1114818 - RNA, 15 nt, Mycobacterium bovis subsp bovis AF2122/97
gccagaccgcgcgca

SEQ ID NO: 1114819 - RNA, 13 nt, Mycobacterium bovis subsp bovis AF2122/97
gccagaccgcggc

SEQ ID NO: 1114820 - RNA, 14 nt, Mycobacterium bovis subsp bovis AF2122/97
gccagaccgcggcg

SEQ ID NO: 1114821 - RNA, 14 nt, Mycobacterium bovis subsp bovis AF2122/97
gccagaccgcacca

SEQ ID NO: 1114822 - RNA, 13 nt, Mycobacterium bovis subsp bovis AF2122/97
gccagaccgccga

SEQ ID NO: 1114823 - RNA, 11 nt, Mycobacterium bovis subsp bovis AF2122/97
gccagacccga

SEQ ID NO: 1114824 - RNA, 16 nt, Mycobacterium bovis subsp bovis AF2122/97
gccagacccuggccgu

SEQ ID NO: 1114825 - RNA, 18 nt, Mycobacterium bovis subsp bovis AF2122/97
gccagaccagggcagcgg

SEQ ID NO: 1114826 - RNA, 19 nt, Mycobacterium bovis subsp bovis AF2122/97
gccagaccagggcagcggc

SEQ ID NO: 1114827 - RNA, 21 nt, Mycobacterium bovis subsp bovis AF2122/97
gccagaccagggcagcggcca

SEQ ID NO: 1114828 - RNA, 15 nt, Mycobacterium bovis subsp bovis AF2122/97
gccagacccaccacc

SEQ ID NO: 1114829 - RNA, 20 nt, Mycobacterium bovis subsp bovis AF2122/97
gccagaucucgcgcgcggcg

SEQ ID NO: 1114830 - RNA, 18 nt, Mycobacterium bovis subsp bovis AF2122/97
gccagaucggucggccaa

SEQ ID NO: 1114831 - RNA, 15 nt, Mycobacterium bovis subsp bovis AF2122/97
gccagaucggucggc

SEQ ID NO: 1114832 - RNA, 22 nt, Mycobacterium bovis subsp bovis AF2122/97
gccagaucgcuaggaccgcggu

SEQ ID NO: 1114833 - RNA, 17 nt, Mycobacterium bovis subsp bovis AF2122/97
gccagaucgaacgcagc

SEQ ID NO: 1114834 - RNA, 20 nt, Mycobacterium bovis subsp bovis AF2122/97
gccagaucgaacgcagccag

SEQ ID NO: 1114835 - RNA, 21 nt, Mycobacterium bovis subsp bovis AF2122/97
gccagaucgaacgcagccagc

SEQ ID NO: 1114836 - RNA, 18 nt, Mycobacterium bovis subsp bovis AF2122/97
gccagaucgaagcgcagc

SEQ ID NO: 1114837 - RNA, 21 nt, Mycobacterium bovis subsp bovis AF2122/97
gccagaucgaagcgcagcacc

SEQ ID NO: 1114838 - RNA, 19 nt, Mycobacterium bovis subsp bovis AF2122/97
gccagauaguuguucgacu

SEQ ID NO: 1114839 - RNA, 14 nt, Mycobacterium bovis subsp bovis AF2122/97
gccagaucacgcac

SEQ ID NO: 1114840 - RNA, 14 nt, Mycobacterium bovis subsp bovis AF2122/97
gccagaucagcacc

SEQ ID NO: 1114841 - RNA, 15 nt, Mycobacterium bovis subsp bovis AF2122/97
gccagaucagccgcc

SEQ ID NO: 1114842 - RNA, 19 nt, Mycobacterium bovis subsp bovis AF2122/97
gccagaucagccgccgccu

SEQ ID NO: 1114843 - RNA, 15 nt, Mycobacterium bovis subsp bovis AF2122/97
gccagaucgaacgca

SEQ ID NO: 1114844 - RNA, 13 nt, Mycobacterium bovis subsp bovis AF2122/97
gccagagaucagc

SEQ ID NO: 1114845 - RNA, 15 nt, Mycobacterium bovis subsp bovis AF2122/97
gccagagaucgaggu

SEQ ID NO: 1114846 - RNA, 17 nt, Mycobacterium bovis subsp bovis AF2122/97
gcccgccgacgccagau

SEQ ID NO: 1114847 - RNA, 23 nt, Mycobacterium bovis subsp bovis AF2122/97
gcccgcgaacgaucccgccgauc

SEQ ID NO: 1114848 - RNA, 15 nt, Mycobacterium bovis subsp bovis AF2122/97
gcccgcccuggcaac

SEQ ID NO: 1114849 - RNA, 19 nt, Mycobacterium bovis subsp bovis AF2122/97
gcccgcccuugcggcguga

SEQ ID NO: 1114850 - RNA, 14 nt, Mycobacterium bovis subsp bovis AF2122/97
gcccgcccgagccg

SEQ ID NO: 1114851 - RNA, 23 nt, Mycobacterium bovis subsp bovis AF2122/97
gcccgccccgcgccuuggcaccc

SEQ ID NO: 1114852 - RNA, 19 nt, Mycobacterium bovis subsp bovis AF2122/97
gcccgcgccaccagcaccg

SEQ ID NO: 1114853 - RNA, 13 nt, Mycobacterium bovis subsp bovis AF2122/97
gcccgcgccaccg

SEQ ID NO: 1114854 - RNA, 16 nt, Mycobacterium bovis subsp bovis AF2122/97
gcccgcgccaccgaua

SEQ ID NO: 1114855 - RNA, 14 nt, Mycobacterium bovis subsp bovis AF2122/97
gcccgcgccaccgg

SEQ ID NO: 1114856 - RNA, 15 nt, Mycobacterium bovis subsp bovis AF2122/97
gcccgcgccaccggc

SEQ ID NO: 1114857 - RNA, 16 nt, Mycobacterium bovis subsp bovis AF2122/97
gcccgcgccaccggca

SEQ ID NO: 1114858 - RNA, 18 nt, Mycobacterium bovis subsp bovis AF2122/97
gcccgcgcccccggugcc

SEQ ID NO: 1114859 - RNA, 22 nt, Mycobacterium bovis subsp bovis AF2122/97
gcccgcgcagcacugcggcagc

SEQ ID NO: 1114860 - RNA, 14 nt, Mycobacterium bovis subsp bovis AF2122/97
gcccgcgccgccgc

SEQ ID NO: 1114861 - RNA, 15 nt, Mycobacterium bovis subsp bovis AF2122/97
gcccgcgccgccgcc

SEQ ID NO: 1114862 - RNA, 14 nt, Mycobacterium bovis subsp bovis AF2122/97
gcccgcgccgccgg

SEQ ID NO: 1114863 - RNA, 15 nt, Mycobacterium bovis subsp bovis AF2122/97
gcccgcgccgccgga

SEQ ID NO: 1114864 - RNA, 13 nt, Mycobacterium bovis subsp bovis AF2122/97
gcccgcgaucggg

SEQ ID NO: 1114865 - RNA, 15 nt, Mycobacterium bovis subsp bovis AF2122/97
gcccgcgcagcacug

SEQ ID NO: 1114866 - RNA, 20 nt, Mycobacterium bovis subsp bovis AF2122/97
gcccgcgcagcacugcggca

SEQ ID NO: 1114867 - RNA, 18 nt, Mycobacterium bovis subsp bovis AF2122/97
gcccgcgaauacgaggac

SEQ ID NO: 1114868 - RNA, 13 nt, Mycobacterium bovis subsp bovis AF2122/97
gcccgcgggauca

SEQ ID NO: 1114869 - RNA, 15 nt, Mycobacterium bovis subsp bovis AF2122/97
gcccgcgggaucagc

SEQ ID NO: 1114870 - RNA, 15 nt, Mycobacterium bovis subsp bovis AF2122/97
gcccgcgcuugaucc

SEQ ID NO: 1114871 - RNA, 19 nt, Mycobacterium bovis subsp bovis AF2122/97
gcccgcgggcaguggcagc

SEQ ID NO: 1114872 - RNA, 20 nt, Mycobacterium bovis subsp bovis AF2122/97
gcccgcgggcaagccggaca

SEQ ID NO: 1114873 - RNA, 21 nt, Mycobacterium bovis subsp bovis AF2122/97
gcccgcgggcgguaaucgcga

SEQ ID NO: 1114874 - RNA, 16 nt, Mycobacterium bovis subsp bovis AF2122/97
gcccgcgguccggcga

SEQ ID NO: 1114875 - RNA, 16 nt, Mycobacterium bovis subsp bovis AF2122/97
gcccgcggucgcgacu

SEQ ID NO: 1114876 - RNA, 20 nt, Mycobacterium bovis subsp bovis AF2122/97
gcccgcggucgcgacuacca

SEQ ID NO: 1114877 - RNA, 13 nt, Mycobacterium bovis subsp bovis AF2122/97
gcccgcggugacc

SEQ ID NO: 1114878 - RNA, 16 nt, Mycobacterium bovis subsp bovis AF2122/97
gcccgcggugaccacc

SEQ ID NO: 1114879 - RNA, 20 nt, Mycobacterium bovis subsp bovis AF2122/97
gcccgcggugaccaccccgg

SEQ ID NO: 1114880 - RNA, 18 nt, Mycobacterium bovis subsp bovis AF2122/97
gcccgcggugacgagcac

SEQ ID NO: 1114881 - RNA, 17 nt, Mycobacterium bovis subsp bovis AF2122/97
gcccgcggugacgcaac

SEQ ID NO: 1114882 - RNA, 19 nt, Mycobacterium bovis subsp bovis AF2122/97
gcccgcgcgguggcggucg

SEQ ID NO: 1114883 - RNA, 16 nt, Mycobacterium bovis subsp bovis AF2122/97
gcccgcgcugccgacu

SEQ ID NO: 1114884 - RNA, 15 nt, Mycobacterium bovis subsp bovis AF2122/97
gcccgcggacgugcc

SEQ ID NO: 1114885 - RNA, 18 nt, Mycobacterium bovis subsp bovis AF2122/97
gcccgcggacgugccggu

SEQ ID NO: 1114886 - RNA, 14 nt, Mycobacterium bovis subsp bovis AF2122/97
gcccgcggccgcca

SEQ ID NO: 1114887 - RNA, 19 nt, Mycobacterium bovis subsp bovis AF2122/97
gcccgcggccgccagcgga

SEQ ID NO: 1114888 - RNA, 14 nt, Mycobacterium bovis subsp bovis AF2122/97
gcccgcgcggcggu

SEQ ID NO: 1114889 - RNA, 13 nt, Mycobacterium bovis subsp bovis AF2122/97
gcccgcgcggcgc

SEQ ID NO: 1114890 - RNA, 22 nt, Mycobacterium bovis subsp bovis AF2122/97
gcccgcgcggccaaucagcccg

SEQ ID NO: 1114891 - RNA, 14 nt, Mycobacterium bovis subsp bovis AF2122/97
gcccgcugccaucg

SEQ ID NO: 1114892 - RNA, 15 nt, Mycobacterium bovis subsp bovis AF2122/97
gcccgcugccaucgc

SEQ ID NO: 1114893 - RNA, 20 nt, Mycobacterium bovis subsp bovis AF2122/97
gcccgcugagccagcuccac

SEQ ID NO: 1114894 - RNA, 14 nt, Mycobacterium bovis subsp bovis AF2122/97
gcccgcugcgccgg

SEQ ID NO: 1114895 - RNA, 12 nt, Mycobacterium bovis subsp bovis AF2122/97
gcccgcugggcu

SEQ ID NO: 1114896 - RNA, 15 nt, Mycobacterium bovis subsp bovis AF2122/97
gcccgcugcggcggc

SEQ ID NO: 1114897 - RNA, 17 nt, Mycobacterium bovis subsp bovis AF2122/97
gcccggaacccgagccg

SEQ ID NO: 1114898 - RNA, 18 nt, Mycobacterium bovis subsp bovis AF2122/97
gcccggaaccggcgugca

SEQ ID NO: 1114899 - RNA, 18 nt, Mycobacterium bovis subsp bovis AF2122/97
gcccggaacgaaugucac

SEQ ID NO: 1114900 - RNA, 15 nt, Mycobacterium bovis subsp bovis AF2122/97
gcccgcucgaucggc

SEQ ID NO: 1114901 - RNA, 14 nt, Mycobacterium bovis subsp bovis AF2122/97
gcccgcuccuccgg

SEQ ID NO: 1114902 - RNA, 19 nt, Mycobacterium bovis subsp bovis AF2122/97
gcccgcuccuccggcacca

SEQ ID NO: 1114903 - RNA, 20 nt, Mycobacterium bovis subsp bovis AF2122/97
gcccgcucgaucggcagcca

SEQ ID NO: 1114904 - RNA, 13 nt, Mycobacterium bovis subsp bovis AF2122/97
gcccgcucgaugu

SEQ ID NO: 1114905 - RNA, 11 nt, Mycobacterium bovis subsp bovis AF2122/97
gcccgcucggg

SEQ ID NO: 1114906 - RNA, 14 nt, Mycobacterium bovis subsp bovis AF2122/97
gcccgcucggccgc

SEQ ID NO: 1114907 - RNA, 17 nt, Mycobacterium bovis subsp bovis AF2122/97
gcccgcugaccaucaca

SEQ ID NO: 1114908 - RNA, 20 nt, Mycobacterium bovis subsp bovis AF2122/97
gcccgcugaccaucacaccc

SEQ ID NO: 1114909 - RNA, 17 nt, Mycobacterium bovis subsp bovis AF2122/97
gcccgcucggccgcagc

SEQ ID NO: 1114910 - RNA, 13 nt, Mycobacterium bovis subsp bovis AF2122/97
gcccgcuccgcgg

SEQ ID NO: 1114911 - RNA, 15 nt, Mycobacterium bovis subsp bovis AF2122/97
gcccgcuccgcggcu

SEQ ID NO: 1114912 - RNA, 17 nt, Mycobacterium bovis subsp bovis AF2122/97
gcccgcuccgccgucgc

SEQ ID NO: 1114913 - RNA, 23 nt, Mycobacterium bovis subsp bovis AF2122/97
gcccgcuccgccgucgccgccgg

SEQ ID NO: 1114914 - RNA, 21 nt, Mycobacterium bovis subsp bovis AF2122/97
gcccgcuccaacacccgccgg

SEQ ID NO: 1114915 - RNA, 18 nt, Mycobacterium bovis subsp bovis AF2122/97
gcccgcucagccguccgg

SEQ ID NO: 1114916 - RNA, 13 nt, Mycobacterium bovis subsp bovis AF2122/97
gcccggcaccgcg

SEQ ID NO: 1114917 - RNA, 18 nt, Mycobacterium bovis subsp bovis AF2122/97
gcccggcacggugucgcg

SEQ ID NO: 1114918 - RNA, 18 nt, Mycobacterium bovis subsp bovis AF2122/97
gcccggcagauguguccg

SEQ ID NO: 1114919 - RNA, 22 nt, Mycobacterium bovis subsp bovis AF2122/97
gcccggcaucgcgaucggggcg

SEQ ID NO: 1114920 - RNA, 12 nt, Mycobacterium bovis subsp bovis AF2122/97
gcccggcaucgc

SEQ ID NO: 1114921 - RNA, 21 nt, Mycobacterium bovis subsp bovis AF2122/97
gcccggcaguucgcggccauc

SEQ ID NO: 1114922 - RNA, 23 nt, Mycobacterium bovis subsp bovis AF2122/97
gcccggcaguucgcggccaucgc

SEQ ID NO: 1114923 - RNA, 18 nt, Mycobacterium bovis subsp bovis AF2122/97
gcccggacgcaacacccg

SEQ ID NO: 1114924 - RNA, 23 nt, Mycobacterium bovis subsp bovis AF2122/97
gcccggacgcaacacccgggcga

SEQ ID NO: 1114925 - RNA, 20 nt, Mycobacterium bovis subsp bovis AF2122/97
gcccggacaugcgggcagca

SEQ ID NO: 1114926 - RNA, 21 nt, Mycobacterium bovis subsp bovis AF2122/97
gcccggacguaggcaccccgg

SEQ ID NO: 1114927 - RNA, 17 nt, Mycobacterium bovis subsp bovis AF2122/97
gcccggacgucggcggc

SEQ ID NO: 1114928 - RNA, 16 nt, Mycobacterium bovis subsp bovis AF2122/97
gcccggacgauggcgu

SEQ ID NO: 1114929 - RNA, 22 nt, Mycobacterium bovis subsp bovis AF2122/97
gcccggacgauggcgucggcca

SEQ ID NO: 1114930 - RNA, 13 nt, Mycobacterium bovis subsp bovis AF2122/97
gcccggauuggcg

SEQ ID NO: 1114931 - RNA, 18 nt, Mycobacterium bovis subsp bovis AF2122/97
gcccggauguccgccgac

SEQ ID NO: 1114932 - RNA, 20 nt, Mycobacterium bovis subsp bovis AF2122/97
gcccggaucucggcguaggc

SEQ ID NO: 1114933 - RNA, 14 nt, Mycobacterium bovis subsp bovis AF2122/97
gcccggcaaugauc

SEQ ID NO: 1114934 - RNA, 22 nt, Mycobacterium bovis subsp bovis AF2122/97
gcccggcaaugaucaucccggc

SEQ ID NO: 1114935 - RNA, 17 nt, Mycobacterium bovis subsp bovis AF2122/97
gcccggcgcaccaucgc

SEQ ID NO: 1114936 - RNA, 16 nt, Mycobacterium bovis subsp bovis AF2122/97
gcccggcgcgaagucg

SEQ ID NO: 1114937 - RNA, 13 nt, Mycobacterium bovis subsp bovis AF2122/97
gcccggcgcccgg

SEQ ID NO: 1114938 - RNA, 18 nt, Mycobacterium bovis subsp bovis AF2122/97
gcccggcgcuagcgccgc

SEQ ID NO: 1114939 - RNA, 13 nt, Mycobacterium bovis subsp bovis AF2122/97
gcccggcggcccg

SEQ ID NO: 1114940 - RNA, 14 nt, Mycobacterium bovis subsp bovis AF2122/97
gcccggcggccgcu

SEQ ID NO: 1114941 - RNA, 19 nt, Mycobacterium bovis subsp bovis AF2122/97
gcccggcggccgcuucggc

SEQ ID NO: 1114942 - RNA, 22 nt, Mycobacterium bovis subsp bovis AF2122/97
gcccggcggaucccgaggcgcc

SEQ ID NO: 1114943 - RNA, 14 nt, Mycobacterium bovis subsp bovis AF2122/97
gcccggcggccaac

SEQ ID NO: 1114944 - RNA, 12 nt, Mycobacterium bovis subsp bovis AF2122/97
gcccggcgguaa

SEQ ID NO: 1114945 - RNA, 12 nt, Mycobacterium bovis subsp bovis AF2122/97
gcccggcggcgg

SEQ ID NO: 1114946 - RNA, 22 nt, Mycobacterium bovis subsp bovis AF2122/97
gcccggcgugucgccgccacca

SEQ ID NO: 1114947 - RNA, 14 nt, Mycobacterium bovis subsp bovis AF2122/97
gcccggcgaugagc

SEQ ID NO: 1114948 - RNA, 13 nt, Mycobacterium bovis subsp bovis AF2122/97
gcccggcgugcag

SEQ ID NO: 1114949 - RNA, 23 nt, Mycobacterium bovis subsp bovis AF2122/97
gcccggcuaggagaucagcaccg

SEQ ID NO: 1114950 - RNA, 19 nt, Mycobacterium bovis subsp bovis AF2122/97
gcccggcucacagcacagc

SEQ ID NO: 1114951 - RNA, 17 nt, Mycobacterium bovis subsp bovis AF2122/97
gcccggcuacgacggcg

SEQ ID NO: 1114952 - RNA, 20 nt, Mycobacterium bovis subsp bovis AF2122/97
gcccggcuacgacggcgcca

SEQ ID NO: 1114953 - RNA, 18 nt, Mycobacterium bovis subsp bovis AF2122/97
gcccggcguuguugacca

SEQ ID NO: 1114954 - RNA, 17 nt, Mycobacterium bovis subsp bovis AF2122/97
gcccggcuccuccccgg

SEQ ID NO: 1114955 - RNA, 16 nt, Mycobacterium bovis subsp bovis AF2122/97
gcccggccaggucgac

SEQ ID NO: 1114956 - RNA, 20 nt, Mycobacterium bovis subsp bovis AF2122/97
gcccggccacuccaguacgg

SEQ ID NO: 1114957 - RNA, 19 nt, Mycobacterium bovis subsp bovis AF2122/97
gcccggccaaccaccaacu

SEQ ID NO: 1114958 - RNA, 17 nt, Mycobacterium bovis subsp bovis AF2122/97
gcccggccaagccggcg

SEQ ID NO: 1114959 - RNA, 16 nt, Mycobacterium bovis subsp bovis AF2122/97
gcccggcccgcucagc

SEQ ID NO: 1114960 - RNA, 23 nt, Mycobacterium bovis subsp bovis AF2122/97
gcccggccccgcggccagcaccg

SEQ ID NO: 1114961 - RNA, 21 nt, Mycobacterium bovis subsp bovis AF2122/97
gcccggccaggucgacaccgc

SEQ ID NO: 1114962 - RNA, 14 nt, Mycobacterium bovis subsp bovis AF2122/97
gcccggcccggcuc

SEQ ID NO: 1114963 - RNA, 17 nt, Mycobacterium bovis subsp bovis AF2122/97
gcccggcccgcucagcc

SEQ ID NO: 1114964 - RNA, 13 nt, Mycobacterium bovis subsp bovis AF2122/97
gcccggccgccga

SEQ ID NO: 1114965 - RNA, 18 nt, Mycobacterium bovis subsp bovis AF2122/97
gcccggccgccagcgcgc

SEQ ID NO: 1114966 - RNA, 15 nt, Mycobacterium bovis subsp bovis AF2122/97
gcccggccgccagcg

SEQ ID NO: 1114967 - RNA, 11 nt, Mycobacterium bovis subsp bovis AF2122/97
gcccggccgcg

SEQ ID NO: 1114968 - RNA, 13 nt, Mycobacterium bovis subsp bovis AF2122/97
gcccggccgcgcc

SEQ ID NO: 1114969 - RNA, 14 nt, Mycobacterium bovis subsp bovis AF2122/97
gcccggccggucga

SEQ ID NO: 1114970 - RNA, 14 nt, Mycobacterium bovis subsp bovis AF2122/97
gcccggcgacgacc

SEQ ID NO: 1114971 - RNA, 15 nt, Mycobacterium bovis subsp bovis AF2122/97
gcccggccuugccgc

SEQ ID NO: 1114972 - RNA, 20 nt, Mycobacterium bovis subsp bovis AF2122/97
gcccggccuugccgccggcc

SEQ ID NO: 1114973 - RNA, 23 nt, Mycobacterium bovis subsp bovis AF2122/97
gcccggccuugccgccggcgccg

SEQ ID NO: 1114974 - RNA, 16 nt, Mycobacterium bovis subsp bovis AF2122/97
gcccggccugcugguc

SEQ ID NO: 1114975 - RNA, 14 nt, Mycobacterium bovis subsp bovis AF2122/97
gcccggcgcaagcg

SEQ ID NO: 1114976 - RNA, 16 nt, Mycobacterium bovis subsp bovis AF2122/97
gcccggcgcaagcgcc

SEQ ID NO: 1114977 - RNA, 18 nt, Mycobacterium bovis subsp bovis AF2122/97
gcccggcgcaagcgccgc

SEQ ID NO: 1114978 - RNA, 24 nt, Mycobacterium bovis subsp bovis AF2122/97
gcccggcgauaaacccgaggcucg

SEQ ID NO: 1114979 - RNA, 20 nt, Mycobacterium bovis subsp bovis AF2122/97
gcccggcgaauacgaccguc

SEQ ID NO: 1114980 - RNA, 19 nt, Mycobacterium bovis subsp bovis AF2122/97
gcccggguggcccggaaca

SEQ ID NO: 1114981 - RNA, 23 nt, Mycobacterium bovis subsp bovis AF2122/97
gcccgguaucgucccggcgaccg

SEQ ID NO: 1114982 - RNA, 17 nt, Mycobacterium bovis subsp bovis AF2122/97
gcccgguacgccgcgcc

SEQ ID NO: 1114983 - RNA, 18 nt, Mycobacterium bovis subsp bovis AF2122/97
gcccggguggcgucgauc

SEQ ID NO: 1114984 - RNA, 16 nt, Mycobacterium bovis subsp bovis AF2122/97
gcccgucacgcccgcg

SEQ ID NO: 1114985 - RNA, 18 nt, Mycobacterium bovis subsp bovis AF2122/97
gcccgucacgcccgcgaa

SEQ ID NO: 1114986 - RNA, 20 nt, Mycobacterium bovis subsp bovis AF2122/97
gcccgucauacucgacaccg

SEQ ID NO: 1114987 - RNA, 23 nt, Mycobacterium bovis subsp bovis AF2122/97
gcccgucauacucgacaccgacu

SEQ ID NO: 1114988 - RNA, 19 nt, Mycobacterium bovis subsp bovis AF2122/97
gcccgucccgcucgagcag

SEQ ID NO: 1114989 - RNA, 20 nt, Mycobacterium bovis subsp bovis AF2122/97
gcccgucccgcucgagcagc

SEQ ID NO: 1114990 - RNA, 14 nt, Mycobacterium bovis subsp bovis AF2122/97
gcccgucgucggca

SEQ ID NO: 1114991 - RNA, 15 nt, Mycobacterium bovis subsp bovis AF2122/97
gcccgucgucggcaa

SEQ ID NO: 1114992 - RNA, 18 nt, Mycobacterium bovis subsp bovis AF2122/97
gcccgucgucggcaacca

SEQ ID NO: 1114993 - RNA, 14 nt, Mycobacterium bovis subsp bovis AF2122/97
gcccgucgguggug

SEQ ID NO: 1114994 - RNA, 17 nt, Mycobacterium bovis subsp bovis AF2122/97
gcccgucggcgugcgga

SEQ ID NO: 1114995 - RNA, 16 nt, Mycobacterium bovis subsp bovis AF2122/97
gcccgucgggccgucg

SEQ ID NO: 1114996 - RNA, 17 nt, Mycobacterium bovis subsp bovis AF2122/97
gcccgucgggccgucgg

SEQ ID NO: 1114997 - RNA, 15 nt, Mycobacterium bovis subsp bovis AF2122/97
gcccgucggcgcccg

SEQ ID NO: 1114998 - RNA, 14 nt, Mycobacterium bovis subsp bovis AF2122/97
gcccgucggcgccg

SEQ ID NO: 1114999 - RNA, 15 nt, Mycobacterium bovis subsp bovis AF2122/97
gcccgucggcgccga

SEQ ID NO: 1115000 - RNA, 13 nt, Mycobacterium bovis subsp bovis AF2122/97
gcccgucgcuggg

SEQ ID NO: 1115001 - RNA, 16 nt, Mycobacterium bovis subsp bovis AF2122/97
gcccgucgcggccggc

SEQ ID NO: 1115002 - RNA, 17 nt, Mycobacterium bovis subsp bovis AF2122/97
gcccgucgcggccggcg

SEQ ID NO: 1115003 - RNA, 20 nt, Mycobacterium bovis subsp bovis AF2122/97
gcccgucgcggccggcggcc

SEQ ID NO: 1115004 - RNA, 23 nt, Mycobacterium bovis subsp bovis AF2122/97
gcccgucagcuccccgucgggga

SEQ ID NO: 1115005 - RNA, 16 nt, Mycobacterium bovis subsp bovis AF2122/97
gcccgggacaaguucg

SEQ ID NO: 1115006 - RNA, 19 nt, Mycobacterium bovis subsp bovis AF2122/97
gcccggcuuuugcgcccag

SEQ ID NO: 1115007 - RNA, 20 nt, Mycobacterium bovis subsp bovis AF2122/97
gcccgggaccauagccugcg

SEQ ID NO: 1115008 - RNA, 23 nt, Mycobacterium bovis subsp bovis AF2122/97
gcccgggauaguuuucggccgcc

SEQ ID NO: 1115009 - RNA, 16 nt, Mycobacterium bovis subsp bovis AF2122/97
gcccgggaucggggca

SEQ ID NO: 1115010 - RNA, 19 nt, Mycobacterium bovis subsp bovis AF2122/97
gcccgggaucggggcaccg

SEQ ID NO: 1115011 - RNA, 22 nt, Mycobacterium bovis subsp bovis AF2122/97
gcccgggaucuagaugcggaac

SEQ ID NO: 1115012 - RNA, 17 nt, Mycobacterium bovis subsp bovis AF2122/97
gcccggcuggcuagcag

SEQ ID NO: 1115013 - RNA, 15 nt, Mycobacterium bovis subsp bovis AF2122/97
gcccggcucggcagg

SEQ ID NO: 1115014 - RNA, 16 nt, Mycobacterium bovis subsp bovis AF2122/97
gcccgggccguacggc

SEQ ID NO: 1115015 - RNA, 22 nt, Mycobacterium bovis subsp bovis AF2122/97
gcccgggcccgcgggaucagcg

SEQ ID NO: 1115016 - RNA, 19 nt, Mycobacterium bovis subsp bovis AF2122/97
gcccgggccaccggaaucc

SEQ ID NO: 1115017 - RNA, 22 nt, Mycobacterium bovis subsp bovis AF2122/97
gcccgggcauccuucaccagcu

SEQ ID NO: 1115018 - RNA, 13 nt, Mycobacterium bovis subsp bovis AF2122/97
gcccgggcaccgg

SEQ ID NO: 1115019 - RNA, 14 nt, Mycobacterium bovis subsp bovis AF2122/97
gcccgggcaccggc

SEQ ID NO: 1115020 - RNA, 17 nt, Mycobacterium bovis subsp bovis AF2122/97
gcccgggcaccggccgg

SEQ ID NO: 1115021 - RNA, 15 nt, Mycobacterium bovis subsp bovis AF2122/97
gcccgggcagcacca

SEQ ID NO: 1115022 - RNA, 18 nt, Mycobacterium bovis subsp bovis AF2122/97
gcccgggcagcaccagcg

SEQ ID NO: 1115023 - RNA, 20 nt, Mycobacterium bovis subsp bovis AF2122/97
gcccgggcggaacgccggca

SEQ ID NO: 1115024 - RNA, 13 nt, Mycobacterium bovis subsp bovis AF2122/97
gcccgggcggcgu

SEQ ID NO: 1115025 - RNA, 21 nt, Mycobacterium bovis subsp bovis AF2122/97
gcccgggcggcgucggugagc

SEQ ID NO: 1115026 - RNA, 21 nt, Mycobacterium bovis subsp bovis AF2122/97
gcccgggcgugguaucgccgg

SEQ ID NO: 1115027 - RNA, 13 nt, Mycobacterium bovis subsp bovis AF2122/97
gcccgggcggcca

SEQ ID NO: 1115028 - RNA, 18 nt, Mycobacterium bovis subsp bovis AF2122/97
gcccggggcgcucgugau

SEQ ID NO: 1115029 - RNA, 19 nt, Mycobacterium bovis subsp bovis AF2122/97
gcccgggguguucgucgac

SEQ ID NO: 1115030 - RNA, 19 nt, Mycobacterium bovis subsp bovis AF2122/97
gcccgggucuccggcgcac

SEQ ID NO: 1115031 - RNA, 15 nt, Mycobacterium bovis subsp bovis AF2122/97
gcccggguaucgcca

SEQ ID NO: 1115032 - RNA, 20 nt, Mycobacterium bovis subsp bovis AF2122/97
gcccgggucccggcagcugg

SEQ ID NO: 1115033 - RNA, 22 nt, Mycobacterium bovis subsp bovis AF2122/97
gcccgggucggccggguugccc

SEQ ID NO: 1115034 - RNA, 15 nt, Mycobacterium bovis subsp bovis AF2122/97
gccccggcgcuggug

SEQ ID NO: 1115035 - RNA, 15 nt, Mycobacterium bovis subsp bovis AF2122/97
gccccggcgguaccg

SEQ ID NO: 1115036 - RNA, 11 nt, Mycobacterium bovis subsp bovis AF2122/97
gccccggcgcg

SEQ ID NO: 1115037 - RNA, 13 nt, Mycobacterium bovis subsp bovis AF2122/97
gccccggcggcgg

SEQ ID NO: 1115038 - RNA, 19 nt, Mycobacterium bovis subsp bovis AF2122/97
gccccggcuuucccaccgc

SEQ ID NO: 1115039 - RNA, 10 nt, Mycobacterium bovis subsp bovis AF2122/97
gccccggcuc

SEQ ID NO: 1115040 - RNA, 19 nt, Mycobacterium bovis subsp bovis AF2122/97
gccccguugagcagcaccc

SEQ ID NO: 1115041 - RNA, 20 nt, Mycobacterium bovis subsp bovis AF2122/97
gccccguugugucaccggcg

SEQ ID NO: 1115042 - RNA, 20 nt, Mycobacterium bovis subsp bovis AF2122/97
gccccgggcggugaggcagc

SEQ ID NO: 1115043 - RNA, 18 nt, Mycobacterium bovis subsp bovis AF2122/97
gccccguuggucagcgug

SEQ ID NO: 1115044 - RNA, 22 nt, Mycobacterium bovis subsp bovis AF2122/97
gccccguuggucagcguggacg

SEQ ID NO: 1115045 - RNA, 22 nt, Mycobacterium bovis subsp bovis AF2122/97
gccccguugugucaccggcguc

SEQ ID NO: 1115046 - RNA, 17 nt, Mycobacterium bovis subsp bovis AF2122/97
gccccguuucggucgac

SEQ ID NO: 1115047 - RNA, 17 nt, Mycobacterium bovis subsp bovis AF2122/97
gccccuugaccgcugcc

SEQ ID NO: 1115048 - RNA, 18 nt, Mycobacterium bovis subsp bovis AF2122/97
gcccgaaccaccgcguug

SEQ ID NO: 1115049 - RNA, 22 nt, Mycobacterium bovis subsp bovis AF2122/97
gcccgaaccaccgcguuggcca

SEQ ID NO: 1115050 - RNA, 19 nt, Mycobacterium bovis subsp bovis AF2122/97
gccccuuggcgccaccggc

SEQ ID NO: 1115051 - RNA, 20 nt, Mycobacterium bovis subsp bovis AF2122/97
gccccuccggccacacucgc

SEQ ID NO: 1115052 - RNA, 23 nt, Mycobacterium bovis subsp bovis AF2122/97
gccccugucauguccugggccgc

SEQ ID NO: 1115053 - RNA, 16 nt, Mycobacterium bovis subsp bovis AF2122/97
gccccuccgcgccgau

SEQ ID NO: 1115054 - RNA, 13 nt, Mycobacterium bovis subsp bovis AF2122/97
gccccucaccucg

SEQ ID NO: 1115055 - RNA, 23 nt, Mycobacterium bovis subsp bovis AF2122/97
gccccucaccucggcuuugccgc

SEQ ID NO: 1115056 - RNA, 15 nt, Mycobacterium bovis subsp bovis AF2122/97
gccccggccgcuggc

SEQ ID NO: 1115057 - RNA, 18 nt, Mycobacterium bovis subsp bovis AF2122/97
gccccggccgcuggcguu

SEQ ID NO: 1115058 - RNA, 20 nt, Mycobacterium bovis subsp bovis AF2122/97
gccccgcuggucgaccggcg

SEQ ID NO: 1115059 - RNA, 17 nt, Mycobacterium bovis subsp bovis AF2122/97
gccccgcgcguucggcg

SEQ ID NO: 1115060 - RNA, 12 nt, Mycobacterium bovis subsp bovis AF2122/97
gccccgcucggu

SEQ ID NO: 1115061 - RNA, 18 nt, Mycobacterium bovis subsp bovis AF2122/97
gccccgccguuuccgccg

SEQ ID NO: 1115062 - RNA, 14 nt, Mycobacterium bovis subsp bovis AF2122/97
gccccgccgucgcc

SEQ ID NO: 1115063 - RNA, 22 nt, Mycobacterium bovis subsp bovis AF2122/97
gccccgccguugaacggcacca

SEQ ID NO: 1115064 - RNA, 13 nt, Mycobacterium bovis subsp bovis AF2122/97
gccccgccguugc

SEQ ID NO: 1115065 - RNA, 19 nt, Mycobacterium bovis subsp bovis AF2122/97
gccccgccguugccgccga

SEQ ID NO: 1115066 - RNA, 20 nt, Mycobacterium bovis subsp bovis AF2122/97
gccccgccguugccgccgac

SEQ ID NO: 1115067 - RNA, 15 nt, Mycobacterium bovis subsp bovis AF2122/97
gccccgccggcgccg

SEQ ID NO: 1115068 - RNA, 13 nt, Mycobacterium bovis subsp bovis AF2122/97
gccccgccggugg

SEQ ID NO: 1115069 - RNA, 19 nt, Mycobacterium bovis subsp bovis AF2122/97
gccccgccuuggccaccau

SEQ ID NO: 1115070 - RNA, 23 nt, Mycobacterium bovis subsp bovis AF2122/97
gccccgcgcccaccccggccgca

SEQ ID NO: 1115071 - RNA, 18 nt, Mycobacterium bovis subsp bovis AF2122/97
gccccgcgcguucggcga

SEQ ID NO: 1115072 - RNA, 14 nt, Mycobacterium bovis subsp bovis AF2122/97
gccccgcggcagac

SEQ ID NO: 1115073 - RNA, 13 nt, Mycobacterium bovis subsp bovis AF2122/97
gccccgcggccag

SEQ ID NO: 1115074 - RNA, 18 nt, Mycobacterium bovis subsp bovis AF2122/97
gccccgcggccagcaccg

SEQ ID NO: 1115075 - RNA, 17 nt, Mycobacterium bovis subsp bovis AF2122/97
gcccccuaaaccggcag

SEQ ID NO: 1115076 - RNA, 15 nt, Mycobacterium bovis subsp bovis AF2122/97
gcccccggugccgcc

SEQ ID NO: 1115077 - RNA, 18 nt, Mycobacterium bovis subsp bovis AF2122/97
gcccccucuagcgccucg

SEQ ID NO: 1115078 - RNA, 18 nt, Mycobacterium bovis subsp bovis AF2122/97
gcccccggucgagcucga

SEQ ID NO: 1115079 - RNA, 16 nt, Mycobacterium bovis subsp bovis AF2122/97
gcccccuggauggcgc

SEQ ID NO: 1115080 - RNA, 15 nt, Mycobacterium bovis subsp bovis AF2122/97
gccccgaagcgggcg

SEQ ID NO: 1115081 - RNA, 22 nt, Mycobacterium bovis subsp bovis AF2122/97
gccccgaauguugcgaucugcg

SEQ ID NO: 1115082 - RNA, 14 nt, Mycobacterium bovis subsp bovis AF2122/97
gccccgaccagcag

SEQ ID NO: 1115083 - RNA, 17 nt, Mycobacterium bovis subsp bovis AF2122/97
gcccccguugccgccug

SEQ ID NO: 1115084 - RNA, 16 nt, Mycobacterium bovis subsp bovis AF2122/97
gccccgaaacgauggc

SEQ ID NO: 1115085 - RNA, 17 nt, Mycobacterium bovis subsp bovis AF2122/97
gcccgaacucguuggcg

SEQ ID NO: 1115086 - RNA, 20 nt, Mycobacterium bovis subsp bovis AF2122/97
gcccgaacucguuggcgaac

SEQ ID NO: 1115087 - RNA, 22 nt, Mycobacterium bovis subsp bovis AF2122/97
gcccgaacuucugguaggcggc

SEQ ID NO: 1115088 - RNA, 23 nt, Mycobacterium bovis subsp bovis AF2122/97
gcccgaagaaugggauggcacca

SEQ ID NO: 1115089 - RNA, 17 nt, Mycobacterium bovis subsp bovis AF2122/97
gcccgaagacggggugg

SEQ ID NO: 1115090 - RNA, 21 nt, Mycobacterium bovis subsp bovis AF2122/97
gcccgacaccgccccgccgcg

SEQ ID NO: 1115091 - RNA, 13 nt, Mycobacterium bovis subsp bovis AF2122/97
gcccgacacccgu

SEQ ID NO: 1115092 - RNA, 11 nt, Mycobacterium bovis subsp bovis AF2122/97
gcccgacaccg

SEQ ID NO: 1115093 - RNA, 22 nt, Mycobacterium bovis subsp bovis AF2122/97
gcccgacaccgaucggacgucg

SEQ ID NO: 1115094 - RNA, 22 nt, Mycobacterium bovis subsp bovis AF2122/97
gcccgaauucccuacgccgcca

SEQ ID NO: 1115095 - RNA, 23 nt, Mycobacterium bovis subsp bovis AF2122/97
gcccgaauucccuacgccgccag

SEQ ID NO: 1115096 - RNA, 14 nt, Mycobacterium bovis subsp bovis AF2122/97
gcccgaaugcggug

SEQ ID NO: 1115097 - RNA, 17 nt, Mycobacterium bovis subsp bovis AF2122/97
gcccgaaggcggcucca

SEQ ID NO: 1115098 - RNA, 12 nt, Mycobacterium bovis subsp bovis AF2122/97
gcccgacccgcc

SEQ ID NO: 1115099 - RNA, 24 nt, Mycobacterium bovis subsp bovis AF2122/97
gcccgacaccguccagcagcucgg

SEQ ID NO: 1115100 - RNA, 12 nt, Mycobacterium bovis subsp bovis AF2122/97
gcccgacaccgu

SEQ ID NO: 1115101 - RNA, 21 nt, Mycobacterium bovis subsp bovis AF2122/97
gcccgacaguggucccgguga

SEQ ID NO: 1115102 - RNA, 15 nt, Mycobacterium bovis subsp bovis AF2122/97
gcccgacccgccgau

SEQ ID NO: 1115103 - RNA, 15 nt, Mycobacterium bovis subsp bovis AF2122/97
gcccgagccggugcc

SEQ ID NO: 1115104 - RNA, 18 nt, Mycobacterium bovis subsp bovis AF2122/97
gcccgagccgcugcgaca

SEQ ID NO: 1115105 - RNA, 13 nt, Mycobacterium bovis subsp bovis AF2122/97
gcccgagccggug

SEQ ID NO: 1115106 - RNA, 18 nt, Mycobacterium bovis subsp bovis AF2122/97
gcccgagcucgccgcagc

SEQ ID NO: 1115107 - RNA, 13 nt, Mycobacterium bovis subsp bovis AF2122/97
gcccgagcggcug

SEQ ID NO: 1115108 - RNA, 13 nt, Mycobacterium bovis subsp bovis AF2122/97
gcccgacccggcc

SEQ ID NO: 1115109 - RNA, 13 nt, Mycobacterium bovis subsp bovis AF2122/97
gcccgagcgcgcg

SEQ ID NO: 1115110 - RNA, 15 nt, Mycobacterium bovis subsp bovis AF2122/97
gcccgagcgcgcgcu

SEQ ID NO: 1115111 - RNA, 17 nt, Mycobacterium bovis subsp bovis AF2122/97
gcccgaggcgagacgcu

SEQ ID NO: 1115112 - RNA, 24 nt, Mycobacterium bovis subsp bovis AF2122/97
gcccgagcuggccgucagcgucgg

SEQ ID NO: 1115113 - RNA, 23 nt, Mycobacterium bovis subsp bovis AF2122/97
gcccgaucgcuuccucguaggcg

SEQ ID NO: 1115114 - RNA, 19 nt, Mycobacterium bovis subsp bovis AF2122/97
gcccgaggcgagacgcucc

SEQ ID NO: 1115115 - RNA, 23 nt, Mycobacterium bovis subsp bovis AF2122/97
gcccgaucggcggaucgugcccu

SEQ ID NO: 1115116 - RNA, 17 nt, Mycobacterium bovis subsp bovis AF2122/97
gcccgagucgaaaccgc

SEQ ID NO: 1115117 - RNA, 21 nt, Mycobacterium bovis subsp bovis AF2122/97
gcccgaucguaggacucggcg

SEQ ID NO: 1115118 - RNA, 22 nt, Mycobacterium bovis subsp bovis AF2122/97
gcccgaugaggacauccggcgc

SEQ ID NO: 1115119 - RNA, 15 nt, Mycobacterium bovis subsp bovis AF2122/97
gcccgaugaucccgc

SEQ ID NO: 1115120 - RNA, 23 nt, Mycobacterium bovis subsp bovis AF2122/97
gcccgaucguaggacucggcgga

SEQ ID NO: 1115121 - RNA, 22 nt, Mycobacterium bovis subsp bovis AF2122/97
gcccgaugaucccgccaccgaa

SEQ ID NO: 1115122 - RNA, 21 nt, Mycobacterium bovis subsp bovis AF2122/97
gcccgcagcccgccgggcucc

SEQ ID NO: 1115123 - RNA, 22 nt, Mycobacterium bovis subsp bovis AF2122/97
gcccgcauugaucucgaccggc

SEQ ID NO: 1115124 - RNA, 16 nt, Mycobacterium bovis subsp bovis AF2122/97
gcccgccacccuuggc

SEQ ID NO: 1115125 - RNA, 16 nt, Mycobacterium bovis subsp bovis AF2122/97
gcccgccacgaugucg

SEQ ID NO: 1115126 - RNA, 20 nt, Mycobacterium bovis subsp bovis AF2122/97
gcccgccacgaugucgucga

SEQ ID NO: 1115127 - RNA, 17 nt, Mycobacterium bovis subsp bovis AF2122/97
gcccgccacgcucgguu

SEQ ID NO: 1115128 - RNA, 19 nt, Mycobacterium bovis subsp bovis AF2122/97
gcccgccacaacggcggcg

SEQ ID NO: 1115129 - RNA, 21 nt, Mycobacterium bovis subsp bovis AF2122/97
gcccgccaccggcgcgaccgc

SEQ ID NO: 1115130 - RNA, 23 nt, Mycobacterium bovis subsp bovis AF2122/97
gcccgccaccggguucaccgagg

SEQ ID NO: 1115131 - RNA, 16 nt, Mycobacterium bovis subsp bovis AF2122/97
gcccgccagaacggcg

SEQ ID NO: 1115132 - RNA, 22 nt, Mycobacterium bovis subsp bovis AF2122/97
gcccgccacguacuuggacgac

SEQ ID NO: 1115133 - RNA, 20 nt, Mycobacterium bovis subsp bovis AF2122/97
gcccgaugcgccaccggcgc

SEQ ID NO: 1115134 - RNA, 15 nt, Mycobacterium bovis subsp bovis AF2122/97
gcccgaugcgccagc

SEQ ID NO: 1115135 - RNA, 17 nt, Mycobacterium bovis subsp bovis AF2122/97
gcccgaugcgccaccgg

SEQ ID NO: 1115136 - RNA, 19 nt, Mycobacterium bovis subsp bovis AF2122/97
gcccgaugcgccaccggcg

SEQ ID NO: 1115137 - RNA, 22 nt, Mycobacterium bovis subsp bovis AF2122/97
gcccgcacccacuuucgacccg

SEQ ID NO: 1115138 - RNA, 20 nt, Mycobacterium bovis subsp bovis AF2122/97
gcccgcacccaugaucccgc

SEQ ID NO: 1115139 - RNA, 13 nt, Mycobacterium bovis subsp bovis AF2122/97
gcccgcaccaccg

SEQ ID NO: 1115140 - RNA, 15 nt, Mycobacterium bovis subsp bovis AF2122/97
gcccgcaccaccggc

SEQ ID NO: 1115141 - RNA, 21 nt, Mycobacterium bovis subsp bovis AF2122/97
gcccgcacccguccggccggg

SEQ ID NO: 1115142 - RNA, 23 nt, Mycobacterium bovis subsp bovis AF2122/97
gcccgcacccguccggccgggcc

SEQ ID NO: 1115143 - RNA, 12 nt, Mycobacterium bovis subsp bovis AF2122/97
gcccgcaccgcg

SEQ ID NO: 1115144 - RNA, 15 nt, Mycobacterium bovis subsp bovis AF2122/97
gcccgcacgcucggc

SEQ ID NO: 1115145 - RNA, 20 nt, Mycobacterium bovis subsp bovis AF2122/97
gcccgcacgacgaauccccg

SEQ ID NO: 1115146 - RNA, 15 nt, Mycobacterium bovis subsp bovis AF2122/97
gcccgcacgaucucg

SEQ ID NO: 1115147 - RNA, 15 nt, Mycobacterium bovis subsp bovis AF2122/97
gcccgcacguuggcg

SEQ ID NO: 1115148 - RNA, 17 nt, Mycobacterium bovis subsp bovis AF2122/97
gcccgcacugccgccgg

SEQ ID NO: 1115149 - RNA, 22 nt, Mycobacterium bovis subsp bovis AF2122/97
gcccaccacgaacacguucggg

SEQ ID NO: 1115150 - RNA, 16 nt, Mycobacterium bovis subsp bovis AF2122/97
gcccaauugcgccgag

SEQ ID NO: 1115151 - RNA, 14 nt, Mycobacterium bovis subsp bovis AF2122/97
gcccaccaccgaca

SEQ ID NO: 1115152 - RNA, 22 nt, Mycobacterium bovis subsp bovis AF2122/97
gcccaccaccgacagcacccgg

SEQ ID NO: 1115153 - RNA, 15 nt, Mycobacterium bovis subsp bovis AF2122/97
gcccaagccgccggc

SEQ ID NO: 1115154 - RNA, 19 nt, Mycobacterium bovis subsp bovis AF2122/97
gcccaagccgccggcgcca

SEQ ID NO: 1115155 - RNA, 17 nt, Mycobacterium bovis subsp bovis AF2122/97
gcccaccacgcgacgcg

SEQ ID NO: 1115156 - RNA, 13 nt, Mycobacterium bovis subsp bovis AF2122/97
gcccaccagcggc

SEQ ID NO: 1115157 - RNA, 16 nt, Mycobacterium bovis subsp bovis AF2122/97
gcccaccagcggcggc

SEQ ID NO: 1115158 - RNA, 18 nt, Mycobacterium bovis subsp bovis AF2122/97
gcccaccagcggcggcaa

SEQ ID NO: 1115159 - RNA, 19 nt, Mycobacterium bovis subsp bovis AF2122/97
gcccaccagcggcggcaac

SEQ ID NO: 1115160 - RNA, 20 nt, Mycobacterium bovis subsp bovis AF2122/97
gcccaccagcggcggcaacg

SEQ ID NO: 1115161 - RNA, 15 nt, Mycobacterium bovis subsp bovis AF2122/97
gcccaccaucccgcu

SEQ ID NO: 1115162 - RNA, 11 nt, Mycobacterium bovis subsp bovis AF2122/97
gcccaccaucc

SEQ ID NO: 1115163 - RNA, 20 nt, Mycobacterium bovis subsp bovis AF2122/97
gcccaccaugaucacaccga

SEQ ID NO: 1115164 - RNA, 14 nt, Mycobacterium bovis subsp bovis AF2122/97
gcccaccagcgcag

SEQ ID NO: 1115165 - RNA, 15 nt, Mycobacterium bovis subsp bovis AF2122/97
gcccaccagcgcagc

SEQ ID NO: 1115166 - RNA, 17 nt, Mycobacterium bovis subsp bovis AF2122/97
gcccagcgaggugggcg

SEQ ID NO: 1115167 - RNA, 19 nt, Mycobacterium bovis subsp bovis AF2122/97
gcccagcgcccccagcagc

SEQ ID NO: 1115168 - RNA, 20 nt, Mycobacterium bovis subsp bovis AF2122/97
gcccagcgcccgcgcggcca

SEQ ID NO: 1115169 - RNA, 13 nt, Mycobacterium bovis subsp bovis AF2122/97
gcccagcgccgaa

SEQ ID NO: 1115170 - RNA, 16 nt, Mycobacterium bovis subsp bovis AF2122/97
gcccagcgccgaauuc

SEQ ID NO: 1115171 - RNA, 18 nt, Mycobacterium bovis subsp bovis AF2122/97
gcccaggcgcgacguacg

SEQ ID NO: 1115172 - RNA, 19 nt, Mycobacterium bovis subsp bovis AF2122/97
gcccaggcgugucgucgcg

SEQ ID NO: 1115173 - RNA, 17 nt, Mycobacterium bovis subsp bovis AF2122/97
gcccaggcauggccugg

SEQ ID NO: 1115174 - RNA, 16 nt, Mycobacterium bovis subsp bovis AF2122/97
gcccagggcgucggcg

SEQ ID NO: 1115175 - RNA, 18 nt, Mycobacterium bovis subsp bovis AF2122/97
gcccagggcgucggcgac

SEQ ID NO: 1115176 - RNA, 16 nt, Mycobacterium bovis subsp bovis AF2122/97
gcccagcgcgccagcu

SEQ ID NO: 1115177 - RNA, 13 nt, Mycobacterium bovis subsp bovis AF2122/97
gcccagcggaucg

SEQ ID NO: 1115178 - RNA, 12 nt, Mycobacterium bovis subsp bovis AF2122/97
gcccagcggccg

SEQ ID NO: 1115179 - RNA, 16 nt, Mycobacterium bovis subsp bovis AF2122/97
gcccagcggccgcgau

SEQ ID NO: 1115180 - RNA, 11 nt, Mycobacterium bovis subsp bovis AF2122/97
gcccaggacgg

SEQ ID NO: 1115181 - RNA, 20 nt, Mycobacterium bovis subsp bovis AF2122/97
gcccagcggccgcgauggug

SEQ ID NO: 1115182 - RNA, 19 nt, Mycobacterium bovis subsp bovis AF2122/97
gcccaggacagcagccgcc

SEQ ID NO: 1115183 - RNA, 20 nt, Mycobacterium bovis subsp bovis AF2122/97
gcccaggacagcagccgccg

SEQ ID NO: 1115184 - RNA, 21 nt, Mycobacterium bovis subsp bovis AF2122/97
gcccaggacagcagccgccgg

SEQ ID NO: 1115185 - RNA, 22 nt, Mycobacterium bovis subsp bovis AF2122/97
gcccaggacagcagccgccggc

SEQ ID NO: 1115186 - RNA, 23 nt, Mycobacterium bovis subsp bovis AF2122/97
gcccaggacagcagccgccggcc

SEQ ID NO: 1115187 - RNA, 11 nt, Mycobacterium bovis subsp bovis AF2122/97
gcccccggugc

SEQ ID NO: 1115188 - RNA, 14 nt, Mycobacterium bovis subsp bovis AF2122/97
gcccccggugccgc

SEQ ID NO: 1115189 - RNA, 17 nt, Mycobacterium bovis subsp bovis AF2122/97
gcccccggauccgucgc

SEQ ID NO: 1115190 - RNA, 14 nt, Mycobacterium bovis subsp bovis AF2122/97
gccccccgcgccug

SEQ ID NO: 1115191 - RNA, 14 nt, Mycobacterium bovis subsp bovis AF2122/97
gccccccggcgacg

SEQ ID NO: 1115192 - RNA, 22 nt, Mycobacterium bovis subsp bovis AF2122/97
gccccccggcgacggcguagcc

SEQ ID NO: 1115193 - RNA, 20 nt, Mycobacterium bovis subsp bovis AF2122/97
gcccccauugccgccgucgc

SEQ ID NO: 1115194 - RNA, 20 nt, Mycobacterium bovis subsp bovis AF2122/97
gccccccgagcuguggucac

SEQ ID NO: 1115195 - RNA, 16 nt, Mycobacterium bovis subsp bovis AF2122/97
gccccauugccgucgc

SEQ ID NO: 1115196 - RNA, 16 nt, Mycobacterium bovis subsp bovis AF2122/97
gccccaggacaccuug

SEQ ID NO: 1115197 - RNA, 14 nt, Mycobacterium bovis subsp bovis AF2122/97
gccccaugcaacac

SEQ ID NO: 1115198 - RNA, 18 nt, Mycobacterium bovis subsp bovis AF2122/97
gccccagcugcggucgcg

SEQ ID NO: 1115199 - RNA, 20 nt, Mycobacterium bovis subsp bovis AF2122/97
gccccagcguucccgccggc

SEQ ID NO: 1115200 - RNA, 19 nt, Mycobacterium bovis subsp bovis AF2122/97
gccccagcgacgucgcaau

SEQ ID NO: 1115201 - RNA, 16 nt, Mycobacterium bovis subsp bovis AF2122/97
gccccagcgacgucgc

SEQ ID NO: 1115202 - RNA, 13 nt, Mycobacterium bovis subsp bovis AF2122/97
gccccaccgcgcc

SEQ ID NO: 1115203 - RNA, 14 nt, Mycobacterium bovis subsp bovis AF2122/97
gccccaccgcgccg

SEQ ID NO: 1115204 - RNA, 16 nt, Mycobacterium bovis subsp bovis AF2122/97
gccccacccgccgccg

SEQ ID NO: 1115205 - RNA, 16 nt, Mycobacterium bovis subsp bovis AF2122/97
gccccacccgcggcgc

SEQ ID NO: 1115206 - RNA, 16 nt, Mycobacterium bovis subsp bovis AF2122/97
gccccacccgagcacu

SEQ ID NO: 1115207 - RNA, 18 nt, Mycobacterium bovis subsp bovis AF2122/97
gccccaccgaacgugugg

SEQ ID NO: 1115208 - RNA, 14 nt, Mycobacterium bovis subsp bovis AF2122/97
gcccauggcgucga

SEQ ID NO: 1115209 - RNA, 21 nt, Mycobacterium bovis subsp bovis AF2122/97
gcccaguuccgcugcggugcc

SEQ ID NO: 1115210 - RNA, 16 nt, Mycobacterium bovis subsp bovis AF2122/97
gcccaguagaucgcga

SEQ ID NO: 1115211 - RNA, 17 nt, Mycobacterium bovis subsp bovis AF2122/97
gcccaguacguuggugu

SEQ ID NO: 1115212 - RNA, 20 nt, Mycobacterium bovis subsp bovis AF2122/97
gcccaguacguugguguccc

SEQ ID NO: 1115213 - RNA, 16 nt, Mycobacterium bovis subsp bovis AF2122/97
gcccagugccagaacc

SEQ ID NO: 1115214 - RNA, 20 nt, Mycobacterium bovis subsp bovis AF2122/97
gcccagugggacuggcguga

SEQ ID NO: 1115215 - RNA, 21 nt, Mycobacterium bovis subsp bovis AF2122/97
gccccaacccuaaaccagcca

SEQ ID NO: 1115216 - RNA, 23 nt, Mycobacterium bovis subsp bovis AF2122/97
gccccaaaucguaggggucugcg

SEQ ID NO: 1115217 - RNA, 21 nt, Mycobacterium bovis subsp bovis AF2122/97
gccccacaaggguuggccgau

SEQ ID NO: 1115218 - RNA, 22 nt, Mycobacterium bovis subsp bovis AF2122/97
gccccaagcgccugagcggccu

SEQ ID NO: 1115219 - RNA, 12 nt, Mycobacterium bovis subsp bovis AF2122/97
gcccaugucgag

SEQ ID NO: 1115220 - RNA, 21 nt, Mycobacterium bovis subsp bovis AF2122/97
gcccauucaucuugcggcagc

SEQ ID NO: 1115221 - RNA, 22 nt, Mycobacterium bovis subsp bovis AF2122/97
gcccauucaucuugcggcagcg

SEQ ID NO: 1115222 - RNA, 20 nt, Mycobacterium bovis subsp bovis AF2122/97
gcccauuggccagguggcga

SEQ ID NO: 1115223 - RNA, 21 nt, Mycobacterium bovis subsp bovis AF2122/97
gcccauugacguagaccgucg

SEQ ID NO: 1115224 - RNA, 22 nt, Mycobacterium bovis subsp bovis AF2122/97
gcccauugacguagaccgucga

SEQ ID NO: 1115225 - RNA, 23 nt, Mycobacterium bovis subsp bovis AF2122/97
cuggugcgccacgccaccgcggu

SEQ ID NO: 1115226 - RNA, 14 nt, Mycobacterium bovis subsp bovis AF2122/97
cuggugcgggacgc

SEQ ID NO: 1115227 - RNA, 17 nt, Mycobacterium bovis subsp bovis AF2122/97
cuggugcgggacgccga

SEQ ID NO: 1115228 - RNA, 13 nt, Mycobacterium bovis subsp bovis AF2122/97
cuggugcguagcc

SEQ ID NO: 1115229 - RNA, 21 nt, Mycobacterium bovis subsp bovis AF2122/97
cuggugcguagcccacccggg

SEQ ID NO: 1115230 - RNA, 23 nt, Mycobacterium bovis subsp bovis AF2122/97
cuggugcucaacggcgacaucgg

SEQ ID NO: 1115231 - RNA, 21 nt, Mycobacterium bovis subsp bovis AF2122/97
cugguggcgccauccccgccg

SEQ ID NO: 1115232 - RNA, 14 nt, Mycobacterium bovis subsp bovis AF2122/97
cugguggcggcacu

SEQ ID NO: 1115233 - RNA, 19 nt, Mycobacterium bovis subsp bovis AF2122/97
cugguggcggucaccacgc

SEQ ID NO: 1115234 - RNA, 14 nt, Mycobacterium bovis subsp bovis AF2122/97
cuggugggacgcgg

SEQ ID NO: 1115235 - RNA, 16 nt, Mycobacterium bovis subsp bovis AF2122/97
cuggugggagaccugu

SEQ ID NO: 1115236 - RNA, 23 nt, Mycobacterium bovis subsp bovis AF2122/97
cuggugggaggggacccagcggc

SEQ ID NO: 1115237 - RNA, 17 nt, Mycobacterium bovis subsp bovis AF2122/97
cugguggggggugugga

SEQ ID NO: 1115238 - RNA, 20 nt, Mycobacterium bovis subsp bovis AF2122/97
cugguguacacacccgccuc

SEQ ID NO: 1115239 - RNA, 16 nt, Mycobacterium bovis subsp bovis AF2122/97
cugguggucggcgacg

SEQ ID NO: 1115240 - RNA, 18 nt, Mycobacterium bovis subsp bovis AF2122/97
cuggugaucugcugggca

SEQ ID NO: 1115241 - RNA, 20 nt, Mycobacterium bovis subsp bovis AF2122/97
cuggugaucugguccggcaa

SEQ ID NO: 1115242 - RNA, 17 nt, Mycobacterium bovis subsp bovis AF2122/97
cuggugcaaccgugccg

SEQ ID NO: 1115243 - RNA, 19 nt, Mycobacterium bovis subsp bovis AF2122/97
cuggugcaaccgugccgca

SEQ ID NO: 1115244 - RNA, 16 nt, Mycobacterium bovis subsp bovis AF2122/97
cuggugacggugaagc

SEQ ID NO: 1115245 - RNA, 22 nt, Mycobacterium bovis subsp bovis AF2122/97
cuggucuugacuccauugccgg

SEQ ID NO: 1115246 - RNA, 13 nt, Mycobacterium bovis subsp bovis AF2122/97
cuggugcagcgcc

SEQ ID NO: 1115247 - RNA, 14 nt, Mycobacterium bovis subsp bovis AF2122/97
cuggugcagcgccg

SEQ ID NO: 1115248 - RNA, 15 nt, Mycobacterium bovis subsp bovis AF2122/97
cuggugcagcgccga

SEQ ID NO: 1115249 - RNA, 15 nt, Mycobacterium bovis subsp bovis AF2122/97
cuggugccugccgca

SEQ ID NO: 1115250 - RNA, 18 nt, Mycobacterium bovis subsp bovis AF2122/97
cuggugcccgacccgccg

SEQ ID NO: 1115251 - RNA, 22 nt, Mycobacterium bovis subsp bovis AF2122/97
cuggugccaacugcgccguucg

SEQ ID NO: 1115252 - RNA, 21 nt, Mycobacterium bovis subsp bovis AF2122/97
cuggucggcuaccgccgaccg

SEQ ID NO: 1115253 - RNA, 17 nt, Mycobacterium bovis subsp bovis AF2122/97
cuggucgugggccacca

SEQ ID NO: 1115254 - RNA, 22 nt, Mycobacterium bovis subsp bovis AF2122/97
cuggucucccagaggucgagcg

SEQ ID NO: 1115255 - RNA, 16 nt, Mycobacterium bovis subsp bovis AF2122/97
cuggucggcuucgggg

SEQ ID NO: 1115256 - RNA, 19 nt, Mycobacterium bovis subsp bovis AF2122/97
cuggucgucgaacggcagc

SEQ ID NO: 1115257 - RNA, 17 nt, Mycobacterium bovis subsp bovis AF2122/97
cuggucgcugcugcgau

SEQ ID NO: 1115258 - RNA, 14 nt, Mycobacterium bovis subsp bovis AF2122/97
cuggucggccgcaa

SEQ ID NO: 1115259 - RNA, 22 nt, Mycobacterium bovis subsp bovis AF2122/97
cuggucggccgcaaggcgccga

SEQ ID NO: 1115260 - RNA, 15 nt, Mycobacterium bovis subsp bovis AF2122/97
cuggucgcuggugca

SEQ ID NO: 1115261 - RNA, 19 nt, Mycobacterium bovis subsp bovis AF2122/97
cuggucgcgguggcggcgg

SEQ ID NO: 1115262 - RNA, 22 nt, Mycobacterium bovis subsp bovis AF2122/97
cuggucgcguaccaacaggaug

SEQ ID NO: 1115263 - RNA, 12 nt, Mycobacterium bovis subsp bovis AF2122/97
cuggucgccgcg

SEQ ID NO: 1115264 - RNA, 16 nt, Mycobacterium bovis subsp bovis AF2122/97
cuggucgccgcggcag

SEQ ID NO: 1115265 - RNA, 18 nt, Mycobacterium bovis subsp bovis AF2122/97
cuggucgccgucgaagcg

SEQ ID NO: 1115266 - RNA, 21 nt, Mycobacterium bovis subsp bovis AF2122/97
cuggucgccugccaucacgcg

SEQ ID NO: 1115267 - RNA, 17 nt, Mycobacterium bovis subsp bovis AF2122/97
cuggucgccaacgccag

SEQ ID NO: 1115268 - RNA, 22 nt, Mycobacterium bovis subsp bovis AF2122/97
cuggucgagcacgcugcugcgg

SEQ ID NO: 1115269 - RNA, 13 nt, Mycobacterium bovis subsp bovis AF2122/97
cuggucgagcacg

SEQ ID NO: 1115270 - RNA, 13 nt, Mycobacterium bovis subsp bovis AF2122/97
cugguagcaccca

SEQ ID NO: 1115271 - RNA, 21 nt, Mycobacterium bovis subsp bovis AF2122/97
cugguagcacccacggcgaga

SEQ ID NO: 1115272 - RNA, 15 nt, Mycobacterium bovis subsp bovis AF2122/97
cugguaccgcggugu

SEQ ID NO: 1115273 - RNA, 18 nt, Mycobacterium bovis subsp bovis AF2122/97
cugguaccgcgguguucg

SEQ ID NO: 1115274 - RNA, 17 nt, Mycobacterium bovis subsp bovis AF2122/97
cugguaaggccggccgg

SEQ ID NO: 1115275 - RNA, 18 nt, Mycobacterium bovis subsp bovis AF2122/97
cugguaaggccggccggu

SEQ ID NO: 1115276 - RNA, 18 nt, Mycobacterium bovis subsp bovis AF2122/97
cugggcacucggcccggc

SEQ ID NO: 1115277 - RNA, 14 nt, Mycobacterium bovis subsp bovis AF2122/97
cugggcagaccgau

SEQ ID NO: 1115278 - RNA, 18 nt, Mycobacterium bovis subsp bovis AF2122/97
cugggcagaccgaucggc

SEQ ID NO: 1115279 - RNA, 22 nt, Mycobacterium bovis subsp bovis AF2122/97
cugggcaucaccgacgcgucgg

SEQ ID NO: 1115280 - RNA, 14 nt, Mycobacterium bovis subsp bovis AF2122/97
cugggcaucaccgc

SEQ ID NO: 1115281 - RNA, 15 nt, Mycobacterium bovis subsp bovis AF2122/97
cugggcaucaccgcc

SEQ ID NO: 1115282 - RNA, 20 nt, Mycobacterium bovis subsp bovis AF2122/97
cugggcaucaccgccgcggc

SEQ ID NO: 1115283 - RNA, 21 nt, Mycobacterium bovis subsp bovis AF2122/97
cugggcaucaccgccgcggcc

SEQ ID NO: 1115284 - RNA, 21 nt, Mycobacterium bovis subsp bovis AF2122/97
cugggauguucgaucagcgac

SEQ ID NO: 1115285 - RNA, 21 nt, Mycobacterium bovis subsp bovis AF2122/97
cuggcuguggcugaacaccgc

SEQ ID NO: 1115286 - RNA, 22 nt, Mycobacterium bovis subsp bovis AF2122/97
cuggcuguggcugaacaccgcg

SEQ ID NO: 1115287 - RNA, 19 nt, Mycobacterium bovis subsp bovis AF2122/97
cuggcuuugaucgcccggu

SEQ ID NO: 1115288 - RNA, 14 nt, Mycobacterium bovis subsp bovis AF2122/97
cugggacggcggca

SEQ ID NO: 1115289 - RNA, 15 nt, Mycobacterium bovis subsp bovis AF2122/97
cugggacgggcgcgu

SEQ ID NO: 1115290 - RNA, 18 nt, Mycobacterium bovis subsp bovis AF2122/97
cugggacgggcgcgucgg

SEQ ID NO: 1115291 - RNA, 17 nt, Mycobacterium bovis subsp bovis AF2122/97
cuggcgguaucgaaagc

SEQ ID NO: 1115292 - RNA, 20 nt, Mycobacterium bovis subsp bovis AF2122/97
cuggcggguaagcgaccgac

SEQ ID NO: 1115293 - RNA, 17 nt, Mycobacterium bovis subsp bovis AF2122/97
cuggcggguggcgauga

SEQ ID NO: 1115294 - RNA, 23 nt, Mycobacterium bovis subsp bovis AF2122/97
cuggcggugcagugccucggcgg

SEQ ID NO: 1115295 - RNA, 12 nt, Mycobacterium bovis subsp bovis AF2122/97
cuggcgguugcc

SEQ ID NO: 1115296 - RNA, 20 nt, Mycobacterium bovis subsp bovis AF2122/97
cuggcgggcacucagcaggg

SEQ ID NO: 1115297 - RNA, 19 nt, Mycobacterium bovis subsp bovis AF2122/97
cuggcggguaagcgaccga

SEQ ID NO: 1115298 - RNA, 19 nt, Mycobacterium bovis subsp bovis AF2122/97
cuggcggcguggcgccggc

SEQ ID NO: 1115299 - RNA, 15 nt, Mycobacterium bovis subsp bovis AF2122/97
cugggccagccgcuc

SEQ ID NO: 1115300 - RNA, 19 nt, Mycobacterium bovis subsp bovis AF2122/97
cugggcggcuacccauggc

SEQ ID NO: 1115301 - RNA, 18 nt, Mycobacterium bovis subsp bovis AF2122/97
cugggcuucaucggcgau

SEQ ID NO: 1115302 - RNA, 15 nt, Mycobacterium bovis subsp bovis AF2122/97
cugggcuugugggcc

SEQ ID NO: 1115303 - RNA, 21 nt, Mycobacterium bovis subsp bovis AF2122/97
cugggcuuucugcacccgcca

SEQ ID NO: 1115304 - RNA, 17 nt, Mycobacterium bovis subsp bovis AF2122/97
cugggcuuugcagcguu

SEQ ID NO: 1115305 - RNA, 15 nt, Mycobacterium bovis subsp bovis AF2122/97
cugggcugcggccgc

SEQ ID NO: 1115306 - RNA, 22 nt, Mycobacterium bovis subsp bovis AF2122/97
cugggcggugaaggccccgccg

SEQ ID NO: 1115307 - RNA, 22 nt, Mycobacterium bovis subsp bovis AF2122/97
cugggucuuggauccggccgcc

SEQ ID NO: 1115308 - RNA, 16 nt, Mycobacterium bovis subsp bovis AF2122/97
cuggggcaccacgcug

SEQ ID NO: 1115309 - RNA, 14 nt, Mycobacterium bovis subsp bovis AF2122/97
cugggcuggccagc

SEQ ID NO: 1115310 - RNA, 18 nt, Mycobacterium bovis subsp bovis AF2122/97
cuggggaacagcagcgca

SEQ ID NO: 1115311 - RNA, 16 nt, Mycobacterium bovis subsp bovis AF2122/97
cugggugccggcagcg

SEQ ID NO: 1115312 - RNA, 15 nt, Mycobacterium bovis subsp bovis AF2122/97
cuggguggccaacca

SEQ ID NO: 1115313 - RNA, 16 nt, Mycobacterium bovis subsp bovis AF2122/97
cuggguggcgucgcgg

SEQ ID NO: 1115314 - RNA, 13 nt, Mycobacterium bovis subsp bovis AF2122/97
cuggguggcgucg

SEQ ID NO: 1115315 - RNA, 20 nt, Mycobacterium bovis subsp bovis AF2122/97
cuggguggacaggucgggcc

SEQ ID NO: 1115316 - RNA, 16 nt, Mycobacterium bovis subsp bovis AF2122/97
cugggugaccucgucg

SEQ ID NO: 1115317 - RNA, 17 nt, Mycobacterium bovis subsp bovis AF2122/97
cuggguugcguagucgu

SEQ ID NO: 1115318 - RNA, 20 nt, Mycobacterium bovis subsp bovis AF2122/97
cuggguuugcacggcgcgcc

SEQ ID NO: 1115319 - RNA, 17 nt, Mycobacterium bovis subsp bovis AF2122/97
cuggccagcagagcggc

SEQ ID NO: 1115320 - RNA, 21 nt, Mycobacterium bovis subsp bovis AF2122/97
cuggccagcagagcggcacgc

SEQ ID NO: 1115321 - RNA, 23 nt, Mycobacterium bovis subsp bovis AF2122/97
cuggccagcagagcggcacgcac

SEQ ID NO: 1115322 - RNA, 12 nt, Mycobacterium bovis subsp bovis AF2122/97
cuggccagcaca

SEQ ID NO: 1115323 - RNA, 21 nt, Mycobacterium bovis subsp bovis AF2122/97
cuggcccgcacgaaccggucg

SEQ ID NO: 1115324 - RNA, 17 nt, Mycobacterium bovis subsp bovis AF2122/97
cuggccagcccgagcuc

SEQ ID NO: 1115325 - RNA, 14 nt, Mycobacterium bovis subsp bovis AF2122/97
cuggcccgcaugcc

SEQ ID NO: 1115326 - RNA, 17 nt, Mycobacterium bovis subsp bovis AF2122/97
cuggcccgcaugccggc

SEQ ID NO: 1115327 - RNA, 20 nt, Mycobacterium bovis subsp bovis AF2122/97
cuggcccgcaugccggcgca

SEQ ID NO: 1115328 - RNA, 21 nt, Mycobacterium bovis subsp bovis AF2122/97
cuggcccgcaugccggcgcac

SEQ ID NO: 1115329 - RNA, 23 nt, Mycobacterium bovis subsp bovis AF2122/97
cuggcccgccagaacggcgucga

SEQ ID NO: 1115330 - RNA, 15 nt, Mycobacterium bovis subsp bovis AF2122/97
cuggcccggcuacga

SEQ ID NO: 1115331 - RNA, 17 nt, Mycobacterium bovis subsp bovis AF2122/97
cuggcccggacaugcgg

SEQ ID NO: 1115332 - RNA, 21 nt, Mycobacterium bovis subsp bovis AF2122/97
cuggccgaacgacggguccgg

SEQ ID NO: 1115333 - RNA, 21 nt, Mycobacterium bovis subsp bovis AF2122/97
cuggccgaauaacagcaggca

SEQ ID NO: 1115334 - RNA, 18 nt, Mycobacterium bovis subsp bovis AF2122/97
cuggccuuugagcgcggc

SEQ ID NO: 1115335 - RNA, 22 nt, Mycobacterium bovis subsp bovis AF2122/97
cuggccuuugagcgcggccacc

SEQ ID NO: 1115336 - RNA, 23 nt, Mycobacterium bovis subsp bovis AF2122/97
cuggccuuugagcgcggccacca

SEQ ID NO: 1115337 - RNA, 20 nt, Mycobacterium bovis subsp bovis AF2122/97
cuggccuuggcaguccagcc

SEQ ID NO: 1115338 - RNA, 13 nt, Mycobacterium bovis subsp bovis AF2122/97
cuggccugcggca

SEQ ID NO: 1115339 - RNA, 15 nt, Mycobacterium bovis subsp bovis AF2122/97
cuggccugcggcagg

SEQ ID NO: 1115340 - RNA, 13 nt, Mycobacterium bovis subsp bovis AF2122/97
cuggccugcccca

SEQ ID NO: 1115341 - RNA, 21 nt, Mycobacterium bovis subsp bovis AF2122/97
cuggcgccgaaguagccgacc

SEQ ID NO: 1115342 - RNA, 18 nt, Mycobacterium bovis subsp bovis AF2122/97
cuggcgccgccggugcca

SEQ ID NO: 1115343 - RNA, 16 nt, Mycobacterium bovis subsp bovis AF2122/97
cuggcgccggugccgc

SEQ ID NO: 1115344 - RNA, 20 nt, Mycobacterium bovis subsp bovis AF2122/97
cuggcgcccccgacgacggc

SEQ ID NO: 1115345 - RNA, 13 nt, Mycobacterium bovis subsp bovis AF2122/97
cuggcgcccccgc

SEQ ID NO: 1115346 - RNA, 14 nt, Mycobacterium bovis subsp bovis AF2122/97
cuggcgcccccgcc

SEQ ID NO: 1115347 - RNA, 17 nt, Mycobacterium bovis subsp bovis AF2122/97
cuggcgcccccgccauu

SEQ ID NO: 1115348 - RNA, 19 nt, Mycobacterium bovis subsp bovis AF2122/97
cuggcgcagcaacucgacg

SEQ ID NO: 1115349 - RNA, 17 nt, Mycobacterium bovis subsp bovis AF2122/97
cuggcgagcagacgcaa

SEQ ID NO: 1115350 - RNA, 23 nt, Mycobacterium bovis subsp bovis AF2122/97
cuggcgaugacgaucgcguccgc

SEQ ID NO: 1115351 - RNA, 15 nt, Mycobacterium bovis subsp bovis AF2122/97
cuggcgauaucggcc

SEQ ID NO: 1115352 - RNA, 16 nt, Mycobacterium bovis subsp bovis AF2122/97
cuggcgaucuggucgg

SEQ ID NO: 1115353 - RNA, 17 nt, Mycobacterium bovis subsp bovis AF2122/97
cuggcgaugacgaucgc

SEQ ID NO: 1115354 - RNA, 20 nt, Mycobacterium bovis subsp bovis AF2122/97
cuggcgagggcuaccggcgc

SEQ ID NO: 1115355 - RNA, 22 nt, Mycobacterium bovis subsp bovis AF2122/97
cuggcgagggcuaccggcgccg

SEQ ID NO: 1115356 - RNA, 23 nt, Mycobacterium bovis subsp bovis AF2122/97
cuggcgagggcuaccggcgccgc

SEQ ID NO: 1115357 - RNA, 14 nt, Mycobacterium bovis subsp bovis AF2122/97
cuggaggcggcgcc

SEQ ID NO: 1115358 - RNA, 21 nt, Mycobacterium bovis subsp bovis AF2122/97
cuggaggcggcgccuguucgg

SEQ ID NO: 1115359 - RNA, 21 nt, Mycobacterium bovis subsp bovis AF2122/97
cuggaggugaacucguucagc

SEQ ID NO: 1115360 - RNA, 19 nt, Mycobacterium bovis subsp bovis AF2122/97
cuggaguaggugugcggga

SEQ ID NO: 1115361 - RNA, 15 nt, Mycobacterium bovis subsp bovis AF2122/97
cuggagccgugcggu

SEQ ID NO: 1115362 - RNA, 18 nt, Mycobacterium bovis subsp bovis AF2122/97
cuggagaucacgccgacg

SEQ ID NO: 1115363 - RNA, 18 nt, Mycobacterium bovis subsp bovis AF2122/97
cuggagaacucugcgaga

SEQ ID NO: 1115364 - RNA, 16 nt, Mycobacterium bovis subsp bovis AF2122/97
cuggaucagaucccgc

SEQ ID NO: 1115365 - RNA, 15 nt, Mycobacterium bovis subsp bovis AF2122/97
cuggauacccagcgc

SEQ ID NO: 1115366 - RNA, 18 nt, Mycobacterium bovis subsp bovis AF2122/97
cuggauacccagcgcccg

SEQ ID NO: 1115367 - RNA, 23 nt, Mycobacterium bovis subsp bovis AF2122/97
cuggagugaggcugugccccagg

SEQ ID NO: 1115368 - RNA, 17 nt, Mycobacterium bovis subsp bovis AF2122/97
cuggaguucgucaccgu

SEQ ID NO: 1115369 - RNA, 19 nt, Mycobacterium bovis subsp bovis AF2122/97
cuggacgcgaaauccccug

SEQ ID NO: 1115370 - RNA, 22 nt, Mycobacterium bovis subsp bovis AF2122/97
cuggacgcuccgggaauggcga

SEQ ID NO: 1115371 - RNA, 16 nt, Mycobacterium bovis subsp bovis AF2122/97
cuggagaaaccacugg

SEQ ID NO: 1115372 - RNA, 21 nt, Mycobacterium bovis subsp bovis AF2122/97
cugcgagacuuggugauccga

SEQ ID NO: 1115373 - RNA, 16 nt, Mycobacterium bovis subsp bovis AF2122/97
cuggacggcgggccgc

SEQ ID NO: 1115374 - RNA, 23 nt, Mycobacterium bovis subsp bovis AF2122/97
cuggacugcagcccugcgcagcc

SEQ ID NO: 1115375 - RNA, 18 nt, Mycobacterium bovis subsp bovis AF2122/97
cuggacuggggcgccacc

SEQ ID NO: 1115376 - RNA, 17 nt, Mycobacterium bovis subsp bovis AF2122/97
cugcgagggcacgcgca

SEQ ID NO: 1115377 - RNA, 19 nt, Mycobacterium bovis subsp bovis AF2122/97
cugcgagaggugcugcacc

SEQ ID NO: 1115378 - RNA, 23 nt, Mycobacterium bovis subsp bovis AF2122/97
cuggccacccagaaugacaucgu

SEQ ID NO: 1115379 - RNA, 18 nt, Mycobacterium bovis subsp bovis AF2122/97
cuggccacucccagccaa

SEQ ID NO: 1115380 - RNA, 20 nt, Mycobacterium bovis subsp bovis AF2122/97
cuggccacuuucagaucgau

SEQ ID NO: 1115381 - RNA, 22 nt, Mycobacterium bovis subsp bovis AF2122/97
cuggcaggauaccgaaaucacc

SEQ ID NO: 1115382 - RNA, 22 nt, Mycobacterium bovis subsp bovis AF2122/97
cuggcagcuccucgcgcucgcc

SEQ ID NO: 1115383 - RNA, 15 nt, Mycobacterium bovis subsp bovis AF2122/97
cuggcagcggccucc

SEQ ID NO: 1115384 - RNA, 21 nt, Mycobacterium bovis subsp bovis AF2122/97
cuggcagcggccuccgggcca

SEQ ID NO: 1115385 - RNA, 14 nt, Mycobacterium bovis subsp bovis AF2122/97
cuggaucgcggugg

SEQ ID NO: 1115386 - RNA, 15 nt, Mycobacterium bovis subsp bovis AF2122/97
cuggaucgacuucgg

SEQ ID NO: 1115387 - RNA, 18 nt, Mycobacterium bovis subsp bovis AF2122/97
cuguucgagaucgccgag

SEQ ID NO: 1115388 - RNA, 13 nt, Mycobacterium bovis subsp bovis AF2122/97
cuguucgccgacg

SEQ ID NO: 1115389 - RNA, 19 nt, Mycobacterium bovis subsp bovis AF2122/97
cuguuccagaaggccgcac

SEQ ID NO: 1115390 - RNA, 20 nt, Mycobacterium bovis subsp bovis AF2122/97
cuguuccagaaggccgcacc

SEQ ID NO: 1115391 - RNA, 15 nt, Mycobacterium bovis subsp bovis AF2122/97
cugugcgcggacacc

SEQ ID NO: 1115392 - RNA, 16 nt, Mycobacterium bovis subsp bovis AF2122/97
cuguucaacuccggca

SEQ ID NO: 1115393 - RNA, 15 nt, Mycobacterium bovis subsp bovis AF2122/97
cugucguaccgcgga

SEQ ID NO: 1115394 - RNA, 13 nt, Mycobacterium bovis subsp bovis AF2122/97
cugucggcaugcc

SEQ ID NO: 1115395 - RNA, 14 nt, Mycobacterium bovis subsp bovis AF2122/97
cugucggccggguc

SEQ ID NO: 1115396 - RNA, 21 nt, Mycobacterium bovis subsp bovis AF2122/97
cugugccgagaugccggcgag

SEQ ID NO: 1115397 - RNA, 22 nt, Mycobacterium bovis subsp bovis AF2122/97
cugugccgagaugccggcgagc

SEQ ID NO: 1115398 - RNA, 12 nt, Mycobacterium bovis subsp bovis AF2122/97
cugugccgccgg

SEQ ID NO: 1115399 - RNA, 14 nt, Mycobacterium bovis subsp bovis AF2122/97
cugugccgccggcg

SEQ ID NO: 1115400 - RNA, 17 nt, Mycobacterium bovis subsp bovis AF2122/97
cugugcgcagacaucgg

SEQ ID NO: 1115401 - RNA, 15 nt, Mycobacterium bovis subsp bovis AF2122/97
cugugccaccgcugg

SEQ ID NO: 1115402 - RNA, 22 nt, Mycobacterium bovis subsp bovis AF2122/97
cugugccagcagcagcgccgcg

SEQ ID NO: 1115403 - RNA, 14 nt, Mycobacterium bovis subsp bovis AF2122/97
cugugcccggcgcc

SEQ ID NO: 1115404 - RNA, 21 nt, Mycobacterium bovis subsp bovis AF2122/97
cugugcccucaacgucccagc

SEQ ID NO: 1115405 - RNA, 16 nt, Mycobacterium bovis subsp bovis AF2122/97
cuguucuccgugaucg

SEQ ID NO: 1115406 - RNA, 15 nt, Mycobacterium bovis subsp bovis AF2122/97
cuguucucgccgaag

SEQ ID NO: 1115407 - RNA, 22 nt, Mycobacterium bovis subsp bovis AF2122/97
cuguucggccauggcggcgccg

SEQ ID NO: 1115408 - RNA, 19 nt, Mycobacterium bovis subsp bovis AF2122/97
cuguugacuaccaccgcgu

SEQ ID NO: 1115409 - RNA, 18 nt, Mycobacterium bovis subsp bovis AF2122/97
cuguugaagaggcgcacc

SEQ ID NO: 1115410 - RNA, 18 nt, Mycobacterium bovis subsp bovis AF2122/97
cuguugacgccacgacgc

SEQ ID NO: 1115411 - RNA, 17 nt, Mycobacterium bovis subsp bovis AF2122/97
cuguuuggggcugugca

SEQ ID NO: 1115412 - RNA, 16 nt, Mycobacterium bovis subsp bovis AF2122/97
cuguuucugagcgcgc

SEQ ID NO: 1115413 - RNA, 16 nt, Mycobacterium bovis subsp bovis AF2122/97
cuguugcaucgccgcg

SEQ ID NO: 1115414 - RNA, 21 nt, Mycobacterium bovis subsp bovis AF2122/97
cuguugccagucgaucgcggc

SEQ ID NO: 1115415 - RNA, 15 nt, Mycobacterium bovis subsp bovis AF2122/97
cuguugccaucgacg

SEQ ID NO: 1115416 - RNA, 15 nt, Mycobacterium bovis subsp bovis AF2122/97
cuguugcccuuggga

SEQ ID NO: 1115417 - RNA, 20 nt, Mycobacterium bovis subsp bovis AF2122/97
cuuagcgucgcugcccgcgg

SEQ ID NO: 1115418 - RNA, 16 nt, Mycobacterium bovis subsp bovis AF2122/97
cuguagggccggugac

SEQ ID NO: 1115419 - RNA, 20 nt, Mycobacterium bovis subsp bovis AF2122/97
cuguaggucacagcugcgca

SEQ ID NO: 1115420 - RNA, 13 nt, Mycobacterium bovis subsp bovis AF2122/97
cuguaggcgauca

SEQ ID NO: 1115421 - RNA, 17 nt, Mycobacterium bovis subsp bovis AF2122/97
cuguacucgcggcgcgg

SEQ ID NO: 1115422 - RNA, 12 nt, Mycobacterium bovis subsp bovis AF2122/97
cuguagcgaaug

SEQ ID NO: 1115423 - RNA, 17 nt, Mycobacterium bovis subsp bovis AF2122/97
cuguccgaccucgccgc

SEQ ID NO: 1115424 - RNA, 19 nt, Mycobacterium bovis subsp bovis AF2122/97
cuguccgaccucgccgcgc

SEQ ID NO: 1115425 - RNA, 19 nt, Mycobacterium bovis subsp bovis AF2122/97
cuguccgacuucuccaggc

SEQ ID NO: 1115426 - RNA, 21 nt, Mycobacterium bovis subsp bovis AF2122/97
cugucccucgggaucaccgau

SEQ ID NO: 1115427 - RNA, 16 nt, Mycobacterium bovis subsp bovis AF2122/97
cugucgaucacggccg

SEQ ID NO: 1115428 - RNA, 12 nt, Mycobacterium bovis subsp bovis AF2122/97
cugucgcgccgg

SEQ ID NO: 1115429 - RNA, 17 nt, Mycobacterium bovis subsp bovis AF2122/97
cugucgauuucgccguc

SEQ ID NO: 1115430 - RNA, 13 nt, Mycobacterium bovis subsp bovis AF2122/97
cugucgcaccaga

SEQ ID NO: 1115431 - RNA, 23 nt, Mycobacterium bovis subsp bovis AF2122/97
cuguccacgaugacgucgacaac

SEQ ID NO: 1115432 - RNA, 22 nt, Mycobacterium bovis subsp bovis AF2122/97
cuguccacguccagcccgucca

SEQ ID NO: 1115433 - RNA, 19 nt, Mycobacterium bovis subsp bovis AF2122/97
cuguccacugccaccgcga

SEQ ID NO: 1115434 - RNA, 21 nt, Mycobacterium bovis subsp bovis AF2122/97
cugucccgccggccccgccga

SEQ ID NO: 1115435 - RNA, 16 nt, Mycobacterium bovis subsp bovis AF2122/97
cugguuggccugccgu

SEQ ID NO: 1115436 - RNA, 20 nt, Mycobacterium bovis subsp bovis AF2122/97
cugguugucgaucucggcca

SEQ ID NO: 1115437 - RNA, 19 nt, Mycobacterium bovis subsp bovis AF2122/97
cugguugccuuugcggcgg

SEQ ID NO: 1115438 - RNA, 22 nt, Mycobacterium bovis subsp bovis AF2122/97
cugguugggcgagaccgcgagc

SEQ ID NO: 1115439 - RNA, 14 nt, Mycobacterium bovis subsp bovis AF2122/97
cugguuggugacgu

SEQ ID NO: 1115440 - RNA, 17 nt, Mycobacterium bovis subsp bovis AF2122/97
cugguuguugccgacga

SEQ ID NO: 1115441 - RNA, 13 nt, Mycobacterium bovis subsp bovis AF2122/97
cugguuucggccg

SEQ ID NO: 1115442 - RNA, 15 nt, Mycobacterium bovis subsp bovis AF2122/97
cugguuucggccgca

SEQ ID NO: 1115443 - RNA, 12 nt, Mycobacterium bovis subsp bovis AF2122/97
cugguuucgggg

SEQ ID NO: 1115444 - RNA, 16 nt, Mycobacterium bovis subsp bovis AF2122/97
cugguuaccgaagguc

SEQ ID NO: 1115445 - RNA, 17 nt, Mycobacterium bovis subsp bovis AF2122/97
cugguguugaucgucgg

SEQ ID NO: 1115446 - RNA, 15 nt, Mycobacterium bovis subsp bovis AF2122/97
cugguugacggcgaa

SEQ ID NO: 1115447 - RNA, 15 nt, Mycobacterium bovis subsp bovis AF2122/97
cuguaacacccggcc

SEQ ID NO: 1115448 - RNA, 21 nt, Mycobacterium bovis subsp bovis AF2122/97
cuguacauacucugcgacacc

SEQ ID NO: 1115449 - RNA, 14 nt, Mycobacterium bovis subsp bovis AF2122/97
cuguacaacgccgu

SEQ ID NO: 1115450 - RNA, 16 nt, Mycobacterium bovis subsp bovis AF2122/97
cuucgcgaagaacgac

SEQ ID NO: 1115451 - RNA, 17 nt, Mycobacterium bovis subsp bovis AF2122/97
cuucgcgauguccucga

SEQ ID NO: 1115452 - RNA, 15 nt, Mycobacterium bovis subsp bovis AF2122/97
cuucgccgucggcga

SEQ ID NO: 1115453 - RNA, 13 nt, Mycobacterium bovis subsp bovis AF2122/97
cuucgcgcgcugg

SEQ ID NO: 1115454 - RNA, 17 nt, Mycobacterium bovis subsp bovis AF2122/97
cuucgcggcggucguug

SEQ ID NO: 1115455 - RNA, 15 nt, Mycobacterium bovis subsp bovis AF2122/97
cuucgcgcagccgcc

SEQ ID NO: 1115456 - RNA, 20 nt, Mycobacterium bovis subsp bovis AF2122/97
cuucgcgcagccgccgcgcc

SEQ ID NO: 1115457 - RNA, 22 nt, Mycobacterium bovis subsp bovis AF2122/97
cuucgcgucggcgaacagacgc

SEQ ID NO: 1115458 - RNA, 14 nt, Mycobacterium bovis subsp bovis AF2122/97
cuucgcggcgguga

SEQ ID NO: 1115459 - RNA, 22 nt, Mycobacterium bovis subsp bovis AF2122/97
cuucgcgggacgcgacucggcg

SEQ ID NO: 1115460 - RNA, 23 nt, Mycobacterium bovis subsp bovis AF2122/97
cuucgcgggacgcgacucggcgg

SEQ ID NO: 1115461 - RNA, 21 nt, Mycobacterium bovis subsp bovis AF2122/97
cuucgcgguuggcggcgaugg

SEQ ID NO: 1115462 - RNA, 21 nt, Mycobacterium bovis subsp bovis AF2122/97
cuucgcuggaaaccucuucgg

SEQ ID NO: 1115463 - RNA, 15 nt, Mycobacterium bovis subsp bovis AF2122/97
cuucggcgccgcgcc

SEQ ID NO: 1115464 - RNA, 15 nt, Mycobacterium bovis subsp bovis AF2122/97
cuucggcggucagcg

SEQ ID NO: 1115465 - RNA, 20 nt, Mycobacterium bovis subsp bovis AF2122/97
cuucggcggucgccgcgcgu

SEQ ID NO: 1115466 - RNA, 22 nt, Mycobacterium bovis subsp bovis AF2122/97
cuucggcggugcccagcagcgc

SEQ ID NO: 1115467 - RNA, 14 nt, Mycobacterium bovis subsp bovis AF2122/97
cuucggcgacaggc

SEQ ID NO: 1115468 - RNA, 17 nt, Mycobacterium bovis subsp bovis AF2122/97
cuucggcgacaggccga

SEQ ID NO: 1115469 - RNA, 15 nt, Mycobacterium bovis subsp bovis AF2122/97
cuucggcagaccggc

SEQ ID NO: 1115470 - RNA, 12 nt, Mycobacterium bovis subsp bovis AF2122/97
cuucggccgcac

SEQ ID NO: 1115471 - RNA, 16 nt, Mycobacterium bovis subsp bovis AF2122/97
cuucggccggcguguu

SEQ ID NO: 1115472 - RNA, 20 nt, Mycobacterium bovis subsp bovis AF2122/97
cuucgcugguauagcucacg

SEQ ID NO: 1115473 - RNA, 17 nt, Mycobacterium bovis subsp bovis AF2122/97
cuucgcuuucccgucgg

SEQ ID NO: 1115474 - RNA, 18 nt, Mycobacterium bovis subsp bovis AF2122/97
cuucggacagcagccggc

SEQ ID NO: 1115475 - RNA, 14 nt, Mycobacterium bovis subsp bovis AF2122/97
cuucggaccggcuc

SEQ ID NO: 1115476 - RNA, 19 nt, Mycobacterium bovis subsp bovis AF2122/97
cuucggagaccgccucguc

SEQ ID NO: 1115477 - RNA, 19 nt, Mycobacterium bovis subsp bovis AF2122/97
cuuccauucauggccgcga

SEQ ID NO: 1115478 - RNA, 14 nt, Mycobacterium bovis subsp bovis AF2122/97
cuuccuggcgugag

SEQ ID NO: 1115479 - RNA, 13 nt, Mycobacterium bovis subsp bovis AF2122/97
cuuccucggccac

SEQ ID NO: 1115480 - RNA, 21 nt, Mycobacterium bovis subsp bovis AF2122/97
cuuccucguaggcguacacca

SEQ ID NO: 1115481 - RNA, 19 nt, Mycobacterium bovis subsp bovis AF2122/97
cuucgcagcauguggccgc

SEQ ID NO: 1115482 - RNA, 20 nt, Mycobacterium bovis subsp bovis AF2122/97
cuucgcagcauguggccgcc

SEQ ID NO: 1115483 - RNA, 23 nt, Mycobacterium bovis subsp bovis AF2122/97
cuucgcagcgguggucggcgcgc

SEQ ID NO: 1115484 - RNA, 24 nt, Mycobacterium bovis subsp bovis AF2122/97
cuucgcagcgguggucggcgcgcc

SEQ ID NO: 1115485 - RNA, 17 nt, Mycobacterium bovis subsp bovis AF2122/97
cuucgauucuggccgga

SEQ ID NO: 1115486 - RNA, 18 nt, Mycobacterium bovis subsp bovis AF2122/97
cuucgauugcgcugcacc

SEQ ID NO: 1115487 - RNA, 22 nt, Mycobacterium bovis subsp bovis AF2122/97
cuucgauugcgcugcaccgggu

SEQ ID NO: 1115488 - RNA, 16 nt, Mycobacterium bovis subsp bovis AF2122/97
cuucgcaagucaucca

SEQ ID NO: 1115489 - RNA, 22 nt, Mycobacterium bovis subsp bovis AF2122/97
cuucgaucaucgaccuggccac

SEQ ID NO: 1115490 - RNA, 22 nt, Mycobacterium bovis subsp bovis AF2122/97
cuucgauggugugcccgcaccg

SEQ ID NO: 1115491 - RNA, 20 nt, Mycobacterium bovis subsp bovis AF2122/97
cuucgauaaccucagcgcgg

SEQ ID NO: 1115492 - RNA, 18 nt, Mycobacterium bovis subsp bovis AF2122/97
cuucgaguuuggcgacga

SEQ ID NO: 1115493 - RNA, 21 nt, Mycobacterium bovis subsp bovis AF2122/97
cuucacgccgccccugcgcgg

SEQ ID NO: 1115494 - RNA, 17 nt, Mycobacterium bovis subsp bovis AF2122/97
cuucacgggccguccag

SEQ ID NO: 1115495 - RNA, 17 nt, Mycobacterium bovis subsp bovis AF2122/97
cuucaccucgucgacaa

SEQ ID NO: 1115496 - RNA, 17 nt, Mycobacterium bovis subsp bovis AF2122/97
cuucagcaagccaaccc

SEQ ID NO: 1115497 - RNA, 18 nt, Mycobacterium bovis subsp bovis AF2122/97
cuucagcaugguggacga

SEQ ID NO: 1115498 - RNA, 14 nt, Mycobacterium bovis subsp bovis AF2122/97
cuucacugcgaccg

SEQ ID NO: 1115499 - RNA, 21 nt, Mycobacterium bovis subsp bovis AF2122/97
cuucacucguugaccggccgg

SEQ ID NO: 1115500 - RNA, 14 nt, Mycobacterium bovis subsp bovis AF2122/97
cuucacuggcgaac

SEQ ID NO: 1115501 - RNA, 16 nt, Mycobacterium bovis subsp bovis AF2122/97
cuucagguagcggccc

SEQ ID NO: 1115502 - RNA, 15 nt, Mycobacterium bovis subsp bovis AF2122/97
cuucagggcgucgaa

SEQ ID NO: 1115503 - RNA, 14 nt, Mycobacterium bovis subsp bovis AF2122/97
cuucagguccaccg

SEQ ID NO: 1115504 - RNA, 12 nt, Mycobacterium bovis subsp bovis AF2122/97
cuucauagcgcc

SEQ ID NO: 1115505 - RNA, 23 nt, Mycobacterium bovis subsp bovis AF2122/97
cuucagcugcggauacagccgcc

SEQ ID NO: 1115506 - RNA, 17 nt, Mycobacterium bovis subsp bovis AF2122/97
cuucagcuaccuccgcc

SEQ ID NO: 1115507 - RNA, 14 nt, Mycobacterium bovis subsp bovis AF2122/97
cuucaucggcgaua

SEQ ID NO: 1115508 - RNA, 13 nt, Mycobacterium bovis subsp bovis AF2122/97
cuuccagcucguc

SEQ ID NO: 1115509 - RNA, 20 nt, Mycobacterium bovis subsp bovis AF2122/97
cuuccaggcgggcggcaccg

SEQ ID NO: 1115510 - RNA, 15 nt, Mycobacterium bovis subsp bovis AF2122/97
cuuccaggagcgccg

SEQ ID NO: 1115511 - RNA, 22 nt, Mycobacterium bovis subsp bovis AF2122/97
cuugcgcgccauuggcgccgcc

SEQ ID NO: 1115512 - RNA, 17 nt, Mycobacterium bovis subsp bovis AF2122/97
cuugcgcaucgccgaca

SEQ ID NO: 1115513 - RNA, 18 nt, Mycobacterium bovis subsp bovis AF2122/97
cuugcgcaucgccgacag

SEQ ID NO: 1115514 - RNA, 17 nt, Mycobacterium bovis subsp bovis AF2122/97
cuugcgcaaugccgacg

SEQ ID NO: 1115515 - RNA, 15 nt, Mycobacterium bovis subsp bovis AF2122/97
cuugcgccgcagcga

SEQ ID NO: 1115516 - RNA, 20 nt, Mycobacterium bovis subsp bovis AF2122/97
cuugcgccggaugacaccga

SEQ ID NO: 1115517 - RNA, 22 nt, Mycobacterium bovis subsp bovis AF2122/97
cuugcugcacgcucugcgccac

SEQ ID NO: 1115518 - RNA, 20 nt, Mycobacterium bovis subsp bovis AF2122/97
cuugcucggcgugcucggcc

SEQ ID NO: 1115519 - RNA, 14 nt, Mycobacterium bovis subsp bovis AF2122/97
cuugcuccacaucg

SEQ ID NO: 1115520 - RNA, 23 nt, Mycobacterium bovis subsp bovis AF2122/97
cuugcggcacccagucggcgccg

SEQ ID NO: 1115521 - RNA, 17 nt, Mycobacterium bovis subsp bovis AF2122/97
cuugcucacccgucguc

SEQ ID NO: 1115522 - RNA, 14 nt, Mycobacterium bovis subsp bovis AF2122/97
cuugcucagccggc

SEQ ID NO: 1115523 - RNA, 19 nt, Mycobacterium bovis subsp bovis AF2122/97
cuugcggcacccagucggc

SEQ ID NO: 1115524 - RNA, 22 nt, Mycobacterium bovis subsp bovis AF2122/97
cuugcggaccuggcggcgguag

SEQ ID NO: 1115525 - RNA, 13 nt, Mycobacterium bovis subsp bovis AF2122/97
cuugcggcaccca

SEQ ID NO: 1115526 - RNA, 14 nt, Mycobacterium bovis subsp bovis AF2122/97
cuugcggaccuggc

SEQ ID NO: 1115527 - RNA, 16 nt, Mycobacterium bovis subsp bovis AF2122/97
cuucguagcggccgca

SEQ ID NO: 1115528 - RNA, 15 nt, Mycobacterium bovis subsp bovis AF2122/97
cuucguaaccacgac

SEQ ID NO: 1115529 - RNA, 16 nt, Mycobacterium bovis subsp bovis AF2122/97
cuucguaaccacgacg

SEQ ID NO: 1115530 - RNA, 18 nt, Mycobacterium bovis subsp bovis AF2122/97
cuucgucauggccggcca

SEQ ID NO: 1115531 - RNA, 15 nt, Mycobacterium bovis subsp bovis AF2122/97
cuucgucggccggca

SEQ ID NO: 1115532 - RNA, 22 nt, Mycobacterium bovis subsp bovis AF2122/97
cuucgucgccgaacagcgacgc

SEQ ID NO: 1115533 - RNA, 15 nt, Mycobacterium bovis subsp bovis AF2122/97
cuucgucggccagca

SEQ ID NO: 1115534 - RNA, 12 nt, Mycobacterium bovis subsp bovis AF2122/97
cuugcccacggc

SEQ ID NO: 1115535 - RNA, 16 nt, Mycobacterium bovis subsp bovis AF2122/97
cuucuaccccggugac

SEQ ID NO: 1115536 - RNA, 14 nt, Mycobacterium bovis subsp bovis AF2122/97
cuugccccgccgag

SEQ ID NO: 1115537 - RNA, 14 nt, Mycobacterium bovis subsp bovis AF2122/97
cuugcccgucggcg

SEQ ID NO: 1115538 - RNA, 15 nt, Mycobacterium bovis subsp bovis AF2122/97
cuugcccucaacggc

SEQ ID NO: 1115539 - RNA, 20 nt, Mycobacterium bovis subsp bovis AF2122/97
cuugcccucaacggcggcaa

SEQ ID NO: 1115540 - RNA, 14 nt, Mycobacterium bovis subsp bovis AF2122/97
cuugcccuccgggu

SEQ ID NO: 1115541 - RNA, 23 nt, Mycobacterium bovis subsp bovis AF2122/97
cuugcccuccggguauggcggcg

SEQ ID NO: 1115542 - RNA, 17 nt, Mycobacterium bovis subsp bovis AF2122/97
cuugccgaaauccuuga

SEQ ID NO: 1115543 - RNA, 21 nt, Mycobacterium bovis subsp bovis AF2122/97
cuugccccgccuuggccacca

SEQ ID NO: 1115544 - RNA, 15 nt, Mycobacterium bovis subsp bovis AF2122/97
cuugccgucgcugac

SEQ ID NO: 1115545 - RNA, 16 nt, Mycobacterium bovis subsp bovis AF2122/97
cuugccgucggccggc

SEQ ID NO: 1115546 - RNA, 22 nt, Mycobacterium bovis subsp bovis AF2122/97
cuugccguuguagacggcggca

SEQ ID NO: 1115547 - RNA, 15 nt, Mycobacterium bovis subsp bovis AF2122/97
cuugcgaucgccgcu

SEQ ID NO: 1115548 - RNA, 21 nt, Mycobacterium bovis subsp bovis AF2122/97
cuuggccagcagcagcgcuuc

SEQ ID NO: 1115549 - RNA, 16 nt, Mycobacterium bovis subsp bovis AF2122/97
cuuggccagcagccgc

SEQ ID NO: 1115550 - RNA, 17 nt, Mycobacterium bovis subsp bovis AF2122/97
cuuggccaugcugguca

SEQ ID NO: 1115551 - RNA, 20 nt, Mycobacterium bovis subsp bovis AF2122/97
cuuggccaugcuggucagcg

SEQ ID NO: 1115552 - RNA, 20 nt, Mycobacterium bovis subsp bovis AF2122/97
cuuggccggccccgcccgcg

SEQ ID NO: 1115553 - RNA, 17 nt, Mycobacterium bovis subsp bovis AF2122/97
cuuggccgccacucgcc

SEQ ID NO: 1115554 - RNA, 20 nt, Mycobacterium bovis subsp bovis AF2122/97
cuuggccgccccggccgcug

SEQ ID NO: 1115555 - RNA, 12 nt, Mycobacterium bovis subsp bovis AF2122/97
cuuggccgcgca

SEQ ID NO: 1115556 - RNA, 16 nt, Mycobacterium bovis subsp bovis AF2122/97
cuuggugaaccgcgcg

SEQ ID NO: 1115557 - RNA, 17 nt, Mycobacterium bovis subsp bovis AF2122/97
cuuggucuugaacccga

SEQ ID NO: 1115558 - RNA, 17 nt, Mycobacterium bovis subsp bovis AF2122/97
cuugguccugcggucgc

SEQ ID NO: 1115559 - RNA, 19 nt, Mycobacterium bovis subsp bovis AF2122/97
cuugguccugcggucgcgg

SEQ ID NO: 1115560 - RNA, 17 nt, Mycobacterium bovis subsp bovis AF2122/97
cuuggucgaccgccgag

SEQ ID NO: 1115561 - RNA, 15 nt, Mycobacterium bovis subsp bovis AF2122/97
cuuggucgcccagcc

SEQ ID NO: 1115562 - RNA, 23 nt, Mycobacterium bovis subsp bovis AF2122/97
cuuggucgccgccuuacgcaccg

SEQ ID NO: 1115563 - RNA, 23 nt, Mycobacterium bovis subsp bovis AF2122/97
cuugguggcguggcccucggcga

SEQ ID NO: 1115564 - RNA, 17 nt, Mycobacterium bovis subsp bovis AF2122/97
cuuggugcgcgucagcc

SEQ ID NO: 1115565 - RNA, 20 nt, Mycobacterium bovis subsp bovis AF2122/97
cuuggcccccgacggugaac

SEQ ID NO: 1115566 - RNA, 14 nt, Mycobacterium bovis subsp bovis AF2122/97
cuugguggccagcc

SEQ ID NO: 1115567 - RNA, 21 nt, Mycobacterium bovis subsp bovis AF2122/97
cuugucggagcuagacccguc

SEQ ID NO: 1115568 - RNA, 19 nt, Mycobacterium bovis subsp bovis AF2122/97
cuugguggucuuggccggu

SEQ ID NO: 1115569 - RNA, 17 nt, Mycobacterium bovis subsp bovis AF2122/97
cuugguggugguacggg

SEQ ID NO: 1115570 - RNA, 14 nt, Mycobacterium bovis subsp bovis AF2122/97
cuugugggcgacgg

SEQ ID NO: 1115571 - RNA, 15 nt, Mycobacterium bovis subsp bovis AF2122/97
cuuguugccgcgcca

SEQ ID NO: 1115572 - RNA, 18 nt, Mycobacterium bovis subsp bovis AF2122/97
cuuguuugucaccgcagc

SEQ ID NO: 1115573 - RNA, 14 nt, Mycobacterium bovis subsp bovis AF2122/97
cuuguugaccacca

SEQ ID NO: 1115574 - RNA, 18 nt, Mycobacterium bovis subsp bovis AF2122/97
cuuguugccgccggccau

SEQ ID NO: 1115575 - RNA, 15 nt, Mycobacterium bovis subsp bovis AF2122/97
cuuguugucgugcaa

SEQ ID NO: 1115576 - RNA, 17 nt, Mycobacterium bovis subsp bovis AF2122/97
cuuguuccagcgcaucg

SEQ ID NO: 1115577 - RNA, 15 nt, Mycobacterium bovis subsp bovis AF2122/97
cuuguugaagccgau

SEQ ID NO: 1115578 - RNA, 16 nt, Mycobacterium bovis subsp bovis AF2122/97
gaaagcuaccgaucgc

SEQ ID NO: 1115579 - RNA, 23 nt, Mycobacterium bovis subsp bovis AF2122/97
gaaagcuaccgaucgccaaggcg

SEQ ID NO: 1115580 - RNA, 13 nt, Mycobacterium bovis subsp bovis AF2122/97
gaaaggcuuccgc

SEQ ID NO: 1115581 - RNA, 21 nt, Mycobacterium bovis subsp bovis AF2122/97
gaaaguguggaauggaccagc

SEQ ID NO: 1115582 - RNA, 16 nt, Mycobacterium bovis subsp bovis AF2122/97
gaaaguuguaucgcag

SEQ ID NO: 1115583 - RNA, 15 nt, Mycobacterium bovis subsp bovis AF2122/97
gaaaguuccacgaca

SEQ ID NO: 1115584 - RNA, 23 nt, Mycobacterium bovis subsp bovis AF2122/97
gaaauagauucccggcucgaugg

SEQ ID NO: 1115585 - RNA, 19 nt, Mycobacterium bovis subsp bovis AF2122/97
gaaaucaccucaccaguca

SEQ ID NO: 1115586 - RNA, 18 nt, Mycobacterium bovis subsp bovis AF2122/97
gaaacaccgacgacggcg

SEQ ID NO: 1115587 - RNA, 19 nt, Mycobacterium bovis subsp bovis AF2122/97
gaaacaacgucgccgcggc

SEQ ID NO: 1115588 - RNA, 13 nt, Mycobacterium bovis subsp bovis AF2122/97
gaaacaccgucug

SEQ ID NO: 1115589 - RNA, 14 nt, Mycobacterium bovis subsp bovis AF2122/97
gaaacaccgucugg

SEQ ID NO: 1115590 - RNA, 23 nt, Mycobacterium bovis subsp bovis AF2122/97
gaaacagcacccagacgauggcc

SEQ ID NO: 1115591 - RNA, 17 nt, Mycobacterium bovis subsp bovis AF2122/97
gaaacugaugucgccga

SEQ ID NO: 1115592 - RNA, 13 nt, Mycobacterium bovis subsp bovis AF2122/97
gaaacucgacgug

SEQ ID NO: 1115593 - RNA, 17 nt, Mycobacterium bovis subsp bovis AF2122/97
gaaagcggccgucggga

SEQ ID NO: 1115594 - RNA, 15 nt, Mycobacterium bovis subsp bovis AF2122/97
gaaagccgcggccga

SEQ ID NO: 1115595 - RNA, 14 nt, Mycobacterium bovis subsp bovis AF2122/97
gaaagccggcguuu

SEQ ID NO: 1115596 - RNA, 14 nt, Mycobacterium bovis subsp bovis AF2122/97
gaaaaugccgccca

SEQ ID NO: 1115597 - RNA, 17 nt, Mycobacterium bovis subsp bovis AF2122/97
gaaaauucgucgcgucg

SEQ ID NO: 1115598 - RNA, 20 nt, Mycobacterium bovis subsp bovis AF2122/97
gaaaacggaugugucggcga

SEQ ID NO: 1115599 - RNA, 22 nt, Mycobacterium bovis subsp bovis AF2122/97
gaaaaccuaugauucagccggc

SEQ ID NO: 1115600 - RNA, 24 nt, Mycobacterium bovis subsp bovis AF2122/97
gaaaacgaacccacugcccgccga

SEQ ID NO: 1115601 - RNA, 15 nt, Mycobacterium bovis subsp bovis AF2122/97
cuuuuccggcguucc

SEQ ID NO: 1115602 - RNA, 16 nt, Mycobacterium bovis subsp bovis AF2122/97
gaaccagcggucggcg

SEQ ID NO: 1115603 - RNA, 20 nt, Mycobacterium bovis subsp bovis AF2122/97
gaaccagcggucggcgacca

SEQ ID NO: 1115604 - RNA, 19 nt, Mycobacterium bovis subsp bovis AF2122/97
gaaccagcugagccgucgg

SEQ ID NO: 1115605 - RNA, 15 nt, Mycobacterium bovis subsp bovis AF2122/97
gaaccagcccgccga

SEQ ID NO: 1115606 - RNA, 17 nt, Mycobacterium bovis subsp bovis AF2122/97
gaaccagcccgccgauc

SEQ ID NO: 1115607 - RNA, 22 nt, Mycobacterium bovis subsp bovis AF2122/97
gaaccagguaaucaccuggcug

SEQ ID NO: 1115608 - RNA, 19 nt, Mycobacterium bovis subsp bovis AF2122/97
gaaccaggcggccgcgucg

SEQ ID NO: 1115609 - RNA, 19 nt, Mycobacterium bovis subsp bovis AF2122/97
gaaccaccuguccggugga

SEQ ID NO: 1115610 - RNA, 15 nt, Mycobacterium bovis subsp bovis AF2122/97
gaaccaccggcgccg

SEQ ID NO: 1115611 - RNA, 18 nt, Mycobacterium bovis subsp bovis AF2122/97
gaaccaccggcgccgccg

SEQ ID NO: 1115612 - RNA, 19 nt, Mycobacterium bovis subsp bovis AF2122/97
gaaccaccggcgccgccgg

SEQ ID NO: 1115613 - RNA, 20 nt, Mycobacterium bovis subsp bovis AF2122/97
gaaccaccggcgccgccggc

SEQ ID NO: 1115614 - RNA, 19 nt, Mycobacterium bovis subsp bovis AF2122/97
gaaccaccagcacggcgau

SEQ ID NO: 1115615 - RNA, 19 nt, Mycobacterium bovis subsp bovis AF2122/97
gaaccaccaguaccaccgg

SEQ ID NO: 1115616 - RNA, 21 nt, Mycobacterium bovis subsp bovis AF2122/97
gaaccaccaguaccaccggca

SEQ ID NO: 1115617 - RNA, 18 nt, Mycobacterium bovis subsp bovis AF2122/97
gaaccacccaccggccac

SEQ ID NO: 1115618 - RNA, 21 nt, Mycobacterium bovis subsp bovis AF2122/97
gaaccacccaccggccaccag

SEQ ID NO: 1115619 - RNA, 15 nt, Mycobacterium bovis subsp bovis AF2122/97
gaaccacgcgcccgc

SEQ ID NO: 1115620 - RNA, 23 nt, Mycobacterium bovis subsp bovis AF2122/97
gaaccacgcgcccgcaccaccgg

SEQ ID NO: 1115621 - RNA, 14 nt, Mycobacterium bovis subsp bovis AF2122/97
gaacccgcuuucgg

SEQ ID NO: 1115622 - RNA, 20 nt, Mycobacterium bovis subsp bovis AF2122/97
gaacccgcguugaaggcgcc

SEQ ID NO: 1115623 - RNA, 16 nt, Mycobacterium bovis subsp bovis AF2122/97
gaacccguguucugcg

SEQ ID NO: 1115624 - RNA, 16 nt, Mycobacterium bovis subsp bovis AF2122/97
gaacccucagccgcgc

SEQ ID NO: 1115625 - RNA, 17 nt, Mycobacterium bovis subsp bovis AF2122/97
gaacccggcggacgacg

SEQ ID NO: 1115626 - RNA, 20 nt, Mycobacterium bovis subsp bovis AF2122/97
gaaccccgaauagucggcau

SEQ ID NO: 1115627 - RNA, 22 nt, Mycobacterium bovis subsp bovis AF2122/97
gaaccccgaauagucggcaucg

SEQ ID NO: 1115628 - RNA, 23 nt, Mycobacterium bovis subsp bovis AF2122/97
gaaccccgaauagucggcaucgc

SEQ ID NO: 1115629 - RNA, 16 nt, Mycobacterium bovis subsp bovis AF2122/97
gaacccgagccgccgu

SEQ ID NO: 1115630 - RNA, 21 nt, Mycobacterium bovis subsp bovis AF2122/97
gaacccgauaacaaggccgcc

SEQ ID NO: 1115631 - RNA, 18 nt, Mycobacterium bovis subsp bovis AF2122/97
gaacccgaucgucgagcc

SEQ ID NO: 1115632 - RNA, 16 nt, Mycobacterium bovis subsp bovis AF2122/97
gaacccgauucugguc

SEQ ID NO: 1115633 - RNA, 16 nt, Mycobacterium bovis subsp bovis AF2122/97
gaacccaccgugccgg

SEQ ID NO: 1115634 - RNA, 17 nt, Mycobacterium bovis subsp bovis AF2122/97
gaacccaggccgucgcg

SEQ ID NO: 1115635 - RNA, 18 nt, Mycobacterium bovis subsp bovis AF2122/97
gaaccccauaaucacauc

SEQ ID NO: 1115636 - RNA, 15 nt, Mycobacterium bovis subsp bovis AF2122/97
gaacccccgccgcgc

SEQ ID NO: 1115637 - RNA, 13 nt, Mycobacterium bovis subsp bovis AF2122/97
gaacccccucgcg

SEQ ID NO: 1115638 - RNA, 18 nt, Mycobacterium bovis subsp bovis AF2122/97
gaaccgucucggcgaccg

SEQ ID NO: 1115639 - RNA, 19 nt, Mycobacterium bovis subsp bovis AF2122/97
gaaccgugcugggcaucac

SEQ ID NO: 1115640 - RNA, 15 nt, Mycobacterium bovis subsp bovis AF2122/97
gaaccguagcgccca

SEQ ID NO: 1115641 - RNA, 14 nt, Mycobacterium bovis subsp bovis AF2122/97
gaaccgguugacac

SEQ ID NO: 1115642 - RNA, 13 nt, Mycobacterium bovis subsp bovis AF2122/97
gaaccgucagcgc

SEQ ID NO: 1115643 - RNA, 22 nt, Mycobacterium bovis subsp bovis AF2122/97
gaaccguucggcgacagcgcgg

SEQ ID NO: 1115644 - RNA, 22 nt, Mycobacterium bovis subsp bovis AF2122/97
gaaccuccucggguucgucagu

SEQ ID NO: 1115645 - RNA, 17 nt, Mycobacterium bovis subsp bovis AF2122/97
gaaccucgaccgucacc

SEQ ID NO: 1115646 - RNA, 19 nt, Mycobacterium bovis subsp bovis AF2122/97
gaaccguccaagccggcug

SEQ ID NO: 1115647 - RNA, 18 nt, Mycobacterium bovis subsp bovis AF2122/97
gaaccguuucgccggcgc

SEQ ID NO: 1115648 - RNA, 19 nt, Mycobacterium bovis subsp bovis AF2122/97
gaaccguuugacgcgcucg

SEQ ID NO: 1115649 - RNA, 21 nt, Mycobacterium bovis subsp bovis AF2122/97
gaaccguuugacgcgcucgcg

SEQ ID NO: 1115650 - RNA, 13 nt, Mycobacterium bovis subsp bovis AF2122/97
gaaccgggcaaau

SEQ ID NO: 1115651 - RNA, 22 nt, Mycobacterium bovis subsp bovis AF2122/97
gaaccggcucaaggacgcaccg

SEQ ID NO: 1115652 - RNA, 23 nt, Mycobacterium bovis subsp bovis AF2122/97
gaaccggcucaaggacgcaccgc

SEQ ID NO: 1115653 - RNA, 14 nt, Mycobacterium bovis subsp bovis AF2122/97
gaaccggaccuggg

SEQ ID NO: 1115654 - RNA, 18 nt, Mycobacterium bovis subsp bovis AF2122/97
gaaccggcaccagcggca

SEQ ID NO: 1115655 - RNA, 15 nt, Mycobacterium bovis subsp bovis AF2122/97
gaaccggucgauccc

SEQ ID NO: 1115656 - RNA, 13 nt, Mycobacterium bovis subsp bovis AF2122/97
gaaccgccgacgg

SEQ ID NO: 1115657 - RNA, 18 nt, Mycobacterium bovis subsp bovis AF2122/97
gaaccgcacggugaccac

SEQ ID NO: 1115658 - RNA, 16 nt, Mycobacterium bovis subsp bovis AF2122/97
gaaccgacaccugucg

SEQ ID NO: 1115659 - RNA, 20 nt, Mycobacterium bovis subsp bovis AF2122/97
gaaccgacccggccgcugac

SEQ ID NO: 1115660 - RNA, 21 nt, Mycobacterium bovis subsp bovis AF2122/97
gaaccgacgcguccggugcac

SEQ ID NO: 1115661 - RNA, 16 nt, Mycobacterium bovis subsp bovis AF2122/97
gaaccgaagccgucga

SEQ ID NO: 1115662 - RNA, 19 nt, Mycobacterium bovis subsp bovis AF2122/97
gaaccgaagccucggcaug

SEQ ID NO: 1115663 - RNA, 23 nt, Mycobacterium bovis subsp bovis AF2122/97
gaaccgcugcggguagccgucga

SEQ ID NO: 1115664 - RNA, 17 nt, Mycobacterium bovis subsp bovis AF2122/97
gaaccgcugggacaacg

SEQ ID NO: 1115665 - RNA, 13 nt, Mycobacterium bovis subsp bovis AF2122/97
gaaccgccgccgc

SEQ ID NO: 1115666 - RNA, 18 nt, Mycobacterium bovis subsp bovis AF2122/97
gaaccgccgcugccgcgc

SEQ ID NO: 1115667 - RNA, 22 nt, Mycobacterium bovis subsp bovis AF2122/97
gaaccgccgcugccgcgcggcg

SEQ ID NO: 1115668 - RNA, 23 nt, Mycobacterium bovis subsp bovis AF2122/97
gaaccgccgcugccgcgcggcga

SEQ ID NO: 1115669 - RNA, 16 nt, Mycobacterium bovis subsp bovis AF2122/97
gaaccgcucgucacgu

SEQ ID NO: 1115670 - RNA, 18 nt, Mycobacterium bovis subsp bovis AF2122/97
gaacgccgccagcgcggu

SEQ ID NO: 1115671 - RNA, 16 nt, Mycobacterium bovis subsp bovis AF2122/97
gaacgccggugcgcug

SEQ ID NO: 1115672 - RNA, 14 nt, Mycobacterium bovis subsp bovis AF2122/97
gaacgccgucgagc

SEQ ID NO: 1115673 - RNA, 17 nt, Mycobacterium bovis subsp bovis AF2122/97
gaacgccugcgggaagu

SEQ ID NO: 1115674 - RNA, 14 nt, Mycobacterium bovis subsp bovis AF2122/97
gaacgccggcaucg

SEQ ID NO: 1115675 - RNA, 22 nt, Mycobacterium bovis subsp bovis AF2122/97
gaacgccggcaucgcgcgcggc

SEQ ID NO: 1115676 - RNA, 12 nt, Mycobacterium bovis subsp bovis AF2122/97
gaacgccggggc

SEQ ID NO: 1115677 - RNA, 20 nt, Mycobacterium bovis subsp bovis AF2122/97
gaacgcgaggugauugguca

SEQ ID NO: 1115678 - RNA, 18 nt, Mycobacterium bovis subsp bovis AF2122/97
gaacgcgcgcagccgggc

SEQ ID NO: 1115679 - RNA, 23 nt, Mycobacterium bovis subsp bovis AF2122/97
gaacgccucgccggccaccagcc

SEQ ID NO: 1115680 - RNA, 13 nt, Mycobacterium bovis subsp bovis AF2122/97
gaacgcgagcgcu

SEQ ID NO: 1115681 - RNA, 21 nt, Mycobacterium bovis subsp bovis AF2122/97
gaacgcgaauaccagaccggc

SEQ ID NO: 1115682 - RNA, 23 nt, Mycobacterium bovis subsp bovis AF2122/97
gaacgcgacagccaccucgacgg

SEQ ID NO: 1115683 - RNA, 14 nt, Mycobacterium bovis subsp bovis AF2122/97
gaacgcgagcgcua

SEQ ID NO: 1115684 - RNA, 14 nt, Mycobacterium bovis subsp bovis AF2122/97
gaaccugagcacca

SEQ ID NO: 1115685 - RNA, 14 nt, Mycobacterium bovis subsp bovis AF2122/97
gaaccucggcggga

SEQ ID NO: 1115686 - RNA, 17 nt, Mycobacterium bovis subsp bovis AF2122/97
gaaccuggcgacgcgac

SEQ ID NO: 1115687 - RNA, 20 nt, Mycobacterium bovis subsp bovis AF2122/97
gaaccugcugggagggacca

SEQ ID NO: 1115688 - RNA, 14 nt, Mycobacterium bovis subsp bovis AF2122/97
gaacgaaccgccgc

SEQ ID NO: 1115689 - RNA, 16 nt, Mycobacterium bovis subsp bovis AF2122/97
gaaccuugaccgacca

SEQ ID NO: 1115690 - RNA, 18 nt, Mycobacterium bovis subsp bovis AF2122/97
gaaccuggcgacgcgaca

SEQ ID NO: 1115691 - RNA, 23 nt, Mycobacterium bovis subsp bovis AF2122/97
gaaccugucgaucacggccgucg

SEQ ID NO: 1115692 - RNA, 11 nt, Mycobacterium bovis subsp bovis AF2122/97
gaacgaccucu

SEQ ID NO: 1115693 - RNA, 20 nt, Mycobacterium bovis subsp bovis AF2122/97
gaacgcccgcuucagcacgg

SEQ ID NO: 1115694 - RNA, 15 nt, Mycobacterium bovis subsp bovis AF2122/97
gaacgacauccggcc

SEQ ID NO: 1115695 - RNA, 17 nt, Mycobacterium bovis subsp bovis AF2122/97
gaacgaagucgacgaac

SEQ ID NO: 1115696 - RNA, 15 nt, Mycobacterium bovis subsp bovis AF2122/97
gaacgaagucgacga

SEQ ID NO: 1115697 - RNA, 18 nt, Mycobacterium bovis subsp bovis AF2122/97
gaacgcggccucgucgag

SEQ ID NO: 1115698 - RNA, 13 nt, Mycobacterium bovis subsp bovis AF2122/97
gaacgcgcgcgug

SEQ ID NO: 1115699 - RNA, 19 nt, Mycobacterium bovis subsp bovis AF2122/97
gaacgcggccaccgaccgc

SEQ ID NO: 1115700 - RNA, 20 nt, Mycobacterium bovis subsp bovis AF2122/97
gaacgcggccaccacaacgc

SEQ ID NO: 1115701 - RNA, 16 nt, Mycobacterium bovis subsp bovis AF2122/97
gaacgcgcgugcagcc

SEQ ID NO: 1115702 - RNA, 16 nt, Mycobacterium bovis subsp bovis AF2122/97
gaacggcaaggucgcg

SEQ ID NO: 1115703 - RNA, 15 nt, Mycobacterium bovis subsp bovis AF2122/97
gaacggcaccagcgg

SEQ ID NO: 1115704 - RNA, 14 nt, Mycobacterium bovis subsp bovis AF2122/97
gaacggaugccggu

SEQ ID NO: 1115705 - RNA, 17 nt, Mycobacterium bovis subsp bovis AF2122/97
gaacggaugccggucgg

SEQ ID NO: 1115706 - RNA, 14 nt, Mycobacterium bovis subsp bovis AF2122/97
gaacggcagcacgg

SEQ ID NO: 1115707 - RNA, 14 nt, Mycobacterium bovis subsp bovis AF2122/97
gaacggcagcccgg

SEQ ID NO: 1115708 - RNA, 17 nt, Mycobacterium bovis subsp bovis AF2122/97
gaacggcagcccgggcg

SEQ ID NO: 1115709 - RNA, 22 nt, Mycobacterium bovis subsp bovis AF2122/97
gaacggccaggacaacgcaccg

SEQ ID NO: 1115710 - RNA, 16 nt, Mycobacterium bovis subsp bovis AF2122/97
gaacggcgcaguuggc

SEQ ID NO: 1115711 - RNA, 17 nt, Mycobacterium bovis subsp bovis AF2122/97
gaacggcgcaguuggca

SEQ ID NO: 1115712 - RNA, 18 nt, Mycobacterium bovis subsp bovis AF2122/97
gaacggcgcaguuggcac

SEQ ID NO: 1115713 - RNA, 12 nt, Mycobacterium bovis subsp bovis AF2122/97
gaacuccgcgga

SEQ ID NO: 1115714 - RNA, 17 nt, Mycobacterium bovis subsp bovis AF2122/97
gaacuccgcggaaccca

SEQ ID NO: 1115715 - RNA, 19 nt, Mycobacterium bovis subsp bovis AF2122/97
gaacuccgccgcgaucucc

SEQ ID NO: 1115716 - RNA, 15 nt, Mycobacterium bovis subsp bovis AF2122/97
gaacuccgcgauccg

SEQ ID NO: 1115717 - RNA, 20 nt, Mycobacterium bovis subsp bovis AF2122/97
gaacuccgcgauccgcugcg

SEQ ID NO: 1115718 - RNA, 22 nt, Mycobacterium bovis subsp bovis AF2122/97
gaacuccgcgauccgcugcgcc

SEQ ID NO: 1115719 - RNA, 23 nt, Mycobacterium bovis subsp bovis AF2122/97
gaacuccgccaccaucgccucgg

SEQ ID NO: 1115720 - RNA, 19 nt, Mycobacterium bovis subsp bovis AF2122/97
gaacucgaccaccgccggc

SEQ ID NO: 1115721 - RNA, 22 nt, Mycobacterium bovis subsp bovis AF2122/97
gaacucgaccaccgccggcccg

SEQ ID NO: 1115722 - RNA, 23 nt, Mycobacterium bovis subsp bovis AF2122/97
gaacucgaccaccgccggcccgc

SEQ ID NO: 1115723 - RNA, 22 nt, Mycobacterium bovis subsp bovis AF2122/97
gaacuccucgcugucgaucagc

SEQ ID NO: 1115724 - RNA, 14 nt, Mycobacterium bovis subsp bovis AF2122/97
gaacuccguccgcc

SEQ ID NO: 1115725 - RNA, 18 nt, Mycobacterium bovis subsp bovis AF2122/97
gaacuccgcggaacccag

SEQ ID NO: 1115726 - RNA, 14 nt, Mycobacterium bovis subsp bovis AF2122/97
gaacuccaugccgc

SEQ ID NO: 1115727 - RNA, 17 nt, Mycobacterium bovis subsp bovis AF2122/97
gaacuccaugccgcuga

SEQ ID NO: 1115728 - RNA, 18 nt, Mycobacterium bovis subsp bovis AF2122/97
gaacuccccggucgccgc

SEQ ID NO: 1115729 - RNA, 15 nt, Mycobacterium bovis subsp bovis AF2122/97
gaacucaccgacgga

SEQ ID NO: 1115730 - RNA, 20 nt, Mycobacterium bovis subsp bovis AF2122/97
gaacucaucgugguaaccau

SEQ ID NO: 1115731 - RNA, 16 nt, Mycobacterium bovis subsp bovis AF2122/97
gaacucaacaccagca

SEQ ID NO: 1115732 - RNA, 17 nt, Mycobacterium bovis subsp bovis AF2122/97
gaacuacugcgaucgcg

SEQ ID NO: 1115733 - RNA, 19 nt, Mycobacterium bovis subsp bovis AF2122/97
gaacuacugcgaucgcgag

SEQ ID NO: 1115734 - RNA, 22 nt, Mycobacterium bovis subsp bovis AF2122/97
gaacaucgccagcgccggccag

SEQ ID NO: 1115735 - RNA, 14 nt, Mycobacterium bovis subsp bovis AF2122/97
gaacaucgccagcg

SEQ ID NO: 1115736 - RNA, 20 nt, Mycobacterium bovis subsp bovis AF2122/97
gaacaucaccucgaugccgc

SEQ ID NO: 1115737 - RNA, 15 nt, Mycobacterium bovis subsp bovis AF2122/97
gaacaucagaucgcc

SEQ ID NO: 1115738 - RNA, 17 nt, Mycobacterium bovis subsp bovis AF2122/97
gaacaugugaccggcga

SEQ ID NO: 1115739 - RNA, 20 nt, Mycobacterium bovis subsp bovis AF2122/97
gaaccaccacuucggcgccg

SEQ ID NO: 1115740 - RNA, 18 nt, Mycobacterium bovis subsp bovis AF2122/97
gaaccaccagcacggcga

SEQ ID NO: 1115741 - RNA, 23 nt, Mycobacterium bovis subsp bovis AF2122/97
gaaccaaccucggaucgccaggc

SEQ ID NO: 1115742 - RNA, 17 nt, Mycobacterium bovis subsp bovis AF2122/97
gaacagguuggccccgg

SEQ ID NO: 1115743 - RNA, 17 nt, Mycobacterium bovis subsp bovis AF2122/97
gaacagggugguggcgg

SEQ ID NO: 1115744 - RNA, 18 nt, Mycobacterium bovis subsp bovis AF2122/97
gaacagggaggucgccgc

SEQ ID NO: 1115745 - RNA, 17 nt, Mycobacterium bovis subsp bovis AF2122/97
gaacaguugcacaccgg

SEQ ID NO: 1115746 - RNA, 19 nt, Mycobacterium bovis subsp bovis AF2122/97
gaacaguugcacaccggca

SEQ ID NO: 1115747 - RNA, 20 nt, Mycobacterium bovis subsp bovis AF2122/97
gaacaguugcccgacgccgg

SEQ ID NO: 1115748 - RNA, 15 nt, Mycobacterium bovis subsp bovis AF2122/97
gaacaguaucgccgg

SEQ ID NO: 1115749 - RNA, 21 nt, Mycobacterium bovis subsp bovis AF2122/97
gaacaguggggguccggcggc

SEQ ID NO: 1115750 - RNA, 20 nt, Mycobacterium bovis subsp bovis AF2122/97
gaacacguuauucaugccca

SEQ ID NO: 1115751 - RNA, 14 nt, Mycobacterium bovis subsp bovis AF2122/97
gaacacguucggcg

SEQ ID NO: 1115752 - RNA, 17 nt, Mycobacterium bovis subsp bovis AF2122/97
gaacacguucggcgucg

SEQ ID NO: 1115753 - RNA, 13 nt, Mycobacterium bovis subsp bovis AF2122/97
gaacaccgcggca

SEQ ID NO: 1115754 - RNA, 19 nt, Mycobacterium bovis subsp bovis AF2122/97
gaacagcaccgaacccgcc

SEQ ID NO: 1115755 - RNA, 15 nt, Mycobacterium bovis subsp bovis AF2122/97
gaacacgucgggaug

SEQ ID NO: 1115756 - RNA, 16 nt, Mycobacterium bovis subsp bovis AF2122/97
gaacagcaccgccggc

SEQ ID NO: 1115757 - RNA, 19 nt, Mycobacterium bovis subsp bovis AF2122/97
gaacagcaccgccggcgac

SEQ ID NO: 1115758 - RNA, 15 nt, Mycobacterium bovis subsp bovis AF2122/97
gaacagcaugauccg

SEQ ID NO: 1115759 - RNA, 18 nt, Mycobacterium bovis subsp bovis AF2122/97
gaacagcgaaccgccggc

SEQ ID NO: 1115760 - RNA, 20 nt, Mycobacterium bovis subsp bovis AF2122/97
gaacagcuucgcgcagccgg

SEQ ID NO: 1115761 - RNA, 19 nt, Mycobacterium bovis subsp bovis AF2122/97
gaacagcucgaucagccgg

SEQ ID NO: 1115762 - RNA, 22 nt, Mycobacterium bovis subsp bovis AF2122/97
gaacagcugcccgccagcgccg

SEQ ID NO: 1115763 - RNA, 20 nt, Mycobacterium bovis subsp bovis AF2122/97
gaacagcgggggcagcgcga

SEQ ID NO: 1115764 - RNA, 22 nt, Mycobacterium bovis subsp bovis AF2122/97
gaacacgaugcgcggugcgcgu

SEQ ID NO: 1115765 - RNA, 23 nt, Mycobacterium bovis subsp bovis AF2122/97
gaacacggccggauacggcgaca

SEQ ID NO: 1115766 - RNA, 23 nt, Mycobacterium bovis subsp bovis AF2122/97
gaacacggcgucuuccucggcca

SEQ ID NO: 1115767 - RNA, 13 nt, Mycobacterium bovis subsp bovis AF2122/97
gaacacgagcuca

SEQ ID NO: 1115768 - RNA, 23 nt, Mycobacterium bovis subsp bovis AF2122/97
gaacaccggugaaacgaucgugc

SEQ ID NO: 1115769 - RNA, 23 nt, Mycobacterium bovis subsp bovis AF2122/97
gaacaccggccaggccggcggcg

SEQ ID NO: 1115770 - RNA, 19 nt, Mycobacterium bovis subsp bovis AF2122/97
gaacaccggcgccucaucg

SEQ ID NO: 1115771 - RNA, 14 nt, Mycobacterium bovis subsp bovis AF2122/97
gaacaccucggcac

SEQ ID NO: 1115772 - RNA, 19 nt, Mycobacterium bovis subsp bovis AF2122/97
gaacacccgaagccggcgc

SEQ ID NO: 1115773 - RNA, 17 nt, Mycobacterium bovis subsp bovis AF2122/97
gaacaccgaggcgaccg

SEQ ID NO: 1115774 - RNA, 18 nt, Mycobacterium bovis subsp bovis AF2122/97
gaacaccgaggcgaccgg

SEQ ID NO: 1115775 - RNA, 15 nt, Mycobacterium bovis subsp bovis AF2122/97
gaacaccaugaucag

SEQ ID NO: 1115776 - RNA, 15 nt, Mycobacterium bovis subsp bovis AF2122/97
gaacaccagcgcgcc

SEQ ID NO: 1115777 - RNA, 16 nt, Mycobacterium bovis subsp bovis AF2122/97
gaacaccagcgcgccg

SEQ ID NO: 1115778 - RNA, 12 nt, Mycobacterium bovis subsp bovis AF2122/97
gaacacaccgca

SEQ ID NO: 1115779 - RNA, 22 nt, Mycobacterium bovis subsp bovis AF2122/97
gaacacaccgggcgggcuggug

SEQ ID NO: 1115780 - RNA, 21 nt, Mycobacterium bovis subsp bovis AF2122/97
gaacaagguauggccggagcg

SEQ ID NO: 1115781 - RNA, 14 nt, Mycobacterium bovis subsp bovis AF2122/97
gaacaagaaaagca

SEQ ID NO: 1115782 - RNA, 14 nt, Mycobacterium bovis subsp bovis AF2122/97
gaacaccacgcagu

SEQ ID NO: 1115783 - RNA, 18 nt, Mycobacterium bovis subsp bovis AF2122/97
gaacaccaaaucgauguc

SEQ ID NO: 1115784 - RNA, 19 nt, Mycobacterium bovis subsp bovis AF2122/97
gaacaacggcguaaucggg

SEQ ID NO: 1115785 - RNA, 12 nt, Mycobacterium bovis subsp bovis AF2122/97
gaacaaccagca

SEQ ID NO: 1115786 - RNA, 15 nt, Mycobacterium bovis subsp bovis AF2122/97
gaacaaccugccggu

SEQ ID NO: 1115787 - RNA, 22 nt, Mycobacterium bovis subsp bovis AF2122/97
gaacaacgcggacuucguuccg

SEQ ID NO: 1115788 - RNA, 16 nt, Mycobacterium bovis subsp bovis AF2122/97
gaacaaaugccggugc

SEQ ID NO: 1115789 - RNA, 17 nt, Mycobacterium bovis subsp bovis AF2122/97
gaaaucgacagcagcgc

SEQ ID NO: 1115790 - RNA, 19 nt, Mycobacterium bovis subsp bovis AF2122/97
gaaaucgcccugacccgga

SEQ ID NO: 1115791 - RNA, 18 nt, Mycobacterium bovis subsp bovis AF2122/97
gaaaucgcccugacccgg

SEQ ID NO: 1115792 - RNA, 16 nt, Mycobacterium bovis subsp bovis AF2122/97
gaaauccccugcgcug

SEQ ID NO: 1115793 - RNA, 16 nt, Mycobacterium bovis subsp bovis AF2122/97
gaaauccgagccgcga

SEQ ID NO: 1115794 - RNA, 14 nt, Mycobacterium bovis subsp bovis AF2122/97
gaaaugacggcuga

SEQ ID NO: 1115795 - RNA, 19 nt, Mycobacterium bovis subsp bovis AF2122/97
gaaaucgggaucugcgccg

SEQ ID NO: 1115796 - RNA, 22 nt, Mycobacterium bovis subsp bovis AF2122/97
gaaaucgggaucugcgccgcgc

SEQ ID NO: 1115797 - RNA, 14 nt, Mycobacterium bovis subsp bovis AF2122/97
gaaaugccugcgcg

SEQ ID NO: 1115798 - RNA, 21 nt, Mycobacterium bovis subsp bovis AF2122/97
gaaauguuggccguaccggug

SEQ ID NO: 1115799 - RNA, 19 nt, Mycobacterium bovis subsp bovis AF2122/97
gaaauugagccggcccugc

SEQ ID NO: 1115800 - RNA, 23 nt, Mycobacterium bovis subsp bovis AF2122/97
gaaauugagccggcccugcucgc

SEQ ID NO: 1115801 - RNA, 15 nt, Mycobacterium bovis subsp bovis AF2122/97
gacaguccgcgccgg

SEQ ID NO: 1115802 - RNA, 16 nt, Mycobacterium bovis subsp bovis AF2122/97
gacaguccgcgccggc

SEQ ID NO: 1115803 - RNA, 21 nt, Mycobacterium bovis subsp bovis AF2122/97
gacauccagggccgagcagcu

SEQ ID NO: 1115804 - RNA, 19 nt, Mycobacterium bovis subsp bovis AF2122/97
gacauccagaucggauugc

SEQ ID NO: 1115805 - RNA, 17 nt, Mycobacterium bovis subsp bovis AF2122/97
gacaucagugcgccggc

SEQ ID NO: 1115806 - RNA, 22 nt, Mycobacterium bovis subsp bovis AF2122/97
gaccacaaccgugagcaccagc

SEQ ID NO: 1115807 - RNA, 23 nt, Mycobacterium bovis subsp bovis AF2122/97
gaccacaaccgugagcaccagca

SEQ ID NO: 1115808 - RNA, 15 nt, Mycobacterium bovis subsp bovis AF2122/97
gaccacaacgccucg

SEQ ID NO: 1115809 - RNA, 16 nt, Mycobacterium bovis subsp bovis AF2122/97
gaccaauucgcaaucg

SEQ ID NO: 1115810 - RNA, 13 nt, Mycobacterium bovis subsp bovis AF2122/97
gacaucggagauc

SEQ ID NO: 1115811 - RNA, 23 nt, Mycobacterium bovis subsp bovis AF2122/97
gacaucgcgaggcgucaccccgg

SEQ ID NO: 1115812 - RNA, 19 nt, Mycobacterium bovis subsp bovis AF2122/97
gacauccgcuuacgggugu

SEQ ID NO: 1115813 - RNA, 14 nt, Mycobacterium bovis subsp bovis AF2122/97
gacauccggcgccg

SEQ ID NO: 1115814 - RNA, 14 nt, Mycobacterium bovis subsp bovis AF2122/97
gaccacagaaccgg

SEQ ID NO: 1115815 - RNA, 14 nt, Mycobacterium bovis subsp bovis AF2122/97
gaccacagccgcgc

SEQ ID NO: 1115816 - RNA, 17 nt, Mycobacterium bovis subsp bovis AF2122/97
gaccacagccgcgccga

SEQ ID NO: 1115817 - RNA, 15 nt, Mycobacterium bovis subsp bovis AF2122/97
gaccacaccgucacc

SEQ ID NO: 1115818 - RNA, 17 nt, Mycobacterium bovis subsp bovis AF2122/97
gaccacaacgccucgcc

SEQ ID NO: 1115819 - RNA, 17 nt, Mycobacterium bovis subsp bovis AF2122/97
gaccacaccacgauggc

SEQ ID NO: 1115820 - RNA, 21 nt, Mycobacterium bovis subsp bovis AF2122/97
gaccacagcggagacgaucgc

SEQ ID NO: 1115821 - RNA, 14 nt, Mycobacterium bovis subsp bovis AF2122/97
gaccaccacgauga

SEQ ID NO: 1115822 - RNA, 19 nt, Mycobacterium bovis subsp bovis AF2122/97
gaccaccagagcgucgaac

SEQ ID NO: 1115823 - RNA, 22 nt, Mycobacterium bovis subsp bovis AF2122/97
gaccaccggaauuugcgucgug

SEQ ID NO: 1115824 - RNA, 13 nt, Mycobacterium bovis subsp bovis AF2122/97
gaccaccagcgcu

SEQ ID NO: 1115825 - RNA, 14 nt, Mycobacterium bovis subsp bovis AF2122/97
gaccaccgcucgcc

SEQ ID NO: 1115826 - RNA, 20 nt, Mycobacterium bovis subsp bovis AF2122/97
gaccaccacuaggucgccgg

SEQ ID NO: 1115827 - RNA, 16 nt, Mycobacterium bovis subsp bovis AF2122/97
gaccaccugcugcacg

SEQ ID NO: 1115828 - RNA, 16 nt, Mycobacterium bovis subsp bovis AF2122/97
gaccacgaacgcgcgc

SEQ ID NO: 1115829 - RNA, 15 nt, Mycobacterium bovis subsp bovis AF2122/97
gaccacgccguggcc

SEQ ID NO: 1115830 - RNA, 14 nt, Mycobacterium bovis subsp bovis AF2122/97
gaccacgccgccgg

SEQ ID NO: 1115831 - RNA, 20 nt, Mycobacterium bovis subsp bovis AF2122/97
gaccacgccgccggcgcuga

SEQ ID NO: 1115832 - RNA, 12 nt, Mycobacterium bovis subsp bovis AF2122/97
gaccacgcaccg

SEQ ID NO: 1115833 - RNA, 22 nt, Mycobacterium bovis subsp bovis AF2122/97
gaccacgguagacaagucggcg

SEQ ID NO: 1115834 - RNA, 23 nt, Mycobacterium bovis subsp bovis AF2122/97
gaccacgguagacaagucggcgc

SEQ ID NO: 1115835 - RNA, 13 nt, Mycobacterium bovis subsp bovis AF2122/97
gaccacggcguug

SEQ ID NO: 1115836 - RNA, 22 nt, Mycobacterium bovis subsp bovis AF2122/97
gaccaccuucugacgcggccgg

SEQ ID NO: 1115837 - RNA, 20 nt, Mycobacterium bovis subsp bovis AF2122/97
gaccacgucgagguccacca

SEQ ID NO: 1115838 - RNA, 23 nt, Mycobacterium bovis subsp bovis AF2122/97
gaccacgucgagguccaccaccc

SEQ ID NO: 1115839 - RNA, 14 nt, Mycobacterium bovis subsp bovis AF2122/97
gaccacucgagcgc

SEQ ID NO: 1115840 - RNA, 21 nt, Mycobacterium bovis subsp bovis AF2122/97
gaccacucgccggcggacgcc

SEQ ID NO: 1115841 - RNA, 17 nt, Mycobacterium bovis subsp bovis AF2122/97
gaccacuccacgcagcc

SEQ ID NO: 1115842 - RNA, 13 nt, Mycobacterium bovis subsp bovis AF2122/97
gaccacgucggcg

SEQ ID NO: 1115843 - RNA, 19 nt, Mycobacterium bovis subsp bovis AF2122/97
gaccacuccacgcagcccg

SEQ ID NO: 1115844 - RNA, 16 nt, Mycobacterium bovis subsp bovis AF2122/97
gaccacugaucggcau

SEQ ID NO: 1115845 - RNA, 17 nt, Mycobacterium bovis subsp bovis AF2122/97
gaccacuucgauggcgc

SEQ ID NO: 1115846 - RNA, 20 nt, Mycobacterium bovis subsp bovis AF2122/97
gaccacuugcagcacaacgu

SEQ ID NO: 1115847 - RNA, 14 nt, Mycobacterium bovis subsp bovis AF2122/97
gaccacugcccggg

SEQ ID NO: 1115848 - RNA, 21 nt, Mycobacterium bovis subsp bovis AF2122/97
gaccagaaccuggagccgugc

SEQ ID NO: 1115849 - RNA, 14 nt, Mycobacterium bovis subsp bovis AF2122/97
gaccagcacaccgg

SEQ ID NO: 1115850 - RNA, 15 nt, Mycobacterium bovis subsp bovis AF2122/97
gaccagagccgcgag

SEQ ID NO: 1115851 - RNA, 13 nt, Mycobacterium bovis subsp bovis AF2122/97
gaccagagcucga

SEQ ID NO: 1115852 - RNA, 20 nt, Mycobacterium bovis subsp bovis AF2122/97
gaccagaggcgugucgacuc

SEQ ID NO: 1115853 - RNA, 19 nt, Mycobacterium bovis subsp bovis AF2122/97
gaccagagccaacgaugau

SEQ ID NO: 1115854 - RNA, 19 nt, Mycobacterium bovis subsp bovis AF2122/97
gaccagaacgacgccgcgg

SEQ ID NO: 1115855 - RNA, 16 nt, Mycobacterium bovis subsp bovis AF2122/97
gaccagaacucgugau

SEQ ID NO: 1115856 - RNA, 13 nt, Mycobacterium bovis subsp bovis AF2122/97
gacaggccgagca

SEQ ID NO: 1115857 - RNA, 21 nt, Mycobacterium bovis subsp bovis AF2122/97
gacaggcuuggcaugcggauc

SEQ ID NO: 1115858 - RNA, 15 nt, Mycobacterium bovis subsp bovis AF2122/97
gacaggcgcccacaa

SEQ ID NO: 1115859 - RNA, 12 nt, Mycobacterium bovis subsp bovis AF2122/97
gacaggcggcgg

SEQ ID NO: 1115860 - RNA, 13 nt, Mycobacterium bovis subsp bovis AF2122/97
gacaggcggcggc

SEQ ID NO: 1115861 - RNA, 14 nt, Mycobacterium bovis subsp bovis AF2122/97
gacaggcggcggcc

SEQ ID NO: 1115862 - RNA, 15 nt, Mycobacterium bovis subsp bovis AF2122/97
gacaggcggcggccu

SEQ ID NO: 1115863 - RNA, 22 nt, Mycobacterium bovis subsp bovis AF2122/97
gacaggucgcccaacaccgcgc

SEQ ID NO: 1115864 - RNA, 18 nt, Mycobacterium bovis subsp bovis AF2122/97
gacaggucgggcccccgg

SEQ ID NO: 1115865 - RNA, 21 nt, Mycobacterium bovis subsp bovis AF2122/97
gacagcgcggcggucgagcga

SEQ ID NO: 1115866 - RNA, 17 nt, Mycobacterium bovis subsp bovis AF2122/97
gacagggugggggcauc

SEQ ID NO: 1115867 - RNA, 12 nt, Mycobacterium bovis subsp bovis AF2122/97
gacaggucggca

SEQ ID NO: 1115868 - RNA, 16 nt, Mycobacterium bovis subsp bovis AF2122/97
gacagggccgcucgcc

SEQ ID NO: 1115869 - RNA, 21 nt, Mycobacterium bovis subsp bovis AF2122/97
gacagggugcgcuugcggccg

SEQ ID NO: 1115870 - RNA, 21 nt, Mycobacterium bovis subsp bovis AF2122/97
gacagggcggcaacggcggca

SEQ ID NO: 1115871 - RNA, 13 nt, Mycobacterium bovis subsp bovis AF2122/97
gacagggcggcga

SEQ ID NO: 1115872 - RNA, 14 nt, Mycobacterium bovis subsp bovis AF2122/97
gacagggcggcgag

SEQ ID NO: 1115873 - RNA, 17 nt, Mycobacterium bovis subsp bovis AF2122/97
gacagcggcaccggggu

SEQ ID NO: 1115874 - RNA, 16 nt, Mycobacterium bovis subsp bovis AF2122/97
gacagcgccaugcccu

SEQ ID NO: 1115875 - RNA, 13 nt, Mycobacterium bovis subsp bovis AF2122/97
gacagccugcgcc

SEQ ID NO: 1115876 - RNA, 21 nt, Mycobacterium bovis subsp bovis AF2122/97
gacagcgacggucccggcacg

SEQ ID NO: 1115877 - RNA, 21 nt, Mycobacterium bovis subsp bovis AF2122/97
gacagcauguuccccgucgcc

SEQ ID NO: 1115878 - RNA, 17 nt, Mycobacterium bovis subsp bovis AF2122/97
gacagcgaaggcgccga

SEQ ID NO: 1115879 - RNA, 19 nt, Mycobacterium bovis subsp bovis AF2122/97
gacagcgaaggcgccgaac

SEQ ID NO: 1115880 - RNA, 20 nt, Mycobacterium bovis subsp bovis AF2122/97
gacagcgaaggcgccgaaca

SEQ ID NO: 1115881 - RNA, 13 nt, Mycobacterium bovis subsp bovis AF2122/97
gacaccgcccgac

SEQ ID NO: 1115882 - RNA, 23 nt, Mycobacterium bovis subsp bovis AF2122/97
gacaccgcccgacccaucaccag

SEQ ID NO: 1115883 - RNA, 17 nt, Mycobacterium bovis subsp bovis AF2122/97
gacaccgcagcgggcgg

SEQ ID NO: 1115884 - RNA, 19 nt, Mycobacterium bovis subsp bovis AF2122/97
gacaccgauccggccgccg

SEQ ID NO: 1115885 - RNA, 22 nt, Mycobacterium bovis subsp bovis AF2122/97
gacaccgaggaccucgucaccg

SEQ ID NO: 1115886 - RNA, 14 nt, Mycobacterium bovis subsp bovis AF2122/97
gacaccgaccgggu

SEQ ID NO: 1115887 - RNA, 17 nt, Mycobacterium bovis subsp bovis AF2122/97
gacaccgaccgggucgc

SEQ ID NO: 1115888 - RNA, 22 nt, Mycobacterium bovis subsp bovis AF2122/97
gacaccgaccgggucgcaaccg

SEQ ID NO: 1115889 - RNA, 18 nt, Mycobacterium bovis subsp bovis AF2122/97
gacaccgcggcgaucugc

SEQ ID NO: 1115890 - RNA, 20 nt, Mycobacterium bovis subsp bovis AF2122/97
gacaccgcgaucaccaccgg

SEQ ID NO: 1115891 - RNA, 12 nt, Mycobacterium bovis subsp bovis AF2122/97
gacagcacccgg

SEQ ID NO: 1115892 - RNA, 18 nt, Mycobacterium bovis subsp bovis AF2122/97
gacagcacccggccaccg

SEQ ID NO: 1115893 - RNA, 15 nt, Mycobacterium bovis subsp bovis AF2122/97
gacagcaccgccggu

SEQ ID NO: 1115894 - RNA, 20 nt, Mycobacterium bovis subsp bovis AF2122/97
gacaccgcggacccgcagcu

SEQ ID NO: 1115895 - RNA, 15 nt, Mycobacterium bovis subsp bovis AF2122/97
gacagcagccgccgg

SEQ ID NO: 1115896 - RNA, 16 nt, Mycobacterium bovis subsp bovis AF2122/97
gacagcagccgccggc

SEQ ID NO: 1115897 - RNA, 16 nt, Mycobacterium bovis subsp bovis AF2122/97
gacagcagcgccaccc

SEQ ID NO: 1115898 - RNA, 15 nt, Mycobacterium bovis subsp bovis AF2122/97
gacagcagcgcgaca

SEQ ID NO: 1115899 - RNA, 13 nt, Mycobacterium bovis subsp bovis AF2122/97
gacagcagccggc

SEQ ID NO: 1115900 - RNA, 13 nt, Mycobacterium bovis subsp bovis AF2122/97
gacagcagcgcca

SEQ ID NO: 1115901 - RNA, 14 nt, Mycobacterium bovis subsp bovis AF2122/97
gacacccgcucggc

SEQ ID NO: 1115902 - RNA, 20 nt, Mycobacterium bovis subsp bovis AF2122/97
gacaccgaaccgccgcugcc

SEQ ID NO: 1115903 - RNA, 23 nt, Mycobacterium bovis subsp bovis AF2122/97
gacaccgaaccgccgcugccgcg

SEQ ID NO: 1115904 - RNA, 21 nt, Mycobacterium bovis subsp bovis AF2122/97
gacacccguaagcggaugucc

SEQ ID NO: 1115905 - RNA, 22 nt, Mycobacterium bovis subsp bovis AF2122/97
gacaccaggaugccuaccgugc

SEQ ID NO: 1115906 - RNA, 16 nt, Mycobacterium bovis subsp bovis AF2122/97
gacacccagccgcagc

SEQ ID NO: 1115907 - RNA, 20 nt, Mycobacterium bovis subsp bovis AF2122/97
gacacccgcacgaagccggc

SEQ ID NO: 1115908 - RNA, 14 nt, Mycobacterium bovis subsp bovis AF2122/97
gacacccgcauggc

SEQ ID NO: 1115909 - RNA, 18 nt, Mycobacterium bovis subsp bovis AF2122/97
gacacccgccaggccgcg

SEQ ID NO: 1115910 - RNA, 16 nt, Mycobacterium bovis subsp bovis AF2122/97
gacaccauaggccgac

SEQ ID NO: 1115911 - RNA, 23 nt, Mycobacterium bovis subsp bovis AF2122/97
gacaccaucuccgccgucgccac

SEQ ID NO: 1115912 - RNA, 15 nt, Mycobacterium bovis subsp bovis AF2122/97
gacaccagcgugugg

SEQ ID NO: 1115913 - RNA, 14 nt, Mycobacterium bovis subsp bovis AF2122/97
gacaccaccucguc

SEQ ID NO: 1115914 - RNA, 13 nt, Mycobacterium bovis subsp bovis AF2122/97
gacaccagagcga

SEQ ID NO: 1115915 - RNA, 13 nt, Mycobacterium bovis subsp bovis AF2122/97
gacaccaccggcg

SEQ ID NO: 1115916 - RNA, 23 nt, Mycobacterium bovis subsp bovis AF2122/97
gacaccaccagguccaccccgcc

SEQ ID NO: 1115917 - RNA, 15 nt, Mycobacterium bovis subsp bovis AF2122/97
gaaucccgcgaugcg

SEQ ID NO: 1115918 - RNA, 21 nt, Mycobacterium bovis subsp bovis AF2122/97
gaauccggaguuuaagacgcc

SEQ ID NO: 1115919 - RNA, 21 nt, Mycobacterium bovis subsp bovis AF2122/97
gaauccggcccaccggucgcg

SEQ ID NO: 1115920 - RNA, 19 nt, Mycobacterium bovis subsp bovis AF2122/97
gaauccgaucaccucggcg

SEQ ID NO: 1115921 - RNA, 20 nt, Mycobacterium bovis subsp bovis AF2122/97
gaauccaggccguacucgau

SEQ ID NO: 1115922 - RNA, 14 nt, Mycobacterium bovis subsp bovis AF2122/97
gaauccagccgcgc

SEQ ID NO: 1115923 - RNA, 14 nt, Mycobacterium bovis subsp bovis AF2122/97
gaauccccgcggcg

SEQ ID NO: 1115924 - RNA, 16 nt, Mycobacterium bovis subsp bovis AF2122/97
gaauccccgcggcggu

SEQ ID NO: 1115925 - RNA, 15 nt, Mycobacterium bovis subsp bovis AF2122/97
gaaucagcagcagcg

SEQ ID NO: 1115926 - RNA, 22 nt, Mycobacterium bovis subsp bovis AF2122/97
gaaucagcagcagcgugaccac

SEQ ID NO: 1115927 - RNA, 19 nt, Mycobacterium bovis subsp bovis AF2122/97
gaaucacguggaccacggc

SEQ ID NO: 1115928 - RNA, 22 nt, Mycobacterium bovis subsp bovis AF2122/97
gaaucagugaagacaccaggcc

SEQ ID NO: 1115929 - RNA, 14 nt, Mycobacterium bovis subsp bovis AF2122/97
gaaucgucugacga

SEQ ID NO: 1115930 - RNA, 16 nt, Mycobacterium bovis subsp bovis AF2122/97
gaauccuggccgccgc

SEQ ID NO: 1115931 - RNA, 13 nt, Mycobacterium bovis subsp bovis AF2122/97
gaauccugcgcug

SEQ ID NO: 1115932 - RNA, 17 nt, Mycobacterium bovis subsp bovis AF2122/97
gaaucgugcggcgaccg

SEQ ID NO: 1115933 - RNA, 15 nt, Mycobacterium bovis subsp bovis AF2122/97
gaauccguucgacga

SEQ ID NO: 1115934 - RNA, 14 nt, Mycobacterium bovis subsp bovis AF2122/97
gaauccggucggcc

SEQ ID NO: 1115935 - RNA, 16 nt, Mycobacterium bovis subsp bovis AF2122/97
gaauccguucgacgag

SEQ ID NO: 1115936 - RNA, 21 nt, Mycobacterium bovis subsp bovis AF2122/97
gaauccucgcgaaaccgccgu

SEQ ID NO: 1115937 - RNA, 22 nt, Mycobacterium bovis subsp bovis AF2122/97
gaaucuuguuguucgccaccgc

SEQ ID NO: 1115938 - RNA, 20 nt, Mycobacterium bovis subsp bovis AF2122/97
gaaugaagcccucgucggga

SEQ ID NO: 1115939 - RNA, 14 nt, Mycobacterium bovis subsp bovis AF2122/97
gaaucugacgacgc

SEQ ID NO: 1115940 - RNA, 21 nt, Mycobacterium bovis subsp bovis AF2122/97
gaaucuaauucgccucgccug

SEQ ID NO: 1115941 - RNA, 13 nt, Mycobacterium bovis subsp bovis AF2122/97
gaaucucgccccc

SEQ ID NO: 1115942 - RNA, 21 nt, Mycobacterium bovis subsp bovis AF2122/97
gaacugcugaugaaacgccgu

SEQ ID NO: 1115943 - RNA, 19 nt, Mycobacterium bovis subsp bovis AF2122/97
gaaucacccgcgagaucgg

SEQ ID NO: 1115944 - RNA, 13 nt, Mycobacterium bovis subsp bovis AF2122/97
gaaucaccggcaa

SEQ ID NO: 1115945 - RNA, 22 nt, Mycobacterium bovis subsp bovis AF2122/97
gaauacccgcggggaaucaccc

SEQ ID NO: 1115946 - RNA, 23 nt, Mycobacterium bovis subsp bovis AF2122/97
gaauacagcuugaucgccgaggc

SEQ ID NO: 1115947 - RNA, 12 nt, Mycobacterium bovis subsp bovis AF2122/97
gaauacgcgccg

SEQ ID NO: 1115948 - RNA, 16 nt, Mycobacterium bovis subsp bovis AF2122/97
gaauacgcgccgccgg

SEQ ID NO: 1115949 - RNA, 23 nt, Mycobacterium bovis subsp bovis AF2122/97
gaauacgcgccgccggcucgccg

SEQ ID NO: 1115950 - RNA, 23 nt, Mycobacterium bovis subsp bovis AF2122/97
gaauacgcguugugcccgccggc

SEQ ID NO: 1115951 - RNA, 13 nt, Mycobacterium bovis subsp bovis AF2122/97
gaacucggcgucg

SEQ ID NO: 1115952 - RNA, 23 nt, Mycobacterium bovis subsp bovis AF2122/97
gaacucgggcaaugucgacaccg

SEQ ID NO: 1115953 - RNA, 22 nt, Mycobacterium bovis subsp bovis AF2122/97
gaacucguugagcagcuggacc

SEQ ID NO: 1115954 - RNA, 23 nt, Mycobacterium bovis subsp bovis AF2122/97
gaacuccucgcugucgaucagcg

SEQ ID NO: 1115955 - RNA, 16 nt, Mycobacterium bovis subsp bovis AF2122/97
gaacucggcgaucucg

SEQ ID NO: 1115956 - RNA, 15 nt, Mycobacterium bovis subsp bovis AF2122/97
gaacugcucgauccg

SEQ ID NO: 1115957 - RNA, 21 nt, Mycobacterium bovis subsp bovis AF2122/97
gaacugcaugguggcgccgac

SEQ ID NO: 1115958 - RNA, 23 nt, Mycobacterium bovis subsp bovis AF2122/97
gaacugaugaaccacggcaggca

SEQ ID NO: 1115959 - RNA, 17 nt, Mycobacterium bovis subsp bovis AF2122/97
gaacugaaacgcuuggc

SEQ ID NO: 1115960 - RNA, 17 nt, Mycobacterium bovis subsp bovis AF2122/97
gaacucuggugacggug

SEQ ID NO: 1115961 - RNA, 14 nt, Mycobacterium bovis subsp bovis AF2122/97
gaacugagggcgga

SEQ ID NO: 1115962 - RNA, 15 nt, Mycobacterium bovis subsp bovis AF2122/97
gaacugaucgaccgc

SEQ ID NO: 1115963 - RNA, 19 nt, Mycobacterium bovis subsp bovis AF2122/97
gaacugaugaaccacggca

SEQ ID NO: 1115964 - RNA, 22 nt, Mycobacterium bovis subsp bovis AF2122/97
gacaacccguaggguggccgac

SEQ ID NO: 1115965 - RNA, 13 nt, Mycobacterium bovis subsp bovis AF2122/97
gacaaccgggcgg

SEQ ID NO: 1115966 - RNA, 18 nt, Mycobacterium bovis subsp bovis AF2122/97
gacaaccucgucgaucuc

SEQ ID NO: 1115967 - RNA, 11 nt, Mycobacterium bovis subsp bovis AF2122/97
gacaaccuggg

SEQ ID NO: 1115968 - RNA, 14 nt, Mycobacterium bovis subsp bovis AF2122/97
gacaaccuuggcga

SEQ ID NO: 1115969 - RNA, 23 nt, Mycobacterium bovis subsp bovis AF2122/97
gaaucuucugagacugccgccgc

SEQ ID NO: 1115970 - RNA, 20 nt, Mycobacterium bovis subsp bovis AF2122/97
gaaugcgguccucgaucggu

SEQ ID NO: 1115971 - RNA, 22 nt, Mycobacterium bovis subsp bovis AF2122/97
gaaugcugacggugcaggacca

SEQ ID NO: 1115972 - RNA, 23 nt, Mycobacterium bovis subsp bovis AF2122/97
gaaugcugugccgagaugccggc

SEQ ID NO: 1115973 - RNA, 16 nt, Mycobacterium bovis subsp bovis AF2122/97
gaauggaccagcgccc

SEQ ID NO: 1115974 - RNA, 19 nt, Mycobacterium bovis subsp bovis AF2122/97
gaauggaccagcgccccgg

SEQ ID NO: 1115975 - RNA, 16 nt, Mycobacterium bovis subsp bovis AF2122/97
gaauggaggccgccga

SEQ ID NO: 1115976 - RNA, 22 nt, Mycobacterium bovis subsp bovis AF2122/97
gaaugucgaaacccacguacgc

SEQ ID NO: 1115977 - RNA, 13 nt, Mycobacterium bovis subsp bovis AF2122/97
gaaugucgcgcug

SEQ ID NO: 1115978 - RNA, 15 nt, Mycobacterium bovis subsp bovis AF2122/97
gaauguccggcaucg

SEQ ID NO: 1115979 - RNA, 20 nt, Mycobacterium bovis subsp bovis AF2122/97
gaauguaguccagcucgcug

SEQ ID NO: 1115980 - RNA, 16 nt, Mycobacterium bovis subsp bovis AF2122/97
gaaugguggugucggc

SEQ ID NO: 1115981 - RNA, 14 nt, Mycobacterium bovis subsp bovis AF2122/97
gaaugggcgccaca

SEQ ID NO: 1115982 - RNA, 13 nt, Mycobacterium bovis subsp bovis AF2122/97
gaaugggcggcau

SEQ ID NO: 1115983 - RNA, 18 nt, Mycobacterium bovis subsp bovis AF2122/97
gaauggggccaacaccuc

SEQ ID NO: 1115984 - RNA, 16 nt, Mycobacterium bovis subsp bovis AF2122/97
gacaacgugccgaacg

SEQ ID NO: 1115985 - RNA, 17 nt, Mycobacterium bovis subsp bovis AF2122/97
gacaacucgcguggcac

SEQ ID NO: 1115986 - RNA, 19 nt, Mycobacterium bovis subsp bovis AF2122/97
gacaacucgcguggcaccg

SEQ ID NO: 1115987 - RNA, 16 nt, Mycobacterium bovis subsp bovis AF2122/97
gacaacguugguccgc

SEQ ID NO: 1115988 - RNA, 23 nt, Mycobacterium bovis subsp bovis AF2122/97
gacaacuaucgucgugucgccgc

SEQ ID NO: 1115989 - RNA, 20 nt, Mycobacterium bovis subsp bovis AF2122/97
gacaacgccuuguuggcgcc

SEQ ID NO: 1115990 - RNA, 23 nt, Mycobacterium bovis subsp bovis AF2122/97
gacaacgaugucacccucccgca

SEQ ID NO: 1115991 - RNA, 14 nt, Mycobacterium bovis subsp bovis AF2122/97
gacaaggugcgcug

SEQ ID NO: 1115992 - RNA, 18 nt, Mycobacterium bovis subsp bovis AF2122/97
gacaaggguucaggucgg

SEQ ID NO: 1115993 - RNA, 20 nt, Mycobacterium bovis subsp bovis AF2122/97
gacaagccuuaccccgcagc

SEQ ID NO: 1115994 - RNA, 13 nt, Mycobacterium bovis subsp bovis AF2122/97
gacaagccgcuga

SEQ ID NO: 1115995 - RNA, 23 nt, Mycobacterium bovis subsp bovis AF2122/97
gacaaggcgauugucggggccgc

SEQ ID NO: 1115996 - RNA, 16 nt, Mycobacterium bovis subsp bovis AF2122/97
gacaagcccgcugcca

SEQ ID NO: 1115997 - RNA, 23 nt, Mycobacterium bovis subsp bovis AF2122/97
gacaagcgauuuggcgucgccga

SEQ ID NO: 1115998 - RNA, 13 nt, Mycobacterium bovis subsp bovis AF2122/97
gacaagcggcccg

SEQ ID NO: 1115999 - RNA, 16 nt, Mycobacterium bovis subsp bovis AF2122/97
gacaagcugucggcga

SEQ ID NO: 1116000 - RNA, 19 nt, Mycobacterium bovis subsp bovis AF2122/97
gacaaucguccacccgagc

SEQ ID NO: 1116001 - RNA, 15 nt, Mycobacterium bovis subsp bovis AF2122/97
gacaagucggcaccg

SEQ ID NO: 1116002 - RNA, 16 nt, Mycobacterium bovis subsp bovis AF2122/97
gacaagucggcaccgg

SEQ ID NO: 1116003 - RNA, 13 nt, Mycobacterium bovis subsp bovis AF2122/97
gacaagucggcgc

SEQ ID NO: 1116004 - RNA, 16 nt, Mycobacterium bovis subsp bovis AF2122/97
gacaagucggcgcugg

SEQ ID NO: 1116005 - RNA, 14 nt, Mycobacterium bovis subsp bovis AF2122/97
gacaagugcccggc

SEQ ID NO: 1116006 - RNA, 19 nt, Mycobacterium bovis subsp bovis AF2122/97
gacaagugccggcgcggag

SEQ ID NO: 1116007 - RNA, 16 nt, Mycobacterium bovis subsp bovis AF2122/97
gacacaauccacgucg

SEQ ID NO: 1116008 - RNA, 14 nt, Mycobacterium bovis subsp bovis AF2122/97
gacacacaggcggc

SEQ ID NO: 1116009 - RNA, 19 nt, Mycobacterium bovis subsp bovis AF2122/97
gacacacgccgccgguguc

SEQ ID NO: 1116010 - RNA, 18 nt, Mycobacterium bovis subsp bovis AF2122/97
gacaauggcgccagccga

SEQ ID NO: 1116011 - RNA, 14 nt, Mycobacterium bovis subsp bovis AF2122/97
gacaaugucggcga

SEQ ID NO: 1116012 - RNA, 13 nt, Mycobacterium bovis subsp bovis AF2122/97
gacacauugacca

SEQ ID NO: 1116013 - RNA, 13 nt, Mycobacterium bovis subsp bovis AF2122/97
gacaccaacaccg

SEQ ID NO: 1116014 - RNA, 18 nt, Mycobacterium bovis subsp bovis AF2122/97
gacaccaacaccgguggc

SEQ ID NO: 1116015 - RNA, 23 nt, Mycobacterium bovis subsp bovis AF2122/97
gacaccaacccaccccccagcgc

SEQ ID NO: 1116016 - RNA, 14 nt, Mycobacterium bovis subsp bovis AF2122/97
gacacagcggcggg

SEQ ID NO: 1116017 - RNA, 13 nt, Mycobacterium bovis subsp bovis AF2122/97
gaccccggcggua

SEQ ID NO: 1116018 - RNA, 16 nt, Mycobacterium bovis subsp bovis AF2122/97
gaccccggcgguaccg

SEQ ID NO: 1116019 - RNA, 20 nt, Mycobacterium bovis subsp bovis AF2122/97
gaccccggcguugccgccgu

SEQ ID NO: 1116020 - RNA, 22 nt, Mycobacterium bovis subsp bovis AF2122/97
gaccccggcguugccgccguug

SEQ ID NO: 1116021 - RNA, 20 nt, Mycobacterium bovis subsp bovis AF2122/97
gaccccuggccgccggcgcc

SEQ ID NO: 1116022 - RNA, 21 nt, Mycobacterium bovis subsp bovis AF2122/97
gaccccuggccgccggcgccg

SEQ ID NO: 1116023 - RNA, 14 nt, Mycobacterium bovis subsp bovis AF2122/97
gacccgaagccgac

SEQ ID NO: 1116024 - RNA, 12 nt, Mycobacterium bovis subsp bovis AF2122/97
gaccccgucgac

SEQ ID NO: 1116025 - RNA, 17 nt, Mycobacterium bovis subsp bovis AF2122/97
gaccccguaggcgccga

SEQ ID NO: 1116026 - RNA, 19 nt, Mycobacterium bovis subsp bovis AF2122/97
gaccccguaggcgccgaac

SEQ ID NO: 1116027 - RNA, 20 nt, Mycobacterium bovis subsp bovis AF2122/97
gaccccguaggcgccgaacc

SEQ ID NO: 1116028 - RNA, 16 nt, Mycobacterium bovis subsp bovis AF2122/97
gacccgagaucaccgg

SEQ ID NO: 1116029 - RNA, 15 nt, Mycobacterium bovis subsp bovis AF2122/97
gacccgacgaugccg

SEQ ID NO: 1116030 - RNA, 16 nt, Mycobacterium bovis subsp bovis AF2122/97
gaccccggcugcgcuu

SEQ ID NO: 1116031 - RNA, 20 nt, Mycobacterium bovis subsp bovis AF2122/97
gacccgacaugguccgacca

SEQ ID NO: 1116032 - RNA, 13 nt, Mycobacterium bovis subsp bovis AF2122/97
gacccgaucgcgc

SEQ ID NO: 1116033 - RNA, 18 nt, Mycobacterium bovis subsp bovis AF2122/97
gacccgaugcgucucgcg

SEQ ID NO: 1116034 - RNA, 17 nt, Mycobacterium bovis subsp bovis AF2122/97
gacccgcauccacgucg

SEQ ID NO: 1116035 - RNA, 14 nt, Mycobacterium bovis subsp bovis AF2122/97
gacccgcauggcgc

SEQ ID NO: 1116036 - RNA, 20 nt, Mycobacterium bovis subsp bovis AF2122/97
gacccgcaauuccggugauc

SEQ ID NO: 1116037 - RNA, 20 nt, Mycobacterium bovis subsp bovis AF2122/97
gaccaugcgaccggcaacgc

SEQ ID NO: 1116038 - RNA, 19 nt, Mycobacterium bovis subsp bovis AF2122/97
gaccccgcgcuggacaacg

SEQ ID NO: 1116039 - RNA, 17 nt, Mycobacterium bovis subsp bovis AF2122/97
gaccaugaugaccggca

SEQ ID NO: 1116040 - RNA, 18 nt, Mycobacterium bovis subsp bovis AF2122/97
gaccaugaugaccggcaa

SEQ ID NO: 1116041 - RNA, 14 nt, Mycobacterium bovis subsp bovis AF2122/97
gaccaugcgaccgg

SEQ ID NO: 1116042 - RNA, 18 nt, Mycobacterium bovis subsp bovis AF2122/97
gaccaugcgaccggcaac

SEQ ID NO: 1116043 - RNA, 22 nt, Mycobacterium bovis subsp bovis AF2122/97
gaccaucugcuguggaucgaca

SEQ ID NO: 1116044 - RNA, 19 nt, Mycobacterium bovis subsp bovis AF2122/97
gaccaugagccggcgccgc

SEQ ID NO: 1116045 - RNA, 17 nt, Mycobacterium bovis subsp bovis AF2122/97
gaccaucucaccgggcc

SEQ ID NO: 1116046 - RNA, 15 nt, Mycobacterium bovis subsp bovis AF2122/97
gaccaucuccggugu

SEQ ID NO: 1116047 - RNA, 15 nt, Mycobacterium bovis subsp bovis AF2122/97
gaccaucucgacguc

SEQ ID NO: 1116048 - RNA, 23 nt, Mycobacterium bovis subsp bovis AF2122/97
gaccauccgaguugucgccggag

SEQ ID NO: 1116049 - RNA, 13 nt, Mycobacterium bovis subsp bovis AF2122/97
gaccaucacaccc

SEQ ID NO: 1116050 - RNA, 18 nt, Mycobacterium bovis subsp bovis AF2122/97
gaccaucaccacggccgc

SEQ ID NO: 1116051 - RNA, 20 nt, Mycobacterium bovis subsp bovis AF2122/97
gaccaucaccacggccgccg

SEQ ID NO: 1116052 - RNA, 13 nt, Mycobacterium bovis subsp bovis AF2122/97
gaccauacccgcg

SEQ ID NO: 1116053 - RNA, 21 nt, Mycobacterium bovis subsp bovis AF2122/97
gaccauacuaauggcgccacc

SEQ ID NO: 1116054 - RNA, 22 nt, Mycobacterium bovis subsp bovis AF2122/97
gaccauagccugcgccgacccg

SEQ ID NO: 1116055 - RNA, 17 nt, Mycobacterium bovis subsp bovis AF2122/97
gaccauaaaccgcugcu

SEQ ID NO: 1116056 - RNA, 15 nt, Mycobacterium bovis subsp bovis AF2122/97
gaccauagucgccgu

SEQ ID NO: 1116057 - RNA, 12 nt, Mycobacterium bovis subsp bovis AF2122/97
gacccggccagc

SEQ ID NO: 1116058 - RNA, 20 nt, Mycobacterium bovis subsp bovis AF2122/97
gacccgagcgcucgaucacg

SEQ ID NO: 1116059 - RNA, 16 nt, Mycobacterium bovis subsp bovis AF2122/97
gacccgcccaggcguc

SEQ ID NO: 1116060 - RNA, 16 nt, Mycobacterium bovis subsp bovis AF2122/97
gacccggccggcccgg

SEQ ID NO: 1116061 - RNA, 15 nt, Mycobacterium bovis subsp bovis AF2122/97
gacccggcagcccgg

SEQ ID NO: 1116062 - RNA, 17 nt, Mycobacterium bovis subsp bovis AF2122/97
gacccggaccuucggcg

SEQ ID NO: 1116063 - RNA, 22 nt, Mycobacterium bovis subsp bovis AF2122/97
gacccggagccgccaggugcuc

SEQ ID NO: 1116064 - RNA, 18 nt, Mycobacterium bovis subsp bovis AF2122/97
gacccgcccuugccgccg

SEQ ID NO: 1116065 - RNA, 19 nt, Mycobacterium bovis subsp bovis AF2122/97
gacccgcccuugccgccga

SEQ ID NO: 1116066 - RNA, 18 nt, Mycobacterium bovis subsp bovis AF2122/97
gacccggaaucccgaguc

SEQ ID NO: 1116067 - RNA, 21 nt, Mycobacterium bovis subsp bovis AF2122/97
gacccgggccgcggcggccag

SEQ ID NO: 1116068 - RNA, 22 nt, Mycobacterium bovis subsp bovis AF2122/97
gacccgggaaggaaccgggcaa

SEQ ID NO: 1116069 - RNA, 16 nt, Mycobacterium bovis subsp bovis AF2122/97
gacccggccagcggca

SEQ ID NO: 1116070 - RNA, 21 nt, Mycobacterium bovis subsp bovis AF2122/97
gacccgggaaggaaccgggca

SEQ ID NO: 1116071 - RNA, 21 nt, Mycobacterium bovis subsp bovis AF2122/97
gacccgggcgagcgcggccug

SEQ ID NO: 1116072 - RNA, 23 nt, Mycobacterium bovis subsp bovis AF2122/97
gaccgaaucgggucggccgcugg

SEQ ID NO: 1116073 - RNA, 20 nt, Mycobacterium bovis subsp bovis AF2122/97
gaccgaauggccgccgcagc

SEQ ID NO: 1116074 - RNA, 22 nt, Mycobacterium bovis subsp bovis AF2122/97
gaccgaaugugaaaugcgcgau

SEQ ID NO: 1116075 - RNA, 21 nt, Mycobacterium bovis subsp bovis AF2122/97
gaccgaagagcuccgucgcgg

SEQ ID NO: 1116076 - RNA, 14 nt, Mycobacterium bovis subsp bovis AF2122/97
gaccgaacgacucg

SEQ ID NO: 1116077 - RNA, 15 nt, Mycobacterium bovis subsp bovis AF2122/97
gacccggggccguug

SEQ ID NO: 1116078 - RNA, 18 nt, Mycobacterium bovis subsp bovis AF2122/97
gacccggggccguuggug

SEQ ID NO: 1116079 - RNA, 20 nt, Mycobacterium bovis subsp bovis AF2122/97
gaccgagaucgucgcgaccu

SEQ ID NO: 1116080 - RNA, 17 nt, Mycobacterium bovis subsp bovis AF2122/97
gaccgagcccgauggug

SEQ ID NO: 1116081 - RNA, 13 nt, Mycobacterium bovis subsp bovis AF2122/97
gaccgaucggcag

SEQ ID NO: 1116082 - RNA, 19 nt, Mycobacterium bovis subsp bovis AF2122/97
gaccgaucggcaggccgcu

SEQ ID NO: 1116083 - RNA, 18 nt, Mycobacterium bovis subsp bovis AF2122/97
gaccgauaaguucggcug

SEQ ID NO: 1116084 - RNA, 18 nt, Mycobacterium bovis subsp bovis AF2122/97
gaccgaggcacgucgaaa

SEQ ID NO: 1116085 - RNA, 17 nt, Mycobacterium bovis subsp bovis AF2122/97
gaccgagccgaucugcu

SEQ ID NO: 1116086 - RNA, 14 nt, Mycobacterium bovis subsp bovis AF2122/97
gaccgacagcggca

SEQ ID NO: 1116087 - RNA, 15 nt, Mycobacterium bovis subsp bovis AF2122/97
gaccgacagcggcac

SEQ ID NO: 1116088 - RNA, 16 nt, Mycobacterium bovis subsp bovis AF2122/97
gaccgacagcggcacc

SEQ ID NO: 1116089 - RNA, 19 nt, Mycobacterium bovis subsp bovis AF2122/97
gaccgacagcggcaccggg

SEQ ID NO: 1116090 - RNA, 23 nt, Mycobacterium bovis subsp bovis AF2122/97
gacccgggaaggaaccgggcaaa

SEQ ID NO: 1116091 - RNA, 15 nt, Mycobacterium bovis subsp bovis AF2122/97
gaccgacccggaccu

SEQ ID NO: 1116092 - RNA, 14 nt, Mycobacterium bovis subsp bovis AF2122/97
gaccgaccucggcg

SEQ ID NO: 1116093 - RNA, 16 nt, Mycobacterium bovis subsp bovis AF2122/97
gaccgaccucggcgac

SEQ ID NO: 1116094 - RNA, 16 nt, Mycobacterium bovis subsp bovis AF2122/97
gaccgaccgcauggug

SEQ ID NO: 1116095 - RNA, 18 nt, Mycobacterium bovis subsp bovis AF2122/97
gaccgaccgcaugguggu

SEQ ID NO: 1116096 - RNA, 14 nt, Mycobacterium bovis subsp bovis AF2122/97
gaccgacgccggug

SEQ ID NO: 1116097 - RNA, 13 nt, Mycobacterium bovis subsp bovis AF2122/97
gaccgacgucgcc

SEQ ID NO: 1116098 - RNA, 15 nt, Mycobacterium bovis subsp bovis AF2122/97
gaccgacgucgccca

SEQ ID NO: 1116099 - RNA, 14 nt, Mycobacterium bovis subsp bovis AF2122/97
gaccaguucggugu

SEQ ID NO: 1116100 - RNA, 17 nt, Mycobacterium bovis subsp bovis AF2122/97
gaccagucgcggcguuc

SEQ ID NO: 1116101 - RNA, 19 nt, Mycobacterium bovis subsp bovis AF2122/97
gaccagugguggccgaacg

SEQ ID NO: 1116102 - RNA, 18 nt, Mycobacterium bovis subsp bovis AF2122/97
gaccaggaccaccgcaua

SEQ ID NO: 1116103 - RNA, 15 nt, Mycobacterium bovis subsp bovis AF2122/97
gaccagggccgccgc

SEQ ID NO: 1116104 - RNA, 15 nt, Mycobacterium bovis subsp bovis AF2122/97
gaccagggucugcuc

SEQ ID NO: 1116105 - RNA, 19 nt, Mycobacterium bovis subsp bovis AF2122/97
gaccaggucgccagcucgg

SEQ ID NO: 1116106 - RNA, 17 nt, Mycobacterium bovis subsp bovis AF2122/97
gaccaggugcagcacca

SEQ ID NO: 1116107 - RNA, 18 nt, Mycobacterium bovis subsp bovis AF2122/97
gaccaggcggcgcggguc

SEQ ID NO: 1116108 - RNA, 23 nt, Mycobacterium bovis subsp bovis AF2122/97
gaccaggcggcgcgggucggcga

SEQ ID NO: 1116109 - RNA, 19 nt, Mycobacterium bovis subsp bovis AF2122/97
gaccaggcggacgccgcgc

SEQ ID NO: 1116110 - RNA, 20 nt, Mycobacterium bovis subsp bovis AF2122/97
gaccaggcggacgccgcgcc

SEQ ID NO: 1116111 - RNA, 14 nt, Mycobacterium bovis subsp bovis AF2122/97
gaccaggccgguga

SEQ ID NO: 1116112 - RNA, 16 nt, Mycobacterium bovis subsp bovis AF2122/97
gaccaggccgcgcgca

SEQ ID NO: 1116113 - RNA, 19 nt, Mycobacterium bovis subsp bovis AF2122/97
gaccaggccgcgcgcaccg

SEQ ID NO: 1116114 - RNA, 20 nt, Mycobacterium bovis subsp bovis AF2122/97
gaccaggccggcccgcaacg

SEQ ID NO: 1116115 - RNA, 16 nt, Mycobacterium bovis subsp bovis AF2122/97
gaccagggcagcggcc

SEQ ID NO: 1116116 - RNA, 17 nt, Mycobacterium bovis subsp bovis AF2122/97
gaccaggaccggcugca

SEQ ID NO: 1116117 - RNA, 15 nt, Mycobacterium bovis subsp bovis AF2122/97
gaccagcuucggcug

SEQ ID NO: 1116118 - RNA, 17 nt, Mycobacterium bovis subsp bovis AF2122/97
gaccagcucagcugcgg

SEQ ID NO: 1116119 - RNA, 13 nt, Mycobacterium bovis subsp bovis AF2122/97
gaccagcugccgg

SEQ ID NO: 1116120 - RNA, 16 nt, Mycobacterium bovis subsp bovis AF2122/97
gaccagcugccggcga

SEQ ID NO: 1116121 - RNA, 14 nt, Mycobacterium bovis subsp bovis AF2122/97
gaccagccgagcga

SEQ ID NO: 1116122 - RNA, 22 nt, Mycobacterium bovis subsp bovis AF2122/97
gaccagcaggcccuggccaccc

SEQ ID NO: 1116123 - RNA, 16 nt, Mycobacterium bovis subsp bovis AF2122/97
gaccagcaggccgggc

SEQ ID NO: 1116124 - RNA, 15 nt, Mycobacterium bovis subsp bovis AF2122/97
gaccagccagcgagg

SEQ ID NO: 1116125 - RNA, 20 nt, Mycobacterium bovis subsp bovis AF2122/97
gaccagcaccgccgcgccgg

SEQ ID NO: 1116126 - RNA, 13 nt, Mycobacterium bovis subsp bovis AF2122/97
gaccagcacccgc

SEQ ID NO: 1116127 - RNA, 16 nt, Mycobacterium bovis subsp bovis AF2122/97
gaccagcgcuagcggu

SEQ ID NO: 1116128 - RNA, 16 nt, Mycobacterium bovis subsp bovis AF2122/97
gaccagcgccggaccg

SEQ ID NO: 1116129 - RNA, 18 nt, Mycobacterium bovis subsp bovis AF2122/97
gaccagcguccagccgcc

SEQ ID NO: 1116130 - RNA, 19 nt, Mycobacterium bovis subsp bovis AF2122/97
gaccagcguggggccgcca

SEQ ID NO: 1116131 - RNA, 22 nt, Mycobacterium bovis subsp bovis AF2122/97
gaccagcguggggccgccacca

SEQ ID NO: 1116132 - RNA, 23 nt, Mycobacterium bovis subsp bovis AF2122/97
gaccagcguggggccgccaccag

SEQ ID NO: 1116133 - RNA, 12 nt, Mycobacterium bovis subsp bovis AF2122/97
gaccagcggccg

SEQ ID NO: 1116134 - RNA, 22 nt, Mycobacterium bovis subsp bovis AF2122/97
gaccagcguccagccgcccucg

SEQ ID NO: 1116135 - RNA, 14 nt, Mycobacterium bovis subsp bovis AF2122/97
gaccgggucgccga

SEQ ID NO: 1116136 - RNA, 19 nt, Mycobacterium bovis subsp bovis AF2122/97
gaccgggucgaugacgccg

SEQ ID NO: 1116137 - RNA, 19 nt, Mycobacterium bovis subsp bovis AF2122/97
gaccgggucgaucaccgac

SEQ ID NO: 1116138 - RNA, 23 nt, Mycobacterium bovis subsp bovis AF2122/97
gaccgggucgaucaccgacaccg

SEQ ID NO: 1116139 - RNA, 15 nt, Mycobacterium bovis subsp bovis AF2122/97
gaccgggucgaugac

SEQ ID NO: 1116140 - RNA, 18 nt, Mycobacterium bovis subsp bovis AF2122/97
gaccggggaucggggcac

SEQ ID NO: 1116141 - RNA, 19 nt, Mycobacterium bovis subsp bovis AF2122/97
gaccggggucggccugcgg

SEQ ID NO: 1116142 - RNA, 21 nt, Mycobacterium bovis subsp bovis AF2122/97
gaccggggucggccugcggca

SEQ ID NO: 1116143 - RNA, 15 nt, Mycobacterium bovis subsp bovis AF2122/97
gaccgggucgccgau

SEQ ID NO: 1116144 - RNA, 22 nt, Mycobacterium bovis subsp bovis AF2122/97
gaccgggugggucguucaccga

SEQ ID NO: 1116145 - RNA, 24 nt, Mycobacterium bovis subsp bovis AF2122/97
gaccgggugggucguucaccgauc

SEQ ID NO: 1116146 - RNA, 23 nt, Mycobacterium bovis subsp bovis AF2122/97
gaccggugcugucgacgucggca

SEQ ID NO: 1116147 - RNA, 14 nt, Mycobacterium bovis subsp bovis AF2122/97
gaccgguggcaccg

SEQ ID NO: 1116148 - RNA, 19 nt, Mycobacterium bovis subsp bovis AF2122/97
gaccgguggcaccggcggc

SEQ ID NO: 1116149 - RNA, 15 nt, Mycobacterium bovis subsp bovis AF2122/97
gaccgguggccaucg

SEQ ID NO: 1116150 - RNA, 21 nt, Mycobacterium bovis subsp bovis AF2122/97
gaccgguggccaucgcgcgga

SEQ ID NO: 1116151 - RNA, 18 nt, Mycobacterium bovis subsp bovis AF2122/97
gaccgguaggcaccgauc

SEQ ID NO: 1116152 - RNA, 22 nt, Mycobacterium bovis subsp bovis AF2122/97
gaccgguaggcaccgaucggug

SEQ ID NO: 1116153 - RNA, 12 nt, Mycobacterium bovis subsp bovis AF2122/97
gaccggucgaca

SEQ ID NO: 1116154 - RNA, 13 nt, Mycobacterium bovis subsp bovis AF2122/97
gaccgguccagcc

SEQ ID NO: 1116155 - RNA, 13 nt, Mycobacterium bovis subsp bovis AF2122/97
gaccgguccccgg

SEQ ID NO: 1116156 - RNA, 23 nt, Mycobacterium bovis subsp bovis AF2122/97
gaccggucgacagcgaaggcgcc

SEQ ID NO: 1116157 - RNA, 16 nt, Mycobacterium bovis subsp bovis AF2122/97
gaccggcgggaugcgc

SEQ ID NO: 1116158 - RNA, 17 nt, Mycobacterium bovis subsp bovis AF2122/97
gaccggcgggaugcgcg

SEQ ID NO: 1116159 - RNA, 19 nt, Mycobacterium bovis subsp bovis AF2122/97
gaccggcgggaugcgcgcc

SEQ ID NO: 1116160 - RNA, 22 nt, Mycobacterium bovis subsp bovis AF2122/97
gaccggcgggaugcgcgcccga

SEQ ID NO: 1116161 - RNA, 12 nt, Mycobacterium bovis subsp bovis AF2122/97
gaccggcuccgg

SEQ ID NO: 1116162 - RNA, 17 nt, Mycobacterium bovis subsp bovis AF2122/97
gaccggcucgccggcgc

SEQ ID NO: 1116163 - RNA, 16 nt, Mycobacterium bovis subsp bovis AF2122/97
gaccggcuugccgccg

SEQ ID NO: 1116164 - RNA, 17 nt, Mycobacterium bovis subsp bovis AF2122/97
gaccggcuugccgccgu

SEQ ID NO: 1116165 - RNA, 18 nt, Mycobacterium bovis subsp bovis AF2122/97
gaccgggcucuggccagu

SEQ ID NO: 1116166 - RNA, 12 nt, Mycobacterium bovis subsp bovis AF2122/97
gaccgggcccgg

SEQ ID NO: 1116167 - RNA, 17 nt, Mycobacterium bovis subsp bovis AF2122/97
gaccgggcccggcgaac

SEQ ID NO: 1116168 - RNA, 16 nt, Mycobacterium bovis subsp bovis AF2122/97
gaccgggcuggccagc

SEQ ID NO: 1116169 - RNA, 17 nt, Mycobacterium bovis subsp bovis AF2122/97
gaccgggcuggccagcg

SEQ ID NO: 1116170 - RNA, 13 nt, Mycobacterium bovis subsp bovis AF2122/97
gaccggggacagc

SEQ ID NO: 1116171 - RNA, 21 nt, Mycobacterium bovis subsp bovis AF2122/97
gaccggcuccgguaggcgaga

SEQ ID NO: 1116172 - RNA, 15 nt, Mycobacterium bovis subsp bovis AF2122/97
gaccgggcaacggcg

SEQ ID NO: 1116173 - RNA, 20 nt, Mycobacterium bovis subsp bovis AF2122/97
gaccgggcaguuuguucgcg

SEQ ID NO: 1116174 - RNA, 22 nt, Mycobacterium bovis subsp bovis AF2122/97
gaccgggaggcggcgccgcacc

SEQ ID NO: 1116175 - RNA, 15 nt, Mycobacterium bovis subsp bovis AF2122/97
gaccgggaucggcuc

SEQ ID NO: 1116176 - RNA, 17 nt, Mycobacterium bovis subsp bovis AF2122/97
gaccgggaucgucaggc

SEQ ID NO: 1116177 - RNA, 19 nt, Mycobacterium bovis subsp bovis AF2122/97
gaccgaucuuggccaccgc

SEQ ID NO: 1116178 - RNA, 17 nt, Mycobacterium bovis subsp bovis AF2122/97
gaccgaugacgaucggc

SEQ ID NO: 1116179 - RNA, 13 nt, Mycobacterium bovis subsp bovis AF2122/97
gaccgcaccgacc

SEQ ID NO: 1116180 - RNA, 18 nt, Mycobacterium bovis subsp bovis AF2122/97
gaccgauugucggcaacg

SEQ ID NO: 1116181 - RNA, 13 nt, Mycobacterium bovis subsp bovis AF2122/97
gaccgcaccgugc

SEQ ID NO: 1116182 - RNA, 17 nt, Mycobacterium bovis subsp bovis AF2122/97
gaccgcaccgugccgac

SEQ ID NO: 1116183 - RNA, 17 nt, Mycobacterium bovis subsp bovis AF2122/97
gaccgcacuugaucgac

SEQ ID NO: 1116184 - RNA, 23 nt, Mycobacterium bovis subsp bovis AF2122/97
gaccgcacuugaucgacggccau

SEQ ID NO: 1116185 - RNA, 17 nt, Mycobacterium bovis subsp bovis AF2122/97
gaccgcagucgcugggu

SEQ ID NO: 1116186 - RNA, 22 nt, Mycobacterium bovis subsp bovis AF2122/97
gaccgcagucgcuggguggcgg

SEQ ID NO: 1116187 - RNA, 23 nt, Mycobacterium bovis subsp bovis AF2122/97
gaccgcaucggcagccacguaga

SEQ ID NO: 1116188 - RNA, 18 nt, Mycobacterium bovis subsp bovis AF2122/97
gaccgcaugaucgcaccg

SEQ ID NO: 1116189 - RNA, 22 nt, Mycobacterium bovis subsp bovis AF2122/97
gaccgccacacggggccgccag

SEQ ID NO: 1116190 - RNA, 17 nt, Mycobacterium bovis subsp bovis AF2122/97
gaccgcggccccgccgu

SEQ ID NO: 1116191 - RNA, 13 nt, Mycobacterium bovis subsp bovis AF2122/97
gaccgcggcccgg

SEQ ID NO: 1116192 - RNA, 15 nt, Mycobacterium bovis subsp bovis AF2122/97
gaccgcggcccggac

SEQ ID NO: 1116193 - RNA, 23 nt, Mycobacterium bovis subsp bovis AF2122/97
gaccgcggcccggacgucggcgg

SEQ ID NO: 1116194 - RNA, 12 nt, Mycobacterium bovis subsp bovis AF2122/97
gaccgcggccgc

SEQ ID NO: 1116195 - RNA, 13 nt, Mycobacterium bovis subsp bovis AF2122/97
gaccgcgcucacc

SEQ ID NO: 1116196 - RNA, 15 nt, Mycobacterium bovis subsp bovis AF2122/97
gaccggccgacguga

SEQ ID NO: 1116197 - RNA, 16 nt, Mycobacterium bovis subsp bovis AF2122/97
gaccggccggccgcgg

SEQ ID NO: 1116198 - RNA, 21 nt, Mycobacterium bovis subsp bovis AF2122/97
gaccggcccgcauccgcaccg

SEQ ID NO: 1116199 - RNA, 23 nt, Mycobacterium bovis subsp bovis AF2122/97
gaccgcggucuucuucaccgccu

SEQ ID NO: 1116200 - RNA, 21 nt, Mycobacterium bovis subsp bovis AF2122/97
gaccgcggccuuggcggccgc

SEQ ID NO: 1116201 - RNA, 14 nt, Mycobacterium bovis subsp bovis AF2122/97
gaccgcgggcgccu

SEQ ID NO: 1116202 - RNA, 19 nt, Mycobacterium bovis subsp bovis AF2122/97
gaccgcggucauggcgacg

SEQ ID NO: 1116203 - RNA, 19 nt, Mycobacterium bovis subsp bovis AF2122/97
gaccggccugcgacgagcc

SEQ ID NO: 1116204 - RNA, 16 nt, Mycobacterium bovis subsp bovis AF2122/97
gaccgcgggccgacgc

SEQ ID NO: 1116205 - RNA, 12 nt, Mycobacterium bovis subsp bovis AF2122/97
gaccgcggggca

SEQ ID NO: 1116206 - RNA, 14 nt, Mycobacterium bovis subsp bovis AF2122/97
gaccgcggggcagc

SEQ ID NO: 1116207 - RNA, 19 nt, Mycobacterium bovis subsp bovis AF2122/97
gaccgcgggucgugccagc

SEQ ID NO: 1116208 - RNA, 23 nt, Mycobacterium bovis subsp bovis AF2122/97
gaccgcgggucgugccagcagca

SEQ ID NO: 1116209 - RNA, 21 nt, Mycobacterium bovis subsp bovis AF2122/97
gaccgcggcgcguccgggcuc

SEQ ID NO: 1116210 - RNA, 16 nt, Mycobacterium bovis subsp bovis AF2122/97
gaccgcggcggccgaa

SEQ ID NO: 1116211 - RNA, 13 nt, Mycobacterium bovis subsp bovis AF2122/97
gaccgcggccgcu

SEQ ID NO: 1116212 - RNA, 13 nt, Mycobacterium bovis subsp bovis AF2122/97
gaccucggcgauc

SEQ ID NO: 1116213 - RNA, 18 nt, Mycobacterium bovis subsp bovis AF2122/97
gaccgugucaccgccggg

SEQ ID NO: 1116214 - RNA, 11 nt, Mycobacterium bovis subsp bovis AF2122/97
gaccucggcga

SEQ ID NO: 1116215 - RNA, 17 nt, Mycobacterium bovis subsp bovis AF2122/97
gaccucggcgaugucgc

SEQ ID NO: 1116216 - RNA, 20 nt, Mycobacterium bovis subsp bovis AF2122/97
gaccucgucaaucaccaccg

SEQ ID NO: 1116217 - RNA, 21 nt, Mycobacterium bovis subsp bovis AF2122/97
gaccucgucaaucaccaccgc

SEQ ID NO: 1116218 - RNA, 15 nt, Mycobacterium bovis subsp bovis AF2122/97
gaccucggcggcggc

SEQ ID NO: 1116219 - RNA, 18 nt, Mycobacterium bovis subsp bovis AF2122/97
gaccucggcggcggcacg

SEQ ID NO: 1116220 - RNA, 20 nt, Mycobacterium bovis subsp bovis AF2122/97
gaccucgugguucugcaggu

SEQ ID NO: 1116221 - RNA, 20 nt, Mycobacterium bovis subsp bovis AF2122/97
gaccucgucggccgacaccg

SEQ ID NO: 1116222 - RNA, 16 nt, Mycobacterium bovis subsp bovis AF2122/97
gaccucgggaucggcg

SEQ ID NO: 1116223 - RNA, 19 nt, Mycobacterium bovis subsp bovis AF2122/97
gaccucucugcgccaggcg

SEQ ID NO: 1116224 - RNA, 22 nt, Mycobacterium bovis subsp bovis AF2122/97
gaccucucugcgccaggcggca

SEQ ID NO: 1116225 - RNA, 17 nt, Mycobacterium bovis subsp bovis AF2122/97
gaccucguucgucacca

SEQ ID NO: 1116226 - RNA, 17 nt, Mycobacterium bovis subsp bovis AF2122/97
gaccucguugcugccgg

SEQ ID NO: 1116227 - RNA, 16 nt, Mycobacterium bovis subsp bovis AF2122/97
gaccucugcguccagc

SEQ ID NO: 1116228 - RNA, 16 nt, Mycobacterium bovis subsp bovis AF2122/97
gaccucuucgggcagc

SEQ ID NO: 1116229 - RNA, 13 nt, Mycobacterium bovis subsp bovis AF2122/97
gaccucuugcccu

SEQ ID NO: 1116230 - RNA, 14 nt, Mycobacterium bovis subsp bovis AF2122/97
gaccugaccggugg

SEQ ID NO: 1116231 - RNA, 18 nt, Mycobacterium bovis subsp bovis AF2122/97
gaccugaccgguggccau

SEQ ID NO: 1116232 - RNA, 15 nt, Mycobacterium bovis subsp bovis AF2122/97
gaccugacgcucggu

SEQ ID NO: 1116233 - RNA, 17 nt, Mycobacterium bovis subsp bovis AF2122/97
gaccugauccggccggu

SEQ ID NO: 1116234 - RNA, 19 nt, Mycobacterium bovis subsp bovis AF2122/97
gaccuggacaaccucgucg

SEQ ID NO: 1116235 - RNA, 22 nt, Mycobacterium bovis subsp bovis AF2122/97
gaccuggacaaccucgucgauc

SEQ ID NO: 1116236 - RNA, 17 nt, Mycobacterium bovis subsp bovis AF2122/97
gaccuggaugggcucga

SEQ ID NO: 1116237 - RNA, 19 nt, Mycobacterium bovis subsp bovis AF2122/97
gaccuggaugggcucgacg

SEQ ID NO: 1116238 - RNA, 21 nt, Mycobacterium bovis subsp bovis AF2122/97
gaccuggccgcccgcugcggc

SEQ ID NO: 1116239 - RNA, 19 nt, Mycobacterium bovis subsp bovis AF2122/97
gaccgugcgucgauggcgu

SEQ ID NO: 1116240 - RNA, 18 nt, Mycobacterium bovis subsp bovis AF2122/97
gaccgugcugggcgccgc

SEQ ID NO: 1116241 - RNA, 21 nt, Mycobacterium bovis subsp bovis AF2122/97
gaccgugacguaucgccgcgg

SEQ ID NO: 1116242 - RNA, 14 nt, Mycobacterium bovis subsp bovis AF2122/97
gaccgugccgucgg

SEQ ID NO: 1116243 - RNA, 16 nt, Mycobacterium bovis subsp bovis AF2122/97
gaccgugccgucggcg

SEQ ID NO: 1116244 - RNA, 20 nt, Mycobacterium bovis subsp bovis AF2122/97
gaccgugccgucggcgugca

SEQ ID NO: 1116245 - RNA, 13 nt, Mycobacterium bovis subsp bovis AF2122/97
gaccguggcgccg

SEQ ID NO: 1116246 - RNA, 21 nt, Mycobacterium bovis subsp bovis AF2122/97
gaccguggcgccggucgccgg

SEQ ID NO: 1116247 - RNA, 23 nt, Mycobacterium bovis subsp bovis AF2122/97
gaccguggcggggaaaccggcca

SEQ ID NO: 1116248 - RNA, 12 nt, Mycobacterium bovis subsp bovis AF2122/97
gaccguucggcg

SEQ ID NO: 1116249 - RNA, 21 nt, Mycobacterium bovis subsp bovis AF2122/97
gaccguucguucccgcucggg

SEQ ID NO: 1116250 - RNA, 15 nt, Mycobacterium bovis subsp bovis AF2122/97
gaccguggcggccuc

SEQ ID NO: 1116251 - RNA, 15 nt, Mycobacterium bovis subsp bovis AF2122/97
gaccguggcggggaa

SEQ ID NO: 1116252 - RNA, 17 nt, Mycobacterium bovis subsp bovis AF2122/97
gaccgucuuuggugccg

SEQ ID NO: 1116253 - RNA, 21 nt, Mycobacterium bovis subsp bovis AF2122/97
gaccgucuuuggugccgagca

SEQ ID NO: 1116254 - RNA, 14 nt, Mycobacterium bovis subsp bovis AF2122/97
gaccgugaucagcg

SEQ ID NO: 1116255 - RNA, 15 nt, Mycobacterium bovis subsp bovis AF2122/97
gaccgugaucagcgc

SEQ ID NO: 1116256 - RNA, 17 nt, Mycobacterium bovis subsp bovis AF2122/97
gaccguauagccgacgc

SEQ ID NO: 1116257 - RNA, 17 nt, Mycobacterium bovis subsp bovis AF2122/97
gaccgggucgccgauga

SEQ ID NO: 1116258 - RNA, 16 nt, Mycobacterium bovis subsp bovis AF2122/97
gaccguauugaccagc

SEQ ID NO: 1116259 - RNA, 14 nt, Mycobacterium bovis subsp bovis AF2122/97
gaccuggccgucgc

SEQ ID NO: 1116260 - RNA, 19 nt, Mycobacterium bovis subsp bovis AF2122/97
gaccuggccgucgcuggug

SEQ ID NO: 1116261 - RNA, 19 nt, Mycobacterium bovis subsp bovis AF2122/97
gaccuggcggugccggcgg

SEQ ID NO: 1116262 - RNA, 24 nt, Mycobacterium bovis subsp bovis AF2122/97
gaccuggcggugccggcggcgcau

SEQ ID NO: 1116263 - RNA, 21 nt, Mycobacterium bovis subsp bovis AF2122/97
gaccugggcgacuaccggcuc

SEQ ID NO: 1116264 - RNA, 15 nt, Mycobacterium bovis subsp bovis AF2122/97
gaccuucucgucggc

SEQ ID NO: 1116265 - RNA, 19 nt, Mycobacterium bovis subsp bovis AF2122/97
gaccuucucgucggccagu

SEQ ID NO: 1116266 - RNA, 21 nt, Mycobacterium bovis subsp bovis AF2122/97
gaccuucucgucggccagugc

SEQ ID NO: 1116267 - RNA, 22 nt, Mycobacterium bovis subsp bovis AF2122/97
gaccuucgagccgcacaaacgg

SEQ ID NO: 1116268 - RNA, 16 nt, Mycobacterium bovis subsp bovis AF2122/97
gaccuugacccgcaag

SEQ ID NO: 1116269 - RNA, 14 nt, Mycobacterium bovis subsp bovis AF2122/97
gaccuugccggugg

SEQ ID NO: 1116270 - RNA, 15 nt, Mycobacterium bovis subsp bovis AF2122/97
gaccuuggccgugcc

SEQ ID NO: 1116271 - RNA, 18 nt, Mycobacterium bovis subsp bovis AF2122/97
gaccugggacaguucgcg

SEQ ID NO: 1116272 - RNA, 13 nt, Mycobacterium bovis subsp bovis AF2122/97
gaccuucggcccg

SEQ ID NO: 1116273 - RNA, 21 nt, Mycobacterium bovis subsp bovis AF2122/97
gacgaaguagccgaccauggu

SEQ ID NO: 1116274 - RNA, 14 nt, Mycobacterium bovis subsp bovis AF2122/97
gacgaaggcgacgg

SEQ ID NO: 1116275 - RNA, 19 nt, Mycobacterium bovis subsp bovis AF2122/97
gacgaacccaccgugccgg

SEQ ID NO: 1116276 - RNA, 14 nt, Mycobacterium bovis subsp bovis AF2122/97
gacgaacaccucgg

SEQ ID NO: 1116277 - RNA, 14 nt, Mycobacterium bovis subsp bovis AF2122/97
gacgaacaccagcg

SEQ ID NO: 1116278 - RNA, 20 nt, Mycobacterium bovis subsp bovis AF2122/97
gacgaacaacgcgacgaagc

SEQ ID NO: 1116279 - RNA, 23 nt, Mycobacterium bovis subsp bovis AF2122/97
gacgaacaccccgggcgccgauc

SEQ ID NO: 1116280 - RNA, 23 nt, Mycobacterium bovis subsp bovis AF2122/97
gaccuuguuggccauguccacca

SEQ ID NO: 1116281 - RNA, 16 nt, Mycobacterium bovis subsp bovis AF2122/97
gaccuugcaccggccg

SEQ ID NO: 1116282 - RNA, 18 nt, Mycobacterium bovis subsp bovis AF2122/97
gacgaacaacgcgacgaa

SEQ ID NO: 1116283 - RNA, 13 nt, Mycobacterium bovis subsp bovis AF2122/97
gacgaaauccgcc

SEQ ID NO: 1116284 - RNA, 15 nt, Mycobacterium bovis subsp bovis AF2122/97
gacgaaacccgaaau

SEQ ID NO: 1116285 - RNA, 16 nt, Mycobacterium bovis subsp bovis AF2122/97
gacgaaaucggcggcg

SEQ ID NO: 1116286 - RNA, 17 nt, Mycobacterium bovis subsp bovis AF2122/97
gacgaaacggccgggca

SEQ ID NO: 1116287 - RNA, 15 nt, Mycobacterium bovis subsp bovis AF2122/97
gacgcuggucggcgg

SEQ ID NO: 1116288 - RNA, 16 nt, Mycobacterium bovis subsp bovis AF2122/97
gacgcuggucggcggc

SEQ ID NO: 1116289 - RNA, 17 nt, Mycobacterium bovis subsp bovis AF2122/97
gacgcuggucggcggcu

SEQ ID NO: 1116290 - RNA, 15 nt, Mycobacterium bovis subsp bovis AF2122/97
gacggaguuggcccg

SEQ ID NO: 1116291 - RNA, 18 nt, Mycobacterium bovis subsp bovis AF2122/97
gacggaguuggcccgacg

SEQ ID NO: 1116292 - RNA, 22 nt, Mycobacterium bovis subsp bovis AF2122/97
gacggaguuggcccgacgcagc

SEQ ID NO: 1116293 - RNA, 17 nt, Mycobacterium bovis subsp bovis AF2122/97
gacggaguucgacgucg

SEQ ID NO: 1116294 - RNA, 17 nt, Mycobacterium bovis subsp bovis AF2122/97
gacggacuucccgcgcg

SEQ ID NO: 1116295 - RNA, 14 nt, Mycobacterium bovis subsp bovis AF2122/97
gacggagcccaaaa

SEQ ID NO: 1116296 - RNA, 18 nt, Mycobacterium bovis subsp bovis AF2122/97
gacggaaucgucggcgcg

SEQ ID NO: 1116297 - RNA, 19 nt, Mycobacterium bovis subsp bovis AF2122/97
gacggaaucgucggcgcgg

SEQ ID NO: 1116298 - RNA, 20 nt, Mycobacterium bovis subsp bovis AF2122/97
gacggaaucgucggcgcggc

SEQ ID NO: 1116299 - RNA, 19 nt, Mycobacterium bovis subsp bovis AF2122/97
gacggaaugucagccgguu

SEQ ID NO: 1116300 - RNA, 15 nt, Mycobacterium bovis subsp bovis AF2122/97
gacgcuggccacgau

SEQ ID NO: 1116301 - RNA, 22 nt, Mycobacterium bovis subsp bovis AF2122/97
gacgcugcucuggacggucauc

SEQ ID NO: 1116302 - RNA, 22 nt, Mycobacterium bovis subsp bovis AF2122/97
gacgcuggcgguguagccgcgg

SEQ ID NO: 1116303 - RNA, 22 nt, Mycobacterium bovis subsp bovis AF2122/97
gacgcugccgguguaggccucg

SEQ ID NO: 1116304 - RNA, 22 nt, Mycobacterium bovis subsp bovis AF2122/97
gacgcugcgcgccagacacaac

SEQ ID NO: 1116305 - RNA, 22 nt, Mycobacterium bovis subsp bovis AF2122/97
gacgcugcccaaaagcgcggca

SEQ ID NO: 1116306 - RNA, 12 nt, Mycobacterium bovis subsp bovis AF2122/97
gacgcucugcga

SEQ ID NO: 1116307 - RNA, 16 nt, Mycobacterium bovis subsp bovis AF2122/97
gacgcggucggcggcc

SEQ ID NO: 1116308 - RNA, 20 nt, Mycobacterium bovis subsp bovis AF2122/97
gacgcggggcucaaccccgu

SEQ ID NO: 1116309 - RNA, 21 nt, Mycobacterium bovis subsp bovis AF2122/97
gacgcggucaucgagcugacc

SEQ ID NO: 1116310 - RNA, 14 nt, Mycobacterium bovis subsp bovis AF2122/97
gacgcgggccgacc

SEQ ID NO: 1116311 - RNA, 23 nt, Mycobacterium bovis subsp bovis AF2122/97
gacgcucggcuauggguucgcgg

SEQ ID NO: 1116312 - RNA, 20 nt, Mycobacterium bovis subsp bovis AF2122/97
gacgcucggucgccaccgcc

SEQ ID NO: 1116313 - RNA, 16 nt, Mycobacterium bovis subsp bovis AF2122/97
gacgcucgcugcagca

SEQ ID NO: 1116314 - RNA, 24 nt, Mycobacterium bovis subsp bovis AF2122/97
gacgcuccgggaauggcgaccacc

SEQ ID NO: 1116315 - RNA, 15 nt, Mycobacterium bovis subsp bovis AF2122/97
gacgcgucagcggcg

SEQ ID NO: 1116316 - RNA, 16 nt, Mycobacterium bovis subsp bovis AF2122/97
gacgcgucagcggcga

SEQ ID NO: 1116317 - RNA, 18 nt, Mycobacterium bovis subsp bovis AF2122/97
gacgcgcagcaucggcga

SEQ ID NO: 1116318 - RNA, 20 nt, Mycobacterium bovis subsp bovis AF2122/97
gacgcgcagcaucggcgaca

SEQ ID NO: 1116319 - RNA, 12 nt, Mycobacterium bovis subsp bovis AF2122/97
gacgccgucagc

SEQ ID NO: 1116320 - RNA, 19 nt, Mycobacterium bovis subsp bovis AF2122/97
gacgccgguccccgccggc

SEQ ID NO: 1116321 - RNA, 15 nt, Mycobacterium bovis subsp bovis AF2122/97
gacgcgcaucgcacg

SEQ ID NO: 1116322 - RNA, 16 nt, Mycobacterium bovis subsp bovis AF2122/97
gacgcgcaucgcacgg

SEQ ID NO: 1116323 - RNA, 22 nt, Mycobacterium bovis subsp bovis AF2122/97
gacgcgcauucgccgggcggca

SEQ ID NO: 1116324 - RNA, 16 nt, Mycobacterium bovis subsp bovis AF2122/97
gacgcgcaugccccga

SEQ ID NO: 1116325 - RNA, 16 nt, Mycobacterium bovis subsp bovis AF2122/97
gacgcgcauucgccgg

SEQ ID NO: 1116326 - RNA, 23 nt, Mycobacterium bovis subsp bovis AF2122/97
gacgacaaccggccagauggugg

SEQ ID NO: 1116327 - RNA, 16 nt, Mycobacterium bovis subsp bovis AF2122/97
gacgacaagugcccgg

SEQ ID NO: 1116328 - RNA, 21 nt, Mycobacterium bovis subsp bovis AF2122/97
gacgacaagugcccggccaac

SEQ ID NO: 1116329 - RNA, 12 nt, Mycobacterium bovis subsp bovis AF2122/97
gacgcagcucgu

SEQ ID NO: 1116330 - RNA, 21 nt, Mycobacterium bovis subsp bovis AF2122/97
gacgcagcuugcccgacggcg

SEQ ID NO: 1116331 - RNA, 12 nt, Mycobacterium bovis subsp bovis AF2122/97
gacgaaucccgc

SEQ ID NO: 1116332 - RNA, 21 nt, Mycobacterium bovis subsp bovis AF2122/97
gacgcagagucgcacugcgcc

SEQ ID NO: 1116333 - RNA, 20 nt, Mycobacterium bovis subsp bovis AF2122/97
gacgacaaacggcgacccag

SEQ ID NO: 1116334 - RNA, 16 nt, Mycobacterium bovis subsp bovis AF2122/97
gacgacaacagccagc

SEQ ID NO: 1116335 - RNA, 16 nt, Mycobacterium bovis subsp bovis AF2122/97
gacgacaacaggccgu

SEQ ID NO: 1116336 - RNA, 15 nt, Mycobacterium bovis subsp bovis AF2122/97
gacgacaaacggcga

SEQ ID NO: 1116337 - RNA, 20 nt, Mycobacterium bovis subsp bovis AF2122/97
gacgccauucaucggcaucg

SEQ ID NO: 1116338 - RNA, 21 nt, Mycobacterium bovis subsp bovis AF2122/97
gacgccaugagcgcgcccaac

SEQ ID NO: 1116339 - RNA, 14 nt, Mycobacterium bovis subsp bovis AF2122/97
gacgccaugcccgc

SEQ ID NO: 1116340 - RNA, 17 nt, Mycobacterium bovis subsp bovis AF2122/97
gacgccaugcccgcacg

SEQ ID NO: 1116341 - RNA, 14 nt, Mycobacterium bovis subsp bovis AF2122/97
gacgcccaccgaca

SEQ ID NO: 1116342 - RNA, 17 nt, Mycobacterium bovis subsp bovis AF2122/97
gacgccaugucgauguc

SEQ ID NO: 1116343 - RNA, 17 nt, Mycobacterium bovis subsp bovis AF2122/97
gacgccauucaucggca

SEQ ID NO: 1116344 - RNA, 21 nt, Mycobacterium bovis subsp bovis AF2122/97
gacgcauaagcccccgacacg

SEQ ID NO: 1116345 - RNA, 22 nt, Mycobacterium bovis subsp bovis AF2122/97
gacgaaucccgcgcccggccgg

SEQ ID NO: 1116346 - RNA, 21 nt, Mycobacterium bovis subsp bovis AF2122/97
gacgcaggugaacgccggugc

SEQ ID NO: 1116347 - RNA, 16 nt, Mycobacterium bovis subsp bovis AF2122/97
gacgcagugcccgauc

SEQ ID NO: 1116348 - RNA, 15 nt, Mycobacterium bovis subsp bovis AF2122/97
gacgcauaaccggcg

SEQ ID NO: 1116349 - RNA, 17 nt, Mycobacterium bovis subsp bovis AF2122/97
gacgcauaaccggcgcg

SEQ ID NO: 1116350 - RNA, 17 nt, Mycobacterium bovis subsp bovis AF2122/97
gacgcaugggucauggc

SEQ ID NO: 1116351 - RNA, 15 nt, Mycobacterium bovis subsp bovis AF2122/97
gacgccggccagcgg

SEQ ID NO: 1116352 - RNA, 15 nt, Mycobacterium bovis subsp bovis AF2122/97
gacgccggcgccgcc

SEQ ID NO: 1116353 - RNA, 16 nt, Mycobacterium bovis subsp bovis AF2122/97
gacgccggcgccgcca

SEQ ID NO: 1116354 - RNA, 16 nt, Mycobacterium bovis subsp bovis AF2122/97
gacgccggccagcggc

SEQ ID NO: 1116355 - RNA, 13 nt, Mycobacterium bovis subsp bovis AF2122/97
gacgccggccagu

SEQ ID NO: 1116356 - RNA, 21 nt, Mycobacterium bovis subsp bovis AF2122/97
gacgccggccuggccgccaga

SEQ ID NO: 1116357 - RNA, 12 nt, Mycobacterium bovis subsp bovis AF2122/97
gacgccgguggc

SEQ ID NO: 1116358 - RNA, 23 nt, Mycobacterium bovis subsp bovis AF2122/97
gacgccgguggcagagccgccgu

SEQ ID NO: 1116359 - RNA, 16 nt, Mycobacterium bovis subsp bovis AF2122/97
gacgccggucacggca

SEQ ID NO: 1116360 - RNA, 12 nt, Mycobacterium bovis subsp bovis AF2122/97
gacgccgguccc

SEQ ID NO: 1116361 - RNA, 19 nt, Mycobacterium bovis subsp bovis AF2122/97
gacgccgaugugcucgguu

SEQ ID NO: 1116362 - RNA, 19 nt, Mycobacterium bovis subsp bovis AF2122/97
gacgccgaucgcggcggcc

SEQ ID NO: 1116363 - RNA, 18 nt, Mycobacterium bovis subsp bovis AF2122/97
gacgccgagcugguugac

SEQ ID NO: 1116364 - RNA, 18 nt, Mycobacterium bovis subsp bovis AF2122/97
gacgccccgaucggccac

SEQ ID NO: 1116365 - RNA, 19 nt, Mycobacterium bovis subsp bovis AF2122/97
gacgccccgaucggccacc

SEQ ID NO: 1116366 - RNA, 22 nt, Mycobacterium bovis subsp bovis AF2122/97
gacgccccgucuggcaugaccg

SEQ ID NO: 1116367 - RNA, 19 nt, Mycobacterium bovis subsp bovis AF2122/97
gacgcccgauacgccaccg

SEQ ID NO: 1116368 - RNA, 14 nt, Mycobacterium bovis subsp bovis AF2122/97
gacgcccgccaccg

SEQ ID NO: 1116369 - RNA, 13 nt, Mycobacterium bovis subsp bovis AF2122/97
gacgcccgcccgc

SEQ ID NO: 1116370 - RNA, 16 nt, Mycobacterium bovis subsp bovis AF2122/97
gacgcccgcccgcacg

SEQ ID NO: 1116371 - RNA, 17 nt, Mycobacterium bovis subsp bovis AF2122/97
gacgccccgaucggcca

SEQ ID NO: 1116372 - RNA, 17 nt, Mycobacterium bovis subsp bovis AF2122/97
gacgcccgggcaccggc

SEQ ID NO: 1116373 - RNA, 18 nt, Mycobacterium bovis subsp bovis AF2122/97
gacgcccggcgcaccauc

SEQ ID NO: 1116374 - RNA, 14 nt, Mycobacterium bovis subsp bovis AF2122/97
gacgcccucggcga

SEQ ID NO: 1116375 - RNA, 16 nt, Mycobacterium bovis subsp bovis AF2122/97
gacgccgaccacccgg

SEQ ID NO: 1116376 - RNA, 17 nt, Mycobacterium bovis subsp bovis AF2122/97
gacgccgagaccgccgc

SEQ ID NO: 1116377 - RNA, 19 nt, Mycobacterium bovis subsp bovis AF2122/97
gacgccgaaaaugccgccc

SEQ ID NO: 1116378 - RNA, 20 nt, Mycobacterium bovis subsp bovis AF2122/97
gacgcccucggcgaccuggc

SEQ ID NO: 1116379 - RNA, 18 nt, Mycobacterium bovis subsp bovis AF2122/97
gacgguggggauggcgcc

SEQ ID NO: 1116380 - RNA, 22 nt, Mycobacterium bovis subsp bovis AF2122/97
gacgguggggucgccgucgaac

SEQ ID NO: 1116381 - RNA, 17 nt, Mycobacterium bovis subsp bovis AF2122/97
gacggucgucgaucacg

SEQ ID NO: 1116382 - RNA, 19 nt, Mycobacterium bovis subsp bovis AF2122/97
gacgguguagccgccggca

SEQ ID NO: 1116383 - RNA, 20 nt, Mycobacterium bovis subsp bovis AF2122/97
gacggugucuugggcguccu

SEQ ID NO: 1116384 - RNA, 17 nt, Mycobacterium bovis subsp bovis AF2122/97
gacgguguggaaaccgc

SEQ ID NO: 1116385 - RNA, 18 nt, Mycobacterium bovis subsp bovis AF2122/97
gacgguguuggugaccgg

SEQ ID NO: 1116386 - RNA, 15 nt, Mycobacterium bovis subsp bovis AF2122/97
gacggucccggcacg

SEQ ID NO: 1116387 - RNA, 14 nt, Mycobacterium bovis subsp bovis AF2122/97
gacggucauccggc

SEQ ID NO: 1116388 - RNA, 18 nt, Mycobacterium bovis subsp bovis AF2122/97
gacgguccguucgcgccg

SEQ ID NO: 1116389 - RNA, 16 nt, Mycobacterium bovis subsp bovis AF2122/97
gacgguccuggcccgc

SEQ ID NO: 1116390 - RNA, 23 nt, Mycobacterium bovis subsp bovis AF2122/97
gacggucauccggccgucggcgg

SEQ ID NO: 1116391 - RNA, 23 nt, Mycobacterium bovis subsp bovis AF2122/97
gacggucaucgcuguaggcagcc

SEQ ID NO: 1116392 - RNA, 20 nt, Mycobacterium bovis subsp bovis AF2122/97
gacgguccgcuacggcgucc

SEQ ID NO: 1116393 - RNA, 21 nt, Mycobacterium bovis subsp bovis AF2122/97
gacgguggcgccgucggccga

SEQ ID NO: 1116394 - RNA, 13 nt, Mycobacterium bovis subsp bovis AF2122/97
gacgguggccggc

SEQ ID NO: 1116395 - RNA, 14 nt, Mycobacterium bovis subsp bovis AF2122/97
gacgguggccggca

SEQ ID NO: 1116396 - RNA, 14 nt, Mycobacterium bovis subsp bovis AF2122/97
gacggucgucgauc

SEQ ID NO: 1116397 - RNA, 16 nt, Mycobacterium bovis subsp bovis AF2122/97
gacggucggcggaaac

SEQ ID NO: 1116398 - RNA, 17 nt, Mycobacterium bovis subsp bovis AF2122/97
gacggucggcggaaaca

SEQ ID NO: 1116399 - RNA, 15 nt, Mycobacterium bovis subsp bovis AF2122/97
gacggucgcucggca

SEQ ID NO: 1116400 - RNA, 18 nt, Mycobacterium bovis subsp bovis AF2122/97
gacgguaaaugucgaaca

SEQ ID NO: 1116401 - RNA, 21 nt, Mycobacterium bovis subsp bovis AF2122/97
gacggucaaggugcgccgcca

SEQ ID NO: 1116402 - RNA, 12 nt, Mycobacterium bovis subsp bovis AF2122/97
gacggucagccg

SEQ ID NO: 1116403 - RNA, 16 nt, Mycobacterium bovis subsp bovis AF2122/97
gacggucagccgcggg

SEQ ID NO: 1116404 - RNA, 17 nt, Mycobacterium bovis subsp bovis AF2122/97
gacggucagccgcgggg

SEQ ID NO: 1116405 - RNA, 18 nt, Mycobacterium bovis subsp bovis AF2122/97
gacggucagccgcggggc

SEQ ID NO: 1116406 - RNA, 19 nt, Mycobacterium bovis subsp bovis AF2122/97
gacggucaccggcgcaccg

SEQ ID NO: 1116407 - RNA, 20 nt, Mycobacterium bovis subsp bovis AF2122/97
gacgggucguaggacaccac

SEQ ID NO: 1116408 - RNA, 16 nt, Mycobacterium bovis subsp bovis AF2122/97
gacgggugcgggccga

SEQ ID NO: 1116409 - RNA, 13 nt, Mycobacterium bovis subsp bovis AF2122/97
gacgggucggcgc

SEQ ID NO: 1116410 - RNA, 16 nt, Mycobacterium bovis subsp bovis AF2122/97
gacgggucggcgccga

SEQ ID NO: 1116411 - RNA, 23 nt, Mycobacterium bovis subsp bovis AF2122/97
gacgggucggcgccgagcagccc

SEQ ID NO: 1116412 - RNA, 19 nt, Mycobacterium bovis subsp bovis AF2122/97
gacgggugcgggccgaaca

SEQ ID NO: 1116413 - RNA, 16 nt, Mycobacterium bovis subsp bovis AF2122/97
gacggguggcccgacc

SEQ ID NO: 1116414 - RNA, 16 nt, Mycobacterium bovis subsp bovis AF2122/97
gacggcugccgucagc

SEQ ID NO: 1116415 - RNA, 16 nt, Mycobacterium bovis subsp bovis AF2122/97
gacggcugcgccgaac

SEQ ID NO: 1116416 - RNA, 15 nt, Mycobacterium bovis subsp bovis AF2122/97
gacgggguugaccgc

SEQ ID NO: 1116417 - RNA, 16 nt, Mycobacterium bovis subsp bovis AF2122/97
gacgggguugaccgcc

SEQ ID NO: 1116418 - RNA, 19 nt, Mycobacterium bovis subsp bovis AF2122/97
gacgggguugaccgccacc

SEQ ID NO: 1116419 - RNA, 23 nt, Mycobacterium bovis subsp bovis AF2122/97
gacgggguugaccgccaccccgg

SEQ ID NO: 1116420 - RNA, 15 nt, Mycobacterium bovis subsp bovis AF2122/97
gacgggucgccgcca

SEQ ID NO: 1116421 - RNA, 17 nt, Mycobacterium bovis subsp bovis AF2122/97
gacgggucgccgccauc

SEQ ID NO: 1116422 - RNA, 13 nt, Mycobacterium bovis subsp bovis AF2122/97
gacggcaccggcc

SEQ ID NO: 1116423 - RNA, 16 nt, Mycobacterium bovis subsp bovis AF2122/97
gacggcaccggcccag

SEQ ID NO: 1116424 - RNA, 18 nt, Mycobacterium bovis subsp bovis AF2122/97
gacggcggcaacggcggu

SEQ ID NO: 1116425 - RNA, 18 nt, Mycobacterium bovis subsp bovis AF2122/97
gacggcggcaagggcggc

SEQ ID NO: 1116426 - RNA, 21 nt, Mycobacterium bovis subsp bovis AF2122/97
gacggcggcaagggcggcaac

SEQ ID NO: 1116427 - RNA, 22 nt, Mycobacterium bovis subsp bovis AF2122/97
gacggcggcaagggcggcaacg

SEQ ID NO: 1116428 - RNA, 12 nt, Mycobacterium bovis subsp bovis AF2122/97
gacggcggcagu

SEQ ID NO: 1116429 - RNA, 12 nt, Mycobacterium bovis subsp bovis AF2122/97
gacggcggccaa

SEQ ID NO: 1116430 - RNA, 22 nt, Mycobacterium bovis subsp bovis AF2122/97
gacggcggccacguggucggcg

SEQ ID NO: 1116431 - RNA, 20 nt, Mycobacterium bovis subsp bovis AF2122/97
gacggcggccuucggccggc

SEQ ID NO: 1116432 - RNA, 14 nt, Mycobacterium bovis subsp bovis AF2122/97
gacggcggccgcga

SEQ ID NO: 1116433 - RNA, 15 nt, Mycobacterium bovis subsp bovis AF2122/97
gacggcggccgcgau

SEQ ID NO: 1116434 - RNA, 21 nt, Mycobacterium bovis subsp bovis AF2122/97
gacggcaaaacacaccgaaca

SEQ ID NO: 1116435 - RNA, 23 nt, Mycobacterium bovis subsp bovis AF2122/97
gacggcaaaccaguuggcgauca

SEQ ID NO: 1116436 - RNA, 17 nt, Mycobacterium bovis subsp bovis AF2122/97
gacggcaaacgacauca

SEQ ID NO: 1116437 - RNA, 22 nt, Mycobacterium bovis subsp bovis AF2122/97
gacggcacccgacucgucggcc

SEQ ID NO: 1116438 - RNA, 16 nt, Mycobacterium bovis subsp bovis AF2122/97
gacggcacccccgacg

SEQ ID NO: 1116439 - RNA, 17 nt, Mycobacterium bovis subsp bovis AF2122/97
gacggcacccccgacga

SEQ ID NO: 1116440 - RNA, 16 nt, Mycobacterium bovis subsp bovis AF2122/97
gacggcaaugcggggc

SEQ ID NO: 1116441 - RNA, 14 nt, Mycobacterium bovis subsp bovis AF2122/97
gacggaucgucgug

SEQ ID NO: 1116442 - RNA, 21 nt, Mycobacterium bovis subsp bovis AF2122/97
gacggauuacaugucacaccc

SEQ ID NO: 1116443 - RNA, 17 nt, Mycobacterium bovis subsp bovis AF2122/97
gacggaucgcccugaca

SEQ ID NO: 1116444 - RNA, 16 nt, Mycobacterium bovis subsp bovis AF2122/97
gacggaugaucagcga

SEQ ID NO: 1116445 - RNA, 17 nt, Mycobacterium bovis subsp bovis AF2122/97
gacggcgguaccgccgc

SEQ ID NO: 1116446 - RNA, 17 nt, Mycobacterium bovis subsp bovis AF2122/97
gacggcggggcggcggu

SEQ ID NO: 1116447 - RNA, 21 nt, Mycobacterium bovis subsp bovis AF2122/97
gacggcggggcggcggugggc

SEQ ID NO: 1116448 - RNA, 13 nt, Mycobacterium bovis subsp bovis AF2122/97
gacggcgggccgc

SEQ ID NO: 1116449 - RNA, 17 nt, Mycobacterium bovis subsp bovis AF2122/97
gacggcgggccgcgcgg

SEQ ID NO: 1116450 - RNA, 18 nt, Mycobacterium bovis subsp bovis AF2122/97
gacggcgggccgcgcggc

SEQ ID NO: 1116451 - RNA, 12 nt, Mycobacterium bovis subsp bovis AF2122/97
gacggcgucgac

SEQ ID NO: 1116452 - RNA, 22 nt, Mycobacterium bovis subsp bovis AF2122/97
gacggcgucgaguaguucgucg

SEQ ID NO: 1116453 - RNA, 15 nt, Mycobacterium bovis subsp bovis AF2122/97
gacggcucagcgugc

SEQ ID NO: 1116454 - RNA, 16 nt, Mycobacterium bovis subsp bovis AF2122/97
gacggcguugauccgc

SEQ ID NO: 1116455 - RNA, 15 nt, Mycobacterium bovis subsp bovis AF2122/97
gacggcuaccaccgc

SEQ ID NO: 1116456 - RNA, 22 nt, Mycobacterium bovis subsp bovis AF2122/97
gacggcuaccaccgcaccugcg

SEQ ID NO: 1116457 - RNA, 19 nt, Mycobacterium bovis subsp bovis AF2122/97
gacggggcugaccgccacc

SEQ ID NO: 1116458 - RNA, 23 nt, Mycobacterium bovis subsp bovis AF2122/97
gacggggcugaccgccaccccgc

SEQ ID NO: 1116459 - RNA, 19 nt, Mycobacterium bovis subsp bovis AF2122/97
gacggggucgcccggggcg

SEQ ID NO: 1116460 - RNA, 20 nt, Mycobacterium bovis subsp bovis AF2122/97
gacggggucgcccggggcgc

SEQ ID NO: 1116461 - RNA, 13 nt, Mycobacterium bovis subsp bovis AF2122/97
gacggggucgcga

SEQ ID NO: 1116462 - RNA, 19 nt, Mycobacterium bovis subsp bovis AF2122/97
gacggcugagacagaccgg

SEQ ID NO: 1116463 - RNA, 22 nt, Mycobacterium bovis subsp bovis AF2122/97
gacggcugagacagaccgggcc

SEQ ID NO: 1116464 - RNA, 15 nt, Mycobacterium bovis subsp bovis AF2122/97
gacggcugccacgcg

SEQ ID NO: 1116465 - RNA, 17 nt, Mycobacterium bovis subsp bovis AF2122/97
gacgugaccagcuucgg

SEQ ID NO: 1116466 - RNA, 15 nt, Mycobacterium bovis subsp bovis AF2122/97
gacguggcgccgaca

SEQ ID NO: 1116467 - RNA, 22 nt, Mycobacterium bovis subsp bovis AF2122/97
gacgugucaucacggucagccg

SEQ ID NO: 1116468 - RNA, 21 nt, Mycobacterium bovis subsp bovis AF2122/97
gacgugugagggccggguggc

SEQ ID NO: 1116469 - RNA, 20 nt, Mycobacterium bovis subsp bovis AF2122/97
gacguggcugcguucgccgg

SEQ ID NO: 1116470 - RNA, 19 nt, Mycobacterium bovis subsp bovis AF2122/97
gacguggaacugcagcggc

SEQ ID NO: 1116471 - RNA, 19 nt, Mycobacterium bovis subsp bovis AF2122/97
gacgugcggcgcggcgaca

SEQ ID NO: 1116472 - RNA, 17 nt, Mycobacterium bovis subsp bovis AF2122/97
gacgugcgucggcccgg

SEQ ID NO: 1116473 - RNA, 21 nt, Mycobacterium bovis subsp bovis AF2122/97
gacgugcgcgccaaguggcgc

SEQ ID NO: 1116474 - RNA, 15 nt, Mycobacterium bovis subsp bovis AF2122/97
gacgugcccugacgc

SEQ ID NO: 1116475 - RNA, 20 nt, Mycobacterium bovis subsp bovis AF2122/97
gacguuguagauucccgaga

SEQ ID NO: 1116476 - RNA, 17 nt, Mycobacterium bovis subsp bovis AF2122/97
gacguuggcgcgguugc

SEQ ID NO: 1116477 - RNA, 21 nt, Mycobacterium bovis subsp bovis AF2122/97
gacguuguccaccgccaccac

SEQ ID NO: 1116478 - RNA, 22 nt, Mycobacterium bovis subsp bovis AF2122/97
gacguugugccuuagcugccau

SEQ ID NO: 1116479 - RNA, 18 nt, Mycobacterium bovis subsp bovis AF2122/97
gacguuguccaccgccac

SEQ ID NO: 1116480 - RNA, 13 nt, Mycobacterium bovis subsp bovis AF2122/97
gacguugcagccg

SEQ ID NO: 1116481 - RNA, 15 nt, Mycobacterium bovis subsp bovis AF2122/97
gacguugcagccggc

SEQ ID NO: 1116482 - RNA, 17 nt, Mycobacterium bovis subsp bovis AF2122/97
gacguugccgaagccgg

SEQ ID NO: 1116483 - RNA, 19 nt, Mycobacterium bovis subsp bovis AF2122/97
gacguugcgaggccgcacg

SEQ ID NO: 1116484 - RNA, 20 nt, Mycobacterium bovis subsp bovis AF2122/97
gacguugcuggcuggguggc

SEQ ID NO: 1116485 - RNA, 15 nt, Mycobacterium bovis subsp bovis AF2122/97
gacguucgguggcga

SEQ ID NO: 1116486 - RNA, 21 nt, Mycobacterium bovis subsp bovis AF2122/97
gacguuagcauugaguucggc

SEQ ID NO: 1116487 - RNA, 19 nt, Mycobacterium bovis subsp bovis AF2122/97
gacgucgauuucggcgacc

SEQ ID NO: 1116488 - RNA, 19 nt, Mycobacterium bovis subsp bovis AF2122/97
gacguagauguugccgccc

SEQ ID NO: 1116489 - RNA, 19 nt, Mycobacterium bovis subsp bovis AF2122/97
gacguagauguugccgccu

SEQ ID NO: 1116490 - RNA, 14 nt, Mycobacterium bovis subsp bovis AF2122/97
gacguacugggcga

SEQ ID NO: 1116491 - RNA, 18 nt, Mycobacterium bovis subsp bovis AF2122/97
gacguagacgacgucggc

SEQ ID NO: 1116492 - RNA, 20 nt, Mycobacterium bovis subsp bovis AF2122/97
gacguagaaugcgccgucgg

SEQ ID NO: 1116493 - RNA, 15 nt, Mycobacterium bovis subsp bovis AF2122/97
gacguagaccgucga

SEQ ID NO: 1116494 - RNA, 21 nt, Mycobacterium bovis subsp bovis AF2122/97
gacguagaccgucgauccguc

SEQ ID NO: 1116495 - RNA, 16 nt, Mycobacterium bovis subsp bovis AF2122/97
gacguagacgacgucg

SEQ ID NO: 1116496 - RNA, 21 nt, Mycobacterium bovis subsp bovis AF2122/97
gacgucgccggacgacaacag

SEQ ID NO: 1116497 - RNA, 12 nt, Mycobacterium bovis subsp bovis AF2122/97
gacgucgccgac

SEQ ID NO: 1116498 - RNA, 14 nt, Mycobacterium bovis subsp bovis AF2122/97
gacgguuucgacca

SEQ ID NO: 1116499 - RNA, 16 nt, Mycobacterium bovis subsp bovis AF2122/97
gacgguuucgaccacc

SEQ ID NO: 1116500 - RNA, 18 nt, Mycobacterium bovis subsp bovis AF2122/97
gacgguugguccgccguc

SEQ ID NO: 1116501 - RNA, 21 nt, Mycobacterium bovis subsp bovis AF2122/97
gacgguucauccacuccgcca

SEQ ID NO: 1116502 - RNA, 16 nt, Mycobacterium bovis subsp bovis AF2122/97
gacgguuccgccaccg

SEQ ID NO: 1116503 - RNA, 17 nt, Mycobacterium bovis subsp bovis AF2122/97
gacgguuccgccaccgg

SEQ ID NO: 1116504 - RNA, 15 nt, Mycobacterium bovis subsp bovis AF2122/97
gacgguucggucggg

SEQ ID NO: 1116505 - RNA, 13 nt, Mycobacterium bovis subsp bovis AF2122/97
gacgguugagaug

SEQ ID NO: 1116506 - RNA, 15 nt, Mycobacterium bovis subsp bovis AF2122/97
gacgguugccccggc

SEQ ID NO: 1116507 - RNA, 17 nt, Mycobacterium bovis subsp bovis AF2122/97
gacguaccacggcgauc

SEQ ID NO: 1116508 - RNA, 21 nt, Mycobacterium bovis subsp bovis AF2122/97
gacguaaugcgcugccgccgu

SEQ ID NO: 1116509 - RNA, 19 nt, Mycobacterium bovis subsp bovis AF2122/97
gacguaaaagcccccauuu

SEQ ID NO: 1116510 - RNA, 18 nt, Mycobacterium bovis subsp bovis AF2122/97
gacgucggcaaucucgau

SEQ ID NO: 1116511 - RNA, 14 nt, Mycobacterium bovis subsp bovis AF2122/97
gacgucggcaucgg

SEQ ID NO: 1116512 - RNA, 23 nt, Mycobacterium bovis subsp bovis AF2122/97
gacgucgcuagaucccaguccga

SEQ ID NO: 1116513 - RNA, 14 nt, Mycobacterium bovis subsp bovis AF2122/97
gacgucggaccagc

SEQ ID NO: 1116514 - RNA, 22 nt, Mycobacterium bovis subsp bovis AF2122/97
gacgucgcggaguagccgcagc

SEQ ID NO: 1116515 - RNA, 24 nt, Mycobacterium bovis subsp bovis AF2122/97
gacgucgcggauugccgcgcgcaa

SEQ ID NO: 1116516 - RNA, 13 nt, Mycobacterium bovis subsp bovis AF2122/97
gacgucggcguag

SEQ ID NO: 1116517 - RNA, 22 nt, Mycobacterium bovis subsp bovis AF2122/97
gacgucuuggaacacggccgga

SEQ ID NO: 1116518 - RNA, 15 nt, Mycobacterium bovis subsp bovis AF2122/97
gacgucggcggccgu

SEQ ID NO: 1116519 - RNA, 19 nt, Mycobacterium bovis subsp bovis AF2122/97
gacgucggcaucggcggcg

SEQ ID NO: 1116520 - RNA, 12 nt, Mycobacterium bovis subsp bovis AF2122/97
gacgucggccgc

SEQ ID NO: 1116521 - RNA, 16 nt, Mycobacterium bovis subsp bovis AF2122/97
gacgucggccgcaucg

SEQ ID NO: 1116522 - RNA, 16 nt, Mycobacterium bovis subsp bovis AF2122/97
gacgugcagccgcagg

SEQ ID NO: 1116523 - RNA, 17 nt, Mycobacterium bovis subsp bovis AF2122/97
gacgugacgucguggcg

SEQ ID NO: 1116524 - RNA, 22 nt, Mycobacterium bovis subsp bovis AF2122/97
gacgugacgucguggcgcucgg

SEQ ID NO: 1116525 - RNA, 20 nt, Mycobacterium bovis subsp bovis AF2122/97
gacgugagggucaugucgau

SEQ ID NO: 1116526 - RNA, 21 nt, Mycobacterium bovis subsp bovis AF2122/97
gacgugaguuucaccacucgg

SEQ ID NO: 1116527 - RNA, 23 nt, Mycobacterium bovis subsp bovis AF2122/97
gacgucuuugacgaacuggucuc

SEQ ID NO: 1116528 - RNA, 14 nt, Mycobacterium bovis subsp bovis AF2122/97
gagcaccugggcgc

SEQ ID NO: 1116529 - RNA, 15 nt, Mycobacterium bovis subsp bovis AF2122/97
gagcaccugggcgcg

SEQ ID NO: 1116530 - RNA, 19 nt, Mycobacterium bovis subsp bovis AF2122/97
gagcaccucgaagugcagg

SEQ ID NO: 1116531 - RNA, 20 nt, Mycobacterium bovis subsp bovis AF2122/97
gagcacgcgcggcgucgugg

SEQ ID NO: 1116532 - RNA, 13 nt, Mycobacterium bovis subsp bovis AF2122/97
gagcacggcgcgg

SEQ ID NO: 1116533 - RNA, 20 nt, Mycobacterium bovis subsp bovis AF2122/97
gagcacggugagccgguggc

SEQ ID NO: 1116534 - RNA, 15 nt, Mycobacterium bovis subsp bovis AF2122/97
gagcagacgcaaaau

SEQ ID NO: 1116535 - RNA, 19 nt, Mycobacterium bovis subsp bovis AF2122/97
gagcagacgcaaaaucccc

SEQ ID NO: 1116536 - RNA, 21 nt, Mycobacterium bovis subsp bovis AF2122/97
gagcagacgcaaaaucgcacg

SEQ ID NO: 1116537 - RNA, 21 nt, Mycobacterium bovis subsp bovis AF2122/97
gagcagacgcaaaaucgccca

SEQ ID NO: 1116538 - RNA, 19 nt, Mycobacterium bovis subsp bovis AF2122/97
gagcagacgcaaaagcccc

SEQ ID NO: 1116539 - RNA, 21 nt, Mycobacterium bovis subsp bovis AF2122/97
gagcagacgcaaaagcccccu

SEQ ID NO: 1116540 - RNA, 21 nt, Mycobacterium bovis subsp bovis AF2122/97
gagcacugggcuggccagcac

SEQ ID NO: 1116541 - RNA, 21 nt, Mycobacterium bovis subsp bovis AF2122/97
gagcagacacagaaucgccca

SEQ ID NO: 1116542 - RNA, 12 nt, Mycobacterium bovis subsp bovis AF2122/97
gagcacgucggg

SEQ ID NO: 1116543 - RNA, 16 nt, Mycobacterium bovis subsp bovis AF2122/97
gagcacguucaccgcg

SEQ ID NO: 1116544 - RNA, 13 nt, Mycobacterium bovis subsp bovis AF2122/97
gagcacuacccca

SEQ ID NO: 1116545 - RNA, 15 nt, Mycobacterium bovis subsp bovis AF2122/97
gagcacuaccccaca

SEQ ID NO: 1116546 - RNA, 16 nt, Mycobacterium bovis subsp bovis AF2122/97
gagcacuccgucguag

SEQ ID NO: 1116547 - RNA, 22 nt, Mycobacterium bovis subsp bovis AF2122/97
gagcaccuccagauacaggaac

SEQ ID NO: 1116548 - RNA, 13 nt, Mycobacterium bovis subsp bovis AF2122/97
gagcaccggcugc

SEQ ID NO: 1116549 - RNA, 21 nt, Mycobacterium bovis subsp bovis AF2122/97
gagcaccggauacagccacgc

SEQ ID NO: 1116550 - RNA, 23 nt, Mycobacterium bovis subsp bovis AF2122/97
gagcaccgcgcccuucagcacgg

SEQ ID NO: 1116551 - RNA, 22 nt, Mycobacterium bovis subsp bovis AF2122/97
gagcaccgacaccggccgcgac

SEQ ID NO: 1116552 - RNA, 23 nt, Mycobacterium bovis subsp bovis AF2122/97
gagcaccgacaccggccgcgacg

SEQ ID NO: 1116553 - RNA, 14 nt, Mycobacterium bovis subsp bovis AF2122/97
gagcaccgaccagg

SEQ ID NO: 1116554 - RNA, 13 nt, Mycobacterium bovis subsp bovis AF2122/97
gagcaccccgacg

SEQ ID NO: 1116555 - RNA, 17 nt, Mycobacterium bovis subsp bovis AF2122/97
gagcaccccgacguucg

SEQ ID NO: 1116556 - RNA, 20 nt, Mycobacterium bovis subsp bovis AF2122/97
gagcaccaccccagcggcca

SEQ ID NO: 1116557 - RNA, 13 nt, Mycobacterium bovis subsp bovis AF2122/97
gagcaccagcagc

SEQ ID NO: 1116558 - RNA, 17 nt, Mycobacterium bovis subsp bovis AF2122/97
gagcacaagauccgcca

SEQ ID NO: 1116559 - RNA, 22 nt, Mycobacterium bovis subsp bovis AF2122/97
gagcacacguccggcgaugacc

SEQ ID NO: 1116560 - RNA, 18 nt, Mycobacterium bovis subsp bovis AF2122/97
gagcaaugacccgcgggu

SEQ ID NO: 1116561 - RNA, 18 nt, Mycobacterium bovis subsp bovis AF2122/97
gagaucgcggcgacccgg

SEQ ID NO: 1116562 - RNA, 17 nt, Mycobacterium bovis subsp bovis AF2122/97
gagaucgucgacccacc

SEQ ID NO: 1116563 - RNA, 19 nt, Mycobacterium bovis subsp bovis AF2122/97
gagaucgucgacccaccau

SEQ ID NO: 1116564 - RNA, 22 nt, Mycobacterium bovis subsp bovis AF2122/97
gagaucgucgcgaccuugcccg

SEQ ID NO: 1116565 - RNA, 14 nt, Mycobacterium bovis subsp bovis AF2122/97
gagaucugcgaugg

SEQ ID NO: 1116566 - RNA, 19 nt, Mycobacterium bovis subsp bovis AF2122/97
gagaucguagggacgccga

SEQ ID NO: 1116567 - RNA, 17 nt, Mycobacterium bovis subsp bovis AF2122/97
gagaucucacgugcccg

SEQ ID NO: 1116568 - RNA, 15 nt, Mycobacterium bovis subsp bovis AF2122/97
gagaugccggcgagc

SEQ ID NO: 1116569 - RNA, 14 nt, Mycobacterium bovis subsp bovis AF2122/97
gagaucgccgccgg

SEQ ID NO: 1116570 - RNA, 13 nt, Mycobacterium bovis subsp bovis AF2122/97
gagaucgccgccg

SEQ ID NO: 1116571 - RNA, 14 nt, Mycobacterium bovis subsp bovis AF2122/97
gagaucgcggcgac

SEQ ID NO: 1116572 - RNA, 17 nt, Mycobacterium bovis subsp bovis AF2122/97
gagauccaggugugccc

SEQ ID NO: 1116573 - RNA, 18 nt, Mycobacterium bovis subsp bovis AF2122/97
gagaucagcaugcccucg

SEQ ID NO: 1116574 - RNA, 14 nt, Mycobacterium bovis subsp bovis AF2122/97
gagaucagccucgc

SEQ ID NO: 1116575 - RNA, 16 nt, Mycobacterium bovis subsp bovis AF2122/97
gagaucauggcgagcg

SEQ ID NO: 1116576 - RNA, 13 nt, Mycobacterium bovis subsp bovis AF2122/97
gagauccuucgcg

SEQ ID NO: 1116577 - RNA, 22 nt, Mycobacterium bovis subsp bovis AF2122/97
gagaucgacuucauagcgccgg

SEQ ID NO: 1116578 - RNA, 13 nt, Mycobacterium bovis subsp bovis AF2122/97
gagcaacggcggc

SEQ ID NO: 1116579 - RNA, 23 nt, Mycobacterium bovis subsp bovis AF2122/97
gagcaacggcggcaggccggcca

SEQ ID NO: 1116580 - RNA, 20 nt, Mycobacterium bovis subsp bovis AF2122/97
gagcaacaccagggccucca

SEQ ID NO: 1116581 - RNA, 17 nt, Mycobacterium bovis subsp bovis AF2122/97
gagcaaaauggccaccg

SEQ ID NO: 1116582 - RNA, 18 nt, Mycobacterium bovis subsp bovis AF2122/97
gagcaaaauggccaccgg

SEQ ID NO: 1116583 - RNA, 22 nt, Mycobacterium bovis subsp bovis AF2122/97
gagcaaaauggccaccggcggu

SEQ ID NO: 1116584 - RNA, 19 nt, Mycobacterium bovis subsp bovis AF2122/97
gagauugccgggccgccga

SEQ ID NO: 1116585 - RNA, 17 nt, Mycobacterium bovis subsp bovis AF2122/97
gagaccgggcaacggcg

SEQ ID NO: 1116586 - RNA, 22 nt, Mycobacterium bovis subsp bovis AF2122/97
gagacgaaaagccgcgucgcga

SEQ ID NO: 1116587 - RNA, 21 nt, Mycobacterium bovis subsp bovis AF2122/97
gagaccugucgguaccgccca

SEQ ID NO: 1116588 - RNA, 15 nt, Mycobacterium bovis subsp bovis AF2122/97
gagacgaaccgccga

SEQ ID NO: 1116589 - RNA, 17 nt, Mycobacterium bovis subsp bovis AF2122/97
gagacgaaccgccgacg

SEQ ID NO: 1116590 - RNA, 21 nt, Mycobacterium bovis subsp bovis AF2122/97
gagacgaaccgccgacggcgc

SEQ ID NO: 1116591 - RNA, 23 nt, Mycobacterium bovis subsp bovis AF2122/97
gagacgaccuccucgaugaccgg

SEQ ID NO: 1116592 - RNA, 17 nt, Mycobacterium bovis subsp bovis AF2122/97
gagacgacgaccggcua

SEQ ID NO: 1116593 - RNA, 17 nt, Mycobacterium bovis subsp bovis AF2122/97
gagacgcaaaaucgccc

SEQ ID NO: 1116594 - RNA, 18 nt, Mycobacterium bovis subsp bovis AF2122/97
gagacgcaaaaucgcccg

SEQ ID NO: 1116595 - RNA, 17 nt, Mycobacterium bovis subsp bovis AF2122/97
gagacgcacggccaccg

SEQ ID NO: 1116596 - RNA, 16 nt, Mycobacterium bovis subsp bovis AF2122/97
gagaccgcgagcagca

SEQ ID NO: 1116597 - RNA, 15 nt, Mycobacterium bovis subsp bovis AF2122/97
gagaccacgcgcguc

SEQ ID NO: 1116598 - RNA, 23 nt, Mycobacterium bovis subsp bovis AF2122/97
gagacaugucgcugccgccgccg

SEQ ID NO: 1116599 - RNA, 13 nt, Mycobacterium bovis subsp bovis AF2122/97
gagacaugccggc

SEQ ID NO: 1116600 - RNA, 23 nt, Mycobacterium bovis subsp bovis AF2122/97
gagacagcgccaugcccucggcg

SEQ ID NO: 1116601 - RNA, 13 nt, Mycobacterium bovis subsp bovis AF2122/97
gagaacuccggga

SEQ ID NO: 1116602 - RNA, 17 nt, Mycobacterium bovis subsp bovis AF2122/97
gagaacgauguccgcgc

SEQ ID NO: 1116603 - RNA, 18 nt, Mycobacterium bovis subsp bovis AF2122/97
gagaagcaugauuggcuc

SEQ ID NO: 1116604 - RNA, 15 nt, Mycobacterium bovis subsp bovis AF2122/97
gagacguuuugcggc

SEQ ID NO: 1116605 - RNA, 19 nt, Mycobacterium bovis subsp bovis AF2122/97
gagacguuuugcggcccgg

SEQ ID NO: 1116606 - RNA, 17 nt, Mycobacterium bovis subsp bovis AF2122/97
gagacguaaccgcuggc

SEQ ID NO: 1116607 - RNA, 20 nt, Mycobacterium bovis subsp bovis AF2122/97
gagacuccagcaaggccagc

SEQ ID NO: 1116608 - RNA, 21 nt, Mycobacterium bovis subsp bovis AF2122/97
gagacgcuuuccgccgcaccg

SEQ ID NO: 1116609 - RNA, 22 nt, Mycobacterium bovis subsp bovis AF2122/97
gagacgaucaucucgucgucgc

SEQ ID NO: 1116610 - RNA, 13 nt, Mycobacterium bovis subsp bovis AF2122/97
gagacgccgucga

SEQ ID NO: 1116611 - RNA, 22 nt, Mycobacterium bovis subsp bovis AF2122/97
gagacgccgucgacgucgaugg

SEQ ID NO: 1116612 - RNA, 16 nt, Mycobacterium bovis subsp bovis AF2122/97
gagagaguucgcaugc

SEQ ID NO: 1116613 - RNA, 19 nt, Mycobacterium bovis subsp bovis AF2122/97
gagacuucgguguagccca

SEQ ID NO: 1116614 - RNA, 16 nt, Mycobacterium bovis subsp bovis AF2122/97
gagacuucuucgacgc

SEQ ID NO: 1116615 - RNA, 14 nt, Mycobacterium bovis subsp bovis AF2122/97
gagagccucggcca

SEQ ID NO: 1116616 - RNA, 13 nt, Mycobacterium bovis subsp bovis AF2122/97
gagagccggcggc

SEQ ID NO: 1116617 - RNA, 18 nt, Mycobacterium bovis subsp bovis AF2122/97
gagagcagccagccaccg

SEQ ID NO: 1116618 - RNA, 16 nt, Mycobacterium bovis subsp bovis AF2122/97
gagagcaccgcucggu

SEQ ID NO: 1116619 - RNA, 12 nt, Mycobacterium bovis subsp bovis AF2122/97
gagagcacuggg

SEQ ID NO: 1116620 - RNA, 16 nt, Mycobacterium bovis subsp bovis AF2122/97
gagagauggucgggcg

SEQ ID NO: 1116621 - RNA, 15 nt, Mycobacterium bovis subsp bovis AF2122/97
gagaguaucgacccg

SEQ ID NO: 1116622 - RNA, 15 nt, Mycobacterium bovis subsp bovis AF2122/97
gagagccucggccau

SEQ ID NO: 1116623 - RNA, 14 nt, Mycobacterium bovis subsp bovis AF2122/97
gagagccugcucgc

SEQ ID NO: 1116624 - RNA, 13 nt, Mycobacterium bovis subsp bovis AF2122/97
gagaucaccgcca

SEQ ID NO: 1116625 - RNA, 15 nt, Mycobacterium bovis subsp bovis AF2122/97
gagaucaccgccacc

SEQ ID NO: 1116626 - RNA, 22 nt, Mycobacterium bovis subsp bovis AF2122/97
gagaguggccucguccagcucg

SEQ ID NO: 1116627 - RNA, 22 nt, Mycobacterium bovis subsp bovis AF2122/97
gagauagcaacgaagccggcgc

SEQ ID NO: 1116628 - RNA, 22 nt, Mycobacterium bovis subsp bovis AF2122/97
gagauagucggccggcggucgc

SEQ ID NO: 1116629 - RNA, 19 nt, Mycobacterium bovis subsp bovis AF2122/97
gagaguuugauccuggcuc

SEQ ID NO: 1116630 - RNA, 13 nt, Mycobacterium bovis subsp bovis AF2122/97
gagauaccccgag

SEQ ID NO: 1116631 - RNA, 14 nt, Mycobacterium bovis subsp bovis AF2122/97
gagauaccgaccau

SEQ ID NO: 1116632 - RNA, 14 nt, Mycobacterium bovis subsp bovis AF2122/97
gacuccagcgcccg

SEQ ID NO: 1116633 - RNA, 17 nt, Mycobacterium bovis subsp bovis AF2122/97
gacuccagcgcccgguc

SEQ ID NO: 1116634 - RNA, 15 nt, Mycobacterium bovis subsp bovis AF2122/97
gacuccagcaccagc

SEQ ID NO: 1116635 - RNA, 21 nt, Mycobacterium bovis subsp bovis AF2122/97
gacuccaccccacccagcgac

SEQ ID NO: 1116636 - RNA, 18 nt, Mycobacterium bovis subsp bovis AF2122/97
gacuccagcaaggccagc

SEQ ID NO: 1116637 - RNA, 22 nt, Mycobacterium bovis subsp bovis AF2122/97
gacuccagcaaggccagcacgg

SEQ ID NO: 1116638 - RNA, 16 nt, Mycobacterium bovis subsp bovis AF2122/97
gacucaucggccgcgg

SEQ ID NO: 1116639 - RNA, 20 nt, Mycobacterium bovis subsp bovis AF2122/97
gacucaucggcgugcuugcc

SEQ ID NO: 1116640 - RNA, 18 nt, Mycobacterium bovis subsp bovis AF2122/97
gacucaucaccgauggca

SEQ ID NO: 1116641 - RNA, 15 nt, Mycobacterium bovis subsp bovis AF2122/97
gacucaugccgagcg

SEQ ID NO: 1116642 - RNA, 22 nt, Mycobacterium bovis subsp bovis AF2122/97
gacucaugccgagcgaccgucc

SEQ ID NO: 1116643 - RNA, 16 nt, Mycobacterium bovis subsp bovis AF2122/97
gacuccugcggcaccg

SEQ ID NO: 1116644 - RNA, 13 nt, Mycobacterium bovis subsp bovis AF2122/97
gacuccggcaagc

SEQ ID NO: 1116645 - RNA, 19 nt, Mycobacterium bovis subsp bovis AF2122/97
gacuccggccgcacgccga

SEQ ID NO: 1116646 - RNA, 21 nt, Mycobacterium bovis subsp bovis AF2122/97
gacuccggccgcacgccgacc

SEQ ID NO: 1116647 - RNA, 16 nt, Mycobacterium bovis subsp bovis AF2122/97
gacuccguaccggguu

SEQ ID NO: 1116648 - RNA, 16 nt, Mycobacterium bovis subsp bovis AF2122/97
gacucccccggcuccg

SEQ ID NO: 1116649 - RNA, 18 nt, Mycobacterium bovis subsp bovis AF2122/97
gacucccccggcuccgca

SEQ ID NO: 1116650 - RNA, 19 nt, Mycobacterium bovis subsp bovis AF2122/97
gacuccgccuugcagcgcg

SEQ ID NO: 1116651 - RNA, 15 nt, Mycobacterium bovis subsp bovis AF2122/97
gacuagacgccgccg

SEQ ID NO: 1116652 - RNA, 16 nt, Mycobacterium bovis subsp bovis AF2122/97
gacuaucggccgccgg

SEQ ID NO: 1116653 - RNA, 22 nt, Mycobacterium bovis subsp bovis AF2122/97
gacucaccgugaaccgcccgcc

SEQ ID NO: 1116654 - RNA, 13 nt, Mycobacterium bovis subsp bovis AF2122/97
gacucacgaggca

SEQ ID NO: 1116655 - RNA, 22 nt, Mycobacterium bovis subsp bovis AF2122/97
gacucaggucggugcggucauc

SEQ ID NO: 1116656 - RNA, 15 nt, Mycobacterium bovis subsp bovis AF2122/97
gacuaccacccgcag

SEQ ID NO: 1116657 - RNA, 13 nt, Mycobacterium bovis subsp bovis AF2122/97
gacuaccaccgcg

SEQ ID NO: 1116658 - RNA, 15 nt, Mycobacterium bovis subsp bovis AF2122/97
gacuaccaccgcguu

SEQ ID NO: 1116659 - RNA, 21 nt, Mycobacterium bovis subsp bovis AF2122/97
gacguuguuggauccggccac

SEQ ID NO: 1116660 - RNA, 24 nt, Mycobacterium bovis subsp bovis AF2122/97
gacguuucagccgggugccacaac

SEQ ID NO: 1116661 - RNA, 13 nt, Mycobacterium bovis subsp bovis AF2122/97
gacuaccgagacg

SEQ ID NO: 1116662 - RNA, 15 nt, Mycobacterium bovis subsp bovis AF2122/97
gacuacccagccagc

SEQ ID NO: 1116663 - RNA, 20 nt, Mycobacterium bovis subsp bovis AF2122/97
gacuacccagccagccgcga

SEQ ID NO: 1116664 - RNA, 21 nt, Mycobacterium bovis subsp bovis AF2122/97
gacuacccagccagccgcgaa

SEQ ID NO: 1116665 - RNA, 18 nt, Mycobacterium bovis subsp bovis AF2122/97
gacuaccgccggcggcgg

SEQ ID NO: 1116666 - RNA, 20 nt, Mycobacterium bovis subsp bovis AF2122/97
gacuaccgccggcggcggcc

SEQ ID NO: 1116667 - RNA, 23 nt, Mycobacterium bovis subsp bovis AF2122/97
gacuaccgccggcggcggccgca

SEQ ID NO: 1116668 - RNA, 13 nt, Mycobacterium bovis subsp bovis AF2122/97
gacucgcgguggc

SEQ ID NO: 1116669 - RNA, 18 nt, Mycobacterium bovis subsp bovis AF2122/97
gacucggccgugaccgag

SEQ ID NO: 1116670 - RNA, 12 nt, Mycobacterium bovis subsp bovis AF2122/97
gacucggccucc

SEQ ID NO: 1116671 - RNA, 13 nt, Mycobacterium bovis subsp bovis AF2122/97
gacucggccuccg

SEQ ID NO: 1116672 - RNA, 17 nt, Mycobacterium bovis subsp bovis AF2122/97
gacucggccuccgccga

SEQ ID NO: 1116673 - RNA, 16 nt, Mycobacterium bovis subsp bovis AF2122/97
gacucggacgcgccgg

SEQ ID NO: 1116674 - RNA, 13 nt, Mycobacterium bovis subsp bovis AF2122/97
gacucggcggaag

SEQ ID NO: 1116675 - RNA, 21 nt, Mycobacterium bovis subsp bovis AF2122/97
gacucgggcgcugaugcgcug

SEQ ID NO: 1116676 - RNA, 19 nt, Mycobacterium bovis subsp bovis AF2122/97
gacucguggcgccacggca

SEQ ID NO: 1116677 - RNA, 18 nt, Mycobacterium bovis subsp bovis AF2122/97
gacucgugucugccucgg

SEQ ID NO: 1116678 - RNA, 23 nt, Mycobacterium bovis subsp bovis AF2122/97
gacucucaucaacucgacccggc

SEQ ID NO: 1116679 - RNA, 15 nt, Mycobacterium bovis subsp bovis AF2122/97
gacucggugcgguga

SEQ ID NO: 1116680 - RNA, 19 nt, Mycobacterium bovis subsp bovis AF2122/97
gacucgucgaugcgguggu

SEQ ID NO: 1116681 - RNA, 17 nt, Mycobacterium bovis subsp bovis AF2122/97
gacucgacaaggccgau

SEQ ID NO: 1116682 - RNA, 18 nt, Mycobacterium bovis subsp bovis AF2122/97
gacucgaccgcgacggca

SEQ ID NO: 1116683 - RNA, 21 nt, Mycobacterium bovis subsp bovis AF2122/97
gacucgcaauugcucguagcc

SEQ ID NO: 1116684 - RNA, 15 nt, Mycobacterium bovis subsp bovis AF2122/97
gacucgaggaccugc

SEQ ID NO: 1116685 - RNA, 17 nt, Mycobacterium bovis subsp bovis AF2122/97
gacucgagucugcgcag

SEQ ID NO: 1116686 - RNA, 19 nt, Mycobacterium bovis subsp bovis AF2122/97
gacucgauaugcagcucgc

SEQ ID NO: 1116687 - RNA, 22 nt, Mycobacterium bovis subsp bovis AF2122/97
gacucggcaccgcggccgcgga

SEQ ID NO: 1116688 - RNA, 14 nt, Mycobacterium bovis subsp bovis AF2122/97
gacucggccgacga

SEQ ID NO: 1116689 - RNA, 14 nt, Mycobacterium bovis subsp bovis AF2122/97
gacucggccgcacc

SEQ ID NO: 1116690 - RNA, 17 nt, Mycobacterium bovis subsp bovis AF2122/97
gacucggccgcaccagc

SEQ ID NO: 1116691 - RNA, 16 nt, Mycobacterium bovis subsp bovis AF2122/97
gacucgcuccgaccgg

SEQ ID NO: 1116692 - RNA, 22 nt, Mycobacterium bovis subsp bovis AF2122/97
gacucgccacauuucaccaccg

SEQ ID NO: 1116693 - RNA, 19 nt, Mycobacterium bovis subsp bovis AF2122/97
gacucgccaccgcggcgau

SEQ ID NO: 1116694 - RNA, 13 nt, Mycobacterium bovis subsp bovis AF2122/97
gacucgccggcga

SEQ ID NO: 1116695 - RNA, 21 nt, Mycobacterium bovis subsp bovis AF2122/97
gacucgccggcgaauccgcac

SEQ ID NO: 1116696 - RNA, 14 nt, Mycobacterium bovis subsp bovis AF2122/97
gacugcacaccacc

SEQ ID NO: 1116697 - RNA, 15 nt, Mycobacterium bovis subsp bovis AF2122/97
gacugcacaccaccg

SEQ ID NO: 1116698 - RNA, 21 nt, Mycobacterium bovis subsp bovis AF2122/97
gacugcacaccaccgccgaac

SEQ ID NO: 1116699 - RNA, 22 nt, Mycobacterium bovis subsp bovis AF2122/97
gacugcacaccaccgccgaaca

SEQ ID NO: 1116700 - RNA, 22 nt, Mycobacterium bovis subsp bovis AF2122/97
gacugcagaaacagccgcagcg

SEQ ID NO: 1116701 - RNA, 13 nt, Mycobacterium bovis subsp bovis AF2122/97
gacugcagcccgu

SEQ ID NO: 1116702 - RNA, 17 nt, Mycobacterium bovis subsp bovis AF2122/97
gacugcagcccugcgca

SEQ ID NO: 1116703 - RNA, 22 nt, Mycobacterium bovis subsp bovis AF2122/97
gacugcacuugaaauugagccg

SEQ ID NO: 1116704 - RNA, 18 nt, Mycobacterium bovis subsp bovis AF2122/97
gacugcagcccugcgcag

SEQ ID NO: 1116705 - RNA, 20 nt, Mycobacterium bovis subsp bovis AF2122/97
gacugacuuugggucggcga

SEQ ID NO: 1116706 - RNA, 17 nt, Mycobacterium bovis subsp bovis AF2122/97
gacugaucgcgauccac

SEQ ID NO: 1116707 - RNA, 12 nt, Mycobacterium bovis subsp bovis AF2122/97
gacugacgguca

SEQ ID NO: 1116708 - RNA, 16 nt, Mycobacterium bovis subsp bovis AF2122/97
gacugaaucgaccgga

SEQ ID NO: 1116709 - RNA, 19 nt, Mycobacterium bovis subsp bovis AF2122/97
gacucugccacccagcacg

SEQ ID NO: 1116710 - RNA, 20 nt, Mycobacterium bovis subsp bovis AF2122/97
gacucugccacccagcacgc

SEQ ID NO: 1116711 - RNA, 20 nt, Mycobacterium bovis subsp bovis AF2122/97
gacucugcguccaccacgca

SEQ ID NO: 1116712 - RNA, 14 nt, Mycobacterium bovis subsp bovis AF2122/97
gacugcagcgcggc

SEQ ID NO: 1116713 - RNA, 16 nt, Mycobacterium bovis subsp bovis AF2122/97
gacugcagcgcggugg

SEQ ID NO: 1116714 - RNA, 17 nt, Mycobacterium bovis subsp bovis AF2122/97
gacugcagcgcgguggu

SEQ ID NO: 1116715 - RNA, 13 nt, Mycobacterium bovis subsp bovis AF2122/97
gacugcagcggcg

SEQ ID NO: 1116716 - RNA, 15 nt, Mycobacterium bovis subsp bovis AF2122/97
gacugcagcgccucg

SEQ ID NO: 1116717 - RNA, 14 nt, Mycobacterium bovis subsp bovis AF2122/97
gacugcagcggcgc

SEQ ID NO: 1116718 - RNA, 16 nt, Mycobacterium bovis subsp bovis AF2122/97
gacugcagcggcgcau

SEQ ID NO: 1116719 - RNA, 14 nt, Mycobacterium bovis subsp bovis AF2122/97
gacugccagcgccg

SEQ ID NO: 1116720 - RNA, 13 nt, Mycobacterium bovis subsp bovis AF2122/97
gacugcgccaccg

SEQ ID NO: 1116721 - RNA, 12 nt, Mycobacterium bovis subsp bovis AF2122/97
gacugcgcccau

SEQ ID NO: 1116722 - RNA, 16 nt, Mycobacterium bovis subsp bovis AF2122/97
gacugcgccgccggcg

SEQ ID NO: 1116723 - RNA, 17 nt, Mycobacterium bovis subsp bovis AF2122/97
gacugcgcuacaucaga

SEQ ID NO: 1116724 - RNA, 22 nt, Mycobacterium bovis subsp bovis AF2122/97
gacugcgccgggugaggcggug

SEQ ID NO: 1116725 - RNA, 15 nt, Mycobacterium bovis subsp bovis AF2122/97
gacugcggcccgacc

SEQ ID NO: 1116726 - RNA, 14 nt, Mycobacterium bovis subsp bovis AF2122/97
gacugcgucggcgg

SEQ ID NO: 1116727 - RNA, 17 nt, Mycobacterium bovis subsp bovis AF2122/97
gacugcgugccgcaccg

SEQ ID NO: 1116728 - RNA, 18 nt, Mycobacterium bovis subsp bovis AF2122/97
gacugcguuccgaucggc

SEQ ID NO: 1116729 - RNA, 16 nt, Mycobacterium bovis subsp bovis AF2122/97
gacugcggguucgccg

SEQ ID NO: 1116730 - RNA, 15 nt, Mycobacterium bovis subsp bovis AF2122/97
gacuggccgcccggc

SEQ ID NO: 1116731 - RNA, 16 nt, Mycobacterium bovis subsp bovis AF2122/97
gacuggccguuucggc

SEQ ID NO: 1116732 - RNA, 20 nt, Mycobacterium bovis subsp bovis AF2122/97
gacuggccgcccggcgagca

SEQ ID NO: 1116733 - RNA, 15 nt, Mycobacterium bovis subsp bovis AF2122/97
gacuggggcgccacc

SEQ ID NO: 1116734 - RNA, 13 nt, Mycobacterium bovis subsp bovis AF2122/97
gacugggcgcugg

SEQ ID NO: 1116735 - RNA, 19 nt, Mycobacterium bovis subsp bovis AF2122/97
gacugggccaggucggcga

SEQ ID NO: 1116736 - RNA, 16 nt, Mycobacterium bovis subsp bovis AF2122/97
gacugggacgacgcca

SEQ ID NO: 1116737 - RNA, 17 nt, Mycobacterium bovis subsp bovis AF2122/97
gacugucuggucggcua

SEQ ID NO: 1116738 - RNA, 17 nt, Mycobacterium bovis subsp bovis AF2122/97
gacugucccaccaggua

SEQ ID NO: 1116739 - RNA, 21 nt, Mycobacterium bovis subsp bovis AF2122/97
gacugucccaccagguacgcg

SEQ ID NO: 1116740 - RNA, 10 nt, Mycobacterium bovis subsp bovis AF2122/97
gacuguccca

SEQ ID NO: 1116741 - RNA, 16 nt, Mycobacterium bovis subsp bovis AF2122/97
gacuguggcgccgccg

SEQ ID NO: 1116742 - RNA, 17 nt, Mycobacterium bovis subsp bovis AF2122/97
gacuguggcgccgccgg

SEQ ID NO: 1116743 - RNA, 21 nt, Mycobacterium bovis subsp bovis AF2122/97
gacugugggggcgcaccgagc

SEQ ID NO: 1116744 - RNA, 22 nt, Mycobacterium bovis subsp bovis AF2122/97
gacuuagcgggugccagcccgu

SEQ ID NO: 1116745 - RNA, 15 nt, Mycobacterium bovis subsp bovis AF2122/97
gacugugcgccgcag

SEQ ID NO: 1116746 - RNA, 17 nt, Mycobacterium bovis subsp bovis AF2122/97
gacugugcgccgcagcc

SEQ ID NO: 1116747 - RNA, 20 nt, Mycobacterium bovis subsp bovis AF2122/97
gacugugaaucugacgacgc

SEQ ID NO: 1116748 - RNA, 21 nt, Mycobacterium bovis subsp bovis AF2122/97
gacuucgggaacgcucgucga

SEQ ID NO: 1116749 - RNA, 17 nt, Mycobacterium bovis subsp bovis AF2122/97
gacuucggggucaccgg

SEQ ID NO: 1116750 - RNA, 13 nt, Mycobacterium bovis subsp bovis AF2122/97
gacuucggcgucg

SEQ ID NO: 1116751 - RNA, 23 nt, Mycobacterium bovis subsp bovis AF2122/97
gacuucggugagcagggcggcga

SEQ ID NO: 1116752 - RNA, 14 nt, Mycobacterium bovis subsp bovis AF2122/97
gacuucgguggcgg

SEQ ID NO: 1116753 - RNA, 22 nt, Mycobacterium bovis subsp bovis AF2122/97
gacuucgguggcgggcuugccg

SEQ ID NO: 1116754 - RNA, 18 nt, Mycobacterium bovis subsp bovis AF2122/97
gacuugauuucgaucgcg

SEQ ID NO: 1116755 - RNA, 21 nt, Mycobacterium bovis subsp bovis AF2122/97
gacuugauuucgaucgcggca

SEQ ID NO: 1116756 - RNA, 23 nt, Mycobacterium bovis subsp bovis AF2122/97
gacuugauuucgaucgcggcaau

SEQ ID NO: 1116757 - RNA, 20 nt, Mycobacterium bovis subsp bovis AF2122/97
gacuugcacgucggcugccg

SEQ ID NO: 1116758 - RNA, 14 nt, Mycobacterium bovis subsp bovis AF2122/97
gacuugcaggcguc

SEQ ID NO: 1116759 - RNA, 15 nt, Mycobacterium bovis subsp bovis AF2122/97
gacuuauccggccag

SEQ ID NO: 1116760 - RNA, 20 nt, Mycobacterium bovis subsp bovis AF2122/97
gacuucacucguugaccggc

SEQ ID NO: 1116761 - RNA, 21 nt, Mycobacterium bovis subsp bovis AF2122/97
gacuucagcaggcccagcgga

SEQ ID NO: 1116762 - RNA, 16 nt, Mycobacterium bovis subsp bovis AF2122/97
gacuuccgcgucgccg

SEQ ID NO: 1116763 - RNA, 19 nt, Mycobacterium bovis subsp bovis AF2122/97
gacuuccgcgucgccggcc

SEQ ID NO: 1116764 - RNA, 16 nt, Mycobacterium bovis subsp bovis AF2122/97
gacuucgacgcggcga

SEQ ID NO: 1116765 - RNA, 19 nt, Mycobacterium bovis subsp bovis AF2122/97
gacuucgacgcggcgaccg

SEQ ID NO: 1116766 - RNA, 16 nt, Mycobacterium bovis subsp bovis AF2122/97
gacuucgccgcccgca

SEQ ID NO: 1116767 - RNA, 19 nt, Mycobacterium bovis subsp bovis AF2122/97
gacuugugacggucgucga

SEQ ID NO: 1116768 - RNA, 17 nt, Mycobacterium bovis subsp bovis AF2122/97
gacuuggccagcagccg

SEQ ID NO: 1116769 - RNA, 16 nt, Mycobacterium bovis subsp bovis AF2122/97
gacuuggccaugcugg

SEQ ID NO: 1116770 - RNA, 14 nt, Mycobacterium bovis subsp bovis AF2122/97
gacuuggcggucgg

SEQ ID NO: 1116771 - RNA, 15 nt, Mycobacterium bovis subsp bovis AF2122/97
gacuuugggucggcg

SEQ ID NO: 1116772 - RNA, 16 nt, Mycobacterium bovis subsp bovis AF2122/97
gacuuugggucggcga

SEQ ID NO: 1116773 - RNA, 17 nt, Mycobacterium bovis subsp bovis AF2122/97
gacuuugggucggcgau

SEQ ID NO: 1116774 - RNA, 23 nt, Mycobacterium bovis subsp bovis AF2122/97
gacuuugggucggcgauggcggc

SEQ ID NO: 1116775 - RNA, 19 nt, Mycobacterium bovis subsp bovis AF2122/97
gacuuggugauccgagacc

SEQ ID NO: 1116776 - RNA, 19 nt, Mycobacterium bovis subsp bovis AF2122/97
gacuuucgcccagucgccg

SEQ ID NO: 1116777 - RNA, 19 nt, Mycobacterium bovis subsp bovis AF2122/97
gagaacacguucggcgucg

SEQ ID NO: 1116778 - RNA, 23 nt, Mycobacterium bovis subsp bovis AF2122/97
gagaaaacggcggcgccgguggu

SEQ ID NO: 1116779 - RNA, 14 nt, Mycobacterium bovis subsp bovis AF2122/97
gagaaacacgacag

SEQ ID NO: 1116780 - RNA, 14 nt, Mycobacterium bovis subsp bovis AF2122/97
cguccagcgccgcg

SEQ ID NO: 1116781 - RNA, 16 nt, Mycobacterium bovis subsp bovis AF2122/97
cguccagcgccgcggc

SEQ ID NO: 1116782 - RNA, 18 nt, Mycobacterium bovis subsp bovis AF2122/97
cguccagcgccgcggccc

SEQ ID NO: 1116783 - RNA, 20 nt, Mycobacterium bovis subsp bovis AF2122/97
cguccagcgccgcggcccgc

SEQ ID NO: 1116784 - RNA, 22 nt, Mycobacterium bovis subsp bovis AF2122/97
cguccagcuggcauaggaucgc

SEQ ID NO: 1116785 - RNA, 18 nt, Mycobacterium bovis subsp bovis AF2122/97
cguccagcaaaugcggcg

SEQ ID NO: 1116786 - RNA, 20 nt, Mycobacterium bovis subsp bovis AF2122/97
cguccagauaggccaaccgg

SEQ ID NO: 1116787 - RNA, 15 nt, Mycobacterium bovis subsp bovis AF2122/97
cguccagggcgacga

SEQ ID NO: 1116788 - RNA, 21 nt, Mycobacterium bovis subsp bovis AF2122/97
cguccagggcgccgaucgugc

SEQ ID NO: 1116789 - RNA, 12 nt, Mycobacterium bovis subsp bovis AF2122/97
cguccaggcgcu

SEQ ID NO: 1116790 - RNA, 18 nt, Mycobacterium bovis subsp bovis AF2122/97
cguccaucaccggcggcc

SEQ ID NO: 1116791 - RNA, 19 nt, Mycobacterium bovis subsp bovis AF2122/97
cguccaucaccggcggccc

SEQ ID NO: 1116792 - RNA, 19 nt, Mycobacterium bovis subsp bovis AF2122/97
cguccaguggcagccagcg

SEQ ID NO: 1116793 - RNA, 14 nt, Mycobacterium bovis subsp bovis AF2122/97
cguccagucggucg

SEQ ID NO: 1116794 - RNA, 23 nt, Mycobacterium bovis subsp bovis AF2122/97
cguccagucggucgguaccggua

SEQ ID NO: 1116795 - RNA, 16 nt, Mycobacterium bovis subsp bovis AF2122/97
cguccaggucggccgc

SEQ ID NO: 1116796 - RNA, 17 nt, Mycobacterium bovis subsp bovis AF2122/97
cguccaggucggccgcc

SEQ ID NO: 1116797 - RNA, 20 nt, Mycobacterium bovis subsp bovis AF2122/97
cguccaggucggccgccucg

SEQ ID NO: 1116798 - RNA, 18 nt, Mycobacterium bovis subsp bovis AF2122/97
cguccgcgaucugcagcg

SEQ ID NO: 1116799 - RNA, 13 nt, Mycobacterium bovis subsp bovis AF2122/97
cguccgcgccgag

SEQ ID NO: 1116800 - RNA, 14 nt, Mycobacterium bovis subsp bovis AF2122/97
cguccgcgcaccgc

SEQ ID NO: 1116801 - RNA, 20 nt, Mycobacterium bovis subsp bovis AF2122/97
cguccgccugcaccgccgcc

SEQ ID NO: 1116802 - RNA, 20 nt, Mycobacterium bovis subsp bovis AF2122/97
cguccgcgcguugcuggucg

SEQ ID NO: 1116803 - RNA, 12 nt, Mycobacterium bovis subsp bovis AF2122/97
cguccgcggacu

SEQ ID NO: 1116804 - RNA, 22 nt, Mycobacterium bovis subsp bovis AF2122/97
cguccgcggacuuggcggucgg

SEQ ID NO: 1116805 - RNA, 18 nt, Mycobacterium bovis subsp bovis AF2122/97
cguccgacgaguacacga

SEQ ID NO: 1116806 - RNA, 22 nt, Mycobacterium bovis subsp bovis AF2122/97
cgucccgcucgagcagcgcgcc

SEQ ID NO: 1116807 - RNA, 18 nt, Mycobacterium bovis subsp bovis AF2122/97
cguccgauuucccagcgc

SEQ ID NO: 1116808 - RNA, 15 nt, Mycobacterium bovis subsp bovis AF2122/97
cguccgaucggcgcg

SEQ ID NO: 1116809 - RNA, 14 nt, Mycobacterium bovis subsp bovis AF2122/97
cguccgacgggccg

SEQ ID NO: 1116810 - RNA, 22 nt, Mycobacterium bovis subsp bovis AF2122/97
cguccgacgggccgucgccguc

SEQ ID NO: 1116811 - RNA, 13 nt, Mycobacterium bovis subsp bovis AF2122/97
cguccgaccaggg

SEQ ID NO: 1116812 - RNA, 19 nt, Mycobacterium bovis subsp bovis AF2122/97
cguccgaccgguacccgua

SEQ ID NO: 1116813 - RNA, 13 nt, Mycobacterium bovis subsp bovis AF2122/97
cgucccgcggcgc

SEQ ID NO: 1116814 - RNA, 15 nt, Mycobacterium bovis subsp bovis AF2122/97
cgucccgcggcgcgg

SEQ ID NO: 1116815 - RNA, 18 nt, Mycobacterium bovis subsp bovis AF2122/97
cgucccgaaacgccgggu

SEQ ID NO: 1116816 - RNA, 19 nt, Mycobacterium bovis subsp bovis AF2122/97
cgucccgaaccgaucauca

SEQ ID NO: 1116817 - RNA, 19 nt, Mycobacterium bovis subsp bovis AF2122/97
cgucccgcgagcagcccgg

SEQ ID NO: 1116818 - RNA, 12 nt, Mycobacterium bovis subsp bovis AF2122/97
cgucccgcccgg

SEQ ID NO: 1116819 - RNA, 17 nt, Mycobacterium bovis subsp bovis AF2122/97
cgucccgauggcggugg

SEQ ID NO: 1116820 - RNA, 19 nt, Mycobacterium bovis subsp bovis AF2122/97
cguccccgucgcuggccgg

SEQ ID NO: 1116821 - RNA, 15 nt, Mycobacterium bovis subsp bovis AF2122/97
cguccccgcagcgcc

SEQ ID NO: 1116822 - RNA, 12 nt, Mycobacterium bovis subsp bovis AF2122/97
cguccccgccga

SEQ ID NO: 1116823 - RNA, 14 nt, Mycobacterium bovis subsp bovis AF2122/97
cguccccgccgacg

SEQ ID NO: 1116824 - RNA, 18 nt, Mycobacterium bovis subsp bovis AF2122/97
cguccccgccgacgccga

SEQ ID NO: 1116825 - RNA, 20 nt, Mycobacterium bovis subsp bovis AF2122/97
cguccccgccgacgccgaua

SEQ ID NO: 1116826 - RNA, 18 nt, Mycobacterium bovis subsp bovis AF2122/97
cguccccagcgccaccgu

SEQ ID NO: 1116827 - RNA, 20 nt, Mycobacterium bovis subsp bovis AF2122/97
cguccaucagcaacacgucg

SEQ ID NO: 1116828 - RNA, 19 nt, Mycobacterium bovis subsp bovis AF2122/97
cguccaucccggcgccgcg

SEQ ID NO: 1116829 - RNA, 13 nt, Mycobacterium bovis subsp bovis AF2122/97
cguccaucgccac

SEQ ID NO: 1116830 - RNA, 17 nt, Mycobacterium bovis subsp bovis AF2122/97
cgucauggcccgaucga

SEQ ID NO: 1116831 - RNA, 22 nt, Mycobacterium bovis subsp bovis AF2122/97
cgucaugcccugcccgaaggug

SEQ ID NO: 1116832 - RNA, 21 nt, Mycobacterium bovis subsp bovis AF2122/97
cgucauggcgaaccgucagcg

SEQ ID NO: 1116833 - RNA, 13 nt, Mycobacterium bovis subsp bovis AF2122/97
cgucauggccggc

SEQ ID NO: 1116834 - RNA, 14 nt, Mycobacterium bovis subsp bovis AF2122/97
cgucauggccggcc

SEQ ID NO: 1116835 - RNA, 23 nt, Mycobacterium bovis subsp bovis AF2122/97
cgucaugcagggaauagcggcgc

SEQ ID NO: 1116836 - RNA, 18 nt, Mycobacterium bovis subsp bovis AF2122/97
cgucaugccagucgccga

SEQ ID NO: 1116837 - RNA, 20 nt, Mycobacterium bovis subsp bovis AF2122/97
cgucaugccagucgccgaaa

SEQ ID NO: 1116838 - RNA, 22 nt, Mycobacterium bovis subsp bovis AF2122/97
cgucaugcccaucuccaacagg

SEQ ID NO: 1116839 - RNA, 11 nt, Mycobacterium bovis subsp bovis AF2122/97
cguccaaccca

SEQ ID NO: 1116840 - RNA, 15 nt, Mycobacterium bovis subsp bovis AF2122/97
cguccaacccagggu

SEQ ID NO: 1116841 - RNA, 21 nt, Mycobacterium bovis subsp bovis AF2122/97
cguccaacuacgccagccgcg

SEQ ID NO: 1116842 - RNA, 22 nt, Mycobacterium bovis subsp bovis AF2122/97
cguccaagccagcguuggcggc

SEQ ID NO: 1116843 - RNA, 15 nt, Mycobacterium bovis subsp bovis AF2122/97
cguccaagccggcca

SEQ ID NO: 1116844 - RNA, 17 nt, Mycobacterium bovis subsp bovis AF2122/97
cguccaagccggcugca

SEQ ID NO: 1116845 - RNA, 21 nt, Mycobacterium bovis subsp bovis AF2122/97
cguccaagccguagaccaggc

SEQ ID NO: 1116846 - RNA, 15 nt, Mycobacterium bovis subsp bovis AF2122/97
cguccacgaccccgg

SEQ ID NO: 1116847 - RNA, 21 nt, Mycobacterium bovis subsp bovis AF2122/97
cguccacgaccccggcgguac

SEQ ID NO: 1116848 - RNA, 15 nt, Mycobacterium bovis subsp bovis AF2122/97
cguccacgccgacgg

SEQ ID NO: 1116849 - RNA, 15 nt, Mycobacterium bovis subsp bovis AF2122/97
cguccaccgccgaca

SEQ ID NO: 1116850 - RNA, 15 nt, Mycobacterium bovis subsp bovis AF2122/97
cguccacgcagaggc

SEQ ID NO: 1116851 - RNA, 22 nt, Mycobacterium bovis subsp bovis AF2122/97
cguccacgugagugccggcgug

SEQ ID NO: 1116852 - RNA, 23 nt, Mycobacterium bovis subsp bovis AF2122/97
cguccacgugagugccggcgugc

SEQ ID NO: 1116853 - RNA, 14 nt, Mycobacterium bovis subsp bovis AF2122/97
cguccaccgucacg

SEQ ID NO: 1116854 - RNA, 14 nt, Mycobacterium bovis subsp bovis AF2122/97
cguccaccagccgg

SEQ ID NO: 1116855 - RNA, 22 nt, Mycobacterium bovis subsp bovis AF2122/97
cguccacccacgaucagcagcg

SEQ ID NO: 1116856 - RNA, 13 nt, Mycobacterium bovis subsp bovis AF2122/97
cguccaccgacgu

SEQ ID NO: 1116857 - RNA, 21 nt, Mycobacterium bovis subsp bovis AF2122/97
cguccacccacgaucagcagc

SEQ ID NO: 1116858 - RNA, 16 nt, Mycobacterium bovis subsp bovis AF2122/97
cguccacccacgauca

SEQ ID NO: 1116859 - RNA, 16 nt, Mycobacterium bovis subsp bovis AF2122/97
cguccaauuggcgucg

SEQ ID NO: 1116860 - RNA, 15 nt, Mycobacterium bovis subsp bovis AF2122/97
cgucaucgcagcaca

SEQ ID NO: 1116861 - RNA, 17 nt, Mycobacterium bovis subsp bovis AF2122/97
cgucaucuccgacucga

SEQ ID NO: 1116862 - RNA, 22 nt, Mycobacterium bovis subsp bovis AF2122/97
cgucaucugguggaccuccgga

SEQ ID NO: 1116863 - RNA, 14 nt, Mycobacterium bovis subsp bovis AF2122/97
cgucaucgcgggug

SEQ ID NO: 1116864 - RNA, 16 nt, Mycobacterium bovis subsp bovis AF2122/97
cgucaucgcggugugc

SEQ ID NO: 1116865 - RNA, 21 nt, Mycobacterium bovis subsp bovis AF2122/97
cgucaucgcggugugccgguc

SEQ ID NO: 1116866 - RNA, 14 nt, Mycobacterium bovis subsp bovis AF2122/97
cgucauccucgucg

SEQ ID NO: 1116867 - RNA, 20 nt, Mycobacterium bovis subsp bovis AF2122/97
cgucauccauccgggccgcg

SEQ ID NO: 1116868 - RNA, 22 nt, Mycobacterium bovis subsp bovis AF2122/97
cgucauccauccgggccgcggc

SEQ ID NO: 1116869 - RNA, 18 nt, Mycobacterium bovis subsp bovis AF2122/97
cgucaggcccucgggugu

SEQ ID NO: 1116870 - RNA, 16 nt, Mycobacterium bovis subsp bovis AF2122/97
cgucagguuccgcgac

SEQ ID NO: 1116871 - RNA, 14 nt, Mycobacterium bovis subsp bovis AF2122/97
cgucagccguucgg

SEQ ID NO: 1116872 - RNA, 16 nt, Mycobacterium bovis subsp bovis AF2122/97
cgucagccgcaccccg

SEQ ID NO: 1116873 - RNA, 20 nt, Mycobacterium bovis subsp bovis AF2122/97
cgucagcccgauacgggugu

SEQ ID NO: 1116874 - RNA, 12 nt, Mycobacterium bovis subsp bovis AF2122/97
cgucagccccga

SEQ ID NO: 1116875 - RNA, 16 nt, Mycobacterium bovis subsp bovis AF2122/97
cgucagcccgacguug

SEQ ID NO: 1116876 - RNA, 19 nt, Mycobacterium bovis subsp bovis AF2122/97
cgucaggcccauggcagcc

SEQ ID NO: 1116877 - RNA, 17 nt, Mycobacterium bovis subsp bovis AF2122/97
cgucagccguucggcua

SEQ ID NO: 1116878 - RNA, 21 nt, Mycobacterium bovis subsp bovis AF2122/97
cgucgaacggaucucgguggu

SEQ ID NO: 1116879 - RNA, 14 nt, Mycobacterium bovis subsp bovis AF2122/97
cgucgaacggcagc

SEQ ID NO: 1116880 - RNA, 22 nt, Mycobacterium bovis subsp bovis AF2122/97
cgucgaacggcagcccgggcgu

SEQ ID NO: 1116881 - RNA, 21 nt, Mycobacterium bovis subsp bovis AF2122/97
cgucgaaccugucgaucacgg

SEQ ID NO: 1116882 - RNA, 20 nt, Mycobacterium bovis subsp bovis AF2122/97
cgucgaacgcgcgcgugguc

SEQ ID NO: 1116883 - RNA, 23 nt, Mycobacterium bovis subsp bovis AF2122/97
cgucgaaccagaggucacgcagc

SEQ ID NO: 1116884 - RNA, 19 nt, Mycobacterium bovis subsp bovis AF2122/97
cgucgaacagugccucgcg

SEQ ID NO: 1116885 - RNA, 21 nt, Mycobacterium bovis subsp bovis AF2122/97
cgucgaagaccgccuccaccg

SEQ ID NO: 1116886 - RNA, 19 nt, Mycobacterium bovis subsp bovis AF2122/97
cgucgaagacgaacguguc

SEQ ID NO: 1116887 - RNA, 13 nt, Mycobacterium bovis subsp bovis AF2122/97
cgucgaagacggc

SEQ ID NO: 1116888 - RNA, 18 nt, Mycobacterium bovis subsp bovis AF2122/97
cgucgaacugccggacua

SEQ ID NO: 1116889 - RNA, 18 nt, Mycobacterium bovis subsp bovis AF2122/97
cgucgaacugggcgcccg

SEQ ID NO: 1116890 - RNA, 19 nt, Mycobacterium bovis subsp bovis AF2122/97
cgucgaacgguagcacggu

SEQ ID NO: 1116891 - RNA, 14 nt, Mycobacterium bovis subsp bovis AF2122/97
cgucgaaccagucc

SEQ ID NO: 1116892 - RNA, 17 nt, Mycobacterium bovis subsp bovis AF2122/97
cgucgaaccagucgaag

SEQ ID NO: 1116893 - RNA, 13 nt, Mycobacterium bovis subsp bovis AF2122/97
cgucgacaccgag

SEQ ID NO: 1116894 - RNA, 14 nt, Mycobacterium bovis subsp bovis AF2122/97
cgucgacacgguga

SEQ ID NO: 1116895 - RNA, 14 nt, Mycobacterium bovis subsp bovis AF2122/97
cgucgacaccgagg

SEQ ID NO: 1116896 - RNA, 20 nt, Mycobacterium bovis subsp bovis AF2122/97
cgucgacaguuuucaccgcg

SEQ ID NO: 1116897 - RNA, 21 nt, Mycobacterium bovis subsp bovis AF2122/97
cgucgacaguuuucaccgcga

SEQ ID NO: 1116898 - RNA, 21 nt, Mycobacterium bovis subsp bovis AF2122/97
cgucgaccaagguguccagca

SEQ ID NO: 1116899 - RNA, 22 nt, Mycobacterium bovis subsp bovis AF2122/97
cgucgaccacaggcaucggagg

SEQ ID NO: 1116900 - RNA, 18 nt, Mycobacterium bovis subsp bovis AF2122/97
cgucgaccaggccacugc

SEQ ID NO: 1116901 - RNA, 13 nt, Mycobacterium bovis subsp bovis AF2122/97
cguccgucggcgc

SEQ ID NO: 1116902 - RNA, 19 nt, Mycobacterium bovis subsp bovis AF2122/97
cguccgucggcgcucgucg

SEQ ID NO: 1116903 - RNA, 16 nt, Mycobacterium bovis subsp bovis AF2122/97
cguccgucucgcaggc

SEQ ID NO: 1116904 - RNA, 19 nt, Mycobacterium bovis subsp bovis AF2122/97
cguccggugcugguccagc

SEQ ID NO: 1116905 - RNA, 16 nt, Mycobacterium bovis subsp bovis AF2122/97
cguccgguggaccgcc

SEQ ID NO: 1116906 - RNA, 21 nt, Mycobacterium bovis subsp bovis AF2122/97
cguccggucgccucaccggcg

SEQ ID NO: 1116907 - RNA, 14 nt, Mycobacterium bovis subsp bovis AF2122/97
cguccgcccagccg

SEQ ID NO: 1116908 - RNA, 23 nt, Mycobacterium bovis subsp bovis AF2122/97
cguccgcggacuuggcggucggu

SEQ ID NO: 1116909 - RNA, 16 nt, Mycobacterium bovis subsp bovis AF2122/97
cguccgcggagcucaa

SEQ ID NO: 1116910 - RNA, 17 nt, Mycobacterium bovis subsp bovis AF2122/97
cguccgcggucgcagca

SEQ ID NO: 1116911 - RNA, 18 nt, Mycobacterium bovis subsp bovis AF2122/97
cguccgcgggggaccgcc

SEQ ID NO: 1116912 - RNA, 15 nt, Mycobacterium bovis subsp bovis AF2122/97
cguccggguggcaca

SEQ ID NO: 1116913 - RNA, 17 nt, Mycobacterium bovis subsp bovis AF2122/97
cguccgggucaccagcg

SEQ ID NO: 1116914 - RNA, 19 nt, Mycobacterium bovis subsp bovis AF2122/97
cguccgggucaccagcgca

SEQ ID NO: 1116915 - RNA, 14 nt, Mycobacterium bovis subsp bovis AF2122/97
cguccggggccgcg

SEQ ID NO: 1116916 - RNA, 16 nt, Mycobacterium bovis subsp bovis AF2122/97
cguccggggccgcggc

SEQ ID NO: 1116917 - RNA, 17 nt, Mycobacterium bovis subsp bovis AF2122/97
cguccggggccgcggcc

SEQ ID NO: 1116918 - RNA, 15 nt, Mycobacterium bovis subsp bovis AF2122/97
cgucgacggcgaugg

SEQ ID NO: 1116919 - RNA, 14 nt, Mycobacterium bovis subsp bovis AF2122/97
cgucgagacuucgg

SEQ ID NO: 1116920 - RNA, 18 nt, Mycobacterium bovis subsp bovis AF2122/97
cgucgagagguucgccgu

SEQ ID NO: 1116921 - RNA, 21 nt, Mycobacterium bovis subsp bovis AF2122/97
cgucgacggccuggggcagcc

SEQ ID NO: 1116922 - RNA, 14 nt, Mycobacterium bovis subsp bovis AF2122/97
cgucgacggcgaug

SEQ ID NO: 1116923 - RNA, 13 nt, Mycobacterium bovis subsp bovis AF2122/97
cgucgacgcguug

SEQ ID NO: 1116924 - RNA, 14 nt, Mycobacterium bovis subsp bovis AF2122/97
cgucgacgcgucgu

SEQ ID NO: 1116925 - RNA, 18 nt, Mycobacterium bovis subsp bovis AF2122/97
cgucgacgccgaucgcgg

SEQ ID NO: 1116926 - RNA, 18 nt, Mycobacterium bovis subsp bovis AF2122/97
cgucgacgccggccagcg

SEQ ID NO: 1116927 - RNA, 22 nt, Mycobacterium bovis subsp bovis AF2122/97
cgucgacgaauaacgcggucgg

SEQ ID NO: 1116928 - RNA, 14 nt, Mycobacterium bovis subsp bovis AF2122/97
cgucgacgaucagc

SEQ ID NO: 1116929 - RNA, 13 nt, Mycobacterium bovis subsp bovis AF2122/97
cgucgacccgaac

SEQ ID NO: 1116930 - RNA, 18 nt, Mycobacterium bovis subsp bovis AF2122/97
cgucgaccaugcgaccgg

SEQ ID NO: 1116931 - RNA, 19 nt, Mycobacterium bovis subsp bovis AF2122/97
cgucgaccaugcgaccggc

SEQ ID NO: 1116932 - RNA, 23 nt, Mycobacterium bovis subsp bovis AF2122/97
cgucgaccaugcgaccggcaacg

SEQ ID NO: 1116933 - RNA, 16 nt, Mycobacterium bovis subsp bovis AF2122/97
cgucgagggugaccaa

SEQ ID NO: 1116934 - RNA, 14 nt, Mycobacterium bovis subsp bovis AF2122/97
cgucgaggcggcag

SEQ ID NO: 1116935 - RNA, 15 nt, Mycobacterium bovis subsp bovis AF2122/97
cgucgaggcugaccg

SEQ ID NO: 1116936 - RNA, 16 nt, Mycobacterium bovis subsp bovis AF2122/97
cgucgaggcugaccgu

SEQ ID NO: 1116937 - RNA, 19 nt, Mycobacterium bovis subsp bovis AF2122/97
cgucgaggcugaccguggc

SEQ ID NO: 1116938 - RNA, 20 nt, Mycobacterium bovis subsp bovis AF2122/97
cgucgagccacagcgucgaa

SEQ ID NO: 1116939 - RNA, 23 nt, Mycobacterium bovis subsp bovis AF2122/97
cgucgagcucguccucgucuucg

SEQ ID NO: 1116940 - RNA, 15 nt, Mycobacterium bovis subsp bovis AF2122/97
cgucgagcugauacg

SEQ ID NO: 1116941 - RNA, 17 nt, Mycobacterium bovis subsp bovis AF2122/97
cgucgagcagcgccacc

SEQ ID NO: 1116942 - RNA, 17 nt, Mycobacterium bovis subsp bovis AF2122/97
cgucgagcaccacccgg

SEQ ID NO: 1116943 - RNA, 18 nt, Mycobacterium bovis subsp bovis AF2122/97
cgucgagauagccgacgu

SEQ ID NO: 1116944 - RNA, 15 nt, Mycobacterium bovis subsp bovis AF2122/97
cgucgagauccucgu

SEQ ID NO: 1116945 - RNA, 21 nt, Mycobacterium bovis subsp bovis AF2122/97
cgucgagcaacgugacccgga

SEQ ID NO: 1116946 - RNA, 14 nt, Mycobacterium bovis subsp bovis AF2122/97
cgucgagcaccuug

SEQ ID NO: 1116947 - RNA, 22 nt, Mycobacterium bovis subsp bovis AF2122/97
cgucgagcagcaccacccgcac

SEQ ID NO: 1116948 - RNA, 14 nt, Mycobacterium bovis subsp bovis AF2122/97
cgucgcccgggugg

SEQ ID NO: 1116949 - RNA, 21 nt, Mycobacterium bovis subsp bovis AF2122/97
cgucgcccggguggcgucgau

SEQ ID NO: 1116950 - RNA, 20 nt, Mycobacterium bovis subsp bovis AF2122/97
cgucgcccgcauugaucucg

SEQ ID NO: 1116951 - RNA, 21 nt, Mycobacterium bovis subsp bovis AF2122/97
cgucgcccagugcgcaaccca

SEQ ID NO: 1116952 - RNA, 18 nt, Mycobacterium bovis subsp bovis AF2122/97
cgucgccgccgucaccgc

SEQ ID NO: 1116953 - RNA, 16 nt, Mycobacterium bovis subsp bovis AF2122/97
cgucgccgccguugcc

SEQ ID NO: 1116954 - RNA, 23 nt, Mycobacterium bovis subsp bovis AF2122/97
cgucgccgccguugccgccggcg

SEQ ID NO: 1116955 - RNA, 22 nt, Mycobacterium bovis subsp bovis AF2122/97
cgucgcccccggccauggcgcg

SEQ ID NO: 1116956 - RNA, 15 nt, Mycobacterium bovis subsp bovis AF2122/97
cgucgccgccggcgc

SEQ ID NO: 1116957 - RNA, 16 nt, Mycobacterium bovis subsp bovis AF2122/97
cgucgccgccggcgcc

SEQ ID NO: 1116958 - RNA, 15 nt, Mycobacterium bovis subsp bovis AF2122/97
cgucgccgccggcuc

SEQ ID NO: 1116959 - RNA, 23 nt, Mycobacterium bovis subsp bovis AF2122/97
cgucgcccugacacaacaccggc

SEQ ID NO: 1116960 - RNA, 12 nt, Mycobacterium bovis subsp bovis AF2122/97
cgucgccggcac

SEQ ID NO: 1116961 - RNA, 13 nt, Mycobacterium bovis subsp bovis AF2122/97
cgucgccggcacc

SEQ ID NO: 1116962 - RNA, 14 nt, Mycobacterium bovis subsp bovis AF2122/97
cgucgccggcaccg

SEQ ID NO: 1116963 - RNA, 20 nt, Mycobacterium bovis subsp bovis AF2122/97
cgucgccggcaccggccuug

SEQ ID NO: 1116964 - RNA, 13 nt, Mycobacterium bovis subsp bovis AF2122/97
cgucgccggcccc

SEQ ID NO: 1116965 - RNA, 22 nt, Mycobacterium bovis subsp bovis AF2122/97
cgucgccggccccgccggcgcc

SEQ ID NO: 1116966 - RNA, 15 nt, Mycobacterium bovis subsp bovis AF2122/97
cgucgccgccgguga

SEQ ID NO: 1116967 - RNA, 14 nt, Mycobacterium bovis subsp bovis AF2122/97
cgucgccgcggcgg

SEQ ID NO: 1116968 - RNA, 18 nt, Mycobacterium bovis subsp bovis AF2122/97
cgucgccgcggcggcagc

SEQ ID NO: 1116969 - RNA, 14 nt, Mycobacterium bovis subsp bovis AF2122/97
cgucgccggccuug

SEQ ID NO: 1116970 - RNA, 20 nt, Mycobacterium bovis subsp bovis AF2122/97
cgucgccggucaggccgccg

SEQ ID NO: 1116971 - RNA, 13 nt, Mycobacterium bovis subsp bovis AF2122/97
cgucgccggugcc

SEQ ID NO: 1116972 - RNA, 16 nt, Mycobacterium bovis subsp bovis AF2122/97
cgucgccggcggcggu

SEQ ID NO: 1116973 - RNA, 17 nt, Mycobacterium bovis subsp bovis AF2122/97
cgucgccggcggcggug

SEQ ID NO: 1116974 - RNA, 20 nt, Mycobacterium bovis subsp bovis AF2122/97
cgucgcgauccacuccggcg

SEQ ID NO: 1116975 - RNA, 13 nt, Mycobacterium bovis subsp bovis AF2122/97
cgucgcgcaucgc

SEQ ID NO: 1116976 - RNA, 21 nt, Mycobacterium bovis subsp bovis AF2122/97
cgucgcgcaucgccuccucga

SEQ ID NO: 1116977 - RNA, 21 nt, Mycobacterium bovis subsp bovis AF2122/97
cgucgcgcagguagcgccgca

SEQ ID NO: 1116978 - RNA, 15 nt, Mycobacterium bovis subsp bovis AF2122/97
cgucgcgccaggcgc

SEQ ID NO: 1116979 - RNA, 14 nt, Mycobacterium bovis subsp bovis AF2122/97
cgucgcggcggcac

SEQ ID NO: 1116980 - RNA, 13 nt, Mycobacterium bovis subsp bovis AF2122/97
cgucgcgggagaa

SEQ ID NO: 1116981 - RNA, 21 nt, Mycobacterium bovis subsp bovis AF2122/97
cgucgagguuuuucgaugggu

SEQ ID NO: 1116982 - RNA, 14 nt, Mycobacterium bovis subsp bovis AF2122/97
cgucgagguggcgc

SEQ ID NO: 1116983 - RNA, 15 nt, Mycobacterium bovis subsp bovis AF2122/97
cgucgagguccacca

SEQ ID NO: 1116984 - RNA, 18 nt, Mycobacterium bovis subsp bovis AF2122/97
cgucgagguccaccaccc

SEQ ID NO: 1116985 - RNA, 15 nt, Mycobacterium bovis subsp bovis AF2122/97
cgucgagguccucga

SEQ ID NO: 1116986 - RNA, 23 nt, Mycobacterium bovis subsp bovis AF2122/97
cgucgagggagcgccgcaggguc

SEQ ID NO: 1116987 - RNA, 20 nt, Mycobacterium bovis subsp bovis AF2122/97
cgucgagguccucgucgucg

SEQ ID NO: 1116988 - RNA, 14 nt, Mycobacterium bovis subsp bovis AF2122/97
cgucgagucgccga

SEQ ID NO: 1116989 - RNA, 16 nt, Mycobacterium bovis subsp bovis AF2122/97
cgucgauaaccuggcg

SEQ ID NO: 1116990 - RNA, 19 nt, Mycobacterium bovis subsp bovis AF2122/97
cgucgaguuccggccggua

SEQ ID NO: 1116991 - RNA, 22 nt, Mycobacterium bovis subsp bovis AF2122/97
cgucgaguucgguugcccccag

SEQ ID NO: 1116992 - RNA, 19 nt, Mycobacterium bovis subsp bovis AF2122/97
cgucgaucagugcaagacc

SEQ ID NO: 1116993 - RNA, 13 nt, Mycobacterium bovis subsp bovis AF2122/97
cgucgaucgccgc

SEQ ID NO: 1116994 - RNA, 15 nt, Mycobacterium bovis subsp bovis AF2122/97
cgucgaucgccgcga

SEQ ID NO: 1116995 - RNA, 19 nt, Mycobacterium bovis subsp bovis AF2122/97
cgucgaucgccgcgauggc

SEQ ID NO: 1116996 - RNA, 15 nt, Mycobacterium bovis subsp bovis AF2122/97
cgucgaucgccgcgc

SEQ ID NO: 1116997 - RNA, 16 nt, Mycobacterium bovis subsp bovis AF2122/97
cgucgaucgccgcgcc

SEQ ID NO: 1116998 - RNA, 16 nt, Mycobacterium bovis subsp bovis AF2122/97
cgucgaucccggucgg

SEQ ID NO: 1116999 - RNA, 17 nt, Mycobacterium bovis subsp bovis AF2122/97
cgucgauccgucggcgg

SEQ ID NO: 1117000 - RNA, 12 nt, Mycobacterium bovis subsp bovis AF2122/97
cgucgaucgcgg

SEQ ID NO: 1117001 - RNA, 18 nt, Mycobacterium bovis subsp bovis AF2122/97
cgucgaugccggcugccg

SEQ ID NO: 1117002 - RNA, 22 nt, Mycobacterium bovis subsp bovis AF2122/97
cgucgaugccggcugccgcacc

SEQ ID NO: 1117003 - RNA, 15 nt, Mycobacterium bovis subsp bovis AF2122/97
cgucgauggccaccc

SEQ ID NO: 1117004 - RNA, 21 nt, Mycobacterium bovis subsp bovis AF2122/97
cgucgaugcgcugcucacgca

SEQ ID NO: 1117005 - RNA, 24 nt, Mycobacterium bovis subsp bovis AF2122/97
cgucgccauuccaucgcgcaccgc

SEQ ID NO: 1117006 - RNA, 17 nt, Mycobacterium bovis subsp bovis AF2122/97
cgucgauuagcccaccc

SEQ ID NO: 1117007 - RNA, 15 nt, Mycobacterium bovis subsp bovis AF2122/97
cgucgauggucagca

SEQ ID NO: 1117008 - RNA, 15 nt, Mycobacterium bovis subsp bovis AF2122/97
cgucgcaaggcccgc

SEQ ID NO: 1117009 - RNA, 15 nt, Mycobacterium bovis subsp bovis AF2122/97
cgucgcaacccggcc

SEQ ID NO: 1117010 - RNA, 15 nt, Mycobacterium bovis subsp bovis AF2122/97
cgucgauuucgacga

SEQ ID NO: 1117011 - RNA, 21 nt, Mycobacterium bovis subsp bovis AF2122/97
cgucgauuucgacgaccaccu

SEQ ID NO: 1117012 - RNA, 15 nt, Mycobacterium bovis subsp bovis AF2122/97
cgucgauuucggcga

SEQ ID NO: 1117013 - RNA, 15 nt, Mycobacterium bovis subsp bovis AF2122/97
cguauucggccgcga

SEQ ID NO: 1117014 - RNA, 22 nt, Mycobacterium bovis subsp bovis AF2122/97
cguauugcaccgccaggucgag

SEQ ID NO: 1117015 - RNA, 19 nt, Mycobacterium bovis subsp bovis AF2122/97
cguauugccaaagcccgac

SEQ ID NO: 1117016 - RNA, 23 nt, Mycobacterium bovis subsp bovis AF2122/97
cgucaacaccaugguggugaugc

SEQ ID NO: 1117017 - RNA, 14 nt, Mycobacterium bovis subsp bovis AF2122/97
cgucaacagcgugg

SEQ ID NO: 1117018 - RNA, 17 nt, Mycobacterium bovis subsp bovis AF2122/97
cguauuggacgcugccg

SEQ ID NO: 1117019 - RNA, 17 nt, Mycobacterium bovis subsp bovis AF2122/97
cguaguaggcgccgcga

SEQ ID NO: 1117020 - RNA, 16 nt, Mycobacterium bovis subsp bovis AF2122/97
cguagguggccagcgc

SEQ ID NO: 1117021 - RNA, 20 nt, Mycobacterium bovis subsp bovis AF2122/97
cguaguaaggagccgggccg

SEQ ID NO: 1117022 - RNA, 15 nt, Mycobacterium bovis subsp bovis AF2122/97
cguaguaaugcucga

SEQ ID NO: 1117023 - RNA, 18 nt, Mycobacterium bovis subsp bovis AF2122/97
cguaugauucacgcucgg

SEQ ID NO: 1117024 - RNA, 22 nt, Mycobacterium bovis subsp bovis AF2122/97
cguaugccaggacuggcaccgc

SEQ ID NO: 1117025 - RNA, 14 nt, Mycobacterium bovis subsp bovis AF2122/97
cguauggacgagga

SEQ ID NO: 1117026 - RNA, 15 nt, Mycobacterium bovis subsp bovis AF2122/97
cguaggcguacacca

SEQ ID NO: 1117027 - RNA, 14 nt, Mycobacterium bovis subsp bovis AF2122/97
cguaggcggcgacc

SEQ ID NO: 1117028 - RNA, 18 nt, Mycobacterium bovis subsp bovis AF2122/97
cguagggauagcagugca

SEQ ID NO: 1117029 - RNA, 14 nt, Mycobacterium bovis subsp bovis AF2122/97
cguagggcagcgcc

SEQ ID NO: 1117030 - RNA, 14 nt, Mycobacterium bovis subsp bovis AF2122/97
cguagggccagcgc

SEQ ID NO: 1117031 - RNA, 12 nt, Mycobacterium bovis subsp bovis AF2122/97
cguaggucgugg

SEQ ID NO: 1117032 - RNA, 17 nt, Mycobacterium bovis subsp bovis AF2122/97
cgucacgccggaugguc

SEQ ID NO: 1117033 - RNA, 22 nt, Mycobacterium bovis subsp bovis AF2122/97
cgucacgccggauggucggcca

SEQ ID NO: 1117034 - RNA, 12 nt, Mycobacterium bovis subsp bovis AF2122/97
cgucacgccacc

SEQ ID NO: 1117035 - RNA, 16 nt, Mycobacterium bovis subsp bovis AF2122/97
cgucacgccaccgcaa

SEQ ID NO: 1117036 - RNA, 14 nt, Mycobacterium bovis subsp bovis AF2122/97
cgucacggaccgcc

SEQ ID NO: 1117037 - RNA, 16 nt, Mycobacterium bovis subsp bovis AF2122/97
cgucacggaccgccac

SEQ ID NO: 1117038 - RNA, 13 nt, Mycobacterium bovis subsp bovis AF2122/97
cgucacgcggguu

SEQ ID NO: 1117039 - RNA, 17 nt, Mycobacterium bovis subsp bovis AF2122/97
cgucacgcguacgucgg

SEQ ID NO: 1117040 - RNA, 17 nt, Mycobacterium bovis subsp bovis AF2122/97
cgucacgcaaccggcgg

SEQ ID NO: 1117041 - RNA, 20 nt, Mycobacterium bovis subsp bovis AF2122/97
cgucacgcaaccggcggaca

SEQ ID NO: 1117042 - RNA, 19 nt, Mycobacterium bovis subsp bovis AF2122/97
cgucacgccccucacgugg

SEQ ID NO: 1117043 - RNA, 13 nt, Mycobacterium bovis subsp bovis AF2122/97
cgucagccaccgc

SEQ ID NO: 1117044 - RNA, 22 nt, Mycobacterium bovis subsp bovis AF2122/97
cgucagcaugggaauccgcugu

SEQ ID NO: 1117045 - RNA, 19 nt, Mycobacterium bovis subsp bovis AF2122/97
cgucaccgacgcacaggcg

SEQ ID NO: 1117046 - RNA, 22 nt, Mycobacterium bovis subsp bovis AF2122/97
cgucacccccgauagcgaccgc

SEQ ID NO: 1117047 - RNA, 14 nt, Mycobacterium bovis subsp bovis AF2122/97
cgucacccgguguc

SEQ ID NO: 1117048 - RNA, 20 nt, Mycobacterium bovis subsp bovis AF2122/97
cgucaccccggucccgccga

SEQ ID NO: 1117049 - RNA, 13 nt, Mycobacterium bovis subsp bovis AF2122/97
cgucacccgcaac

SEQ ID NO: 1117050 - RNA, 13 nt, Mycobacterium bovis subsp bovis AF2122/97
cgucaccgccgac

SEQ ID NO: 1117051 - RNA, 15 nt, Mycobacterium bovis subsp bovis AF2122/97
cgucaccgccgacga

SEQ ID NO: 1117052 - RNA, 18 nt, Mycobacterium bovis subsp bovis AF2122/97
cgucaccgccggcaccgc

SEQ ID NO: 1117053 - RNA, 12 nt, Mycobacterium bovis subsp bovis AF2122/97
cgucaccgccgu

SEQ ID NO: 1117054 - RNA, 13 nt, Mycobacterium bovis subsp bovis AF2122/97
cgucaccgacugc

SEQ ID NO: 1117055 - RNA, 22 nt, Mycobacterium bovis subsp bovis AF2122/97
cgucaccgcccuugccgccggc

SEQ ID NO: 1117056 - RNA, 12 nt, Mycobacterium bovis subsp bovis AF2122/97
cgucaccgccga

SEQ ID NO: 1117057 - RNA, 16 nt, Mycobacterium bovis subsp bovis AF2122/97
cgucaccacgagggcc

SEQ ID NO: 1117058 - RNA, 14 nt, Mycobacterium bovis subsp bovis AF2122/97
cgucaccacgaucg

SEQ ID NO: 1117059 - RNA, 20 nt, Mycobacterium bovis subsp bovis AF2122/97
cgucaccaucgggucgucgg

SEQ ID NO: 1117060 - RNA, 23 nt, Mycobacterium bovis subsp bovis AF2122/97
cgucaccaucgggucgucggcgu

SEQ ID NO: 1117061 - RNA, 21 nt, Mycobacterium bovis subsp bovis AF2122/97
cgucaaccgaucggucguccg

SEQ ID NO: 1117062 - RNA, 17 nt, Mycobacterium bovis subsp bovis AF2122/97
cgucaaccacggccgcc

SEQ ID NO: 1117063 - RNA, 15 nt, Mycobacterium bovis subsp bovis AF2122/97
cgucaacccgguguc

SEQ ID NO: 1117064 - RNA, 24 nt, Mycobacterium bovis subsp bovis AF2122/97
cgucaaccaccaggagcggauagc

SEQ ID NO: 1117065 - RNA, 18 nt, Mycobacterium bovis subsp bovis AF2122/97
cgucaacgaugguggcga

SEQ ID NO: 1117066 - RNA, 20 nt, Mycobacterium bovis subsp bovis AF2122/97
cgucaacgacuggguggugc

SEQ ID NO: 1117067 - RNA, 22 nt, Mycobacterium bovis subsp bovis AF2122/97
cguagagcaugccgcccgcgcc

SEQ ID NO: 1117068 - RNA, 21 nt, Mycobacterium bovis subsp bovis AF2122/97
cguagacuuccucggauugca

SEQ ID NO: 1117069 - RNA, 15 nt, Mycobacterium bovis subsp bovis AF2122/97
cguagagcagcagcg

SEQ ID NO: 1117070 - RNA, 15 nt, Mycobacterium bovis subsp bovis AF2122/97
cguagaggacugcgg

SEQ ID NO: 1117071 - RNA, 20 nt, Mycobacterium bovis subsp bovis AF2122/97
cguagcgaagugcgcgcugg

SEQ ID NO: 1117072 - RNA, 13 nt, Mycobacterium bovis subsp bovis AF2122/97
cguagcgaccgcg

SEQ ID NO: 1117073 - RNA, 18 nt, Mycobacterium bovis subsp bovis AF2122/97
cguagcgaccgcggucgc

SEQ ID NO: 1117074 - RNA, 16 nt, Mycobacterium bovis subsp bovis AF2122/97
cguagcgaccucgccg

SEQ ID NO: 1117075 - RNA, 13 nt, Mycobacterium bovis subsp bovis AF2122/97
cguagcgcagcgc

SEQ ID NO: 1117076 - RNA, 15 nt, Mycobacterium bovis subsp bovis AF2122/97
cguagcgcagcgccu

SEQ ID NO: 1117077 - RNA, 15 nt, Mycobacterium bovis subsp bovis AF2122/97
cguagcuggcgaucu

SEQ ID NO: 1117078 - RNA, 19 nt, Mycobacterium bovis subsp bovis AF2122/97
cguagcuggcgaucugguc

SEQ ID NO: 1117079 - RNA, 17 nt, Mycobacterium bovis subsp bovis AF2122/97
cguagcugggcaccccg

SEQ ID NO: 1117080 - RNA, 17 nt, Mycobacterium bovis subsp bovis AF2122/97
cguagcugacggccugc

SEQ ID NO: 1117081 - RNA, 15 nt, Mycobacterium bovis subsp bovis AF2122/97
cguagcugcgcagcg

SEQ ID NO: 1117082 - RNA, 20 nt, Mycobacterium bovis subsp bovis AF2122/97
cguagcgggucagcucgacc

SEQ ID NO: 1117083 - RNA, 18 nt, Mycobacterium bovis subsp bovis AF2122/97
cguagcggcggcgcccgg

SEQ ID NO: 1117084 - RNA, 18 nt, Mycobacterium bovis subsp bovis AF2122/97
cguagcggucuccccaga

SEQ ID NO: 1117085 - RNA, 22 nt, Mycobacterium bovis subsp bovis AF2122/97
cguagcggucugugcugcgcug

SEQ ID NO: 1117086 - RNA, 15 nt, Mycobacterium bovis subsp bovis AF2122/97
cguagcgggcgcccu

SEQ ID NO: 1117087 - RNA, 17 nt, Mycobacterium bovis subsp bovis AF2122/97
cguagcgggggagcgaa

SEQ ID NO: 1117088 - RNA, 13 nt, Mycobacterium bovis subsp bovis AF2122/97
cguacuccccgcg

SEQ ID NO: 1117089 - RNA, 20 nt, Mycobacterium bovis subsp bovis AF2122/97
cguacucccaggccgccgcc

SEQ ID NO: 1117090 - RNA, 15 nt, Mycobacterium bovis subsp bovis AF2122/97
cguacucggcggcca

SEQ ID NO: 1117091 - RNA, 22 nt, Mycobacterium bovis subsp bovis AF2122/97
cguacucggugaucgcgguggc

SEQ ID NO: 1117092 - RNA, 20 nt, Mycobacterium bovis subsp bovis AF2122/97
cguagacgguuaccgcgaag

SEQ ID NO: 1117093 - RNA, 20 nt, Mycobacterium bovis subsp bovis AF2122/97
cguagacguagaaugcgccg

SEQ ID NO: 1117094 - RNA, 20 nt, Mycobacterium bovis subsp bovis AF2122/97
cguagacguccgcggucgca

SEQ ID NO: 1117095 - RNA, 19 nt, Mycobacterium bovis subsp bovis AF2122/97
cguagacggggugagccga

SEQ ID NO: 1117096 - RNA, 22 nt, Mycobacterium bovis subsp bovis AF2122/97
cguagacggugucacccucgcg

SEQ ID NO: 1117097 - RNA, 18 nt, Mycobacterium bovis subsp bovis AF2122/97
cguagacgacgucggccg

SEQ ID NO: 1117098 - RNA, 15 nt, Mycobacterium bovis subsp bovis AF2122/97
cguacuccaccgcgc

SEQ ID NO: 1117099 - RNA, 16 nt, Mycobacterium bovis subsp bovis AF2122/97
cguacuccaccgcgcc

SEQ ID NO: 1117100 - RNA, 16 nt, Mycobacterium bovis subsp bovis AF2122/97
cguacgacagucgcag

SEQ ID NO: 1117101 - RNA, 20 nt, Mycobacterium bovis subsp bovis AF2122/97
cguaccguucgggccguccu

SEQ ID NO: 1117102 - RNA, 21 nt, Mycobacterium bovis subsp bovis AF2122/97
cguaccguucgggccguccuc

SEQ ID NO: 1117103 - RNA, 17 nt, Mycobacterium bovis subsp bovis AF2122/97
cguaccuaaggcucacc

SEQ ID NO: 1117104 - RNA, 20 nt, Mycobacterium bovis subsp bovis AF2122/97
cguaccuaaggcucaccagg

SEQ ID NO: 1117105 - RNA, 12 nt, Mycobacterium bovis subsp bovis AF2122/97
cguacgcagcgu

SEQ ID NO: 1117106 - RNA, 20 nt, Mycobacterium bovis subsp bovis AF2122/97
cguacgccgccgaucaccag

SEQ ID NO: 1117107 - RNA, 22 nt, Mycobacterium bovis subsp bovis AF2122/97
cguacgccgccgaucaccaggg

SEQ ID NO: 1117108 - RNA, 15 nt, Mycobacterium bovis subsp bovis AF2122/97
cguaccgcgcguugu

SEQ ID NO: 1117109 - RNA, 15 nt, Mycobacterium bovis subsp bovis AF2122/97
cguaaucaagcagcg

SEQ ID NO: 1117110 - RNA, 21 nt, Mycobacterium bovis subsp bovis AF2122/97
cguaaucaauaaucacaucgg

SEQ ID NO: 1117111 - RNA, 13 nt, Mycobacterium bovis subsp bovis AF2122/97
cguaccgauucca

SEQ ID NO: 1117112 - RNA, 21 nt, Mycobacterium bovis subsp bovis AF2122/97
cgguguucaucacgccgccgg

SEQ ID NO: 1117113 - RNA, 22 nt, Mycobacterium bovis subsp bovis AF2122/97
cgguguucaucacgccgccgga

SEQ ID NO: 1117114 - RNA, 15 nt, Mycobacterium bovis subsp bovis AF2122/97
cgguguuagccccga

SEQ ID NO: 1117115 - RNA, 21 nt, Mycobacterium bovis subsp bovis AF2122/97
cgguguuagccccgaagccgg

SEQ ID NO: 1117116 - RNA, 21 nt, Mycobacterium bovis subsp bovis AF2122/97
cgguguuagcgcgaacccggc

SEQ ID NO: 1117117 - RNA, 21 nt, Mycobacterium bovis subsp bovis AF2122/97
cgguguuagugaggcccgagu

SEQ ID NO: 1117118 - RNA, 17 nt, Mycobacterium bovis subsp bovis AF2122/97
cgguguguucggcccgc

SEQ ID NO: 1117119 - RNA, 15 nt, Mycobacterium bovis subsp bovis AF2122/97
cggugugcacgcggg

SEQ ID NO: 1117120 - RNA, 13 nt, Mycobacterium bovis subsp bovis AF2122/97
cggugugcacggc

SEQ ID NO: 1117121 - RNA, 18 nt, Mycobacterium bovis subsp bovis AF2122/97
cgguguguauucgccgac

SEQ ID NO: 1117122 - RNA, 22 nt, Mycobacterium bovis subsp bovis AF2122/97
cggugugugcaagccgaacacc

SEQ ID NO: 1117123 - RNA, 13 nt, Mycobacterium bovis subsp bovis AF2122/97
cgguguguucggc

SEQ ID NO: 1117124 - RNA, 15 nt, Mycobacterium bovis subsp bovis AF2122/97
cggugucgucgaggu

SEQ ID NO: 1117125 - RNA, 16 nt, Mycobacterium bovis subsp bovis AF2122/97
cgguguuccgcccagc

SEQ ID NO: 1117126 - RNA, 16 nt, Mycobacterium bovis subsp bovis AF2122/97
cggugucggcuggucg

SEQ ID NO: 1117127 - RNA, 16 nt, Mycobacterium bovis subsp bovis AF2122/97
cgguguuccgccgcgc

SEQ ID NO: 1117128 - RNA, 19 nt, Mycobacterium bovis subsp bovis AF2122/97
cgguguugauuccggcgug

SEQ ID NO: 1117129 - RNA, 13 nt, Mycobacterium bovis subsp bovis AF2122/97
cgguguugcccga

SEQ ID NO: 1117130 - RNA, 23 nt, Mycobacterium bovis subsp bovis AF2122/97
cgguguugcccgaccacaccggg

SEQ ID NO: 1117131 - RNA, 18 nt, Mycobacterium bovis subsp bovis AF2122/97
cgguguugccgaagcccg

SEQ ID NO: 1117132 - RNA, 15 nt, Mycobacterium bovis subsp bovis AF2122/97
cgguguugagaucgc

SEQ ID NO: 1117133 - RNA, 22 nt, Mycobacterium bovis subsp bovis AF2122/97
cgguguugcucccggccgccga

SEQ ID NO: 1117134 - RNA, 21 nt, Mycobacterium bovis subsp bovis AF2122/97
cgguguugagaucgcccgagu

SEQ ID NO: 1117135 - RNA, 20 nt, Mycobacterium bovis subsp bovis AF2122/97
cgguguugccguuaccgcca

SEQ ID NO: 1117136 - RNA, 21 nt, Mycobacterium bovis subsp bovis AF2122/97
cgguguuggacacucccgggu

SEQ ID NO: 1117137 - RNA, 14 nt, Mycobacterium bovis subsp bovis AF2122/97
cggugucggccagc

SEQ ID NO: 1117138 - RNA, 14 nt, Mycobacterium bovis subsp bovis AF2122/97
cggugucggccgcg

SEQ ID NO: 1117139 - RNA, 15 nt, Mycobacterium bovis subsp bovis AF2122/97
cggugucgcgaugcu

SEQ ID NO: 1117140 - RNA, 15 nt, Mycobacterium bovis subsp bovis AF2122/97
cggugucgucaucgg

SEQ ID NO: 1117141 - RNA, 12 nt, Mycobacterium bovis subsp bovis AF2122/97
cggugucgucga

SEQ ID NO: 1117142 - RNA, 17 nt, Mycobacterium bovis subsp bovis AF2122/97
cggugucggugcgcggc

SEQ ID NO: 1117143 - RNA, 18 nt, Mycobacterium bovis subsp bovis AF2122/97
cggugucggugcgcggca

SEQ ID NO: 1117144 - RNA, 20 nt, Mycobacterium bovis subsp bovis AF2122/97
cggugucgguucggucggcc

SEQ ID NO: 1117145 - RNA, 15 nt, Mycobacterium bovis subsp bovis AF2122/97
cggugucggcugguc

SEQ ID NO: 1117146 - RNA, 11 nt, Mycobacterium bovis subsp bovis AF2122/97
cggugucggug

SEQ ID NO: 1117147 - RNA, 12 nt, Mycobacterium bovis subsp bovis AF2122/97
cgguguagccgc

SEQ ID NO: 1117148 - RNA, 15 nt, Mycobacterium bovis subsp bovis AF2122/97
cgguguagccgccgg

SEQ ID NO: 1117149 - RNA, 14 nt, Mycobacterium bovis subsp bovis AF2122/97
cgguguagccggcg

SEQ ID NO: 1117150 - RNA, 16 nt, Mycobacterium bovis subsp bovis AF2122/97
cgguguagccggcgcc

SEQ ID NO: 1117151 - RNA, 20 nt, Mycobacterium bovis subsp bovis AF2122/97
cgguguagccggcgccgccg

SEQ ID NO: 1117152 - RNA, 13 nt, Mycobacterium bovis subsp bovis AF2122/97
cgguguagcagcg

SEQ ID NO: 1117153 - RNA, 17 nt, Mycobacterium bovis subsp bovis AF2122/97
cgguguagcagcgccag

SEQ ID NO: 1117154 - RNA, 14 nt, Mycobacterium bovis subsp bovis AF2122/97
cgguguagcccagc

SEQ ID NO: 1117155 - RNA, 15 nt, Mycobacterium bovis subsp bovis AF2122/97
cgguguagcccagcc

SEQ ID NO: 1117156 - RNA, 17 nt, Mycobacterium bovis subsp bovis AF2122/97
cgguguagcccagccgg

SEQ ID NO: 1117157 - RNA, 19 nt, Mycobacterium bovis subsp bovis AF2122/97
cgguguagcccagccgggu

SEQ ID NO: 1117158 - RNA, 13 nt, Mycobacterium bovis subsp bovis AF2122/97
cgguguauccgac

SEQ ID NO: 1117159 - RNA, 21 nt, Mycobacterium bovis subsp bovis AF2122/97
cgguguagcguucccacacgc

SEQ ID NO: 1117160 - RNA, 22 nt, Mycobacterium bovis subsp bovis AF2122/97
cgguguauccgacuggccccgc

SEQ ID NO: 1117161 - RNA, 18 nt, Mycobacterium bovis subsp bovis AF2122/97
cgguguagagcgcaccgc

SEQ ID NO: 1117162 - RNA, 15 nt, Mycobacterium bovis subsp bovis AF2122/97
cgguggugcugccga

SEQ ID NO: 1117163 - RNA, 16 nt, Mycobacterium bovis subsp bovis AF2122/97
cgguggugcucgucgg

SEQ ID NO: 1117164 - RNA, 17 nt, Mycobacterium bovis subsp bovis AF2122/97
cgguggugcggucuccg

SEQ ID NO: 1117165 - RNA, 15 nt, Mycobacterium bovis subsp bovis AF2122/97
cgguguacgcccgcu

SEQ ID NO: 1117166 - RNA, 18 nt, Mycobacterium bovis subsp bovis AF2122/97
cgguguacgcccgcucgg

SEQ ID NO: 1117167 - RNA, 15 nt, Mycobacterium bovis subsp bovis AF2122/97
cgguggugcggucuc

SEQ ID NO: 1117168 - RNA, 18 nt, Mycobacterium bovis subsp bovis AF2122/97
cgguggugaucacgucgg

SEQ ID NO: 1117169 - RNA, 16 nt, Mycobacterium bovis subsp bovis AF2122/97
cgguggugccggcgcc

SEQ ID NO: 1117170 - RNA, 15 nt, Mycobacterium bovis subsp bovis AF2122/97
cgguggugaucacgu

SEQ ID NO: 1117171 - RNA, 20 nt, Mycobacterium bovis subsp bovis AF2122/97
cgguggucguaggugacgaa

SEQ ID NO: 1117172 - RNA, 21 nt, Mycobacterium bovis subsp bovis AF2122/97
cgguggucguaggugacgaag

SEQ ID NO: 1117173 - RNA, 22 nt, Mycobacterium bovis subsp bovis AF2122/97
cgguggucgucccgcccauccc

SEQ ID NO: 1117174 - RNA, 15 nt, Mycobacterium bovis subsp bovis AF2122/97
cgguggugaccgcgg

SEQ ID NO: 1117175 - RNA, 11 nt, Mycobacterium bovis subsp bovis AF2122/97
cgguggugacg

SEQ ID NO: 1117176 - RNA, 15 nt, Mycobacterium bovis subsp bovis AF2122/97
cgguggugacggcgg

SEQ ID NO: 1117177 - RNA, 20 nt, Mycobacterium bovis subsp bovis AF2122/97
cgguggugacggcgguaccg

SEQ ID NO: 1117178 - RNA, 17 nt, Mycobacterium bovis subsp bovis AF2122/97
cgguggugagugcgucu

SEQ ID NO: 1117179 - RNA, 15 nt, Mycobacterium bovis subsp bovis AF2122/97
cgguggucgcgaccg

SEQ ID NO: 1117180 - RNA, 16 nt, Mycobacterium bovis subsp bovis AF2122/97
cgguggucgcgcccau

SEQ ID NO: 1117181 - RNA, 14 nt, Mycobacterium bovis subsp bovis AF2122/97
cgguggucggcgcg

SEQ ID NO: 1117182 - RNA, 23 nt, Mycobacterium bovis subsp bovis AF2122/97
cgguggucccgauggcgaugcgc

SEQ ID NO: 1117183 - RNA, 14 nt, Mycobacterium bovis subsp bovis AF2122/97
cggugaccaggccg

SEQ ID NO: 1117184 - RNA, 19 nt, Mycobacterium bovis subsp bovis AF2122/97
cggugaccaggccggcccg

SEQ ID NO: 1117185 - RNA, 20 nt, Mycobacterium bovis subsp bovis AF2122/97
cggugaccaggccggcccgc

SEQ ID NO: 1117186 - RNA, 20 nt, Mycobacterium bovis subsp bovis AF2122/97
cgguggugaccaaguagucg

SEQ ID NO: 1117187 - RNA, 21 nt, Mycobacterium bovis subsp bovis AF2122/97
cgguggugaccaaguagucgg

SEQ ID NO: 1117188 - RNA, 14 nt, Mycobacterium bovis subsp bovis AF2122/97
cgguggucugcgcg

SEQ ID NO: 1117189 - RNA, 14 nt, Mycobacterium bovis subsp bovis AF2122/97
cgguggucguaggu

SEQ ID NO: 1117190 - RNA, 16 nt, Mycobacterium bovis subsp bovis AF2122/97
cggugacccgcugggc

SEQ ID NO: 1117191 - RNA, 17 nt, Mycobacterium bovis subsp bovis AF2122/97
cgguggucggcgcgccg

SEQ ID NO: 1117192 - RNA, 19 nt, Mycobacterium bovis subsp bovis AF2122/97
cggugaagccgagcgcccg

SEQ ID NO: 1117193 - RNA, 22 nt, Mycobacterium bovis subsp bovis AF2122/97
cggugaagccguuugcgcuggc

SEQ ID NO: 1117194 - RNA, 18 nt, Mycobacterium bovis subsp bovis AF2122/97
cggugaaguagugcucgc

SEQ ID NO: 1117195 - RNA, 15 nt, Mycobacterium bovis subsp bovis AF2122/97
cggugaaguccucca

SEQ ID NO: 1117196 - RNA, 17 nt, Mycobacterium bovis subsp bovis AF2122/97
cggugaaucgaagcccg

SEQ ID NO: 1117197 - RNA, 19 nt, Mycobacterium bovis subsp bovis AF2122/97
cggugaaugccgucgccgg

SEQ ID NO: 1117198 - RNA, 20 nt, Mycobacterium bovis subsp bovis AF2122/97
cggugaaugccgucgccgga

SEQ ID NO: 1117199 - RNA, 16 nt, Mycobacterium bovis subsp bovis AF2122/97
cggugaauguugccgc

SEQ ID NO: 1117200 - RNA, 19 nt, Mycobacterium bovis subsp bovis AF2122/97
cggugaauguugccgccgc

SEQ ID NO: 1117201 - RNA, 21 nt, Mycobacterium bovis subsp bovis AF2122/97
cggugaauguugccgccgcgg

SEQ ID NO: 1117202 - RNA, 23 nt, Mycobacterium bovis subsp bovis AF2122/97
cggugaauucacgaugcucgccg

SEQ ID NO: 1117203 - RNA, 16 nt, Mycobacterium bovis subsp bovis AF2122/97
cggugaauucggcgag

SEQ ID NO: 1117204 - RNA, 20 nt, Mycobacterium bovis subsp bovis AF2122/97
cggugaccacuugcagcaca

SEQ ID NO: 1117205 - RNA, 16 nt, Mycobacterium bovis subsp bovis AF2122/97
cggugaccagcaacca

SEQ ID NO: 1117206 - RNA, 16 nt, Mycobacterium bovis subsp bovis AF2122/97
cggugaccaccccggc

SEQ ID NO: 1117207 - RNA, 22 nt, Mycobacterium bovis subsp bovis AF2122/97
cggugacauagacguugccgga

SEQ ID NO: 1117208 - RNA, 17 nt, Mycobacterium bovis subsp bovis AF2122/97
cggugacaaggaugguc

SEQ ID NO: 1117209 - RNA, 16 nt, Mycobacterium bovis subsp bovis AF2122/97
cggugacaccaacacc

SEQ ID NO: 1117210 - RNA, 19 nt, Mycobacterium bovis subsp bovis AF2122/97
cggugacaaauucggcgug

SEQ ID NO: 1117211 - RNA, 20 nt, Mycobacterium bovis subsp bovis AF2122/97
cggugacaaauucggcgugu

SEQ ID NO: 1117212 - RNA, 17 nt, Mycobacterium bovis subsp bovis AF2122/97
cggugacaagcggcccg

SEQ ID NO: 1117213 - RNA, 21 nt, Mycobacterium bovis subsp bovis AF2122/97
cggugacaagcggcccgcugu

SEQ ID NO: 1117214 - RNA, 17 nt, Mycobacterium bovis subsp bovis AF2122/97
cgguugcggcugcguug

SEQ ID NO: 1117215 - RNA, 20 nt, Mycobacterium bovis subsp bovis AF2122/97
cgguugcggucaucggcgcc

SEQ ID NO: 1117216 - RNA, 21 nt, Mycobacterium bovis subsp bovis AF2122/97
cgguugcggucaucggcgcca

SEQ ID NO: 1117217 - RNA, 23 nt, Mycobacterium bovis subsp bovis AF2122/97
cgguuggaccacgugaucgacga

SEQ ID NO: 1117218 - RNA, 18 nt, Mycobacterium bovis subsp bovis AF2122/97
cgguugcugugucguggu

SEQ ID NO: 1117219 - RNA, 17 nt, Mycobacterium bovis subsp bovis AF2122/97
cgguuggcagccacggg

SEQ ID NO: 1117220 - RNA, 18 nt, Mycobacterium bovis subsp bovis AF2122/97
cgguuggcagccacgggu

SEQ ID NO: 1117221 - RNA, 23 nt, Mycobacterium bovis subsp bovis AF2122/97
cgguuggccagccacagccgacc

SEQ ID NO: 1117222 - RNA, 15 nt, Mycobacterium bovis subsp bovis AF2122/97
cgguugccauccguc

SEQ ID NO: 1117223 - RNA, 17 nt, Mycobacterium bovis subsp bovis AF2122/97
cgguugccccgaccgcc

SEQ ID NO: 1117224 - RNA, 16 nt, Mycobacterium bovis subsp bovis AF2122/97
cgguugccccggcgac

SEQ ID NO: 1117225 - RNA, 23 nt, Mycobacterium bovis subsp bovis AF2122/97
cgguugcccgagcggcugagccg

SEQ ID NO: 1117226 - RNA, 16 nt, Mycobacterium bovis subsp bovis AF2122/97
cgguugcacccgcgcg

SEQ ID NO: 1117227 - RNA, 17 nt, Mycobacterium bovis subsp bovis AF2122/97
cgguugccacgccgccg

SEQ ID NO: 1117228 - RNA, 18 nt, Mycobacterium bovis subsp bovis AF2122/97
cgguugccacgccgccgg

SEQ ID NO: 1117229 - RNA, 19 nt, Mycobacterium bovis subsp bovis AF2122/97
cgguugccacgccgccggu

SEQ ID NO: 1117230 - RNA, 17 nt, Mycobacterium bovis subsp bovis AF2122/97
cgguugcauaccgccgg

SEQ ID NO: 1117231 - RNA, 18 nt, Mycobacterium bovis subsp bovis AF2122/97
cgguugaugcggccgcgg

SEQ ID NO: 1117232 - RNA, 19 nt, Mycobacterium bovis subsp bovis AF2122/97
cgguugaugcggccgcggc

SEQ ID NO: 1117233 - RNA, 18 nt, Mycobacterium bovis subsp bovis AF2122/97
cgguugaugguccgccag

SEQ ID NO: 1117234 - RNA, 17 nt, Mycobacterium bovis subsp bovis AF2122/97
cgguugaucgccggccu

SEQ ID NO: 1117235 - RNA, 19 nt, Mycobacterium bovis subsp bovis AF2122/97
cgguugaucgccggccugc

SEQ ID NO: 1117236 - RNA, 14 nt, Mycobacterium bovis subsp bovis AF2122/97
cgguugaucggcca

SEQ ID NO: 1117237 - RNA, 18 nt, Mycobacterium bovis subsp bovis AF2122/97
cgguugaucugucagcgc

SEQ ID NO: 1117238 - RNA, 15 nt, Mycobacterium bovis subsp bovis AF2122/97
cgguugaugcaucca

SEQ ID NO: 1117239 - RNA, 21 nt, Mycobacterium bovis subsp bovis AF2122/97
cgguugaugcauccagaagua

SEQ ID NO: 1117240 - RNA, 19 nt, Mycobacterium bovis subsp bovis AF2122/97
cgguucaccacgucgucgg

SEQ ID NO: 1117241 - RNA, 19 nt, Mycobacterium bovis subsp bovis AF2122/97
cgguucagggguggcgcgg

SEQ ID NO: 1117242 - RNA, 20 nt, Mycobacterium bovis subsp bovis AF2122/97
cgguucagggguggcgcggg

SEQ ID NO: 1117243 - RNA, 23 nt, Mycobacterium bovis subsp bovis AF2122/97
cgguucagggguggcgcgggccg

SEQ ID NO: 1117244 - RNA, 14 nt, Mycobacterium bovis subsp bovis AF2122/97
cgguuccacgcugc

SEQ ID NO: 1117245 - RNA, 18 nt, Mycobacterium bovis subsp bovis AF2122/97
cgguucauccacuccgcc

SEQ ID NO: 1117246 - RNA, 20 nt, Mycobacterium bovis subsp bovis AF2122/97
cgguucagguugagugucgg

SEQ ID NO: 1117247 - RNA, 21 nt, Mycobacterium bovis subsp bovis AF2122/97
cgguucagguugagugucggg

SEQ ID NO: 1117248 - RNA, 17 nt, Mycobacterium bovis subsp bovis AF2122/97
cguaaccgucgccugcc

SEQ ID NO: 1117249 - RNA, 13 nt, Mycobacterium bovis subsp bovis AF2122/97
cguaacgccgcuc

SEQ ID NO: 1117250 - RNA, 15 nt, Mycobacterium bovis subsp bovis AF2122/97
cguaacugcccgcgg

SEQ ID NO: 1117251 - RNA, 18 nt, Mycobacterium bovis subsp bovis AF2122/97
cguaacugcccgcggcgg

SEQ ID NO: 1117252 - RNA, 12 nt, Mycobacterium bovis subsp bovis AF2122/97
cguaaggccgga

SEQ ID NO: 1117253 - RNA, 17 nt, Mycobacterium bovis subsp bovis AF2122/97
cguaaggccggagucga

SEQ ID NO: 1117254 - RNA, 13 nt, Mycobacterium bovis subsp bovis AF2122/97
cgguuggaucggc

SEQ ID NO: 1117255 - RNA, 16 nt, Mycobacterium bovis subsp bovis AF2122/97
cgguuggcggcgaugg

SEQ ID NO: 1117256 - RNA, 14 nt, Mycobacterium bovis subsp bovis AF2122/97
cgguuggcgcgggc

SEQ ID NO: 1117257 - RNA, 16 nt, Mycobacterium bovis subsp bovis AF2122/97
cgguugggguggcggu

SEQ ID NO: 1117258 - RNA, 14 nt, Mycobacterium bovis subsp bovis AF2122/97
cgguugguccucgg

SEQ ID NO: 1117259 - RNA, 18 nt, Mycobacterium bovis subsp bovis AF2122/97
cgguuggugcagcgugca

SEQ ID NO: 1117260 - RNA, 14 nt, Mycobacterium bovis subsp bovis AF2122/97
cgguuggcucgggc

SEQ ID NO: 1117261 - RNA, 13 nt, Mycobacterium bovis subsp bovis AF2122/97
cgguuuagccgcu

SEQ ID NO: 1117262 - RNA, 22 nt, Mycobacterium bovis subsp bovis AF2122/97
cgguuguuguagaucugcgcca

SEQ ID NO: 1117263 - RNA, 13 nt, Mycobacterium bovis subsp bovis AF2122/97
cgguugugcgcgc

SEQ ID NO: 1117264 - RNA, 18 nt, Mycobacterium bovis subsp bovis AF2122/97
cgguugugcgcgcgcccg

SEQ ID NO: 1117265 - RNA, 19 nt, Mycobacterium bovis subsp bovis AF2122/97
cgguugugcugggugccgc

SEQ ID NO: 1117266 - RNA, 20 nt, Mycobacterium bovis subsp bovis AF2122/97
cgguugugcugggugccgca

SEQ ID NO: 1117267 - RNA, 23 nt, Mycobacterium bovis subsp bovis AF2122/97
cgguuguggcugaucccggccag

SEQ ID NO: 1117268 - RNA, 16 nt, Mycobacterium bovis subsp bovis AF2122/97
cgguuguccuccgacg

SEQ ID NO: 1117269 - RNA, 23 nt, Mycobacterium bovis subsp bovis AF2122/97
cgguuguguugggagccaccggc

SEQ ID NO: 1117270 - RNA, 14 nt, Mycobacterium bovis subsp bovis AF2122/97
cgugggcgcggcgc

SEQ ID NO: 1117271 - RNA, 18 nt, Mycobacterium bovis subsp bovis AF2122/97
cgugggcgcggcgccaga

SEQ ID NO: 1117272 - RNA, 14 nt, Mycobacterium bovis subsp bovis AF2122/97
cgugggccugcccg

SEQ ID NO: 1117273 - RNA, 16 nt, Mycobacterium bovis subsp bovis AF2122/97
cgugggccugcccggc

SEQ ID NO: 1117274 - RNA, 15 nt, Mycobacterium bovis subsp bovis AF2122/97
cgugggcgacggcgg

SEQ ID NO: 1117275 - RNA, 15 nt, Mycobacterium bovis subsp bovis AF2122/97
cgugggccgcuggga

SEQ ID NO: 1117276 - RNA, 22 nt, Mycobacterium bovis subsp bovis AF2122/97
cgugggcacagccauggugggc

SEQ ID NO: 1117277 - RNA, 20 nt, Mycobacterium bovis subsp bovis AF2122/97
cgugggccacuugaugcucg

SEQ ID NO: 1117278 - RNA, 18 nt, Mycobacterium bovis subsp bovis AF2122/97
cgugggcauucucgagcc

SEQ ID NO: 1117279 - RNA, 15 nt, Mycobacterium bovis subsp bovis AF2122/97
cgugggcagcgcgau

SEQ ID NO: 1117280 - RNA, 18 nt, Mycobacterium bovis subsp bovis AF2122/97
cgugggcagcgcgcccga

SEQ ID NO: 1117281 - RNA, 15 nt, Mycobacterium bovis subsp bovis AF2122/97
cgugggaagagccgg

SEQ ID NO: 1117282 - RNA, 20 nt, Mycobacterium bovis subsp bovis AF2122/97
cguggcuggcggcgaccguc

SEQ ID NO: 1117283 - RNA, 21 nt, Mycobacterium bovis subsp bovis AF2122/97
cguggcuugguggucgccacc

SEQ ID NO: 1117284 - RNA, 17 nt, Mycobacterium bovis subsp bovis AF2122/97
cgugggcaccuuggccg

SEQ ID NO: 1117285 - RNA, 22 nt, Mycobacterium bovis subsp bovis AF2122/97
cgugggcacuugcccgucggcg

SEQ ID NO: 1117286 - RNA, 14 nt, Mycobacterium bovis subsp bovis AF2122/97
cgugggcagcgcga

SEQ ID NO: 1117287 - RNA, 20 nt, Mycobacterium bovis subsp bovis AF2122/97
cguggcugcgcucgcccgcg

SEQ ID NO: 1117288 - RNA, 15 nt, Mycobacterium bovis subsp bovis AF2122/97
cguggcugcguucgc

SEQ ID NO: 1117289 - RNA, 14 nt, Mycobacterium bovis subsp bovis AF2122/97
cguggcguuggcgg

SEQ ID NO: 1117290 - RNA, 19 nt, Mycobacterium bovis subsp bovis AF2122/97
cguggcguugguggucugc

SEQ ID NO: 1117291 - RNA, 21 nt, Mycobacterium bovis subsp bovis AF2122/97
cguggcuggacccgcauggcg

SEQ ID NO: 1117292 - RNA, 18 nt, Mycobacterium bovis subsp bovis AF2122/97
cguggcuggcaugccggc

SEQ ID NO: 1117293 - RNA, 23 nt, Mycobacterium bovis subsp bovis AF2122/97
cguggcuucacccaaccccgccg

SEQ ID NO: 1117294 - RNA, 16 nt, Mycobacterium bovis subsp bovis AF2122/97
cguggcgggcugcagc

SEQ ID NO: 1117295 - RNA, 17 nt, Mycobacterium bovis subsp bovis AF2122/97
cguggcgggcugcagcc

SEQ ID NO: 1117296 - RNA, 22 nt, Mycobacterium bovis subsp bovis AF2122/97
cguggcggcgggccucggcgac

SEQ ID NO: 1117297 - RNA, 14 nt, Mycobacterium bovis subsp bovis AF2122/97
cguggcggacggcg

SEQ ID NO: 1117298 - RNA, 16 nt, Mycobacterium bovis subsp bovis AF2122/97
cguggcgucgguggca

SEQ ID NO: 1117299 - RNA, 19 nt, Mycobacterium bovis subsp bovis AF2122/97
cguggcgucgugcgcggcc

SEQ ID NO: 1117300 - RNA, 16 nt, Mycobacterium bovis subsp bovis AF2122/97
cguggcgguggccguc

SEQ ID NO: 1117301 - RNA, 15 nt, Mycobacterium bovis subsp bovis AF2122/97
cguggcgucggcguc

SEQ ID NO: 1117302 - RNA, 14 nt, Mycobacterium bovis subsp bovis AF2122/97
cguggcgccacggc

SEQ ID NO: 1117303 - RNA, 18 nt, Mycobacterium bovis subsp bovis AF2122/97
cguggcgccacggcagcg

SEQ ID NO: 1117304 - RNA, 14 nt, Mycobacterium bovis subsp bovis AF2122/97
cguggcgcucggcg

SEQ ID NO: 1117305 - RNA, 18 nt, Mycobacterium bovis subsp bovis AF2122/97
cguggccgcgaucccggc

SEQ ID NO: 1117306 - RNA, 18 nt, Mycobacterium bovis subsp bovis AF2122/97
cguggcgcaccaccgccc

SEQ ID NO: 1117307 - RNA, 17 nt, Mycobacterium bovis subsp bovis AF2122/97
cguggcgaaugacggcc

SEQ ID NO: 1117308 - RNA, 18 nt, Mycobacterium bovis subsp bovis AF2122/97
cguggcgaaugacggcca

SEQ ID NO: 1117309 - RNA, 23 nt, Mycobacterium bovis subsp bovis AF2122/97
cguggcgaaugacggccaguugg

SEQ ID NO: 1117310 - RNA, 16 nt, Mycobacterium bovis subsp bovis AF2122/97
cguggcgaauucgacc

SEQ ID NO: 1117311 - RNA, 24 nt, Mycobacterium bovis subsp bovis AF2122/97
cguggcgaauucgaccacucgccg

SEQ ID NO: 1117312 - RNA, 15 nt, Mycobacterium bovis subsp bovis AF2122/97
cguggcaucgccucc

SEQ ID NO: 1117313 - RNA, 16 nt, Mycobacterium bovis subsp bovis AF2122/97
cguggccgacagcggg

SEQ ID NO: 1117314 - RNA, 14 nt, Mycobacterium bovis subsp bovis AF2122/97
cguggccgccggcg

SEQ ID NO: 1117315 - RNA, 16 nt, Mycobacterium bovis subsp bovis AF2122/97
cguggccgccggcgcu

SEQ ID NO: 1117316 - RNA, 17 nt, Mycobacterium bovis subsp bovis AF2122/97
cguggccgccggcgcug

SEQ ID NO: 1117317 - RNA, 14 nt, Mycobacterium bovis subsp bovis AF2122/97
cguggccccaccga

SEQ ID NO: 1117318 - RNA, 12 nt, Mycobacterium bovis subsp bovis AF2122/97
cguggcacgggu

SEQ ID NO: 1117319 - RNA, 14 nt, Mycobacterium bovis subsp bovis AF2122/97
cguggcaccgacag

SEQ ID NO: 1117320 - RNA, 22 nt, Mycobacterium bovis subsp bovis AF2122/97
cguggcaccaccaagguguggc

SEQ ID NO: 1117321 - RNA, 15 nt, Mycobacterium bovis subsp bovis AF2122/97
cguggaugucgcggu

SEQ ID NO: 1117322 - RNA, 20 nt, Mycobacterium bovis subsp bovis AF2122/97
cguggcacugacgcgcccga

SEQ ID NO: 1117323 - RNA, 17 nt, Mycobacterium bovis subsp bovis AF2122/97
cguggccacggcauucg

SEQ ID NO: 1117324 - RNA, 19 nt, Mycobacterium bovis subsp bovis AF2122/97
cguggcaguacaccggcgu

SEQ ID NO: 1117325 - RNA, 21 nt, Mycobacterium bovis subsp bovis AF2122/97
cguguccggggaccucggcga

SEQ ID NO: 1117326 - RNA, 24 nt, Mycobacterium bovis subsp bovis AF2122/97
cguguccgccggauagcaccggca

SEQ ID NO: 1117327 - RNA, 22 nt, Mycobacterium bovis subsp bovis AF2122/97
cguguccgccaaguacugggcc

SEQ ID NO: 1117328 - RNA, 18 nt, Mycobacterium bovis subsp bovis AF2122/97
cgugucccaagccugccg

SEQ ID NO: 1117329 - RNA, 23 nt, Mycobacterium bovis subsp bovis AF2122/97
cguguccgccggauagcaccggc

SEQ ID NO: 1117330 - RNA, 13 nt, Mycobacterium bovis subsp bovis AF2122/97
cgugucgccgcca

SEQ ID NO: 1117331 - RNA, 18 nt, Mycobacterium bovis subsp bovis AF2122/97
cgugucgccgccaccagc

SEQ ID NO: 1117332 - RNA, 13 nt, Mycobacterium bovis subsp bovis AF2122/97
cgugucgccgccg

SEQ ID NO: 1117333 - RNA, 14 nt, Mycobacterium bovis subsp bovis AF2122/97
cgugucgccgccgu

SEQ ID NO: 1117334 - RNA, 19 nt, Mycobacterium bovis subsp bovis AF2122/97
cgugucgccggcgaaguug

SEQ ID NO: 1117335 - RNA, 14 nt, Mycobacterium bovis subsp bovis AF2122/97
cgugucgacuccga

SEQ ID NO: 1117336 - RNA, 19 nt, Mycobacterium bovis subsp bovis AF2122/97
cgugucgacuccgaucggg

SEQ ID NO: 1117337 - RNA, 20 nt, Mycobacterium bovis subsp bovis AF2122/97
cgugucacccaauggagccg

SEQ ID NO: 1117338 - RNA, 23 nt, Mycobacterium bovis subsp bovis AF2122/97
cgugucacccaauggagccgcga

SEQ ID NO: 1117339 - RNA, 15 nt, Mycobacterium bovis subsp bovis AF2122/97
cgugucacccucggg

SEQ ID NO: 1117340 - RNA, 12 nt, Mycobacterium bovis subsp bovis AF2122/97
cgugucaccggg

SEQ ID NO: 1117341 - RNA, 20 nt, Mycobacterium bovis subsp bovis AF2122/97
cguguccaccggaccgacca

SEQ ID NO: 1117342 - RNA, 18 nt, Mycobacterium bovis subsp bovis AF2122/97
cgugucacgcgaccaccg

SEQ ID NO: 1117343 - RNA, 22 nt, Mycobacterium bovis subsp bovis AF2122/97
cguguaggcaaccuuuggccgc

SEQ ID NO: 1117344 - RNA, 16 nt, Mycobacterium bovis subsp bovis AF2122/97
cguguagccugcggcg

SEQ ID NO: 1117345 - RNA, 16 nt, Mycobacterium bovis subsp bovis AF2122/97
cguguagcugcggguc

SEQ ID NO: 1117346 - RNA, 17 nt, Mycobacterium bovis subsp bovis AF2122/97
cguguacgucgaucagg

SEQ ID NO: 1117347 - RNA, 16 nt, Mycobacterium bovis subsp bovis AF2122/97
cguguacgugcucgua

SEQ ID NO: 1117348 - RNA, 19 nt, Mycobacterium bovis subsp bovis AF2122/97
cgugguugcacguucggcg

SEQ ID NO: 1117349 - RNA, 16 nt, Mycobacterium bovis subsp bovis AF2122/97
cgugguucggcgucga

SEQ ID NO: 1117350 - RNA, 19 nt, Mycobacterium bovis subsp bovis AF2122/97
cgugguugccgaagccgga

SEQ ID NO: 1117351 - RNA, 17 nt, Mycobacterium bovis subsp bovis AF2122/97
cgugguuugcgucagcg

SEQ ID NO: 1117352 - RNA, 17 nt, Mycobacterium bovis subsp bovis AF2122/97
cgugguuuugucgacgu

SEQ ID NO: 1117353 - RNA, 20 nt, Mycobacterium bovis subsp bovis AF2122/97
cguguacauugccgacccgu

SEQ ID NO: 1117354 - RNA, 20 nt, Mycobacterium bovis subsp bovis AF2122/97
cgugguuuugucgacguucg

SEQ ID NO: 1117355 - RNA, 15 nt, Mycobacterium bovis subsp bovis AF2122/97
cguguaacgccgacu

SEQ ID NO: 1117356 - RNA, 13 nt, Mycobacterium bovis subsp bovis AF2122/97
cgugguggacgac

SEQ ID NO: 1117357 - RNA, 18 nt, Mycobacterium bovis subsp bovis AF2122/97
cgugguggacgaccgcgc

SEQ ID NO: 1117358 - RNA, 19 nt, Mycobacterium bovis subsp bovis AF2122/97
cgugguggacgaccgcgcg

SEQ ID NO: 1117359 - RNA, 17 nt, Mycobacterium bovis subsp bovis AF2122/97
cguggugcugaccgcgc

SEQ ID NO: 1117360 - RNA, 18 nt, Mycobacterium bovis subsp bovis AF2122/97
cguggugcugaccgcgcc

SEQ ID NO: 1117361 - RNA, 22 nt, Mycobacterium bovis subsp bovis AF2122/97
cgugguggcauaaccgcugaua

SEQ ID NO: 1117362 - RNA, 15 nt, Mycobacterium bovis subsp bovis AF2122/97
cgugguggccacgga

SEQ ID NO: 1117363 - RNA, 22 nt, Mycobacterium bovis subsp bovis AF2122/97
cgugguggcgccaugaagccgg

SEQ ID NO: 1117364 - RNA, 17 nt, Mycobacterium bovis subsp bovis AF2122/97
cgugguggaugagccgg

SEQ ID NO: 1117365 - RNA, 14 nt, Mycobacterium bovis subsp bovis AF2122/97
cgugguguacccgc

SEQ ID NO: 1117366 - RNA, 19 nt, Mycobacterium bovis subsp bovis AF2122/97
cgugguguaucgacggcgg

SEQ ID NO: 1117367 - RNA, 22 nt, Mycobacterium bovis subsp bovis AF2122/97
cgugguguaucgacggcggccu

SEQ ID NO: 1117368 - RNA, 14 nt, Mycobacterium bovis subsp bovis AF2122/97
cgugguggucgggc

SEQ ID NO: 1117369 - RNA, 17 nt, Mycobacterium bovis subsp bovis AF2122/97
cgugguggucgggcgca

SEQ ID NO: 1117370 - RNA, 21 nt, Mycobacterium bovis subsp bovis AF2122/97
cgugggcuugcuucucucaaa

SEQ ID NO: 1117371 - RNA, 12 nt, Mycobacterium bovis subsp bovis AF2122/97
cgugggugucgg

SEQ ID NO: 1117372 - RNA, 22 nt, Mycobacterium bovis subsp bovis AF2122/97
cgugguaaccauauggcccgcg

SEQ ID NO: 1117373 - RNA, 22 nt, Mycobacterium bovis subsp bovis AF2122/97
cgugguaccgcuuguccaccgu

SEQ ID NO: 1117374 - RNA, 14 nt, Mycobacterium bovis subsp bovis AF2122/97
cgugggugucggug

SEQ ID NO: 1117375 - RNA, 17 nt, Mycobacterium bovis subsp bovis AF2122/97
cgugggugucgguggcc

SEQ ID NO: 1117376 - RNA, 15 nt, Mycobacterium bovis subsp bovis AF2122/97
cgugguagccggcga

SEQ ID NO: 1117377 - RNA, 22 nt, Mycobacterium bovis subsp bovis AF2122/97
cgugguagccggcgacaccgca

SEQ ID NO: 1117378 - RNA, 19 nt, Mycobacterium bovis subsp bovis AF2122/97
cgugguacuuucacgcucg

SEQ ID NO: 1117379 - RNA, 17 nt, Mycobacterium bovis subsp bovis AF2122/97
cgugguagcgccucgug

SEQ ID NO: 1117380 - RNA, 22 nt, Mycobacterium bovis subsp bovis AF2122/97
cguggucaccccuucgccagcg

SEQ ID NO: 1117381 - RNA, 23 nt, Mycobacterium bovis subsp bovis AF2122/97
cguggucaccccuucgccagcgc

SEQ ID NO: 1117382 - RNA, 16 nt, Mycobacterium bovis subsp bovis AF2122/97
cgugguaucgccggga

SEQ ID NO: 1117383 - RNA, 22 nt, Mycobacterium bovis subsp bovis AF2122/97
cguggucaguugugcguugcgc

SEQ ID NO: 1117384 - RNA, 18 nt, Mycobacterium bovis subsp bovis AF2122/97
cguggugagccucggcga

SEQ ID NO: 1117385 - RNA, 18 nt, Mycobacterium bovis subsp bovis AF2122/97
cguggugcaacacgccgg

SEQ ID NO: 1117386 - RNA, 14 nt, Mycobacterium bovis subsp bovis AF2122/97
cguggugcggccgg

SEQ ID NO: 1117387 - RNA, 15 nt, Mycobacterium bovis subsp bovis AF2122/97
cguggucggcgaccc

SEQ ID NO: 1117388 - RNA, 17 nt, Mycobacterium bovis subsp bovis AF2122/97
cguggucgugggugagc

SEQ ID NO: 1117389 - RNA, 13 nt, Mycobacterium bovis subsp bovis AF2122/97
cguggucggccac

SEQ ID NO: 1117390 - RNA, 13 nt, Mycobacterium bovis subsp bovis AF2122/97
cguggucggcaaa

SEQ ID NO: 1117391 - RNA, 18 nt, Mycobacterium bovis subsp bovis AF2122/97
cguggucgcgcggcaccg

SEQ ID NO: 1117392 - RNA, 22 nt, Mycobacterium bovis subsp bovis AF2122/97
cguggucgacggggcggucggc

SEQ ID NO: 1117393 - RNA, 20 nt, Mycobacterium bovis subsp bovis AF2122/97
cguggucgacgugaucgcgg

SEQ ID NO: 1117394 - RNA, 22 nt, Mycobacterium bovis subsp bovis AF2122/97
cgugguccaaccgggccggcua

SEQ ID NO: 1117395 - RNA, 17 nt, Mycobacterium bovis subsp bovis AF2122/97
cguggucgagcaggcga

SEQ ID NO: 1117396 - RNA, 14 nt, Mycobacterium bovis subsp bovis AF2122/97
cguggucgccccga

SEQ ID NO: 1117397 - RNA, 16 nt, Mycobacterium bovis subsp bovis AF2122/97
cguucaugaucggcag

SEQ ID NO: 1117398 - RNA, 18 nt, Mycobacterium bovis subsp bovis AF2122/97
cguucaucauccacaccg

SEQ ID NO: 1117399 - RNA, 21 nt, Mycobacterium bovis subsp bovis AF2122/97
cguucaugaucggcagaaucc

SEQ ID NO: 1117400 - RNA, 21 nt, Mycobacterium bovis subsp bovis AF2122/97
cguucccacccacgccgacua

SEQ ID NO: 1117401 - RNA, 15 nt, Mycobacterium bovis subsp bovis AF2122/97
cguuccacgccggca

SEQ ID NO: 1117402 - RNA, 20 nt, Mycobacterium bovis subsp bovis AF2122/97
cguuccagcaguacaccgcc

SEQ ID NO: 1117403 - RNA, 21 nt, Mycobacterium bovis subsp bovis AF2122/97
cguuccacgucguacucgguc

SEQ ID NO: 1117404 - RNA, 23 nt, Mycobacterium bovis subsp bovis AF2122/97
cguuccagcaguacaccgcccgg

SEQ ID NO: 1117405 - RNA, 16 nt, Mycobacterium bovis subsp bovis AF2122/97
cguuccagcaucggug

SEQ ID NO: 1117406 - RNA, 23 nt, Mycobacterium bovis subsp bovis AF2122/97
cguuccagcaucggugcgggcgc

SEQ ID NO: 1117407 - RNA, 19 nt, Mycobacterium bovis subsp bovis AF2122/97
cguucagcggccagcagug

SEQ ID NO: 1117408 - RNA, 18 nt, Mycobacterium bovis subsp bovis AF2122/97
cguucaggccagcggauu

SEQ ID NO: 1117409 - RNA, 14 nt, Mycobacterium bovis subsp bovis AF2122/97
cguucagccaggcg

SEQ ID NO: 1117410 - RNA, 13 nt, Mycobacterium bovis subsp bovis AF2122/97
cguucagcgacca

SEQ ID NO: 1117411 - RNA, 13 nt, Mycobacterium bovis subsp bovis AF2122/97
cguucagcgccag

SEQ ID NO: 1117412 - RNA, 15 nt, Mycobacterium bovis subsp bovis AF2122/97
cguucagcgccagcg

SEQ ID NO: 1117413 - RNA, 17 nt, Mycobacterium bovis subsp bovis AF2122/97
cguucagcgccagcgcc

SEQ ID NO: 1117414 - RNA, 18 nt, Mycobacterium bovis subsp bovis AF2122/97
cguucagcgacggccgcc

SEQ ID NO: 1117415 - RNA, 19 nt, Mycobacterium bovis subsp bovis AF2122/97
cguucagcgacggccgcca

SEQ ID NO: 1117416 - RNA, 23 nt, Mycobacterium bovis subsp bovis AF2122/97
cguucacgcgcggaucggcggcc

SEQ ID NO: 1117417 - RNA, 17 nt, Mycobacterium bovis subsp bovis AF2122/97
cguucgccgaguauugg

SEQ ID NO: 1117418 - RNA, 16 nt, Mycobacterium bovis subsp bovis AF2122/97
cguucgccgcccggcg

SEQ ID NO: 1117419 - RNA, 14 nt, Mycobacterium bovis subsp bovis AF2122/97
cguucgccgucggu

SEQ ID NO: 1117420 - RNA, 18 nt, Mycobacterium bovis subsp bovis AF2122/97
cguucgccgucggugaug

SEQ ID NO: 1117421 - RNA, 15 nt, Mycobacterium bovis subsp bovis AF2122/97
cguucgcgucgccga

SEQ ID NO: 1117422 - RNA, 18 nt, Mycobacterium bovis subsp bovis AF2122/97
cguucgcgugccagcgcc

SEQ ID NO: 1117423 - RNA, 21 nt, Mycobacterium bovis subsp bovis AF2122/97
cguucgcgugccagcgccccg

SEQ ID NO: 1117424 - RNA, 17 nt, Mycobacterium bovis subsp bovis AF2122/97
cguucgcgggcgucccg

SEQ ID NO: 1117425 - RNA, 21 nt, Mycobacterium bovis subsp bovis AF2122/97
cguucgcgggcgucccgcaua

SEQ ID NO: 1117426 - RNA, 18 nt, Mycobacterium bovis subsp bovis AF2122/97
cguucgcgucacaccagc

SEQ ID NO: 1117427 - RNA, 16 nt, Mycobacterium bovis subsp bovis AF2122/97
cguuccaucgccgacg

SEQ ID NO: 1117428 - RNA, 16 nt, Mycobacterium bovis subsp bovis AF2122/97
cguucgagagccccga

SEQ ID NO: 1117429 - RNA, 13 nt, Mycobacterium bovis subsp bovis AF2122/97
cguucgccaggcc

SEQ ID NO: 1117430 - RNA, 15 nt, Mycobacterium bovis subsp bovis AF2122/97
cguucgcccgcccgu

SEQ ID NO: 1117431 - RNA, 21 nt, Mycobacterium bovis subsp bovis AF2122/97
cguucgcccuaauccgcuugc

SEQ ID NO: 1117432 - RNA, 14 nt, Mycobacterium bovis subsp bovis AF2122/97
cguucggcacaacc

SEQ ID NO: 1117433 - RNA, 14 nt, Mycobacterium bovis subsp bovis AF2122/97
cguucggccgacuc

SEQ ID NO: 1117434 - RNA, 13 nt, Mycobacterium bovis subsp bovis AF2122/97
cguucggccgggc

SEQ ID NO: 1117435 - RNA, 11 nt, Mycobacterium bovis subsp bovis AF2122/97
cguucggcgcu

SEQ ID NO: 1117436 - RNA, 15 nt, Mycobacterium bovis subsp bovis AF2122/97
cguucggcgucguug

SEQ ID NO: 1117437 - RNA, 13 nt, Mycobacterium bovis subsp bovis AF2122/97
cguucggcgcaca

SEQ ID NO: 1117438 - RNA, 17 nt, Mycobacterium bovis subsp bovis AF2122/97
cguucggcgcccgcucg

SEQ ID NO: 1117439 - RNA, 20 nt, Mycobacterium bovis subsp bovis AF2122/97
cguucggcgcccgcucggcc

SEQ ID NO: 1117440 - RNA, 21 nt, Mycobacterium bovis subsp bovis AF2122/97
cguucggcuaagccuucggug

SEQ ID NO: 1117441 - RNA, 15 nt, Mycobacterium bovis subsp bovis AF2122/97
cguucggcugccgcg

SEQ ID NO: 1117442 - RNA, 18 nt, Mycobacterium bovis subsp bovis AF2122/97
cguucggggccccgcggc

SEQ ID NO: 1117443 - RNA, 20 nt, Mycobacterium bovis subsp bovis AF2122/97
cguucggggccccgcggcgc

SEQ ID NO: 1117444 - RNA, 22 nt, Mycobacterium bovis subsp bovis AF2122/97
cguucugcccaggcaaaccgau

SEQ ID NO: 1117445 - RNA, 14 nt, Mycobacterium bovis subsp bovis AF2122/97
cguucggcgcacag

SEQ ID NO: 1117446 - RNA, 18 nt, Mycobacterium bovis subsp bovis AF2122/97
cguucgggcccguagccg

SEQ ID NO: 1117447 - RNA, 24 nt, Mycobacterium bovis subsp bovis AF2122/97
cgugucugggaccccgcugcgacg

SEQ ID NO: 1117448 - RNA, 22 nt, Mycobacterium bovis subsp bovis AF2122/97
cgugucuguacaacgacacgcc

SEQ ID NO: 1117449 - RNA, 24 nt, Mycobacterium bovis subsp bovis AF2122/97
cgugucuuccaauugauaggcccc

SEQ ID NO: 1117450 - RNA, 22 nt, Mycobacterium bovis subsp bovis AF2122/97
cgugucguugccagggcgggcg

SEQ ID NO: 1117451 - RNA, 19 nt, Mycobacterium bovis subsp bovis AF2122/97
cgugucguaacugcccgcg

SEQ ID NO: 1117452 - RNA, 16 nt, Mycobacterium bovis subsp bovis AF2122/97
cgugucgucgcggccg

SEQ ID NO: 1117453 - RNA, 14 nt, Mycobacterium bovis subsp bovis AF2122/97
cgugucgggcgcga

SEQ ID NO: 1117454 - RNA, 18 nt, Mycobacterium bovis subsp bovis AF2122/97
cgugucgccacaccgggg

SEQ ID NO: 1117455 - RNA, 16 nt, Mycobacterium bovis subsp bovis AF2122/97
cgugucggugcgcgca

SEQ ID NO: 1117456 - RNA, 16 nt, Mycobacterium bovis subsp bovis AF2122/97
cgugucgcugcggcgc

SEQ ID NO: 1117457 - RNA, 19 nt, Mycobacterium bovis subsp bovis AF2122/97
cgugucgcugcggcgcugg

SEQ ID NO: 1117458 - RNA, 23 nt, Mycobacterium bovis subsp bovis AF2122/97
cgugucggacaaggacugaccgu

SEQ ID NO: 1117459 - RNA, 15 nt, Mycobacterium bovis subsp bovis AF2122/97
cgugucgccucgaug

SEQ ID NO: 1117460 - RNA, 18 nt, Mycobacterium bovis subsp bovis AF2122/97
cguguccuuugccaccuc

SEQ ID NO: 1117461 - RNA, 22 nt, Mycobacterium bovis subsp bovis AF2122/97
cguguccuuugccaccucggcg

SEQ ID NO: 1117462 - RNA, 19 nt, Mycobacterium bovis subsp bovis AF2122/97
cguguggguguugucgucg

SEQ ID NO: 1117463 - RNA, 14 nt, Mycobacterium bovis subsp bovis AF2122/97
cgugucggccggcc

SEQ ID NO: 1117464 - RNA, 22 nt, Mycobacterium bovis subsp bovis AF2122/97
cguguggcacguggcgaccggc

SEQ ID NO: 1117465 - RNA, 14 nt, Mycobacterium bovis subsp bovis AF2122/97
cguguggcgcaacc

SEQ ID NO: 1117466 - RNA, 19 nt, Mycobacterium bovis subsp bovis AF2122/97
cgugugugcgccuccggga

SEQ ID NO: 1117467 - RNA, 14 nt, Mycobacterium bovis subsp bovis AF2122/97
cgugugcgggcaca

SEQ ID NO: 1117468 - RNA, 20 nt, Mycobacterium bovis subsp bovis AF2122/97
cgugugcucuugcgccacgg

SEQ ID NO: 1117469 - RNA, 22 nt, Mycobacterium bovis subsp bovis AF2122/97
cgugugcucuugcgccacggcg

SEQ ID NO: 1117470 - RNA, 19 nt, Mycobacterium bovis subsp bovis AF2122/97
cgugugcuucgagcaccga

SEQ ID NO: 1117471 - RNA, 19 nt, Mycobacterium bovis subsp bovis AF2122/97
cguguggcacguggcgacc

SEQ ID NO: 1117472 - RNA, 16 nt, Mycobacterium bovis subsp bovis AF2122/97
cgugugcaccaucauc

SEQ ID NO: 1117473 - RNA, 20 nt, Mycobacterium bovis subsp bovis AF2122/97
cguguucgucacgggcguug

SEQ ID NO: 1117474 - RNA, 20 nt, Mycobacterium bovis subsp bovis AF2122/97
cguguucgauagcggcggcg

SEQ ID NO: 1117475 - RNA, 18 nt, Mycobacterium bovis subsp bovis AF2122/97
cguguugcacguacgggc

SEQ ID NO: 1117476 - RNA, 14 nt, Mycobacterium bovis subsp bovis AF2122/97
cguguugaccgggu

SEQ ID NO: 1117477 - RNA, 22 nt, Mycobacterium bovis subsp bovis AF2122/97
cguguucgaccaucaucucggu

SEQ ID NO: 1117478 - RNA, 14 nt, Mycobacterium bovis subsp bovis AF2122/97
cguguucgaccgca

SEQ ID NO: 1117479 - RNA, 15 nt, Mycobacterium bovis subsp bovis AF2122/97
cguguuggccggguc

SEQ ID NO: 1117480 - RNA, 18 nt, Mycobacterium bovis subsp bovis AF2122/97
cguguuguuagccccgca

SEQ ID NO: 1117481 - RNA, 17 nt, Mycobacterium bovis subsp bovis AF2122/97
cguguuguugaagcccg

SEQ ID NO: 1117482 - RNA, 19 nt, Mycobacterium bovis subsp bovis AF2122/97
cguguugcugucgaaguug

SEQ ID NO: 1117483 - RNA, 20 nt, Mycobacterium bovis subsp bovis AF2122/97
cguucaccgucugcggaccg

SEQ ID NO: 1117484 - RNA, 15 nt, Mycobacterium bovis subsp bovis AF2122/97
cguucaaccggacgc

SEQ ID NO: 1117485 - RNA, 14 nt, Mycobacterium bovis subsp bovis AF2122/97
cguucaacgacggc

SEQ ID NO: 1117486 - RNA, 16 nt, Mycobacterium bovis subsp bovis AF2122/97
cguuaugcgccgccca

SEQ ID NO: 1117487 - RNA, 18 nt, Mycobacterium bovis subsp bovis AF2122/97
cguuaucgacaccaccau

SEQ ID NO: 1117488 - RNA, 17 nt, Mycobacterium bovis subsp bovis AF2122/97
cguuaucgaccgccgcg

SEQ ID NO: 1117489 - RNA, 18 nt, Mycobacterium bovis subsp bovis AF2122/97
cguuaucgaccgccgcga

SEQ ID NO: 1117490 - RNA, 23 nt, Mycobacterium bovis subsp bovis AF2122/97
cguuagccaggucggugggcggc

SEQ ID NO: 1117491 - RNA, 18 nt, Mycobacterium bovis subsp bovis AF2122/97
cguuagcauugaguucgg

SEQ ID NO: 1117492 - RNA, 12 nt, Mycobacterium bovis subsp bovis AF2122/97
cguuaccgccgc

SEQ ID NO: 1117493 - RNA, 14 nt, Mycobacterium bovis subsp bovis AF2122/97
cguuaccgccgcug

SEQ ID NO: 1117494 - RNA, 17 nt, Mycobacterium bovis subsp bovis AF2122/97
cguuaccgccgcugccg

SEQ ID NO: 1117495 - RNA, 18 nt, Mycobacterium bovis subsp bovis AF2122/97
cguuaccgccgcugccga

SEQ ID NO: 1117496 - RNA, 15 nt, Mycobacterium bovis subsp bovis AF2122/97
cguuaccgccggcgc

SEQ ID NO: 1117497 - RNA, 16 nt, Mycobacterium bovis subsp bovis AF2122/97
cguuaccgccggcgcc

SEQ ID NO: 1117498 - RNA, 12 nt, Mycobacterium bovis subsp bovis AF2122/97
cguuaccgccgu

SEQ ID NO: 1117499 - RNA, 15 nt, Mycobacterium bovis subsp bovis AF2122/97
cguuacgccgagcac

SEQ ID NO: 1117500 - RNA, 22 nt, Mycobacterium bovis subsp bovis AF2122/97
cguuacgccgcgagagccggcg

SEQ ID NO: 1117501 - RNA, 20 nt, Mycobacterium bovis subsp bovis AF2122/97
cguuacggagggcacgggua

SEQ ID NO: 1117502 - RNA, 14 nt, Mycobacterium bovis subsp bovis AF2122/97
cguuaagacggcga

SEQ ID NO: 1117503 - RNA, 12 nt, Mycobacterium bovis subsp bovis AF2122/97
cguuaccgagcc

SEQ ID NO: 1117504 - RNA, 15 nt, Mycobacterium bovis subsp bovis AF2122/97
cguuaccccaccgga

SEQ ID NO: 1117505 - RNA, 12 nt, Mycobacterium bovis subsp bovis AF2122/97
cgucgucggcgu

SEQ ID NO: 1117506 - RNA, 13 nt, Mycobacterium bovis subsp bovis AF2122/97
cgucgucggcgua

SEQ ID NO: 1117507 - RNA, 17 nt, Mycobacterium bovis subsp bovis AF2122/97
cgucgucggcguagucg

SEQ ID NO: 1117508 - RNA, 23 nt, Mycobacterium bovis subsp bovis AF2122/97
cgucgucggucaugucggccacc

SEQ ID NO: 1117509 - RNA, 15 nt, Mycobacterium bovis subsp bovis AF2122/97
cgucgucggugauca

SEQ ID NO: 1117510 - RNA, 15 nt, Mycobacterium bovis subsp bovis AF2122/97
cgucgucggcaggca

SEQ ID NO: 1117511 - RNA, 17 nt, Mycobacterium bovis subsp bovis AF2122/97
cgucgucgcugccgcca

SEQ ID NO: 1117512 - RNA, 15 nt, Mycobacterium bovis subsp bovis AF2122/97
cgucgucgcggccgc

SEQ ID NO: 1117513 - RNA, 19 nt, Mycobacterium bovis subsp bovis AF2122/97
cgucgucgccgucggugcc

SEQ ID NO: 1117514 - RNA, 14 nt, Mycobacterium bovis subsp bovis AF2122/97
cgucgucgcgucgc

SEQ ID NO: 1117515 - RNA, 16 nt, Mycobacterium bovis subsp bovis AF2122/97
cgucgucgcgucgcca

SEQ ID NO: 1117516 - RNA, 13 nt, Mycobacterium bovis subsp bovis AF2122/97
cgucgucgacggc

SEQ ID NO: 1117517 - RNA, 19 nt, Mycobacterium bovis subsp bovis AF2122/97
cgucgucgagaaucggcau

SEQ ID NO: 1117518 - RNA, 20 nt, Mycobacterium bovis subsp bovis AF2122/97
cgucgucgagauagccgacg

SEQ ID NO: 1117519 - RNA, 21 nt, Mycobacterium bovis subsp bovis AF2122/97
cgucgucgaccacgacguucg

SEQ ID NO: 1117520 - RNA, 20 nt, Mycobacterium bovis subsp bovis AF2122/97
cgucgucaccgcgacggaac

SEQ ID NO: 1117521 - RNA, 23 nt, Mycobacterium bovis subsp bovis AF2122/97
cgucguagguggccggcuugcag

SEQ ID NO: 1117522 - RNA, 14 nt, Mycobacterium bovis subsp bovis AF2122/97
cgucgucacgaucg

SEQ ID NO: 1117523 - RNA, 15 nt, Mycobacterium bovis subsp bovis AF2122/97
cgucgucacgaucgu

SEQ ID NO: 1117524 - RNA, 14 nt, Mycobacterium bovis subsp bovis AF2122/97
cgucgucgcccagg

SEQ ID NO: 1117525 - RNA, 17 nt, Mycobacterium bovis subsp bovis AF2122/97
cgucgucgauuagccca

SEQ ID NO: 1117526 - RNA, 23 nt, Mycobacterium bovis subsp bovis AF2122/97
cgucgucgagauagccgacgucg

SEQ ID NO: 1117527 - RNA, 16 nt, Mycobacterium bovis subsp bovis AF2122/97
cgucgucgagcaccac

SEQ ID NO: 1117528 - RNA, 15 nt, Mycobacterium bovis subsp bovis AF2122/97
cgucgucgaguuggc

SEQ ID NO: 1117529 - RNA, 13 nt, Mycobacterium bovis subsp bovis AF2122/97
cgucgucgaucca

SEQ ID NO: 1117530 - RNA, 12 nt, Mycobacterium bovis subsp bovis AF2122/97
cgucgucgaucg

SEQ ID NO: 1117531 - RNA, 21 nt, Mycobacterium bovis subsp bovis AF2122/97
cgucguagagauacgggaacg

SEQ ID NO: 1117532 - RNA, 22 nt, Mycobacterium bovis subsp bovis AF2122/97
cgucggguagggcaucgucgcc

SEQ ID NO: 1117533 - RNA, 19 nt, Mycobacterium bovis subsp bovis AF2122/97
cgucguagcuggcgaucug

SEQ ID NO: 1117534 - RNA, 18 nt, Mycobacterium bovis subsp bovis AF2122/97
cgucguauugccucacca

SEQ ID NO: 1117535 - RNA, 20 nt, Mycobacterium bovis subsp bovis AF2122/97
cgucguauugccucaccagg

SEQ ID NO: 1117536 - RNA, 16 nt, Mycobacterium bovis subsp bovis AF2122/97
cgucgucaacccggug

SEQ ID NO: 1117537 - RNA, 22 nt, Mycobacterium bovis subsp bovis AF2122/97
cgucguagguggccggcuugca

SEQ ID NO: 1117538 - RNA, 22 nt, Mycobacterium bovis subsp bovis AF2122/97
cgucggguuccuccucggcagg

SEQ ID NO: 1117539 - RNA, 18 nt, Mycobacterium bovis subsp bovis AF2122/97
cgucggguugcgacgaac

SEQ ID NO: 1117540 - RNA, 20 nt, Mycobacterium bovis subsp bovis AF2122/97
cgucggguugucgcgguuca

SEQ ID NO: 1117541 - RNA, 17 nt, Mycobacterium bovis subsp bovis AF2122/97
cgucggguugcacggcg

SEQ ID NO: 1117542 - RNA, 16 nt, Mycobacterium bovis subsp bovis AF2122/97
cgucggguugcgacga

SEQ ID NO: 1117543 - RNA, 19 nt, Mycobacterium bovis subsp bovis AF2122/97
cgucgggugcagcacggcg

SEQ ID NO: 1117544 - RNA, 20 nt, Mycobacterium bovis subsp bovis AF2122/97
cgucguacucggcggccacc

SEQ ID NO: 1117545 - RNA, 17 nt, Mycobacterium bovis subsp bovis AF2122/97
cgucgguaaugccgggc

SEQ ID NO: 1117546 - RNA, 17 nt, Mycobacterium bovis subsp bovis AF2122/97
cgucguaccguucgggc

SEQ ID NO: 1117547 - RNA, 15 nt, Mycobacterium bovis subsp bovis AF2122/97
cgucggucaccgaca

SEQ ID NO: 1117548 - RNA, 16 nt, Mycobacterium bovis subsp bovis AF2122/97
cgucggucaccuggcg

SEQ ID NO: 1117549 - RNA, 18 nt, Mycobacterium bovis subsp bovis AF2122/97
cgucgguaaagggcucga

SEQ ID NO: 1117550 - RNA, 18 nt, Mycobacterium bovis subsp bovis AF2122/97
cgucgguaagcgccaagg

SEQ ID NO: 1117551 - RNA, 21 nt, Mycobacterium bovis subsp bovis AF2122/97
cgucgguaagcgccaaggcga

SEQ ID NO: 1117552 - RNA, 14 nt, Mycobacterium bovis subsp bovis AF2122/97
cgucgcgggccacc

SEQ ID NO: 1117553 - RNA, 16 nt, Mycobacterium bovis subsp bovis AF2122/97
cgucgcgggccaccgc

SEQ ID NO: 1117554 - RNA, 12 nt, Mycobacterium bovis subsp bovis AF2122/97
cgucgcgguagg

SEQ ID NO: 1117555 - RNA, 13 nt, Mycobacterium bovis subsp bovis AF2122/97
cgucgcgguaggc

SEQ ID NO: 1117556 - RNA, 19 nt, Mycobacterium bovis subsp bovis AF2122/97
cgucgcguucuccggcacc

SEQ ID NO: 1117557 - RNA, 20 nt, Mycobacterium bovis subsp bovis AF2122/97
cgucgcguucuccggcaccg

SEQ ID NO: 1117558 - RNA, 13 nt, Mycobacterium bovis subsp bovis AF2122/97
cgucggcgucgcg

SEQ ID NO: 1117559 - RNA, 15 nt, Mycobacterium bovis subsp bovis AF2122/97
cgucggcgucgcgga

SEQ ID NO: 1117560 - RNA, 17 nt, Mycobacterium bovis subsp bovis AF2122/97
cgucggcguacagcgcc

SEQ ID NO: 1117561 - RNA, 13 nt, Mycobacterium bovis subsp bovis AF2122/97
cgucggcgucggu

SEQ ID NO: 1117562 - RNA, 23 nt, Mycobacterium bovis subsp bovis AF2122/97
cgucggcgugcggacugacgucg

SEQ ID NO: 1117563 - RNA, 15 nt, Mycobacterium bovis subsp bovis AF2122/97
cgucggcuccagguc

SEQ ID NO: 1117564 - RNA, 22 nt, Mycobacterium bovis subsp bovis AF2122/97
cgucgggucaaugcuggcagcg

SEQ ID NO: 1117565 - RNA, 14 nt, Mycobacterium bovis subsp bovis AF2122/97
cgucgggucaccca

SEQ ID NO: 1117566 - RNA, 14 nt, Mycobacterium bovis subsp bovis AF2122/97
cgucggguaccacg

SEQ ID NO: 1117567 - RNA, 17 nt, Mycobacterium bovis subsp bovis AF2122/97
cgucggguaccacgcug

SEQ ID NO: 1117568 - RNA, 13 nt, Mycobacterium bovis subsp bovis AF2122/97
cgucggguagauc

SEQ ID NO: 1117569 - RNA, 14 nt, Mycobacterium bovis subsp bovis AF2122/97
cgucgggggcuucg

SEQ ID NO: 1117570 - RNA, 17 nt, Mycobacterium bovis subsp bovis AF2122/97
cgucggggugccggcug

SEQ ID NO: 1117571 - RNA, 18 nt, Mycobacterium bovis subsp bovis AF2122/97
cgucggguaggccgccgu

SEQ ID NO: 1117572 - RNA, 20 nt, Mycobacterium bovis subsp bovis AF2122/97
cgucgggguguucgaugggu

SEQ ID NO: 1117573 - RNA, 15 nt, Mycobacterium bovis subsp bovis AF2122/97
cgucggggucguuga

SEQ ID NO: 1117574 - RNA, 18 nt, Mycobacterium bovis subsp bovis AF2122/97
cgucggggaugccgaacc

SEQ ID NO: 1117575 - RNA, 24 nt, Mycobacterium bovis subsp bovis AF2122/97
cgucgggcgucccggcggucagcg

SEQ ID NO: 1117576 - RNA, 22 nt, Mycobacterium bovis subsp bovis AF2122/97
cgucggggaguucgcgcagcac

SEQ ID NO: 1117577 - RNA, 14 nt, Mycobacterium bovis subsp bovis AF2122/97
cgucgggcucggcg

SEQ ID NO: 1117578 - RNA, 19 nt, Mycobacterium bovis subsp bovis AF2122/97
cgucggcuucucgaucggc

SEQ ID NO: 1117579 - RNA, 22 nt, Mycobacterium bovis subsp bovis AF2122/97
cgucgggcgucccggcggucag

SEQ ID NO: 1117580 - RNA, 14 nt, Mycobacterium bovis subsp bovis AF2122/97
cgucggcuucaccu

SEQ ID NO: 1117581 - RNA, 17 nt, Mycobacterium bovis subsp bovis AF2122/97
cgucggcucgucgcucg

SEQ ID NO: 1117582 - RNA, 16 nt, Mycobacterium bovis subsp bovis AF2122/97
cgucggcugccgcggc

SEQ ID NO: 1117583 - RNA, 15 nt, Mycobacterium bovis subsp bovis AF2122/97
cgucugguggcagcg

SEQ ID NO: 1117584 - RNA, 17 nt, Mycobacterium bovis subsp bovis AF2122/97
cgucugguggcagcgca

SEQ ID NO: 1117585 - RNA, 14 nt, Mycobacterium bovis subsp bovis AF2122/97
cgucucugccacgc

SEQ ID NO: 1117586 - RNA, 13 nt, Mycobacterium bovis subsp bovis AF2122/97
cgucucgcgcacc

SEQ ID NO: 1117587 - RNA, 12 nt, Mycobacterium bovis subsp bovis AF2122/97
cgucucgcgcga

SEQ ID NO: 1117588 - RNA, 16 nt, Mycobacterium bovis subsp bovis AF2122/97
cgucuguucgccgacg

SEQ ID NO: 1117589 - RNA, 16 nt, Mycobacterium bovis subsp bovis AF2122/97
cgucuguaccacgggc

SEQ ID NO: 1117590 - RNA, 22 nt, Mycobacterium bovis subsp bovis AF2122/97
cgucugguggcagcgcacccgg

SEQ ID NO: 1117591 - RNA, 20 nt, Mycobacterium bovis subsp bovis AF2122/97
cgucuuaccugaagccgcgc

SEQ ID NO: 1117592 - RNA, 23 nt, Mycobacterium bovis subsp bovis AF2122/97
cgucuuaccugaagccgcgcugc

SEQ ID NO: 1117593 - RNA, 17 nt, Mycobacterium bovis subsp bovis AF2122/97
cgucuucacucacgacg

SEQ ID NO: 1117594 - RNA, 11 nt, Mycobacterium bovis subsp bovis AF2122/97
cgugaccagcc

SEQ ID NO: 1117595 - RNA, 16 nt, Mycobacterium bovis subsp bovis AF2122/97
cgugaccaccgccgac

SEQ ID NO: 1117596 - RNA, 21 nt, Mycobacterium bovis subsp bovis AF2122/97
cgugacccauucucggccggc

SEQ ID NO: 1117597 - RNA, 22 nt, Mycobacterium bovis subsp bovis AF2122/97
cgugacccauucucggccggcg

SEQ ID NO: 1117598 - RNA, 13 nt, Mycobacterium bovis subsp bovis AF2122/97
cgugacccgacau

SEQ ID NO: 1117599 - RNA, 14 nt, Mycobacterium bovis subsp bovis AF2122/97
cgugacccgacaug

SEQ ID NO: 1117600 - RNA, 15 nt, Mycobacterium bovis subsp bovis AF2122/97
cgugaccaccgccga

SEQ ID NO: 1117601 - RNA, 16 nt, Mycobacterium bovis subsp bovis AF2122/97
cgugaauucgccgaac

SEQ ID NO: 1117602 - RNA, 17 nt, Mycobacterium bovis subsp bovis AF2122/97
cgugacauucugcagcg

SEQ ID NO: 1117603 - RNA, 16 nt, Mycobacterium bovis subsp bovis AF2122/97
cgugaccaggugccag

SEQ ID NO: 1117604 - RNA, 23 nt, Mycobacterium bovis subsp bovis AF2122/97
cgugaccagucgcggcguucggc

SEQ ID NO: 1117605 - RNA, 19 nt, Mycobacterium bovis subsp bovis AF2122/97
cgugacagugaccugggcg

SEQ ID NO: 1117606 - RNA, 20 nt, Mycobacterium bovis subsp bovis AF2122/97
cgugacaccggggacgucga

SEQ ID NO: 1117607 - RNA, 15 nt, Mycobacterium bovis subsp bovis AF2122/97
cgugacaaggugcgc

SEQ ID NO: 1117608 - RNA, 21 nt, Mycobacterium bovis subsp bovis AF2122/97
cgugacaacugcgccggugcc

SEQ ID NO: 1117609 - RNA, 22 nt, Mycobacterium bovis subsp bovis AF2122/97
cgugaaugguggugucggcgag

SEQ ID NO: 1117610 - RNA, 19 nt, Mycobacterium bovis subsp bovis AF2122/97
cgucuuaucggcgucguag

SEQ ID NO: 1117611 - RNA, 14 nt, Mycobacterium bovis subsp bovis AF2122/97
cgucgucuugaccg

SEQ ID NO: 1117612 - RNA, 23 nt, Mycobacterium bovis subsp bovis AF2122/97
cgucgucuugaccgcuugcccgc

SEQ ID NO: 1117613 - RNA, 15 nt, Mycobacterium bovis subsp bovis AF2122/97
cgucgucgucgcugu

SEQ ID NO: 1117614 - RNA, 14 nt, Mycobacterium bovis subsp bovis AF2122/97
cgucgucgucgaga

SEQ ID NO: 1117615 - RNA, 14 nt, Mycobacterium bovis subsp bovis AF2122/97
cgucgugaccggcg

SEQ ID NO: 1117616 - RNA, 20 nt, Mycobacterium bovis subsp bovis AF2122/97
cgucgugaccggcgggaccg

SEQ ID NO: 1117617 - RNA, 22 nt, Mycobacterium bovis subsp bovis AF2122/97
cgucgugagaggccaagauggc

SEQ ID NO: 1117618 - RNA, 15 nt, Mycobacterium bovis subsp bovis AF2122/97
cgucgugagucaccc

SEQ ID NO: 1117619 - RNA, 17 nt, Mycobacterium bovis subsp bovis AF2122/97
cgucgugagucacccgg

SEQ ID NO: 1117620 - RNA, 19 nt, Mycobacterium bovis subsp bovis AF2122/97
cgucgugagucacccggcc

SEQ ID NO: 1117621 - RNA, 17 nt, Mycobacterium bovis subsp bovis AF2122/97
cgucgucgugcaggcgc

SEQ ID NO: 1117622 - RNA, 20 nt, Mycobacterium bovis subsp bovis AF2122/97
cgucgugaugucaacguguc

SEQ ID NO: 1117623 - RNA, 15 nt, Mycobacterium bovis subsp bovis AF2122/97
cgucgugaucggcga

SEQ ID NO: 1117624 - RNA, 19 nt, Mycobacterium bovis subsp bovis AF2122/97
cgucgugcacggcggccag

SEQ ID NO: 1117625 - RNA, 22 nt, Mycobacterium bovis subsp bovis AF2122/97
cgucgugcauaagcccgcgagg

SEQ ID NO: 1117626 - RNA, 14 nt, Mycobacterium bovis subsp bovis AF2122/97
cgucgugccaccgu

SEQ ID NO: 1117627 - RNA, 21 nt, Mycobacterium bovis subsp bovis AF2122/97
cgucgugccaccguugggccg

SEQ ID NO: 1117628 - RNA, 21 nt, Mycobacterium bovis subsp bovis AF2122/97
cgucgugccacuuccacggcg

SEQ ID NO: 1117629 - RNA, 16 nt, Mycobacterium bovis subsp bovis AF2122/97
cgucgugcgauucaca

SEQ ID NO: 1117630 - RNA, 14 nt, Mycobacterium bovis subsp bovis AF2122/97
cgucgugcgcggcc

SEQ ID NO: 1117631 - RNA, 18 nt, Mycobacterium bovis subsp bovis AF2122/97
cgucgugcgcggccggca

SEQ ID NO: 1117632 - RNA, 12 nt, Mycobacterium bovis subsp bovis AF2122/97
cgucgugcgggc

SEQ ID NO: 1117633 - RNA, 17 nt, Mycobacterium bovis subsp bovis AF2122/97
cgucgugcgugcggcga

SEQ ID NO: 1117634 - RNA, 22 nt, Mycobacterium bovis subsp bovis AF2122/97
cgucgugcgugcggcgaaggua

SEQ ID NO: 1117635 - RNA, 22 nt, Mycobacterium bovis subsp bovis AF2122/97
cgucguugucgucgccggcggc

SEQ ID NO: 1117636 - RNA, 19 nt, Mycobacterium bovis subsp bovis AF2122/97
cgucguugugauccggugg

SEQ ID NO: 1117637 - RNA, 22 nt, Mycobacterium bovis subsp bovis AF2122/97
cgucguugugcagaucgucgcc

SEQ ID NO: 1117638 - RNA, 21 nt, Mycobacterium bovis subsp bovis AF2122/97
cgucguugugccggucgauga

SEQ ID NO: 1117639 - RNA, 18 nt, Mycobacterium bovis subsp bovis AF2122/97
cgucguuugggugcgccg

SEQ ID NO: 1117640 - RNA, 21 nt, Mycobacterium bovis subsp bovis AF2122/97
cgucguuugggugcgccguca

SEQ ID NO: 1117641 - RNA, 16 nt, Mycobacterium bovis subsp bovis AF2122/97
cgucguuucgccagcc

SEQ ID NO: 1117642 - RNA, 22 nt, Mycobacterium bovis subsp bovis AF2122/97
cgucguuucgccagccggccgc

SEQ ID NO: 1117643 - RNA, 23 nt, Mycobacterium bovis subsp bovis AF2122/97
cgucguuucgccagccggccgcg

SEQ ID NO: 1117644 - RNA, 15 nt, Mycobacterium bovis subsp bovis AF2122/97
cgucguggagcucac

SEQ ID NO: 1117645 - RNA, 17 nt, Mycobacterium bovis subsp bovis AF2122/97
cgucguugccguccacc

SEQ ID NO: 1117646 - RNA, 21 nt, Mycobacterium bovis subsp bovis AF2122/97
cgucguggaucuucgcgcugu

SEQ ID NO: 1117647 - RNA, 18 nt, Mycobacterium bovis subsp bovis AF2122/97
cgucguugccggcgacca

SEQ ID NO: 1117648 - RNA, 16 nt, Mycobacterium bovis subsp bovis AF2122/97
cgucucgaugcauggc

SEQ ID NO: 1117649 - RNA, 18 nt, Mycobacterium bovis subsp bovis AF2122/97
cgucucgaugcauggcuu

SEQ ID NO: 1117650 - RNA, 13 nt, Mycobacterium bovis subsp bovis AF2122/97
cgucucgcaccgc

SEQ ID NO: 1117651 - RNA, 13 nt, Mycobacterium bovis subsp bovis AF2122/97
cgucucgaucacc

SEQ ID NO: 1117652 - RNA, 17 nt, Mycobacterium bovis subsp bovis AF2122/97
cgucucgcagcaacggc

SEQ ID NO: 1117653 - RNA, 14 nt, Mycobacterium bovis subsp bovis AF2122/97
cgucucgaucgcgg

SEQ ID NO: 1117654 - RNA, 21 nt, Mycobacterium bovis subsp bovis AF2122/97
cgucucgccgggaaacaccgg

SEQ ID NO: 1117655 - RNA, 14 nt, Mycobacterium bovis subsp bovis AF2122/97
cgucucgccgcgca

SEQ ID NO: 1117656 - RNA, 16 nt, Mycobacterium bovis subsp bovis AF2122/97
cgucucgccgcgcacc

SEQ ID NO: 1117657 - RNA, 18 nt, Mycobacterium bovis subsp bovis AF2122/97
cgucuacgucguccagca

SEQ ID NO: 1117658 - RNA, 20 nt, Mycobacterium bovis subsp bovis AF2122/97
cgucuacgucguccagcacc

SEQ ID NO: 1117659 - RNA, 21 nt, Mycobacterium bovis subsp bovis AF2122/97
cgucuacgucguccagcacca

SEQ ID NO: 1117660 - RNA, 14 nt, Mycobacterium bovis subsp bovis AF2122/97
cguggaccggcacg

SEQ ID NO: 1117661 - RNA, 15 nt, Mycobacterium bovis subsp bovis AF2122/97
cguggaccggcacgu

SEQ ID NO: 1117662 - RNA, 22 nt, Mycobacterium bovis subsp bovis AF2122/97
cguggacaucgggcggcaccgc

SEQ ID NO: 1117663 - RNA, 14 nt, Mycobacterium bovis subsp bovis AF2122/97
cguggaccacggcg

SEQ ID NO: 1117664 - RNA, 15 nt, Mycobacterium bovis subsp bovis AF2122/97
cguggaccacggcgu

SEQ ID NO: 1117665 - RNA, 17 nt, Mycobacterium bovis subsp bovis AF2122/97
cguggaccacggcguug

SEQ ID NO: 1117666 - RNA, 22 nt, Mycobacterium bovis subsp bovis AF2122/97
cguggaauggcgccggccggca

SEQ ID NO: 1117667 - RNA, 15 nt, Mycobacterium bovis subsp bovis AF2122/97
cguggaagacgucga

SEQ ID NO: 1117668 - RNA, 21 nt, Mycobacterium bovis subsp bovis AF2122/97
cguggacguacugucgucgcc

SEQ ID NO: 1117669 - RNA, 15 nt, Mycobacterium bovis subsp bovis AF2122/97
cguggacgcccgccc

SEQ ID NO: 1117670 - RNA, 17 nt, Mycobacterium bovis subsp bovis AF2122/97
cguggacgcccgcccgc

SEQ ID NO: 1117671 - RNA, 17 nt, Mycobacterium bovis subsp bovis AF2122/97
cguggacuuuggugucg

SEQ ID NO: 1117672 - RNA, 23 nt, Mycobacterium bovis subsp bovis AF2122/97
cguggauuucaagucauccuuga

SEQ ID NO: 1117673 - RNA, 17 nt, Mycobacterium bovis subsp bovis AF2122/97
cguggaucuuggccagc

SEQ ID NO: 1117674 - RNA, 18 nt, Mycobacterium bovis subsp bovis AF2122/97
cguggaucuuggccagca

SEQ ID NO: 1117675 - RNA, 21 nt, Mycobacterium bovis subsp bovis AF2122/97
cguggaucuuggccagcagcg

SEQ ID NO: 1117676 - RNA, 21 nt, Mycobacterium bovis subsp bovis AF2122/97
cguggagaucacgugccggcu

SEQ ID NO: 1117677 - RNA, 15 nt, Mycobacterium bovis subsp bovis AF2122/97
cguggagccggccgu

SEQ ID NO: 1117678 - RNA, 13 nt, Mycobacterium bovis subsp bovis AF2122/97
cguggagcgcuug

SEQ ID NO: 1117679 - RNA, 15 nt, Mycobacterium bovis subsp bovis AF2122/97
cguggauccagccau

SEQ ID NO: 1117680 - RNA, 15 nt, Mycobacterium bovis subsp bovis AF2122/97
cguggaucggcagcc

SEQ ID NO: 1117681 - RNA, 20 nt, Mycobacterium bovis subsp bovis AF2122/97
cguggaucugccucucgacc

SEQ ID NO: 1117682 - RNA, 12 nt, Mycobacterium bovis subsp bovis AF2122/97
cgugcugccauu

SEQ ID NO: 1117683 - RNA, 15 nt, Mycobacterium bovis subsp bovis AF2122/97
cgugcugcccauccc

SEQ ID NO: 1117684 - RNA, 16 nt, Mycobacterium bovis subsp bovis AF2122/97
cgugcugcccaucccg

SEQ ID NO: 1117685 - RNA, 14 nt, Mycobacterium bovis subsp bovis AF2122/97
cgugcugcuagcca

SEQ ID NO: 1117686 - RNA, 19 nt, Mycobacterium bovis subsp bovis AF2122/97
cgugcugccgccuuggucg

SEQ ID NO: 1117687 - RNA, 16 nt, Mycobacterium bovis subsp bovis AF2122/97
cgugcugggcaucacc

SEQ ID NO: 1117688 - RNA, 18 nt, Mycobacterium bovis subsp bovis AF2122/97
cgugcugggcaucaccga

SEQ ID NO: 1117689 - RNA, 20 nt, Mycobacterium bovis subsp bovis AF2122/97
cgugcugggcaucaccgacg

SEQ ID NO: 1117690 - RNA, 16 nt, Mycobacterium bovis subsp bovis AF2122/97
cgugcuggcaccagca

SEQ ID NO: 1117691 - RNA, 14 nt, Mycobacterium bovis subsp bovis AF2122/97
cgugcuggcgccga

SEQ ID NO: 1117692 - RNA, 16 nt, Mycobacterium bovis subsp bovis AF2122/97
cgugcugggcgccgcg

SEQ ID NO: 1117693 - RNA, 18 nt, Mycobacterium bovis subsp bovis AF2122/97
cgugcugggcgccgcgcu

SEQ ID NO: 1117694 - RNA, 19 nt, Mycobacterium bovis subsp bovis AF2122/97
cguggaacuccguccgccg

SEQ ID NO: 1117695 - RNA, 18 nt, Mycobacterium bovis subsp bovis AF2122/97
cgugcugaacuccgccgc

SEQ ID NO: 1117696 - RNA, 23 nt, Mycobacterium bovis subsp bovis AF2122/97
cgugcugaagcuguaggcgacca

SEQ ID NO: 1117697 - RNA, 14 nt, Mycobacterium bovis subsp bovis AF2122/97
cgugcucucggcga

SEQ ID NO: 1117698 - RNA, 18 nt, Mycobacterium bovis subsp bovis AF2122/97
cgugcggaucgcgcugcg

SEQ ID NO: 1117699 - RNA, 20 nt, Mycobacterium bovis subsp bovis AF2122/97
cgugcgcgucggugucgaug

SEQ ID NO: 1117700 - RNA, 22 nt, Mycobacterium bovis subsp bovis AF2122/97
cgugcgcgucggugucgaugcu

SEQ ID NO: 1117701 - RNA, 15 nt, Mycobacterium bovis subsp bovis AF2122/97
cgugcgcggugaugg

SEQ ID NO: 1117702 - RNA, 17 nt, Mycobacterium bovis subsp bovis AF2122/97
cgugcgcggccggcacg

SEQ ID NO: 1117703 - RNA, 18 nt, Mycobacterium bovis subsp bovis AF2122/97
cgugcggacugacgucga

SEQ ID NO: 1117704 - RNA, 20 nt, Mycobacterium bovis subsp bovis AF2122/97
cgugcgcuuggucgaccgcc

SEQ ID NO: 1117705 - RNA, 21 nt, Mycobacterium bovis subsp bovis AF2122/97
cgugcgcuuggucgaccgccg

SEQ ID NO: 1117706 - RNA, 22 nt, Mycobacterium bovis subsp bovis AF2122/97
cgugcgcuuggucgaccgccga

SEQ ID NO: 1117707 - RNA, 17 nt, Mycobacterium bovis subsp bovis AF2122/97
cgugcgccgacggugca

SEQ ID NO: 1117708 - RNA, 20 nt, Mycobacterium bovis subsp bovis AF2122/97
cgugcgccggggacacagcg

SEQ ID NO: 1117709 - RNA, 20 nt, Mycobacterium bovis subsp bovis AF2122/97
cgugcgccgugcgaucguca

SEQ ID NO: 1117710 - RNA, 14 nt, Mycobacterium bovis subsp bovis AF2122/97
cgugccgcaucacc

SEQ ID NO: 1117711 - RNA, 17 nt, Mycobacterium bovis subsp bovis AF2122/97
cgugccgcagcggcggc

SEQ ID NO: 1117712 - RNA, 21 nt, Mycobacterium bovis subsp bovis AF2122/97
cgugccgcagcggcggcaacc

SEQ ID NO: 1117713 - RNA, 16 nt, Mycobacterium bovis subsp bovis AF2122/97
cgugcgccacggcugu

SEQ ID NO: 1117714 - RNA, 15 nt, Mycobacterium bovis subsp bovis AF2122/97
cgugcgcaucgucga

SEQ ID NO: 1117715 - RNA, 16 nt, Mycobacterium bovis subsp bovis AF2122/97
cgugcgcaucagcggu

SEQ ID NO: 1117716 - RNA, 23 nt, Mycobacterium bovis subsp bovis AF2122/97
cgugccgaacagggaggucgccg

SEQ ID NO: 1117717 - RNA, 16 nt, Mycobacterium bovis subsp bovis AF2122/97
cgugccgacgccccga

SEQ ID NO: 1117718 - RNA, 22 nt, Mycobacterium bovis subsp bovis AF2122/97
cgugccgagcgugcgcuggugg

SEQ ID NO: 1117719 - RNA, 12 nt, Mycobacterium bovis subsp bovis AF2122/97
cgugccgagcuu

SEQ ID NO: 1117720 - RNA, 15 nt, Mycobacterium bovis subsp bovis AF2122/97
cgugccgaaaaucgc

SEQ ID NO: 1117721 - RNA, 16 nt, Mycobacterium bovis subsp bovis AF2122/97
cgugccgaaaaucgca

SEQ ID NO: 1117722 - RNA, 17 nt, Mycobacterium bovis subsp bovis AF2122/97
cgugccgaaaaucgcag

SEQ ID NO: 1117723 - RNA, 19 nt, Mycobacterium bovis subsp bovis AF2122/97
cgugccgaaaaucgcagcc

SEQ ID NO: 1117724 - RNA, 22 nt, Mycobacterium bovis subsp bovis AF2122/97
cgugccgaacacgguguauugg

SEQ ID NO: 1117725 - RNA, 17 nt, Mycobacterium bovis subsp bovis AF2122/97
cgugcccguggugaugg

SEQ ID NO: 1117726 - RNA, 17 nt, Mycobacterium bovis subsp bovis AF2122/97
cgugcccugggugaugg

SEQ ID NO: 1117727 - RNA, 19 nt, Mycobacterium bovis subsp bovis AF2122/97
cgugcccgccaccggcgcg

SEQ ID NO: 1117728 - RNA, 20 nt, Mycobacterium bovis subsp bovis AF2122/97
cgugcccgccaccggcgcga

SEQ ID NO: 1117729 - RNA, 16 nt, Mycobacterium bovis subsp bovis AF2122/97
cgugcacgaucgcggu

SEQ ID NO: 1117730 - RNA, 14 nt, Mycobacterium bovis subsp bovis AF2122/97
cgugcacgaucgcg

SEQ ID NO: 1117731 - RNA, 16 nt, Mycobacterium bovis subsp bovis AF2122/97
cgugcacggcgaggcc

SEQ ID NO: 1117732 - RNA, 16 nt, Mycobacterium bovis subsp bovis AF2122/97
cgugcacugaccgcgg

SEQ ID NO: 1117733 - RNA, 13 nt, Mycobacterium bovis subsp bovis AF2122/97
cgugcacggcggc

SEQ ID NO: 1117734 - RNA, 23 nt, Mycobacterium bovis subsp bovis AF2122/97
cgugcaucugugagauaccgacg

SEQ ID NO: 1117735 - RNA, 16 nt, Mycobacterium bovis subsp bovis AF2122/97
cgugcacgaaaaccgg

SEQ ID NO: 1117736 - RNA, 18 nt, Mycobacterium bovis subsp bovis AF2122/97
cgugcaccucgucccagc

SEQ ID NO: 1117737 - RNA, 23 nt, Mycobacterium bovis subsp bovis AF2122/97
cgugagaggccaagauggcgcgc

SEQ ID NO: 1117738 - RNA, 16 nt, Mycobacterium bovis subsp bovis AF2122/97
cgugcaccgcgaccgc

SEQ ID NO: 1117739 - RNA, 24 nt, Mycobacterium bovis subsp bovis AF2122/97
cgugcaccgcgaccgcgcacggcu

SEQ ID NO: 1117740 - RNA, 16 nt, Mycobacterium bovis subsp bovis AF2122/97
cgugcaccagcgacca

SEQ ID NO: 1117741 - RNA, 19 nt, Mycobacterium bovis subsp bovis AF2122/97
cgugcaccagguugcaacc

SEQ ID NO: 1117742 - RNA, 18 nt, Mycobacterium bovis subsp bovis AF2122/97
cgugcaccauacucaccg

SEQ ID NO: 1117743 - RNA, 18 nt, Mycobacterium bovis subsp bovis AF2122/97
cgugccagcgccccgcgg

SEQ ID NO: 1117744 - RNA, 15 nt, Mycobacterium bovis subsp bovis AF2122/97
cgugccagcugccga

SEQ ID NO: 1117745 - RNA, 22 nt, Mycobacterium bovis subsp bovis AF2122/97
cgugcaugggacauccagaucg

SEQ ID NO: 1117746 - RNA, 17 nt, Mycobacterium bovis subsp bovis AF2122/97
cgugcacgaucgcggug

SEQ ID NO: 1117747 - RNA, 14 nt, Mycobacterium bovis subsp bovis AF2122/97
cgugcaucgcgauu

SEQ ID NO: 1117748 - RNA, 16 nt, Mycobacterium bovis subsp bovis AF2122/97
cgugccacucgaugcu

SEQ ID NO: 1117749 - RNA, 14 nt, Mycobacterium bovis subsp bovis AF2122/97
cgugccacagcucg

SEQ ID NO: 1117750 - RNA, 20 nt, Mycobacterium bovis subsp bovis AF2122/97
cgugccacagcucgccguga

SEQ ID NO: 1117751 - RNA, 19 nt, Mycobacterium bovis subsp bovis AF2122/97
cgugccacagcucgccgug

SEQ ID NO: 1117752 - RNA, 15 nt, Mycobacterium bovis subsp bovis AF2122/97
cgugagccuguccac

SEQ ID NO: 1117753 - RNA, 16 nt, Mycobacterium bovis subsp bovis AF2122/97
cgugagccuguccacg

SEQ ID NO: 1117754 - RNA, 12 nt, Mycobacterium bovis subsp bovis AF2122/97
cgugagcaccag

SEQ ID NO: 1117755 - RNA, 14 nt, Mycobacterium bovis subsp bovis AF2122/97
cgugagcaccagca

SEQ ID NO: 1117756 - RNA, 13 nt, Mycobacterium bovis subsp bovis AF2122/97
cgugagcagacgc

SEQ ID NO: 1117757 - RNA, 19 nt, Mycobacterium bovis subsp bovis AF2122/97
cgugagccagcuugcgcaa

SEQ ID NO: 1117758 - RNA, 21 nt, Mycobacterium bovis subsp bovis AF2122/97
cgugagccaugccgcucggca

SEQ ID NO: 1117759 - RNA, 22 nt, Mycobacterium bovis subsp bovis AF2122/97
cgugagccaugccgcucggcaa

SEQ ID NO: 1117760 - RNA, 17 nt, Mycobacterium bovis subsp bovis AF2122/97
cgugagccccagcgacg

SEQ ID NO: 1117761 - RNA, 17 nt, Mycobacterium bovis subsp bovis AF2122/97
cgugagcucgucgaggc

SEQ ID NO: 1117762 - RNA, 18 nt, Mycobacterium bovis subsp bovis AF2122/97
cgugaugggucaccucgg

SEQ ID NO: 1117763 - RNA, 14 nt, Mycobacterium bovis subsp bovis AF2122/97
cgugagcgccgcgg

SEQ ID NO: 1117764 - RNA, 16 nt, Mycobacterium bovis subsp bovis AF2122/97
cgugagcgccgcggcg

SEQ ID NO: 1117765 - RNA, 17 nt, Mycobacterium bovis subsp bovis AF2122/97
cgugaugguugcucgag

SEQ ID NO: 1117766 - RNA, 20 nt, Mycobacterium bovis subsp bovis AF2122/97
cgugauguggucggacagcg

SEQ ID NO: 1117767 - RNA, 20 nt, Mycobacterium bovis subsp bovis AF2122/97
cgugcacaggcaucguccgc

SEQ ID NO: 1117768 - RNA, 11 nt, Mycobacterium bovis subsp bovis AF2122/97
cgugcaaccac

SEQ ID NO: 1117769 - RNA, 11 nt, Mycobacterium bovis subsp bovis AF2122/97
cgugcaaccau

SEQ ID NO: 1117770 - RNA, 15 nt, Mycobacterium bovis subsp bovis AF2122/97
cgugaccgacgccgu

SEQ ID NO: 1117771 - RNA, 16 nt, Mycobacterium bovis subsp bovis AF2122/97
cgugaccgacgccguc

SEQ ID NO: 1117772 - RNA, 21 nt, Mycobacterium bovis subsp bovis AF2122/97
cgugacccugggguugcauca

SEQ ID NO: 1117773 - RNA, 17 nt, Mycobacterium bovis subsp bovis AF2122/97
cgugaccgacgccgucg

SEQ ID NO: 1117774 - RNA, 14 nt, Mycobacterium bovis subsp bovis AF2122/97
cgugaccgacugcg

SEQ ID NO: 1117775 - RNA, 19 nt, Mycobacterium bovis subsp bovis AF2122/97
cgugaccgagaagcccacc

SEQ ID NO: 1117776 - RNA, 13 nt, Mycobacterium bovis subsp bovis AF2122/97
cgugaccgccgcg

SEQ ID NO: 1117777 - RNA, 14 nt, Mycobacterium bovis subsp bovis AF2122/97
cgugaccgccgcgc

SEQ ID NO: 1117778 - RNA, 18 nt, Mycobacterium bovis subsp bovis AF2122/97
cgugaccgccgcgccggc

SEQ ID NO: 1117779 - RNA, 16 nt, Mycobacterium bovis subsp bovis AF2122/97
cgugaccggcaaccgc

SEQ ID NO: 1117780 - RNA, 20 nt, Mycobacterium bovis subsp bovis AF2122/97
cgugaccggcaaccgccgug

SEQ ID NO: 1117781 - RNA, 15 nt, Mycobacterium bovis subsp bovis AF2122/97
cgugacccgccggcg

SEQ ID NO: 1117782 - RNA, 21 nt, Mycobacterium bovis subsp bovis AF2122/97
cgugaccgugccgucggcgug

SEQ ID NO: 1117783 - RNA, 23 nt, Mycobacterium bovis subsp bovis AF2122/97
cgugaccgugccgucggcgugca

SEQ ID NO: 1117784 - RNA, 17 nt, Mycobacterium bovis subsp bovis AF2122/97
cgugacgaucagcguga

SEQ ID NO: 1117785 - RNA, 18 nt, Mycobacterium bovis subsp bovis AF2122/97
cgugacgaccagccccgc

SEQ ID NO: 1117786 - RNA, 13 nt, Mycobacterium bovis subsp bovis AF2122/97
cgugacgucgugg

SEQ ID NO: 1117787 - RNA, 23 nt, Mycobacterium bovis subsp bovis AF2122/97
cgugacgucguggcgcucggcga

SEQ ID NO: 1117788 - RNA, 22 nt, Mycobacterium bovis subsp bovis AF2122/97
cgugacguuguaggagaacguc

SEQ ID NO: 1117789 - RNA, 17 nt, Mycobacterium bovis subsp bovis AF2122/97
cgugacucggccgacga

SEQ ID NO: 1117790 - RNA, 22 nt, Mycobacterium bovis subsp bovis AF2122/97
cugaaucgguucggccagaacg

SEQ ID NO: 1117791 - RNA, 22 nt, Mycobacterium bovis subsp bovis AF2122/97
cugaauguugguuugccggcgg

SEQ ID NO: 1117792 - RNA, 13 nt, Mycobacterium bovis subsp bovis AF2122/97
cugaauucggcga

SEQ ID NO: 1117793 - RNA, 18 nt, Mycobacterium bovis subsp bovis AF2122/97
cugaauucggcgagcgcc

SEQ ID NO: 1117794 - RNA, 14 nt, Mycobacterium bovis subsp bovis AF2122/97
cugaauuggcgccg

SEQ ID NO: 1117795 - RNA, 18 nt, Mycobacterium bovis subsp bovis AF2122/97
cugacacaacaccggcgu

SEQ ID NO: 1117796 - RNA, 17 nt, Mycobacterium bovis subsp bovis AF2122/97
cucugcgacaccacgaa

SEQ ID NO: 1117797 - RNA, 13 nt, Mycobacterium bovis subsp bovis AF2122/97
cucugcguccacc

SEQ ID NO: 1117798 - RNA, 15 nt, Mycobacterium bovis subsp bovis AF2122/97
cucugcguccagcaa

SEQ ID NO: 1117799 - RNA, 22 nt, Mycobacterium bovis subsp bovis AF2122/97
cucuggaucacgucgaugugac

SEQ ID NO: 1117800 - RNA, 15 nt, Mycobacterium bovis subsp bovis AF2122/97
cucugcgaucaguuc

SEQ ID NO: 1117801 - RNA, 15 nt, Mycobacterium bovis subsp bovis AF2122/97
cucugagcuuggucg

SEQ ID NO: 1117802 - RNA, 13 nt, Mycobacterium bovis subsp bovis AF2122/97
cugaacaggccgg

SEQ ID NO: 1117803 - RNA, 21 nt, Mycobacterium bovis subsp bovis AF2122/97
cugaaaacaccgcacggugcu

SEQ ID NO: 1117804 - RNA, 13 nt, Mycobacterium bovis subsp bovis AF2122/97
cucuugcgccacg

SEQ ID NO: 1117805 - RNA, 13 nt, Mycobacterium bovis subsp bovis AF2122/97
cucggccgucagg

SEQ ID NO: 1117806 - RNA, 13 nt, Mycobacterium bovis subsp bovis AF2122/97
cucggccgugacc

SEQ ID NO: 1117807 - RNA, 12 nt, Mycobacterium bovis subsp bovis AF2122/97
cucggccggcgg

SEQ ID NO: 1117808 - RNA, 14 nt, Mycobacterium bovis subsp bovis AF2122/97
cucggccggcggcg

SEQ ID NO: 1117809 - RNA, 15 nt, Mycobacterium bovis subsp bovis AF2122/97
cucggccggcggcgc

SEQ ID NO: 1117810 - RNA, 16 nt, Mycobacterium bovis subsp bovis AF2122/97
cucggccgggcggucg

SEQ ID NO: 1117811 - RNA, 13 nt, Mycobacterium bovis subsp bovis AF2122/97
cucggccucgucg

SEQ ID NO: 1117812 - RNA, 22 nt, Mycobacterium bovis subsp bovis AF2122/97
cucggccuugaucaccgugcgg

SEQ ID NO: 1117813 - RNA, 17 nt, Mycobacterium bovis subsp bovis AF2122/97
cucggcgaaacccggga

SEQ ID NO: 1117814 - RNA, 23 nt, Mycobacterium bovis subsp bovis AF2122/97
cucggugcggugauuccagccgg

SEQ ID NO: 1117815 - RNA, 19 nt, Mycobacterium bovis subsp bovis AF2122/97
cucggugcugcgccgauac

SEQ ID NO: 1117816 - RNA, 14 nt, Mycobacterium bovis subsp bovis AF2122/97
cucgguggacggca

SEQ ID NO: 1117817 - RNA, 17 nt, Mycobacterium bovis subsp bovis AF2122/97
cucgguggcugcgccgg

SEQ ID NO: 1117818 - RNA, 12 nt, Mycobacterium bovis subsp bovis AF2122/97
cucgguggcgcc

SEQ ID NO: 1117819 - RNA, 18 nt, Mycobacterium bovis subsp bovis AF2122/97
cucgucgaggcugaccgu

SEQ ID NO: 1117820 - RNA, 15 nt, Mycobacterium bovis subsp bovis AF2122/97
cucgucccacagguu

SEQ ID NO: 1117821 - RNA, 23 nt, Mycobacterium bovis subsp bovis AF2122/97
cucgguuugacgagacgacgacc

SEQ ID NO: 1117822 - RNA, 19 nt, Mycobacterium bovis subsp bovis AF2122/97
cucggugugcucgccgacc

SEQ ID NO: 1117823 - RNA, 16 nt, Mycobacterium bovis subsp bovis AF2122/97
cucggugucggccgcg

SEQ ID NO: 1117824 - RNA, 19 nt, Mycobacterium bovis subsp bovis AF2122/97
cucgguugguccucggcgg

SEQ ID NO: 1117825 - RNA, 16 nt, Mycobacterium bovis subsp bovis AF2122/97
cucgucgggaucggcg

SEQ ID NO: 1117826 - RNA, 22 nt, Mycobacterium bovis subsp bovis AF2122/97
cucgucgggaucggcguccauc

SEQ ID NO: 1117827 - RNA, 12 nt, Mycobacterium bovis subsp bovis AF2122/97
cucgucggcgcc

SEQ ID NO: 1117828 - RNA, 15 nt, Mycobacterium bovis subsp bovis AF2122/97
cucgucgagccgacc

SEQ ID NO: 1117829 - RNA, 15 nt, Mycobacterium bovis subsp bovis AF2122/97
cucgucggugucggu

SEQ ID NO: 1117830 - RNA, 20 nt, Mycobacterium bovis subsp bovis AF2122/97
cucgucgagccgaccgcggg

SEQ ID NO: 1117831 - RNA, 19 nt, Mycobacterium bovis subsp bovis AF2122/97
cucgucgucgaaguuggcg

SEQ ID NO: 1117832 - RNA, 23 nt, Mycobacterium bovis subsp bovis AF2122/97
cucgugaacaacuccguugaggu

SEQ ID NO: 1117833 - RNA, 19 nt, Mycobacterium bovis subsp bovis AF2122/97
cucgugaccgccguugucg

SEQ ID NO: 1117834 - RNA, 23 nt, Mycobacterium bovis subsp bovis AF2122/97
cucgucgugagacugggcgcugg

SEQ ID NO: 1117835 - RNA, 20 nt, Mycobacterium bovis subsp bovis AF2122/97
cucgucgugagucacccggc

SEQ ID NO: 1117836 - RNA, 22 nt, Mycobacterium bovis subsp bovis AF2122/97
cucgucgugagucacccggccg

SEQ ID NO: 1117837 - RNA, 20 nt, Mycobacterium bovis subsp bovis AF2122/97
cucgucgucgggaacgccga

SEQ ID NO: 1117838 - RNA, 22 nt, Mycobacterium bovis subsp bovis AF2122/97
cucgucgucgauuagcccaccc

SEQ ID NO: 1117839 - RNA, 19 nt, Mycobacterium bovis subsp bovis AF2122/97
cucgucgucggacucgucc

SEQ ID NO: 1117840 - RNA, 15 nt, Mycobacterium bovis subsp bovis AF2122/97
cucguugaccggccg

SEQ ID NO: 1117841 - RNA, 13 nt, Mycobacterium bovis subsp bovis AF2122/97
cucguuguagccg

SEQ ID NO: 1117842 - RNA, 20 nt, Mycobacterium bovis subsp bovis AF2122/97
cucguugcuggcggccagca

SEQ ID NO: 1117843 - RNA, 13 nt, Mycobacterium bovis subsp bovis AF2122/97
cucguugcugccg

SEQ ID NO: 1117844 - RNA, 14 nt, Mycobacterium bovis subsp bovis AF2122/97
cucguugcugccgg

SEQ ID NO: 1117845 - RNA, 15 nt, Mycobacterium bovis subsp bovis AF2122/97
cucguugccgaccau

SEQ ID NO: 1117846 - RNA, 22 nt, Mycobacterium bovis subsp bovis AF2122/97
cucuagcaaagccagcgcagcc

SEQ ID NO: 1117847 - RNA, 16 nt, Mycobacterium bovis subsp bovis AF2122/97
cucuaccggugguagc

SEQ ID NO: 1117848 - RNA, 17 nt, Mycobacterium bovis subsp bovis AF2122/97
cucuaccuccgccaacu

SEQ ID NO: 1117849 - RNA, 22 nt, Mycobacterium bovis subsp bovis AF2122/97
cucuagauauggaccgccgccg

SEQ ID NO: 1117850 - RNA, 21 nt, Mycobacterium bovis subsp bovis AF2122/97
cucuagcaaagccagcgcagc

SEQ ID NO: 1117851 - RNA, 19 nt, Mycobacterium bovis subsp bovis AF2122/97
cucuaucagacgauucggc

SEQ ID NO: 1117852 - RNA, 17 nt, Mycobacterium bovis subsp bovis AF2122/97
cugaucgcgaagcguuc

SEQ ID NO: 1117853 - RNA, 23 nt, Mycobacterium bovis subsp bovis AF2122/97
cugaucggaaacggagccgagcc

SEQ ID NO: 1117854 - RNA, 21 nt, Mycobacterium bovis subsp bovis AF2122/97
cugaucggcaggguggccagc

SEQ ID NO: 1117855 - RNA, 22 nt, Mycobacterium bovis subsp bovis AF2122/97
cugaucgugaacacgucgcggu

SEQ ID NO: 1117856 - RNA, 13 nt, Mycobacterium bovis subsp bovis AF2122/97
cugaucggcgcgg

SEQ ID NO: 1117857 - RNA, 18 nt, Mycobacterium bovis subsp bovis AF2122/97
cugaucggcgcggccgua

SEQ ID NO: 1117858 - RNA, 19 nt, Mycobacterium bovis subsp bovis AF2122/97
cugaugaaccacggcaggc

SEQ ID NO: 1117859 - RNA, 17 nt, Mycobacterium bovis subsp bovis AF2122/97
cugaucuuggcaagcca

SEQ ID NO: 1117860 - RNA, 21 nt, Mycobacterium bovis subsp bovis AF2122/97
cugaucuuccccucggccgcc

SEQ ID NO: 1117861 - RNA, 18 nt, Mycobacterium bovis subsp bovis AF2122/97
cugaucuucgagccggcg

SEQ ID NO: 1117862 - RNA, 20 nt, Mycobacterium bovis subsp bovis AF2122/97
cugaucguuggcaucggcgg

SEQ ID NO: 1117863 - RNA, 14 nt, Mycobacterium bovis subsp bovis AF2122/97
cugaucugcguugc

SEQ ID NO: 1117864 - RNA, 16 nt, Mycobacterium bovis subsp bovis AF2122/97
cugaucuggggcacca

SEQ ID NO: 1117865 - RNA, 14 nt, Mycobacterium bovis subsp bovis AF2122/97
cugaugaagaugau

SEQ ID NO: 1117866 - RNA, 22 nt, Mycobacterium bovis subsp bovis AF2122/97
cugaugaagaugauuucgccga

SEQ ID NO: 1117867 - RNA, 20 nt, Mycobacterium bovis subsp bovis AF2122/97
cugcaacgucacucccuggc

SEQ ID NO: 1117868 - RNA, 16 nt, Mycobacterium bovis subsp bovis AF2122/97
cugcaaccagcggcac

SEQ ID NO: 1117869 - RNA, 13 nt, Mycobacterium bovis subsp bovis AF2122/97
cugcaaccgccgg

SEQ ID NO: 1117870 - RNA, 18 nt, Mycobacterium bovis subsp bovis AF2122/97
cugcaaccgccggugccg

SEQ ID NO: 1117871 - RNA, 16 nt, Mycobacterium bovis subsp bovis AF2122/97
cugaugcaucccaacg

SEQ ID NO: 1117872 - RNA, 17 nt, Mycobacterium bovis subsp bovis AF2122/97
cugcacccgacccgaug

SEQ ID NO: 1117873 - RNA, 11 nt, Mycobacterium bovis subsp bovis AF2122/97
cugcacccgcc

SEQ ID NO: 1117874 - RNA, 20 nt, Mycobacterium bovis subsp bovis AF2122/97
cugcacccaggcaucgguga

SEQ ID NO: 1117875 - RNA, 14 nt, Mycobacterium bovis subsp bovis AF2122/97
cugcacccagccgu

SEQ ID NO: 1117876 - RNA, 17 nt, Mycobacterium bovis subsp bovis AF2122/97
cugcaccacggcggcca

SEQ ID NO: 1117877 - RNA, 19 nt, Mycobacterium bovis subsp bovis AF2122/97
cugcaccacggcggccacc

SEQ ID NO: 1117878 - RNA, 17 nt, Mycobacterium bovis subsp bovis AF2122/97
cugcacauucagcgccg

SEQ ID NO: 1117879 - RNA, 13 nt, Mycobacterium bovis subsp bovis AF2122/97
cugcacccggcga

SEQ ID NO: 1117880 - RNA, 14 nt, Mycobacterium bovis subsp bovis AF2122/97
cugcacccggcgau

SEQ ID NO: 1117881 - RNA, 16 nt, Mycobacterium bovis subsp bovis AF2122/97
cugcacgcgcucgcgc

SEQ ID NO: 1117882 - RNA, 14 nt, Mycobacterium bovis subsp bovis AF2122/97
cugcaccgccgccg

SEQ ID NO: 1117883 - RNA, 15 nt, Mycobacterium bovis subsp bovis AF2122/97
cugcaccgccgccgc

SEQ ID NO: 1117884 - RNA, 22 nt, Mycobacterium bovis subsp bovis AF2122/97
cugcacggucaauugugcggcc

SEQ ID NO: 1117885 - RNA, 14 nt, Mycobacterium bovis subsp bovis AF2122/97
cugcagaucggccg

SEQ ID NO: 1117886 - RNA, 17 nt, Mycobacterium bovis subsp bovis AF2122/97
cugcagcacgcgugguu

SEQ ID NO: 1117887 - RNA, 19 nt, Mycobacterium bovis subsp bovis AF2122/97
cugcagcacucggugucgg

SEQ ID NO: 1117888 - RNA, 19 nt, Mycobacterium bovis subsp bovis AF2122/97
cugcagauaggacccagcc

SEQ ID NO: 1117889 - RNA, 13 nt, Mycobacterium bovis subsp bovis AF2122/97
cugcagcagcgca

SEQ ID NO: 1117890 - RNA, 16 nt, Mycobacterium bovis subsp bovis AF2122/97
cugcagcagacccggu

SEQ ID NO: 1117891 - RNA, 20 nt, Mycobacterium bovis subsp bovis AF2122/97
cugcagcagacccgguggcg

SEQ ID NO: 1117892 - RNA, 23 nt, Mycobacterium bovis subsp bovis AF2122/97
cugcagcagacccgguggcgugg

SEQ ID NO: 1117893 - RNA, 19 nt, Mycobacterium bovis subsp bovis AF2122/97
cugcagacggguggcccga

SEQ ID NO: 1117894 - RNA, 16 nt, Mycobacterium bovis subsp bovis AF2122/97
cugcagacgguccgcu

SEQ ID NO: 1117895 - RNA, 22 nt, Mycobacterium bovis subsp bovis AF2122/97
cugcacuugaaauugagccggc

SEQ ID NO: 1117896 - RNA, 14 nt, Mycobacterium bovis subsp bovis AF2122/97
cugacggugcagga

SEQ ID NO: 1117897 - RNA, 19 nt, Mycobacterium bovis subsp bovis AF2122/97
cugacgguggggauggcgc

SEQ ID NO: 1117898 - RNA, 14 nt, Mycobacterium bovis subsp bovis AF2122/97
cugacgguucgguc

SEQ ID NO: 1117899 - RNA, 15 nt, Mycobacterium bovis subsp bovis AF2122/97
cugacgcuuggccag

SEQ ID NO: 1117900 - RNA, 19 nt, Mycobacterium bovis subsp bovis AF2122/97
cugacgcuuggccagguca

SEQ ID NO: 1117901 - RNA, 15 nt, Mycobacterium bovis subsp bovis AF2122/97
cugacccgcauaccg

SEQ ID NO: 1117902 - RNA, 22 nt, Mycobacterium bovis subsp bovis AF2122/97
cugaccgccagcggccgcucca

SEQ ID NO: 1117903 - RNA, 16 nt, Mycobacterium bovis subsp bovis AF2122/97
cugaccggcucgccgg

SEQ ID NO: 1117904 - RNA, 22 nt, Mycobacterium bovis subsp bovis AF2122/97
cugaccggcucgccggcgcgca

SEQ ID NO: 1117905 - RNA, 24 nt, Mycobacterium bovis subsp bovis AF2122/97
cugaccggcucgccggcgcgcacc

SEQ ID NO: 1117906 - RNA, 19 nt, Mycobacterium bovis subsp bovis AF2122/97
cugaccgcgaucgccgacg

SEQ ID NO: 1117907 - RNA, 18 nt, Mycobacterium bovis subsp bovis AF2122/97
cugaccggggcgcccggc

SEQ ID NO: 1117908 - RNA, 19 nt, Mycobacterium bovis subsp bovis AF2122/97
cugaccggggucggccugc

SEQ ID NO: 1117909 - RNA, 19 nt, Mycobacterium bovis subsp bovis AF2122/97
cugaccggucacccgugcu

SEQ ID NO: 1117910 - RNA, 13 nt, Mycobacterium bovis subsp bovis AF2122/97
cugacccugaucg

SEQ ID NO: 1117911 - RNA, 17 nt, Mycobacterium bovis subsp bovis AF2122/97
cugacccggagccgcca

SEQ ID NO: 1117912 - RNA, 23 nt, Mycobacterium bovis subsp bovis AF2122/97
cugacccggagccgccaggugcu

SEQ ID NO: 1117913 - RNA, 17 nt, Mycobacterium bovis subsp bovis AF2122/97
cugaccccgccgccacg

SEQ ID NO: 1117914 - RNA, 16 nt, Mycobacterium bovis subsp bovis AF2122/97
cugaccccccgacccc

SEQ ID NO: 1117915 - RNA, 21 nt, Mycobacterium bovis subsp bovis AF2122/97
cugaccccccgaccccgacgg

SEQ ID NO: 1117916 - RNA, 14 nt, Mycobacterium bovis subsp bovis AF2122/97
cugaccccgccggc

SEQ ID NO: 1117917 - RNA, 17 nt, Mycobacterium bovis subsp bovis AF2122/97
cugaccgaauggccgcc

SEQ ID NO: 1117918 - RNA, 19 nt, Mycobacterium bovis subsp bovis AF2122/97
cugaccgaauggccgccgc

SEQ ID NO: 1117919 - RNA, 20 nt, Mycobacterium bovis subsp bovis AF2122/97
cugaccgaauggccgccgca

SEQ ID NO: 1117920 - RNA, 12 nt, Mycobacterium bovis subsp bovis AF2122/97
cugaccgccagc

SEQ ID NO: 1117921 - RNA, 13 nt, Mycobacterium bovis subsp bovis AF2122/97
cugaccgccagcg

SEQ ID NO: 1117922 - RNA, 20 nt, Mycobacterium bovis subsp bovis AF2122/97
cugacccaccgccccggcgg

SEQ ID NO: 1117923 - RNA, 13 nt, Mycobacterium bovis subsp bovis AF2122/97
cugacccaccgcc

SEQ ID NO: 1117924 - RNA, 17 nt, Mycobacterium bovis subsp bovis AF2122/97
cugaccaugaccgggcu

SEQ ID NO: 1117925 - RNA, 23 nt, Mycobacterium bovis subsp bovis AF2122/97
cugaccaucacacccaucacccu

SEQ ID NO: 1117926 - RNA, 14 nt, Mycobacterium bovis subsp bovis AF2122/97
cugaccaugaccgg

SEQ ID NO: 1117927 - RNA, 17 nt, Mycobacterium bovis subsp bovis AF2122/97
cugagcggccucgggac

SEQ ID NO: 1117928 - RNA, 17 nt, Mycobacterium bovis subsp bovis AF2122/97
cugagcgccaggccgca

SEQ ID NO: 1117929 - RNA, 18 nt, Mycobacterium bovis subsp bovis AF2122/97
cugagcgccaggccgcac

SEQ ID NO: 1117930 - RNA, 15 nt, Mycobacterium bovis subsp bovis AF2122/97
cugagcgcgcuggcc

SEQ ID NO: 1117931 - RNA, 22 nt, Mycobacterium bovis subsp bovis AF2122/97
cugagcgcgcuggccagcccgg

SEQ ID NO: 1117932 - RNA, 18 nt, Mycobacterium bovis subsp bovis AF2122/97
cugagcguccgacaacga

SEQ ID NO: 1117933 - RNA, 16 nt, Mycobacterium bovis subsp bovis AF2122/97
cugagcgugcggugau

SEQ ID NO: 1117934 - RNA, 21 nt, Mycobacterium bovis subsp bovis AF2122/97
cugauaguggcgcgcggcgcc

SEQ ID NO: 1117935 - RNA, 20 nt, Mycobacterium bovis subsp bovis AF2122/97
cugauagcggucggucacca

SEQ ID NO: 1117936 - RNA, 20 nt, Mycobacterium bovis subsp bovis AF2122/97
cugacgucuuggaacacggc

SEQ ID NO: 1117937 - RNA, 21 nt, Mycobacterium bovis subsp bovis AF2122/97
cugacgucuuggaacacggcc

SEQ ID NO: 1117938 - RNA, 22 nt, Mycobacterium bovis subsp bovis AF2122/97
cugacgucuuggaacacggccg

SEQ ID NO: 1117939 - RNA, 19 nt, Mycobacterium bovis subsp bovis AF2122/97
cugacgucacguucggcgc

SEQ ID NO: 1117940 - RNA, 20 nt, Mycobacterium bovis subsp bovis AF2122/97
cugacgucacguucggcgca

SEQ ID NO: 1117941 - RNA, 12 nt, Mycobacterium bovis subsp bovis AF2122/97
cugacgucacca

SEQ ID NO: 1117942 - RNA, 23 nt, Mycobacterium bovis subsp bovis AF2122/97
cugagccacagggaagcaagggc

SEQ ID NO: 1117943 - RNA, 16 nt, Mycobacterium bovis subsp bovis AF2122/97
cugagccaccaacacc

SEQ ID NO: 1117944 - RNA, 16 nt, Mycobacterium bovis subsp bovis AF2122/97
cugagccaccccgggu

SEQ ID NO: 1117945 - RNA, 13 nt, Mycobacterium bovis subsp bovis AF2122/97
cugagcccgccgc

SEQ ID NO: 1117946 - RNA, 15 nt, Mycobacterium bovis subsp bovis AF2122/97
cugagcccgccgcga

SEQ ID NO: 1117947 - RNA, 15 nt, Mycobacterium bovis subsp bovis AF2122/97
cugagccgucggcgc

SEQ ID NO: 1117948 - RNA, 21 nt, Mycobacterium bovis subsp bovis AF2122/97
cugagcgacugcagcggcgca

SEQ ID NO: 1117949 - RNA, 21 nt, Mycobacterium bovis subsp bovis AF2122/97
cugauccacgauaucgaugcg

SEQ ID NO: 1117950 - RNA, 15 nt, Mycobacterium bovis subsp bovis AF2122/97
cugaucccggccagg

SEQ ID NO: 1117951 - RNA, 13 nt, Mycobacterium bovis subsp bovis AF2122/97
cugauccggccgg

SEQ ID NO: 1117952 - RNA, 16 nt, Mycobacterium bovis subsp bovis AF2122/97
cugauccgggcgccga

SEQ ID NO: 1117953 - RNA, 20 nt, Mycobacterium bovis subsp bovis AF2122/97
cugauccggguggcgucacc

SEQ ID NO: 1117954 - RNA, 17 nt, Mycobacterium bovis subsp bovis AF2122/97
cugauccggugccgcga

SEQ ID NO: 1117955 - RNA, 19 nt, Mycobacterium bovis subsp bovis AF2122/97
cugauccucgaugacaucg

SEQ ID NO: 1117956 - RNA, 16 nt, Mycobacterium bovis subsp bovis AF2122/97
cugaucgccacccggu

SEQ ID NO: 1117957 - RNA, 15 nt, Mycobacterium bovis subsp bovis AF2122/97
cugaucgaccgccuc

SEQ ID NO: 1117958 - RNA, 19 nt, Mycobacterium bovis subsp bovis AF2122/97
cugaucaggccgaugacga

SEQ ID NO: 1117959 - RNA, 16 nt, Mycobacterium bovis subsp bovis AF2122/97
cugaucacucacccgg

SEQ ID NO: 1117960 - RNA, 18 nt, Mycobacterium bovis subsp bovis AF2122/97
cugaucagcaugcggcca

SEQ ID NO: 1117961 - RNA, 12 nt, Mycobacterium bovis subsp bovis AF2122/97
cugccuggccgg

SEQ ID NO: 1117962 - RNA, 17 nt, Mycobacterium bovis subsp bovis AF2122/97
cugccuggccgggaccg

SEQ ID NO: 1117963 - RNA, 22 nt, Mycobacterium bovis subsp bovis AF2122/97
cugccuggccgggaccgccccg

SEQ ID NO: 1117964 - RNA, 13 nt, Mycobacterium bovis subsp bovis AF2122/97
cugccuuacacgc

SEQ ID NO: 1117965 - RNA, 15 nt, Mycobacterium bovis subsp bovis AF2122/97
cugccuuacacgccu

SEQ ID NO: 1117966 - RNA, 15 nt, Mycobacterium bovis subsp bovis AF2122/97
cugccuuaccaaccg

SEQ ID NO: 1117967 - RNA, 15 nt, Mycobacterium bovis subsp bovis AF2122/97
cugccuuggccggcu

SEQ ID NO: 1117968 - RNA, 18 nt, Mycobacterium bovis subsp bovis AF2122/97
cugcgaaaauccgugccg

SEQ ID NO: 1117969 - RNA, 16 nt, Mycobacterium bovis subsp bovis AF2122/97
cugcgaaacgccaccg

SEQ ID NO: 1117970 - RNA, 12 nt, Mycobacterium bovis subsp bovis AF2122/97
cugccuucggcg

SEQ ID NO: 1117971 - RNA, 14 nt, Mycobacterium bovis subsp bovis AF2122/97
cugccucucgaccu

SEQ ID NO: 1117972 - RNA, 18 nt, Mycobacterium bovis subsp bovis AF2122/97
cugccuccggaaggcucg

SEQ ID NO: 1117973 - RNA, 12 nt, Mycobacterium bovis subsp bovis AF2122/97
cugccucaccgc

SEQ ID NO: 1117974 - RNA, 23 nt, Mycobacterium bovis subsp bovis AF2122/97
cugcgacuaagggcacuccaccg

SEQ ID NO: 1117975 - RNA, 16 nt, Mycobacterium bovis subsp bovis AF2122/97
cugcgacuggaucgcg

SEQ ID NO: 1117976 - RNA, 19 nt, Mycobacterium bovis subsp bovis AF2122/97
cugcgacuggugccugccg

SEQ ID NO: 1117977 - RNA, 17 nt, Mycobacterium bovis subsp bovis AF2122/97
cugcgacgagcccaccg

SEQ ID NO: 1117978 - RNA, 18 nt, Mycobacterium bovis subsp bovis AF2122/97
cugcgacgagcccaccgu

SEQ ID NO: 1117979 - RNA, 16 nt, Mycobacterium bovis subsp bovis AF2122/97
cugcgacgaugccgcc

SEQ ID NO: 1117980 - RNA, 21 nt, Mycobacterium bovis subsp bovis AF2122/97
cugcgacgaugccgccuggug

SEQ ID NO: 1117981 - RNA, 15 nt, Mycobacterium bovis subsp bovis AF2122/97
cugcgacccgggccg

SEQ ID NO: 1117982 - RNA, 16 nt, Mycobacterium bovis subsp bovis AF2122/97
cugcgacccgggccgc

SEQ ID NO: 1117983 - RNA, 19 nt, Mycobacterium bovis subsp bovis AF2122/97
cugcgacccgggccgcggc

SEQ ID NO: 1117984 - RNA, 14 nt, Mycobacterium bovis subsp bovis AF2122/97
cugcgaccucgccg

SEQ ID NO: 1117985 - RNA, 18 nt, Mycobacterium bovis subsp bovis AF2122/97
cugcgaccucgccggacg

SEQ ID NO: 1117986 - RNA, 16 nt, Mycobacterium bovis subsp bovis AF2122/97
cugcgaccaggcgcgg

SEQ ID NO: 1117987 - RNA, 22 nt, Mycobacterium bovis subsp bovis AF2122/97
cugcgaccaggcgcggcgacaa

SEQ ID NO: 1117988 - RNA, 19 nt, Mycobacterium bovis subsp bovis AF2122/97
cugccuugauugccgcgua

SEQ ID NO: 1117989 - RNA, 20 nt, Mycobacterium bovis subsp bovis AF2122/97
cugcgaagucgcauggcggc

SEQ ID NO: 1117990 - RNA, 22 nt, Mycobacterium bovis subsp bovis AF2122/97
cugcgaaggaccagagcucgaa

SEQ ID NO: 1117991 - RNA, 16 nt, Mycobacterium bovis subsp bovis AF2122/97
cugcgaagucgcaugg

SEQ ID NO: 1117992 - RNA, 17 nt, Mycobacterium bovis subsp bovis AF2122/97
cugcgaaucuccgcgcg

SEQ ID NO: 1117993 - RNA, 18 nt, Mycobacterium bovis subsp bovis AF2122/97
cugcgaaucuccgcgcgg

SEQ ID NO: 1117994 - RNA, 14 nt, Mycobacterium bovis subsp bovis AF2122/97
cugcgaaugcuggg

SEQ ID NO: 1117995 - RNA, 16 nt, Mycobacterium bovis subsp bovis AF2122/97
cugcgaaugcugggcc

SEQ ID NO: 1117996 - RNA, 20 nt, Mycobacterium bovis subsp bovis AF2122/97
cugcgaaugcugggcccgcc

SEQ ID NO: 1117997 - RNA, 21 nt, Mycobacterium bovis subsp bovis AF2122/97
cugcgaaugcugggcccgcca

SEQ ID NO: 1117998 - RNA, 14 nt, Mycobacterium bovis subsp bovis AF2122/97
cugccgguggcggc

SEQ ID NO: 1117999 - RNA, 17 nt, Mycobacterium bovis subsp bovis AF2122/97
cugccgguggcggcggc

SEQ ID NO: 1118000 - RNA, 18 nt, Mycobacterium bovis subsp bovis AF2122/97
cugccgguggcggcggcg

SEQ ID NO: 1118001 - RNA, 22 nt, Mycobacterium bovis subsp bovis AF2122/97
cugccgguggcggcggcggcaa

SEQ ID NO: 1118002 - RNA, 23 nt, Mycobacterium bovis subsp bovis AF2122/97
cugccgguggcggcggcggcaac

SEQ ID NO: 1118003 - RNA, 22 nt, Mycobacterium bovis subsp bovis AF2122/97
cugccggugggcguucccccgg

SEQ ID NO: 1118004 - RNA, 22 nt, Mycobacterium bovis subsp bovis AF2122/97
cugccgguguaggccucggcag

SEQ ID NO: 1118005 - RNA, 14 nt, Mycobacterium bovis subsp bovis AF2122/97
cugccgguaccggc

SEQ ID NO: 1118006 - RNA, 17 nt, Mycobacterium bovis subsp bovis AF2122/97
cugccgguagcacagca

SEQ ID NO: 1118007 - RNA, 20 nt, Mycobacterium bovis subsp bovis AF2122/97
cugccgguagcacagcagca

SEQ ID NO: 1118008 - RNA, 15 nt, Mycobacterium bovis subsp bovis AF2122/97
cugccggucgauguc

SEQ ID NO: 1118009 - RNA, 24 nt, Mycobacterium bovis subsp bovis AF2122/97
cugccggguggguaauacaggccg

SEQ ID NO: 1118010 - RNA, 15 nt, Mycobacterium bovis subsp bovis AF2122/97
cugccggcgccgcca

SEQ ID NO: 1118011 - RNA, 22 nt, Mycobacterium bovis subsp bovis AF2122/97
cugccggcugacgaccaaccac

SEQ ID NO: 1118012 - RNA, 17 nt, Mycobacterium bovis subsp bovis AF2122/97
cugccgggccacggcug

SEQ ID NO: 1118013 - RNA, 16 nt, Mycobacterium bovis subsp bovis AF2122/97
cugccggcgccgccac

SEQ ID NO: 1118014 - RNA, 22 nt, Mycobacterium bovis subsp bovis AF2122/97
cugccguucggggcgcgguacc

SEQ ID NO: 1118015 - RNA, 23 nt, Mycobacterium bovis subsp bovis AF2122/97
cugccguucggggcgcgguaccg

SEQ ID NO: 1118016 - RNA, 23 nt, Mycobacterium bovis subsp bovis AF2122/97
cugccguuagcuuagcugccguc

SEQ ID NO: 1118017 - RNA, 22 nt, Mycobacterium bovis subsp bovis AF2122/97
cugccguuccagcaucggugcg

SEQ ID NO: 1118018 - RNA, 14 nt, Mycobacterium bovis subsp bovis AF2122/97
cugccgucgcugcc

SEQ ID NO: 1118019 - RNA, 22 nt, Mycobacterium bovis subsp bovis AF2122/97
cugccguggcggcagcggugcu

SEQ ID NO: 1118020 - RNA, 18 nt, Mycobacterium bovis subsp bovis AF2122/97
cugccggugagugcgcga

SEQ ID NO: 1118021 - RNA, 19 nt, Mycobacterium bovis subsp bovis AF2122/97
cugccguauccaggcgugc

SEQ ID NO: 1118022 - RNA, 19 nt, Mycobacterium bovis subsp bovis AF2122/97
cugccgcccuugccgcccg

SEQ ID NO: 1118023 - RNA, 20 nt, Mycobacterium bovis subsp bovis AF2122/97
cugccgcccuugccgcccgc

SEQ ID NO: 1118024 - RNA, 15 nt, Mycobacterium bovis subsp bovis AF2122/97
cugccgccgccgccg

SEQ ID NO: 1118025 - RNA, 17 nt, Mycobacterium bovis subsp bovis AF2122/97
cugccgccgccgccggc

SEQ ID NO: 1118026 - RNA, 14 nt, Mycobacterium bovis subsp bovis AF2122/97
cugccgccgagcug

SEQ ID NO: 1118027 - RNA, 22 nt, Mycobacterium bovis subsp bovis AF2122/97
cugccgcgaugagcggcgcggc

SEQ ID NO: 1118028 - RNA, 11 nt, Mycobacterium bovis subsp bovis AF2122/97
cugccgccguu

SEQ ID NO: 1118029 - RNA, 15 nt, Mycobacterium bovis subsp bovis AF2122/97
cugccgccguugccg

SEQ ID NO: 1118030 - RNA, 19 nt, Mycobacterium bovis subsp bovis AF2122/97
cugccgccggugccgccgg

SEQ ID NO: 1118031 - RNA, 22 nt, Mycobacterium bovis subsp bovis AF2122/97
cugccgccggugccgccggugc

SEQ ID NO: 1118032 - RNA, 14 nt, Mycobacterium bovis subsp bovis AF2122/97
cugccgccgcucca

SEQ ID NO: 1118033 - RNA, 14 nt, Mycobacterium bovis subsp bovis AF2122/97
cugccgccggcccc

SEQ ID NO: 1118034 - RNA, 15 nt, Mycobacterium bovis subsp bovis AF2122/97
cugccgccgucgccg

SEQ ID NO: 1118035 - RNA, 21 nt, Mycobacterium bovis subsp bovis AF2122/97
cugccgccuuggucgcgucgg

SEQ ID NO: 1118036 - RNA, 13 nt, Mycobacterium bovis subsp bovis AF2122/97
cugccgcggcacc

SEQ ID NO: 1118037 - RNA, 16 nt, Mycobacterium bovis subsp bovis AF2122/97
cugccgcggccggcgu

SEQ ID NO: 1118038 - RNA, 14 nt, Mycobacterium bovis subsp bovis AF2122/97
cugccgcgcggcga

SEQ ID NO: 1118039 - RNA, 14 nt, Mycobacterium bovis subsp bovis AF2122/97
cugccggcagcggc

SEQ ID NO: 1118040 - RNA, 22 nt, Mycobacterium bovis subsp bovis AF2122/97
cugccggcagcggcgcucggcg

SEQ ID NO: 1118041 - RNA, 21 nt, Mycobacterium bovis subsp bovis AF2122/97
cugccggcagcguccgaacca

SEQ ID NO: 1118042 - RNA, 15 nt, Mycobacterium bovis subsp bovis AF2122/97
cugccggcaccaacc

SEQ ID NO: 1118043 - RNA, 19 nt, Mycobacterium bovis subsp bovis AF2122/97
cugccggcaccaaccaccg

SEQ ID NO: 1118044 - RNA, 21 nt, Mycobacterium bovis subsp bovis AF2122/97
cugccggcaccaaccaccgac

SEQ ID NO: 1118045 - RNA, 16 nt, Mycobacterium bovis subsp bovis AF2122/97
cugccggccggcgggc

SEQ ID NO: 1118046 - RNA, 18 nt, Mycobacterium bovis subsp bovis AF2122/97
cugccggacagccacgca

SEQ ID NO: 1118047 - RNA, 15 nt, Mycobacterium bovis subsp bovis AF2122/97
cugccggaccgcgga

SEQ ID NO: 1118048 - RNA, 14 nt, Mycobacterium bovis subsp bovis AF2122/97
cugccgcugcgccg

SEQ ID NO: 1118049 - RNA, 15 nt, Mycobacterium bovis subsp bovis AF2122/97
cugccgcugcgccgu

SEQ ID NO: 1118050 - RNA, 19 nt, Mycobacterium bovis subsp bovis AF2122/97
cugccgcucgccgguaggc

SEQ ID NO: 1118051 - RNA, 14 nt, Mycobacterium bovis subsp bovis AF2122/97
cugcccgucgucgg

SEQ ID NO: 1118052 - RNA, 16 nt, Mycobacterium bovis subsp bovis AF2122/97
cugcccgucgucggca

SEQ ID NO: 1118053 - RNA, 16 nt, Mycobacterium bovis subsp bovis AF2122/97
cugcccugauugaagc

SEQ ID NO: 1118054 - RNA, 21 nt, Mycobacterium bovis subsp bovis AF2122/97
cugcccuguucguagucucga

SEQ ID NO: 1118055 - RNA, 16 nt, Mycobacterium bovis subsp bovis AF2122/97
cugccgaccagcgcgc

SEQ ID NO: 1118056 - RNA, 19 nt, Mycobacterium bovis subsp bovis AF2122/97
cugccgaagcggccaccgc

SEQ ID NO: 1118057 - RNA, 24 nt, Mycobacterium bovis subsp bovis AF2122/97
cugccgaagcggccaccgccgccg

SEQ ID NO: 1118058 - RNA, 19 nt, Mycobacterium bovis subsp bovis AF2122/97
cugccgaacaguucggcga

SEQ ID NO: 1118059 - RNA, 17 nt, Mycobacterium bovis subsp bovis AF2122/97
cugccgaaacgccgacc

SEQ ID NO: 1118060 - RNA, 18 nt, Mycobacterium bovis subsp bovis AF2122/97
cugccgaaacgccgaccg

SEQ ID NO: 1118061 - RNA, 23 nt, Mycobacterium bovis subsp bovis AF2122/97
cugccgaaacgccgaccgcgccg

SEQ ID NO: 1118062 - RNA, 18 nt, Mycobacterium bovis subsp bovis AF2122/97
cugccgaagcggccaccg

SEQ ID NO: 1118063 - RNA, 18 nt, Mycobacterium bovis subsp bovis AF2122/97
cugccgcacacgcgugca

SEQ ID NO: 1118064 - RNA, 16 nt, Mycobacterium bovis subsp bovis AF2122/97
cugccgcacccggucg

SEQ ID NO: 1118065 - RNA, 17 nt, Mycobacterium bovis subsp bovis AF2122/97
cugccgcacccggucga

SEQ ID NO: 1118066 - RNA, 18 nt, Mycobacterium bovis subsp bovis AF2122/97
cugccgcacgggcccagg

SEQ ID NO: 1118067 - RNA, 18 nt, Mycobacterium bovis subsp bovis AF2122/97
cugccgcacguucggcga

SEQ ID NO: 1118068 - RNA, 21 nt, Mycobacterium bovis subsp bovis AF2122/97
cugccgcacguucggcgauga

SEQ ID NO: 1118069 - RNA, 19 nt, Mycobacterium bovis subsp bovis AF2122/97
cugccgcaugcgcuccggc

SEQ ID NO: 1118070 - RNA, 18 nt, Mycobacterium bovis subsp bovis AF2122/97
cugccgaucccguggugg

SEQ ID NO: 1118071 - RNA, 18 nt, Mycobacterium bovis subsp bovis AF2122/97
cugccgacucaucggccg

SEQ ID NO: 1118072 - RNA, 15 nt, Mycobacterium bovis subsp bovis AF2122/97
cugccgacucaucgg

SEQ ID NO: 1118073 - RNA, 21 nt, Mycobacterium bovis subsp bovis AF2122/97
cugccgacaguuuaccgugcc

SEQ ID NO: 1118074 - RNA, 16 nt, Mycobacterium bovis subsp bovis AF2122/97
cugcccagcacccccu

SEQ ID NO: 1118075 - RNA, 11 nt, Mycobacterium bovis subsp bovis AF2122/97
cugcccaccau

SEQ ID NO: 1118076 - RNA, 17 nt, Mycobacterium bovis subsp bovis AF2122/97
cugcccaccaucccgcu

SEQ ID NO: 1118077 - RNA, 16 nt, Mycobacterium bovis subsp bovis AF2122/97
cugcccacgggccggc

SEQ ID NO: 1118078 - RNA, 19 nt, Mycobacterium bovis subsp bovis AF2122/97
cugcccagcgucaucccga

SEQ ID NO: 1118079 - RNA, 22 nt, Mycobacterium bovis subsp bovis AF2122/97
cugcccaacggaagaccgcggg

SEQ ID NO: 1118080 - RNA, 18 nt, Mycobacterium bovis subsp bovis AF2122/97
cugccauugccugggcga

SEQ ID NO: 1118081 - RNA, 21 nt, Mycobacterium bovis subsp bovis AF2122/97
cugccauugccugggcgaccg

SEQ ID NO: 1118082 - RNA, 16 nt, Mycobacterium bovis subsp bovis AF2122/97
cugccagugccgccca

SEQ ID NO: 1118083 - RNA, 17 nt, Mycobacterium bovis subsp bovis AF2122/97
cugccagugggccgacg

SEQ ID NO: 1118084 - RNA, 18 nt, Mycobacterium bovis subsp bovis AF2122/97
cugccagugggccgacgu

SEQ ID NO: 1118085 - RNA, 19 nt, Mycobacterium bovis subsp bovis AF2122/97
cugccagggugcgccgguc

SEQ ID NO: 1118086 - RNA, 18 nt, Mycobacterium bovis subsp bovis AF2122/97
cugccaucuggguccguc

SEQ ID NO: 1118087 - RNA, 15 nt, Mycobacterium bovis subsp bovis AF2122/97
cugccagcggccggg

SEQ ID NO: 1118088 - RNA, 18 nt, Mycobacterium bovis subsp bovis AF2122/97
cugccagcggccgggcgg

SEQ ID NO: 1118089 - RNA, 17 nt, Mycobacterium bovis subsp bovis AF2122/97
cugccagcgccgccgcc

SEQ ID NO: 1118090 - RNA, 21 nt, Mycobacterium bovis subsp bovis AF2122/97
cugccagcgccgccgccgacg

SEQ ID NO: 1118091 - RNA, 14 nt, Mycobacterium bovis subsp bovis AF2122/97
cugccagcgccgcg

SEQ ID NO: 1118092 - RNA, 15 nt, Mycobacterium bovis subsp bovis AF2122/97
cugccagcgccgcgg

SEQ ID NO: 1118093 - RNA, 13 nt, Mycobacterium bovis subsp bovis AF2122/97
cugcccccgccgg

SEQ ID NO: 1118094 - RNA, 19 nt, Mycobacterium bovis subsp bovis AF2122/97
cugcccccgcgcgcacggc

SEQ ID NO: 1118095 - RNA, 21 nt, Mycobacterium bovis subsp bovis AF2122/97
cugccccgccaccucgccggc

SEQ ID NO: 1118096 - RNA, 14 nt, Mycobacterium bovis subsp bovis AF2122/97
cugccccgccgcca

SEQ ID NO: 1118097 - RNA, 22 nt, Mycobacterium bovis subsp bovis AF2122/97
cugccccccagacaauccgccg

SEQ ID NO: 1118098 - RNA, 15 nt, Mycobacterium bovis subsp bovis AF2122/97
cugcccaugcggcag

SEQ ID NO: 1118099 - RNA, 16 nt, Mycobacterium bovis subsp bovis AF2122/97
cugcccaugcggcagg

SEQ ID NO: 1118100 - RNA, 14 nt, Mycobacterium bovis subsp bovis AF2122/97
cugccccuccgggc

SEQ ID NO: 1118101 - RNA, 14 nt, Mycobacterium bovis subsp bovis AF2122/97
cugcccgaaccacc

SEQ ID NO: 1118102 - RNA, 23 nt, Mycobacterium bovis subsp bovis AF2122/97
cugcccgagaucgcgugcgacga

SEQ ID NO: 1118103 - RNA, 21 nt, Mycobacterium bovis subsp bovis AF2122/97
cugcccgauguuacggcccca

SEQ ID NO: 1118104 - RNA, 21 nt, Mycobacterium bovis subsp bovis AF2122/97
cugcccgauggcuaccuugga

SEQ ID NO: 1118105 - RNA, 13 nt, Mycobacterium bovis subsp bovis AF2122/97
cugcccgaggucc

SEQ ID NO: 1118106 - RNA, 21 nt, Mycobacterium bovis subsp bovis AF2122/97
cugcccgauacccggugaugg

SEQ ID NO: 1118107 - RNA, 14 nt, Mycobacterium bovis subsp bovis AF2122/97
cugcccgcgcggcc

SEQ ID NO: 1118108 - RNA, 13 nt, Mycobacterium bovis subsp bovis AF2122/97
cugcccgcggacg

SEQ ID NO: 1118109 - RNA, 16 nt, Mycobacterium bovis subsp bovis AF2122/97
cugcccgcggacgugc

SEQ ID NO: 1118110 - RNA, 18 nt, Mycobacterium bovis subsp bovis AF2122/97
cugcccgcggacgugccg

SEQ ID NO: 1118111 - RNA, 17 nt, Mycobacterium bovis subsp bovis AF2122/97
cugcccgggcugccgcc

SEQ ID NO: 1118112 - RNA, 14 nt, Mycobacterium bovis subsp bovis AF2122/97
cugcccgcggcgga

SEQ ID NO: 1118113 - RNA, 13 nt, Mycobacterium bovis subsp bovis AF2122/97
cugcccgccguua

SEQ ID NO: 1118114 - RNA, 16 nt, Mycobacterium bovis subsp bovis AF2122/97
cugcccggcccgcccg

SEQ ID NO: 1118115 - RNA, 15 nt, Mycobacterium bovis subsp bovis AF2122/97
cugcaggaaggcuuc

SEQ ID NO: 1118116 - RNA, 22 nt, Mycobacterium bovis subsp bovis AF2122/97
cugcaggccgccggccagcguc

SEQ ID NO: 1118117 - RNA, 16 nt, Mycobacterium bovis subsp bovis AF2122/97
cugcagggccuggcca

SEQ ID NO: 1118118 - RNA, 18 nt, Mycobacterium bovis subsp bovis AF2122/97
cugcagggccuggccaca

SEQ ID NO: 1118119 - RNA, 14 nt, Mycobacterium bovis subsp bovis AF2122/97
cugcaggcggccga

SEQ ID NO: 1118120 - RNA, 20 nt, Mycobacterium bovis subsp bovis AF2122/97
cugcagguuaggguccaggu

SEQ ID NO: 1118121 - RNA, 16 nt, Mycobacterium bovis subsp bovis AF2122/97
cugcagguuccacgcg

SEQ ID NO: 1118122 - RNA, 15 nt, Mycobacterium bovis subsp bovis AF2122/97
cugcagcgaugacga

SEQ ID NO: 1118123 - RNA, 16 nt, Mycobacterium bovis subsp bovis AF2122/97
cugcagcgcauccggu

SEQ ID NO: 1118124 - RNA, 21 nt, Mycobacterium bovis subsp bovis AF2122/97
cugcagcggcuugcccaggcg

SEQ ID NO: 1118125 - RNA, 14 nt, Mycobacterium bovis subsp bovis AF2122/97
cugcagcgcgaccc

SEQ ID NO: 1118126 - RNA, 18 nt, Mycobacterium bovis subsp bovis AF2122/97
cugcagcgcggauucggu

SEQ ID NO: 1118127 - RNA, 14 nt, Mycobacterium bovis subsp bovis AF2122/97
cugcagcgcggugg

SEQ ID NO: 1118128 - RNA, 23 nt, Mycobacterium bovis subsp bovis AF2122/97
cugcagcgcgguggucagcaccg

SEQ ID NO: 1118129 - RNA, 18 nt, Mycobacterium bovis subsp bovis AF2122/97
cugcagcccgggcagcac

SEQ ID NO: 1118130 - RNA, 20 nt, Mycobacterium bovis subsp bovis AF2122/97
cugcagcccgggcagcacca

SEQ ID NO: 1118131 - RNA, 19 nt, Mycobacterium bovis subsp bovis AF2122/97
cugccaacgcccguguuga

SEQ ID NO: 1118132 - RNA, 23 nt, Mycobacterium bovis subsp bovis AF2122/97
cugccaaucugcacgcgcucgcg

SEQ ID NO: 1118133 - RNA, 16 nt, Mycobacterium bovis subsp bovis AF2122/97
cugccaaugcugcagg

SEQ ID NO: 1118134 - RNA, 19 nt, Mycobacterium bovis subsp bovis AF2122/97
cugccaaacuaacggcagc

SEQ ID NO: 1118135 - RNA, 20 nt, Mycobacterium bovis subsp bovis AF2122/97
cugccaaacuaacggcagcc

SEQ ID NO: 1118136 - RNA, 16 nt, Mycobacterium bovis subsp bovis AF2122/97
cugcaugguggcgccg

SEQ ID NO: 1118137 - RNA, 17 nt, Mycobacterium bovis subsp bovis AF2122/97
cugcaugguggcgccga

SEQ ID NO: 1118138 - RNA, 14 nt, Mycobacterium bovis subsp bovis AF2122/97
cugccacagcgaca

SEQ ID NO: 1118139 - RNA, 16 nt, Mycobacterium bovis subsp bovis AF2122/97
cugccacagcgacagc

SEQ ID NO: 1118140 - RNA, 15 nt, Mycobacterium bovis subsp bovis AF2122/97
cugccacaggcguuu

SEQ ID NO: 1118141 - RNA, 16 nt, Mycobacterium bovis subsp bovis AF2122/97
cugccacccagcacgc

SEQ ID NO: 1118142 - RNA, 18 nt, Mycobacterium bovis subsp bovis AF2122/97
cugccacacaggcgucca

SEQ ID NO: 1118143 - RNA, 20 nt, Mycobacterium bovis subsp bovis AF2122/97
cugccaccagacaacgccgu

SEQ ID NO: 1118144 - RNA, 22 nt, Mycobacterium bovis subsp bovis AF2122/97
cugccaccgcgagggggguguu

SEQ ID NO: 1118145 - RNA, 20 nt, Mycobacterium bovis subsp bovis AF2122/97
cugccaccgcgggcggcauc

SEQ ID NO: 1118146 - RNA, 17 nt, Mycobacterium bovis subsp bovis AF2122/97
cugccaccgcgguggcg

SEQ ID NO: 1118147 - RNA, 19 nt, Mycobacterium bovis subsp bovis AF2122/97
cugccaccucuaccggugg

SEQ ID NO: 1118148 - RNA, 18 nt, Mycobacterium bovis subsp bovis AF2122/97
cugccacgaacgcuucca

SEQ ID NO: 1118149 - RNA, 24 nt, Mycobacterium bovis subsp bovis AF2122/97
cugccacgaggcaucguccacgca

SEQ ID NO: 1118150 - RNA, 22 nt, Mycobacterium bovis subsp bovis AF2122/97
cugccacuagcauugucgccgg

SEQ ID NO: 1118151 - RNA, 20 nt, Mycobacterium bovis subsp bovis AF2122/97
cugcagguuguuucguucga

SEQ ID NO: 1118152 - RNA, 17 nt, Mycobacterium bovis subsp bovis AF2122/97
cugcagguuuccggccu

SEQ ID NO: 1118153 - RNA, 20 nt, Mycobacterium bovis subsp bovis AF2122/97
cugcaguaguagcgcaaccg

SEQ ID NO: 1118154 - RNA, 15 nt, Mycobacterium bovis subsp bovis AF2122/97
cugcagugcagcgau

SEQ ID NO: 1118155 - RNA, 14 nt, Mycobacterium bovis subsp bovis AF2122/97
cugcagugccgcac

SEQ ID NO: 1118156 - RNA, 16 nt, Mycobacterium bovis subsp bovis AF2122/97
cugcagugcggcguua

SEQ ID NO: 1118157 - RNA, 13 nt, Mycobacterium bovis subsp bovis AF2122/97
cugcaugcccaga

SEQ ID NO: 1118158 - RNA, 15 nt, Mycobacterium bovis subsp bovis AF2122/97
cucgagccgcggcaa

SEQ ID NO: 1118159 - RNA, 18 nt, Mycobacterium bovis subsp bovis AF2122/97
cucgaggaccugcucggg

SEQ ID NO: 1118160 - RNA, 14 nt, Mycobacterium bovis subsp bovis AF2122/97
cucgaggaccacca

SEQ ID NO: 1118161 - RNA, 16 nt, Mycobacterium bovis subsp bovis AF2122/97
cucgagcuugccgucg

SEQ ID NO: 1118162 - RNA, 20 nt, Mycobacterium bovis subsp bovis AF2122/97
cucgagcguggcaacgagca

SEQ ID NO: 1118163 - RNA, 20 nt, Mycobacterium bovis subsp bovis AF2122/97
cucgagcugcuggcgcgccu

SEQ ID NO: 1118164 - RNA, 13 nt, Mycobacterium bovis subsp bovis AF2122/97
cucgagcgcgccg

SEQ ID NO: 1118165 - RNA, 17 nt, Mycobacterium bovis subsp bovis AF2122/97
cucgagcgcggcgaucg

SEQ ID NO: 1118166 - RNA, 21 nt, Mycobacterium bovis subsp bovis AF2122/97
cucgagcccucguuaucgacc

SEQ ID NO: 1118167 - RNA, 20 nt, Mycobacterium bovis subsp bovis AF2122/97
cucgcagcgacacguuggcg

SEQ ID NO: 1118168 - RNA, 21 nt, Mycobacterium bovis subsp bovis AF2122/97
cucgcagcaacggcggcgucg

SEQ ID NO: 1118169 - RNA, 22 nt, Mycobacterium bovis subsp bovis AF2122/97
cucgcagagccgucaccgacug

SEQ ID NO: 1118170 - RNA, 13 nt, Mycobacterium bovis subsp bovis AF2122/97
cucgcacagccgc

SEQ ID NO: 1118171 - RNA, 19 nt, Mycobacterium bovis subsp bovis AF2122/97
cucgcacagccgcuuggcg

SEQ ID NO: 1118172 - RNA, 13 nt, Mycobacterium bovis subsp bovis AF2122/97
cucgcaccgcccg

SEQ ID NO: 1118173 - RNA, 15 nt, Mycobacterium bovis subsp bovis AF2122/97
cucgcaccgcccgcc

SEQ ID NO: 1118174 - RNA, 15 nt, Mycobacterium bovis subsp bovis AF2122/97
cucgcaccgcgccgu

SEQ ID NO: 1118175 - RNA, 17 nt, Mycobacterium bovis subsp bovis AF2122/97
cucgcaccggauccacg

SEQ ID NO: 1118176 - RNA, 20 nt, Mycobacterium bovis subsp bovis AF2122/97
cucgcacaauggcggcgccg

SEQ ID NO: 1118177 - RNA, 23 nt, Mycobacterium bovis subsp bovis AF2122/97
cucgccagagucggagacccguc

SEQ ID NO: 1118178 - RNA, 14 nt, Mycobacterium bovis subsp bovis AF2122/97
cucgccaggcaagc

SEQ ID NO: 1118179 - RNA, 16 nt, Mycobacterium bovis subsp bovis AF2122/97
cucgccaggcaagcca

SEQ ID NO: 1118180 - RNA, 14 nt, Mycobacterium bovis subsp bovis AF2122/97
cucgccaggggaac

SEQ ID NO: 1118181 - RNA, 19 nt, Mycobacterium bovis subsp bovis AF2122/97
cucgccaguucgcgccacg

SEQ ID NO: 1118182 - RNA, 21 nt, Mycobacterium bovis subsp bovis AF2122/97
cucgccaguucgcgccacgca

SEQ ID NO: 1118183 - RNA, 17 nt, Mycobacterium bovis subsp bovis AF2122/97
cucgcccacccgcugcg

SEQ ID NO: 1118184 - RNA, 15 nt, Mycobacterium bovis subsp bovis AF2122/97
cucgcccaccuccug

SEQ ID NO: 1118185 - RNA, 18 nt, Mycobacterium bovis subsp bovis AF2122/97
cucgccaggccuaggccg

SEQ ID NO: 1118186 - RNA, 17 nt, Mycobacterium bovis subsp bovis AF2122/97
cucgcaggccggcggcg

SEQ ID NO: 1118187 - RNA, 19 nt, Mycobacterium bovis subsp bovis AF2122/97
cucgcauguucuccacgcc

SEQ ID NO: 1118188 - RNA, 21 nt, Mycobacterium bovis subsp bovis AF2122/97
cucgcauguucuccacgccga

SEQ ID NO: 1118189 - RNA, 13 nt, Mycobacterium bovis subsp bovis AF2122/97
cucgcauucggcg

SEQ ID NO: 1118190 - RNA, 14 nt, Mycobacterium bovis subsp bovis AF2122/97
cucgccaccgcggc

SEQ ID NO: 1118191 - RNA, 15 nt, Mycobacterium bovis subsp bovis AF2122/97
cucgccaccgcggcg

SEQ ID NO: 1118192 - RNA, 20 nt, Mycobacterium bovis subsp bovis AF2122/97
cucgccacacucccgcgccc

SEQ ID NO: 1118193 - RNA, 22 nt, Mycobacterium bovis subsp bovis AF2122/97
cucgccagagucggagacccgu

SEQ ID NO: 1118194 - RNA, 21 nt, Mycobacterium bovis subsp bovis AF2122/97
cucgccacucagcccgacacc

SEQ ID NO: 1118195 - RNA, 23 nt, Mycobacterium bovis subsp bovis AF2122/97
cucgccacucagcccgacaccga

SEQ ID NO: 1118196 - RNA, 20 nt, Mycobacterium bovis subsp bovis AF2122/97
cucgcccagugaaucggacc

SEQ ID NO: 1118197 - RNA, 15 nt, Mycobacterium bovis subsp bovis AF2122/97
cucgcccgcaccagc

SEQ ID NO: 1118198 - RNA, 15 nt, Mycobacterium bovis subsp bovis AF2122/97
cucgcccucccgggc

SEQ ID NO: 1118199 - RNA, 18 nt, Mycobacterium bovis subsp bovis AF2122/97
cucgcccugacgucacgu

SEQ ID NO: 1118200 - RNA, 15 nt, Mycobacterium bovis subsp bovis AF2122/97
cucgccgacccgccg

SEQ ID NO: 1118201 - RNA, 17 nt, Mycobacterium bovis subsp bovis AF2122/97
cucgccgaaucgcugac

SEQ ID NO: 1118202 - RNA, 19 nt, Mycobacterium bovis subsp bovis AF2122/97
cucgccgacgucgacgccg

SEQ ID NO: 1118203 - RNA, 19 nt, Mycobacterium bovis subsp bovis AF2122/97
cucgccgacggcaagggca

SEQ ID NO: 1118204 - RNA, 12 nt, Mycobacterium bovis subsp bovis AF2122/97
cucgccgagcug

SEQ ID NO: 1118205 - RNA, 24 nt, Mycobacterium bovis subsp bovis AF2122/97
cucgccgaggaaaucgcccucguc

SEQ ID NO: 1118206 - RNA, 16 nt, Mycobacterium bovis subsp bovis AF2122/97
cucgccgaccuuggcg

SEQ ID NO: 1118207 - RNA, 13 nt, Mycobacterium bovis subsp bovis AF2122/97
cucgccgccagcg

SEQ ID NO: 1118208 - RNA, 13 nt, Mycobacterium bovis subsp bovis AF2122/97
cucgccgcgcacc

SEQ ID NO: 1118209 - RNA, 21 nt, Mycobacterium bovis subsp bovis AF2122/97
cucgccggaaagcccgucguc

SEQ ID NO: 1118210 - RNA, 13 nt, Mycobacterium bovis subsp bovis AF2122/97
cucgccggccacc

SEQ ID NO: 1118211 - RNA, 16 nt, Mycobacterium bovis subsp bovis AF2122/97
cucgccggccaccagc

SEQ ID NO: 1118212 - RNA, 13 nt, Mycobacterium bovis subsp bovis AF2122/97
cucgccggcacgc

SEQ ID NO: 1118213 - RNA, 18 nt, Mycobacterium bovis subsp bovis AF2122/97
cucgcgcaaggcgccgca

SEQ ID NO: 1118214 - RNA, 15 nt, Mycobacterium bovis subsp bovis AF2122/97
cucgcgacaucaccg

SEQ ID NO: 1118215 - RNA, 23 nt, Mycobacterium bovis subsp bovis AF2122/97
cucgcgacaucaccgaacggcga

SEQ ID NO: 1118216 - RNA, 16 nt, Mycobacterium bovis subsp bovis AF2122/97
cucgccggcgaagacc

SEQ ID NO: 1118217 - RNA, 14 nt, Mycobacterium bovis subsp bovis AF2122/97
cucgccugcacccg

SEQ ID NO: 1118218 - RNA, 19 nt, Mycobacterium bovis subsp bovis AF2122/97
cucgccugcccgaaccacc

SEQ ID NO: 1118219 - RNA, 18 nt, Mycobacterium bovis subsp bovis AF2122/97
cucgcgggcgaucggcau

SEQ ID NO: 1118220 - RNA, 15 nt, Mycobacterium bovis subsp bovis AF2122/97
cucgcgggcggcgug

SEQ ID NO: 1118221 - RNA, 19 nt, Mycobacterium bovis subsp bovis AF2122/97
cucgcgggcccgcgcggcg

SEQ ID NO: 1118222 - RNA, 16 nt, Mycobacterium bovis subsp bovis AF2122/97
cucgcgggcccgcgcg

SEQ ID NO: 1118223 - RNA, 17 nt, Mycobacterium bovis subsp bovis AF2122/97
cucgcgggcccgcgcgg

SEQ ID NO: 1118224 - RNA, 14 nt, Mycobacterium bovis subsp bovis AF2122/97
cucgcgggcgacca

SEQ ID NO: 1118225 - RNA, 19 nt, Mycobacterium bovis subsp bovis AF2122/97
cucgcgggcgaccaccgcg

SEQ ID NO: 1118226 - RNA, 16 nt, Mycobacterium bovis subsp bovis AF2122/97
cucgcgguagcgccgu

SEQ ID NO: 1118227 - RNA, 15 nt, Mycobacterium bovis subsp bovis AF2122/97
cucgcucgccgagcu

SEQ ID NO: 1118228 - RNA, 21 nt, Mycobacterium bovis subsp bovis AF2122/97
cucgcucgccgagcugugcgc

SEQ ID NO: 1118229 - RNA, 16 nt, Mycobacterium bovis subsp bovis AF2122/97
cucgcgggcggcgugg

SEQ ID NO: 1118230 - RNA, 21 nt, Mycobacterium bovis subsp bovis AF2122/97
cucgcgggcuuaugcacgacg

SEQ ID NO: 1118231 - RNA, 18 nt, Mycobacterium bovis subsp bovis AF2122/97
cucgcugauaguggcgcg

SEQ ID NO: 1118232 - RNA, 18 nt, Mycobacterium bovis subsp bovis AF2122/97
cucggcagcaucuccguc

SEQ ID NO: 1118233 - RNA, 15 nt, Mycobacterium bovis subsp bovis AF2122/97
cucggcaggccgacc

SEQ ID NO: 1118234 - RNA, 18 nt, Mycobacterium bovis subsp bovis AF2122/97
cucggcaucccguucagc

SEQ ID NO: 1118235 - RNA, 15 nt, Mycobacterium bovis subsp bovis AF2122/97
cucggcaucgagcag

SEQ ID NO: 1118236 - RNA, 19 nt, Mycobacterium bovis subsp bovis AF2122/97
cucggccaucugcucgugg

SEQ ID NO: 1118237 - RNA, 16 nt, Mycobacterium bovis subsp bovis AF2122/97
cucggccgcaccagca

SEQ ID NO: 1118238 - RNA, 16 nt, Mycobacterium bovis subsp bovis AF2122/97
cucggccgacgagauc

SEQ ID NO: 1118239 - RNA, 12 nt, Mycobacterium bovis subsp bovis AF2122/97
cucggccgcccg

SEQ ID NO: 1118240 - RNA, 14 nt, Mycobacterium bovis subsp bovis AF2122/97
cucggcccggcagg

SEQ ID NO: 1118241 - RNA, 14 nt, Mycobacterium bovis subsp bovis AF2122/97
cucggcccggguga

SEQ ID NO: 1118242 - RNA, 13 nt, Mycobacterium bovis subsp bovis AF2122/97
cucggccgcaggc

SEQ ID NO: 1118243 - RNA, 14 nt, Mycobacterium bovis subsp bovis AF2122/97
cucggccauagcgc

SEQ ID NO: 1118244 - RNA, 15 nt, Mycobacterium bovis subsp bovis AF2122/97
cucggccccgccgcc

SEQ ID NO: 1118245 - RNA, 15 nt, Mycobacterium bovis subsp bovis AF2122/97
cucggcccagcgcgc

SEQ ID NO: 1118246 - RNA, 16 nt, Mycobacterium bovis subsp bovis AF2122/97
cucggcccagcgcgcc

SEQ ID NO: 1118247 - RNA, 17 nt, Mycobacterium bovis subsp bovis AF2122/97
cucggcccagcgcgcca

SEQ ID NO: 1118248 - RNA, 14 nt, Mycobacterium bovis subsp bovis AF2122/97
cucggcagccggcu

SEQ ID NO: 1118249 - RNA, 14 nt, Mycobacterium bovis subsp bovis AF2122/97
cucggcacccgccg

SEQ ID NO: 1118250 - RNA, 20 nt, Mycobacterium bovis subsp bovis AF2122/97
cucggcacccggcagagcac

SEQ ID NO: 1118251 - RNA, 19 nt, Mycobacterium bovis subsp bovis AF2122/97
cucggcacggaccgcgucg

SEQ ID NO: 1118252 - RNA, 14 nt, Mycobacterium bovis subsp bovis AF2122/97
cucgcuggccgcac

SEQ ID NO: 1118253 - RNA, 22 nt, Mycobacterium bovis subsp bovis AF2122/97
cucgcuggugaaccacucggug

SEQ ID NO: 1118254 - RNA, 21 nt, Mycobacterium bovis subsp bovis AF2122/97
cucggaucgccaggccgucgg

SEQ ID NO: 1118255 - RNA, 15 nt, Mycobacterium bovis subsp bovis AF2122/97
cucggcaagucgacg

SEQ ID NO: 1118256 - RNA, 16 nt, Mycobacterium bovis subsp bovis AF2122/97
cucggcaagucgacgc

SEQ ID NO: 1118257 - RNA, 18 nt, Mycobacterium bovis subsp bovis AF2122/97
cucggcaaaccaagcgcg

SEQ ID NO: 1118258 - RNA, 19 nt, Mycobacterium bovis subsp bovis AF2122/97
cucggcaaccaccucgugg

SEQ ID NO: 1118259 - RNA, 21 nt, Mycobacterium bovis subsp bovis AF2122/97
cucggcaaccugcgaccaggc

SEQ ID NO: 1118260 - RNA, 18 nt, Mycobacterium bovis subsp bovis AF2122/97
cucgcugcaccagcugcu

SEQ ID NO: 1118261 - RNA, 23 nt, Mycobacterium bovis subsp bovis AF2122/97
cucgcugcaccagcugcucgucg

SEQ ID NO: 1118262 - RNA, 14 nt, Mycobacterium bovis subsp bovis AF2122/97
cucgcugcagcagg

SEQ ID NO: 1118263 - RNA, 18 nt, Mycobacterium bovis subsp bovis AF2122/97
cuccggauaacccagcgg

SEQ ID NO: 1118264 - RNA, 13 nt, Mycobacterium bovis subsp bovis AF2122/97
cuccggaucgccg

SEQ ID NO: 1118265 - RNA, 19 nt, Mycobacterium bovis subsp bovis AF2122/97
cuccggauaacccagcggc

SEQ ID NO: 1118266 - RNA, 15 nt, Mycobacterium bovis subsp bovis AF2122/97
cuccgcugccgcccg

SEQ ID NO: 1118267 - RNA, 16 nt, Mycobacterium bovis subsp bovis AF2122/97
cuccgcugccgcccgc

SEQ ID NO: 1118268 - RNA, 19 nt, Mycobacterium bovis subsp bovis AF2122/97
cuccggacaccccgcacgg

SEQ ID NO: 1118269 - RNA, 18 nt, Mycobacterium bovis subsp bovis AF2122/97
cuccgcugaugagccgca

SEQ ID NO: 1118270 - RNA, 13 nt, Mycobacterium bovis subsp bovis AF2122/97
cuccgcugccgcc

SEQ ID NO: 1118271 - RNA, 16 nt, Mycobacterium bovis subsp bovis AF2122/97
cuccgcgccgaucagc

SEQ ID NO: 1118272 - RNA, 14 nt, Mycobacterium bovis subsp bovis AF2122/97
cuccgcgcucgucu

SEQ ID NO: 1118273 - RNA, 18 nt, Mycobacterium bovis subsp bovis AF2122/97
cuccgcgagcccggccuc

SEQ ID NO: 1118274 - RNA, 19 nt, Mycobacterium bovis subsp bovis AF2122/97
cuccgcgagcccggccucg

SEQ ID NO: 1118275 - RNA, 23 nt, Mycobacterium bovis subsp bovis AF2122/97
cuccgcgagcccggccucggcga

SEQ ID NO: 1118276 - RNA, 19 nt, Mycobacterium bovis subsp bovis AF2122/97
cuccgccguugccgccgcc

SEQ ID NO: 1118277 - RNA, 13 nt, Mycobacterium bovis subsp bovis AF2122/97
cuccgcgauccgc

SEQ ID NO: 1118278 - RNA, 22 nt, Mycobacterium bovis subsp bovis AF2122/97
cuccgcgggguugauugacccg

SEQ ID NO: 1118279 - RNA, 14 nt, Mycobacterium bovis subsp bovis AF2122/97
cuccgcggcgaacc

SEQ ID NO: 1118280 - RNA, 16 nt, Mycobacterium bovis subsp bovis AF2122/97
cuccgcgucggucagc

SEQ ID NO: 1118281 - RNA, 21 nt, Mycobacterium bovis subsp bovis AF2122/97
cuccgcucgguaccggucgac

SEQ ID NO: 1118282 - RNA, 17 nt, Mycobacterium bovis subsp bovis AF2122/97
cuccgcggaacccagca

SEQ ID NO: 1118283 - RNA, 16 nt, Mycobacterium bovis subsp bovis AF2122/97
cuccggcaccaacgcc

SEQ ID NO: 1118284 - RNA, 18 nt, Mycobacterium bovis subsp bovis AF2122/97
cuccggcaccaacgccac

SEQ ID NO: 1118285 - RNA, 20 nt, Mycobacterium bovis subsp bovis AF2122/97
cuccggcaccaacgccaccg

SEQ ID NO: 1118286 - RNA, 14 nt, Mycobacterium bovis subsp bovis AF2122/97
cuccggcaccgguc

SEQ ID NO: 1118287 - RNA, 17 nt, Mycobacterium bovis subsp bovis AF2122/97
cuccggcaagcacaccg

SEQ ID NO: 1118288 - RNA, 21 nt, Mycobacterium bovis subsp bovis AF2122/97
cuccggcaacagcaccagugu

SEQ ID NO: 1118289 - RNA, 20 nt, Mycobacterium bovis subsp bovis AF2122/97
cuccggauaacccagcggcg

SEQ ID NO: 1118290 - RNA, 22 nt, Mycobacterium bovis subsp bovis AF2122/97
cuccggauugcuguacugcggu

SEQ ID NO: 1118291 - RNA, 22 nt, Mycobacterium bovis subsp bovis AF2122/97
cuccggccacacucgccagggc

SEQ ID NO: 1118292 - RNA, 17 nt, Mycobacterium bovis subsp bovis AF2122/97
cuccggcccugccgccg

SEQ ID NO: 1118293 - RNA, 12 nt, Mycobacterium bovis subsp bovis AF2122/97
cuccggccgcac

SEQ ID NO: 1118294 - RNA, 19 nt, Mycobacterium bovis subsp bovis AF2122/97
cuccggccgcacgccgacc

SEQ ID NO: 1118295 - RNA, 19 nt, Mycobacterium bovis subsp bovis AF2122/97
cuccggccgcacgccuacg

SEQ ID NO: 1118296 - RNA, 21 nt, Mycobacterium bovis subsp bovis AF2122/97
cuccggcgcaccugggcugcc

SEQ ID NO: 1118297 - RNA, 16 nt, Mycobacterium bovis subsp bovis AF2122/97
cuccggcgcagcgacc

SEQ ID NO: 1118298 - RNA, 13 nt, Mycobacterium bovis subsp bovis AF2122/97
cuccggcggugcc

SEQ ID NO: 1118299 - RNA, 20 nt, Mycobacterium bovis subsp bovis AF2122/97
cuccggcggugccgucgccg

SEQ ID NO: 1118300 - RNA, 16 nt, Mycobacterium bovis subsp bovis AF2122/97
cuccggcggcagcggc

SEQ ID NO: 1118301 - RNA, 19 nt, Mycobacterium bovis subsp bovis AF2122/97
cuccggcggcagcggcgcc

SEQ ID NO: 1118302 - RNA, 16 nt, Mycobacterium bovis subsp bovis AF2122/97
cuccggcgcgacgccc

SEQ ID NO: 1118303 - RNA, 17 nt, Mycobacterium bovis subsp bovis AF2122/97
cuccggcgccaccgccg

SEQ ID NO: 1118304 - RNA, 20 nt, Mycobacterium bovis subsp bovis AF2122/97
cuccgacucgauauaacccg

SEQ ID NO: 1118305 - RNA, 21 nt, Mycobacterium bovis subsp bovis AF2122/97
cuccgacucgauauaacccgg

SEQ ID NO: 1118306 - RNA, 13 nt, Mycobacterium bovis subsp bovis AF2122/97
cuccgacggcccg

SEQ ID NO: 1118307 - RNA, 17 nt, Mycobacterium bovis subsp bovis AF2122/97
cuccgacggccgcggcg

SEQ ID NO: 1118308 - RNA, 14 nt, Mycobacterium bovis subsp bovis AF2122/97
cuccgacggggguc

SEQ ID NO: 1118309 - RNA, 14 nt, Mycobacterium bovis subsp bovis AF2122/97
cuccgaggccgcca

SEQ ID NO: 1118310 - RNA, 20 nt, Mycobacterium bovis subsp bovis AF2122/97
cuccgauccacauggugacc

SEQ ID NO: 1118311 - RNA, 14 nt, Mycobacterium bovis subsp bovis AF2122/97
cuccgaucgggccc

SEQ ID NO: 1118312 - RNA, 21 nt, Mycobacterium bovis subsp bovis AF2122/97
cuccgcaaucgcgacgggguc

SEQ ID NO: 1118313 - RNA, 19 nt, Mycobacterium bovis subsp bovis AF2122/97
cuccgaaucugccggccgg

SEQ ID NO: 1118314 - RNA, 14 nt, Mycobacterium bovis subsp bovis AF2122/97
cuccgaaaucguca

SEQ ID NO: 1118315 - RNA, 13 nt, Mycobacterium bovis subsp bovis AF2122/97
cucccuuccgcgc

SEQ ID NO: 1118316 - RNA, 14 nt, Mycobacterium bovis subsp bovis AF2122/97
cucccuuccgcgcu

SEQ ID NO: 1118317 - RNA, 18 nt, Mycobacterium bovis subsp bovis AF2122/97
cucccugggcgucgacca

SEQ ID NO: 1118318 - RNA, 16 nt, Mycobacterium bovis subsp bovis AF2122/97
cucccucgaucacggc

SEQ ID NO: 1118319 - RNA, 21 nt, Mycobacterium bovis subsp bovis AF2122/97
cucccucgaucacggcggccc

SEQ ID NO: 1118320 - RNA, 20 nt, Mycobacterium bovis subsp bovis AF2122/97
cuccgccggucaugauccga

SEQ ID NO: 1118321 - RNA, 10 nt, Mycobacterium bovis subsp bovis AF2122/97
cuccgccguc

SEQ ID NO: 1118322 - RNA, 16 nt, Mycobacterium bovis subsp bovis AF2122/97
cuccgccgucgccgcc

SEQ ID NO: 1118323 - RNA, 17 nt, Mycobacterium bovis subsp bovis AF2122/97
cuccgccguugacgccg

SEQ ID NO: 1118324 - RNA, 19 nt, Mycobacterium bovis subsp bovis AF2122/97
cuccgccguugacgccguu

SEQ ID NO: 1118325 - RNA, 12 nt, Mycobacterium bovis subsp bovis AF2122/97
cuccgccgguca

SEQ ID NO: 1118326 - RNA, 15 nt, Mycobacterium bovis subsp bovis AF2122/97
cuccgccguugccgc

SEQ ID NO: 1118327 - RNA, 23 nt, Mycobacterium bovis subsp bovis AF2122/97
cuccgccugccccacccgcggcg

SEQ ID NO: 1118328 - RNA, 14 nt, Mycobacterium bovis subsp bovis AF2122/97
cuccgccugccgcu

SEQ ID NO: 1118329 - RNA, 15 nt, Mycobacterium bovis subsp bovis AF2122/97
cuccgcccgcgggcc

SEQ ID NO: 1118330 - RNA, 16 nt, Mycobacterium bovis subsp bovis AF2122/97
cuccgaugcaucggug

SEQ ID NO: 1118331 - RNA, 14 nt, Mycobacterium bovis subsp bovis AF2122/97
cuccgccgccgacg

SEQ ID NO: 1118332 - RNA, 20 nt, Mycobacterium bovis subsp bovis AF2122/97
cuccgccagaauugccggcg

SEQ ID NO: 1118333 - RNA, 23 nt, Mycobacterium bovis subsp bovis AF2122/97
cuccgccaacaucuccgcgucgg

SEQ ID NO: 1118334 - RNA, 13 nt, Mycobacterium bovis subsp bovis AF2122/97
cuccgccaaccgg

SEQ ID NO: 1118335 - RNA, 14 nt, Mycobacterium bovis subsp bovis AF2122/97
cuccgccaaccggg

SEQ ID NO: 1118336 - RNA, 13 nt, Mycobacterium bovis subsp bovis AF2122/97
cuccgccaccauc

SEQ ID NO: 1118337 - RNA, 16 nt, Mycobacterium bovis subsp bovis AF2122/97
cuccgcagcgaagacc

SEQ ID NO: 1118338 - RNA, 22 nt, Mycobacterium bovis subsp bovis AF2122/97
cuccgcagcgaagaccagcggc

SEQ ID NO: 1118339 - RNA, 12 nt, Mycobacterium bovis subsp bovis AF2122/97
cuccgcagcuau

SEQ ID NO: 1118340 - RNA, 20 nt, Mycobacterium bovis subsp bovis AF2122/97
cucgacggccucgucgaugu

SEQ ID NO: 1118341 - RNA, 17 nt, Mycobacterium bovis subsp bovis AF2122/97
cucgacgcgucgccggc

SEQ ID NO: 1118342 - RNA, 19 nt, Mycobacterium bovis subsp bovis AF2122/97
cucgacgcgucgccggccg

SEQ ID NO: 1118343 - RNA, 13 nt, Mycobacterium bovis subsp bovis AF2122/97
cucgacgcgcauc

SEQ ID NO: 1118344 - RNA, 17 nt, Mycobacterium bovis subsp bovis AF2122/97
cucgacgcgcucgggcg

SEQ ID NO: 1118345 - RNA, 14 nt, Mycobacterium bovis subsp bovis AF2122/97
cucgacgcggcagg

SEQ ID NO: 1118346 - RNA, 22 nt, Mycobacterium bovis subsp bovis AF2122/97
cucgacgagucggcgggcgaca

SEQ ID NO: 1118347 - RNA, 19 nt, Mycobacterium bovis subsp bovis AF2122/97
cucgacgagcacgccgacc

SEQ ID NO: 1118348 - RNA, 14 nt, Mycobacterium bovis subsp bovis AF2122/97
cucgacgcccgccc

SEQ ID NO: 1118349 - RNA, 23 nt, Mycobacterium bovis subsp bovis AF2122/97
cucgacgcccgcccuggcaacga

SEQ ID NO: 1118350 - RNA, 13 nt, Mycobacterium bovis subsp bovis AF2122/97
cucgacggugacg

SEQ ID NO: 1118351 - RNA, 14 nt, Mycobacterium bovis subsp bovis AF2122/97
cucgacggugacga

SEQ ID NO: 1118352 - RNA, 14 nt, Mycobacterium bovis subsp bovis AF2122/97
cucgacggcccgcc

SEQ ID NO: 1118353 - RNA, 15 nt, Mycobacterium bovis subsp bovis AF2122/97
cucgacggucaucgc

SEQ ID NO: 1118354 - RNA, 18 nt, Mycobacterium bovis subsp bovis AF2122/97
cucgacggcgccgcccac

SEQ ID NO: 1118355 - RNA, 19 nt, Mycobacterium bovis subsp bovis AF2122/97
cucgacggcgccgcccacg

SEQ ID NO: 1118356 - RNA, 14 nt, Mycobacterium bovis subsp bovis AF2122/97
cucgacggcggccg

SEQ ID NO: 1118357 - RNA, 16 nt, Mycobacterium bovis subsp bovis AF2122/97
cucgacggcggccgcg

SEQ ID NO: 1118358 - RNA, 14 nt, Mycobacterium bovis subsp bovis AF2122/97
cucgagcaugccca

SEQ ID NO: 1118359 - RNA, 22 nt, Mycobacterium bovis subsp bovis AF2122/97
cucgagcaugcccagcgaaucc

SEQ ID NO: 1118360 - RNA, 12 nt, Mycobacterium bovis subsp bovis AF2122/97
cucgagccgccg

SEQ ID NO: 1118361 - RNA, 17 nt, Mycobacterium bovis subsp bovis AF2122/97
cucgagccgccggaucg

SEQ ID NO: 1118362 - RNA, 17 nt, Mycobacterium bovis subsp bovis AF2122/97
cucgaccugacugguca

SEQ ID NO: 1118363 - RNA, 19 nt, Mycobacterium bovis subsp bovis AF2122/97
cucgaccucgucggccgac

SEQ ID NO: 1118364 - RNA, 16 nt, Mycobacterium bovis subsp bovis AF2122/97
cucgaccguggcggcc

SEQ ID NO: 1118365 - RNA, 24 nt, Mycobacterium bovis subsp bovis AF2122/97
cucgacgaagaucuucaccggccg

SEQ ID NO: 1118366 - RNA, 20 nt, Mycobacterium bovis subsp bovis AF2122/97
cucgacgacgggcgccaacg

SEQ ID NO: 1118367 - RNA, 19 nt, Mycobacterium bovis subsp bovis AF2122/97
cucgaccguauugaccagc

SEQ ID NO: 1118368 - RNA, 21 nt, Mycobacterium bovis subsp bovis AF2122/97
cucgaagaugucgucaccgug

SEQ ID NO: 1118369 - RNA, 17 nt, Mycobacterium bovis subsp bovis AF2122/97
cucgaacuccccggucg

SEQ ID NO: 1118370 - RNA, 22 nt, Mycobacterium bovis subsp bovis AF2122/97
cucgaacuccccggucgccgcg

SEQ ID NO: 1118371 - RNA, 17 nt, Mycobacterium bovis subsp bovis AF2122/97
cucgaacugggucggca

SEQ ID NO: 1118372 - RNA, 21 nt, Mycobacterium bovis subsp bovis AF2122/97
cucgaagaacuggugcuucca

SEQ ID NO: 1118373 - RNA, 19 nt, Mycobacterium bovis subsp bovis AF2122/97
cucgaacgccgcccgcugg

SEQ ID NO: 1118374 - RNA, 20 nt, Mycobacterium bovis subsp bovis AF2122/97
cucgaagcccagcaccacca

SEQ ID NO: 1118375 - RNA, 20 nt, Mycobacterium bovis subsp bovis AF2122/97
cuccuccguuuggcugccga

SEQ ID NO: 1118376 - RNA, 16 nt, Mycobacterium bovis subsp bovis AF2122/97
cuccuccccgaccgcc

SEQ ID NO: 1118377 - RNA, 16 nt, Mycobacterium bovis subsp bovis AF2122/97
cuccuccccggcccgc

SEQ ID NO: 1118378 - RNA, 17 nt, Mycobacterium bovis subsp bovis AF2122/97
cuccucgaccgcggccu

SEQ ID NO: 1118379 - RNA, 17 nt, Mycobacterium bovis subsp bovis AF2122/97
cuccucgacgucggcga

SEQ ID NO: 1118380 - RNA, 14 nt, Mycobacterium bovis subsp bovis AF2122/97
cuccucggccagcg

SEQ ID NO: 1118381 - RNA, 16 nt, Mycobacterium bovis subsp bovis AF2122/97
cuccucgcgggcggcg

SEQ ID NO: 1118382 - RNA, 12 nt, Mycobacterium bovis subsp bovis AF2122/97
cuccucgcuguc

SEQ ID NO: 1118383 - RNA, 21 nt, Mycobacterium bovis subsp bovis AF2122/97
cuccgggaauggcgaccaccc

SEQ ID NO: 1118384 - RNA, 11 nt, Mycobacterium bovis subsp bovis AF2122/97
cuccgggcgca

SEQ ID NO: 1118385 - RNA, 14 nt, Mycobacterium bovis subsp bovis AF2122/97
cuccgggcgcacca

SEQ ID NO: 1118386 - RNA, 21 nt, Mycobacterium bovis subsp bovis AF2122/97
cuccuccaccagugccccgcc

SEQ ID NO: 1118387 - RNA, 13 nt, Mycobacterium bovis subsp bovis AF2122/97
cuccggcucgaca

SEQ ID NO: 1118388 - RNA, 22 nt, Mycobacterium bovis subsp bovis AF2122/97
cuccggcguggcuuguucggac

SEQ ID NO: 1118389 - RNA, 15 nt, Mycobacterium bovis subsp bovis AF2122/97
cuccggcguugacga

SEQ ID NO: 1118390 - RNA, 23 nt, Mycobacterium bovis subsp bovis AF2122/97
cuccgggaugaagcucgaccgcc

SEQ ID NO: 1118391 - RNA, 16 nt, Mycobacterium bovis subsp bovis AF2122/97
cuccuuggcccagcgg

SEQ ID NO: 1118392 - RNA, 18 nt, Mycobacterium bovis subsp bovis AF2122/97
cuccuguggggauuccgc

SEQ ID NO: 1118393 - RNA, 14 nt, Mycobacterium bovis subsp bovis AF2122/97
cuccucggcgaugc

SEQ ID NO: 1118394 - RNA, 12 nt, Mycobacterium bovis subsp bovis AF2122/97
cuccucggcgcg

SEQ ID NO: 1118395 - RNA, 22 nt, Mycobacterium bovis subsp bovis AF2122/97
cucgaacaucggaacgugaccg

SEQ ID NO: 1118396 - RNA, 16 nt, Mycobacterium bovis subsp bovis AF2122/97
cucgaacaaccccggu

SEQ ID NO: 1118397 - RNA, 21 nt, Mycobacterium bovis subsp bovis AF2122/97
cucgaaaccguggccaucgau

SEQ ID NO: 1118398 - RNA, 17 nt, Mycobacterium bovis subsp bovis AF2122/97
cuccuuggcccagcggu

SEQ ID NO: 1118399 - RNA, 21 nt, Mycobacterium bovis subsp bovis AF2122/97
cuccuugggcgacgcggcgcc

SEQ ID NO: 1118400 - RNA, 21 nt, Mycobacterium bovis subsp bovis AF2122/97
cuccuuugcgggacuaggucc

SEQ ID NO: 1118401 - RNA, 20 nt, Mycobacterium bovis subsp bovis AF2122/97
cuagccgcggcaccgccgag

SEQ ID NO: 1118402 - RNA, 22 nt, Mycobacterium bovis subsp bovis AF2122/97
cuagccgcggcaccgccgagca

SEQ ID NO: 1118403 - RNA, 13 nt, Mycobacterium bovis subsp bovis AF2122/97
cuagccgauggcu

SEQ ID NO: 1118404 - RNA, 19 nt, Mycobacterium bovis subsp bovis AF2122/97
cuagcccgguaucgucccg

SEQ ID NO: 1118405 - RNA, 20 nt, Mycobacterium bovis subsp bovis AF2122/97
cuagccaccaggcggucagg

SEQ ID NO: 1118406 - RNA, 15 nt, Mycobacterium bovis subsp bovis AF2122/97
cuagcccggcagcac

SEQ ID NO: 1118407 - RNA, 19 nt, Mycobacterium bovis subsp bovis AF2122/97
cuagcagggugccggcgcc

SEQ ID NO: 1118408 - RNA, 21 nt, Mycobacterium bovis subsp bovis AF2122/97
cuagcagggugccggcgccgc

SEQ ID NO: 1118409 - RNA, 17 nt, Mycobacterium bovis subsp bovis AF2122/97
cuagcccgaccggucca

SEQ ID NO: 1118410 - RNA, 21 nt, Mycobacterium bovis subsp bovis AF2122/97
cuagcccgaccgguccagcca

SEQ ID NO: 1118411 - RNA, 14 nt, Mycobacterium bovis subsp bovis AF2122/97
cuagcccggcagca

SEQ ID NO: 1118412 - RNA, 13 nt, Mycobacterium bovis subsp bovis AF2122/97
cuagcgagcggca

SEQ ID NO: 1118413 - RNA, 23 nt, Mycobacterium bovis subsp bovis AF2122/97
cuagccguucggcugccgcgcgc

SEQ ID NO: 1118414 - RNA, 16 nt, Mycobacterium bovis subsp bovis AF2122/97
cuagccgggcgcgccg

SEQ ID NO: 1118415 - RNA, 23 nt, Mycobacterium bovis subsp bovis AF2122/97
cuagccggguguuggggaucgca

SEQ ID NO: 1118416 - RNA, 16 nt, Mycobacterium bovis subsp bovis AF2122/97
cuagcggcucaccgcg

SEQ ID NO: 1118417 - RNA, 17 nt, Mycobacterium bovis subsp bovis AF2122/97
cuagcggcucaccgcgc

SEQ ID NO: 1118418 - RNA, 14 nt, Mycobacterium bovis subsp bovis AF2122/97
cuagcgccucgccg

SEQ ID NO: 1118419 - RNA, 18 nt, Mycobacterium bovis subsp bovis AF2122/97
cuagcgcuauaggccgca

SEQ ID NO: 1118420 - RNA, 17 nt, Mycobacterium bovis subsp bovis AF2122/97
cuaucagugagccgcca

SEQ ID NO: 1118421 - RNA, 19 nt, Mycobacterium bovis subsp bovis AF2122/97
cuaucagacgauucggcgg

SEQ ID NO: 1118422 - RNA, 21 nt, Mycobacterium bovis subsp bovis AF2122/97
cuaucagacgauucggcggcc

SEQ ID NO: 1118423 - RNA, 17 nt, Mycobacterium bovis subsp bovis AF2122/97
cuaucuccaugcucgag

SEQ ID NO: 1118424 - RNA, 18 nt, Mycobacterium bovis subsp bovis AF2122/97
cucaaccucuggcggcgg

SEQ ID NO: 1118425 - RNA, 20 nt, Mycobacterium bovis subsp bovis AF2122/97
cucaaccagcagacgccgua

SEQ ID NO: 1118426 - RNA, 12 nt, Mycobacterium bovis subsp bovis AF2122/97
cucaaccccguc

SEQ ID NO: 1118427 - RNA, 15 nt, Mycobacterium bovis subsp bovis AF2122/97
cucaaccccguccuc

SEQ ID NO: 1118428 - RNA, 16 nt, Mycobacterium bovis subsp bovis AF2122/97
cucaacaccaggccgu

SEQ ID NO: 1118429 - RNA, 16 nt, Mycobacterium bovis subsp bovis AF2122/97
cucaacacccggccga

SEQ ID NO: 1118430 - RNA, 17 nt, Mycobacterium bovis subsp bovis AF2122/97
cucaacaaucggugguc

SEQ ID NO: 1118431 - RNA, 14 nt, Mycobacterium bovis subsp bovis AF2122/97
cuauggcccgggcc

SEQ ID NO: 1118432 - RNA, 17 nt, Mycobacterium bovis subsp bovis AF2122/97
cuauggcgccgcggcug

SEQ ID NO: 1118433 - RNA, 18 nt, Mycobacterium bovis subsp bovis AF2122/97
cuaugcuggcgcagcgcc

SEQ ID NO: 1118434 - RNA, 19 nt, Mycobacterium bovis subsp bovis AF2122/97
cuaugcuggcgcagcgcca

SEQ ID NO: 1118435 - RNA, 22 nt, Mycobacterium bovis subsp bovis AF2122/97
cuaugccaacgacaggcgccca

SEQ ID NO: 1118436 - RNA, 16 nt, Mycobacterium bovis subsp bovis AF2122/97
cucaaggcuucggcgg

SEQ ID NO: 1118437 - RNA, 13 nt, Mycobacterium bovis subsp bovis AF2122/97
cucaaggcuucgg

SEQ ID NO: 1118438 - RNA, 17 nt, Mycobacterium bovis subsp bovis AF2122/97
cucaagauaacggcgac

SEQ ID NO: 1118439 - RNA, 19 nt, Mycobacterium bovis subsp bovis AF2122/97
cucaagcgcgucgucacga

SEQ ID NO: 1118440 - RNA, 16 nt, Mycobacterium bovis subsp bovis AF2122/97
cucaacggcgacaucg

SEQ ID NO: 1118441 - RNA, 16 nt, Mycobacterium bovis subsp bovis AF2122/97
cucaacgaucgcgccg

SEQ ID NO: 1118442 - RNA, 20 nt, Mycobacterium bovis subsp bovis AF2122/97
cucaacgaucgcgccgucgu

SEQ ID NO: 1118443 - RNA, 22 nt, Mycobacterium bovis subsp bovis AF2122/97
cguugagguucuucugcgccac

SEQ ID NO: 1118444 - RNA, 21 nt, Mycobacterium bovis subsp bovis AF2122/97
cguugagguucuucugcgcca

SEQ ID NO: 1118445 - RNA, 20 nt, Mycobacterium bovis subsp bovis AF2122/97
cuacacccguagaccuucga

SEQ ID NO: 1118446 - RNA, 14 nt, Mycobacterium bovis subsp bovis AF2122/97
cuacaccggcaagc

SEQ ID NO: 1118447 - RNA, 21 nt, Mycobacterium bovis subsp bovis AF2122/97
cuacaugggggcguuggcggg

SEQ ID NO: 1118448 - RNA, 14 nt, Mycobacterium bovis subsp bovis AF2122/97
cuacaucgaucaga

SEQ ID NO: 1118449 - RNA, 20 nt, Mycobacterium bovis subsp bovis AF2122/97
cuacaucgucgagcgcggug

SEQ ID NO: 1118450 - RNA, 17 nt, Mycobacterium bovis subsp bovis AF2122/97
cuaccaacaccgcccgc

SEQ ID NO: 1118451 - RNA, 17 nt, Mycobacterium bovis subsp bovis AF2122/97
cuacccggacagggcgg

SEQ ID NO: 1118452 - RNA, 13 nt, Mycobacterium bovis subsp bovis AF2122/97
cguugaggccggu

SEQ ID NO: 1118453 - RNA, 20 nt, Mycobacterium bovis subsp bovis AF2122/97
cguugagauaccccgagacc

SEQ ID NO: 1118454 - RNA, 23 nt, Mycobacterium bovis subsp bovis AF2122/97
cguugagcaagugggugccggca

SEQ ID NO: 1118455 - RNA, 15 nt, Mycobacterium bovis subsp bovis AF2122/97
cguugagcagcaccc

SEQ ID NO: 1118456 - RNA, 22 nt, Mycobacterium bovis subsp bovis AF2122/97
cguugaacgcacucaucgccgg

SEQ ID NO: 1118457 - RNA, 15 nt, Mycobacterium bovis subsp bovis AF2122/97
cguugaacugugcgg

SEQ ID NO: 1118458 - RNA, 17 nt, Mycobacterium bovis subsp bovis AF2122/97
cguugaacugugcggca

SEQ ID NO: 1118459 - RNA, 18 nt, Mycobacterium bovis subsp bovis AF2122/97
cguugaagaauccggccc

SEQ ID NO: 1118460 - RNA, 18 nt, Mycobacterium bovis subsp bovis AF2122/97
cguugacgucgagcagcg

SEQ ID NO: 1118461 - RNA, 18 nt, Mycobacterium bovis subsp bovis AF2122/97
cguugacgucggucaucg

SEQ ID NO: 1118462 - RNA, 17 nt, Mycobacterium bovis subsp bovis AF2122/97
cguucuggaaccccgag

SEQ ID NO: 1118463 - RNA, 19 nt, Mycobacterium bovis subsp bovis AF2122/97
cguucugucccggcgcgcc

SEQ ID NO: 1118464 - RNA, 20 nt, Mycobacterium bovis subsp bovis AF2122/97
cguucugucccggcgcgcca

SEQ ID NO: 1118465 - RNA, 17 nt, Mycobacterium bovis subsp bovis AF2122/97
cguucuugggaccgacu

SEQ ID NO: 1118466 - RNA, 17 nt, Mycobacterium bovis subsp bovis AF2122/97
cuaccgagaucaccgcc

SEQ ID NO: 1118467 - RNA, 21 nt, Mycobacterium bovis subsp bovis AF2122/97
cuaccgagaucaccgccacca

SEQ ID NO: 1118468 - RNA, 22 nt, Mycobacterium bovis subsp bovis AF2122/97
cuaccgagaucaccgccaccac

SEQ ID NO: 1118469 - RNA, 18 nt, Mycobacterium bovis subsp bovis AF2122/97
cuaccgccggcggcggcc

SEQ ID NO: 1118470 - RNA, 22 nt, Mycobacterium bovis subsp bovis AF2122/97
cuaccgccggcggcggccgcag

SEQ ID NO: 1118471 - RNA, 12 nt, Mycobacterium bovis subsp bovis AF2122/97
cuaccgccgggg

SEQ ID NO: 1118472 - RNA, 15 nt, Mycobacterium bovis subsp bovis AF2122/97
cuaccgccuugucgg

SEQ ID NO: 1118473 - RNA, 19 nt, Mycobacterium bovis subsp bovis AF2122/97
cuaccgccuuugcccgccg

SEQ ID NO: 1118474 - RNA, 21 nt, Mycobacterium bovis subsp bovis AF2122/97
cuaccgcuucccccgguccgg

SEQ ID NO: 1118475 - RNA, 21 nt, Mycobacterium bovis subsp bovis AF2122/97
cuacguuggccgagcagggcc

SEQ ID NO: 1118476 - RNA, 15 nt, Mycobacterium bovis subsp bovis AF2122/97
cuaccggcgccgcgc

SEQ ID NO: 1118477 - RNA, 16 nt, Mycobacterium bovis subsp bovis AF2122/97
cuaccggcgccgcgcg

SEQ ID NO: 1118478 - RNA, 17 nt, Mycobacterium bovis subsp bovis AF2122/97
cuaccggcgccgcgcgg

SEQ ID NO: 1118479 - RNA, 20 nt, Mycobacterium bovis subsp bovis AF2122/97
cuaccggccuuuccagcacc

SEQ ID NO: 1118480 - RNA, 13 nt, Mycobacterium bovis subsp bovis AF2122/97
cuagaccgggcgg

SEQ ID NO: 1118481 - RNA, 19 nt, Mycobacterium bovis subsp bovis AF2122/97
cuagacgccgccgcugccg

SEQ ID NO: 1118482 - RNA, 20 nt, Mycobacterium bovis subsp bovis AF2122/97
cuagacgccgccgcugccgc

SEQ ID NO: 1118483 - RNA, 23 nt, Mycobacterium bovis subsp bovis AF2122/97
cuagaacagacggggucgcccgg

SEQ ID NO: 1118484 - RNA, 22 nt, Mycobacterium bovis subsp bovis AF2122/97
cuagaggcggcccccggcagcg

SEQ ID NO: 1118485 - RNA, 14 nt, Mycobacterium bovis subsp bovis AF2122/97
cuacucccccgcga

SEQ ID NO: 1118486 - RNA, 15 nt, Mycobacterium bovis subsp bovis AF2122/97
cuacucgaacaaccc

SEQ ID NO: 1118487 - RNA, 17 nt, Mycobacterium bovis subsp bovis AF2122/97
cuacucuguuuuuggug

SEQ ID NO: 1118488 - RNA, 14 nt, Mycobacterium bovis subsp bovis AF2122/97
cuacugggugggua

SEQ ID NO: 1118489 - RNA, 14 nt, Mycobacterium bovis subsp bovis AF2122/97
cuacuuccucgacg

SEQ ID NO: 1118490 - RNA, 17 nt, Mycobacterium bovis subsp bovis AF2122/97
cucaucgaccgcggccg

SEQ ID NO: 1118491 - RNA, 20 nt, Mycobacterium bovis subsp bovis AF2122/97
cucaucgcagacggcugcca

SEQ ID NO: 1118492 - RNA, 15 nt, Mycobacterium bovis subsp bovis AF2122/97
cucaucgcgcccgcc

SEQ ID NO: 1118493 - RNA, 12 nt, Mycobacterium bovis subsp bovis AF2122/97
cucaucgcggcg

SEQ ID NO: 1118494 - RNA, 14 nt, Mycobacterium bovis subsp bovis AF2122/97
cucaucgcggcgaa

SEQ ID NO: 1118495 - RNA, 14 nt, Mycobacterium bovis subsp bovis AF2122/97
cucaucgcggucgc

SEQ ID NO: 1118496 - RNA, 15 nt, Mycobacterium bovis subsp bovis AF2122/97
cucauccgccgggcc

SEQ ID NO: 1118497 - RNA, 17 nt, Mycobacterium bovis subsp bovis AF2122/97
cucauccuccugcgccg

SEQ ID NO: 1118498 - RNA, 23 nt, Mycobacterium bovis subsp bovis AF2122/97
cucaucggccgcggucggccacc

SEQ ID NO: 1118499 - RNA, 16 nt, Mycobacterium bovis subsp bovis AF2122/97
cucaugccgagcgacc

SEQ ID NO: 1118500 - RNA, 18 nt, Mycobacterium bovis subsp bovis AF2122/97
cucaugccgagcgaccgu

SEQ ID NO: 1118501 - RNA, 18 nt, Mycobacterium bovis subsp bovis AF2122/97
cucagcgcggccacgccg

SEQ ID NO: 1118502 - RNA, 13 nt, Mycobacterium bovis subsp bovis AF2122/97
cucagcgcggccc

SEQ ID NO: 1118503 - RNA, 19 nt, Mycobacterium bovis subsp bovis AF2122/97
cucagcggcgaccgcaucc

SEQ ID NO: 1118504 - RNA, 23 nt, Mycobacterium bovis subsp bovis AF2122/97
cucagguacggcgggcggccgcu

SEQ ID NO: 1118505 - RNA, 14 nt, Mycobacterium bovis subsp bovis AF2122/97
cucaggucaccggc

SEQ ID NO: 1118506 - RNA, 18 nt, Mycobacterium bovis subsp bovis AF2122/97
cucaggucaucggcggcg

SEQ ID NO: 1118507 - RNA, 15 nt, Mycobacterium bovis subsp bovis AF2122/97
cucaguucacguucg

SEQ ID NO: 1118508 - RNA, 16 nt, Mycobacterium bovis subsp bovis AF2122/97
cucaguguacaccgcg

SEQ ID NO: 1118509 - RNA, 17 nt, Mycobacterium bovis subsp bovis AF2122/97
cucaguguacaccgcgc

SEQ ID NO: 1118510 - RNA, 19 nt, Mycobacterium bovis subsp bovis AF2122/97
cucaguguacaccgcgccc

SEQ ID NO: 1118511 - RNA, 18 nt, Mycobacterium bovis subsp bovis AF2122/97
cucaguguuccgccaccc

SEQ ID NO: 1118512 - RNA, 16 nt, Mycobacterium bovis subsp bovis AF2122/97
cucagcgaugcggccc

SEQ ID NO: 1118513 - RNA, 12 nt, Mycobacterium bovis subsp bovis AF2122/97
cucagccguccg

SEQ ID NO: 1118514 - RNA, 13 nt, Mycobacterium bovis subsp bovis AF2122/97
cucagccguccgg

SEQ ID NO: 1118515 - RNA, 16 nt, Mycobacterium bovis subsp bovis AF2122/97
cucacgugcccgcgcg

SEQ ID NO: 1118516 - RNA, 17 nt, Mycobacterium bovis subsp bovis AF2122/97
cucacgugcccgcgcgg

SEQ ID NO: 1118517 - RNA, 21 nt, Mycobacterium bovis subsp bovis AF2122/97
cucacgugcccgcgcggcgca

SEQ ID NO: 1118518 - RNA, 14 nt, Mycobacterium bovis subsp bovis AF2122/97
cucacugcagcgcc

SEQ ID NO: 1118519 - RNA, 12 nt, Mycobacterium bovis subsp bovis AF2122/97
cucacugcggcg

SEQ ID NO: 1118520 - RNA, 21 nt, Mycobacterium bovis subsp bovis AF2122/97
cucacgucuaacacgcggucc

SEQ ID NO: 1118521 - RNA, 17 nt, Mycobacterium bovis subsp bovis AF2122/97
cucacguggacugaccu

SEQ ID NO: 1118522 - RNA, 18 nt, Mycobacterium bovis subsp bovis AF2122/97
cucacgggcgaucgugcg

SEQ ID NO: 1118523 - RNA, 21 nt, Mycobacterium bovis subsp bovis AF2122/97
cucacggauucgggcgaagcu

SEQ ID NO: 1118524 - RNA, 17 nt, Mycobacterium bovis subsp bovis AF2122/97
cucacggcauccgcuca

SEQ ID NO: 1118525 - RNA, 22 nt, Mycobacterium bovis subsp bovis AF2122/97
cucaccacgaggcuugcggcac

SEQ ID NO: 1118526 - RNA, 16 nt, Mycobacterium bovis subsp bovis AF2122/97
cucaccacgucgaccg

SEQ ID NO: 1118527 - RNA, 23 nt, Mycobacterium bovis subsp bovis AF2122/97
cucaccaaucugcgggccgguga

SEQ ID NO: 1118528 - RNA, 16 nt, Mycobacterium bovis subsp bovis AF2122/97
cucaccagcggucagc

SEQ ID NO: 1118529 - RNA, 21 nt, Mycobacterium bovis subsp bovis AF2122/97
cucaccagcggucagccggcc

SEQ ID NO: 1118530 - RNA, 17 nt, Mycobacterium bovis subsp bovis AF2122/97
cucacaugcccggacga

SEQ ID NO: 1118531 - RNA, 14 nt, Mycobacterium bovis subsp bovis AF2122/97
cucacagcacagcg

SEQ ID NO: 1118532 - RNA, 23 nt, Mycobacterium bovis subsp bovis AF2122/97
cucacagcacagcgcagccugca

SEQ ID NO: 1118533 - RNA, 16 nt, Mycobacterium bovis subsp bovis AF2122/97
cucaauuggcucggcg

SEQ ID NO: 1118534 - RNA, 18 nt, Mycobacterium bovis subsp bovis AF2122/97
cucccaccagcggcggcc

SEQ ID NO: 1118535 - RNA, 23 nt, Mycobacterium bovis subsp bovis AF2122/97
cucccagcacgguggcuucgacg

SEQ ID NO: 1118536 - RNA, 14 nt, Mycobacterium bovis subsp bovis AF2122/97
cucccagccaaccc

SEQ ID NO: 1118537 - RNA, 22 nt, Mycobacterium bovis subsp bovis AF2122/97
cucccggauauugccaucccuc

SEQ ID NO: 1118538 - RNA, 21 nt, Mycobacterium bovis subsp bovis AF2122/97
cucccgggugcgacgcgaccg

SEQ ID NO: 1118539 - RNA, 22 nt, Mycobacterium bovis subsp bovis AF2122/97
cucccgggugcgacgcgaccgc

SEQ ID NO: 1118540 - RNA, 12 nt, Mycobacterium bovis subsp bovis AF2122/97
cucccggccgca

SEQ ID NO: 1118541 - RNA, 13 nt, Mycobacterium bovis subsp bovis AF2122/97
cucccggccgcac

SEQ ID NO: 1118542 - RNA, 23 nt, Mycobacterium bovis subsp bovis AF2122/97
cucccgguugggguggcggugcc

SEQ ID NO: 1118543 - RNA, 13 nt, Mycobacterium bovis subsp bovis AF2122/97
cucccguacgccg

SEQ ID NO: 1118544 - RNA, 22 nt, Mycobacterium bovis subsp bovis AF2122/97
cucccuacgagcccacgcgcca

SEQ ID NO: 1118545 - RNA, 21 nt, Mycobacterium bovis subsp bovis AF2122/97
cuccagcugcgcgggcgagua

SEQ ID NO: 1118546 - RNA, 22 nt, Mycobacterium bovis subsp bovis AF2122/97
cuccagcugggugaccucgucg

SEQ ID NO: 1118547 - RNA, 14 nt, Mycobacterium bovis subsp bovis AF2122/97
cuccaggaucgccg

SEQ ID NO: 1118548 - RNA, 18 nt, Mycobacterium bovis subsp bovis AF2122/97
cuccaggccuaguccggc

SEQ ID NO: 1118549 - RNA, 20 nt, Mycobacterium bovis subsp bovis AF2122/97
cuccaggccuaguccggcac

SEQ ID NO: 1118550 - RNA, 18 nt, Mycobacterium bovis subsp bovis AF2122/97
cuccaggcgcgccgcacc

SEQ ID NO: 1118551 - RNA, 13 nt, Mycobacterium bovis subsp bovis AF2122/97
cuccaggucgaca

SEQ ID NO: 1118552 - RNA, 21 nt, Mycobacterium bovis subsp bovis AF2122/97
cuccagggcccugcuggccca

SEQ ID NO: 1118553 - RNA, 16 nt, Mycobacterium bovis subsp bovis AF2122/97
cuccagcugggugacc

SEQ ID NO: 1118554 - RNA, 13 nt, Mycobacterium bovis subsp bovis AF2122/97
cuccagcucggcc

SEQ ID NO: 1118555 - RNA, 15 nt, Mycobacterium bovis subsp bovis AF2122/97
cuccagcucggcggg

SEQ ID NO: 1118556 - RNA, 14 nt, Mycobacterium bovis subsp bovis AF2122/97
cuccagcgaaccga

SEQ ID NO: 1118557 - RNA, 22 nt, Mycobacterium bovis subsp bovis AF2122/97
cuccagcgaaccgacccggccg

SEQ ID NO: 1118558 - RNA, 13 nt, Mycobacterium bovis subsp bovis AF2122/97
cuccagccgcgcg

SEQ ID NO: 1118559 - RNA, 16 nt, Mycobacterium bovis subsp bovis AF2122/97
cuccagcgcccgguca

SEQ ID NO: 1118560 - RNA, 17 nt, Mycobacterium bovis subsp bovis AF2122/97
cuccagcagcucgccgg

SEQ ID NO: 1118561 - RNA, 19 nt, Mycobacterium bovis subsp bovis AF2122/97
cuccagcagcucgccggca

SEQ ID NO: 1118562 - RNA, 21 nt, Mycobacterium bovis subsp bovis AF2122/97
cuccagcagcucgccggcacg

SEQ ID NO: 1118563 - RNA, 17 nt, Mycobacterium bovis subsp bovis AF2122/97
cuccagcagcccggugg

SEQ ID NO: 1118564 - RNA, 22 nt, Mycobacterium bovis subsp bovis AF2122/97
cuccagcacccggucgauucgg

SEQ ID NO: 1118565 - RNA, 16 nt, Mycobacterium bovis subsp bovis AF2122/97
cuccagcagcgacggu

SEQ ID NO: 1118566 - RNA, 20 nt, Mycobacterium bovis subsp bovis AF2122/97
cuccagcagguccgcggccg

SEQ ID NO: 1118567 - RNA, 18 nt, Mycobacterium bovis subsp bovis AF2122/97
cuccagcaugggcgagaa

SEQ ID NO: 1118568 - RNA, 14 nt, Mycobacterium bovis subsp bovis AF2122/97
cucaugggcgccau

SEQ ID NO: 1118569 - RNA, 16 nt, Mycobacterium bovis subsp bovis AF2122/97
cagcgcagcagcggca

SEQ ID NO: 1118570 - RNA, 17 nt, Mycobacterium bovis subsp bovis AF2122/97
cagcgcagccaggcugc

SEQ ID NO: 1118571 - RNA, 17 nt, Mycobacterium bovis subsp bovis AF2122/97
cagcgcaucggccagca

SEQ ID NO: 1118572 - RNA, 21 nt, Mycobacterium bovis subsp bovis AF2122/97
cagcgccaagacgucggcgug

SEQ ID NO: 1118573 - RNA, 21 nt, Mycobacterium bovis subsp bovis AF2122/97
cagcgccacauacaccggccg

SEQ ID NO: 1118574 - RNA, 22 nt, Mycobacterium bovis subsp bovis AF2122/97
cagcgccacauacaccggccgg

SEQ ID NO: 1118575 - RNA, 23 nt, Mycobacterium bovis subsp bovis AF2122/97
cagcgccacauacaccggccggu

SEQ ID NO: 1118576 - RNA, 18 nt, Mycobacterium bovis subsp bovis AF2122/97
cagcgccaagacgucggc

SEQ ID NO: 1118577 - RNA, 12 nt, Mycobacterium bovis subsp bovis AF2122/97
cagcgccagcgg

SEQ ID NO: 1118578 - RNA, 16 nt, Mycobacterium bovis subsp bovis AF2122/97
cagcgccagcgccugc

SEQ ID NO: 1118579 - RNA, 15 nt, Mycobacterium bovis subsp bovis AF2122/97
cagcgccagcgagca

SEQ ID NO: 1118580 - RNA, 21 nt, Mycobacterium bovis subsp bovis AF2122/97
cagcgccacccgaucgggcgu

SEQ ID NO: 1118581 - RNA, 23 nt, Mycobacterium bovis subsp bovis AF2122/97
cagcgccaccguuaccgccguuu

SEQ ID NO: 1118582 - RNA, 18 nt, Mycobacterium bovis subsp bovis AF2122/97
cagcgccacccgguccgg

SEQ ID NO: 1118583 - RNA, 20 nt, Mycobacterium bovis subsp bovis AF2122/97
cagcgccacccgguccggcc

SEQ ID NO: 1118584 - RNA, 13 nt, Mycobacterium bovis subsp bovis AF2122/97
cagcgcccgccgg

SEQ ID NO: 1118585 - RNA, 15 nt, Mycobacterium bovis subsp bovis AF2122/97
cagcgcccggccacu

SEQ ID NO: 1118586 - RNA, 14 nt, Mycobacterium bovis subsp bovis AF2122/97
cagcgcccggcccg

SEQ ID NO: 1118587 - RNA, 16 nt, Mycobacterium bovis subsp bovis AF2122/97
cagcgcccggcccgcc

SEQ ID NO: 1118588 - RNA, 21 nt, Mycobacterium bovis subsp bovis AF2122/97
cagcgcccggauguccgccga

SEQ ID NO: 1118589 - RNA, 23 nt, Mycobacterium bovis subsp bovis AF2122/97
cagcgcccggauguccgccgacg

SEQ ID NO: 1118590 - RNA, 17 nt, Mycobacterium bovis subsp bovis AF2122/97
cagcgccgagagcaccg

SEQ ID NO: 1118591 - RNA, 16 nt, Mycobacterium bovis subsp bovis AF2122/97
cagcgccgauaccagc

SEQ ID NO: 1118592 - RNA, 17 nt, Mycobacterium bovis subsp bovis AF2122/97
cagcgccgcacccgcuc

SEQ ID NO: 1118593 - RNA, 19 nt, Mycobacterium bovis subsp bovis AF2122/97
cagcgcccuuggacgcgau

SEQ ID NO: 1118594 - RNA, 21 nt, Mycobacterium bovis subsp bovis AF2122/97
cagcgccgaauucauccgggc

SEQ ID NO: 1118595 - RNA, 18 nt, Mycobacterium bovis subsp bovis AF2122/97
cagcgccgacuccaguuc

SEQ ID NO: 1118596 - RNA, 12 nt, Mycobacterium bovis subsp bovis AF2122/97
cagcgccgaccu

SEQ ID NO: 1118597 - RNA, 11 nt, Mycobacterium bovis subsp bovis AF2122/97
cagcgccgacc

SEQ ID NO: 1118598 - RNA, 21 nt, Mycobacterium bovis subsp bovis AF2122/97
cagcgccgacccaacccgauc

SEQ ID NO: 1118599 - RNA, 16 nt, Mycobacterium bovis subsp bovis AF2122/97
cagcgccaggccguug

SEQ ID NO: 1118600 - RNA, 23 nt, Mycobacterium bovis subsp bovis AF2122/97
cagcgccauauugauuccgaccc

SEQ ID NO: 1118601 - RNA, 21 nt, Mycobacterium bovis subsp bovis AF2122/97
cagcgcccagaucgccgagau

SEQ ID NO: 1118602 - RNA, 22 nt, Mycobacterium bovis subsp bovis AF2122/97
cagcgccccaugcaacacaccg

SEQ ID NO: 1118603 - RNA, 21 nt, Mycobacterium bovis subsp bovis AF2122/97
cagcgcccccagcagcugcga

SEQ ID NO: 1118604 - RNA, 19 nt, Mycobacterium bovis subsp bovis AF2122/97
cagcgccccgcgguccugg

SEQ ID NO: 1118605 - RNA, 15 nt, Mycobacterium bovis subsp bovis AF2122/97
cagcgccccggcgcg

SEQ ID NO: 1118606 - RNA, 22 nt, Mycobacterium bovis subsp bovis AF2122/97
cagcgccauuccaagacguugc

SEQ ID NO: 1118607 - RNA, 21 nt, Mycobacterium bovis subsp bovis AF2122/97
cagcgccaugcccucggcgcc

SEQ ID NO: 1118608 - RNA, 16 nt, Mycobacterium bovis subsp bovis AF2122/97
cagcgccaucgaugcg

SEQ ID NO: 1118609 - RNA, 13 nt, Mycobacterium bovis subsp bovis AF2122/97
cagcgccuugacg

SEQ ID NO: 1118610 - RNA, 17 nt, Mycobacterium bovis subsp bovis AF2122/97
cagcgccuugaccagca

SEQ ID NO: 1118611 - RNA, 18 nt, Mycobacterium bovis subsp bovis AF2122/97
cagcgccuuguggcacac

SEQ ID NO: 1118612 - RNA, 23 nt, Mycobacterium bovis subsp bovis AF2122/97
cagcgccuuguggcacacccgca

SEQ ID NO: 1118613 - RNA, 19 nt, Mycobacterium bovis subsp bovis AF2122/97
cagcgccuuguuggcgaag

SEQ ID NO: 1118614 - RNA, 21 nt, Mycobacterium bovis subsp bovis AF2122/97
cagcgcgaacaccaugaucag

SEQ ID NO: 1118615 - RNA, 16 nt, Mycobacterium bovis subsp bovis AF2122/97
cagcgcgacgguuugc

SEQ ID NO: 1118616 - RNA, 17 nt, Mycobacterium bovis subsp bovis AF2122/97
cagcgcgacguccacca

SEQ ID NO: 1118617 - RNA, 16 nt, Mycobacterium bovis subsp bovis AF2122/97
cagcgcgaccgucagg

SEQ ID NO: 1118618 - RNA, 21 nt, Mycobacterium bovis subsp bovis AF2122/97
cagcgcgacguccaccagccg

SEQ ID NO: 1118619 - RNA, 16 nt, Mycobacterium bovis subsp bovis AF2122/97
cagcgccuccucgauc

SEQ ID NO: 1118620 - RNA, 19 nt, Mycobacterium bovis subsp bovis AF2122/97
cagcgccuccagcaccacg

SEQ ID NO: 1118621 - RNA, 13 nt, Mycobacterium bovis subsp bovis AF2122/97
cagcgccggccag

SEQ ID NO: 1118622 - RNA, 21 nt, Mycobacterium bovis subsp bovis AF2122/97
cagcgccuccacucuucgggc

SEQ ID NO: 1118623 - RNA, 14 nt, Mycobacterium bovis subsp bovis AF2122/97
cagcgccuccagca

SEQ ID NO: 1118624 - RNA, 16 nt, Mycobacterium bovis subsp bovis AF2122/97
cagcgccuccagcacc

SEQ ID NO: 1118625 - RNA, 15 nt, Mycobacterium bovis subsp bovis AF2122/97
cagcgccucgauggu

SEQ ID NO: 1118626 - RNA, 13 nt, Mycobacterium bovis subsp bovis AF2122/97
cagcgccucgacc

SEQ ID NO: 1118627 - RNA, 17 nt, Mycobacterium bovis subsp bovis AF2122/97
cagcgccucggcaucgc

SEQ ID NO: 1118628 - RNA, 20 nt, Mycobacterium bovis subsp bovis AF2122/97
cagcgccucggcaucgccgc

SEQ ID NO: 1118629 - RNA, 22 nt, Mycobacterium bovis subsp bovis AF2122/97
cagcgccucggcaucgccgcgg

SEQ ID NO: 1118630 - RNA, 17 nt, Mycobacterium bovis subsp bovis AF2122/97
cagcgccuccagcacca

SEQ ID NO: 1118631 - RNA, 13 nt, Mycobacterium bovis subsp bovis AF2122/97
cagcgccugcggc

SEQ ID NO: 1118632 - RNA, 14 nt, Mycobacterium bovis subsp bovis AF2122/97
cagcgccgccaccc

SEQ ID NO: 1118633 - RNA, 16 nt, Mycobacterium bovis subsp bovis AF2122/97
cagcgccgccaccccg

SEQ ID NO: 1118634 - RNA, 13 nt, Mycobacterium bovis subsp bovis AF2122/97
cagcgccgccgcg

SEQ ID NO: 1118635 - RNA, 14 nt, Mycobacterium bovis subsp bovis AF2122/97
cagcgccgccgcgu

SEQ ID NO: 1118636 - RNA, 12 nt, Mycobacterium bovis subsp bovis AF2122/97
cagcgccgccgg

SEQ ID NO: 1118637 - RNA, 13 nt, Mycobacterium bovis subsp bovis AF2122/97
cagcgccgcgcgc

SEQ ID NO: 1118638 - RNA, 14 nt, Mycobacterium bovis subsp bovis AF2122/97
cagcgccgucaucg

SEQ ID NO: 1118639 - RNA, 22 nt, Mycobacterium bovis subsp bovis AF2122/97
cagcgccgcugacuccugcggc

SEQ ID NO: 1118640 - RNA, 16 nt, Mycobacterium bovis subsp bovis AF2122/97
cagcgccgcguggcug

SEQ ID NO: 1118641 - RNA, 14 nt, Mycobacterium bovis subsp bovis AF2122/97
cagcgccgcguuca

SEQ ID NO: 1118642 - RNA, 16 nt, Mycobacterium bovis subsp bovis AF2122/97
cagccuuuccggccgc

SEQ ID NO: 1118643 - RNA, 17 nt, Mycobacterium bovis subsp bovis AF2122/97
cagccuuuccggccgcc

SEQ ID NO: 1118644 - RNA, 21 nt, Mycobacterium bovis subsp bovis AF2122/97
cagccuuggacgugcgcgcca

SEQ ID NO: 1118645 - RNA, 19 nt, Mycobacterium bovis subsp bovis AF2122/97
cagcgaaacaccggccagc

SEQ ID NO: 1118646 - RNA, 18 nt, Mycobacterium bovis subsp bovis AF2122/97
cagcgaaacaccggccag

SEQ ID NO: 1118647 - RNA, 14 nt, Mycobacterium bovis subsp bovis AF2122/97
cagccugugcugcc

SEQ ID NO: 1118648 - RNA, 18 nt, Mycobacterium bovis subsp bovis AF2122/97
cagccuaccggcuacggc

SEQ ID NO: 1118649 - RNA, 17 nt, Mycobacterium bovis subsp bovis AF2122/97
cagccguuugaggucua

SEQ ID NO: 1118650 - RNA, 15 nt, Mycobacterium bovis subsp bovis AF2122/97
cagccguucgucgcg

SEQ ID NO: 1118651 - RNA, 19 nt, Mycobacterium bovis subsp bovis AF2122/97
cagccguggcagucgcacg

SEQ ID NO: 1118652 - RNA, 13 nt, Mycobacterium bovis subsp bovis AF2122/97
cagccguggcggc

SEQ ID NO: 1118653 - RNA, 21 nt, Mycobacterium bovis subsp bovis AF2122/97
cagccguagcugggcaccccg

SEQ ID NO: 1118654 - RNA, 18 nt, Mycobacterium bovis subsp bovis AF2122/97
cagccggugacguggugg

SEQ ID NO: 1118655 - RNA, 19 nt, Mycobacterium bovis subsp bovis AF2122/97
cagccgguuggcugccggc

SEQ ID NO: 1118656 - RNA, 15 nt, Mycobacterium bovis subsp bovis AF2122/97
cagccggugccgccg

SEQ ID NO: 1118657 - RNA, 16 nt, Mycobacterium bovis subsp bovis AF2122/97
cagccggugccgccgu

SEQ ID NO: 1118658 - RNA, 19 nt, Mycobacterium bovis subsp bovis AF2122/97
cagccggucgaugccgaug

SEQ ID NO: 1118659 - RNA, 17 nt, Mycobacterium bovis subsp bovis AF2122/97
cagccggucgucgcgca

SEQ ID NO: 1118660 - RNA, 21 nt, Mycobacterium bovis subsp bovis AF2122/97
cagccgguggucugcgcggug

SEQ ID NO: 1118661 - RNA, 14 nt, Mycobacterium bovis subsp bovis AF2122/97
cagccggucgucgc

SEQ ID NO: 1118662 - RNA, 20 nt, Mycobacterium bovis subsp bovis AF2122/97
cagccgguccagacccagcu

SEQ ID NO: 1118663 - RNA, 23 nt, Mycobacterium bovis subsp bovis AF2122/97
cagccgguccagcagcucggccg

SEQ ID NO: 1118664 - RNA, 24 nt, Mycobacterium bovis subsp bovis AF2122/97
cagccgguccagcagcucggccga

SEQ ID NO: 1118665 - RNA, 12 nt, Mycobacterium bovis subsp bovis AF2122/97
cagccgguccag

SEQ ID NO: 1118666 - RNA, 15 nt, Mycobacterium bovis subsp bovis AF2122/97
cagccgguccagacc

SEQ ID NO: 1118667 - RNA, 19 nt, Mycobacterium bovis subsp bovis AF2122/97
cagccgggucuacagcguu

SEQ ID NO: 1118668 - RNA, 19 nt, Mycobacterium bovis subsp bovis AF2122/97
cagccgggugccggcauag

SEQ ID NO: 1118669 - RNA, 17 nt, Mycobacterium bovis subsp bovis AF2122/97
cagccgggugcgcaccc

SEQ ID NO: 1118670 - RNA, 18 nt, Mycobacterium bovis subsp bovis AF2122/97
cagccgggugcgcacccg

SEQ ID NO: 1118671 - RNA, 18 nt, Mycobacterium bovis subsp bovis AF2122/97
cagccgggcggcagcggc

SEQ ID NO: 1118672 - RNA, 20 nt, Mycobacterium bovis subsp bovis AF2122/97
cagccgggugccacaacccg

SEQ ID NO: 1118673 - RNA, 14 nt, Mycobacterium bovis subsp bovis AF2122/97
cagccgggcgucgc

SEQ ID NO: 1118674 - RNA, 19 nt, Mycobacterium bovis subsp bovis AF2122/97
cagccgggccaaccggucg

SEQ ID NO: 1118675 - RNA, 18 nt, Mycobacterium bovis subsp bovis AF2122/97
cagccgggcaaggcccgg

SEQ ID NO: 1118676 - RNA, 17 nt, Mycobacterium bovis subsp bovis AF2122/97
cagccgggcacccuugc

SEQ ID NO: 1118677 - RNA, 19 nt, Mycobacterium bovis subsp bovis AF2122/97
cagccgaugcugcgggcgg

SEQ ID NO: 1118678 - RNA, 20 nt, Mycobacterium bovis subsp bovis AF2122/97
cagccgaugcugcgggcggu

SEQ ID NO: 1118679 - RNA, 18 nt, Mycobacterium bovis subsp bovis AF2122/97
cagccgaugucgcgcgcu

SEQ ID NO: 1118680 - RNA, 21 nt, Mycobacterium bovis subsp bovis AF2122/97
cagccgaucgucucggccacg

SEQ ID NO: 1118681 - RNA, 22 nt, Mycobacterium bovis subsp bovis AF2122/97
cagccggcggagaaggcgacca

SEQ ID NO: 1118682 - RNA, 15 nt, Mycobacterium bovis subsp bovis AF2122/97
cagccgaucacgggc

SEQ ID NO: 1118683 - RNA, 16 nt, Mycobacterium bovis subsp bovis AF2122/97
cagccgaucaucaccg

SEQ ID NO: 1118684 - RNA, 17 nt, Mycobacterium bovis subsp bovis AF2122/97
cagccgaucaucaccgg

SEQ ID NO: 1118685 - RNA, 19 nt, Mycobacterium bovis subsp bovis AF2122/97
cagccgaucaucaccggca

SEQ ID NO: 1118686 - RNA, 19 nt, Mycobacterium bovis subsp bovis AF2122/97
cagccgagcguggcguugg

SEQ ID NO: 1118687 - RNA, 22 nt, Mycobacterium bovis subsp bovis AF2122/97
cagccgagcucacuucacgccg

SEQ ID NO: 1118688 - RNA, 19 nt, Mycobacterium bovis subsp bovis AF2122/97
cagcgagcgguugaucgcg

SEQ ID NO: 1118689 - RNA, 15 nt, Mycobacterium bovis subsp bovis AF2122/97
cagcgaggccagcgg

SEQ ID NO: 1118690 - RNA, 14 nt, Mycobacterium bovis subsp bovis AF2122/97
cagcgaggccagcg

SEQ ID NO: 1118691 - RNA, 23 nt, Mycobacterium bovis subsp bovis AF2122/97
cagcgaggaauuccgcuaccgca

SEQ ID NO: 1118692 - RNA, 21 nt, Mycobacterium bovis subsp bovis AF2122/97
cagcgaggugggcgucaucga

SEQ ID NO: 1118693 - RNA, 22 nt, Mycobacterium bovis subsp bovis AF2122/97
cagcgaguccucgagugccgcc

SEQ ID NO: 1118694 - RNA, 22 nt, Mycobacterium bovis subsp bovis AF2122/97
cagcgaguucuggaauccggcc

SEQ ID NO: 1118695 - RNA, 21 nt, Mycobacterium bovis subsp bovis AF2122/97
cagcgaccaggucgccagcuc

SEQ ID NO: 1118696 - RNA, 22 nt, Mycobacterium bovis subsp bovis AF2122/97
cagcgaccaggucgccagcucg

SEQ ID NO: 1118697 - RNA, 18 nt, Mycobacterium bovis subsp bovis AF2122/97
cagcgacccggccagcgg

SEQ ID NO: 1118698 - RNA, 19 nt, Mycobacterium bovis subsp bovis AF2122/97
cagcgacccggccagcggc

SEQ ID NO: 1118699 - RNA, 12 nt, Mycobacterium bovis subsp bovis AF2122/97
cagcgacccguu

SEQ ID NO: 1118700 - RNA, 14 nt, Mycobacterium bovis subsp bovis AF2122/97
cagcgacccggcca

SEQ ID NO: 1118701 - RNA, 17 nt, Mycobacterium bovis subsp bovis AF2122/97
cagcgacccggccagcg

SEQ ID NO: 1118702 - RNA, 12 nt, Mycobacterium bovis subsp bovis AF2122/97
cagcgaccaccg

SEQ ID NO: 1118703 - RNA, 19 nt, Mycobacterium bovis subsp bovis AF2122/97
cagcgagacuucgacgcgg

SEQ ID NO: 1118704 - RNA, 15 nt, Mycobacterium bovis subsp bovis AF2122/97
cagcgaccgguaauc

SEQ ID NO: 1118705 - RNA, 14 nt, Mycobacterium bovis subsp bovis AF2122/97
cagcgaccucacga

SEQ ID NO: 1118706 - RNA, 15 nt, Mycobacterium bovis subsp bovis AF2122/97
cagcgaccucacugc

SEQ ID NO: 1118707 - RNA, 21 nt, Mycobacterium bovis subsp bovis AF2122/97
cagcgaaccaccggcgccgcc

SEQ ID NO: 1118708 - RNA, 20 nt, Mycobacterium bovis subsp bovis AF2122/97
cagcgcaaaaucaccggugu

SEQ ID NO: 1118709 - RNA, 20 nt, Mycobacterium bovis subsp bovis AF2122/97
cagcgcaaagcccuccucga

SEQ ID NO: 1118710 - RNA, 13 nt, Mycobacterium bovis subsp bovis AF2122/97
cagcgaugacgac

SEQ ID NO: 1118711 - RNA, 15 nt, Mycobacterium bovis subsp bovis AF2122/97
cagcgaugacgacca

SEQ ID NO: 1118712 - RNA, 23 nt, Mycobacterium bovis subsp bovis AF2122/97
cagcgauggguguugcuggccgc

SEQ ID NO: 1118713 - RNA, 15 nt, Mycobacterium bovis subsp bovis AF2122/97
cagcgauauccacaa

SEQ ID NO: 1118714 - RNA, 14 nt, Mycobacterium bovis subsp bovis AF2122/97
cagcgauaucggcg

SEQ ID NO: 1118715 - RNA, 23 nt, Mycobacterium bovis subsp bovis AF2122/97
cagcgauauugagggugagccga

SEQ ID NO: 1118716 - RNA, 19 nt, Mycobacterium bovis subsp bovis AF2122/97
cagcgauauccacaauccg

SEQ ID NO: 1118717 - RNA, 14 nt, Mycobacterium bovis subsp bovis AF2122/97
cagcgauccaccaa

SEQ ID NO: 1118718 - RNA, 15 nt, Mycobacterium bovis subsp bovis AF2122/97
cagcgaucccgguga

SEQ ID NO: 1118719 - RNA, 20 nt, Mycobacterium bovis subsp bovis AF2122/97
cagcgcacgauagccaccga

SEQ ID NO: 1118720 - RNA, 22 nt, Mycobacterium bovis subsp bovis AF2122/97
cagcgcacgauagccaccgacg

SEQ ID NO: 1118721 - RNA, 14 nt, Mycobacterium bovis subsp bovis AF2122/97
cagcgcacgcagcc

SEQ ID NO: 1118722 - RNA, 21 nt, Mycobacterium bovis subsp bovis AF2122/97
cagcgcagcaucgucgccacg

SEQ ID NO: 1118723 - RNA, 18 nt, Mycobacterium bovis subsp bovis AF2122/97
cagcgcagcaacugggcg

SEQ ID NO: 1118724 - RNA, 23 nt, Mycobacterium bovis subsp bovis AF2122/97
cagcgcagcaacugggcggccug

SEQ ID NO: 1118725 - RNA, 13 nt, Mycobacterium bovis subsp bovis AF2122/97
cagcgcagcagcg

SEQ ID NO: 1118726 - RNA, 14 nt, Mycobacterium bovis subsp bovis AF2122/97
cagcgcacggacca

SEQ ID NO: 1118727 - RNA, 23 nt, Mycobacterium bovis subsp bovis AF2122/97
cagcgcacggaccaucgccaggc

SEQ ID NO: 1118728 - RNA, 14 nt, Mycobacterium bovis subsp bovis AF2122/97
cagcgcaccgccga

SEQ ID NO: 1118729 - RNA, 20 nt, Mycobacterium bovis subsp bovis AF2122/97
cagcgcacccggucggcggc

SEQ ID NO: 1118730 - RNA, 21 nt, Mycobacterium bovis subsp bovis AF2122/97
cagcgcacccggucggcggca

SEQ ID NO: 1118731 - RNA, 18 nt, Mycobacterium bovis subsp bovis AF2122/97
cagcgcacacuaccgccg

SEQ ID NO: 1118732 - RNA, 21 nt, Mycobacterium bovis subsp bovis AF2122/97
cagcgcaaugcaucgcggcgg

SEQ ID NO: 1118733 - RNA, 14 nt, Mycobacterium bovis subsp bovis AF2122/97
cagcauccggccgu

SEQ ID NO: 1118734 - RNA, 21 nt, Mycobacterium bovis subsp bovis AF2122/97
cagcaguucggcgaugcgcgg

SEQ ID NO: 1118735 - RNA, 22 nt, Mycobacterium bovis subsp bovis AF2122/97
cagcaguuucaccuugcgcacc

SEQ ID NO: 1118736 - RNA, 16 nt, Mycobacterium bovis subsp bovis AF2122/97
cagcaucggcagcagc

SEQ ID NO: 1118737 - RNA, 16 nt, Mycobacterium bovis subsp bovis AF2122/97
cagcaucggcaccccg

SEQ ID NO: 1118738 - RNA, 14 nt, Mycobacterium bovis subsp bovis AF2122/97
cagcaucggucaca

SEQ ID NO: 1118739 - RNA, 17 nt, Mycobacterium bovis subsp bovis AF2122/97
cagcaucggucacaccg

SEQ ID NO: 1118740 - RNA, 15 nt, Mycobacterium bovis subsp bovis AF2122/97
cagcaucggugcggg

SEQ ID NO: 1118741 - RNA, 16 nt, Mycobacterium bovis subsp bovis AF2122/97
cagcaucucgucgauc

SEQ ID NO: 1118742 - RNA, 24 nt, Mycobacterium bovis subsp bovis AF2122/97
cagcaucucggccuugacgcacga

SEQ ID NO: 1118743 - RNA, 20 nt, Mycobacterium bovis subsp bovis AF2122/97
cagcaucgucgaauccucgc

SEQ ID NO: 1118744 - RNA, 17 nt, Mycobacterium bovis subsp bovis AF2122/97
cagcaucgucgccacga

SEQ ID NO: 1118745 - RNA, 15 nt, Mycobacterium bovis subsp bovis AF2122/97
cagcauguggccgcc

SEQ ID NO: 1118746 - RNA, 16 nt, Mycobacterium bovis subsp bovis AF2122/97
cagcauguggccgccg

SEQ ID NO: 1118747 - RNA, 17 nt, Mycobacterium bovis subsp bovis AF2122/97
cagcauguggccgccgu

SEQ ID NO: 1118748 - RNA, 18 nt, Mycobacterium bovis subsp bovis AF2122/97
cagcauguggccgccguc

SEQ ID NO: 1118749 - RNA, 19 nt, Mycobacterium bovis subsp bovis AF2122/97
cagcauguggccgccgucg

SEQ ID NO: 1118750 - RNA, 17 nt, Mycobacterium bovis subsp bovis AF2122/97
cagcaugucucgggcgc

SEQ ID NO: 1118751 - RNA, 19 nt, Mycobacterium bovis subsp bovis AF2122/97
cagcaugucucgggcgcgg

SEQ ID NO: 1118752 - RNA, 13 nt, Mycobacterium bovis subsp bovis AF2122/97
cagcaugucgcgg

SEQ ID NO: 1118753 - RNA, 17 nt, Mycobacterium bovis subsp bovis AF2122/97
cagcaugucgcggaccc

SEQ ID NO: 1118754 - RNA, 23 nt, Mycobacterium bovis subsp bovis AF2122/97
cagcaugucgggccgcucgaaau

SEQ ID NO: 1118755 - RNA, 19 nt, Mycobacterium bovis subsp bovis AF2122/97
cagcauggugcggcggcgu

SEQ ID NO: 1118756 - RNA, 20 nt, Mycobacterium bovis subsp bovis AF2122/97
cagcauggugcggcggcguc

SEQ ID NO: 1118757 - RNA, 20 nt, Mycobacterium bovis subsp bovis AF2122/97
cagcaugguuagcggugaug

SEQ ID NO: 1118758 - RNA, 22 nt, Mycobacterium bovis subsp bovis AF2122/97
cagcaugguuagcggugauggg

SEQ ID NO: 1118759 - RNA, 23 nt, Mycobacterium bovis subsp bovis AF2122/97
cagcaucuggggguagccgccgg

SEQ ID NO: 1118760 - RNA, 22 nt, Mycobacterium bovis subsp bovis AF2122/97
cagcaucugcgggucggcaucg

SEQ ID NO: 1118761 - RNA, 18 nt, Mycobacterium bovis subsp bovis AF2122/97
cagcaugguccacagccg

SEQ ID NO: 1118762 - RNA, 21 nt, Mycobacterium bovis subsp bovis AF2122/97
cagcauggcuuuugcgccgaa

SEQ ID NO: 1118763 - RNA, 15 nt, Mycobacterium bovis subsp bovis AF2122/97
cagcaugggaauccg

SEQ ID NO: 1118764 - RNA, 20 nt, Mycobacterium bovis subsp bovis AF2122/97
cagcaugggcgagaaguccg

SEQ ID NO: 1118765 - RNA, 22 nt, Mycobacterium bovis subsp bovis AF2122/97
cagccaggugcccaagcagucc

SEQ ID NO: 1118766 - RNA, 24 nt, Mycobacterium bovis subsp bovis AF2122/97
cagccagggucccgccgccuggaa

SEQ ID NO: 1118767 - RNA, 16 nt, Mycobacterium bovis subsp bovis AF2122/97
cagccaggugucgucg

SEQ ID NO: 1118768 - RNA, 23 nt, Mycobacterium bovis subsp bovis AF2122/97
cagccaggugucgucgaucgcgg

SEQ ID NO: 1118769 - RNA, 14 nt, Mycobacterium bovis subsp bovis AF2122/97
cagccacugacggc

SEQ ID NO: 1118770 - RNA, 15 nt, Mycobacterium bovis subsp bovis AF2122/97
cagccacucgccacu

SEQ ID NO: 1118771 - RNA, 15 nt, Mycobacterium bovis subsp bovis AF2122/97
cagccagggcgccga

SEQ ID NO: 1118772 - RNA, 15 nt, Mycobacterium bovis subsp bovis AF2122/97
cagccaggccgcaau

SEQ ID NO: 1118773 - RNA, 23 nt, Mycobacterium bovis subsp bovis AF2122/97
cagccaggccuuggugcggccgg

SEQ ID NO: 1118774 - RNA, 23 nt, Mycobacterium bovis subsp bovis AF2122/97
cagccacguagacaaggccaagc

SEQ ID NO: 1118775 - RNA, 17 nt, Mycobacterium bovis subsp bovis AF2122/97
cagccacgcagcacggc

SEQ ID NO: 1118776 - RNA, 13 nt, Mycobacterium bovis subsp bovis AF2122/97
cagccaccgcggu

SEQ ID NO: 1118777 - RNA, 20 nt, Mycobacterium bovis subsp bovis AF2122/97
cagccaccucgacggugacg

SEQ ID NO: 1118778 - RNA, 22 nt, Mycobacterium bovis subsp bovis AF2122/97
cagccaccgggcgugcggcggc

SEQ ID NO: 1118779 - RNA, 23 nt, Mycobacterium bovis subsp bovis AF2122/97
cagccaccgggcgugcggcggcc

SEQ ID NO: 1118780 - RNA, 12 nt, Mycobacterium bovis subsp bovis AF2122/97
cagccaccggug

SEQ ID NO: 1118781 - RNA, 23 nt, Mycobacterium bovis subsp bovis AF2122/97
cagccacgaacugaucgaccgcc

SEQ ID NO: 1118782 - RNA, 12 nt, Mycobacterium bovis subsp bovis AF2122/97
cagccaccacca

SEQ ID NO: 1118783 - RNA, 16 nt, Mycobacterium bovis subsp bovis AF2122/97
cagccaccaccagguc

SEQ ID NO: 1118784 - RNA, 12 nt, Mycobacterium bovis subsp bovis AF2122/97
cagccaccccug

SEQ ID NO: 1118785 - RNA, 15 nt, Mycobacterium bovis subsp bovis AF2122/97
cagccaccccugcgg

SEQ ID NO: 1118786 - RNA, 16 nt, Mycobacterium bovis subsp bovis AF2122/97
cagccaugcggcugcc

SEQ ID NO: 1118787 - RNA, 17 nt, Mycobacterium bovis subsp bovis AF2122/97
cagccaugcucgucuug

SEQ ID NO: 1118788 - RNA, 14 nt, Mycobacterium bovis subsp bovis AF2122/97
cagccaugcggcug

SEQ ID NO: 1118789 - RNA, 15 nt, Mycobacterium bovis subsp bovis AF2122/97
cagccaucucuugca

SEQ ID NO: 1118790 - RNA, 17 nt, Mycobacterium bovis subsp bovis AF2122/97
cagcccgaacucguugg

SEQ ID NO: 1118791 - RNA, 16 nt, Mycobacterium bovis subsp bovis AF2122/97
cagccccuccgcgccg

SEQ ID NO: 1118792 - RNA, 23 nt, Mycobacterium bovis subsp bovis AF2122/97
cagccccgcuggucgaccggcgu

SEQ ID NO: 1118793 - RNA, 16 nt, Mycobacterium bovis subsp bovis AF2122/97
cagccccugccgaucc

SEQ ID NO: 1118794 - RNA, 20 nt, Mycobacterium bovis subsp bovis AF2122/97
cagccccccggcgacggcgu

SEQ ID NO: 1118795 - RNA, 14 nt, Mycobacterium bovis subsp bovis AF2122/97
cagccccgcgccca

SEQ ID NO: 1118796 - RNA, 14 nt, Mycobacterium bovis subsp bovis AF2122/97
cagccccgcggcca

SEQ ID NO: 1118797 - RNA, 17 nt, Mycobacterium bovis subsp bovis AF2122/97
cagccccgcggccagca

SEQ ID NO: 1118798 - RNA, 18 nt, Mycobacterium bovis subsp bovis AF2122/97
cagccccaugaucuggug

SEQ ID NO: 1118799 - RNA, 23 nt, Mycobacterium bovis subsp bovis AF2122/97
cagccccauugccgucgcgguca

SEQ ID NO: 1118800 - RNA, 19 nt, Mycobacterium bovis subsp bovis AF2122/97
cagccccaucaccaccggc

SEQ ID NO: 1118801 - RNA, 14 nt, Mycobacterium bovis subsp bovis AF2122/97
cagcccgacguugc

SEQ ID NO: 1118802 - RNA, 15 nt, Mycobacterium bovis subsp bovis AF2122/97
cagcccgacaccgau

SEQ ID NO: 1118803 - RNA, 19 nt, Mycobacterium bovis subsp bovis AF2122/97
cagcccgacaccgaucgga

SEQ ID NO: 1118804 - RNA, 18 nt, Mycobacterium bovis subsp bovis AF2122/97
cagcccgaugaucccgcc

SEQ ID NO: 1118805 - RNA, 23 nt, Mycobacterium bovis subsp bovis AF2122/97
cagcccgaugaucccgccaccga

SEQ ID NO: 1118806 - RNA, 22 nt, Mycobacterium bovis subsp bovis AF2122/97
cagcccggacguaggcaccccg

SEQ ID NO: 1118807 - RNA, 15 nt, Mycobacterium bovis subsp bovis AF2122/97
cagcccggaacccga

SEQ ID NO: 1118808 - RNA, 19 nt, Mycobacterium bovis subsp bovis AF2122/97
cagcccggaacccgagccg

SEQ ID NO: 1118809 - RNA, 21 nt, Mycobacterium bovis subsp bovis AF2122/97
cagcccggcacugaccgcgau

SEQ ID NO: 1118810 - RNA, 19 nt, Mycobacterium bovis subsp bovis AF2122/97
cagcccggccagccgcacg

SEQ ID NO: 1118811 - RNA, 20 nt, Mycobacterium bovis subsp bovis AF2122/97
cagcccggccagccgcacgg

SEQ ID NO: 1118812 - RNA, 15 nt, Mycobacterium bovis subsp bovis AF2122/97
cagcccuucgcggga

SEQ ID NO: 1118813 - RNA, 24 nt, Mycobacterium bovis subsp bovis AF2122/97
cagccgaacaauuucugcagccca

SEQ ID NO: 1118814 - RNA, 16 nt, Mycobacterium bovis subsp bovis AF2122/97
cagcccggccgccgag

SEQ ID NO: 1118815 - RNA, 23 nt, Mycobacterium bovis subsp bovis AF2122/97
cagcccuguuugacugcgaccgg

SEQ ID NO: 1118816 - RNA, 14 nt, Mycobacterium bovis subsp bovis AF2122/97
cagcccuucagcga

SEQ ID NO: 1118817 - RNA, 19 nt, Mycobacterium bovis subsp bovis AF2122/97
cagcccuucagcgaagccg

SEQ ID NO: 1118818 - RNA, 15 nt, Mycobacterium bovis subsp bovis AF2122/97
cagccgaagcgcccg

SEQ ID NO: 1118819 - RNA, 18 nt, Mycobacterium bovis subsp bovis AF2122/97
cagccgaagcgcccguug

SEQ ID NO: 1118820 - RNA, 15 nt, Mycobacterium bovis subsp bovis AF2122/97
cagccgaaccggcac

SEQ ID NO: 1118821 - RNA, 18 nt, Mycobacterium bovis subsp bovis AF2122/97
cagccgaaccggcaccag

SEQ ID NO: 1118822 - RNA, 20 nt, Mycobacterium bovis subsp bovis AF2122/97
cagccgaaccggcaccagcg

SEQ ID NO: 1118823 - RNA, 22 nt, Mycobacterium bovis subsp bovis AF2122/97
cagccgaaccggcaccagcggc

SEQ ID NO: 1118824 - RNA, 18 nt, Mycobacterium bovis subsp bovis AF2122/97
cagccgaagaaccggucg

SEQ ID NO: 1118825 - RNA, 17 nt, Mycobacterium bovis subsp bovis AF2122/97
cagccgaaguggcgccu

SEQ ID NO: 1118826 - RNA, 21 nt, Mycobacterium bovis subsp bovis AF2122/97
cagccgaccgauggcucacca

SEQ ID NO: 1118827 - RNA, 13 nt, Mycobacterium bovis subsp bovis AF2122/97
cagccgacgcggc

SEQ ID NO: 1118828 - RNA, 15 nt, Mycobacterium bovis subsp bovis AF2122/97
cagcagugccaccgg

SEQ ID NO: 1118829 - RNA, 23 nt, Mycobacterium bovis subsp bovis AF2122/97
cagcaguacuaacaacaccacca

SEQ ID NO: 1118830 - RNA, 15 nt, Mycobacterium bovis subsp bovis AF2122/97
cagcagugccgugcu

SEQ ID NO: 1118831 - RNA, 16 nt, Mycobacterium bovis subsp bovis AF2122/97
cagcagugccgugcug

SEQ ID NO: 1118832 - RNA, 14 nt, Mycobacterium bovis subsp bovis AF2122/97
cagcagguuggcga

SEQ ID NO: 1118833 - RNA, 17 nt, Mycobacterium bovis subsp bovis AF2122/97
cagcaguacaccgcccg

SEQ ID NO: 1118834 - RNA, 17 nt, Mycobacterium bovis subsp bovis AF2122/97
cagcaggucgucggcgu

SEQ ID NO: 1118835 - RNA, 19 nt, Mycobacterium bovis subsp bovis AF2122/97
cagcaggucgucggcgucg

SEQ ID NO: 1118836 - RNA, 22 nt, Mycobacterium bovis subsp bovis AF2122/97
cagcaggucgucggcgucgcgg

SEQ ID NO: 1118837 - RNA, 22 nt, Mycobacterium bovis subsp bovis AF2122/97
cagcaggugccaaccgcggcga

SEQ ID NO: 1118838 - RNA, 23 nt, Mycobacterium bovis subsp bovis AF2122/97
cagcagggugugcgucugcggcg

SEQ ID NO: 1118839 - RNA, 14 nt, Mycobacterium bovis subsp bovis AF2122/97
cagcagggcggcgu

SEQ ID NO: 1118840 - RNA, 22 nt, Mycobacterium bovis subsp bovis AF2122/97
cagcaggggacgaccaugccga

SEQ ID NO: 1118841 - RNA, 22 nt, Mycobacterium bovis subsp bovis AF2122/97
cagcaggggaucguccggccgg

SEQ ID NO: 1118842 - RNA, 14 nt, Mycobacterium bovis subsp bovis AF2122/97
cagcagggcgcgca

SEQ ID NO: 1118843 - RNA, 16 nt, Mycobacterium bovis subsp bovis AF2122/97
cagcagcggcgaccgc

SEQ ID NO: 1118844 - RNA, 21 nt, Mycobacterium bovis subsp bovis AF2122/97
cagcagcggcgaccgcggucg

SEQ ID NO: 1118845 - RNA, 13 nt, Mycobacterium bovis subsp bovis AF2122/97
cagcagcggcgga

SEQ ID NO: 1118846 - RNA, 15 nt, Mycobacterium bovis subsp bovis AF2122/97
cagcagcgggcuggc

SEQ ID NO: 1118847 - RNA, 21 nt, Mycobacterium bovis subsp bovis AF2122/97
cagcagcggcucuauccggcg

SEQ ID NO: 1118848 - RNA, 18 nt, Mycobacterium bovis subsp bovis AF2122/97
cagcagcggugcagcccg

SEQ ID NO: 1118849 - RNA, 22 nt, Mycobacterium bovis subsp bovis AF2122/97
cagcagcggugcagcccgccgg

SEQ ID NO: 1118850 - RNA, 19 nt, Mycobacterium bovis subsp bovis AF2122/97
cagcagcgguugaugcggc

SEQ ID NO: 1118851 - RNA, 21 nt, Mycobacterium bovis subsp bovis AF2122/97
cagcagcgguugaugcggccg

SEQ ID NO: 1118852 - RNA, 22 nt, Mycobacterium bovis subsp bovis AF2122/97
cagcagcgucggugccaccacg

SEQ ID NO: 1118853 - RNA, 16 nt, Mycobacterium bovis subsp bovis AF2122/97
cagcaggcccuggcca

SEQ ID NO: 1118854 - RNA, 18 nt, Mycobacterium bovis subsp bovis AF2122/97
cagcaggcccuggccacc

SEQ ID NO: 1118855 - RNA, 16 nt, Mycobacterium bovis subsp bovis AF2122/97
cagcaggccgcgcucg

SEQ ID NO: 1118856 - RNA, 20 nt, Mycobacterium bovis subsp bovis AF2122/97
cagcaggcccuggccaccca

SEQ ID NO: 1118857 - RNA, 17 nt, Mycobacterium bovis subsp bovis AF2122/97
cagcaggccgggacagc

SEQ ID NO: 1118858 - RNA, 20 nt, Mycobacterium bovis subsp bovis AF2122/97
cagcaggccgggacagcgcc

SEQ ID NO: 1118859 - RNA, 19 nt, Mycobacterium bovis subsp bovis AF2122/97
cagcaggccgggcgcaagc

SEQ ID NO: 1118860 - RNA, 16 nt, Mycobacterium bovis subsp bovis AF2122/97
cagcaggccgucgauc

SEQ ID NO: 1118861 - RNA, 15 nt, Mycobacterium bovis subsp bovis AF2122/97
cagcaggcucgaacc

SEQ ID NO: 1118862 - RNA, 22 nt, Mycobacterium bovis subsp bovis AF2122/97
cagcaggccuccaagcccgccg

SEQ ID NO: 1118863 - RNA, 16 nt, Mycobacterium bovis subsp bovis AF2122/97
cagcagggccaccacc

SEQ ID NO: 1118864 - RNA, 18 nt, Mycobacterium bovis subsp bovis AF2122/97
cagcagggccaccaccac

SEQ ID NO: 1118865 - RNA, 14 nt, Mycobacterium bovis subsp bovis AF2122/97
cagcagggccacca

SEQ ID NO: 1118866 - RNA, 19 nt, Mycobacterium bovis subsp bovis AF2122/97
cagcacuuccaagccgacc

SEQ ID NO: 1118867 - RNA, 19 nt, Mycobacterium bovis subsp bovis AF2122/97
cagcacugccaucgcggcg

SEQ ID NO: 1118868 - RNA, 20 nt, Mycobacterium bovis subsp bovis AF2122/97
cagcacugccaucgcggcgu

SEQ ID NO: 1118869 - RNA, 19 nt, Mycobacterium bovis subsp bovis AF2122/97
cagcacucggugucggccg

SEQ ID NO: 1118870 - RNA, 22 nt, Mycobacterium bovis subsp bovis AF2122/97
cagcacucggugucggccgcgu

SEQ ID NO: 1118871 - RNA, 16 nt, Mycobacterium bovis subsp bovis AF2122/97
cagcacuccaccgcug

SEQ ID NO: 1118872 - RNA, 16 nt, Mycobacterium bovis subsp bovis AF2122/97
cagcagcaacgcggug

SEQ ID NO: 1118873 - RNA, 17 nt, Mycobacterium bovis subsp bovis AF2122/97
cagcagcaacgcggugc

SEQ ID NO: 1118874 - RNA, 16 nt, Mycobacterium bovis subsp bovis AF2122/97
cagcacucuucgauga

SEQ ID NO: 1118875 - RNA, 13 nt, Mycobacterium bovis subsp bovis AF2122/97
cagcagcaccgcg

SEQ ID NO: 1118876 - RNA, 13 nt, Mycobacterium bovis subsp bovis AF2122/97
cagcagccggcgg

SEQ ID NO: 1118877 - RNA, 13 nt, Mycobacterium bovis subsp bovis AF2122/97
cagcagccggcgu

SEQ ID NO: 1118878 - RNA, 12 nt, Mycobacterium bovis subsp bovis AF2122/97
cagcagccgccg

SEQ ID NO: 1118879 - RNA, 16 nt, Mycobacterium bovis subsp bovis AF2122/97
cagcagccgccggccg

SEQ ID NO: 1118880 - RNA, 22 nt, Mycobacterium bovis subsp bovis AF2122/97
cagcagccgccggccggcaucc

SEQ ID NO: 1118881 - RNA, 14 nt, Mycobacterium bovis subsp bovis AF2122/97
cagcagccgcgaca

SEQ ID NO: 1118882 - RNA, 14 nt, Mycobacterium bovis subsp bovis AF2122/97
cagcagccgcgacg

SEQ ID NO: 1118883 - RNA, 16 nt, Mycobacterium bovis subsp bovis AF2122/97
cagcagcccgguggug

SEQ ID NO: 1118884 - RNA, 17 nt, Mycobacterium bovis subsp bovis AF2122/97
cagcagccggugccggu

SEQ ID NO: 1118885 - RNA, 14 nt, Mycobacterium bovis subsp bovis AF2122/97
cagcagccugcgcc

SEQ ID NO: 1118886 - RNA, 19 nt, Mycobacterium bovis subsp bovis AF2122/97
cagcagccugcgccgcgcg

SEQ ID NO: 1118887 - RNA, 14 nt, Mycobacterium bovis subsp bovis AF2122/97
cagcagcgcgacgg

SEQ ID NO: 1118888 - RNA, 13 nt, Mycobacterium bovis subsp bovis AF2122/97
cagcagcccccgc

SEQ ID NO: 1118889 - RNA, 12 nt, Mycobacterium bovis subsp bovis AF2122/97
cagcagcaccug

SEQ ID NO: 1118890 - RNA, 13 nt, Mycobacterium bovis subsp bovis AF2122/97
cagcagcaccugc

SEQ ID NO: 1118891 - RNA, 18 nt, Mycobacterium bovis subsp bovis AF2122/97
cagcagcaaugcgguacc

SEQ ID NO: 1118892 - RNA, 14 nt, Mycobacterium bovis subsp bovis AF2122/97
cagcacguccgcgg

SEQ ID NO: 1118893 - RNA, 12 nt, Mycobacterium bovis subsp bovis AF2122/97
cagcacgucgca

SEQ ID NO: 1118894 - RNA, 19 nt, Mycobacterium bovis subsp bovis AF2122/97
cagcacguaacccaguccc

SEQ ID NO: 1118895 - RNA, 13 nt, Mycobacterium bovis subsp bovis AF2122/97
cagcacguacugc

SEQ ID NO: 1118896 - RNA, 15 nt, Mycobacterium bovis subsp bovis AF2122/97
cagcacgucgcggcc

SEQ ID NO: 1118897 - RNA, 17 nt, Mycobacterium bovis subsp bovis AF2122/97
cagcacgugggccaacg

SEQ ID NO: 1118898 - RNA, 20 nt, Mycobacterium bovis subsp bovis AF2122/97
cagcacgucuugcugcacgc

SEQ ID NO: 1118899 - RNA, 23 nt, Mycobacterium bovis subsp bovis AF2122/97
cagcacgugccaaaugaugacga

SEQ ID NO: 1118900 - RNA, 20 nt, Mycobacterium bovis subsp bovis AF2122/97
cagcacggugaucagcagca

SEQ ID NO: 1118901 - RNA, 17 nt, Mycobacterium bovis subsp bovis AF2122/97
cagcacggugaucagca

SEQ ID NO: 1118902 - RNA, 17 nt, Mycobacterium bovis subsp bovis AF2122/97
cagcacgguggcuucga

SEQ ID NO: 1118903 - RNA, 21 nt, Mycobacterium bovis subsp bovis AF2122/97
cagcacgguggcuucgacggc

SEQ ID NO: 1118904 - RNA, 16 nt, Mycobacterium bovis subsp bovis AF2122/97
cagcacggugugcgau

SEQ ID NO: 1118905 - RNA, 20 nt, Mycobacterium bovis subsp bovis AF2122/97
cagcacgguguugcgcaccc

SEQ ID NO: 1118906 - RNA, 21 nt, Mycobacterium bovis subsp bovis AF2122/97
cagcacgguguugcgcacccg

SEQ ID NO: 1118907 - RNA, 15 nt, Mycobacterium bovis subsp bovis AF2122/97
cagcacggucaacgu

SEQ ID NO: 1118908 - RNA, 19 nt, Mycobacterium bovis subsp bovis AF2122/97
cagcacggcgccgccacgg

SEQ ID NO: 1118909 - RNA, 13 nt, Mycobacterium bovis subsp bovis AF2122/97
cagcacggcuucg

SEQ ID NO: 1118910 - RNA, 16 nt, Mycobacterium bovis subsp bovis AF2122/97
cagcacggcuucgcgg

SEQ ID NO: 1118911 - RNA, 16 nt, Mycobacterium bovis subsp bovis AF2122/97
cagcaacaucuugccg

SEQ ID NO: 1118912 - RNA, 14 nt, Mycobacterium bovis subsp bovis AF2122/97
cagcaagacgauga

SEQ ID NO: 1118913 - RNA, 14 nt, Mycobacterium bovis subsp bovis AF2122/97
cagcaagagccgca

SEQ ID NO: 1118914 - RNA, 13 nt, Mycobacterium bovis subsp bovis AF2122/97
cagcaagccgccg

SEQ ID NO: 1118915 - RNA, 14 nt, Mycobacterium bovis subsp bovis AF2122/97
cagcaagccgccgg

SEQ ID NO: 1118916 - RNA, 23 nt, Mycobacterium bovis subsp bovis AF2122/97
cacgcggcggucguugccgaccg

SEQ ID NO: 1118917 - RNA, 12 nt, Mycobacterium bovis subsp bovis AF2122/97
cacgcggcgaug

SEQ ID NO: 1118918 - RNA, 16 nt, Mycobacterium bovis subsp bovis AF2122/97
cacgcgggugccgacg

SEQ ID NO: 1118919 - RNA, 19 nt, Mycobacterium bovis subsp bovis AF2122/97
cacgcgggugccgacgucg

SEQ ID NO: 1118920 - RNA, 13 nt, Mycobacterium bovis subsp bovis AF2122/97
cacgcgggcguug

SEQ ID NO: 1118921 - RNA, 14 nt, Mycobacterium bovis subsp bovis AF2122/97
cacgcgggugccga

SEQ ID NO: 1118922 - RNA, 17 nt, Mycobacterium bovis subsp bovis AF2122/97
cacgcggaccucgaagc

SEQ ID NO: 1118923 - RNA, 24 nt, Mycobacterium bovis subsp bovis AF2122/97
cacgcggaaaccaucgccagccgg

SEQ ID NO: 1118924 - RNA, 17 nt, Mycobacterium bovis subsp bovis AF2122/97
cacgcgcucggugccgc

SEQ ID NO: 1118925 - RNA, 18 nt, Mycobacterium bovis subsp bovis AF2122/97
cacgcgcucggugccgcc

SEQ ID NO: 1118926 - RNA, 15 nt, Mycobacterium bovis subsp bovis AF2122/97
cacgccucgccgaag

SEQ ID NO: 1118927 - RNA, 17 nt, Mycobacterium bovis subsp bovis AF2122/97
cacgccugccaccggcg

SEQ ID NO: 1118928 - RNA, 21 nt, Mycobacterium bovis subsp bovis AF2122/97
cacgccugccaugggcaaugg

SEQ ID NO: 1118929 - RNA, 21 nt, Mycobacterium bovis subsp bovis AF2122/97
cacgccugaacgacccgcugg

SEQ ID NO: 1118930 - RNA, 15 nt, Mycobacterium bovis subsp bovis AF2122/97
cacgccugagccacc

SEQ ID NO: 1118931 - RNA, 16 nt, Mycobacterium bovis subsp bovis AF2122/97
cacgccugagccacca

SEQ ID NO: 1118932 - RNA, 21 nt, Mycobacterium bovis subsp bovis AF2122/97
cacgccugagccaccaacacc

SEQ ID NO: 1118933 - RNA, 21 nt, Mycobacterium bovis subsp bovis AF2122/97
cacgccggguguggcuugacg

SEQ ID NO: 1118934 - RNA, 14 nt, Mycobacterium bovis subsp bovis AF2122/97
cacgccgucgaccg

SEQ ID NO: 1118935 - RNA, 18 nt, Mycobacterium bovis subsp bovis AF2122/97
cacgccgucgaccggcgg

SEQ ID NO: 1118936 - RNA, 12 nt, Mycobacterium bovis subsp bovis AF2122/97
cacgccgggcga

SEQ ID NO: 1118937 - RNA, 22 nt, Mycobacterium bovis subsp bovis AF2122/97
cacgccgggcgaguacaggcgc

SEQ ID NO: 1118938 - RNA, 20 nt, Mycobacterium bovis subsp bovis AF2122/97
cacgccgggugccgccacgu

SEQ ID NO: 1118939 - RNA, 23 nt, Mycobacterium bovis subsp bovis AF2122/97
cacgccggugacgggguugaccg

SEQ ID NO: 1118940 - RNA, 14 nt, Mycobacterium bovis subsp bovis AF2122/97
cacgccggucgagg

SEQ ID NO: 1118941 - RNA, 20 nt, Mycobacterium bovis subsp bovis AF2122/97
cacgccgaucaacaugccgg

SEQ ID NO: 1118942 - RNA, 19 nt, Mycobacterium bovis subsp bovis AF2122/97
cacgccgaccaucucaccg

SEQ ID NO: 1118943 - RNA, 22 nt, Mycobacterium bovis subsp bovis AF2122/97
cacgccgacgauuaccagcggc

SEQ ID NO: 1118944 - RNA, 13 nt, Mycobacterium bovis subsp bovis AF2122/97
cacgccgacggca

SEQ ID NO: 1118945 - RNA, 13 nt, Mycobacterium bovis subsp bovis AF2122/97
cacgccgaccggc

SEQ ID NO: 1118946 - RNA, 14 nt, Mycobacterium bovis subsp bovis AF2122/97
cacgccgaccggcc

SEQ ID NO: 1118947 - RNA, 13 nt, Mycobacterium bovis subsp bovis AF2122/97
cacgccggccucg

SEQ ID NO: 1118948 - RNA, 16 nt, Mycobacterium bovis subsp bovis AF2122/97
cacgccggccucgccg

SEQ ID NO: 1118949 - RNA, 17 nt, Mycobacterium bovis subsp bovis AF2122/97
cacgccggccucgccga

SEQ ID NO: 1118950 - RNA, 14 nt, Mycobacterium bovis subsp bovis AF2122/97
cacgccggcaucgu

SEQ ID NO: 1118951 - RNA, 20 nt, Mycobacterium bovis subsp bovis AF2122/97
cacgccggcaucgucgacgc

SEQ ID NO: 1118952 - RNA, 19 nt, Mycobacterium bovis subsp bovis AF2122/97
cacgccggcgcuggagacg

SEQ ID NO: 1118953 - RNA, 13 nt, Mycobacterium bovis subsp bovis AF2122/97
cacgccgauucgc

SEQ ID NO: 1118954 - RNA, 22 nt, Mycobacterium bovis subsp bovis AF2122/97
cacgccgaugauggacaccagc

SEQ ID NO: 1118955 - RNA, 17 nt, Mycobacterium bovis subsp bovis AF2122/97
cacgccgauucgccguc

SEQ ID NO: 1118956 - RNA, 20 nt, Mycobacterium bovis subsp bovis AF2122/97
cacgccggauggucggccac

SEQ ID NO: 1118957 - RNA, 18 nt, Mycobacterium bovis subsp bovis AF2122/97
caccucccacgccgccgu

SEQ ID NO: 1118958 - RNA, 21 nt, Mycobacterium bovis subsp bovis AF2122/97
caccucccagggcucggcggc

SEQ ID NO: 1118959 - RNA, 14 nt, Mycobacterium bovis subsp bovis AF2122/97
caccucaucgccau

SEQ ID NO: 1118960 - RNA, 17 nt, Mycobacterium bovis subsp bovis AF2122/97
caccucaugaucucacc

SEQ ID NO: 1118961 - RNA, 18 nt, Mycobacterium bovis subsp bovis AF2122/97
caccucagcugcggacug

SEQ ID NO: 1118962 - RNA, 21 nt, Mycobacterium bovis subsp bovis AF2122/97
caccuccaauugcgaaccggc

SEQ ID NO: 1118963 - RNA, 23 nt, Mycobacterium bovis subsp bovis AF2122/97
caccuccaauugcgaaccggccg

SEQ ID NO: 1118964 - RNA, 22 nt, Mycobacterium bovis subsp bovis AF2122/97
caccuccaccgcgccggcggca

SEQ ID NO: 1118965 - RNA, 20 nt, Mycobacterium bovis subsp bovis AF2122/97
cacgcccaauguccaggcgc

SEQ ID NO: 1118966 - RNA, 18 nt, Mycobacterium bovis subsp bovis AF2122/97
cacgcccacagcugacga

SEQ ID NO: 1118967 - RNA, 16 nt, Mycobacterium bovis subsp bovis AF2122/97
cacgcccaugaccggc

SEQ ID NO: 1118968 - RNA, 18 nt, Mycobacterium bovis subsp bovis AF2122/97
cacgcccaugaccggccg

SEQ ID NO: 1118969 - RNA, 20 nt, Mycobacterium bovis subsp bovis AF2122/97
cacgcccaugaccggccgcc

SEQ ID NO: 1118970 - RNA, 18 nt, Mycobacterium bovis subsp bovis AF2122/97
cacgcucacccggcgucu

SEQ ID NO: 1118971 - RNA, 14 nt, Mycobacterium bovis subsp bovis AF2122/97
cacgcguagcgguc

SEQ ID NO: 1118972 - RNA, 16 nt, Mycobacterium bovis subsp bovis AF2122/97
cacgcgugacucggcc

SEQ ID NO: 1118973 - RNA, 18 nt, Mycobacterium bovis subsp bovis AF2122/97
cacgcgugacucggccga

SEQ ID NO: 1118974 - RNA, 21 nt, Mycobacterium bovis subsp bovis AF2122/97
cacgcgugacucggccgacga

SEQ ID NO: 1118975 - RNA, 13 nt, Mycobacterium bovis subsp bovis AF2122/97
cacgcgugccgca

SEQ ID NO: 1118976 - RNA, 15 nt, Mycobacterium bovis subsp bovis AF2122/97
cacgcguugacgauc

SEQ ID NO: 1118977 - RNA, 22 nt, Mycobacterium bovis subsp bovis AF2122/97
cacgcguuccauggcccgcucg

SEQ ID NO: 1118978 - RNA, 20 nt, Mycobacterium bovis subsp bovis AF2122/97
cacgcguuucgaaccgcacg

SEQ ID NO: 1118979 - RNA, 15 nt, Mycobacterium bovis subsp bovis AF2122/97
cacgcuagccgacag

SEQ ID NO: 1118980 - RNA, 19 nt, Mycobacterium bovis subsp bovis AF2122/97
cacgcucgugacgaucagc

SEQ ID NO: 1118981 - RNA, 22 nt, Mycobacterium bovis subsp bovis AF2122/97
cacgcucggcggggaccgcggu

SEQ ID NO: 1118982 - RNA, 14 nt, Mycobacterium bovis subsp bovis AF2122/97
cacgcucggcgugu

SEQ ID NO: 1118983 - RNA, 17 nt, Mycobacterium bovis subsp bovis AF2122/97
cacgcucggcguccgcc

SEQ ID NO: 1118984 - RNA, 18 nt, Mycobacterium bovis subsp bovis AF2122/97
cacgcucggcguccgccc

SEQ ID NO: 1118985 - RNA, 22 nt, Mycobacterium bovis subsp bovis AF2122/97
cacgcucggcguccgcccagca

SEQ ID NO: 1118986 - RNA, 13 nt, Mycobacterium bovis subsp bovis AF2122/97
cacgcucggcgug

SEQ ID NO: 1118987 - RNA, 11 nt, Mycobacterium bovis subsp bovis AF2122/97
cacgcucggcg

SEQ ID NO: 1118988 - RNA, 13 nt, Mycobacterium bovis subsp bovis AF2122/97
cacgcugcccacg

SEQ ID NO: 1118989 - RNA, 23 nt, Mycobacterium bovis subsp bovis AF2122/97
cacgcugcccacgggccggccga

SEQ ID NO: 1118990 - RNA, 18 nt, Mycobacterium bovis subsp bovis AF2122/97
cacgcugagcguccgaca

SEQ ID NO: 1118991 - RNA, 20 nt, Mycobacterium bovis subsp bovis AF2122/97
cacgcugaauuccacugcgc

SEQ ID NO: 1118992 - RNA, 23 nt, Mycobacterium bovis subsp bovis AF2122/97
cacgcugaauuccacugcgccac

SEQ ID NO: 1118993 - RNA, 22 nt, Mycobacterium bovis subsp bovis AF2122/97
cacgcugaccggaucugacggc

SEQ ID NO: 1118994 - RNA, 13 nt, Mycobacterium bovis subsp bovis AF2122/97
cacgcugucgauc

SEQ ID NO: 1118995 - RNA, 12 nt, Mycobacterium bovis subsp bovis AF2122/97
cacgcugugcgg

SEQ ID NO: 1118996 - RNA, 15 nt, Mycobacterium bovis subsp bovis AF2122/97
cacgcugucgaucug

SEQ ID NO: 1118997 - RNA, 14 nt, Mycobacterium bovis subsp bovis AF2122/97
cacgcuggcgcccc

SEQ ID NO: 1118998 - RNA, 17 nt, Mycobacterium bovis subsp bovis AF2122/97
cacgcugugcgguaucg

SEQ ID NO: 1118999 - RNA, 22 nt, Mycobacterium bovis subsp bovis AF2122/97
cacgcugugcgguaucggucag

SEQ ID NO: 1119000 - RNA, 15 nt, Mycobacterium bovis subsp bovis AF2122/97
cacgcugugcucgac

SEQ ID NO: 1119001 - RNA, 16 nt, Mycobacterium bovis subsp bovis AF2122/97
cacgcugucgaucuga

SEQ ID NO: 1119002 - RNA, 22 nt, Mycobacterium bovis subsp bovis AF2122/97
cacgcugugcucgacgaagauc

SEQ ID NO: 1119003 - RNA, 19 nt, Mycobacterium bovis subsp bovis AF2122/97
cacggcagccuugaucucg

SEQ ID NO: 1119004 - RNA, 20 nt, Mycobacterium bovis subsp bovis AF2122/97
cacggcagccaaccggcgca

SEQ ID NO: 1119005 - RNA, 13 nt, Mycobacterium bovis subsp bovis AF2122/97
cacggcagcgccg

SEQ ID NO: 1119006 - RNA, 17 nt, Mycobacterium bovis subsp bovis AF2122/97
cacggcagcgccggucg

SEQ ID NO: 1119007 - RNA, 14 nt, Mycobacterium bovis subsp bovis AF2122/97
cacggaccgccacc

SEQ ID NO: 1119008 - RNA, 16 nt, Mycobacterium bovis subsp bovis AF2122/97
cacggagaccggccgg

SEQ ID NO: 1119009 - RNA, 21 nt, Mycobacterium bovis subsp bovis AF2122/97
cacggagaccggccgggugaa

SEQ ID NO: 1119010 - RNA, 20 nt, Mycobacterium bovis subsp bovis AF2122/97
cacggcaggcggugaacacc

SEQ ID NO: 1119011 - RNA, 16 nt, Mycobacterium bovis subsp bovis AF2122/97
cacggcaucggccacc

SEQ ID NO: 1119012 - RNA, 21 nt, Mycobacterium bovis subsp bovis AF2122/97
cacggaccagcgccggaccgu

SEQ ID NO: 1119013 - RNA, 16 nt, Mycobacterium bovis subsp bovis AF2122/97
cacggaaggcccggcg

SEQ ID NO: 1119014 - RNA, 22 nt, Mycobacterium bovis subsp bovis AF2122/97
cacggaaggcccggcgcggccg

SEQ ID NO: 1119015 - RNA, 20 nt, Mycobacterium bovis subsp bovis AF2122/97
cacggaaguaucgccggccg

SEQ ID NO: 1119016 - RNA, 22 nt, Mycobacterium bovis subsp bovis AF2122/97
cacggaaguaucgccggccgcg

SEQ ID NO: 1119017 - RNA, 21 nt, Mycobacterium bovis subsp bovis AF2122/97
cacgcuucuuccgcgcgccgg

SEQ ID NO: 1119018 - RNA, 14 nt, Mycobacterium bovis subsp bovis AF2122/97
cacgcuguucccga

SEQ ID NO: 1119019 - RNA, 15 nt, Mycobacterium bovis subsp bovis AF2122/97
cacgggcacgaucgu

SEQ ID NO: 1119020 - RNA, 13 nt, Mycobacterium bovis subsp bovis AF2122/97
cacgggcagcuuc

SEQ ID NO: 1119021 - RNA, 23 nt, Mycobacterium bovis subsp bovis AF2122/97
cacgggcagcuucaaugucggug

SEQ ID NO: 1119022 - RNA, 20 nt, Mycobacterium bovis subsp bovis AF2122/97
cacgggaguacgggagccgg

SEQ ID NO: 1119023 - RNA, 22 nt, Mycobacterium bovis subsp bovis AF2122/97
cacgggaucgaucugcggaggc

SEQ ID NO: 1119024 - RNA, 14 nt, Mycobacterium bovis subsp bovis AF2122/97
cacgggaucugcgg

SEQ ID NO: 1119025 - RNA, 18 nt, Mycobacterium bovis subsp bovis AF2122/97
cacgggaucugcggaggc

SEQ ID NO: 1119026 - RNA, 20 nt, Mycobacterium bovis subsp bovis AF2122/97
cacgggaucugcggaggcga

SEQ ID NO: 1119027 - RNA, 18 nt, Mycobacterium bovis subsp bovis AF2122/97
cacggcuuuucgacgcug

SEQ ID NO: 1119028 - RNA, 22 nt, Mycobacterium bovis subsp bovis AF2122/97
cacggcuuuucgacgcuguggc

SEQ ID NO: 1119029 - RNA, 15 nt, Mycobacterium bovis subsp bovis AF2122/97
cacgggacgacggca

SEQ ID NO: 1119030 - RNA, 16 nt, Mycobacterium bovis subsp bovis AF2122/97
cacggcgaggugcucg

SEQ ID NO: 1119031 - RNA, 19 nt, Mycobacterium bovis subsp bovis AF2122/97
cacggcgaggugcucggau

SEQ ID NO: 1119032 - RNA, 21 nt, Mycobacterium bovis subsp bovis AF2122/97
cacggcuucgcgguuggcggc

SEQ ID NO: 1119033 - RNA, 20 nt, Mycobacterium bovis subsp bovis AF2122/97
cacggcuucggcgagcgcau

SEQ ID NO: 1119034 - RNA, 21 nt, Mycobacterium bovis subsp bovis AF2122/97
cacggcuucggcgagcgcauc

SEQ ID NO: 1119035 - RNA, 13 nt, Mycobacterium bovis subsp bovis AF2122/97
cacgggccggccg

SEQ ID NO: 1119036 - RNA, 14 nt, Mycobacterium bovis subsp bovis AF2122/97
cacgggccggccga

SEQ ID NO: 1119037 - RNA, 15 nt, Mycobacterium bovis subsp bovis AF2122/97
cacgggcggccaugg

SEQ ID NO: 1119038 - RNA, 16 nt, Mycobacterium bovis subsp bovis AF2122/97
cacggucaacgugaug

SEQ ID NO: 1119039 - RNA, 18 nt, Mycobacterium bovis subsp bovis AF2122/97
cacggucaagccggcgcc

SEQ ID NO: 1119040 - RNA, 19 nt, Mycobacterium bovis subsp bovis AF2122/97
cacggucaagccggcgccc

SEQ ID NO: 1119041 - RNA, 22 nt, Mycobacterium bovis subsp bovis AF2122/97
cacggcuucggcgagcgcaucg

SEQ ID NO: 1119042 - RNA, 19 nt, Mycobacterium bovis subsp bovis AF2122/97
cacggucaauugugcggcc

SEQ ID NO: 1119043 - RNA, 16 nt, Mycobacterium bovis subsp bovis AF2122/97
cacggucacacgccag

SEQ ID NO: 1119044 - RNA, 22 nt, Mycobacterium bovis subsp bovis AF2122/97
cacggucagcucgcugacggca

SEQ ID NO: 1119045 - RNA, 20 nt, Mycobacterium bovis subsp bovis AF2122/97
cacggucacacgccagccgg

SEQ ID NO: 1119046 - RNA, 19 nt, Mycobacterium bovis subsp bovis AF2122/97
cacggcgacgaucucggcg

SEQ ID NO: 1119047 - RNA, 23 nt, Mycobacterium bovis subsp bovis AF2122/97
cacggcgacgaucucggcggccg

SEQ ID NO: 1119048 - RNA, 14 nt, Mycobacterium bovis subsp bovis AF2122/97
cacggcgacgccag

SEQ ID NO: 1119049 - RNA, 16 nt, Mycobacterium bovis subsp bovis AF2122/97
cacggcgaccacgccg

SEQ ID NO: 1119050 - RNA, 16 nt, Mycobacterium bovis subsp bovis AF2122/97
cacggcgaggccgaac

SEQ ID NO: 1119051 - RNA, 14 nt, Mycobacterium bovis subsp bovis AF2122/97
cacggcgaaccggc

SEQ ID NO: 1119052 - RNA, 20 nt, Mycobacterium bovis subsp bovis AF2122/97
cacggcgaaccggcccaccg

SEQ ID NO: 1119053 - RNA, 21 nt, Mycobacterium bovis subsp bovis AF2122/97
cacggccagaaacccggcgac

SEQ ID NO: 1119054 - RNA, 13 nt, Mycobacterium bovis subsp bovis AF2122/97
cacggccagcggg

SEQ ID NO: 1119055 - RNA, 14 nt, Mycobacterium bovis subsp bovis AF2122/97
cacggccaccgcgc

SEQ ID NO: 1119056 - RNA, 14 nt, Mycobacterium bovis subsp bovis AF2122/97
cacguagcagcgcc

SEQ ID NO: 1119057 - RNA, 17 nt, Mycobacterium bovis subsp bovis AF2122/97
cacguaguagccgagca

SEQ ID NO: 1119058 - RNA, 17 nt, Mycobacterium bovis subsp bovis AF2122/97
cacgucaaacaacgcaa

SEQ ID NO: 1119059 - RNA, 19 nt, Mycobacterium bovis subsp bovis AF2122/97
cacgucaucggcuggccgc

SEQ ID NO: 1119060 - RNA, 15 nt, Mycobacterium bovis subsp bovis AF2122/97
cacgucaucuggcgc

SEQ ID NO: 1119061 - RNA, 18 nt, Mycobacterium bovis subsp bovis AF2122/97
cacgucaucggcuggccg

SEQ ID NO: 1119062 - RNA, 23 nt, Mycobacterium bovis subsp bovis AF2122/97
cacguagcagcagacgacgauca

SEQ ID NO: 1119063 - RNA, 15 nt, Mycobacterium bovis subsp bovis AF2122/97
cacguagcgaccgcg

SEQ ID NO: 1119064 - RNA, 20 nt, Mycobacterium bovis subsp bovis AF2122/97
cacguagcgaccgcggucgc

SEQ ID NO: 1119065 - RNA, 21 nt, Mycobacterium bovis subsp bovis AF2122/97
cacguacuuggacgacccggg

SEQ ID NO: 1119066 - RNA, 14 nt, Mycobacterium bovis subsp bovis AF2122/97
cacguacgccgccg

SEQ ID NO: 1119067 - RNA, 15 nt, Mycobacterium bovis subsp bovis AF2122/97
cacguacgccgccga

SEQ ID NO: 1119068 - RNA, 17 nt, Mycobacterium bovis subsp bovis AF2122/97
cacguacgcgauuucga

SEQ ID NO: 1119069 - RNA, 22 nt, Mycobacterium bovis subsp bovis AF2122/97
cacguagaaguaggcggcgacg

SEQ ID NO: 1119070 - RNA, 23 nt, Mycobacterium bovis subsp bovis AF2122/97
cacggucugccacgaggcaucgu

SEQ ID NO: 1119071 - RNA, 16 nt, Mycobacterium bovis subsp bovis AF2122/97
cacgguucgggcagca

SEQ ID NO: 1119072 - RNA, 13 nt, Mycobacterium bovis subsp bovis AF2122/97
cacggucgccgac

SEQ ID NO: 1119073 - RNA, 14 nt, Mycobacterium bovis subsp bovis AF2122/97
cacggucgccgacc

SEQ ID NO: 1119074 - RNA, 18 nt, Mycobacterium bovis subsp bovis AF2122/97
cacggucaggcguagguc

SEQ ID NO: 1119075 - RNA, 19 nt, Mycobacterium bovis subsp bovis AF2122/97
cacggucaugccgccgccg

SEQ ID NO: 1119076 - RNA, 17 nt, Mycobacterium bovis subsp bovis AF2122/97
cacgguccacgguggcg

SEQ ID NO: 1119077 - RNA, 19 nt, Mycobacterium bovis subsp bovis AF2122/97
cacgguccacgguggcgcc

SEQ ID NO: 1119078 - RNA, 24 nt, Mycobacterium bovis subsp bovis AF2122/97
cacgguccacgguggcgccgaacg

SEQ ID NO: 1119079 - RNA, 12 nt, Mycobacterium bovis subsp bovis AF2122/97
cacggucggcgg

SEQ ID NO: 1119080 - RNA, 14 nt, Mycobacterium bovis subsp bovis AF2122/97
cacgguugccggcg

SEQ ID NO: 1119081 - RNA, 22 nt, Mycobacterium bovis subsp bovis AF2122/97
cacgguuggccaccagcuggcg

SEQ ID NO: 1119082 - RNA, 17 nt, Mycobacterium bovis subsp bovis AF2122/97
cacgguuguuguagauc

SEQ ID NO: 1119083 - RNA, 17 nt, Mycobacterium bovis subsp bovis AF2122/97
cacgguucuuggcgucu

SEQ ID NO: 1119084 - RNA, 15 nt, Mycobacterium bovis subsp bovis AF2122/97
cacgguugccggcgg

SEQ ID NO: 1119085 - RNA, 16 nt, Mycobacterium bovis subsp bovis AF2122/97
cacgguugccggcggc

SEQ ID NO: 1119086 - RNA, 18 nt, Mycobacterium bovis subsp bovis AF2122/97
cacgguugccggcggcga

SEQ ID NO: 1119087 - RNA, 13 nt, Mycobacterium bovis subsp bovis AF2122/97
cacgguuggccac

SEQ ID NO: 1119088 - RNA, 14 nt, Mycobacterium bovis subsp bovis AF2122/97
cacgugcccgcgcg

SEQ ID NO: 1119089 - RNA, 19 nt, Mycobacterium bovis subsp bovis AF2122/97
cacgugcccgcgcggcgca

SEQ ID NO: 1119090 - RNA, 18 nt, Mycobacterium bovis subsp bovis AF2122/97
cacgugggccaacgacgc

SEQ ID NO: 1119091 - RNA, 16 nt, Mycobacterium bovis subsp bovis AF2122/97
cacgugggccaugcua

SEQ ID NO: 1119092 - RNA, 14 nt, Mycobacterium bovis subsp bovis AF2122/97
cacguggugcggcc

SEQ ID NO: 1119093 - RNA, 14 nt, Mycobacterium bovis subsp bovis AF2122/97
cacguggucggcca

SEQ ID NO: 1119094 - RNA, 19 nt, Mycobacterium bovis subsp bovis AF2122/97
cacgugguccaaccgggcc

SEQ ID NO: 1119095 - RNA, 20 nt, Mycobacterium bovis subsp bovis AF2122/97
cacgugguccaaccgggccg

SEQ ID NO: 1119096 - RNA, 12 nt, Mycobacterium bovis subsp bovis AF2122/97
cacguucggcga

SEQ ID NO: 1119097 - RNA, 14 nt, Mycobacterium bovis subsp bovis AF2122/97
cacguucggcgaug

SEQ ID NO: 1119098 - RNA, 12 nt, Mycobacterium bovis subsp bovis AF2122/97
cacguucggcgc

SEQ ID NO: 1119099 - RNA, 23 nt, Mycobacterium bovis subsp bovis AF2122/97
cacguucggcgcugccaggccgc

SEQ ID NO: 1119100 - RNA, 15 nt, Mycobacterium bovis subsp bovis AF2122/97
cacguucggcugcga

SEQ ID NO: 1119101 - RNA, 13 nt, Mycobacterium bovis subsp bovis AF2122/97
cacguucgcggcc

SEQ ID NO: 1119102 - RNA, 15 nt, Mycobacterium bovis subsp bovis AF2122/97
cacgucgagcagccg

SEQ ID NO: 1119103 - RNA, 17 nt, Mycobacterium bovis subsp bovis AF2122/97
cacgucgagguccacca

SEQ ID NO: 1119104 - RNA, 20 nt, Mycobacterium bovis subsp bovis AF2122/97
cacgucgacggcggccgcca

SEQ ID NO: 1119105 - RNA, 13 nt, Mycobacterium bovis subsp bovis AF2122/97
cacgucgagcacc

SEQ ID NO: 1119106 - RNA, 20 nt, Mycobacterium bovis subsp bovis AF2122/97
cacgucgacccccugccaca

SEQ ID NO: 1119107 - RNA, 18 nt, Mycobacterium bovis subsp bovis AF2122/97
cacgucgaccgaacccga

SEQ ID NO: 1119108 - RNA, 16 nt, Mycobacterium bovis subsp bovis AF2122/97
cacgucgagcacccgc

SEQ ID NO: 1119109 - RNA, 22 nt, Mycobacterium bovis subsp bovis AF2122/97
cacgucgaaaucggugcacaac

SEQ ID NO: 1119110 - RNA, 23 nt, Mycobacterium bovis subsp bovis AF2122/97
cacgucgaacucguugaagaauc

SEQ ID NO: 1119111 - RNA, 19 nt, Mycobacterium bovis subsp bovis AF2122/97
cacguugugcagcgcguca

SEQ ID NO: 1119112 - RNA, 15 nt, Mycobacterium bovis subsp bovis AF2122/97
cacguuguucaccga

SEQ ID NO: 1119113 - RNA, 19 nt, Mycobacterium bovis subsp bovis AF2122/97
cacguugaccgugauauca

SEQ ID NO: 1119114 - RNA, 14 nt, Mycobacterium bovis subsp bovis AF2122/97
cacguugcgcugga

SEQ ID NO: 1119115 - RNA, 17 nt, Mycobacterium bovis subsp bovis AF2122/97
cacguuuagggugcccg

SEQ ID NO: 1119116 - RNA, 16 nt, Mycobacterium bovis subsp bovis AF2122/97
cacguuucacgugguc

SEQ ID NO: 1119117 - RNA, 16 nt, Mycobacterium bovis subsp bovis AF2122/97
cacguugauccgcgca

SEQ ID NO: 1119118 - RNA, 14 nt, Mycobacterium bovis subsp bovis AF2122/97
cacguugauucggg

SEQ ID NO: 1119119 - RNA, 23 nt, Mycobacterium bovis subsp bovis AF2122/97
cacguugccgaucccggcgagca

SEQ ID NO: 1119120 - RNA, 16 nt, Mycobacterium bovis subsp bovis AF2122/97
cacguuguccgcgacg

SEQ ID NO: 1119121 - RNA, 20 nt, Mycobacterium bovis subsp bovis AF2122/97
cacuaaccuggcguagauca

SEQ ID NO: 1119122 - RNA, 20 nt, Mycobacterium bovis subsp bovis AF2122/97
cacuaccccacaagcgaugg

SEQ ID NO: 1119123 - RNA, 16 nt, Mycobacterium bovis subsp bovis AF2122/97
cacuaccgccgcgacc

SEQ ID NO: 1119124 - RNA, 16 nt, Mycobacterium bovis subsp bovis AF2122/97
cacuagcccugagcga

SEQ ID NO: 1119125 - RNA, 22 nt, Mycobacterium bovis subsp bovis AF2122/97
cacuagcgagccggcgccgggu

SEQ ID NO: 1119126 - RNA, 22 nt, Mycobacterium bovis subsp bovis AF2122/97
cacucaaccugaaccggccgcg

SEQ ID NO: 1119127 - RNA, 14 nt, Mycobacterium bovis subsp bovis AF2122/97
cacucacauccugg

SEQ ID NO: 1119128 - RNA, 18 nt, Mycobacterium bovis subsp bovis AF2122/97
cacucacauuggccaggu

SEQ ID NO: 1119129 - RNA, 18 nt, Mycobacterium bovis subsp bovis AF2122/97
cacucacgggugcuggca

SEQ ID NO: 1119130 - RNA, 22 nt, Mycobacterium bovis subsp bovis AF2122/97
cacucaggaucccgguggcagc

SEQ ID NO: 1119131 - RNA, 23 nt, Mycobacterium bovis subsp bovis AF2122/97
cacucagguacggcgggcggccg

SEQ ID NO: 1119132 - RNA, 13 nt, Mycobacterium bovis subsp bovis AF2122/97
cagaccgugacgu

SEQ ID NO: 1119133 - RNA, 14 nt, Mycobacterium bovis subsp bovis AF2122/97
cagaccguagcggc

SEQ ID NO: 1119134 - RNA, 21 nt, Mycobacterium bovis subsp bovis AF2122/97
cagaccguccagcaacagcga

SEQ ID NO: 1119135 - RNA, 16 nt, Mycobacterium bovis subsp bovis AF2122/97
cagaccggugcugucg

SEQ ID NO: 1119136 - RNA, 16 nt, Mycobacterium bovis subsp bovis AF2122/97
cagaccgggcaccaga

SEQ ID NO: 1119137 - RNA, 17 nt, Mycobacterium bovis subsp bovis AF2122/97
cagaccggcucgucggg

SEQ ID NO: 1119138 - RNA, 16 nt, Mycobacterium bovis subsp bovis AF2122/97
cagaccggcgccguag

SEQ ID NO: 1119139 - RNA, 20 nt, Mycobacterium bovis subsp bovis AF2122/97
cagaccggcgccguagccga

SEQ ID NO: 1119140 - RNA, 14 nt, Mycobacterium bovis subsp bovis AF2122/97
cagaccggcaucga

SEQ ID NO: 1119141 - RNA, 24 nt, Mycobacterium bovis subsp bovis AF2122/97
cagaccggccacccacauggcggc

SEQ ID NO: 1119142 - RNA, 16 nt, Mycobacterium bovis subsp bovis AF2122/97
cagaccggccgacgug

SEQ ID NO: 1119143 - RNA, 17 nt, Mycobacterium bovis subsp bovis AF2122/97
cagaccgccaccggcug

SEQ ID NO: 1119144 - RNA, 13 nt, Mycobacterium bovis subsp bovis AF2122/97
cagaccgccgacg

SEQ ID NO: 1119145 - RNA, 19 nt, Mycobacterium bovis subsp bovis AF2122/97
cagaccgccgacgccguug

SEQ ID NO: 1119146 - RNA, 14 nt, Mycobacterium bovis subsp bovis AF2122/97
cagacgauggccag

SEQ ID NO: 1119147 - RNA, 18 nt, Mycobacterium bovis subsp bovis AF2122/97
cagacgauggccagguug

SEQ ID NO: 1119148 - RNA, 18 nt, Mycobacterium bovis subsp bovis AF2122/97
cagacgaaguagccgacc

SEQ ID NO: 1119149 - RNA, 19 nt, Mycobacterium bovis subsp bovis AF2122/97
cagacgaaguagccgacca

SEQ ID NO: 1119150 - RNA, 16 nt, Mycobacterium bovis subsp bovis AF2122/97
cagacgacgaucgcgu

SEQ ID NO: 1119151 - RNA, 18 nt, Mycobacterium bovis subsp bovis AF2122/97
cagacgacgaucgcgucg

SEQ ID NO: 1119152 - RNA, 20 nt, Mycobacterium bovis subsp bovis AF2122/97
cagacgcaaaaucgcacggu

SEQ ID NO: 1119153 - RNA, 20 nt, Mycobacterium bovis subsp bovis AF2122/97
cagacgcaaaaucgcccaau

SEQ ID NO: 1119154 - RNA, 19 nt, Mycobacterium bovis subsp bovis AF2122/97
cagacgcaaaagcccccua

SEQ ID NO: 1119155 - RNA, 19 nt, Mycobacterium bovis subsp bovis AF2122/97
cagacgcaaaaucgcccau

SEQ ID NO: 1119156 - RNA, 19 nt, Mycobacterium bovis subsp bovis AF2122/97
cagacgcgaaaucccccga

SEQ ID NO: 1119157 - RNA, 12 nt, Mycobacterium bovis subsp bovis AF2122/97
cagacgccgcgu

SEQ ID NO: 1119158 - RNA, 21 nt, Mycobacterium bovis subsp bovis AF2122/97
cagacgccguagccggccggc

SEQ ID NO: 1119159 - RNA, 23 nt, Mycobacterium bovis subsp bovis AF2122/97
cagacgccacugccagccgugca

SEQ ID NO: 1119160 - RNA, 19 nt, Mycobacterium bovis subsp bovis AF2122/97
cagacgcauaagcccccga

SEQ ID NO: 1119161 - RNA, 17 nt, Mycobacterium bovis subsp bovis AF2122/97
cagacacuggccgucgg

SEQ ID NO: 1119162 - RNA, 18 nt, Mycobacterium bovis subsp bovis AF2122/97
cagacacuggccgucggc

SEQ ID NO: 1119163 - RNA, 16 nt, Mycobacterium bovis subsp bovis AF2122/97
cagacagcaccgccgg

SEQ ID NO: 1119164 - RNA, 14 nt, Mycobacterium bovis subsp bovis AF2122/97
cagacacgaccccg

SEQ ID NO: 1119165 - RNA, 14 nt, Mycobacterium bovis subsp bovis AF2122/97
cagacacagcaccg

SEQ ID NO: 1119166 - RNA, 13 nt, Mycobacterium bovis subsp bovis AF2122/97
cagaccaccgccu

SEQ ID NO: 1119167 - RNA, 15 nt, Mycobacterium bovis subsp bovis AF2122/97
cagaccaccgccugg

SEQ ID NO: 1119168 - RNA, 10 nt, Mycobacterium bovis subsp bovis AF2122/97
cagaccaacg

SEQ ID NO: 1119169 - RNA, 23 nt, Mycobacterium bovis subsp bovis AF2122/97
cagaccaagcccgucgucgugca

SEQ ID NO: 1119170 - RNA, 23 nt, Mycobacterium bovis subsp bovis AF2122/97
cagaccaaggcgaagguccgugc

SEQ ID NO: 1119171 - RNA, 23 nt, Mycobacterium bovis subsp bovis AF2122/97
cagacauggcaagucaacaccgc

SEQ ID NO: 1119172 - RNA, 17 nt, Mycobacterium bovis subsp bovis AF2122/97
cagacaucgcgacgauc

SEQ ID NO: 1119173 - RNA, 17 nt, Mycobacterium bovis subsp bovis AF2122/97
cagacaggcggcggccu

SEQ ID NO: 1119174 - RNA, 19 nt, Mycobacterium bovis subsp bovis AF2122/97
cagacaggcggcggccugg

SEQ ID NO: 1119175 - RNA, 18 nt, Mycobacterium bovis subsp bovis AF2122/97
cagacccguucgccgucg

SEQ ID NO: 1119176 - RNA, 19 nt, Mycobacterium bovis subsp bovis AF2122/97
cagaccgaucggcaggccg

SEQ ID NO: 1119177 - RNA, 20 nt, Mycobacterium bovis subsp bovis AF2122/97
cagaccgaucggcaggccgc

SEQ ID NO: 1119178 - RNA, 16 nt, Mycobacterium bovis subsp bovis AF2122/97
cagacccgguaguccg

SEQ ID NO: 1119179 - RNA, 13 nt, Mycobacterium bovis subsp bovis AF2122/97
cagacccgugccg

SEQ ID NO: 1119180 - RNA, 14 nt, Mycobacterium bovis subsp bovis AF2122/97
cagacccgugccgu

SEQ ID NO: 1119181 - RNA, 16 nt, Mycobacterium bovis subsp bovis AF2122/97
cagacccgugccguca

SEQ ID NO: 1119182 - RNA, 16 nt, Mycobacterium bovis subsp bovis AF2122/97
cagaccauccagguug

SEQ ID NO: 1119183 - RNA, 16 nt, Mycobacterium bovis subsp bovis AF2122/97
cagacccaccaccgca

SEQ ID NO: 1119184 - RNA, 21 nt, Mycobacterium bovis subsp bovis AF2122/97
cagacccaccaccgcaaccaa

SEQ ID NO: 1119185 - RNA, 14 nt, Mycobacterium bovis subsp bovis AF2122/97
cagacccaccaccg

SEQ ID NO: 1119186 - RNA, 16 nt, Mycobacterium bovis subsp bovis AF2122/97
cagacaauccgccgcc

SEQ ID NO: 1119187 - RNA, 18 nt, Mycobacterium bovis subsp bovis AF2122/97
cagacaauccgccgccgg

SEQ ID NO: 1119188 - RNA, 21 nt, Mycobacterium bovis subsp bovis AF2122/97
cagaagcccccaaaccggcgg

SEQ ID NO: 1119189 - RNA, 18 nt, Mycobacterium bovis subsp bovis AF2122/97
cagaacgguggcgcggug

SEQ ID NO: 1119190 - RNA, 16 nt, Mycobacterium bovis subsp bovis AF2122/97
cagaacucaccgacgg

SEQ ID NO: 1119191 - RNA, 14 nt, Mycobacterium bovis subsp bovis AF2122/97
cagaacggcgucga

SEQ ID NO: 1119192 - RNA, 20 nt, Mycobacterium bovis subsp bovis AF2122/97
cagaacgucggugugcgcgc

SEQ ID NO: 1119193 - RNA, 21 nt, Mycobacterium bovis subsp bovis AF2122/97
cagaacgucggugugcgcgcc

SEQ ID NO: 1119194 - RNA, 20 nt, Mycobacterium bovis subsp bovis AF2122/97
cagaacguggccauccucga

SEQ ID NO: 1119195 - RNA, 20 nt, Mycobacterium bovis subsp bovis AF2122/97
cagaacggaauucagcgacg

SEQ ID NO: 1119196 - RNA, 20 nt, Mycobacterium bovis subsp bovis AF2122/97
cagaaacaucgacagcauca

SEQ ID NO: 1119197 - RNA, 15 nt, Mycobacterium bovis subsp bovis AF2122/97
cacucguugccgacc

SEQ ID NO: 1119198 - RNA, 17 nt, Mycobacterium bovis subsp bovis AF2122/97
cacucguugaccggccg

SEQ ID NO: 1119199 - RNA, 13 nt, Mycobacterium bovis subsp bovis AF2122/97
cacuuccgggcga

SEQ ID NO: 1119200 - RNA, 21 nt, Mycobacterium bovis subsp bovis AF2122/97
cacuucggugccgugaucggc

SEQ ID NO: 1119201 - RNA, 20 nt, Mycobacterium bovis subsp bovis AF2122/97
cacuucgcuuucccgucggc

SEQ ID NO: 1119202 - RNA, 22 nt, Mycobacterium bovis subsp bovis AF2122/97
cacuucggugccgugaucggcg

SEQ ID NO: 1119203 - RNA, 21 nt, Mycobacterium bovis subsp bovis AF2122/97
cacuucuuucgaaaugagguc

SEQ ID NO: 1119204 - RNA, 16 nt, Mycobacterium bovis subsp bovis AF2122/97
cacuugcccgucggcg

SEQ ID NO: 1119205 - RNA, 18 nt, Mycobacterium bovis subsp bovis AF2122/97
cacuugcccgucggcgcc

SEQ ID NO: 1119206 - RNA, 20 nt, Mycobacterium bovis subsp bovis AF2122/97
cacuugcccgucggcgcccg

SEQ ID NO: 1119207 - RNA, 22 nt, Mycobacterium bovis subsp bovis AF2122/97
cacucggucguugccgcggucg

SEQ ID NO: 1119208 - RNA, 17 nt, Mycobacterium bovis subsp bovis AF2122/97
cacucggcgguuccggc

SEQ ID NO: 1119209 - RNA, 13 nt, Mycobacterium bovis subsp bovis AF2122/97
cacucggccgggc

SEQ ID NO: 1119210 - RNA, 18 nt, Mycobacterium bovis subsp bovis AF2122/97
cacucgggauucggcagc

SEQ ID NO: 1119211 - RNA, 16 nt, Mycobacterium bovis subsp bovis AF2122/97
cacucggugucggccg

SEQ ID NO: 1119212 - RNA, 18 nt, Mycobacterium bovis subsp bovis AF2122/97
cacucggccacgacgacu

SEQ ID NO: 1119213 - RNA, 17 nt, Mycobacterium bovis subsp bovis AF2122/97
cacuccggagcccacac

SEQ ID NO: 1119214 - RNA, 14 nt, Mycobacterium bovis subsp bovis AF2122/97
cacuccaccgcugg

SEQ ID NO: 1119215 - RNA, 18 nt, Mycobacterium bovis subsp bovis AF2122/97
cacuccagcagcucgccg

SEQ ID NO: 1119216 - RNA, 13 nt, Mycobacterium bovis subsp bovis AF2122/97
cacuccaugaucc

SEQ ID NO: 1119217 - RNA, 17 nt, Mycobacterium bovis subsp bovis AF2122/97
cacuccccagccccacc

SEQ ID NO: 1119218 - RNA, 19 nt, Mycobacterium bovis subsp bovis AF2122/97
cacucccgggugcgacgcg

SEQ ID NO: 1119219 - RNA, 20 nt, Mycobacterium bovis subsp bovis AF2122/97
cagacggguggcccgaccgg

SEQ ID NO: 1119220 - RNA, 17 nt, Mycobacterium bovis subsp bovis AF2122/97
cagacggggucgcccgg

SEQ ID NO: 1119221 - RNA, 20 nt, Mycobacterium bovis subsp bovis AF2122/97
cagacggcugccacgcgucg

SEQ ID NO: 1119222 - RNA, 14 nt, Mycobacterium bovis subsp bovis AF2122/97
cagacggugcagcu

SEQ ID NO: 1119223 - RNA, 17 nt, Mycobacterium bovis subsp bovis AF2122/97
cagacggucuugauguu

SEQ ID NO: 1119224 - RNA, 13 nt, Mycobacterium bovis subsp bovis AF2122/97
cagacgucaugcg

SEQ ID NO: 1119225 - RNA, 17 nt, Mycobacterium bovis subsp bovis AF2122/97
cagacgcguuucgucga

SEQ ID NO: 1119226 - RNA, 20 nt, Mycobacterium bovis subsp bovis AF2122/97
cagacgcuaaagcccccgca

SEQ ID NO: 1119227 - RNA, 22 nt, Mycobacterium bovis subsp bovis AF2122/97
cagacgcuaaagcccccgcacg

SEQ ID NO: 1119228 - RNA, 20 nt, Mycobacterium bovis subsp bovis AF2122/97
cagacgcggaaucgcaccgu

SEQ ID NO: 1119229 - RNA, 20 nt, Mycobacterium bovis subsp bovis AF2122/97
cagacguaaaagcccccauu

SEQ ID NO: 1119230 - RNA, 21 nt, Mycobacterium bovis subsp bovis AF2122/97
cagacguuccaucacggacca

SEQ ID NO: 1119231 - RNA, 23 nt, Mycobacterium bovis subsp bovis AF2122/97
cagacguuccaucacggaccagg

SEQ ID NO: 1119232 - RNA, 17 nt, Mycobacterium bovis subsp bovis AF2122/97
cagacgugguagccggc

SEQ ID NO: 1119233 - RNA, 19 nt, Mycobacterium bovis subsp bovis AF2122/97
cagacgugguagccggcga

SEQ ID NO: 1119234 - RNA, 14 nt, Mycobacterium bovis subsp bovis AF2122/97
cagacugucgagcg

SEQ ID NO: 1119235 - RNA, 14 nt, Mycobacterium bovis subsp bovis AF2122/97
cagacuccguugcc

SEQ ID NO: 1119236 - RNA, 20 nt, Mycobacterium bovis subsp bovis AF2122/97
cagacucgauaugcagcucg

SEQ ID NO: 1119237 - RNA, 18 nt, Mycobacterium bovis subsp bovis AF2122/97
cagagcguacaggucggc

SEQ ID NO: 1119238 - RNA, 13 nt, Mycobacterium bovis subsp bovis AF2122/97
cagagcgcugguu

SEQ ID NO: 1119239 - RNA, 16 nt, Mycobacterium bovis subsp bovis AF2122/97
cagagcggaaaaucac

SEQ ID NO: 1119240 - RNA, 16 nt, Mycobacterium bovis subsp bovis AF2122/97
cagagccgucaccgac

SEQ ID NO: 1119241 - RNA, 18 nt, Mycobacterium bovis subsp bovis AF2122/97
cagagccgucaccgacug

SEQ ID NO: 1119242 - RNA, 17 nt, Mycobacterium bovis subsp bovis AF2122/97
cagagcgaacccccgcc

SEQ ID NO: 1119243 - RNA, 20 nt, Mycobacterium bovis subsp bovis AF2122/97
cagagcgaacccccgccgcg

SEQ ID NO: 1119244 - RNA, 22 nt, Mycobacterium bovis subsp bovis AF2122/97
cagaggcgcaagaaugccgccg

SEQ ID NO: 1119245 - RNA, 12 nt, Mycobacterium bovis subsp bovis AF2122/97
cagaggcuggcg

SEQ ID NO: 1119246 - RNA, 23 nt, Mycobacterium bovis subsp bovis AF2122/97
cagagccgccguugccgccggcg

SEQ ID NO: 1119247 - RNA, 16 nt, Mycobacterium bovis subsp bovis AF2122/97
cagagccgcgcgccgg

SEQ ID NO: 1119248 - RNA, 21 nt, Mycobacterium bovis subsp bovis AF2122/97
cagagacgaucaucucgucgu

SEQ ID NO: 1119249 - RNA, 20 nt, Mycobacterium bovis subsp bovis AF2122/97
cagagacgaucaucucgucg

SEQ ID NO: 1119250 - RNA, 15 nt, Mycobacterium bovis subsp bovis AF2122/97
cagauccacgccgac

SEQ ID NO: 1119251 - RNA, 16 nt, Mycobacterium bovis subsp bovis AF2122/97
cagauccacgccgacc

SEQ ID NO: 1119252 - RNA, 17 nt, Mycobacterium bovis subsp bovis AF2122/97
cagauccacgccgacca

SEQ ID NO: 1119253 - RNA, 21 nt, Mycobacterium bovis subsp bovis AF2122/97
cagauccagcaacgcggugga

SEQ ID NO: 1119254 - RNA, 15 nt, Mycobacterium bovis subsp bovis AF2122/97
cagagucgcccgcac

SEQ ID NO: 1119255 - RNA, 22 nt, Mycobacterium bovis subsp bovis AF2122/97
cagagucgcacugcgccggccg

SEQ ID NO: 1119256 - RNA, 14 nt, Mycobacterium bovis subsp bovis AF2122/97
cagagugguggcga

SEQ ID NO: 1119257 - RNA, 20 nt, Mycobacterium bovis subsp bovis AF2122/97
cagaguucccgaaacccgau

SEQ ID NO: 1119258 - RNA, 17 nt, Mycobacterium bovis subsp bovis AF2122/97
cagaucgaacgcagcca

SEQ ID NO: 1119259 - RNA, 23 nt, Mycobacterium bovis subsp bovis AF2122/97
cagaucgaacgcagccagcgcca

SEQ ID NO: 1119260 - RNA, 23 nt, Mycobacterium bovis subsp bovis AF2122/97
cagauccgccccguaaucggugg

SEQ ID NO: 1119261 - RNA, 13 nt, Mycobacterium bovis subsp bovis AF2122/97
cagauccgcgauu

SEQ ID NO: 1119262 - RNA, 19 nt, Mycobacterium bovis subsp bovis AF2122/97
cagauccgacgaccgcauu

SEQ ID NO: 1119263 - RNA, 23 nt, Mycobacterium bovis subsp bovis AF2122/97
cagaucccauucguagucguugg

SEQ ID NO: 1119264 - RNA, 15 nt, Mycobacterium bovis subsp bovis AF2122/97
cagaucccgccgcgg

SEQ ID NO: 1119265 - RNA, 14 nt, Mycobacterium bovis subsp bovis AF2122/97
cagaucgcgguccg

SEQ ID NO: 1119266 - RNA, 18 nt, Mycobacterium bovis subsp bovis AF2122/97
cagaucguagugcgcgcc

SEQ ID NO: 1119267 - RNA, 18 nt, Mycobacterium bovis subsp bovis AF2122/97
cagaucggcgacgccguc

SEQ ID NO: 1119268 - RNA, 22 nt, Mycobacterium bovis subsp bovis AF2122/97
cagauugucgacggucaccggc

SEQ ID NO: 1119269 - RNA, 22 nt, Mycobacterium bovis subsp bovis AF2122/97
cagauugccgagcccagguggu

SEQ ID NO: 1119270 - RNA, 20 nt, Mycobacterium bovis subsp bovis AF2122/97
cagauugccugggcggccgg

SEQ ID NO: 1119271 - RNA, 20 nt, Mycobacterium bovis subsp bovis AF2122/97
cagaugccacccagaugcag

SEQ ID NO: 1119272 - RNA, 15 nt, Mycobacterium bovis subsp bovis AF2122/97
cagaugagcgcggcg

SEQ ID NO: 1119273 - RNA, 22 nt, Mycobacterium bovis subsp bovis AF2122/97
cagaugaugccacccucggugu

SEQ ID NO: 1119274 - RNA, 24 nt, Mycobacterium bovis subsp bovis AF2122/97
cagaugcaccucgcccugcagacg

SEQ ID NO: 1119275 - RNA, 13 nt, Mycobacterium bovis subsp bovis AF2122/97
cagaugcaccucg

SEQ ID NO: 1119276 - RNA, 21 nt, Mycobacterium bovis subsp bovis AF2122/97
cagaucgucgggcaccuccaa

SEQ ID NO: 1119277 - RNA, 19 nt, Mycobacterium bovis subsp bovis AF2122/97
cagaucgugcacaaucggu

SEQ ID NO: 1119278 - RNA, 17 nt, Mycobacterium bovis subsp bovis AF2122/97
cagaucguuccaggccg

SEQ ID NO: 1119279 - RNA, 19 nt, Mycobacterium bovis subsp bovis AF2122/97
cagaucggcguuggcauga

SEQ ID NO: 1119280 - RNA, 14 nt, Mycobacterium bovis subsp bovis AF2122/97
cagaucguccaccg

SEQ ID NO: 1119281 - RNA, 17 nt, Mycobacterium bovis subsp bovis AF2122/97
cagaucuccccgaccgc

SEQ ID NO: 1119282 - RNA, 19 nt, Mycobacterium bovis subsp bovis AF2122/97
cagaucguccaccgccgac

SEQ ID NO: 1119283 - RNA, 22 nt, Mycobacterium bovis subsp bovis AF2122/97
cagaucuccccgaccgcgcccg

SEQ ID NO: 1119284 - RNA, 22 nt, Mycobacterium bovis subsp bovis AF2122/97
cagcaacagcgagcgguugauc

SEQ ID NO: 1119285 - RNA, 17 nt, Mycobacterium bovis subsp bovis AF2122/97
cagcaaacaucgcaggc

SEQ ID NO: 1119286 - RNA, 15 nt, Mycobacterium bovis subsp bovis AF2122/97
cagcaaaaaccagcg

SEQ ID NO: 1119287 - RNA, 19 nt, Mycobacterium bovis subsp bovis AF2122/97
caggcccaggucaacgacg

SEQ ID NO: 1119288 - RNA, 14 nt, Mycobacterium bovis subsp bovis AF2122/97
caggcacccuguac

SEQ ID NO: 1119289 - RNA, 23 nt, Mycobacterium bovis subsp bovis AF2122/97
caggcccauacgugccgccgaug

SEQ ID NO: 1119290 - RNA, 19 nt, Mycobacterium bovis subsp bovis AF2122/97
caggcccauacgugccgcc

SEQ ID NO: 1119291 - RNA, 17 nt, Mycobacterium bovis subsp bovis AF2122/97
caggcccacggcgacca

SEQ ID NO: 1119292 - RNA, 15 nt, Mycobacterium bovis subsp bovis AF2122/97
caggcaccggaugau

SEQ ID NO: 1119293 - RNA, 19 nt, Mycobacterium bovis subsp bovis AF2122/97
caggcaccacgaccgacac

SEQ ID NO: 1119294 - RNA, 15 nt, Mycobacterium bovis subsp bovis AF2122/97
caggcaccacgaccg

SEQ ID NO: 1119295 - RNA, 17 nt, Mycobacterium bovis subsp bovis AF2122/97
caggcaccccgaucacc

SEQ ID NO: 1119296 - RNA, 21 nt, Mycobacterium bovis subsp bovis AF2122/97
caggcccgaguuaccggugac

SEQ ID NO: 1119297 - RNA, 21 nt, Mycobacterium bovis subsp bovis AF2122/97
caggcccgccaucauggcggc

SEQ ID NO: 1119298 - RNA, 23 nt, Mycobacterium bovis subsp bovis AF2122/97
caggcccaucucgggcaggccgu

SEQ ID NO: 1119299 - RNA, 18 nt, Mycobacterium bovis subsp bovis AF2122/97
caggccccggugccgacc

SEQ ID NO: 1119300 - RNA, 16 nt, Mycobacterium bovis subsp bovis AF2122/97
caggcccgggcggaug

SEQ ID NO: 1119301 - RNA, 23 nt, Mycobacterium bovis subsp bovis AF2122/97
caggccgacaaugucggcgaugc

SEQ ID NO: 1119302 - RNA, 14 nt, Mycobacterium bovis subsp bovis AF2122/97
caggcccucgggac

SEQ ID NO: 1119303 - RNA, 22 nt, Mycobacterium bovis subsp bovis AF2122/97
caggcccucgggacugcgcggc

SEQ ID NO: 1119304 - RNA, 23 nt, Mycobacterium bovis subsp bovis AF2122/97
caggcccucgggacugcgcggcu

SEQ ID NO: 1119305 - RNA, 16 nt, Mycobacterium bovis subsp bovis AF2122/97
caggcccgguggcggc

SEQ ID NO: 1119306 - RNA, 18 nt, Mycobacterium bovis subsp bovis AF2122/97
caggcccgguggcggcuc

SEQ ID NO: 1119307 - RNA, 18 nt, Mycobacterium bovis subsp bovis AF2122/97
caggcccgugccuggccg

SEQ ID NO: 1119308 - RNA, 15 nt, Mycobacterium bovis subsp bovis AF2122/97
caggccggcggcggc

SEQ ID NO: 1119309 - RNA, 14 nt, Mycobacterium bovis subsp bovis AF2122/97
caggccggcgucga

SEQ ID NO: 1119310 - RNA, 18 nt, Mycobacterium bovis subsp bovis AF2122/97
caggccggcucgccgacc

SEQ ID NO: 1119311 - RNA, 14 nt, Mycobacterium bovis subsp bovis AF2122/97
caggccgggcgcaa

SEQ ID NO: 1119312 - RNA, 15 nt, Mycobacterium bovis subsp bovis AF2122/97
caggccgaccgcgca

SEQ ID NO: 1119313 - RNA, 14 nt, Mycobacterium bovis subsp bovis AF2122/97
caggccgagcccgg

SEQ ID NO: 1119314 - RNA, 18 nt, Mycobacterium bovis subsp bovis AF2122/97
caggccgagcccggugcu

SEQ ID NO: 1119315 - RNA, 14 nt, Mycobacterium bovis subsp bovis AF2122/97
caggccgagccgcc

SEQ ID NO: 1119316 - RNA, 17 nt, Mycobacterium bovis subsp bovis AF2122/97
caggccgacgucgacca

SEQ ID NO: 1119317 - RNA, 15 nt, Mycobacterium bovis subsp bovis AF2122/97
caggccgagcucguu

SEQ ID NO: 1119318 - RNA, 18 nt, Mycobacterium bovis subsp bovis AF2122/97
caggccggccgcgaucca

SEQ ID NO: 1119319 - RNA, 14 nt, Mycobacterium bovis subsp bovis AF2122/97
caggccggcaaggc

SEQ ID NO: 1119320 - RNA, 15 nt, Mycobacterium bovis subsp bovis AF2122/97
caggccggccaccag

SEQ ID NO: 1119321 - RNA, 14 nt, Mycobacterium bovis subsp bovis AF2122/97
caggcgcuuggccg

SEQ ID NO: 1119322 - RNA, 16 nt, Mycobacterium bovis subsp bovis AF2122/97
caggcggccagcaucg

SEQ ID NO: 1119323 - RNA, 21 nt, Mycobacterium bovis subsp bovis AF2122/97
caggcggcgcgggucggcgac

SEQ ID NO: 1119324 - RNA, 14 nt, Mycobacterium bovis subsp bovis AF2122/97
caggcggcggaccc

SEQ ID NO: 1119325 - RNA, 15 nt, Mycobacterium bovis subsp bovis AF2122/97
caggcggcggacccg

SEQ ID NO: 1119326 - RNA, 19 nt, Mycobacterium bovis subsp bovis AF2122/97
caggcggcggacccgcucg

SEQ ID NO: 1119327 - RNA, 17 nt, Mycobacterium bovis subsp bovis AF2122/97
caggcggccgcgucguc

SEQ ID NO: 1119328 - RNA, 16 nt, Mycobacterium bovis subsp bovis AF2122/97
caggcggccgagcugg

SEQ ID NO: 1119329 - RNA, 14 nt, Mycobacterium bovis subsp bovis AF2122/97
caggcggccgccag

SEQ ID NO: 1119330 - RNA, 14 nt, Mycobacterium bovis subsp bovis AF2122/97
caggcggccgucgu

SEQ ID NO: 1119331 - RNA, 15 nt, Mycobacterium bovis subsp bovis AF2122/97
caggcggcuggcccg

SEQ ID NO: 1119332 - RNA, 20 nt, Mycobacterium bovis subsp bovis AF2122/97
caggcggcuggcccgcaugc

SEQ ID NO: 1119333 - RNA, 22 nt, Mycobacterium bovis subsp bovis AF2122/97
caggcggcugaacggcagccga

SEQ ID NO: 1119334 - RNA, 20 nt, Mycobacterium bovis subsp bovis AF2122/97
caggcggccgucgucggcca

SEQ ID NO: 1119335 - RNA, 22 nt, Mycobacterium bovis subsp bovis AF2122/97
caggcggcggccuggcacccgg

SEQ ID NO: 1119336 - RNA, 15 nt, Mycobacterium bovis subsp bovis AF2122/97
caggcgccgucucgc

SEQ ID NO: 1119337 - RNA, 11 nt, Mycobacterium bovis subsp bovis AF2122/97
caggcgcgacg

SEQ ID NO: 1119338 - RNA, 19 nt, Mycobacterium bovis subsp bovis AF2122/97
caggcgcgacguagacgac

SEQ ID NO: 1119339 - RNA, 16 nt, Mycobacterium bovis subsp bovis AF2122/97
caggcgcucagcgcgg

SEQ ID NO: 1119340 - RNA, 17 nt, Mycobacterium bovis subsp bovis AF2122/97
caggcgcucagcgcggc

SEQ ID NO: 1119341 - RNA, 19 nt, Mycobacterium bovis subsp bovis AF2122/97
caggcgcucagcgcggcca

SEQ ID NO: 1119342 - RNA, 23 nt, Mycobacterium bovis subsp bovis AF2122/97
caggcgcucaucacccagcgccg

SEQ ID NO: 1119343 - RNA, 14 nt, Mycobacterium bovis subsp bovis AF2122/97
caggcgcugcagca

SEQ ID NO: 1119344 - RNA, 13 nt, Mycobacterium bovis subsp bovis AF2122/97
caggcgcugccgg

SEQ ID NO: 1119345 - RNA, 17 nt, Mycobacterium bovis subsp bovis AF2122/97
caggccguaguggccgg

SEQ ID NO: 1119346 - RNA, 15 nt, Mycobacterium bovis subsp bovis AF2122/97
caggccgucaccgac

SEQ ID NO: 1119347 - RNA, 17 nt, Mycobacterium bovis subsp bovis AF2122/97
caggccgucaccgacgc

SEQ ID NO: 1119348 - RNA, 17 nt, Mycobacterium bovis subsp bovis AF2122/97
caggccgucaggcgugc

SEQ ID NO: 1119349 - RNA, 19 nt, Mycobacterium bovis subsp bovis AF2122/97
caggccguagcccacgacg

SEQ ID NO: 1119350 - RNA, 17 nt, Mycobacterium bovis subsp bovis AF2122/97
caggccggugugcgggc

SEQ ID NO: 1119351 - RNA, 21 nt, Mycobacterium bovis subsp bovis AF2122/97
caggccgucgaguuccggccg

SEQ ID NO: 1119352 - RNA, 22 nt, Mycobacterium bovis subsp bovis AF2122/97
caggccgucgaguuccggccgg

SEQ ID NO: 1119353 - RNA, 14 nt, Mycobacterium bovis subsp bovis AF2122/97
caggccgucgccgg

SEQ ID NO: 1119354 - RNA, 13 nt, Mycobacterium bovis subsp bovis AF2122/97
caggccgucgcgc

SEQ ID NO: 1119355 - RNA, 20 nt, Mycobacterium bovis subsp bovis AF2122/97
caggccgucguugccggcga

SEQ ID NO: 1119356 - RNA, 23 nt, Mycobacterium bovis subsp bovis AF2122/97
caggccgucguugccggcgacca

SEQ ID NO: 1119357 - RNA, 14 nt, Mycobacterium bovis subsp bovis AF2122/97
caggccguggcacc

SEQ ID NO: 1119358 - RNA, 19 nt, Mycobacterium bovis subsp bovis AF2122/97
caggccguguacgugcucg

SEQ ID NO: 1119359 - RNA, 17 nt, Mycobacterium bovis subsp bovis AF2122/97
caggccguggcggacgg

SEQ ID NO: 1119360 - RNA, 23 nt, Mycobacterium bovis subsp bovis AF2122/97
caggccguggcggacggcgucga

SEQ ID NO: 1119361 - RNA, 15 nt, Mycobacterium bovis subsp bovis AF2122/97
caggcgccacccgaa

SEQ ID NO: 1119362 - RNA, 16 nt, Mycobacterium bovis subsp bovis AF2122/97
caggcgccacccgaau

SEQ ID NO: 1119363 - RNA, 23 nt, Mycobacterium bovis subsp bovis AF2122/97
caggcgacggcccucgagcagcg

SEQ ID NO: 1119364 - RNA, 18 nt, Mycobacterium bovis subsp bovis AF2122/97
caggcgagccggcgcgca

SEQ ID NO: 1119365 - RNA, 18 nt, Mycobacterium bovis subsp bovis AF2122/97
caggcgaucuggccgaac

SEQ ID NO: 1119366 - RNA, 23 nt, Mycobacterium bovis subsp bovis AF2122/97
caggcgaguuaggccgccagccg

SEQ ID NO: 1119367 - RNA, 19 nt, Mycobacterium bovis subsp bovis AF2122/97
caggcgagugaacucgucc

SEQ ID NO: 1119368 - RNA, 19 nt, Mycobacterium bovis subsp bovis AF2122/97
caggcgaucgcccggcccc

SEQ ID NO: 1119369 - RNA, 16 nt, Mycobacterium bovis subsp bovis AF2122/97
caggcgggcggcaccg

SEQ ID NO: 1119370 - RNA, 17 nt, Mycobacterium bovis subsp bovis AF2122/97
caggcgggcggcaccga

SEQ ID NO: 1119371 - RNA, 16 nt, Mycobacterium bovis subsp bovis AF2122/97
caggcgggggaucggu

SEQ ID NO: 1119372 - RNA, 17 nt, Mycobacterium bovis subsp bovis AF2122/97
caggcgggggaucggug

SEQ ID NO: 1119373 - RNA, 22 nt, Mycobacterium bovis subsp bovis AF2122/97
caggcgggggaucggugguacg

SEQ ID NO: 1119374 - RNA, 16 nt, Mycobacterium bovis subsp bovis AF2122/97
caggcgggggaucucg

SEQ ID NO: 1119375 - RNA, 22 nt, Mycobacterium bovis subsp bovis AF2122/97
caggcgggggaucucgagccgc

SEQ ID NO: 1119376 - RNA, 15 nt, Mycobacterium bovis subsp bovis AF2122/97
caggcgggaacgauc

SEQ ID NO: 1119377 - RNA, 18 nt, Mycobacterium bovis subsp bovis AF2122/97
caggcgggaacgaucgau

SEQ ID NO: 1119378 - RNA, 18 nt, Mycobacterium bovis subsp bovis AF2122/97
caggcgggacaaccgggc

SEQ ID NO: 1119379 - RNA, 19 nt, Mycobacterium bovis subsp bovis AF2122/97
caggcgggacaaccgggcg

SEQ ID NO: 1119380 - RNA, 14 nt, Mycobacterium bovis subsp bovis AF2122/97
caggcgggagcgga

SEQ ID NO: 1119381 - RNA, 20 nt, Mycobacterium bovis subsp bovis AF2122/97
caggcgguacgggucgccgg

SEQ ID NO: 1119382 - RNA, 18 nt, Mycobacterium bovis subsp bovis AF2122/97
caggcuaauagcucgccg

SEQ ID NO: 1119383 - RNA, 19 nt, Mycobacterium bovis subsp bovis AF2122/97
caggcgugucgucgcggcc

SEQ ID NO: 1119384 - RNA, 19 nt, Mycobacterium bovis subsp bovis AF2122/97
caggcgugcuugaccgccu

SEQ ID NO: 1119385 - RNA, 21 nt, Mycobacterium bovis subsp bovis AF2122/97
caggcgugcuugaccgccugg

SEQ ID NO: 1119386 - RNA, 20 nt, Mycobacterium bovis subsp bovis AF2122/97
caggcgucccagccgaucac

SEQ ID NO: 1119387 - RNA, 13 nt, Mycobacterium bovis subsp bovis AF2122/97
caggcgucccgcc

SEQ ID NO: 1119388 - RNA, 17 nt, Mycobacterium bovis subsp bovis AF2122/97
caggcugcagucgagca

SEQ ID NO: 1119389 - RNA, 18 nt, Mycobacterium bovis subsp bovis AF2122/97
caggcuggcgagggcuga

SEQ ID NO: 1119390 - RNA, 14 nt, Mycobacterium bovis subsp bovis AF2122/97
caggcuggcgaugg

SEQ ID NO: 1119391 - RNA, 15 nt, Mycobacterium bovis subsp bovis AF2122/97
caggcucgggcaagg

SEQ ID NO: 1119392 - RNA, 22 nt, Mycobacterium bovis subsp bovis AF2122/97
caggcucgggcaaggccaccgg

SEQ ID NO: 1119393 - RNA, 23 nt, Mycobacterium bovis subsp bovis AF2122/97
caggcugaaggacggcagcuugg

SEQ ID NO: 1119394 - RNA, 18 nt, Mycobacterium bovis subsp bovis AF2122/97
caggcucauccgccgggc

SEQ ID NO: 1119395 - RNA, 17 nt, Mycobacterium bovis subsp bovis AF2122/97
caggcucgccgaugcug

SEQ ID NO: 1119396 - RNA, 12 nt, Mycobacterium bovis subsp bovis AF2122/97
caggcucaccga

SEQ ID NO: 1119397 - RNA, 18 nt, Mycobacterium bovis subsp bovis AF2122/97
caggcuaguugccaacac

SEQ ID NO: 1119398 - RNA, 20 nt, Mycobacterium bovis subsp bovis AF2122/97
caggcuauggugccggugau

SEQ ID NO: 1119399 - RNA, 22 nt, Mycobacterium bovis subsp bovis AF2122/97
caggcuauggugccggugaugg

SEQ ID NO: 1119400 - RNA, 22 nt, Mycobacterium bovis subsp bovis AF2122/97
caggcucacacucggccgggcu

SEQ ID NO: 1119401 - RNA, 16 nt, Mycobacterium bovis subsp bovis AF2122/97
cagggcgacggccaca

SEQ ID NO: 1119402 - RNA, 16 nt, Mycobacterium bovis subsp bovis AF2122/97
cagggccuuggcaggu

SEQ ID NO: 1119403 - RNA, 16 nt, Mycobacterium bovis subsp bovis AF2122/97
cagggcgguggccacc

SEQ ID NO: 1119404 - RNA, 19 nt, Mycobacterium bovis subsp bovis AF2122/97
cagggcgguggccacccgg

SEQ ID NO: 1119405 - RNA, 22 nt, Mycobacterium bovis subsp bovis AF2122/97
cagggcgguggccacccggccg

SEQ ID NO: 1119406 - RNA, 18 nt, Mycobacterium bovis subsp bovis AF2122/97
cagggcggugcucuucgg

SEQ ID NO: 1119407 - RNA, 17 nt, Mycobacterium bovis subsp bovis AF2122/97
cagggcgucgaccgcgg

SEQ ID NO: 1119408 - RNA, 19 nt, Mycobacterium bovis subsp bovis AF2122/97
cagggcgucggcgacgucc

SEQ ID NO: 1119409 - RNA, 20 nt, Mycobacterium bovis subsp bovis AF2122/97
cagggcgucggcgacgucca

SEQ ID NO: 1119410 - RNA, 19 nt, Mycobacterium bovis subsp bovis AF2122/97
cagggcucggcggcccggc

SEQ ID NO: 1119411 - RNA, 21 nt, Mycobacterium bovis subsp bovis AF2122/97
cagggcucggcggcccggccg

SEQ ID NO: 1119412 - RNA, 22 nt, Mycobacterium bovis subsp bovis AF2122/97
cagggcucggcggcccggccga

SEQ ID NO: 1119413 - RNA, 16 nt, Mycobacterium bovis subsp bovis AF2122/97
cagggccuggccacac

SEQ ID NO: 1119414 - RNA, 21 nt, Mycobacterium bovis subsp bovis AF2122/97
cagggccucgaccgccagccg

SEQ ID NO: 1119415 - RNA, 16 nt, Mycobacterium bovis subsp bovis AF2122/97
cagggccucggucgcc

SEQ ID NO: 1119416 - RNA, 22 nt, Mycobacterium bovis subsp bovis AF2122/97
cagggccuccacccgccacggu

SEQ ID NO: 1119417 - RNA, 16 nt, Mycobacterium bovis subsp bovis AF2122/97
cagggccucgaccgcc

SEQ ID NO: 1119418 - RNA, 12 nt, Mycobacterium bovis subsp bovis AF2122/97
cagggcagcccg

SEQ ID NO: 1119419 - RNA, 21 nt, Mycobacterium bovis subsp bovis AF2122/97
cagggcaucagcagagccccg

SEQ ID NO: 1119420 - RNA, 14 nt, Mycobacterium bovis subsp bovis AF2122/97
cagggacgaugccc

SEQ ID NO: 1119421 - RNA, 16 nt, Mycobacterium bovis subsp bovis AF2122/97
cagggcaacggccgcu

SEQ ID NO: 1119422 - RNA, 22 nt, Mycobacterium bovis subsp bovis AF2122/97
cagggcacguucggcgcacagc

SEQ ID NO: 1119423 - RNA, 23 nt, Mycobacterium bovis subsp bovis AF2122/97
caggcuucugggguuggcucggc

SEQ ID NO: 1119424 - RNA, 23 nt, Mycobacterium bovis subsp bovis AF2122/97
caggcuuccagccacagcccggc

SEQ ID NO: 1119425 - RNA, 23 nt, Mycobacterium bovis subsp bovis AF2122/97
caggcuguggccagcaucaucaa

SEQ ID NO: 1119426 - RNA, 15 nt, Mycobacterium bovis subsp bovis AF2122/97
caggcuggcgucacc

SEQ ID NO: 1119427 - RNA, 22 nt, Mycobacterium bovis subsp bovis AF2122/97
caggcugggcagaccgaucggc

SEQ ID NO: 1119428 - RNA, 20 nt, Mycobacterium bovis subsp bovis AF2122/97
cagggacccgagaucaccgg

SEQ ID NO: 1119429 - RNA, 17 nt, Mycobacterium bovis subsp bovis AF2122/97
cagggaauagcggcgcc

SEQ ID NO: 1119430 - RNA, 19 nt, Mycobacterium bovis subsp bovis AF2122/97
cagggacccggcgccgucg

SEQ ID NO: 1119431 - RNA, 23 nt, Mycobacterium bovis subsp bovis AF2122/97
cagggacccggcgccgucgauga

SEQ ID NO: 1119432 - RNA, 14 nt, Mycobacterium bovis subsp bovis AF2122/97
cagggaccgguuau

SEQ ID NO: 1119433 - RNA, 13 nt, Mycobacterium bovis subsp bovis AF2122/97
cagggagugccgc

SEQ ID NO: 1119434 - RNA, 14 nt, Mycobacterium bovis subsp bovis AF2122/97
cagggaucaccccg

SEQ ID NO: 1119435 - RNA, 18 nt, Mycobacterium bovis subsp bovis AF2122/97
cagggaucagccgugcgg

SEQ ID NO: 1119436 - RNA, 18 nt, Mycobacterium bovis subsp bovis AF2122/97
cagggaaccauugcccga

SEQ ID NO: 1119437 - RNA, 16 nt, Mycobacterium bovis subsp bovis AF2122/97
cagcucgaacagcucg

SEQ ID NO: 1119438 - RNA, 14 nt, Mycobacterium bovis subsp bovis AF2122/97
cagcucccgggcgg

SEQ ID NO: 1119439 - RNA, 18 nt, Mycobacterium bovis subsp bovis AF2122/97
cagcucgaucagccgggu

SEQ ID NO: 1119440 - RNA, 20 nt, Mycobacterium bovis subsp bovis AF2122/97
cagcucgagguccucagcga

SEQ ID NO: 1119441 - RNA, 22 nt, Mycobacterium bovis subsp bovis AF2122/97
cagcucgcacucguugccgacc

SEQ ID NO: 1119442 - RNA, 14 nt, Mycobacterium bovis subsp bovis AF2122/97
cagcucgccggccg

SEQ ID NO: 1119443 - RNA, 15 nt, Mycobacterium bovis subsp bovis AF2122/97
cagcucgccggccgg

SEQ ID NO: 1119444 - RNA, 20 nt, Mycobacterium bovis subsp bovis AF2122/97
cagcucgccgugaccaggug

SEQ ID NO: 1119445 - RNA, 23 nt, Mycobacterium bovis subsp bovis AF2122/97
cagcucgccuaguugcaacgggu

SEQ ID NO: 1119446 - RNA, 15 nt, Mycobacterium bovis subsp bovis AF2122/97
cagcucgcgcucgcu

SEQ ID NO: 1119447 - RNA, 14 nt, Mycobacterium bovis subsp bovis AF2122/97
cagcucgcgggccg

SEQ ID NO: 1119448 - RNA, 17 nt, Mycobacterium bovis subsp bovis AF2122/97
cagcucgcgggccgcgu

SEQ ID NO: 1119449 - RNA, 12 nt, Mycobacterium bovis subsp bovis AF2122/97
cagcucgcugua

SEQ ID NO: 1119450 - RNA, 14 nt, Mycobacterium bovis subsp bovis AF2122/97
cagcucggaucggu

SEQ ID NO: 1119451 - RNA, 21 nt, Mycobacterium bovis subsp bovis AF2122/97
cagcucgccggcacgcagcca

SEQ ID NO: 1119452 - RNA, 12 nt, Mycobacterium bovis subsp bovis AF2122/97
cagcucggccag

SEQ ID NO: 1119453 - RNA, 17 nt, Mycobacterium bovis subsp bovis AF2122/97
cagcucggccaggcugg

SEQ ID NO: 1119454 - RNA, 18 nt, Mycobacterium bovis subsp bovis AF2122/97
cagcucggccaggcuggc

SEQ ID NO: 1119455 - RNA, 21 nt, Mycobacterium bovis subsp bovis AF2122/97
cagcucggcggcagcggcggu

SEQ ID NO: 1119456 - RNA, 15 nt, Mycobacterium bovis subsp bovis AF2122/97
cagcucccgccacgu

SEQ ID NO: 1119457 - RNA, 18 nt, Mycobacterium bovis subsp bovis AF2122/97
cagcucccgccacgucgc

SEQ ID NO: 1119458 - RNA, 14 nt, Mycobacterium bovis subsp bovis AF2122/97
cagcuccccgccgg

SEQ ID NO: 1119459 - RNA, 23 nt, Mycobacterium bovis subsp bovis AF2122/97
cagcuaaaaaccgcugccggugu

SEQ ID NO: 1119460 - RNA, 20 nt, Mycobacterium bovis subsp bovis AF2122/97
cagcuccagcaaaacccgcu

SEQ ID NO: 1119461 - RNA, 17 nt, Mycobacterium bovis subsp bovis AF2122/97
cagcguugaccgcaucg

SEQ ID NO: 1119462 - RNA, 18 nt, Mycobacterium bovis subsp bovis AF2122/97
cagcguugacggcuucgg

SEQ ID NO: 1119463 - RNA, 20 nt, Mycobacterium bovis subsp bovis AF2122/97
cagcguugacggcuucggca

SEQ ID NO: 1119464 - RNA, 19 nt, Mycobacterium bovis subsp bovis AF2122/97
cagcguugacggucagccg

SEQ ID NO: 1119465 - RNA, 15 nt, Mycobacterium bovis subsp bovis AF2122/97
cagcguuugaacgca

SEQ ID NO: 1119466 - RNA, 13 nt, Mycobacterium bovis subsp bovis AF2122/97
cagcguuggcggc

SEQ ID NO: 1119467 - RNA, 16 nt, Mycobacterium bovis subsp bovis AF2122/97
cagcgugcccgccacc

SEQ ID NO: 1119468 - RNA, 20 nt, Mycobacterium bovis subsp bovis AF2122/97
cagcgugcccgccaccggcg

SEQ ID NO: 1119469 - RNA, 20 nt, Mycobacterium bovis subsp bovis AF2122/97
cagcgugcgaugcagcgcgc

SEQ ID NO: 1119470 - RNA, 14 nt, Mycobacterium bovis subsp bovis AF2122/97
cagcgugcagcggc

SEQ ID NO: 1119471 - RNA, 20 nt, Mycobacterium bovis subsp bovis AF2122/97
cagcgugcagcggcgggcga

SEQ ID NO: 1119472 - RNA, 24 nt, Mycobacterium bovis subsp bovis AF2122/97
cagcgugagugcagcacgauccag

SEQ ID NO: 1119473 - RNA, 22 nt, Mycobacterium bovis subsp bovis AF2122/97
cagcgugcccgccaccggcgcg

SEQ ID NO: 1119474 - RNA, 19 nt, Mycobacterium bovis subsp bovis AF2122/97
cagcgcgcaaagacaccga

SEQ ID NO: 1119475 - RNA, 13 nt, Mycobacterium bovis subsp bovis AF2122/97
cagcgcgccagcu

SEQ ID NO: 1119476 - RNA, 12 nt, Mycobacterium bovis subsp bovis AF2122/97
cagcgcgcccgc

SEQ ID NO: 1119477 - RNA, 15 nt, Mycobacterium bovis subsp bovis AF2122/97
cagcgcgccagcuug

SEQ ID NO: 1119478 - RNA, 19 nt, Mycobacterium bovis subsp bovis AF2122/97
cagcgcgccagcuugucgg

SEQ ID NO: 1119479 - RNA, 15 nt, Mycobacterium bovis subsp bovis AF2122/97
cagcgcgcccgacac

SEQ ID NO: 1119480 - RNA, 17 nt, Mycobacterium bovis subsp bovis AF2122/97
cagcgcgcccgcggccg

SEQ ID NO: 1119481 - RNA, 13 nt, Mycobacterium bovis subsp bovis AF2122/97
cagcgcgccaccc

SEQ ID NO: 1119482 - RNA, 19 nt, Mycobacterium bovis subsp bovis AF2122/97
cagcgcgaucaacgcguug

SEQ ID NO: 1119483 - RNA, 15 nt, Mycobacterium bovis subsp bovis AF2122/97
cagcgcgaucaccga

SEQ ID NO: 1119484 - RNA, 21 nt, Mycobacterium bovis subsp bovis AF2122/97
cagcgcgagaucagccggcag

SEQ ID NO: 1119485 - RNA, 21 nt, Mycobacterium bovis subsp bovis AF2122/97
cagcgcgagcccgaaccaccg

SEQ ID NO: 1119486 - RNA, 22 nt, Mycobacterium bovis subsp bovis AF2122/97
cagcgcgagcccgaaccaccgc

SEQ ID NO: 1119487 - RNA, 20 nt, Mycobacterium bovis subsp bovis AF2122/97
cagcgcgaggcucguggcga

SEQ ID NO: 1119488 - RNA, 23 nt, Mycobacterium bovis subsp bovis AF2122/97
cagcgcgaggcucguggcgacgg

SEQ ID NO: 1119489 - RNA, 13 nt, Mycobacterium bovis subsp bovis AF2122/97
cagcgggcuggcg

SEQ ID NO: 1119490 - RNA, 14 nt, Mycobacterium bovis subsp bovis AF2122/97
cagcgggcuggcga

SEQ ID NO: 1119491 - RNA, 17 nt, Mycobacterium bovis subsp bovis AF2122/97
cagcgggcuggcgaagg

SEQ ID NO: 1119492 - RNA, 17 nt, Mycobacterium bovis subsp bovis AF2122/97
cagcgguaagcgcaucg

SEQ ID NO: 1119493 - RNA, 18 nt, Mycobacterium bovis subsp bovis AF2122/97
cagcgguaagcgcaucga

SEQ ID NO: 1119494 - RNA, 17 nt, Mycobacterium bovis subsp bovis AF2122/97
cagcgguaaugccagcg

SEQ ID NO: 1119495 - RNA, 19 nt, Mycobacterium bovis subsp bovis AF2122/97
cagcgguaaugccagcggc

SEQ ID NO: 1119496 - RNA, 22 nt, Mycobacterium bovis subsp bovis AF2122/97
cagcgguaaugccagcggcaca

SEQ ID NO: 1119497 - RNA, 13 nt, Mycobacterium bovis subsp bovis AF2122/97
cagcgguagccga

SEQ ID NO: 1119498 - RNA, 12 nt, Mycobacterium bovis subsp bovis AF2122/97
cagcgggcgcgc

SEQ ID NO: 1119499 - RNA, 14 nt, Mycobacterium bovis subsp bovis AF2122/97
cagcgggcacgccg

SEQ ID NO: 1119500 - RNA, 13 nt, Mycobacterium bovis subsp bovis AF2122/97
cagcgggcaucgc

SEQ ID NO: 1119501 - RNA, 23 nt, Mycobacterium bovis subsp bovis AF2122/97
cagcgggcgcuguagucgcgccu

SEQ ID NO: 1119502 - RNA, 14 nt, Mycobacterium bovis subsp bovis AF2122/97
cagcgguugacccu

SEQ ID NO: 1119503 - RNA, 13 nt, Mycobacterium bovis subsp bovis AF2122/97
cagcgguugaugc

SEQ ID NO: 1119504 - RNA, 19 nt, Mycobacterium bovis subsp bovis AF2122/97
cagcgguugaugcggccgc

SEQ ID NO: 1119505 - RNA, 20 nt, Mycobacterium bovis subsp bovis AF2122/97
cagcgguugaugcggccgcg

SEQ ID NO: 1119506 - RNA, 15 nt, Mycobacterium bovis subsp bovis AF2122/97
cagcgguggcuugcc

SEQ ID NO: 1119507 - RNA, 16 nt, Mycobacterium bovis subsp bovis AF2122/97
cagcgguggaccaccg

SEQ ID NO: 1119508 - RNA, 12 nt, Mycobacterium bovis subsp bovis AF2122/97
cagcgguccaga

SEQ ID NO: 1119509 - RNA, 18 nt, Mycobacterium bovis subsp bovis AF2122/97
cagcgguccagacaucag

SEQ ID NO: 1119510 - RNA, 19 nt, Mycobacterium bovis subsp bovis AF2122/97
cagcgguaucccccagccg

SEQ ID NO: 1119511 - RNA, 22 nt, Mycobacterium bovis subsp bovis AF2122/97
cagcgguaucccccagccgcgg

SEQ ID NO: 1119512 - RNA, 18 nt, Mycobacterium bovis subsp bovis AF2122/97
cagcgguccagccaccgc

SEQ ID NO: 1119513 - RNA, 17 nt, Mycobacterium bovis subsp bovis AF2122/97
cagcggucgcagcucgu

SEQ ID NO: 1119514 - RNA, 18 nt, Mycobacterium bovis subsp bovis AF2122/97
cagcggugcagcccgccg

SEQ ID NO: 1119515 - RNA, 14 nt, Mycobacterium bovis subsp bovis AF2122/97
cagcgguugggcga

SEQ ID NO: 1119516 - RNA, 14 nt, Mycobacterium bovis subsp bovis AF2122/97
cagcgguggucggc

SEQ ID NO: 1119517 - RNA, 16 nt, Mycobacterium bovis subsp bovis AF2122/97
cagcgguggucggcgc

SEQ ID NO: 1119518 - RNA, 15 nt, Mycobacterium bovis subsp bovis AF2122/97
cagcguaaauagcgc

SEQ ID NO: 1119519 - RNA, 18 nt, Mycobacterium bovis subsp bovis AF2122/97
cagcguaaauagcgcccu

SEQ ID NO: 1119520 - RNA, 20 nt, Mycobacterium bovis subsp bovis AF2122/97
cagcgguucggugaucgggc

SEQ ID NO: 1119521 - RNA, 13 nt, Mycobacterium bovis subsp bovis AF2122/97
cagcgucgcacgc

SEQ ID NO: 1119522 - RNA, 13 nt, Mycobacterium bovis subsp bovis AF2122/97
cagcgucgaucgu

SEQ ID NO: 1119523 - RNA, 19 nt, Mycobacterium bovis subsp bovis AF2122/97
cagcguccgucgucggcgu

SEQ ID NO: 1119524 - RNA, 23 nt, Mycobacterium bovis subsp bovis AF2122/97
cagcguccuggcguagugcagcu

SEQ ID NO: 1119525 - RNA, 14 nt, Mycobacterium bovis subsp bovis AF2122/97
cagcgucccgaugu

SEQ ID NO: 1119526 - RNA, 17 nt, Mycobacterium bovis subsp bovis AF2122/97
cagcgucccggucgcca

SEQ ID NO: 1119527 - RNA, 18 nt, Mycobacterium bovis subsp bovis AF2122/97
cagcgucccggucgccaa

SEQ ID NO: 1119528 - RNA, 23 nt, Mycobacterium bovis subsp bovis AF2122/97
cagcguaucggccggcagauugu

SEQ ID NO: 1119529 - RNA, 20 nt, Mycobacterium bovis subsp bovis AF2122/97
cagcgucgcgauugccgcgg

SEQ ID NO: 1119530 - RNA, 18 nt, Mycobacterium bovis subsp bovis AF2122/97
cagcgucgcggccacggu

SEQ ID NO: 1119531 - RNA, 17 nt, Mycobacterium bovis subsp bovis AF2122/97
cagcgugaccaccgccg

SEQ ID NO: 1119532 - RNA, 21 nt, Mycobacterium bovis subsp bovis AF2122/97
cagcgugaccaccgccgacag

SEQ ID NO: 1119533 - RNA, 19 nt, Mycobacterium bovis subsp bovis AF2122/97
cagcugcccgccagcgccg

SEQ ID NO: 1119534 - RNA, 20 nt, Mycobacterium bovis subsp bovis AF2122/97
cagcugcucuccgucgcgca

SEQ ID NO: 1119535 - RNA, 20 nt, Mycobacterium bovis subsp bovis AF2122/97
cagcuggcauaggaucgcgc

SEQ ID NO: 1119536 - RNA, 16 nt, Mycobacterium bovis subsp bovis AF2122/97
cagcuggccgcggcga

SEQ ID NO: 1119537 - RNA, 21 nt, Mycobacterium bovis subsp bovis AF2122/97
cagcuggccgcggcgaguacu

SEQ ID NO: 1119538 - RNA, 17 nt, Mycobacterium bovis subsp bovis AF2122/97
cagcugcucgucgucga

SEQ ID NO: 1119539 - RNA, 23 nt, Mycobacterium bovis subsp bovis AF2122/97
cagcugcucgucgucgauccagc

SEQ ID NO: 1119540 - RNA, 20 nt, Mycobacterium bovis subsp bovis AF2122/97
cagcugcucggucaggcggc

SEQ ID NO: 1119541 - RNA, 20 nt, Mycobacterium bovis subsp bovis AF2122/97
cagcugcucgucuuggcggc

SEQ ID NO: 1119542 - RNA, 15 nt, Mycobacterium bovis subsp bovis AF2122/97
cagcugcccgacguu

SEQ ID NO: 1119543 - RNA, 14 nt, Mycobacterium bovis subsp bovis AF2122/97
cagcuugagcacac

SEQ ID NO: 1119544 - RNA, 15 nt, Mycobacterium bovis subsp bovis AF2122/97
cagcuugagcacacg

SEQ ID NO: 1119545 - RNA, 19 nt, Mycobacterium bovis subsp bovis AF2122/97
cagcuugagcacacguccg

SEQ ID NO: 1119546 - RNA, 17 nt, Mycobacterium bovis subsp bovis AF2122/97
cagcuugcagugccgcc

SEQ ID NO: 1119547 - RNA, 16 nt, Mycobacterium bovis subsp bovis AF2122/97
cagcuugccaaucacc

SEQ ID NO: 1119548 - RNA, 18 nt, Mycobacterium bovis subsp bovis AF2122/97
cagcuugccaaucaccgu

SEQ ID NO: 1119549 - RNA, 14 nt, Mycobacterium bovis subsp bovis AF2122/97
cagcuugccgaccu

SEQ ID NO: 1119550 - RNA, 14 nt, Mycobacterium bovis subsp bovis AF2122/97
cagcuucucgccga

SEQ ID NO: 1119551 - RNA, 16 nt, Mycobacterium bovis subsp bovis AF2122/97
cagcuucucgccgacg

SEQ ID NO: 1119552 - RNA, 16 nt, Mycobacterium bovis subsp bovis AF2122/97
cagcuucggcuggcgu

SEQ ID NO: 1119553 - RNA, 18 nt, Mycobacterium bovis subsp bovis AF2122/97
cagcuucggcuggcgugc

SEQ ID NO: 1119554 - RNA, 13 nt, Mycobacterium bovis subsp bovis AF2122/97
cagcuucggccag

SEQ ID NO: 1119555 - RNA, 17 nt, Mycobacterium bovis subsp bovis AF2122/97
cagcuucgcgcagccgg

SEQ ID NO: 1119556 - RNA, 20 nt, Mycobacterium bovis subsp bovis AF2122/97
cagcuucuuaccgcgggccg

SEQ ID NO: 1119557 - RNA, 14 nt, Mycobacterium bovis subsp bovis AF2122/97
cagcuggccgggug

SEQ ID NO: 1119558 - RNA, 15 nt, Mycobacterium bovis subsp bovis AF2122/97
cagcuugacaucggu

SEQ ID NO: 1119559 - RNA, 19 nt, Mycobacterium bovis subsp bovis AF2122/97
cagcucggucagcgucagg

SEQ ID NO: 1119560 - RNA, 23 nt, Mycobacterium bovis subsp bovis AF2122/97
cagcucgggcagggaccgcaucg

SEQ ID NO: 1119561 - RNA, 17 nt, Mycobacterium bovis subsp bovis AF2122/97
cagcucggcgggcucgu

SEQ ID NO: 1119562 - RNA, 13 nt, Mycobacterium bovis subsp bovis AF2122/97
cagcucgggggcg

SEQ ID NO: 1119563 - RNA, 19 nt, Mycobacterium bovis subsp bovis AF2122/97
cagcucgucgacgucguag

SEQ ID NO: 1119564 - RNA, 17 nt, Mycobacterium bovis subsp bovis AF2122/97
cagcucggugcacggcg

SEQ ID NO: 1119565 - RNA, 13 nt, Mycobacterium bovis subsp bovis AF2122/97
cagcucgucgagc

SEQ ID NO: 1119566 - RNA, 17 nt, Mycobacterium bovis subsp bovis AF2122/97
cagcucgucgcugaaca

SEQ ID NO: 1119567 - RNA, 17 nt, Mycobacterium bovis subsp bovis AF2122/97
cagcucgucgacgucgu

SEQ ID NO: 1119568 - RNA, 17 nt, Mycobacterium bovis subsp bovis AF2122/97
cagcugagccgucggcg

SEQ ID NO: 1119569 - RNA, 19 nt, Mycobacterium bovis subsp bovis AF2122/97
cagcugagccgucggcgcc

SEQ ID NO: 1119570 - RNA, 22 nt, Mycobacterium bovis subsp bovis AF2122/97
cagcugagccgugucaaccggu

SEQ ID NO: 1119571 - RNA, 20 nt, Mycobacterium bovis subsp bovis AF2122/97
cagcugaccagcguccagcc

SEQ ID NO: 1119572 - RNA, 23 nt, Mycobacterium bovis subsp bovis AF2122/97
cagcugacgagccgguggcgugg

SEQ ID NO: 1119573 - RNA, 15 nt, Mycobacterium bovis subsp bovis AF2122/97
cagcugacggcgcaa

SEQ ID NO: 1119574 - RNA, 20 nt, Mycobacterium bovis subsp bovis AF2122/97
cagcugcaaugacuggaccg

SEQ ID NO: 1119575 - RNA, 14 nt, Mycobacterium bovis subsp bovis AF2122/97
cagcugcaccuccg

SEQ ID NO: 1119576 - RNA, 21 nt, Mycobacterium bovis subsp bovis AF2122/97
cagcugcaccuccgacggccg

SEQ ID NO: 1119577 - RNA, 19 nt, Mycobacterium bovis subsp bovis AF2122/97
cagcugacgggccgcugug

SEQ ID NO: 1119578 - RNA, 14 nt, Mycobacterium bovis subsp bovis AF2122/97
cagcugagcuggca

SEQ ID NO: 1119579 - RNA, 18 nt, Mycobacterium bovis subsp bovis AF2122/97
cagcucgucgucggcgua

SEQ ID NO: 1119580 - RNA, 20 nt, Mycobacterium bovis subsp bovis AF2122/97
caggaauugcccugacgauc

SEQ ID NO: 1119581 - RNA, 22 nt, Mycobacterium bovis subsp bovis AF2122/97
caggacaccuugcguccguagc

SEQ ID NO: 1119582 - RNA, 14 nt, Mycobacterium bovis subsp bovis AF2122/97
caggaaugccgcgg

SEQ ID NO: 1119583 - RNA, 19 nt, Mycobacterium bovis subsp bovis AF2122/97
caggaaugccgcggggauc

SEQ ID NO: 1119584 - RNA, 20 nt, Mycobacterium bovis subsp bovis AF2122/97
caggaauuccccaccgucgu

SEQ ID NO: 1119585 - RNA, 23 nt, Mycobacterium bovis subsp bovis AF2122/97
caggaauuccccaccgucgucgu

SEQ ID NO: 1119586 - RNA, 17 nt, Mycobacterium bovis subsp bovis AF2122/97
caggaagucgcggacgu

SEQ ID NO: 1119587 - RNA, 22 nt, Mycobacterium bovis subsp bovis AF2122/97
caggaaucccucggccgcaggc

SEQ ID NO: 1119588 - RNA, 22 nt, Mycobacterium bovis subsp bovis AF2122/97
caggaaucgggucagcaccacc

SEQ ID NO: 1119589 - RNA, 23 nt, Mycobacterium bovis subsp bovis AF2122/97
caggaaugaucguuccgauccgg

SEQ ID NO: 1119590 - RNA, 16 nt, Mycobacterium bovis subsp bovis AF2122/97
caggaccugcgucauc

SEQ ID NO: 1119591 - RNA, 20 nt, Mycobacterium bovis subsp bovis AF2122/97
caggaccugcgucaucgcgg

SEQ ID NO: 1119592 - RNA, 16 nt, Mycobacterium bovis subsp bovis AF2122/97
caggaccggcugcagg

SEQ ID NO: 1119593 - RNA, 17 nt, Mycobacterium bovis subsp bovis AF2122/97
caggaccggcugcaggu

SEQ ID NO: 1119594 - RNA, 14 nt, Mycobacterium bovis subsp bovis AF2122/97
caggaccgcgccga

SEQ ID NO: 1119595 - RNA, 16 nt, Mycobacterium bovis subsp bovis AF2122/97
caggaccgcgccgauc

SEQ ID NO: 1119596 - RNA, 17 nt, Mycobacterium bovis subsp bovis AF2122/97
caggacagcagccgccg

SEQ ID NO: 1119597 - RNA, 17 nt, Mycobacterium bovis subsp bovis AF2122/97
caggaccaacgccaacg

SEQ ID NO: 1119598 - RNA, 21 nt, Mycobacterium bovis subsp bovis AF2122/97
caggaccaacgccaacgccac

SEQ ID NO: 1119599 - RNA, 16 nt, Mycobacterium bovis subsp bovis AF2122/97
caggacccaucgccag

SEQ ID NO: 1119600 - RNA, 15 nt, Mycobacterium bovis subsp bovis AF2122/97
caggaagccggcgug

SEQ ID NO: 1119601 - RNA, 19 nt, Mycobacterium bovis subsp bovis AF2122/97
caggaagccgagaccacgc

SEQ ID NO: 1119602 - RNA, 14 nt, Mycobacterium bovis subsp bovis AF2122/97
caggaagcgguggc

SEQ ID NO: 1119603 - RNA, 21 nt, Mycobacterium bovis subsp bovis AF2122/97
cagcuuggcauugaccaccga

SEQ ID NO: 1119604 - RNA, 12 nt, Mycobacterium bovis subsp bovis AF2122/97
caggaagucccg

SEQ ID NO: 1119605 - RNA, 13 nt, Mycobacterium bovis subsp bovis AF2122/97
caggaagucgcgg

SEQ ID NO: 1119606 - RNA, 18 nt, Mycobacterium bovis subsp bovis AF2122/97
cagcuuggagaucgccgc

SEQ ID NO: 1119607 - RNA, 21 nt, Mycobacterium bovis subsp bovis AF2122/97
cagcuuggagaucgccgccgg

SEQ ID NO: 1119608 - RNA, 21 nt, Mycobacterium bovis subsp bovis AF2122/97
cagcuuggccucagccaccgg

SEQ ID NO: 1119609 - RNA, 22 nt, Mycobacterium bovis subsp bovis AF2122/97
cagcuuggccucagccaccggg

SEQ ID NO: 1119610 - RNA, 13 nt, Mycobacterium bovis subsp bovis AF2122/97
cagcuugcugcgc

SEQ ID NO: 1119611 - RNA, 20 nt, Mycobacterium bovis subsp bovis AF2122/97
cagcuugcugcgcaccaagg

SEQ ID NO: 1119612 - RNA, 18 nt, Mycobacterium bovis subsp bovis AF2122/97
caggauucccagucgcgg

SEQ ID NO: 1119613 - RNA, 20 nt, Mycobacterium bovis subsp bovis AF2122/97
caggcacaacgcgacgccgc

SEQ ID NO: 1119614 - RNA, 15 nt, Mycobacterium bovis subsp bovis AF2122/97
caggcaaugcccgac

SEQ ID NO: 1119615 - RNA, 18 nt, Mycobacterium bovis subsp bovis AF2122/97
caggcaagccagcacugc

SEQ ID NO: 1119616 - RNA, 19 nt, Mycobacterium bovis subsp bovis AF2122/97
caggcaaccggucagccug

SEQ ID NO: 1119617 - RNA, 14 nt, Mycobacterium bovis subsp bovis AF2122/97
caggaguggccacg

SEQ ID NO: 1119618 - RNA, 20 nt, Mycobacterium bovis subsp bovis AF2122/97
caggagcgccgucaucgcag

SEQ ID NO: 1119619 - RNA, 23 nt, Mycobacterium bovis subsp bovis AF2122/97
caggagugcgggcaugccggcga

SEQ ID NO: 1119620 - RNA, 19 nt, Mycobacterium bovis subsp bovis AF2122/97
caggaggcguccggcucau

SEQ ID NO: 1119621 - RNA, 23 nt, Mycobacterium bovis subsp bovis AF2122/97
caggaggcgaaugucuucgccgu

SEQ ID NO: 1119622 - RNA, 22 nt, Mycobacterium bovis subsp bovis AF2122/97
caggagcgcgaugaccucggcg

SEQ ID NO: 1119623 - RNA, 16 nt, Mycobacterium bovis subsp bovis AF2122/97
caggagcgugucggcc

SEQ ID NO: 1119624 - RNA, 15 nt, Mycobacterium bovis subsp bovis AF2122/97
caggauggugcggcc

SEQ ID NO: 1119625 - RNA, 18 nt, Mycobacterium bovis subsp bovis AF2122/97
caggaugguugcgacggc

SEQ ID NO: 1119626 - RNA, 16 nt, Mycobacterium bovis subsp bovis AF2122/97
caggauaaacccggcg

SEQ ID NO: 1119627 - RNA, 19 nt, Mycobacterium bovis subsp bovis AF2122/97
caggaucacacuggccugc

SEQ ID NO: 1119628 - RNA, 20 nt, Mycobacterium bovis subsp bovis AF2122/97
caggaguuugaccaccuggu

SEQ ID NO: 1119629 - RNA, 22 nt, Mycobacterium bovis subsp bovis AF2122/97
cagugccgcacccagaccgccg

SEQ ID NO: 1119630 - RNA, 18 nt, Mycobacterium bovis subsp bovis AF2122/97
cagugcgcggaucaacag

SEQ ID NO: 1119631 - RNA, 15 nt, Mycobacterium bovis subsp bovis AF2122/97
cagugccccgccgag

SEQ ID NO: 1119632 - RNA, 14 nt, Mycobacterium bovis subsp bovis AF2122/97
cagugccgccggcc

SEQ ID NO: 1119633 - RNA, 15 nt, Mycobacterium bovis subsp bovis AF2122/97
cagugccgccggcca

SEQ ID NO: 1119634 - RNA, 17 nt, Mycobacterium bovis subsp bovis AF2122/97
cagugcggccuuggcga

SEQ ID NO: 1119635 - RNA, 22 nt, Mycobacterium bovis subsp bovis AF2122/97
cagugcgcggaucaacaggccg

SEQ ID NO: 1119636 - RNA, 24 nt, Mycobacterium bovis subsp bovis AF2122/97
cagugcgcggaucaacaggccggc

SEQ ID NO: 1119637 - RNA, 17 nt, Mycobacterium bovis subsp bovis AF2122/97
cagugcgggcggcgucu

SEQ ID NO: 1119638 - RNA, 16 nt, Mycobacterium bovis subsp bovis AF2122/97
cagugcaucgaucacc

SEQ ID NO: 1119639 - RNA, 12 nt, Mycobacterium bovis subsp bovis AF2122/97
cagugcaucggu

SEQ ID NO: 1119640 - RNA, 21 nt, Mycobacterium bovis subsp bovis AF2122/97
cagugccaauuccagcccccc

SEQ ID NO: 1119641 - RNA, 17 nt, Mycobacterium bovis subsp bovis AF2122/97
cagugccaccugggcgg

SEQ ID NO: 1119642 - RNA, 17 nt, Mycobacterium bovis subsp bovis AF2122/97
cagugccaucuacaucg

SEQ ID NO: 1119643 - RNA, 15 nt, Mycobacterium bovis subsp bovis AF2122/97
cagugaucaccaacc

SEQ ID NO: 1119644 - RNA, 13 nt, Mycobacterium bovis subsp bovis AF2122/97
cagugagccgcca

SEQ ID NO: 1119645 - RNA, 16 nt, Mycobacterium bovis subsp bovis AF2122/97
cagugaugcgccccgg

SEQ ID NO: 1119646 - RNA, 20 nt, Mycobacterium bovis subsp bovis AF2122/97
cagugacguuccgcucgccg

SEQ ID NO: 1119647 - RNA, 17 nt, Mycobacterium bovis subsp bovis AF2122/97
cagugaagacaccaggc

SEQ ID NO: 1119648 - RNA, 14 nt, Mycobacterium bovis subsp bovis AF2122/97
cagugagcagccgg

SEQ ID NO: 1119649 - RNA, 17 nt, Mycobacterium bovis subsp bovis AF2122/97
cagugaccucgucggcg

SEQ ID NO: 1119650 - RNA, 20 nt, Mycobacterium bovis subsp bovis AF2122/97
cagugaccucgucggcgacg

SEQ ID NO: 1119651 - RNA, 15 nt, Mycobacterium bovis subsp bovis AF2122/97
cagugaccugggcgc

SEQ ID NO: 1119652 - RNA, 16 nt, Mycobacterium bovis subsp bovis AF2122/97
cagugaccugggcgcc

SEQ ID NO: 1119653 - RNA, 20 nt, Mycobacterium bovis subsp bovis AF2122/97
cagugaccugggcgccccag

SEQ ID NO: 1119654 - RNA, 17 nt, Mycobacterium bovis subsp bovis AF2122/97
cagugacgccacgaccg

SEQ ID NO: 1119655 - RNA, 18 nt, Mycobacterium bovis subsp bovis AF2122/97
cagugcacgcucggcgcc

SEQ ID NO: 1119656 - RNA, 16 nt, Mycobacterium bovis subsp bovis AF2122/97
cagugcaccgcgucgu

SEQ ID NO: 1119657 - RNA, 17 nt, Mycobacterium bovis subsp bovis AF2122/97
cagugcagacaggcggc

SEQ ID NO: 1119658 - RNA, 21 nt, Mycobacterium bovis subsp bovis AF2122/97
cagugcagacaggcggcggcc

SEQ ID NO: 1119659 - RNA, 23 nt, Mycobacterium bovis subsp bovis AF2122/97
cagugcagacaggcggcggccug

SEQ ID NO: 1119660 - RNA, 13 nt, Mycobacterium bovis subsp bovis AF2122/97
cagugcaggcggc

SEQ ID NO: 1119661 - RNA, 14 nt, Mycobacterium bovis subsp bovis AF2122/97
cagugcaggcggcc

SEQ ID NO: 1119662 - RNA, 15 nt, Mycobacterium bovis subsp bovis AF2122/97
cagugcaggcggccg

SEQ ID NO: 1119663 - RNA, 16 nt, Mycobacterium bovis subsp bovis AF2122/97
cagugcaggcggccgc

SEQ ID NO: 1119664 - RNA, 14 nt, Mycobacterium bovis subsp bovis AF2122/97
caguguggcgauga

SEQ ID NO: 1119665 - RNA, 21 nt, Mycobacterium bovis subsp bovis AF2122/97
cagugugcgguuggaucggcg

SEQ ID NO: 1119666 - RNA, 20 nt, Mycobacterium bovis subsp bovis AF2122/97
cagugugaagaccaccgccc

SEQ ID NO: 1119667 - RNA, 17 nt, Mycobacterium bovis subsp bovis AF2122/97
caguguggugcggcgcg

SEQ ID NO: 1119668 - RNA, 20 nt, Mycobacterium bovis subsp bovis AF2122/97
caguguguccugucgcacca

SEQ ID NO: 1119669 - RNA, 16 nt, Mycobacterium bovis subsp bovis AF2122/97
caguguuccgccaccc

SEQ ID NO: 1119670 - RNA, 18 nt, Mycobacterium bovis subsp bovis AF2122/97
caguguuccgccacccgc

SEQ ID NO: 1119671 - RNA, 15 nt, Mycobacterium bovis subsp bovis AF2122/97
caguguugcgcugcg

SEQ ID NO: 1119672 - RNA, 16 nt, Mycobacterium bovis subsp bovis AF2122/97
caguguugcgcugcgg

SEQ ID NO: 1119673 - RNA, 21 nt, Mycobacterium bovis subsp bovis AF2122/97
cagugucgauagcccgccacc

SEQ ID NO: 1119674 - RNA, 22 nt, Mycobacterium bovis subsp bovis AF2122/97
caguggauccggcagcagccgg

SEQ ID NO: 1119675 - RNA, 20 nt, Mycobacterium bovis subsp bovis AF2122/97
cagugucagcacgacgacaa

SEQ ID NO: 1119676 - RNA, 13 nt, Mycobacterium bovis subsp bovis AF2122/97
cagugcucaucga

SEQ ID NO: 1119677 - RNA, 11 nt, Mycobacterium bovis subsp bovis AF2122/97
cagugcucgca

SEQ ID NO: 1119678 - RNA, 15 nt, Mycobacterium bovis subsp bovis AF2122/97
cagugcucgcccagu

SEQ ID NO: 1119679 - RNA, 22 nt, Mycobacterium bovis subsp bovis AF2122/97
cagugcugccuugggaccgcgc

SEQ ID NO: 1119680 - RNA, 18 nt, Mycobacterium bovis subsp bovis AF2122/97
cagugcugcagacccguu

SEQ ID NO: 1119681 - RNA, 20 nt, Mycobacterium bovis subsp bovis AF2122/97
caguggcaagcugucgucgc

SEQ ID NO: 1119682 - RNA, 13 nt, Mycobacterium bovis subsp bovis AF2122/97
caguggcagcccg

SEQ ID NO: 1119683 - RNA, 21 nt, Mycobacterium bovis subsp bovis AF2122/97
caguucgcgccguggcgucgg

SEQ ID NO: 1119684 - RNA, 22 nt, Mycobacterium bovis subsp bovis AF2122/97
caguucgcgccguggcgucggu

SEQ ID NO: 1119685 - RNA, 17 nt, Mycobacterium bovis subsp bovis AF2122/97
caguuauccgguguccu

SEQ ID NO: 1119686 - RNA, 23 nt, Mycobacterium bovis subsp bovis AF2122/97
caguguuuuugcagacucggcga

SEQ ID NO: 1119687 - RNA, 16 nt, Mycobacterium bovis subsp bovis AF2122/97
caguucggcguacggu

SEQ ID NO: 1119688 - RNA, 17 nt, Mycobacterium bovis subsp bovis AF2122/97
caguucggccgucaugg

SEQ ID NO: 1119689 - RNA, 14 nt, Mycobacterium bovis subsp bovis AF2122/97
caguucggcggccg

SEQ ID NO: 1119690 - RNA, 16 nt, Mycobacterium bovis subsp bovis AF2122/97
caguucgacggcguca

SEQ ID NO: 1119691 - RNA, 18 nt, Mycobacterium bovis subsp bovis AF2122/97
caguucuuggcgaccuug

SEQ ID NO: 1119692 - RNA, 15 nt, Mycobacterium bovis subsp bovis AF2122/97
caguugaacucgacc

SEQ ID NO: 1119693 - RNA, 22 nt, Mycobacterium bovis subsp bovis AF2122/97
caguucugcacagugcggcccc

SEQ ID NO: 1119694 - RNA, 16 nt, Mycobacterium bovis subsp bovis AF2122/97
caguucguggcuggca

SEQ ID NO: 1119695 - RNA, 14 nt, Mycobacterium bovis subsp bovis AF2122/97
cauaaggcgugacg

SEQ ID NO: 1119696 - RNA, 20 nt, Mycobacterium bovis subsp bovis AF2122/97
cauaagcgaggaucucggcg

SEQ ID NO: 1119697 - RNA, 18 nt, Mycobacterium bovis subsp bovis AF2122/97
cauaagcucguagagcac

SEQ ID NO: 1119698 - RNA, 23 nt, Mycobacterium bovis subsp bovis AF2122/97
cauaagcccccgcacgcucgccc

SEQ ID NO: 1119699 - RNA, 17 nt, Mycobacterium bovis subsp bovis AF2122/97
cauaagcccccgccacg

SEQ ID NO: 1119700 - RNA, 19 nt, Mycobacterium bovis subsp bovis AF2122/97
cauaaaccgcguccgcgcg

SEQ ID NO: 1119701 - RNA, 20 nt, Mycobacterium bovis subsp bovis AF2122/97
cauaaaccgcguccgcgcgu

SEQ ID NO: 1119702 - RNA, 15 nt, Mycobacterium bovis subsp bovis AF2122/97
cauacaccggccggu

SEQ ID NO: 1119703 - RNA, 18 nt, Mycobacterium bovis subsp bovis AF2122/97
cauacaccggccggucca

SEQ ID NO: 1119704 - RNA, 18 nt, Mycobacterium bovis subsp bovis AF2122/97
cauacaacuggugggcca

SEQ ID NO: 1119705 - RNA, 12 nt, Mycobacterium bovis subsp bovis AF2122/97
cauacagccggc

SEQ ID NO: 1119706 - RNA, 15 nt, Mycobacterium bovis subsp bovis AF2122/97
cauacagcaggccgc

SEQ ID NO: 1119707 - RNA, 20 nt, Mycobacterium bovis subsp bovis AF2122/97
cauaccuaacgagccgucca

SEQ ID NO: 1119708 - RNA, 16 nt, Mycobacterium bovis subsp bovis AF2122/97
cauagacagggccgcu

SEQ ID NO: 1119709 - RNA, 21 nt, Mycobacterium bovis subsp bovis AF2122/97
cauagacagggccgcucgccu

SEQ ID NO: 1119710 - RNA, 16 nt, Mycobacterium bovis subsp bovis AF2122/97
cauagaccaccggcag

SEQ ID NO: 1119711 - RNA, 18 nt, Mycobacterium bovis subsp bovis AF2122/97
cauagaccaccggcagcg

SEQ ID NO: 1119712 - RNA, 19 nt, Mycobacterium bovis subsp bovis AF2122/97
cauacgcgugugcgcgugc

SEQ ID NO: 1119713 - RNA, 17 nt, Mycobacterium bovis subsp bovis AF2122/97
cauaccguucacccagc

SEQ ID NO: 1119714 - RNA, 16 nt, Mycobacterium bovis subsp bovis AF2122/97
cauacgcgcgcggucg

SEQ ID NO: 1119715 - RNA, 18 nt, Mycobacterium bovis subsp bovis AF2122/97
cauacgacagcccgccgg

SEQ ID NO: 1119716 - RNA, 17 nt, Mycobacterium bovis subsp bovis AF2122/97
cauacgagcagugaccg

SEQ ID NO: 1119717 - RNA, 17 nt, Mycobacterium bovis subsp bovis AF2122/97
cauacgaacucaccgcc

SEQ ID NO: 1119718 - RNA, 18 nt, Mycobacterium bovis subsp bovis AF2122/97
cauacgaacucaccgcca

SEQ ID NO: 1119719 - RNA, 14 nt, Mycobacterium bovis subsp bovis AF2122/97
cauacgcaccggua

SEQ ID NO: 1119720 - RNA, 18 nt, Mycobacterium bovis subsp bovis AF2122/97
cauacgcccacuccagca

SEQ ID NO: 1119721 - RNA, 14 nt, Mycobacterium bovis subsp bovis AF2122/97
caggugcucgucga

SEQ ID NO: 1119722 - RNA, 13 nt, Mycobacterium bovis subsp bovis AF2122/97
caggugcugggcg

SEQ ID NO: 1119723 - RNA, 14 nt, Mycobacterium bovis subsp bovis AF2122/97
caggugcugggcga

SEQ ID NO: 1119724 - RNA, 14 nt, Mycobacterium bovis subsp bovis AF2122/97
caggugcgcgacca

SEQ ID NO: 1119725 - RNA, 14 nt, Mycobacterium bovis subsp bovis AF2122/97
caggugaugccgcc

SEQ ID NO: 1119726 - RNA, 15 nt, Mycobacterium bovis subsp bovis AF2122/97
caggugaugccgccg

SEQ ID NO: 1119727 - RNA, 22 nt, Mycobacterium bovis subsp bovis AF2122/97
caggugcgccuggcuggccagc

SEQ ID NO: 1119728 - RNA, 23 nt, Mycobacterium bovis subsp bovis AF2122/97
caggugcgccuggcuggccagcu

SEQ ID NO: 1119729 - RNA, 16 nt, Mycobacterium bovis subsp bovis AF2122/97
caggugcucgucaucc

SEQ ID NO: 1119730 - RNA, 13 nt, Mycobacterium bovis subsp bovis AF2122/97
caggugcggcggc

SEQ ID NO: 1119731 - RNA, 21 nt, Mycobacterium bovis subsp bovis AF2122/97
caggugcgccuggcuggccag

SEQ ID NO: 1119732 - RNA, 16 nt, Mycobacterium bovis subsp bovis AF2122/97
caggugaucccgaugg

SEQ ID NO: 1119733 - RNA, 13 nt, Mycobacterium bovis subsp bovis AF2122/97
caggugaucgcga

SEQ ID NO: 1119734 - RNA, 17 nt, Mycobacterium bovis subsp bovis AF2122/97
caggugagaccagguuc

SEQ ID NO: 1119735 - RNA, 17 nt, Mycobacterium bovis subsp bovis AF2122/97
caggugagugcggcgua

SEQ ID NO: 1119736 - RNA, 15 nt, Mycobacterium bovis subsp bovis AF2122/97
caggugagaccaggu

SEQ ID NO: 1119737 - RNA, 20 nt, Mycobacterium bovis subsp bovis AF2122/97
caggugagccaguuggccag

SEQ ID NO: 1119738 - RNA, 22 nt, Mycobacterium bovis subsp bovis AF2122/97
cagguguucgccggagacccgg

SEQ ID NO: 1119739 - RNA, 17 nt, Mycobacterium bovis subsp bovis AF2122/97
cagguuccacgcguuga

SEQ ID NO: 1119740 - RNA, 24 nt, Mycobacterium bovis subsp bovis AF2122/97
caggugguucaaccggacgaccgg

SEQ ID NO: 1119741 - RNA, 18 nt, Mycobacterium bovis subsp bovis AF2122/97
cagguuaggcaauagccg

SEQ ID NO: 1119742 - RNA, 15 nt, Mycobacterium bovis subsp bovis AF2122/97
caggugucgucgauc

SEQ ID NO: 1119743 - RNA, 19 nt, Mycobacterium bovis subsp bovis AF2122/97
cagguguugacgauccggu

SEQ ID NO: 1119744 - RNA, 14 nt, Mycobacterium bovis subsp bovis AF2122/97
caggucgcuggccg

SEQ ID NO: 1119745 - RNA, 15 nt, Mycobacterium bovis subsp bovis AF2122/97
caggucgcuggccgu

SEQ ID NO: 1119746 - RNA, 22 nt, Mycobacterium bovis subsp bovis AF2122/97
caggucgcccaacaccgcgccg

SEQ ID NO: 1119747 - RNA, 21 nt, Mycobacterium bovis subsp bovis AF2122/97
caggucuccaucaaccgcgcu

SEQ ID NO: 1119748 - RNA, 15 nt, Mycobacterium bovis subsp bovis AF2122/97
caggucugcggugcu

SEQ ID NO: 1119749 - RNA, 16 nt, Mycobacterium bovis subsp bovis AF2122/97
caggucuucgaccacg

SEQ ID NO: 1119750 - RNA, 20 nt, Mycobacterium bovis subsp bovis AF2122/97
caggucuuucgaauccccgc

SEQ ID NO: 1119751 - RNA, 21 nt, Mycobacterium bovis subsp bovis AF2122/97
caggugaccaguaggcaagca

SEQ ID NO: 1119752 - RNA, 18 nt, Mycobacterium bovis subsp bovis AF2122/97
caggugaacaacagcgcu

SEQ ID NO: 1119753 - RNA, 20 nt, Mycobacterium bovis subsp bovis AF2122/97
caggucgccuucccagccga

SEQ ID NO: 1119754 - RNA, 23 nt, Mycobacterium bovis subsp bovis AF2122/97
caggucgccuucuucgcggcggu

SEQ ID NO: 1119755 - RNA, 18 nt, Mycobacterium bovis subsp bovis AF2122/97
caggucgcgauagccgcc

SEQ ID NO: 1119756 - RNA, 19 nt, Mycobacterium bovis subsp bovis AF2122/97
caggucgcgauagccgccg

SEQ ID NO: 1119757 - RNA, 16 nt, Mycobacterium bovis subsp bovis AF2122/97
caggucgcccggucuc

SEQ ID NO: 1119758 - RNA, 17 nt, Mycobacterium bovis subsp bovis AF2122/97
caggucgccagcucggc

SEQ ID NO: 1119759 - RNA, 23 nt, Mycobacterium bovis subsp bovis AF2122/97
caggucgccagcucggcacccgc

SEQ ID NO: 1119760 - RNA, 15 nt, Mycobacterium bovis subsp bovis AF2122/97
cagucugggcgaucg

SEQ ID NO: 1119761 - RNA, 18 nt, Mycobacterium bovis subsp bovis AF2122/97
cagucucguggcgcuggg

SEQ ID NO: 1119762 - RNA, 23 nt, Mycobacterium bovis subsp bovis AF2122/97
cagucguugaugcuucgaaccgu

SEQ ID NO: 1119763 - RNA, 14 nt, Mycobacterium bovis subsp bovis AF2122/97
cagucgugggcugu

SEQ ID NO: 1119764 - RNA, 15 nt, Mycobacterium bovis subsp bovis AF2122/97
cagucggugcggugc

SEQ ID NO: 1119765 - RNA, 19 nt, Mycobacterium bovis subsp bovis AF2122/97
cagugacagugcgucgagc

SEQ ID NO: 1119766 - RNA, 20 nt, Mycobacterium bovis subsp bovis AF2122/97
cagugaaauccgagccgcga

SEQ ID NO: 1119767 - RNA, 19 nt, Mycobacterium bovis subsp bovis AF2122/97
cagucucaagguuucgaca

SEQ ID NO: 1119768 - RNA, 21 nt, Mycobacterium bovis subsp bovis AF2122/97
caguccuaucagugagccgcc

SEQ ID NO: 1119769 - RNA, 15 nt, Mycobacterium bovis subsp bovis AF2122/97
caguccguccagguc

SEQ ID NO: 1119770 - RNA, 22 nt, Mycobacterium bovis subsp bovis AF2122/97
caguccucgggcaggcggccag

SEQ ID NO: 1119771 - RNA, 15 nt, Mycobacterium bovis subsp bovis AF2122/97
cagucgagcaccugc

SEQ ID NO: 1119772 - RNA, 23 nt, Mycobacterium bovis subsp bovis AF2122/97
cagucgagcaccugccgaucggg

SEQ ID NO: 1119773 - RNA, 15 nt, Mycobacterium bovis subsp bovis AF2122/97
cagucggccaccugg

SEQ ID NO: 1119774 - RNA, 16 nt, Mycobacterium bovis subsp bovis AF2122/97
cagucgaucgcggccc

SEQ ID NO: 1119775 - RNA, 19 nt, Mycobacterium bovis subsp bovis AF2122/97
cagucgcacggugccgccg

SEQ ID NO: 1119776 - RNA, 14 nt, Mycobacterium bovis subsp bovis AF2122/97
cagucgcagcacgg

SEQ ID NO: 1119777 - RNA, 17 nt, Mycobacterium bovis subsp bovis AF2122/97
cagucgauuucggcggc

SEQ ID NO: 1119778 - RNA, 19 nt, Mycobacterium bovis subsp bovis AF2122/97
cagucgcaaaagcccccau

SEQ ID NO: 1119779 - RNA, 19 nt, Mycobacterium bovis subsp bovis AF2122/97
cagguugaggugugccgac

SEQ ID NO: 1119780 - RNA, 20 nt, Mycobacterium bovis subsp bovis AF2122/97
cagguucuucuccaccaccg

SEQ ID NO: 1119781 - RNA, 21 nt, Mycobacterium bovis subsp bovis AF2122/97
cagguugcgccauaacaccgg

SEQ ID NO: 1119782 - RNA, 14 nt, Mycobacterium bovis subsp bovis AF2122/97
cagguugccgucgg

SEQ ID NO: 1119783 - RNA, 17 nt, Mycobacterium bovis subsp bovis AF2122/97
caguaacuucaccggcu

SEQ ID NO: 1119784 - RNA, 21 nt, Mycobacterium bovis subsp bovis AF2122/97
caguaggccuccgcugccgcc

SEQ ID NO: 1119785 - RNA, 22 nt, Mycobacterium bovis subsp bovis AF2122/97
caguagcugcucaucgcgcccg

SEQ ID NO: 1119786 - RNA, 18 nt, Mycobacterium bovis subsp bovis AF2122/97
caguaugcggugcccgcc

SEQ ID NO: 1119787 - RNA, 13 nt, Mycobacterium bovis subsp bovis AF2122/97
caguauggccgcc

SEQ ID NO: 1119788 - RNA, 18 nt, Mycobacterium bovis subsp bovis AF2122/97
caguauggccgccaccgc

SEQ ID NO: 1119789 - RNA, 17 nt, Mycobacterium bovis subsp bovis AF2122/97
cagucaccaaccacaug

SEQ ID NO: 1119790 - RNA, 20 nt, Mycobacterium bovis subsp bovis AF2122/97
caguauggccgccaccgcga

SEQ ID NO: 1119791 - RNA, 16 nt, Mycobacterium bovis subsp bovis AF2122/97
cagucaggaaaccggc

SEQ ID NO: 1119792 - RNA, 23 nt, Mycobacterium bovis subsp bovis AF2122/97
cagucaggccuagcgcggcgacg

SEQ ID NO: 1119793 - RNA, 20 nt, Mycobacterium bovis subsp bovis AF2122/97
caucgagccaacgcgcagag

SEQ ID NO: 1119794 - RNA, 12 nt, Mycobacterium bovis subsp bovis AF2122/97
caucgagcggga

SEQ ID NO: 1119795 - RNA, 20 nt, Mycobacterium bovis subsp bovis AF2122/97
caucgaggcgaucaccgcgc

SEQ ID NO: 1119796 - RNA, 23 nt, Mycobacterium bovis subsp bovis AF2122/97
caucgaucacacguccgcgcacc

SEQ ID NO: 1119797 - RNA, 16 nt, Mycobacterium bovis subsp bovis AF2122/97
caucgaguucggcccg

SEQ ID NO: 1119798 - RNA, 17 nt, Mycobacterium bovis subsp bovis AF2122/97
caucgaguugcucggcc

SEQ ID NO: 1119799 - RNA, 18 nt, Mycobacterium bovis subsp bovis AF2122/97
caucgaguugcucggccg

SEQ ID NO: 1119800 - RNA, 17 nt, Mycobacterium bovis subsp bovis AF2122/97
caucgcacgggccacca

SEQ ID NO: 1119801 - RNA, 17 nt, Mycobacterium bovis subsp bovis AF2122/97
caucgcagacggcugcc

SEQ ID NO: 1119802 - RNA, 20 nt, Mycobacterium bovis subsp bovis AF2122/97
caucgcauccacuuccgggc

SEQ ID NO: 1119803 - RNA, 23 nt, Mycobacterium bovis subsp bovis AF2122/97
caucgcauccccagcacaaccag

SEQ ID NO: 1119804 - RNA, 22 nt, Mycobacterium bovis subsp bovis AF2122/97
caucgcaggcaccccgaucacc

SEQ ID NO: 1119805 - RNA, 18 nt, Mycobacterium bovis subsp bovis AF2122/97
caucgauccucgcccgca

SEQ ID NO: 1119806 - RNA, 19 nt, Mycobacterium bovis subsp bovis AF2122/97
caucgaugucggcucggcc

SEQ ID NO: 1119807 - RNA, 21 nt, Mycobacterium bovis subsp bovis AF2122/97
caucgaccguccgggucacca

SEQ ID NO: 1119808 - RNA, 16 nt, Mycobacterium bovis subsp bovis AF2122/97
caucgaccuggccacg

SEQ ID NO: 1119809 - RNA, 13 nt, Mycobacterium bovis subsp bovis AF2122/97
caucgaccgcccg

SEQ ID NO: 1119810 - RNA, 15 nt, Mycobacterium bovis subsp bovis AF2122/97
caucgaccgcccgcc

SEQ ID NO: 1119811 - RNA, 19 nt, Mycobacterium bovis subsp bovis AF2122/97
caucgaccgcggccgggug

SEQ ID NO: 1119812 - RNA, 22 nt, Mycobacterium bovis subsp bovis AF2122/97
caucgacgcucaucucgggcac

SEQ ID NO: 1119813 - RNA, 15 nt, Mycobacterium bovis subsp bovis AF2122/97
caucgagcagcccgg

SEQ ID NO: 1119814 - RNA, 18 nt, Mycobacterium bovis subsp bovis AF2122/97
caucgagcaguggccgcc

SEQ ID NO: 1119815 - RNA, 19 nt, Mycobacterium bovis subsp bovis AF2122/97
caucgagcaguggccgccg

SEQ ID NO: 1119816 - RNA, 23 nt, Mycobacterium bovis subsp bovis AF2122/97
caucgacgcucaucucgggcacg

SEQ ID NO: 1119817 - RNA, 17 nt, Mycobacterium bovis subsp bovis AF2122/97
caucgagacgagccacg

SEQ ID NO: 1119818 - RNA, 18 nt, Mycobacterium bovis subsp bovis AF2122/97
caucgagacgcacggcca

SEQ ID NO: 1119819 - RNA, 21 nt, Mycobacterium bovis subsp bovis AF2122/97
caucgagacgcacggccaccg

SEQ ID NO: 1119820 - RNA, 20 nt, Mycobacterium bovis subsp bovis AF2122/97
caucgagaguugaauccggg

SEQ ID NO: 1119821 - RNA, 19 nt, Mycobacterium bovis subsp bovis AF2122/97
caucgccaccaucaccgcc

SEQ ID NO: 1119822 - RNA, 14 nt, Mycobacterium bovis subsp bovis AF2122/97
caucgccaacacca

SEQ ID NO: 1119823 - RNA, 15 nt, Mycobacterium bovis subsp bovis AF2122/97
caucgccaccacccc

SEQ ID NO: 1119824 - RNA, 14 nt, Mycobacterium bovis subsp bovis AF2122/97
caucgccaccaccg

SEQ ID NO: 1119825 - RNA, 17 nt, Mycobacterium bovis subsp bovis AF2122/97
caucgccagcaucagcc

SEQ ID NO: 1119826 - RNA, 14 nt, Mycobacterium bovis subsp bovis AF2122/97
caucgccagcggca

SEQ ID NO: 1119827 - RNA, 17 nt, Mycobacterium bovis subsp bovis AF2122/97
caucgcccggaaccggc

SEQ ID NO: 1119828 - RNA, 20 nt, Mycobacterium bovis subsp bovis AF2122/97
caucgcccggaaccggcgug

SEQ ID NO: 1119829 - RNA, 15 nt, Mycobacterium bovis subsp bovis AF2122/97
caucgcccugggcgc

SEQ ID NO: 1119830 - RNA, 20 nt, Mycobacterium bovis subsp bovis AF2122/97
caucgcccugggcgccggcg

SEQ ID NO: 1119831 - RNA, 21 nt, Mycobacterium bovis subsp bovis AF2122/97
caucgcccugggcgccggcgu

SEQ ID NO: 1119832 - RNA, 20 nt, Mycobacterium bovis subsp bovis AF2122/97
caucgccauaccggccgcca

SEQ ID NO: 1119833 - RNA, 12 nt, Mycobacterium bovis subsp bovis AF2122/97
caucgccacgcc

SEQ ID NO: 1119834 - RNA, 15 nt, Mycobacterium bovis subsp bovis AF2122/97
caucgcccaacaacg

SEQ ID NO: 1119835 - RNA, 13 nt, Mycobacterium bovis subsp bovis AF2122/97
caucgccggaccg

SEQ ID NO: 1119836 - RNA, 18 nt, Mycobacterium bovis subsp bovis AF2122/97
caucgccggaccggugug

SEQ ID NO: 1119837 - RNA, 13 nt, Mycobacterium bovis subsp bovis AF2122/97
caucgccggcacg

SEQ ID NO: 1119838 - RNA, 16 nt, Mycobacterium bovis subsp bovis AF2122/97
caucgccggcgcgccg

SEQ ID NO: 1119839 - RNA, 16 nt, Mycobacterium bovis subsp bovis AF2122/97
caucgccgacagcgcc

SEQ ID NO: 1119840 - RNA, 21 nt, Mycobacterium bovis subsp bovis AF2122/97
caucgccgagguggacaaauc

SEQ ID NO: 1119841 - RNA, 16 nt, Mycobacterium bovis subsp bovis AF2122/97
caucgccgccaaccac

SEQ ID NO: 1119842 - RNA, 16 nt, Mycobacterium bovis subsp bovis AF2122/97
caucgccgcagugcgc

SEQ ID NO: 1119843 - RNA, 14 nt, Mycobacterium bovis subsp bovis AF2122/97
caucgccgcccccg

SEQ ID NO: 1119844 - RNA, 19 nt, Mycobacterium bovis subsp bovis AF2122/97
caucgccgcccgagcaccc

SEQ ID NO: 1119845 - RNA, 21 nt, Mycobacterium bovis subsp bovis AF2122/97
caucgccgcccgagcacccca

SEQ ID NO: 1119846 - RNA, 13 nt, Mycobacterium bovis subsp bovis AF2122/97
caucgccgccgcg

SEQ ID NO: 1119847 - RNA, 12 nt, Mycobacterium bovis subsp bovis AF2122/97
caucgccgccgg

SEQ ID NO: 1119848 - RNA, 14 nt, Mycobacterium bovis subsp bovis AF2122/97
caucgccgccguug

SEQ ID NO: 1119849 - RNA, 11 nt, Mycobacterium bovis subsp bovis AF2122/97
caucgcggcga

SEQ ID NO: 1119850 - RNA, 13 nt, Mycobacterium bovis subsp bovis AF2122/97
caucgcggcaucg

SEQ ID NO: 1119851 - RNA, 18 nt, Mycobacterium bovis subsp bovis AF2122/97
caucgcgcgccgaccgac

SEQ ID NO: 1119852 - RNA, 17 nt, Mycobacterium bovis subsp bovis AF2122/97
caucgcgcugcggccca

SEQ ID NO: 1119853 - RNA, 17 nt, Mycobacterium bovis subsp bovis AF2122/97
caucgcgggcggcgcug

SEQ ID NO: 1119854 - RNA, 21 nt, Mycobacterium bovis subsp bovis AF2122/97
caucgcggucgccaccguguc

SEQ ID NO: 1119855 - RNA, 17 nt, Mycobacterium bovis subsp bovis AF2122/97
caucgcgcgcggcuccg

SEQ ID NO: 1119856 - RNA, 14 nt, Mycobacterium bovis subsp bovis AF2122/97
caucgcgcggacca

SEQ ID NO: 1119857 - RNA, 21 nt, Mycobacterium bovis subsp bovis AF2122/97
caucgcgccuuugagcccgcg

SEQ ID NO: 1119858 - RNA, 15 nt, Mycobacterium bovis subsp bovis AF2122/97
caucgcgcgccgacc

SEQ ID NO: 1119859 - RNA, 17 nt, Mycobacterium bovis subsp bovis AF2122/97
caucgccuccaggcgcc

SEQ ID NO: 1119860 - RNA, 21 nt, Mycobacterium bovis subsp bovis AF2122/97
caucgccuccaggcgccaccc

SEQ ID NO: 1119861 - RNA, 14 nt, Mycobacterium bovis subsp bovis AF2122/97
caucgccuccucga

SEQ ID NO: 1119862 - RNA, 20 nt, Mycobacterium bovis subsp bovis AF2122/97
caucgccuccagccggcgaa

SEQ ID NO: 1119863 - RNA, 16 nt, Mycobacterium bovis subsp bovis AF2122/97
caucgccuccucgacg

SEQ ID NO: 1119864 - RNA, 18 nt, Mycobacterium bovis subsp bovis AF2122/97
caucgccuccucgacguc

SEQ ID NO: 1119865 - RNA, 19 nt, Mycobacterium bovis subsp bovis AF2122/97
caucgccuccucgacgucg

SEQ ID NO: 1119866 - RNA, 13 nt, Mycobacterium bovis subsp bovis AF2122/97
caucgccucgagg

SEQ ID NO: 1119867 - RNA, 20 nt, Mycobacterium bovis subsp bovis AF2122/97
caucgccucgaggaccacca

SEQ ID NO: 1119868 - RNA, 19 nt, Mycobacterium bovis subsp bovis AF2122/97
caucgccuugaacauggga

SEQ ID NO: 1119869 - RNA, 22 nt, Mycobacterium bovis subsp bovis AF2122/97
caucgcgaaaccggaccugacc

SEQ ID NO: 1119870 - RNA, 17 nt, Mycobacterium bovis subsp bovis AF2122/97
caucgcgaacucgggca

SEQ ID NO: 1119871 - RNA, 12 nt, Mycobacterium bovis subsp bovis AF2122/97
caucgcgacauc

SEQ ID NO: 1119872 - RNA, 19 nt, Mycobacterium bovis subsp bovis AF2122/97
caucgccuggaugccgauc

SEQ ID NO: 1119873 - RNA, 17 nt, Mycobacterium bovis subsp bovis AF2122/97
caucgcgacggcaagca

SEQ ID NO: 1119874 - RNA, 22 nt, Mycobacterium bovis subsp bovis AF2122/97
caucgcgagaaggugcugcgcg

SEQ ID NO: 1119875 - RNA, 15 nt, Mycobacterium bovis subsp bovis AF2122/97
caucgcgacgaucgu

SEQ ID NO: 1119876 - RNA, 20 nt, Mycobacterium bovis subsp bovis AF2122/97
caucgcgauuccggcggcca

SEQ ID NO: 1119877 - RNA, 22 nt, Mycobacterium bovis subsp bovis AF2122/97
caucgcgauuccggcggccacg

SEQ ID NO: 1119878 - RNA, 22 nt, Mycobacterium bovis subsp bovis AF2122/97
caucgcgaucggggcgacgauc

SEQ ID NO: 1119879 - RNA, 14 nt, Mycobacterium bovis subsp bovis AF2122/97
caucggccgcgguc

SEQ ID NO: 1119880 - RNA, 15 nt, Mycobacterium bovis subsp bovis AF2122/97
caucggccgcggucg

SEQ ID NO: 1119881 - RNA, 14 nt, Mycobacterium bovis subsp bovis AF2122/97
caucggccggcguc

SEQ ID NO: 1119882 - RNA, 16 nt, Mycobacterium bovis subsp bovis AF2122/97
caucggccggcgucag

SEQ ID NO: 1119883 - RNA, 13 nt, Mycobacterium bovis subsp bovis AF2122/97
caucggcgaccgc

SEQ ID NO: 1119884 - RNA, 16 nt, Mycobacterium bovis subsp bovis AF2122/97
caucggcgaccgccug

SEQ ID NO: 1119885 - RNA, 18 nt, Mycobacterium bovis subsp bovis AF2122/97
caucggccucugaccagc

SEQ ID NO: 1119886 - RNA, 21 nt, Mycobacterium bovis subsp bovis AF2122/97
caucggccucugaccagccgg

SEQ ID NO: 1119887 - RNA, 12 nt, Mycobacterium bovis subsp bovis AF2122/97
caucggccagca

SEQ ID NO: 1119888 - RNA, 18 nt, Mycobacterium bovis subsp bovis AF2122/97
caucggcccccaacgcgg

SEQ ID NO: 1119889 - RNA, 13 nt, Mycobacterium bovis subsp bovis AF2122/97
caucggccagccg

SEQ ID NO: 1119890 - RNA, 19 nt, Mycobacterium bovis subsp bovis AF2122/97
caucggccagccguucucg

SEQ ID NO: 1119891 - RNA, 14 nt, Mycobacterium bovis subsp bovis AF2122/97
caucggccagcuug

SEQ ID NO: 1119892 - RNA, 19 nt, Mycobacterium bovis subsp bovis AF2122/97
caucggcagccccugccga

SEQ ID NO: 1119893 - RNA, 18 nt, Mycobacterium bovis subsp bovis AF2122/97
caucggcauccgcgggga

SEQ ID NO: 1119894 - RNA, 23 nt, Mycobacterium bovis subsp bovis AF2122/97
caucggcauccgcggggagucga

SEQ ID NO: 1119895 - RNA, 11 nt, Mycobacterium bovis subsp bovis AF2122/97
caucggcacgc

SEQ ID NO: 1119896 - RNA, 20 nt, Mycobacterium bovis subsp bovis AF2122/97
caucggcacgccauaccggc

SEQ ID NO: 1119897 - RNA, 15 nt, Mycobacterium bovis subsp bovis AF2122/97
caucggcagcagcgc

SEQ ID NO: 1119898 - RNA, 16 nt, Mycobacterium bovis subsp bovis AF2122/97
caucggcaccgucucg

SEQ ID NO: 1119899 - RNA, 13 nt, Mycobacterium bovis subsp bovis AF2122/97
caucggcaccagc

SEQ ID NO: 1119900 - RNA, 21 nt, Mycobacterium bovis subsp bovis AF2122/97
caucggcaccagcgcgcgccg

SEQ ID NO: 1119901 - RNA, 13 nt, Mycobacterium bovis subsp bovis AF2122/97
caucggcaccccg

SEQ ID NO: 1119902 - RNA, 16 nt, Mycobacterium bovis subsp bovis AF2122/97
caucggcaccccggcc

SEQ ID NO: 1119903 - RNA, 17 nt, Mycobacterium bovis subsp bovis AF2122/97
caucggcaccccggcca

SEQ ID NO: 1119904 - RNA, 20 nt, Mycobacterium bovis subsp bovis AF2122/97
caucggagauacgggccacc

SEQ ID NO: 1119905 - RNA, 21 nt, Mycobacterium bovis subsp bovis AF2122/97
caucggagauacgggccaccg

SEQ ID NO: 1119906 - RNA, 20 nt, Mycobacterium bovis subsp bovis AF2122/97
caucggacagcgccuggccg

SEQ ID NO: 1119907 - RNA, 22 nt, Mycobacterium bovis subsp bovis AF2122/97
caucggacagcgccuggccgga

SEQ ID NO: 1119908 - RNA, 21 nt, Mycobacterium bovis subsp bovis AF2122/97
caucggauggcccccaagacc

SEQ ID NO: 1119909 - RNA, 21 nt, Mycobacterium bovis subsp bovis AF2122/97
caucggaaccguuugacgcgc

SEQ ID NO: 1119910 - RNA, 17 nt, Mycobacterium bovis subsp bovis AF2122/97
caucggcaaggcggauc

SEQ ID NO: 1119911 - RNA, 16 nt, Mycobacterium bovis subsp bovis AF2122/97
caucggcacaggcggc

SEQ ID NO: 1119912 - RNA, 21 nt, Mycobacterium bovis subsp bovis AF2122/97
caucggcacaggcggccagca

SEQ ID NO: 1119913 - RNA, 21 nt, Mycobacterium bovis subsp bovis AF2122/97
caucgcugggcacucggcccg

SEQ ID NO: 1119914 - RNA, 17 nt, Mycobacterium bovis subsp bovis AF2122/97
caucgcucaucgucacc

SEQ ID NO: 1119915 - RNA, 23 nt, Mycobacterium bovis subsp bovis AF2122/97
caucgcgggugaucuccaccggc

SEQ ID NO: 1119916 - RNA, 14 nt, Mycobacterium bovis subsp bovis AF2122/97
caucagcgcgaccg

SEQ ID NO: 1119917 - RNA, 20 nt, Mycobacterium bovis subsp bovis AF2122/97
caucaggaagcgugcggucg

SEQ ID NO: 1119918 - RNA, 16 nt, Mycobacterium bovis subsp bovis AF2122/97
cauccacuccgccaac

SEQ ID NO: 1119919 - RNA, 22 nt, Mycobacterium bovis subsp bovis AF2122/97
cauccacugcggcgcugggacg

SEQ ID NO: 1119920 - RNA, 14 nt, Mycobacterium bovis subsp bovis AF2122/97
caucaggccgcgcg

SEQ ID NO: 1119921 - RNA, 17 nt, Mycobacterium bovis subsp bovis AF2122/97
cauccagaagccggcca

SEQ ID NO: 1119922 - RNA, 20 nt, Mycobacterium bovis subsp bovis AF2122/97
cauccagaagccggccacua

SEQ ID NO: 1119923 - RNA, 12 nt, Mycobacterium bovis subsp bovis AF2122/97
cauccagcagcg

SEQ ID NO: 1119924 - RNA, 20 nt, Mycobacterium bovis subsp bovis AF2122/97
cauccagcgcuucggccuga

SEQ ID NO: 1119925 - RNA, 12 nt, Mycobacterium bovis subsp bovis AF2122/97
cauccagcgcgu

SEQ ID NO: 1119926 - RNA, 15 nt, Mycobacterium bovis subsp bovis AF2122/97
cauccagcgcuucgg

SEQ ID NO: 1119927 - RNA, 17 nt, Mycobacterium bovis subsp bovis AF2122/97
cauccaguaaccguccg

SEQ ID NO: 1119928 - RNA, 17 nt, Mycobacterium bovis subsp bovis AF2122/97
cauccaggcugucgcgg

SEQ ID NO: 1119929 - RNA, 12 nt, Mycobacterium bovis subsp bovis AF2122/97
caucccagucga

SEQ ID NO: 1119930 - RNA, 13 nt, Mycobacterium bovis subsp bovis AF2122/97
cauccauucggcg

SEQ ID NO: 1119931 - RNA, 15 nt, Mycobacterium bovis subsp bovis AF2122/97
cauccugcagcucgg

SEQ ID NO: 1119932 - RNA, 19 nt, Mycobacterium bovis subsp bovis AF2122/97
cauccucugaaccagcuga

SEQ ID NO: 1119933 - RNA, 21 nt, Mycobacterium bovis subsp bovis AF2122/97
cauccucugaaccagcugagc

SEQ ID NO: 1119934 - RNA, 18 nt, Mycobacterium bovis subsp bovis AF2122/97
cauccuggcggcugcagc

SEQ ID NO: 1119935 - RNA, 19 nt, Mycobacterium bovis subsp bovis AF2122/97
caucgaauuccagccagcc

SEQ ID NO: 1119936 - RNA, 16 nt, Mycobacterium bovis subsp bovis AF2122/97
caucgaaaaaccucga

SEQ ID NO: 1119937 - RNA, 20 nt, Mycobacterium bovis subsp bovis AF2122/97
caucgaaaaaccucgacgcc

SEQ ID NO: 1119938 - RNA, 16 nt, Mycobacterium bovis subsp bovis AF2122/97
cauccuucgccggcgc

SEQ ID NO: 1119939 - RNA, 17 nt, Mycobacterium bovis subsp bovis AF2122/97
cauccuucgccggcgcc

SEQ ID NO: 1119940 - RNA, 21 nt, Mycobacterium bovis subsp bovis AF2122/97
cauccuucgccggcgccagca

SEQ ID NO: 1119941 - RNA, 15 nt, Mycobacterium bovis subsp bovis AF2122/97
cauccuugacgcggc

SEQ ID NO: 1119942 - RNA, 18 nt, Mycobacterium bovis subsp bovis AF2122/97
cauccuugaggucaucgg

SEQ ID NO: 1119943 - RNA, 20 nt, Mycobacterium bovis subsp bovis AF2122/97
cauccuugaggucaucgggc

SEQ ID NO: 1119944 - RNA, 13 nt, Mycobacterium bovis subsp bovis AF2122/97
cauccuccucguc

SEQ ID NO: 1119945 - RNA, 17 nt, Mycobacterium bovis subsp bovis AF2122/97
cauccuccucgucgacg

SEQ ID NO: 1119946 - RNA, 18 nt, Mycobacterium bovis subsp bovis AF2122/97
cauccuccucgucgacgu

SEQ ID NO: 1119947 - RNA, 15 nt, Mycobacterium bovis subsp bovis AF2122/97
cauccggccgucggg

SEQ ID NO: 1119948 - RNA, 23 nt, Mycobacterium bovis subsp bovis AF2122/97
cauccgcuugcggggccgggcga

SEQ ID NO: 1119949 - RNA, 22 nt, Mycobacterium bovis subsp bovis AF2122/97
caucagcccggcgcgccgaguu

SEQ ID NO: 1119950 - RNA, 19 nt, Mycobacterium bovis subsp bovis AF2122/97
caucagcaggaccaacgcc

SEQ ID NO: 1119951 - RNA, 14 nt, Mycobacterium bovis subsp bovis AF2122/97
caucagcacgucgc

SEQ ID NO: 1119952 - RNA, 18 nt, Mycobacterium bovis subsp bovis AF2122/97
caucacgguggccgcacg

SEQ ID NO: 1119953 - RNA, 15 nt, Mycobacterium bovis subsp bovis AF2122/97
caucacgggacgacg

SEQ ID NO: 1119954 - RNA, 17 nt, Mycobacterium bovis subsp bovis AF2122/97
caucacgggacgacggc

SEQ ID NO: 1119955 - RNA, 19 nt, Mycobacterium bovis subsp bovis AF2122/97
caucacgcgcucaccgacg

SEQ ID NO: 1119956 - RNA, 21 nt, Mycobacterium bovis subsp bovis AF2122/97
caucacgaaggcguucgccgg

SEQ ID NO: 1119957 - RNA, 17 nt, Mycobacterium bovis subsp bovis AF2122/97
caucacgccccagguuc

SEQ ID NO: 1119958 - RNA, 13 nt, Mycobacterium bovis subsp bovis AF2122/97
caucacgccgccg

SEQ ID NO: 1119959 - RNA, 14 nt, Mycobacterium bovis subsp bovis AF2122/97
caucacgccgccgg

SEQ ID NO: 1119960 - RNA, 14 nt, Mycobacterium bovis subsp bovis AF2122/97
caucacgaccaggg

SEQ ID NO: 1119961 - RNA, 17 nt, Mycobacterium bovis subsp bovis AF2122/97
caucacgacucccccgg

SEQ ID NO: 1119962 - RNA, 17 nt, Mycobacterium bovis subsp bovis AF2122/97
caucacgaaggcguucg

SEQ ID NO: 1119963 - RNA, 14 nt, Mycobacterium bovis subsp bovis AF2122/97
caucaccggugcgc

SEQ ID NO: 1119964 - RNA, 16 nt, Mycobacterium bovis subsp bovis AF2122/97
caucaccgucgcccgg

SEQ ID NO: 1119965 - RNA, 17 nt, Mycobacterium bovis subsp bovis AF2122/97
cauagccgaacagcgga

SEQ ID NO: 1119966 - RNA, 17 nt, Mycobacterium bovis subsp bovis AF2122/97
cauagccugcgccgacc

SEQ ID NO: 1119967 - RNA, 20 nt, Mycobacterium bovis subsp bovis AF2122/97
cauagcgacggcgcucggcg

SEQ ID NO: 1119968 - RNA, 14 nt, Mycobacterium bovis subsp bovis AF2122/97
cauagcgccgcgcc

SEQ ID NO: 1119969 - RNA, 15 nt, Mycobacterium bovis subsp bovis AF2122/97
cauagcgccgcgccc

SEQ ID NO: 1119970 - RNA, 19 nt, Mycobacterium bovis subsp bovis AF2122/97
cauagcggcccaucgggcg

SEQ ID NO: 1119971 - RNA, 15 nt, Mycobacterium bovis subsp bovis AF2122/97
cauagcccgagcgcu

SEQ ID NO: 1119972 - RNA, 18 nt, Mycobacterium bovis subsp bovis AF2122/97
cauagcaauccgcacagc

SEQ ID NO: 1119973 - RNA, 19 nt, Mycobacterium bovis subsp bovis AF2122/97
cauagcaauccgcacagcg

SEQ ID NO: 1119974 - RNA, 22 nt, Mycobacterium bovis subsp bovis AF2122/97
cauaggccaccuccgaggccgc

SEQ ID NO: 1119975 - RNA, 21 nt, Mycobacterium bovis subsp bovis AF2122/97
cauaggacaggaacggcccgg

SEQ ID NO: 1119976 - RNA, 15 nt, Mycobacterium bovis subsp bovis AF2122/97
cauaggaucgcgccc

SEQ ID NO: 1119977 - RNA, 16 nt, Mycobacterium bovis subsp bovis AF2122/97
cauagcucagaccggc

SEQ ID NO: 1119978 - RNA, 18 nt, Mycobacterium bovis subsp bovis AF2122/97
cauaggacaggaacggcc

SEQ ID NO: 1119979 - RNA, 15 nt, Mycobacterium bovis subsp bovis AF2122/97
caucaagagcgcgcc

SEQ ID NO: 1119980 - RNA, 16 nt, Mycobacterium bovis subsp bovis AF2122/97
cccuugguggccagcc

SEQ ID NO: 1119981 - RNA, 17 nt, Mycobacterium bovis subsp bovis AF2122/97
cccuugguggccagcca

SEQ ID NO: 1119982 - RNA, 12 nt, Mycobacterium bovis subsp bovis AF2122/97
cccuugccgucc

SEQ ID NO: 1119983 - RNA, 18 nt, Mycobacterium bovis subsp bovis AF2122/97
cccuugccuuccgaccca

SEQ ID NO: 1119984 - RNA, 20 nt, Mycobacterium bovis subsp bovis AF2122/97
cccuuggccagcagggccac

SEQ ID NO: 1119985 - RNA, 22 nt, Mycobacterium bovis subsp bovis AF2122/97
cccuucgguggggucgcugccg

SEQ ID NO: 1119986 - RNA, 17 nt, Mycobacterium bovis subsp bovis AF2122/97
cccuggacuucgggggc

SEQ ID NO: 1119987 - RNA, 14 nt, Mycobacterium bovis subsp bovis AF2122/97
cccugcgguccgcu

SEQ ID NO: 1119988 - RNA, 16 nt, Mycobacterium bovis subsp bovis AF2122/97
cccuucaaagcggccu

SEQ ID NO: 1119989 - RNA, 22 nt, Mycobacterium bovis subsp bovis AF2122/97
cccugugucgccgucgcggcac

SEQ ID NO: 1119990 - RNA, 22 nt, Mycobacterium bovis subsp bovis AF2122/97
cccuguucggcccgaggugccg

SEQ ID NO: 1119991 - RNA, 23 nt, Mycobacterium bovis subsp bovis AF2122/97
cccuuaagccggcgcggcggcgu

SEQ ID NO: 1119992 - RNA, 22 nt, Mycobacterium bovis subsp bovis AF2122/97
cccuguuguugccccggucggc

SEQ ID NO: 1119993 - RNA, 11 nt, Mycobacterium bovis subsp bovis AF2122/97
ccgaacaccgu

SEQ ID NO: 1119994 - RNA, 17 nt, Mycobacterium bovis subsp bovis AF2122/97
ccgaacaccgucagcgu

SEQ ID NO: 1119995 - RNA, 11 nt, Mycobacterium bovis subsp bovis AF2122/97
ccgaacaccga

SEQ ID NO: 1119996 - RNA, 18 nt, Mycobacterium bovis subsp bovis AF2122/97
ccgaacaccgccgcgucg

SEQ ID NO: 1119997 - RNA, 14 nt, Mycobacterium bovis subsp bovis AF2122/97
cccuuucgcgccgc

SEQ ID NO: 1119998 - RNA, 13 nt, Mycobacterium bovis subsp bovis AF2122/97
ccgaacaccucgg

SEQ ID NO: 1119999 - RNA, 19 nt, Mycobacterium bovis subsp bovis AF2122/97
ccgaacaccucggcacgga

SEQ ID NO: 1120000 - RNA, 16 nt, Mycobacterium bovis subsp bovis AF2122/97
ccgaacagccgagcca

SEQ ID NO: 1120001 - RNA, 15 nt, Mycobacterium bovis subsp bovis AF2122/97
ccgaacagcggcagc

SEQ ID NO: 1120002 - RNA, 17 nt, Mycobacterium bovis subsp bovis AF2122/97
ccgaacagcugcccgcc

SEQ ID NO: 1120003 - RNA, 22 nt, Mycobacterium bovis subsp bovis AF2122/97
ccgaacagcugcccgccagcgc

SEQ ID NO: 1120004 - RNA, 12 nt, Mycobacterium bovis subsp bovis AF2122/97
ccgaacagcugg

SEQ ID NO: 1120005 - RNA, 16 nt, Mycobacterium bovis subsp bovis AF2122/97
ccgaacagcggcagcu

SEQ ID NO: 1120006 - RNA, 17 nt, Mycobacterium bovis subsp bovis AF2122/97
ccgaacagcuggacggc

SEQ ID NO: 1120007 - RNA, 15 nt, Mycobacterium bovis subsp bovis AF2122/97
ccgaacagucgcagc

SEQ ID NO: 1120008 - RNA, 21 nt, Mycobacterium bovis subsp bovis AF2122/97
ccgaacaguggggguccggcg

SEQ ID NO: 1120009 - RNA, 21 nt, Mycobacterium bovis subsp bovis AF2122/97
ccgaacagggaggucgccgca

SEQ ID NO: 1120010 - RNA, 17 nt, Mycobacterium bovis subsp bovis AF2122/97
ccgaacgccaccaccuc

SEQ ID NO: 1120011 - RNA, 12 nt, Mycobacterium bovis subsp bovis AF2122/97
ccgaacgcacgu

SEQ ID NO: 1120012 - RNA, 22 nt, Mycobacterium bovis subsp bovis AF2122/97
ccgaacgcacgucgaggcggca

SEQ ID NO: 1120013 - RNA, 13 nt, Mycobacterium bovis subsp bovis AF2122/97
ccgaacgcgaggu

SEQ ID NO: 1120014 - RNA, 16 nt, Mycobacterium bovis subsp bovis AF2122/97
ccgaacguggcucggc

SEQ ID NO: 1120015 - RNA, 18 nt, Mycobacterium bovis subsp bovis AF2122/97
ccgaacuaucguugugcg

SEQ ID NO: 1120016 - RNA, 18 nt, Mycobacterium bovis subsp bovis AF2122/97
ccgaacgugaacucacgg

SEQ ID NO: 1120017 - RNA, 17 nt, Mycobacterium bovis subsp bovis AF2122/97
ccgaacgguugcucguc

SEQ ID NO: 1120018 - RNA, 13 nt, Mycobacterium bovis subsp bovis AF2122/97
ccgaacuccgcgg

SEQ ID NO: 1120019 - RNA, 15 nt, Mycobacterium bovis subsp bovis AF2122/97
ccgaacucguuggcg

SEQ ID NO: 1120020 - RNA, 19 nt, Mycobacterium bovis subsp bovis AF2122/97
ccgaacucgcgggcgacca

SEQ ID NO: 1120021 - RNA, 23 nt, Mycobacterium bovis subsp bovis AF2122/97
ccgaacugggcgaucgacaccgu

SEQ ID NO: 1120022 - RNA, 19 nt, Mycobacterium bovis subsp bovis AF2122/97
ccgaacuucugguaggcgg

SEQ ID NO: 1120023 - RNA, 22 nt, Mycobacterium bovis subsp bovis AF2122/97
ccgaacuucugguaggcggcca

SEQ ID NO: 1120024 - RNA, 23 nt, Mycobacterium bovis subsp bovis AF2122/97
ccgaacuugacgaacucgccguc

SEQ ID NO: 1120025 - RNA, 21 nt, Mycobacterium bovis subsp bovis AF2122/97
cccugcacccagccgugccca

SEQ ID NO: 1120026 - RNA, 18 nt, Mycobacterium bovis subsp bovis AF2122/97
cccugcaccgucacgucg

SEQ ID NO: 1120027 - RNA, 22 nt, Mycobacterium bovis subsp bovis AF2122/97
cccugcagacggguggcccgac

SEQ ID NO: 1120028 - RNA, 16 nt, Mycobacterium bovis subsp bovis AF2122/97
cccugauggggccuug

SEQ ID NO: 1120029 - RNA, 20 nt, Mycobacterium bovis subsp bovis AF2122/97
cccucgcuaauugcggccgc

SEQ ID NO: 1120030 - RNA, 13 nt, Mycobacterium bovis subsp bovis AF2122/97
cccugagccaccc

SEQ ID NO: 1120031 - RNA, 13 nt, Mycobacterium bovis subsp bovis AF2122/97
cccugcgggccga

SEQ ID NO: 1120032 - RNA, 23 nt, Mycobacterium bovis subsp bovis AF2122/97
cccugcgggccgagaucacgccg

SEQ ID NO: 1120033 - RNA, 22 nt, Mycobacterium bovis subsp bovis AF2122/97
cccugcaguccacugaucaggc

SEQ ID NO: 1120034 - RNA, 15 nt, Mycobacterium bovis subsp bovis AF2122/97
cccugcauaggcgcg

SEQ ID NO: 1120035 - RNA, 19 nt, Mycobacterium bovis subsp bovis AF2122/97
cccugcauaggcgcgguca

SEQ ID NO: 1120036 - RNA, 17 nt, Mycobacterium bovis subsp bovis AF2122/97
cccugccagagaucagc

SEQ ID NO: 1120037 - RNA, 19 nt, Mycobacterium bovis subsp bovis AF2122/97
cccucagccgcgccggguc

SEQ ID NO: 1120038 - RNA, 17 nt, Mycobacterium bovis subsp bovis AF2122/97
cccucagccgcggccac

SEQ ID NO: 1120039 - RNA, 12 nt, Mycobacterium bovis subsp bovis AF2122/97
cccucaccgccu

SEQ ID NO: 1120040 - RNA, 13 nt, Mycobacterium bovis subsp bovis AF2122/97
cccucaccucggc

SEQ ID NO: 1120041 - RNA, 13 nt, Mycobacterium bovis subsp bovis AF2122/97
cccucaacggcgg

SEQ ID NO: 1120042 - RNA, 17 nt, Mycobacterium bovis subsp bovis AF2122/97
cccucaacggcggcaac

SEQ ID NO: 1120043 - RNA, 18 nt, Mycobacterium bovis subsp bovis AF2122/97
cccucaacggcggcaacg

SEQ ID NO: 1120044 - RNA, 22 nt, Mycobacterium bovis subsp bovis AF2122/97
cccucgccgaaguagacggugg

SEQ ID NO: 1120045 - RNA, 18 nt, Mycobacterium bovis subsp bovis AF2122/97
cccucagcuagcgcgggc

SEQ ID NO: 1120046 - RNA, 21 nt, Mycobacterium bovis subsp bovis AF2122/97
cccucgauggccaggcuggcg

SEQ ID NO: 1120047 - RNA, 12 nt, Mycobacterium bovis subsp bovis AF2122/97
cccucggccgcc

SEQ ID NO: 1120048 - RNA, 13 nt, Mycobacterium bovis subsp bovis AF2122/97
cccucggccgccc

SEQ ID NO: 1120049 - RNA, 14 nt, Mycobacterium bovis subsp bovis AF2122/97
cccucgccggucag

SEQ ID NO: 1120050 - RNA, 23 nt, Mycobacterium bovis subsp bovis AF2122/97
cccgguggucgucccgcccaucc

SEQ ID NO: 1120051 - RNA, 18 nt, Mycobacterium bovis subsp bovis AF2122/97
cccgguggugcugucgug

SEQ ID NO: 1120052 - RNA, 16 nt, Mycobacterium bovis subsp bovis AF2122/97
cccgguguccagccac

SEQ ID NO: 1120053 - RNA, 21 nt, Mycobacterium bovis subsp bovis AF2122/97
cccgguggacagaaucgaccg

SEQ ID NO: 1120054 - RNA, 16 nt, Mycobacterium bovis subsp bovis AF2122/97
cccggugcuaaccgac

SEQ ID NO: 1120055 - RNA, 21 nt, Mycobacterium bovis subsp bovis AF2122/97
cccggugccguuggagccgcc

SEQ ID NO: 1120056 - RNA, 15 nt, Mycobacterium bovis subsp bovis AF2122/97
cccggucgauucggc

SEQ ID NO: 1120057 - RNA, 14 nt, Mycobacterium bovis subsp bovis AF2122/97
cccggugccgcccg

SEQ ID NO: 1120058 - RNA, 15 nt, Mycobacterium bovis subsp bovis AF2122/97
cccggugccgcccgc

SEQ ID NO: 1120059 - RNA, 14 nt, Mycobacterium bovis subsp bovis AF2122/97
cccgguccugcucg

SEQ ID NO: 1120060 - RNA, 19 nt, Mycobacterium bovis subsp bovis AF2122/97
cccgguccugcucgcacag

SEQ ID NO: 1120061 - RNA, 21 nt, Mycobacterium bovis subsp bovis AF2122/97
cccggucgacgggucggcgcc

SEQ ID NO: 1120062 - RNA, 21 nt, Mycobacterium bovis subsp bovis AF2122/97
cccggucgagccagcggagca

SEQ ID NO: 1120063 - RNA, 15 nt, Mycobacterium bovis subsp bovis AF2122/97
cccggucgaggucgg

SEQ ID NO: 1120064 - RNA, 19 nt, Mycobacterium bovis subsp bovis AF2122/97
cccgguguguauucgccga

SEQ ID NO: 1120065 - RNA, 22 nt, Mycobacterium bovis subsp bovis AF2122/97
cccgguguucaucacgccgccg

SEQ ID NO: 1120066 - RNA, 18 nt, Mycobacterium bovis subsp bovis AF2122/97
cccgguguugccgugacg

SEQ ID NO: 1120067 - RNA, 22 nt, Mycobacterium bovis subsp bovis AF2122/97
cccgguggcguggucucgguca

SEQ ID NO: 1120068 - RNA, 17 nt, Mycobacterium bovis subsp bovis AF2122/97
cccggugucgugggcac

SEQ ID NO: 1120069 - RNA, 12 nt, Mycobacterium bovis subsp bovis AF2122/97
cccguucgccgu

SEQ ID NO: 1120070 - RNA, 13 nt, Mycobacterium bovis subsp bovis AF2122/97
cccggugucgaug

SEQ ID NO: 1120071 - RNA, 18 nt, Mycobacterium bovis subsp bovis AF2122/97
cccgguuauggcaagccg

SEQ ID NO: 1120072 - RNA, 19 nt, Mycobacterium bovis subsp bovis AF2122/97
cccguugacccagaccggc

SEQ ID NO: 1120073 - RNA, 22 nt, Mycobacterium bovis subsp bovis AF2122/97
cccguugagcauaugacgucgc

SEQ ID NO: 1120074 - RNA, 20 nt, Mycobacterium bovis subsp bovis AF2122/97
cccguucgugagcggccagg

SEQ ID NO: 1120075 - RNA, 20 nt, Mycobacterium bovis subsp bovis AF2122/97
cccguugaagacggccaccg

SEQ ID NO: 1120076 - RNA, 22 nt, Mycobacterium bovis subsp bovis AF2122/97
cccguucggggccccgcggcgc

SEQ ID NO: 1120077 - RNA, 17 nt, Mycobacterium bovis subsp bovis AF2122/97
cccguugcucccacggc

SEQ ID NO: 1120078 - RNA, 23 nt, Mycobacterium bovis subsp bovis AF2122/97
cccguugguagccggugaccgcg

SEQ ID NO: 1120079 - RNA, 21 nt, Mycobacterium bovis subsp bovis AF2122/97
cccguuuacggcccggcaccc

SEQ ID NO: 1120080 - RNA, 22 nt, Mycobacterium bovis subsp bovis AF2122/97
cccguugccgccguugccgccg

SEQ ID NO: 1120081 - RNA, 13 nt, Mycobacterium bovis subsp bovis AF2122/97
cccguugccgccg

SEQ ID NO: 1120082 - RNA, 12 nt, Mycobacterium bovis subsp bovis AF2122/97
cccuagcagcaa

SEQ ID NO: 1120083 - RNA, 12 nt, Mycobacterium bovis subsp bovis AF2122/97
cccuagccggcg

SEQ ID NO: 1120084 - RNA, 16 nt, Mycobacterium bovis subsp bovis AF2122/97
cccuagccggcgcgcc

SEQ ID NO: 1120085 - RNA, 18 nt, Mycobacterium bovis subsp bovis AF2122/97
cccuagcuggugcgcccg

SEQ ID NO: 1120086 - RNA, 12 nt, Mycobacterium bovis subsp bovis AF2122/97
cccuaucagccg

SEQ ID NO: 1120087 - RNA, 13 nt, Mycobacterium bovis subsp bovis AF2122/97
ccgacagcacccg

SEQ ID NO: 1120088 - RNA, 14 nt, Mycobacterium bovis subsp bovis AF2122/97
ccgacagcacccgg

SEQ ID NO: 1120089 - RNA, 17 nt, Mycobacterium bovis subsp bovis AF2122/97
ccgacagcacccggcca

SEQ ID NO: 1120090 - RNA, 18 nt, Mycobacterium bovis subsp bovis AF2122/97
ccgacagcacccggccac

SEQ ID NO: 1120091 - RNA, 14 nt, Mycobacterium bovis subsp bovis AF2122/97
ccgacagccccauc

SEQ ID NO: 1120092 - RNA, 14 nt, Mycobacterium bovis subsp bovis AF2122/97
ccgacagcagccgg

SEQ ID NO: 1120093 - RNA, 20 nt, Mycobacterium bovis subsp bovis AF2122/97
ccgacaguuuaccgugccgc

SEQ ID NO: 1120094 - RNA, 19 nt, Mycobacterium bovis subsp bovis AF2122/97
ccgacauacgucggggccg

SEQ ID NO: 1120095 - RNA, 15 nt, Mycobacterium bovis subsp bovis AF2122/97
ccgacaguggcucac

SEQ ID NO: 1120096 - RNA, 14 nt, Mycobacterium bovis subsp bovis AF2122/97
ccgacaguccgcgc

SEQ ID NO: 1120097 - RNA, 15 nt, Mycobacterium bovis subsp bovis AF2122/97
ccgacaguccgcgcc

SEQ ID NO: 1120098 - RNA, 21 nt, Mycobacterium bovis subsp bovis AF2122/97
ccgacaggugcucgucaucca

SEQ ID NO: 1120099 - RNA, 18 nt, Mycobacterium bovis subsp bovis AF2122/97
ccgacagcagccggugcc

SEQ ID NO: 1120100 - RNA, 22 nt, Mycobacterium bovis subsp bovis AF2122/97
ccgacagggccuugaucggcac

SEQ ID NO: 1120101 - RNA, 16 nt, Mycobacterium bovis subsp bovis AF2122/97
ccgacaggccggccac

SEQ ID NO: 1120102 - RNA, 19 nt, Mycobacterium bovis subsp bovis AF2122/97
ccgaccacgcgagggcauc

SEQ ID NO: 1120103 - RNA, 12 nt, Mycobacterium bovis subsp bovis AF2122/97
ccgaccacccgg

SEQ ID NO: 1120104 - RNA, 13 nt, Mycobacterium bovis subsp bovis AF2122/97
ccgaccaccgccg

SEQ ID NO: 1120105 - RNA, 14 nt, Mycobacterium bovis subsp bovis AF2122/97
ccgaccaccgccgg

SEQ ID NO: 1120106 - RNA, 16 nt, Mycobacterium bovis subsp bovis AF2122/97
ccgaccacaccgggau

SEQ ID NO: 1120107 - RNA, 21 nt, Mycobacterium bovis subsp bovis AF2122/97
ccgacaugguccgaccagcgg

SEQ ID NO: 1120108 - RNA, 16 nt, Mycobacterium bovis subsp bovis AF2122/97
ccgacaucgucaucca

SEQ ID NO: 1120109 - RNA, 16 nt, Mycobacterium bovis subsp bovis AF2122/97
ccgacauggcggugcg

SEQ ID NO: 1120110 - RNA, 13 nt, Mycobacterium bovis subsp bovis AF2122/97
ccgacaugguccg

SEQ ID NO: 1120111 - RNA, 12 nt, Mycobacterium bovis subsp bovis AF2122/97
ccgacaucguga

SEQ ID NO: 1120112 - RNA, 12 nt, Mycobacterium bovis subsp bovis AF2122/97
ccgacaucguca

SEQ ID NO: 1120113 - RNA, 18 nt, Mycobacterium bovis subsp bovis AF2122/97
ccgaagacgggguggugg

SEQ ID NO: 1120114 - RNA, 13 nt, Mycobacterium bovis subsp bovis AF2122/97
ccgaagaagcccg

SEQ ID NO: 1120115 - RNA, 21 nt, Mycobacterium bovis subsp bovis AF2122/97
ccgaagaacaguugcccgacg

SEQ ID NO: 1120116 - RNA, 18 nt, Mycobacterium bovis subsp bovis AF2122/97
ccgaagaagcccgacugg

SEQ ID NO: 1120117 - RNA, 16 nt, Mycobacterium bovis subsp bovis AF2122/97
ccgaagagcgcgcgca

SEQ ID NO: 1120118 - RNA, 17 nt, Mycobacterium bovis subsp bovis AF2122/97
ccgaagagcuccgucgc

SEQ ID NO: 1120119 - RNA, 12 nt, Mycobacterium bovis subsp bovis AF2122/97
ccgaagaggaga

SEQ ID NO: 1120120 - RNA, 17 nt, Mycobacterium bovis subsp bovis AF2122/97
ccgaagaggagaacgag

SEQ ID NO: 1120121 - RNA, 22 nt, Mycobacterium bovis subsp bovis AF2122/97
ccgaagagugugacggcggcca

SEQ ID NO: 1120122 - RNA, 14 nt, Mycobacterium bovis subsp bovis AF2122/97
ccgaagagccagca

SEQ ID NO: 1120123 - RNA, 18 nt, Mycobacterium bovis subsp bovis AF2122/97
ccgaagagucgugccgcc

SEQ ID NO: 1120124 - RNA, 19 nt, Mycobacterium bovis subsp bovis AF2122/97
ccgaagagugugacggcgg

SEQ ID NO: 1120125 - RNA, 19 nt, Mycobacterium bovis subsp bovis AF2122/97
ccgaagcucaucgccgcua

SEQ ID NO: 1120126 - RNA, 20 nt, Mycobacterium bovis subsp bovis AF2122/97
ccgaagcucaucaccggcgc

SEQ ID NO: 1120127 - RNA, 20 nt, Mycobacterium bovis subsp bovis AF2122/97
ccgaaggcggcuccaccggg

SEQ ID NO: 1120128 - RNA, 13 nt, Mycobacterium bovis subsp bovis AF2122/97
ccgaaggccgcca

SEQ ID NO: 1120129 - RNA, 18 nt, Mycobacterium bovis subsp bovis AF2122/97
ccgaaguagccgaccggc

SEQ ID NO: 1120130 - RNA, 16 nt, Mycobacterium bovis subsp bovis AF2122/97
ccgaaguacuggccgc

SEQ ID NO: 1120131 - RNA, 18 nt, Mycobacterium bovis subsp bovis AF2122/97
ccgaaguacuggccgccg

SEQ ID NO: 1120132 - RNA, 22 nt, Mycobacterium bovis subsp bovis AF2122/97
ccgaaguacuggccgccgcgca

SEQ ID NO: 1120133 - RNA, 16 nt, Mycobacterium bovis subsp bovis AF2122/97
ccgaaguagaagccca

SEQ ID NO: 1120134 - RNA, 15 nt, Mycobacterium bovis subsp bovis AF2122/97
ccgacacgccgugcg

SEQ ID NO: 1120135 - RNA, 13 nt, Mycobacterium bovis subsp bovis AF2122/97
ccgacacgccguu

SEQ ID NO: 1120136 - RNA, 20 nt, Mycobacterium bovis subsp bovis AF2122/97
ccgacacgccguuggggccg

SEQ ID NO: 1120137 - RNA, 21 nt, Mycobacterium bovis subsp bovis AF2122/97
ccgacacgccguuggggccgu

SEQ ID NO: 1120138 - RNA, 15 nt, Mycobacterium bovis subsp bovis AF2122/97
ccgacaccgugucgc

SEQ ID NO: 1120139 - RNA, 14 nt, Mycobacterium bovis subsp bovis AF2122/97
ccgacaccgugccg

SEQ ID NO: 1120140 - RNA, 21 nt, Mycobacterium bovis subsp bovis AF2122/97
ccgacaccguccagcagcucg

SEQ ID NO: 1120141 - RNA, 21 nt, Mycobacterium bovis subsp bovis AF2122/97
ccgacaccggccgcgacggau

SEQ ID NO: 1120142 - RNA, 18 nt, Mycobacterium bovis subsp bovis AF2122/97
ccgacacguugcagcucg

SEQ ID NO: 1120143 - RNA, 19 nt, Mycobacterium bovis subsp bovis AF2122/97
ccgacacguuucacguggu

SEQ ID NO: 1120144 - RNA, 23 nt, Mycobacterium bovis subsp bovis AF2122/97
ccgacacguuucacguggucggc

SEQ ID NO: 1120145 - RNA, 19 nt, Mycobacterium bovis subsp bovis AF2122/97
ccgacacggcucgccggcu

SEQ ID NO: 1120146 - RNA, 20 nt, Mycobacterium bovis subsp bovis AF2122/97
ccgacaccguguugcugccc

SEQ ID NO: 1120147 - RNA, 23 nt, Mycobacterium bovis subsp bovis AF2122/97
ccgacaccggcugaccgacccgg

SEQ ID NO: 1120148 - RNA, 22 nt, Mycobacterium bovis subsp bovis AF2122/97
ccgacacggugcugccguuggg

SEQ ID NO: 1120149 - RNA, 13 nt, Mycobacterium bovis subsp bovis AF2122/97
ccgaaguccacgc

SEQ ID NO: 1120150 - RNA, 22 nt, Mycobacterium bovis subsp bovis AF2122/97
ccgacaccgccccgccgcgacg

SEQ ID NO: 1120151 - RNA, 18 nt, Mycobacterium bovis subsp bovis AF2122/97
ccgacaccgaucggacgu

SEQ ID NO: 1120152 - RNA, 13 nt, Mycobacterium bovis subsp bovis AF2122/97
ccgacaccgccac

SEQ ID NO: 1120153 - RNA, 13 nt, Mycobacterium bovis subsp bovis AF2122/97
ccgacaccggcgg

SEQ ID NO: 1120154 - RNA, 16 nt, Mycobacterium bovis subsp bovis AF2122/97
ccgacaccggcggcau

SEQ ID NO: 1120155 - RNA, 19 nt, Mycobacterium bovis subsp bovis AF2122/97
ccgacaccggccgcgacgg

SEQ ID NO: 1120156 - RNA, 12 nt, Mycobacterium bovis subsp bovis AF2122/97
ccgaccgcgccg

SEQ ID NO: 1120157 - RNA, 21 nt, Mycobacterium bovis subsp bovis AF2122/97
ccgaccgcgacccggcccagc

SEQ ID NO: 1120158 - RNA, 20 nt, Mycobacterium bovis subsp bovis AF2122/97
ccgaccgcgcccgcgggcag

SEQ ID NO: 1120159 - RNA, 18 nt, Mycobacterium bovis subsp bovis AF2122/97
ccgaccgccaccgccagc

SEQ ID NO: 1120160 - RNA, 14 nt, Mycobacterium bovis subsp bovis AF2122/97
ccgaccgccgagcg

SEQ ID NO: 1120161 - RNA, 22 nt, Mycobacterium bovis subsp bovis AF2122/97
ccgaccgcguuguccgcggcca

SEQ ID NO: 1120162 - RNA, 22 nt, Mycobacterium bovis subsp bovis AF2122/97
ccgaccgcguuuugcaggcccg

SEQ ID NO: 1120163 - RNA, 24 nt, Mycobacterium bovis subsp bovis AF2122/97
ccgaccgcgggucgugccagcagc

SEQ ID NO: 1120164 - RNA, 17 nt, Mycobacterium bovis subsp bovis AF2122/97
ccgaccgcguacaggcc

SEQ ID NO: 1120165 - RNA, 14 nt, Mycobacterium bovis subsp bovis AF2122/97
ccgaccggcccgca

SEQ ID NO: 1120166 - RNA, 17 nt, Mycobacterium bovis subsp bovis AF2122/97
ccgaccggcacccgcgg

SEQ ID NO: 1120167 - RNA, 20 nt, Mycobacterium bovis subsp bovis AF2122/97
ccgaccggcacccgcggcga

SEQ ID NO: 1120168 - RNA, 13 nt, Mycobacterium bovis subsp bovis AF2122/97
ccgaccggcagcg

SEQ ID NO: 1120169 - RNA, 12 nt, Mycobacterium bovis subsp bovis AF2122/97
ccgaccgguugg

SEQ ID NO: 1120170 - RNA, 18 nt, Mycobacterium bovis subsp bovis AF2122/97
ccgaccgugaucagcgcg

SEQ ID NO: 1120171 - RNA, 14 nt, Mycobacterium bovis subsp bovis AF2122/97
ccgaccgucgucgu

SEQ ID NO: 1120172 - RNA, 19 nt, Mycobacterium bovis subsp bovis AF2122/97
ccgaccgucgucgugcagg

SEQ ID NO: 1120173 - RNA, 16 nt, Mycobacterium bovis subsp bovis AF2122/97
ccgaccgugaucagcg

SEQ ID NO: 1120174 - RNA, 23 nt, Mycobacterium bovis subsp bovis AF2122/97
ccgaccguuucuccgccgcccag

SEQ ID NO: 1120175 - RNA, 20 nt, Mycobacterium bovis subsp bovis AF2122/97
ccgaccuaaagaucguugcc

SEQ ID NO: 1120176 - RNA, 23 nt, Mycobacterium bovis subsp bovis AF2122/97
ccgaccuagucaccuugaccggg

SEQ ID NO: 1120177 - RNA, 16 nt, Mycobacterium bovis subsp bovis AF2122/97
ccgaccucacggcauc

SEQ ID NO: 1120178 - RNA, 16 nt, Mycobacterium bovis subsp bovis AF2122/97
ccgaccucaucggcac

SEQ ID NO: 1120179 - RNA, 19 nt, Mycobacterium bovis subsp bovis AF2122/97
ccgaccggucuggcgauga

SEQ ID NO: 1120180 - RNA, 22 nt, Mycobacterium bovis subsp bovis AF2122/97
ccgaccgguggcaccggcggcg

SEQ ID NO: 1120181 - RNA, 23 nt, Mycobacterium bovis subsp bovis AF2122/97
ccgaccgguggcaccggcggcga

SEQ ID NO: 1120182 - RNA, 13 nt, Mycobacterium bovis subsp bovis AF2122/97
ccgaccggcggca

SEQ ID NO: 1120183 - RNA, 13 nt, Mycobacterium bovis subsp bovis AF2122/97
ccgaccucgccgc

SEQ ID NO: 1120184 - RNA, 15 nt, Mycobacterium bovis subsp bovis AF2122/97
ccgaccucgccgcgc

SEQ ID NO: 1120185 - RNA, 16 nt, Mycobacterium bovis subsp bovis AF2122/97
ccgaccucgccgcgcg

SEQ ID NO: 1120186 - RNA, 17 nt, Mycobacterium bovis subsp bovis AF2122/97
ccgaccucgccgcgcgu

SEQ ID NO: 1120187 - RNA, 19 nt, Mycobacterium bovis subsp bovis AF2122/97
ccgaccugcaagacgccga

SEQ ID NO: 1120188 - RNA, 19 nt, Mycobacterium bovis subsp bovis AF2122/97
ccgaccugcucgauacggc

SEQ ID NO: 1120189 - RNA, 16 nt, Mycobacterium bovis subsp bovis AF2122/97
ccgaccucggcgaccg

SEQ ID NO: 1120190 - RNA, 17 nt, Mycobacterium bovis subsp bovis AF2122/97
ccgaccugcgcgacggc

SEQ ID NO: 1120191 - RNA, 15 nt, Mycobacterium bovis subsp bovis AF2122/97
ccgaccugcgcgacg

SEQ ID NO: 1120192 - RNA, 21 nt, Mycobacterium bovis subsp bovis AF2122/97
ccgaccuuccguuggcggcuc

SEQ ID NO: 1120193 - RNA, 14 nt, Mycobacterium bovis subsp bovis AF2122/97
ccgaccuucggccc

SEQ ID NO: 1120194 - RNA, 19 nt, Mycobacterium bovis subsp bovis AF2122/97
ccgacgaacgaaccgccgc

SEQ ID NO: 1120195 - RNA, 21 nt, Mycobacterium bovis subsp bovis AF2122/97
ccgacgaacgaaccgccgccg

SEQ ID NO: 1120196 - RNA, 22 nt, Mycobacterium bovis subsp bovis AF2122/97
ccgacgaacgaaccgccgccgc

SEQ ID NO: 1120197 - RNA, 16 nt, Mycobacterium bovis subsp bovis AF2122/97
ccgacgaacgacgggg

SEQ ID NO: 1120198 - RNA, 17 nt, Mycobacterium bovis subsp bovis AF2122/97
ccgacgacaccagagcg

SEQ ID NO: 1120199 - RNA, 17 nt, Mycobacterium bovis subsp bovis AF2122/97
ccgacgacaucgguggc

SEQ ID NO: 1120200 - RNA, 21 nt, Mycobacterium bovis subsp bovis AF2122/97
ccgacgacauugggcgcggug

SEQ ID NO: 1120201 - RNA, 16 nt, Mycobacterium bovis subsp bovis AF2122/97
ccgacgaagaucgcug

SEQ ID NO: 1120202 - RNA, 17 nt, Mycobacterium bovis subsp bovis AF2122/97
ccgacgaagaucgcugc

SEQ ID NO: 1120203 - RNA, 22 nt, Mycobacterium bovis subsp bovis AF2122/97
ccgacgaagaucgcugcgaagc

SEQ ID NO: 1120204 - RNA, 14 nt, Mycobacterium bovis subsp bovis AF2122/97
ccgaccgccaccgc

SEQ ID NO: 1120205 - RNA, 15 nt, Mycobacterium bovis subsp bovis AF2122/97
ccgaccgcaccgugc

SEQ ID NO: 1120206 - RNA, 16 nt, Mycobacterium bovis subsp bovis AF2122/97
ccgaccgcaccgugcc

SEQ ID NO: 1120207 - RNA, 17 nt, Mycobacterium bovis subsp bovis AF2122/97
ccgaccgcacgaccagc

SEQ ID NO: 1120208 - RNA, 21 nt, Mycobacterium bovis subsp bovis AF2122/97
ccgaccgcacgaccagcugag

SEQ ID NO: 1120209 - RNA, 18 nt, Mycobacterium bovis subsp bovis AF2122/97
ccgaccgcaugaucgcac

SEQ ID NO: 1120210 - RNA, 18 nt, Mycobacterium bovis subsp bovis AF2122/97
ccgaccgauaacacccgg

SEQ ID NO: 1120211 - RNA, 14 nt, Mycobacterium bovis subsp bovis AF2122/97
ccgaccgaccgcac

SEQ ID NO: 1120212 - RNA, 16 nt, Mycobacterium bovis subsp bovis AF2122/97
ccgaccgaccuggucg

SEQ ID NO: 1120213 - RNA, 17 nt, Mycobacterium bovis subsp bovis AF2122/97
ccgaccgaaagccgcac

SEQ ID NO: 1120214 - RNA, 18 nt, Mycobacterium bovis subsp bovis AF2122/97
ccgaccgaaagccgcacc

SEQ ID NO: 1120215 - RNA, 20 nt, Mycobacterium bovis subsp bovis AF2122/97
ccgacccuacuuccucgacg

SEQ ID NO: 1120216 - RNA, 15 nt, Mycobacterium bovis subsp bovis AF2122/97
ccgaccgaaccguca

SEQ ID NO: 1120217 - RNA, 17 nt, Mycobacterium bovis subsp bovis AF2122/97
ccgaccgaaccgucagc

SEQ ID NO: 1120218 - RNA, 19 nt, Mycobacterium bovis subsp bovis AF2122/97
ccgaccgaaucagcacggu

SEQ ID NO: 1120219 - RNA, 19 nt, Mycobacterium bovis subsp bovis AF2122/97
ccgaccgacaccaccaggu

SEQ ID NO: 1120220 - RNA, 13 nt, Mycobacterium bovis subsp bovis AF2122/97
ccgacccggccgc

SEQ ID NO: 1120221 - RNA, 19 nt, Mycobacterium bovis subsp bovis AF2122/97
ccgacccgggggcgcccgg

SEQ ID NO: 1120222 - RNA, 14 nt, Mycobacterium bovis subsp bovis AF2122/97
ccgacccgcugcca

SEQ ID NO: 1120223 - RNA, 14 nt, Mycobacterium bovis subsp bovis AF2122/97
ccgacccgccgacg

SEQ ID NO: 1120224 - RNA, 20 nt, Mycobacterium bovis subsp bovis AF2122/97
ccgacccgccgacgccgccg

SEQ ID NO: 1120225 - RNA, 15 nt, Mycobacterium bovis subsp bovis AF2122/97
ccgacccgccgcgcc

SEQ ID NO: 1120226 - RNA, 16 nt, Mycobacterium bovis subsp bovis AF2122/97
ccgacccgccgcgccc

SEQ ID NO: 1120227 - RNA, 17 nt, Mycobacterium bovis subsp bovis AF2122/97
ccgacccgccgcgcccg

SEQ ID NO: 1120228 - RNA, 19 nt, Mycobacterium bovis subsp bovis AF2122/97
ccgacccgccgcgcccggc

SEQ ID NO: 1120229 - RNA, 22 nt, Mycobacterium bovis subsp bovis AF2122/97
ccgacccgccgcgcccggcgca

SEQ ID NO: 1120230 - RNA, 14 nt, Mycobacterium bovis subsp bovis AF2122/97
ccgacccgccgcgg

SEQ ID NO: 1120231 - RNA, 23 nt, Mycobacterium bovis subsp bovis AF2122/97
ccgacccaucaccagcggcugca

SEQ ID NO: 1120232 - RNA, 16 nt, Mycobacterium bovis subsp bovis AF2122/97
ccgacccgcccgaaga

SEQ ID NO: 1120233 - RNA, 16 nt, Mycobacterium bovis subsp bovis AF2122/97
ccgacccgacgcuggu

SEQ ID NO: 1120234 - RNA, 21 nt, Mycobacterium bovis subsp bovis AF2122/97
ccgaccccgccgagcgcgccg

SEQ ID NO: 1120235 - RNA, 14 nt, Mycobacterium bovis subsp bovis AF2122/97
ccgaccccgcgccg

SEQ ID NO: 1120236 - RNA, 17 nt, Mycobacterium bovis subsp bovis AF2122/97
ccgaccaggaccaccgc

SEQ ID NO: 1120237 - RNA, 14 nt, Mycobacterium bovis subsp bovis AF2122/97
ccgaccagcuugac

SEQ ID NO: 1120238 - RNA, 13 nt, Mycobacterium bovis subsp bovis AF2122/97
ccgaccagggccg

SEQ ID NO: 1120239 - RNA, 16 nt, Mycobacterium bovis subsp bovis AF2122/97
ccgaccagggccgccg

SEQ ID NO: 1120240 - RNA, 17 nt, Mycobacterium bovis subsp bovis AF2122/97
ccgaccagggccgccgc

SEQ ID NO: 1120241 - RNA, 22 nt, Mycobacterium bovis subsp bovis AF2122/97
ccgaccagggccgccgcugccg

SEQ ID NO: 1120242 - RNA, 19 nt, Mycobacterium bovis subsp bovis AF2122/97
ccgaccagucgacgucucu

SEQ ID NO: 1120243 - RNA, 23 nt, Mycobacterium bovis subsp bovis AF2122/97
ccgaccaugcaagugggcgcgaa

SEQ ID NO: 1120244 - RNA, 19 nt, Mycobacterium bovis subsp bovis AF2122/97
ccgacccaacgaccaccac

SEQ ID NO: 1120245 - RNA, 13 nt, Mycobacterium bovis subsp bovis AF2122/97
ccgaccagcgcgc

SEQ ID NO: 1120246 - RNA, 18 nt, Mycobacterium bovis subsp bovis AF2122/97
ccgaccagcgcgcugcgc

SEQ ID NO: 1120247 - RNA, 14 nt, Mycobacterium bovis subsp bovis AF2122/97
ccgaccagcggccg

SEQ ID NO: 1120248 - RNA, 16 nt, Mycobacterium bovis subsp bovis AF2122/97
ccgaccagcggccgac

SEQ ID NO: 1120249 - RNA, 13 nt, Mycobacterium bovis subsp bovis AF2122/97
ccgaccagcuuga

SEQ ID NO: 1120250 - RNA, 16 nt, Mycobacterium bovis subsp bovis AF2122/97
ccgaccagcaucucgg

SEQ ID NO: 1120251 - RNA, 22 nt, Mycobacterium bovis subsp bovis AF2122/97
ccgaccagagcuucgccgcgca

SEQ ID NO: 1120252 - RNA, 23 nt, Mycobacterium bovis subsp bovis AF2122/97
ccgaccagagcuucgccgcgcag

SEQ ID NO: 1120253 - RNA, 19 nt, Mycobacterium bovis subsp bovis AF2122/97
ccgaccagaacgacgccgc

SEQ ID NO: 1120254 - RNA, 21 nt, Mycobacterium bovis subsp bovis AF2122/97
ccgaccagaacgacgccgcgg

SEQ ID NO: 1120255 - RNA, 23 nt, Mycobacterium bovis subsp bovis AF2122/97
ccgaccacuccacgcagcccguc

SEQ ID NO: 1120256 - RNA, 13 nt, Mycobacterium bovis subsp bovis AF2122/97
cccgccgcgcauc

SEQ ID NO: 1120257 - RNA, 13 nt, Mycobacterium bovis subsp bovis AF2122/97
cccgccgucgcca

SEQ ID NO: 1120258 - RNA, 13 nt, Mycobacterium bovis subsp bovis AF2122/97
cccgccgcgcguc

SEQ ID NO: 1120259 - RNA, 16 nt, Mycobacterium bovis subsp bovis AF2122/97
cccgccguccggcgcc

SEQ ID NO: 1120260 - RNA, 13 nt, Mycobacterium bovis subsp bovis AF2122/97
cccgccgccggug

SEQ ID NO: 1120261 - RNA, 14 nt, Mycobacterium bovis subsp bovis AF2122/97
cccgccgcugccgc

SEQ ID NO: 1120262 - RNA, 17 nt, Mycobacterium bovis subsp bovis AF2122/97
cccgccguuuccgccgc

SEQ ID NO: 1120263 - RNA, 18 nt, Mycobacterium bovis subsp bovis AF2122/97
cccgccguuuccgccgcc

SEQ ID NO: 1120264 - RNA, 19 nt, Mycobacterium bovis subsp bovis AF2122/97
cccgccuaaucggccugcc

SEQ ID NO: 1120265 - RNA, 16 nt, Mycobacterium bovis subsp bovis AF2122/97
cccgccuacgacgcag

SEQ ID NO: 1120266 - RNA, 13 nt, Mycobacterium bovis subsp bovis AF2122/97
cccgccgugccgc

SEQ ID NO: 1120267 - RNA, 14 nt, Mycobacterium bovis subsp bovis AF2122/97
cccgccguugccgc

SEQ ID NO: 1120268 - RNA, 22 nt, Mycobacterium bovis subsp bovis AF2122/97
cccgccguugccgccgacgccg

SEQ ID NO: 1120269 - RNA, 18 nt, Mycobacterium bovis subsp bovis AF2122/97
cccgccucgaccgccagc

SEQ ID NO: 1120270 - RNA, 24 nt, Mycobacterium bovis subsp bovis AF2122/97
cccgccgucuuggcccgguccgcc

SEQ ID NO: 1120271 - RNA, 19 nt, Mycobacterium bovis subsp bovis AF2122/97
cccgcgaaccgcggaucga

SEQ ID NO: 1120272 - RNA, 18 nt, Mycobacterium bovis subsp bovis AF2122/97
cccgcgccaccggcaccg

SEQ ID NO: 1120273 - RNA, 13 nt, Mycobacterium bovis subsp bovis AF2122/97
cccgcgccgccgc

SEQ ID NO: 1120274 - RNA, 13 nt, Mycobacterium bovis subsp bovis AF2122/97
cccgcgccgcccg

SEQ ID NO: 1120275 - RNA, 13 nt, Mycobacterium bovis subsp bovis AF2122/97
cccgcgccgcgca

SEQ ID NO: 1120276 - RNA, 15 nt, Mycobacterium bovis subsp bovis AF2122/97
cccgcgccgcgcauc

SEQ ID NO: 1120277 - RNA, 14 nt, Mycobacterium bovis subsp bovis AF2122/97
cccgcgccgccgcc

SEQ ID NO: 1120278 - RNA, 19 nt, Mycobacterium bovis subsp bovis AF2122/97
cccgcggccagcaccgggg

SEQ ID NO: 1120279 - RNA, 15 nt, Mycobacterium bovis subsp bovis AF2122/97
cccgcggacagcccg

SEQ ID NO: 1120280 - RNA, 14 nt, Mycobacterium bovis subsp bovis AF2122/97
cccgcgccugccuc

SEQ ID NO: 1120281 - RNA, 13 nt, Mycobacterium bovis subsp bovis AF2122/97
cccgcgccggccg

SEQ ID NO: 1120282 - RNA, 14 nt, Mycobacterium bovis subsp bovis AF2122/97
cccgcgccggccgc

SEQ ID NO: 1120283 - RNA, 15 nt, Mycobacterium bovis subsp bovis AF2122/97
cccgcgccggccgca

SEQ ID NO: 1120284 - RNA, 12 nt, Mycobacterium bovis subsp bovis AF2122/97
cccgcgccggcg

SEQ ID NO: 1120285 - RNA, 19 nt, Mycobacterium bovis subsp bovis AF2122/97
cccgcggcgccguugccac

SEQ ID NO: 1120286 - RNA, 17 nt, Mycobacterium bovis subsp bovis AF2122/97
cccgcgggcaagccgga

SEQ ID NO: 1120287 - RNA, 23 nt, Mycobacterium bovis subsp bovis AF2122/97
cccgcggcgaaccgucucgcccc

SEQ ID NO: 1120288 - RNA, 14 nt, Mycobacterium bovis subsp bovis AF2122/97
cccgcggcgccgcc

SEQ ID NO: 1120289 - RNA, 15 nt, Mycobacterium bovis subsp bovis AF2122/97
cccgcggcgccgcca

SEQ ID NO: 1120290 - RNA, 17 nt, Mycobacterium bovis subsp bovis AF2122/97
cccgcggcgccgccacg

SEQ ID NO: 1120291 - RNA, 16 nt, Mycobacterium bovis subsp bovis AF2122/97
cccgcguucgagagcc

SEQ ID NO: 1120292 - RNA, 18 nt, Mycobacterium bovis subsp bovis AF2122/97
cccgcgggggcggccggc

SEQ ID NO: 1120293 - RNA, 18 nt, Mycobacterium bovis subsp bovis AF2122/97
cccgcuaacuggcccgga

SEQ ID NO: 1120294 - RNA, 22 nt, Mycobacterium bovis subsp bovis AF2122/97
cccgcguugaaggcgccggugu

SEQ ID NO: 1120295 - RNA, 22 nt, Mycobacterium bovis subsp bovis AF2122/97
cccgcucauccauucggcggcg

SEQ ID NO: 1120296 - RNA, 14 nt, Mycobacterium bovis subsp bovis AF2122/97
cccgcuacgcgcgc

SEQ ID NO: 1120297 - RNA, 15 nt, Mycobacterium bovis subsp bovis AF2122/97
cccgcuacgcgcgcu

SEQ ID NO: 1120298 - RNA, 20 nt, Mycobacterium bovis subsp bovis AF2122/97
cccgcucaacgggccgcauc

SEQ ID NO: 1120299 - RNA, 19 nt, Mycobacterium bovis subsp bovis AF2122/97
cccgcuauucggcggcaug

SEQ ID NO: 1120300 - RNA, 15 nt, Mycobacterium bovis subsp bovis AF2122/97
cccgcuacggcagcc

SEQ ID NO: 1120301 - RNA, 22 nt, Mycobacterium bovis subsp bovis AF2122/97
cccgcuagcgcuugcgaccccg

SEQ ID NO: 1120302 - RNA, 15 nt, Mycobacterium bovis subsp bovis AF2122/97
cccgcugagccagcu

SEQ ID NO: 1120303 - RNA, 14 nt, Mycobacterium bovis subsp bovis AF2122/97
cccgcugaccauca

SEQ ID NO: 1120304 - RNA, 17 nt, Mycobacterium bovis subsp bovis AF2122/97
cccgcuccaagcgcggu

SEQ ID NO: 1120305 - RNA, 20 nt, Mycobacterium bovis subsp bovis AF2122/97
cccgcuaccaacgcaacacg

SEQ ID NO: 1120306 - RNA, 21 nt, Mycobacterium bovis subsp bovis AF2122/97
cccgcucgggguugcucgcga

SEQ ID NO: 1120307 - RNA, 18 nt, Mycobacterium bovis subsp bovis AF2122/97
cccgcucgggguugcucg

SEQ ID NO: 1120308 - RNA, 12 nt, Mycobacterium bovis subsp bovis AF2122/97
cccgcugcgccg

SEQ ID NO: 1120309 - RNA, 12 nt, Mycobacterium bovis subsp bovis AF2122/97
cccgcugccauu

SEQ ID NO: 1120310 - RNA, 23 nt, Mycobacterium bovis subsp bovis AF2122/97
cccgcugccgucggagaccagcu

SEQ ID NO: 1120311 - RNA, 14 nt, Mycobacterium bovis subsp bovis AF2122/97
cccggaaccagccg

SEQ ID NO: 1120312 - RNA, 15 nt, Mycobacterium bovis subsp bovis AF2122/97
cccggaaccagccgc

SEQ ID NO: 1120313 - RNA, 13 nt, Mycobacterium bovis subsp bovis AF2122/97
ccccggcgacccg

SEQ ID NO: 1120314 - RNA, 14 nt, Mycobacterium bovis subsp bovis AF2122/97
ccccggcggccauc

SEQ ID NO: 1120315 - RNA, 23 nt, Mycobacterium bovis subsp bovis AF2122/97
ccccggcgagcagacgcauaagc

SEQ ID NO: 1120316 - RNA, 23 nt, Mycobacterium bovis subsp bovis AF2122/97
ccccggcucucuucgcgcgcugg

SEQ ID NO: 1120317 - RNA, 14 nt, Mycobacterium bovis subsp bovis AF2122/97
ccccggcugccagc

SEQ ID NO: 1120318 - RNA, 19 nt, Mycobacterium bovis subsp bovis AF2122/97
ccccggcugccagcgccgc

SEQ ID NO: 1120319 - RNA, 20 nt, Mycobacterium bovis subsp bovis AF2122/97
cccgauaguucuggcccgca

SEQ ID NO: 1120320 - RNA, 16 nt, Mycobacterium bovis subsp bovis AF2122/97
ccccggcuccgcaacc

SEQ ID NO: 1120321 - RNA, 17 nt, Mycobacterium bovis subsp bovis AF2122/97
cccgaucaccagcccca

SEQ ID NO: 1120322 - RNA, 19 nt, Mycobacterium bovis subsp bovis AF2122/97
cccgaucaccccggucggc

SEQ ID NO: 1120323 - RNA, 20 nt, Mycobacterium bovis subsp bovis AF2122/97
ccccggcguccgaccgguac

SEQ ID NO: 1120324 - RNA, 19 nt, Mycobacterium bovis subsp bovis AF2122/97
ccccggcgguaccggagca

SEQ ID NO: 1120325 - RNA, 13 nt, Mycobacterium bovis subsp bovis AF2122/97
ccccggcggucag

SEQ ID NO: 1120326 - RNA, 13 nt, Mycobacterium bovis subsp bovis AF2122/97
ccccggcgguacc

SEQ ID NO: 1120327 - RNA, 14 nt, Mycobacterium bovis subsp bovis AF2122/97
cccgcaccaccggc

SEQ ID NO: 1120328 - RNA, 15 nt, Mycobacterium bovis subsp bovis AF2122/97
cccgcaccaccggcc

SEQ ID NO: 1120329 - RNA, 17 nt, Mycobacterium bovis subsp bovis AF2122/97
cccgcaccaccggcccc

SEQ ID NO: 1120330 - RNA, 14 nt, Mycobacterium bovis subsp bovis AF2122/97
cccgaucaucgacg

SEQ ID NO: 1120331 - RNA, 13 nt, Mycobacterium bovis subsp bovis AF2122/97
cccgcaccacacc

SEQ ID NO: 1120332 - RNA, 15 nt, Mycobacterium bovis subsp bovis AF2122/97
cccgcaccccggccg

SEQ ID NO: 1120333 - RNA, 16 nt, Mycobacterium bovis subsp bovis AF2122/97
cccgcaccgcgguacg

SEQ ID NO: 1120334 - RNA, 22 nt, Mycobacterium bovis subsp bovis AF2122/97
cccgcaccgcgguacgccgguc

SEQ ID NO: 1120335 - RNA, 13 nt, Mycobacterium bovis subsp bovis AF2122/97
cccgcacgcucgc

SEQ ID NO: 1120336 - RNA, 15 nt, Mycobacterium bovis subsp bovis AF2122/97
cccgcacgcucggcg

SEQ ID NO: 1120337 - RNA, 18 nt, Mycobacterium bovis subsp bovis AF2122/97
cccgcacgcucggcgggg

SEQ ID NO: 1120338 - RNA, 20 nt, Mycobacterium bovis subsp bovis AF2122/97
cccgcacgcucggcgugucg

SEQ ID NO: 1120339 - RNA, 14 nt, Mycobacterium bovis subsp bovis AF2122/97
cccgcaccggaucg

SEQ ID NO: 1120340 - RNA, 15 nt, Mycobacterium bovis subsp bovis AF2122/97
cccgcaccggugacg

SEQ ID NO: 1120341 - RNA, 17 nt, Mycobacterium bovis subsp bovis AF2122/97
cccgcaccggugacgca

SEQ ID NO: 1120342 - RNA, 18 nt, Mycobacterium bovis subsp bovis AF2122/97
cccgcaccuacccugcgc

SEQ ID NO: 1120343 - RNA, 22 nt, Mycobacterium bovis subsp bovis AF2122/97
cccgcaauuguucgcggccguc

SEQ ID NO: 1120344 - RNA, 22 nt, Mycobacterium bovis subsp bovis AF2122/97
cccgaucaccuucggccgaccg

SEQ ID NO: 1120345 - RNA, 21 nt, Mycobacterium bovis subsp bovis AF2122/97
cccgaucagguacgccaggug

SEQ ID NO: 1120346 - RNA, 17 nt, Mycobacterium bovis subsp bovis AF2122/97
cccgauccugcccacca

SEQ ID NO: 1120347 - RNA, 23 nt, Mycobacterium bovis subsp bovis AF2122/97
cccgaucgaagaaacggcgucga

SEQ ID NO: 1120348 - RNA, 13 nt, Mycobacterium bovis subsp bovis AF2122/97
cccgauccgccac

SEQ ID NO: 1120349 - RNA, 22 nt, Mycobacterium bovis subsp bovis AF2122/97
cccgcccgguguguucggcccg

SEQ ID NO: 1120350 - RNA, 16 nt, Mycobacterium bovis subsp bovis AF2122/97
cccgcccuugccgcca

SEQ ID NO: 1120351 - RNA, 14 nt, Mycobacterium bovis subsp bovis AF2122/97
cccgccgaccgaca

SEQ ID NO: 1120352 - RNA, 16 nt, Mycobacterium bovis subsp bovis AF2122/97
cccgccgaccgacacc

SEQ ID NO: 1120353 - RNA, 20 nt, Mycobacterium bovis subsp bovis AF2122/97
cccgccgaccgacaccacca

SEQ ID NO: 1120354 - RNA, 22 nt, Mycobacterium bovis subsp bovis AF2122/97
cccgcccuugccgccagcccca

SEQ ID NO: 1120355 - RNA, 18 nt, Mycobacterium bovis subsp bovis AF2122/97
cccgcccuugccgccgag

SEQ ID NO: 1120356 - RNA, 19 nt, Mycobacterium bovis subsp bovis AF2122/97
cccgcccuugccgccgagg

SEQ ID NO: 1120357 - RNA, 20 nt, Mycobacterium bovis subsp bovis AF2122/97
cccgcccuugcggcgugaug

SEQ ID NO: 1120358 - RNA, 19 nt, Mycobacterium bovis subsp bovis AF2122/97
cccgccgaugaugcggcgc

SEQ ID NO: 1120359 - RNA, 22 nt, Mycobacterium bovis subsp bovis AF2122/97
cccgccgaugaugcggcgcagc

SEQ ID NO: 1120360 - RNA, 19 nt, Mycobacterium bovis subsp bovis AF2122/97
cccgccgaugcugccgccg

SEQ ID NO: 1120361 - RNA, 17 nt, Mycobacterium bovis subsp bovis AF2122/97
cccgccgagcggugccg

SEQ ID NO: 1120362 - RNA, 20 nt, Mycobacterium bovis subsp bovis AF2122/97
cccgccgagcggugccggcg

SEQ ID NO: 1120363 - RNA, 13 nt, Mycobacterium bovis subsp bovis AF2122/97
cccgccgacgccg

SEQ ID NO: 1120364 - RNA, 15 nt, Mycobacterium bovis subsp bovis AF2122/97
cccgccgacgccgcc

SEQ ID NO: 1120365 - RNA, 16 nt, Mycobacterium bovis subsp bovis AF2122/97
cccgccgccgcccggg

SEQ ID NO: 1120366 - RNA, 20 nt, Mycobacterium bovis subsp bovis AF2122/97
cccgccgccacgggugacga

SEQ ID NO: 1120367 - RNA, 14 nt, Mycobacterium bovis subsp bovis AF2122/97
cccgcagcccgccg

SEQ ID NO: 1120368 - RNA, 12 nt, Mycobacterium bovis subsp bovis AF2122/97
cccgcaggacgc

SEQ ID NO: 1120369 - RNA, 20 nt, Mycobacterium bovis subsp bovis AF2122/97
cccgcaggcucaccgagccg

SEQ ID NO: 1120370 - RNA, 19 nt, Mycobacterium bovis subsp bovis AF2122/97
cccgcccggacgcaacacc

SEQ ID NO: 1120371 - RNA, 14 nt, Mycobacterium bovis subsp bovis AF2122/97
cccgcagggccgcc

SEQ ID NO: 1120372 - RNA, 15 nt, Mycobacterium bovis subsp bovis AF2122/97
cccgcagggccgccg

SEQ ID NO: 1120373 - RNA, 16 nt, Mycobacterium bovis subsp bovis AF2122/97
cccgcagccgcgaguc

SEQ ID NO: 1120374 - RNA, 12 nt, Mycobacterium bovis subsp bovis AF2122/97
cccgcagcucga

SEQ ID NO: 1120375 - RNA, 12 nt, Mycobacterium bovis subsp bovis AF2122/97
cccgcacggccg

SEQ ID NO: 1120376 - RNA, 16 nt, Mycobacterium bovis subsp bovis AF2122/97
cccgcacgaaccgguc

SEQ ID NO: 1120377 - RNA, 21 nt, Mycobacterium bovis subsp bovis AF2122/97
cccgcacgacgaauccccgac

SEQ ID NO: 1120378 - RNA, 16 nt, Mycobacterium bovis subsp bovis AF2122/97
cccgcacggccggguc

SEQ ID NO: 1120379 - RNA, 13 nt, Mycobacterium bovis subsp bovis AF2122/97
cccgcacggugua

SEQ ID NO: 1120380 - RNA, 15 nt, Mycobacterium bovis subsp bovis AF2122/97
cccgcagaauccggc

SEQ ID NO: 1120381 - RNA, 18 nt, Mycobacterium bovis subsp bovis AF2122/97
cccgcagaauccggcaac

SEQ ID NO: 1120382 - RNA, 13 nt, Mycobacterium bovis subsp bovis AF2122/97
cccgcacugccgc

SEQ ID NO: 1120383 - RNA, 14 nt, Mycobacterium bovis subsp bovis AF2122/97
cccgcacugccgcc

SEQ ID NO: 1120384 - RNA, 15 nt, Mycobacterium bovis subsp bovis AF2122/97
cccgcacugccgccg

SEQ ID NO: 1120385 - RNA, 21 nt, Mycobacterium bovis subsp bovis AF2122/97
cccgcacugccgccgguuccg

SEQ ID NO: 1120386 - RNA, 13 nt, Mycobacterium bovis subsp bovis AF2122/97
cccggcaucgcga

SEQ ID NO: 1120387 - RNA, 18 nt, Mycobacterium bovis subsp bovis AF2122/97
cccggcacccggugagaa

SEQ ID NO: 1120388 - RNA, 18 nt, Mycobacterium bovis subsp bovis AF2122/97
cccggcagcuggucggug

SEQ ID NO: 1120389 - RNA, 20 nt, Mycobacterium bovis subsp bovis AF2122/97
cccggcaguucgcggccauc

SEQ ID NO: 1120390 - RNA, 22 nt, Mycobacterium bovis subsp bovis AF2122/97
cccggccacugaaccguagcgc

SEQ ID NO: 1120391 - RNA, 15 nt, Mycobacterium bovis subsp bovis AF2122/97
cccggcacggugucg

SEQ ID NO: 1120392 - RNA, 15 nt, Mycobacterium bovis subsp bovis AF2122/97
cccggcacugaccgc

SEQ ID NO: 1120393 - RNA, 21 nt, Mycobacterium bovis subsp bovis AF2122/97
cccggcacccaguuccacccg

SEQ ID NO: 1120394 - RNA, 17 nt, Mycobacterium bovis subsp bovis AF2122/97
cccggcacccggugaga

SEQ ID NO: 1120395 - RNA, 22 nt, Mycobacterium bovis subsp bovis AF2122/97
cccggcagauguguccggcauc

SEQ ID NO: 1120396 - RNA, 13 nt, Mycobacterium bovis subsp bovis AF2122/97
cccggcagcaucg

SEQ ID NO: 1120397 - RNA, 23 nt, Mycobacterium bovis subsp bovis AF2122/97
cccggcagagcacgcgcggcguc

SEQ ID NO: 1120398 - RNA, 13 nt, Mycobacterium bovis subsp bovis AF2122/97
cccggcaccgccg

SEQ ID NO: 1120399 - RNA, 12 nt, Mycobacterium bovis subsp bovis AF2122/97
cccggcaccgcg

SEQ ID NO: 1120400 - RNA, 13 nt, Mycobacterium bovis subsp bovis AF2122/97
cccggcaacaacg

SEQ ID NO: 1120401 - RNA, 16 nt, Mycobacterium bovis subsp bovis AF2122/97
cccggaccuucggcgg

SEQ ID NO: 1120402 - RNA, 19 nt, Mycobacterium bovis subsp bovis AF2122/97
cccggaugucgugcgggcg

SEQ ID NO: 1120403 - RNA, 21 nt, Mycobacterium bovis subsp bovis AF2122/97
cccggaugucgugcgggcgca

SEQ ID NO: 1120404 - RNA, 12 nt, Mycobacterium bovis subsp bovis AF2122/97
cccggaccgccc

SEQ ID NO: 1120405 - RNA, 20 nt, Mycobacterium bovis subsp bovis AF2122/97
cccggaccgcccgugccguc

SEQ ID NO: 1120406 - RNA, 14 nt, Mycobacterium bovis subsp bovis AF2122/97
cccggaccugggcg

SEQ ID NO: 1120407 - RNA, 16 nt, Mycobacterium bovis subsp bovis AF2122/97
cccggaccugggcgac

SEQ ID NO: 1120408 - RNA, 14 nt, Mycobacterium bovis subsp bovis AF2122/97
cccggaccuucggc

SEQ ID NO: 1120409 - RNA, 19 nt, Mycobacterium bovis subsp bovis AF2122/97
cccggaaucgucgcggccg

SEQ ID NO: 1120410 - RNA, 17 nt, Mycobacterium bovis subsp bovis AF2122/97
cccggaccgucguggcg

SEQ ID NO: 1120411 - RNA, 13 nt, Mycobacterium bovis subsp bovis AF2122/97
cccggaagcgccg

SEQ ID NO: 1120412 - RNA, 14 nt, Mycobacterium bovis subsp bovis AF2122/97
cccggaaccggcgu

SEQ ID NO: 1120413 - RNA, 15 nt, Mycobacterium bovis subsp bovis AF2122/97
cccggaacgccgcca

SEQ ID NO: 1120414 - RNA, 19 nt, Mycobacterium bovis subsp bovis AF2122/97
cccggaacgccgccagcgc

SEQ ID NO: 1120415 - RNA, 16 nt, Mycobacterium bovis subsp bovis AF2122/97
cccggaaucgucgcgg

SEQ ID NO: 1120416 - RNA, 12 nt, Mycobacterium bovis subsp bovis AF2122/97
cccggccagccu

SEQ ID NO: 1120417 - RNA, 23 nt, Mycobacterium bovis subsp bovis AF2122/97
cccggccaaaauuuugucggccg

SEQ ID NO: 1120418 - RNA, 14 nt, Mycobacterium bovis subsp bovis AF2122/97
cccggccaaccacc

SEQ ID NO: 1120419 - RNA, 13 nt, Mycobacterium bovis subsp bovis AF2122/97
cccggccagcggc

SEQ ID NO: 1120420 - RNA, 15 nt, Mycobacterium bovis subsp bovis AF2122/97
cccggccagcuccuc

SEQ ID NO: 1120421 - RNA, 19 nt, Mycobacterium bovis subsp bovis AF2122/97
cccggccagcugcguggcg

SEQ ID NO: 1120422 - RNA, 19 nt, Mycobacterium bovis subsp bovis AF2122/97
cccggccaggucgacaccg

SEQ ID NO: 1120423 - RNA, 21 nt, Mycobacterium bovis subsp bovis AF2122/97
cccggccaggucgacaccgcg

SEQ ID NO: 1120424 - RNA, 13 nt, Mycobacterium bovis subsp bovis AF2122/97
cccggccaggggc

SEQ ID NO: 1120425 - RNA, 16 nt, Mycobacterium bovis subsp bovis AF2122/97
cccggccaggggcgca

SEQ ID NO: 1120426 - RNA, 21 nt, Mycobacterium bovis subsp bovis AF2122/97
cccggccaggggcgcagcgcg

SEQ ID NO: 1120427 - RNA, 17 nt, Mycobacterium bovis subsp bovis AF2122/97
cccggcccgcucagccg

SEQ ID NO: 1120428 - RNA, 21 nt, Mycobacterium bovis subsp bovis AF2122/97
cccggcccgcucagccguccg

SEQ ID NO: 1120429 - RNA, 20 nt, Mycobacterium bovis subsp bovis AF2122/97
cccggccccgacggucaacg

SEQ ID NO: 1120430 - RNA, 22 nt, Mycobacterium bovis subsp bovis AF2122/97
cccggccccgcggccagcaccg

SEQ ID NO: 1120431 - RNA, 21 nt, Mycobacterium bovis subsp bovis AF2122/97
cccggcccagugggacagguc

SEQ ID NO: 1120432 - RNA, 12 nt, Mycobacterium bovis subsp bovis AF2122/97
cccggccgcgcg

SEQ ID NO: 1120433 - RNA, 14 nt, Mycobacterium bovis subsp bovis AF2122/97
cccggccgcgcgca

SEQ ID NO: 1120434 - RNA, 13 nt, Mycobacterium bovis subsp bovis AF2122/97
cccggccgccgag

SEQ ID NO: 1120435 - RNA, 14 nt, Mycobacterium bovis subsp bovis AF2122/97
cccggccgccagcg

SEQ ID NO: 1120436 - RNA, 19 nt, Mycobacterium bovis subsp bovis AF2122/97
cccggccgccagcgcgccg

SEQ ID NO: 1120437 - RNA, 23 nt, Mycobacterium bovis subsp bovis AF2122/97
cccggccgcgucacggaccugga

SEQ ID NO: 1120438 - RNA, 14 nt, Mycobacterium bovis subsp bovis AF2122/97
cccggccgucgccg

SEQ ID NO: 1120439 - RNA, 19 nt, Mycobacterium bovis subsp bovis AF2122/97
cccggccguugggccaccg

SEQ ID NO: 1120440 - RNA, 22 nt, Mycobacterium bovis subsp bovis AF2122/97
cccggccguugggccaccggcg

SEQ ID NO: 1120441 - RNA, 12 nt, Mycobacterium bovis subsp bovis AF2122/97
cccggccggccc

SEQ ID NO: 1120442 - RNA, 17 nt, Mycobacterium bovis subsp bovis AF2122/97
cccggcucggugcgcca

SEQ ID NO: 1120443 - RNA, 17 nt, Mycobacterium bovis subsp bovis AF2122/97
cccggcucucuucgcgc

SEQ ID NO: 1120444 - RNA, 19 nt, Mycobacterium bovis subsp bovis AF2122/97
cccggcugagcgugcggug

SEQ ID NO: 1120445 - RNA, 15 nt, Mycobacterium bovis subsp bovis AF2122/97
cccggcugccagcgc

SEQ ID NO: 1120446 - RNA, 20 nt, Mycobacterium bovis subsp bovis AF2122/97
cccgggccgcggcggccagc

SEQ ID NO: 1120447 - RNA, 22 nt, Mycobacterium bovis subsp bovis AF2122/97
cccgggccgcggcggccagcgc

SEQ ID NO: 1120448 - RNA, 19 nt, Mycobacterium bovis subsp bovis AF2122/97
cccggcucggguggccagc

SEQ ID NO: 1120449 - RNA, 20 nt, Mycobacterium bovis subsp bovis AF2122/97
cccggcggcggucaccaccg

SEQ ID NO: 1120450 - RNA, 20 nt, Mycobacterium bovis subsp bovis AF2122/97
cccggcucgagcucggcgau

SEQ ID NO: 1120451 - RNA, 14 nt, Mycobacterium bovis subsp bovis AF2122/97
cccggcucggccac

SEQ ID NO: 1120452 - RNA, 15 nt, Mycobacterium bovis subsp bovis AF2122/97
cccggcucggccacc

SEQ ID NO: 1120453 - RNA, 15 nt, Mycobacterium bovis subsp bovis AF2122/97
cccggcucggccagc

SEQ ID NO: 1120454 - RNA, 19 nt, Mycobacterium bovis subsp bovis AF2122/97
cccgggccugaaccacgcg

SEQ ID NO: 1120455 - RNA, 23 nt, Mycobacterium bovis subsp bovis AF2122/97
cccgggcggcggccugggccagc

SEQ ID NO: 1120456 - RNA, 12 nt, Mycobacterium bovis subsp bovis AF2122/97
cccgggcggucg

SEQ ID NO: 1120457 - RNA, 17 nt, Mycobacterium bovis subsp bovis AF2122/97
cccgggcggccagcugc

SEQ ID NO: 1120458 - RNA, 12 nt, Mycobacterium bovis subsp bovis AF2122/97
cccggguggcac

SEQ ID NO: 1120459 - RNA, 17 nt, Mycobacterium bovis subsp bovis AF2122/97
cccgggugcgacgcgac

SEQ ID NO: 1120460 - RNA, 15 nt, Mycobacterium bovis subsp bovis AF2122/97
cccgggucuccggcg

SEQ ID NO: 1120461 - RNA, 18 nt, Mycobacterium bovis subsp bovis AF2122/97
cccgggcgucaagccaca

SEQ ID NO: 1120462 - RNA, 22 nt, Mycobacterium bovis subsp bovis AF2122/97
cccgggcguugggaucgcgcag

SEQ ID NO: 1120463 - RNA, 13 nt, Mycobacterium bovis subsp bovis AF2122/97
cccgggcguggua

SEQ ID NO: 1120464 - RNA, 19 nt, Mycobacterium bovis subsp bovis AF2122/97
cccgggcgugguaucgccg

SEQ ID NO: 1120465 - RNA, 15 nt, Mycobacterium bovis subsp bovis AF2122/97
cccgguagcguucgg

SEQ ID NO: 1120466 - RNA, 18 nt, Mycobacterium bovis subsp bovis AF2122/97
cccgguagcguucggcga

SEQ ID NO: 1120467 - RNA, 17 nt, Mycobacterium bovis subsp bovis AF2122/97
cccgguacgccgcgccg

SEQ ID NO: 1120468 - RNA, 14 nt, Mycobacterium bovis subsp bovis AF2122/97
cccgguaccucaac

SEQ ID NO: 1120469 - RNA, 19 nt, Mycobacterium bovis subsp bovis AF2122/97
cccgguaacgccaucgucg

SEQ ID NO: 1120470 - RNA, 22 nt, Mycobacterium bovis subsp bovis AF2122/97
cccggucacgcugugcgguauc

SEQ ID NO: 1120471 - RNA, 20 nt, Mycobacterium bovis subsp bovis AF2122/97
cccgguaucgucccggcgac

SEQ ID NO: 1120472 - RNA, 23 nt, Mycobacterium bovis subsp bovis AF2122/97
cccggucacgcugugcgguaucg

SEQ ID NO: 1120473 - RNA, 16 nt, Mycobacterium bovis subsp bovis AF2122/97
cccgguccacgccagg

SEQ ID NO: 1120474 - RNA, 17 nt, Mycobacterium bovis subsp bovis AF2122/97
cccggucccgccgaccg

SEQ ID NO: 1120475 - RNA, 17 nt, Mycobacterium bovis subsp bovis AF2122/97
cccggcgguaccgccgc

SEQ ID NO: 1120476 - RNA, 16 nt, Mycobacterium bovis subsp bovis AF2122/97
cccggcggucagcggc

SEQ ID NO: 1120477 - RNA, 14 nt, Mycobacterium bovis subsp bovis AF2122/97
cccggcggucaggc

SEQ ID NO: 1120478 - RNA, 22 nt, Mycobacterium bovis subsp bovis AF2122/97
cccggcggugccgucagcggcg

SEQ ID NO: 1120479 - RNA, 17 nt, Mycobacterium bovis subsp bovis AF2122/97
cccggcgagcacccgcu

SEQ ID NO: 1120480 - RNA, 20 nt, Mycobacterium bovis subsp bovis AF2122/97
cccggcguauugcaccgcca

SEQ ID NO: 1120481 - RNA, 17 nt, Mycobacterium bovis subsp bovis AF2122/97
cccggcuacgacggcgc

SEQ ID NO: 1120482 - RNA, 16 nt, Mycobacterium bovis subsp bovis AF2122/97
cccggcguugccgccg

SEQ ID NO: 1120483 - RNA, 16 nt, Mycobacterium bovis subsp bovis AF2122/97
cccggcgugucgccgc

SEQ ID NO: 1120484 - RNA, 14 nt, Mycobacterium bovis subsp bovis AF2122/97
cccggcgucgacga

SEQ ID NO: 1120485 - RNA, 18 nt, Mycobacterium bovis subsp bovis AF2122/97
cccggcgugucgccgcca

SEQ ID NO: 1120486 - RNA, 14 nt, Mycobacterium bovis subsp bovis AF2122/97
cccggcuccagcac

SEQ ID NO: 1120487 - RNA, 14 nt, Mycobacterium bovis subsp bovis AF2122/97
cccggcuccgcaac

SEQ ID NO: 1120488 - RNA, 16 nt, Mycobacterium bovis subsp bovis AF2122/97
cccggcuccuccccgg

SEQ ID NO: 1120489 - RNA, 21 nt, Mycobacterium bovis subsp bovis AF2122/97
cccggcuccuccccggcccgc

SEQ ID NO: 1120490 - RNA, 15 nt, Mycobacterium bovis subsp bovis AF2122/97
cccggcgacguuccg

SEQ ID NO: 1120491 - RNA, 15 nt, Mycobacterium bovis subsp bovis AF2122/97
cccggcgagggcaac

SEQ ID NO: 1120492 - RNA, 15 nt, Mycobacterium bovis subsp bovis AF2122/97
cccggcgggcccgcc

SEQ ID NO: 1120493 - RNA, 16 nt, Mycobacterium bovis subsp bovis AF2122/97
cccggcgggcccgccg

SEQ ID NO: 1120494 - RNA, 19 nt, Mycobacterium bovis subsp bovis AF2122/97
cccggcgacccggucacuc

SEQ ID NO: 1120495 - RNA, 14 nt, Mycobacterium bovis subsp bovis AF2122/97
cccggcgaacaggc

SEQ ID NO: 1120496 - RNA, 23 nt, Mycobacterium bovis subsp bovis AF2122/97
cccggcgaauacgaccgucgcgc

SEQ ID NO: 1120497 - RNA, 15 nt, Mycobacterium bovis subsp bovis AF2122/97
cccggcgaccacggc

SEQ ID NO: 1120498 - RNA, 19 nt, Mycobacterium bovis subsp bovis AF2122/97
cccggccuugccgccggcg

SEQ ID NO: 1120499 - RNA, 20 nt, Mycobacterium bovis subsp bovis AF2122/97
cccggccuugccgccggcgc

SEQ ID NO: 1120500 - RNA, 22 nt, Mycobacterium bovis subsp bovis AF2122/97
cccggccuugccgccggcgccg

SEQ ID NO: 1120501 - RNA, 18 nt, Mycobacterium bovis subsp bovis AF2122/97
cccggccuuggcggcggc

SEQ ID NO: 1120502 - RNA, 19 nt, Mycobacterium bovis subsp bovis AF2122/97
cccggccuuggcggcggca

SEQ ID NO: 1120503 - RNA, 21 nt, Mycobacterium bovis subsp bovis AF2122/97
cccggccuuggcggcggcaua

SEQ ID NO: 1120504 - RNA, 15 nt, Mycobacterium bovis subsp bovis AF2122/97
cccggccuugccacc

SEQ ID NO: 1120505 - RNA, 16 nt, Mycobacterium bovis subsp bovis AF2122/97
cccggccuugccaccg

SEQ ID NO: 1120506 - RNA, 22 nt, Mycobacterium bovis subsp bovis AF2122/97
cccggccuugccaccgguaccg

SEQ ID NO: 1120507 - RNA, 14 nt, Mycobacterium bovis subsp bovis AF2122/97
cccggccuugccgc

SEQ ID NO: 1120508 - RNA, 16 nt, Mycobacterium bovis subsp bovis AF2122/97
cccggccugcugguca

SEQ ID NO: 1120509 - RNA, 21 nt, Mycobacterium bovis subsp bovis AF2122/97
cccggccugcuggucaccauc

SEQ ID NO: 1120510 - RNA, 24 nt, Mycobacterium bovis subsp bovis AF2122/97
cccggccugcuggucaccaucacc

SEQ ID NO: 1120511 - RNA, 18 nt, Mycobacterium bovis subsp bovis AF2122/97
cccggccuggagcagcca

SEQ ID NO: 1120512 - RNA, 18 nt, Mycobacterium bovis subsp bovis AF2122/97
cccagcgcugucguaccg

SEQ ID NO: 1120513 - RNA, 19 nt, Mycobacterium bovis subsp bovis AF2122/97
cccagcgcuuugaugccga

SEQ ID NO: 1120514 - RNA, 20 nt, Mycobacterium bovis subsp bovis AF2122/97
cccagcgcuuugaugccgau

SEQ ID NO: 1120515 - RNA, 21 nt, Mycobacterium bovis subsp bovis AF2122/97
cccagcgggacaaaaucagca

SEQ ID NO: 1120516 - RNA, 18 nt, Mycobacterium bovis subsp bovis AF2122/97
cccagcgguagccgagcu

SEQ ID NO: 1120517 - RNA, 12 nt, Mycobacterium bovis subsp bovis AF2122/97
cccagcggccac

SEQ ID NO: 1120518 - RNA, 12 nt, Mycobacterium bovis subsp bovis AF2122/97
cccagcggccgc

SEQ ID NO: 1120519 - RNA, 16 nt, Mycobacterium bovis subsp bovis AF2122/97
cccagcggccgcgaug

SEQ ID NO: 1120520 - RNA, 19 nt, Mycobacterium bovis subsp bovis AF2122/97
cccagcgugcccgccaccg

SEQ ID NO: 1120521 - RNA, 20 nt, Mycobacterium bovis subsp bovis AF2122/97
cccagcgugucuugucgcgc

SEQ ID NO: 1120522 - RNA, 19 nt, Mycobacterium bovis subsp bovis AF2122/97
cccagcguucccgccggcu

SEQ ID NO: 1120523 - RNA, 18 nt, Mycobacterium bovis subsp bovis AF2122/97
cccagcgguaguccggcu

SEQ ID NO: 1120524 - RNA, 18 nt, Mycobacterium bovis subsp bovis AF2122/97
cccagcgguaucccccag

SEQ ID NO: 1120525 - RNA, 21 nt, Mycobacterium bovis subsp bovis AF2122/97
cccagcugaccagcguccagc

SEQ ID NO: 1120526 - RNA, 14 nt, Mycobacterium bovis subsp bovis AF2122/97
cccagcaccaccgc

SEQ ID NO: 1120527 - RNA, 15 nt, Mycobacterium bovis subsp bovis AF2122/97
cccagcaccaccgcg

SEQ ID NO: 1120528 - RNA, 16 nt, Mycobacterium bovis subsp bovis AF2122/97
cccagcaccaccgcgg

SEQ ID NO: 1120529 - RNA, 16 nt, Mycobacterium bovis subsp bovis AF2122/97
cccagcacauucugca

SEQ ID NO: 1120530 - RNA, 18 nt, Mycobacterium bovis subsp bovis AF2122/97
cccagcaccacaacgucg

SEQ ID NO: 1120531 - RNA, 15 nt, Mycobacterium bovis subsp bovis AF2122/97
cccagcaccacggug

SEQ ID NO: 1120532 - RNA, 12 nt, Mycobacterium bovis subsp bovis AF2122/97
cccagcacccgg

SEQ ID NO: 1120533 - RNA, 17 nt, Mycobacterium bovis subsp bovis AF2122/97
cccagcacgcgcgcgac

SEQ ID NO: 1120534 - RNA, 15 nt, Mycobacterium bovis subsp bovis AF2122/97
cccagcacgcuggcg

SEQ ID NO: 1120535 - RNA, 22 nt, Mycobacterium bovis subsp bovis AF2122/97
cccagcacgcuggcguuguuga

SEQ ID NO: 1120536 - RNA, 13 nt, Mycobacterium bovis subsp bovis AF2122/97
cccagcacgguca

SEQ ID NO: 1120537 - RNA, 22 nt, Mycobacterium bovis subsp bovis AF2122/97
cccagcgccuccagcaccacgg

SEQ ID NO: 1120538 - RNA, 21 nt, Mycobacterium bovis subsp bovis AF2122/97
cccagcgcgcugggaagcucg

SEQ ID NO: 1120539 - RNA, 24 nt, Mycobacterium bovis subsp bovis AF2122/97
cccagcgcuagccgggcgcgccgg

SEQ ID NO: 1120540 - RNA, 14 nt, Mycobacterium bovis subsp bovis AF2122/97
cccaucaccgccag

SEQ ID NO: 1120541 - RNA, 12 nt, Mycobacterium bovis subsp bovis AF2122/97
cccaucaccccg

SEQ ID NO: 1120542 - RNA, 14 nt, Mycobacterium bovis subsp bovis AF2122/97
cccaucacacccgg

SEQ ID NO: 1120543 - RNA, 15 nt, Mycobacterium bovis subsp bovis AF2122/97
cccaucacacccggu

SEQ ID NO: 1120544 - RNA, 21 nt, Mycobacterium bovis subsp bovis AF2122/97
cccagugcgcaacccagccgc

SEQ ID NO: 1120545 - RNA, 22 nt, Mycobacterium bovis subsp bovis AF2122/97
cccaucaacgccggcgacggcg

SEQ ID NO: 1120546 - RNA, 21 nt, Mycobacterium bovis subsp bovis AF2122/97
cccagugcacgcucggcgccg

SEQ ID NO: 1120547 - RNA, 22 nt, Mycobacterium bovis subsp bovis AF2122/97
cccagugcagacaggcggcggc

SEQ ID NO: 1120548 - RNA, 14 nt, Mycobacterium bovis subsp bovis AF2122/97
cccagucgcggcgc

SEQ ID NO: 1120549 - RNA, 14 nt, Mycobacterium bovis subsp bovis AF2122/97
cccagucggcgccg

SEQ ID NO: 1120550 - RNA, 17 nt, Mycobacterium bovis subsp bovis AF2122/97
cccagucggcgccgccg

SEQ ID NO: 1120551 - RNA, 20 nt, Mycobacterium bovis subsp bovis AF2122/97
cccaguagaucgccucgacg

SEQ ID NO: 1120552 - RNA, 21 nt, Mycobacterium bovis subsp bovis AF2122/97
cccaggccgaugugucgauga

SEQ ID NO: 1120553 - RNA, 12 nt, Mycobacterium bovis subsp bovis AF2122/97
cccaggccgccg

SEQ ID NO: 1120554 - RNA, 19 nt, Mycobacterium bovis subsp bovis AF2122/97
cccaggccaagguggccac

SEQ ID NO: 1120555 - RNA, 13 nt, Mycobacterium bovis subsp bovis AF2122/97
cccagcugcaggg

SEQ ID NO: 1120556 - RNA, 12 nt, Mycobacterium bovis subsp bovis AF2122/97
cccagcugcgcc

SEQ ID NO: 1120557 - RNA, 13 nt, Mycobacterium bovis subsp bovis AF2122/97
cccagcugcgccg

SEQ ID NO: 1120558 - RNA, 14 nt, Mycobacterium bovis subsp bovis AF2122/97
cccagcugcggucg

SEQ ID NO: 1120559 - RNA, 20 nt, Mycobacterium bovis subsp bovis AF2122/97
cccaccgccccggcggcggc

SEQ ID NO: 1120560 - RNA, 14 nt, Mycobacterium bovis subsp bovis AF2122/97
cccaccgccguugg

SEQ ID NO: 1120561 - RNA, 15 nt, Mycobacterium bovis subsp bovis AF2122/97
cccaccgccguuggg

SEQ ID NO: 1120562 - RNA, 21 nt, Mycobacterium bovis subsp bovis AF2122/97
cccaccgccguugggccgcgc

SEQ ID NO: 1120563 - RNA, 22 nt, Mycobacterium bovis subsp bovis AF2122/97
cccaccgccguugggccgcgcc

SEQ ID NO: 1120564 - RNA, 13 nt, Mycobacterium bovis subsp bovis AF2122/97
cccaccgccuggg

SEQ ID NO: 1120565 - RNA, 21 nt, Mycobacterium bovis subsp bovis AF2122/97
cccaccgccugggcggccagc

SEQ ID NO: 1120566 - RNA, 12 nt, Mycobacterium bovis subsp bovis AF2122/97
cccaccgcgccg

SEQ ID NO: 1120567 - RNA, 12 nt, Mycobacterium bovis subsp bovis AF2122/97
cccaccgggcgg

SEQ ID NO: 1120568 - RNA, 14 nt, Mycobacterium bovis subsp bovis AF2122/97
cccaccgggcggcg

SEQ ID NO: 1120569 - RNA, 15 nt, Mycobacterium bovis subsp bovis AF2122/97
cccaccgguaccgcc

SEQ ID NO: 1120570 - RNA, 15 nt, Mycobacterium bovis subsp bovis AF2122/97
cccaccggucgccgc

SEQ ID NO: 1120571 - RNA, 13 nt, Mycobacterium bovis subsp bovis AF2122/97
cccacccgcaccg

SEQ ID NO: 1120572 - RNA, 14 nt, Mycobacterium bovis subsp bovis AF2122/97
cccacccgccgccg

SEQ ID NO: 1120573 - RNA, 16 nt, Mycobacterium bovis subsp bovis AF2122/97
cccacccgccgccgcc

SEQ ID NO: 1120574 - RNA, 15 nt, Mycobacterium bovis subsp bovis AF2122/97
cccacccgcggcgcc

SEQ ID NO: 1120575 - RNA, 16 nt, Mycobacterium bovis subsp bovis AF2122/97
cccacccgcggcgccg

SEQ ID NO: 1120576 - RNA, 14 nt, Mycobacterium bovis subsp bovis AF2122/97
cccaccagcgcagc

SEQ ID NO: 1120577 - RNA, 18 nt, Mycobacterium bovis subsp bovis AF2122/97
cccaccagcggcggcaac

SEQ ID NO: 1120578 - RNA, 19 nt, Mycobacterium bovis subsp bovis AF2122/97
cccaccagcggcggcaacg

SEQ ID NO: 1120579 - RNA, 17 nt, Mycobacterium bovis subsp bovis AF2122/97
cccaccagcggcggccc

SEQ ID NO: 1120580 - RNA, 18 nt, Mycobacterium bovis subsp bovis AF2122/97
ccauugccucccgcgccg

SEQ ID NO: 1120581 - RNA, 19 nt, Mycobacterium bovis subsp bovis AF2122/97
ccauugccucccgcgccgg

SEQ ID NO: 1120582 - RNA, 20 nt, Mycobacterium bovis subsp bovis AF2122/97
ccauugccucccgcgccggc

SEQ ID NO: 1120583 - RNA, 21 nt, Mycobacterium bovis subsp bovis AF2122/97
ccauugccucccgcgccggcg

SEQ ID NO: 1120584 - RNA, 16 nt, Mycobacterium bovis subsp bovis AF2122/97
cccaccaugugcgaca

SEQ ID NO: 1120585 - RNA, 19 nt, Mycobacterium bovis subsp bovis AF2122/97
cccacccccgguucaccuc

SEQ ID NO: 1120586 - RNA, 14 nt, Mycobacterium bovis subsp bovis AF2122/97
cccaccccggccgc

SEQ ID NO: 1120587 - RNA, 22 nt, Mycobacterium bovis subsp bovis AF2122/97
ccauugccgccgucgccgccgc

SEQ ID NO: 1120588 - RNA, 19 nt, Mycobacterium bovis subsp bovis AF2122/97
ccauugccgccgucgccga

SEQ ID NO: 1120589 - RNA, 22 nt, Mycobacterium bovis subsp bovis AF2122/97
ccauugccauacagcaccccgc

SEQ ID NO: 1120590 - RNA, 16 nt, Mycobacterium bovis subsp bovis AF2122/97
ccauugccgccggcgc

SEQ ID NO: 1120591 - RNA, 22 nt, Mycobacterium bovis subsp bovis AF2122/97
ccauugccgccggugccgccga

SEQ ID NO: 1120592 - RNA, 13 nt, Mycobacterium bovis subsp bovis AF2122/97
ccauucucggccg

SEQ ID NO: 1120593 - RNA, 18 nt, Mycobacterium bovis subsp bovis AF2122/97
ccauugagcucccgcaac

SEQ ID NO: 1120594 - RNA, 20 nt, Mycobacterium bovis subsp bovis AF2122/97
ccauuccagccggugccgcc

SEQ ID NO: 1120595 - RNA, 14 nt, Mycobacterium bovis subsp bovis AF2122/97
ccauuccaucgcgc

SEQ ID NO: 1120596 - RNA, 23 nt, Mycobacterium bovis subsp bovis AF2122/97
ccauucgcgguccaucagcacgg

SEQ ID NO: 1120597 - RNA, 14 nt, Mycobacterium bovis subsp bovis AF2122/97
cccacgaucagcag

SEQ ID NO: 1120598 - RNA, 13 nt, Mycobacterium bovis subsp bovis AF2122/97
cccacgccgccgu

SEQ ID NO: 1120599 - RNA, 12 nt, Mycobacterium bovis subsp bovis AF2122/97
cccacggccagu

SEQ ID NO: 1120600 - RNA, 13 nt, Mycobacterium bovis subsp bovis AF2122/97
cccacggccggcc

SEQ ID NO: 1120601 - RNA, 22 nt, Mycobacterium bovis subsp bovis AF2122/97
cccaccuucaucaacgacacca

SEQ ID NO: 1120602 - RNA, 21 nt, Mycobacterium bovis subsp bovis AF2122/97
cccacgagagcgcugucccga

SEQ ID NO: 1120603 - RNA, 12 nt, Mycobacterium bovis subsp bovis AF2122/97
cccaccgugccg

SEQ ID NO: 1120604 - RNA, 15 nt, Mycobacterium bovis subsp bovis AF2122/97
cccaccgugccgggc

SEQ ID NO: 1120605 - RNA, 18 nt, Mycobacterium bovis subsp bovis AF2122/97
cccaccgugccgggcgac

SEQ ID NO: 1120606 - RNA, 18 nt, Mycobacterium bovis subsp bovis AF2122/97
cccaccguuugggcgccg

SEQ ID NO: 1120607 - RNA, 21 nt, Mycobacterium bovis subsp bovis AF2122/97
cccaccguuugggcgccggug

SEQ ID NO: 1120608 - RNA, 22 nt, Mycobacterium bovis subsp bovis AF2122/97
cccaccguuugggcgccggugu

SEQ ID NO: 1120609 - RNA, 14 nt, Mycobacterium bovis subsp bovis AF2122/97
cccaccggugccgc

SEQ ID NO: 1120610 - RNA, 15 nt, Mycobacterium bovis subsp bovis AF2122/97
cccaccggugccgcc

SEQ ID NO: 1120611 - RNA, 22 nt, Mycobacterium bovis subsp bovis AF2122/97
cccaccggugccgcccgcgccg

SEQ ID NO: 1120612 - RNA, 20 nt, Mycobacterium bovis subsp bovis AF2122/97
cccaccggugccgccguugc

SEQ ID NO: 1120613 - RNA, 18 nt, Mycobacterium bovis subsp bovis AF2122/97
cccaccucgaucgcgccg

SEQ ID NO: 1120614 - RNA, 22 nt, Mycobacterium bovis subsp bovis AF2122/97
cccaccucgaucgcgccgucgg

SEQ ID NO: 1120615 - RNA, 22 nt, Mycobacterium bovis subsp bovis AF2122/97
cccaccucguauacccgggcgg

SEQ ID NO: 1120616 - RNA, 16 nt, Mycobacterium bovis subsp bovis AF2122/97
cccaccgucacccccg

SEQ ID NO: 1120617 - RNA, 13 nt, Mycobacterium bovis subsp bovis AF2122/97
cccagaucggcgu

SEQ ID NO: 1120618 - RNA, 21 nt, Mycobacterium bovis subsp bovis AF2122/97
cccagauauugaaccgggcca

SEQ ID NO: 1120619 - RNA, 18 nt, Mycobacterium bovis subsp bovis AF2122/97
cccagcaaccgcucggcg

SEQ ID NO: 1120620 - RNA, 22 nt, Mycobacterium bovis subsp bovis AF2122/97
cccagaucgguugaucggccac

SEQ ID NO: 1120621 - RNA, 21 nt, Mycobacterium bovis subsp bovis AF2122/97
cccagauugccugggcggccg

SEQ ID NO: 1120622 - RNA, 18 nt, Mycobacterium bovis subsp bovis AF2122/97
cccacggugucccgcgag

SEQ ID NO: 1120623 - RNA, 18 nt, Mycobacterium bovis subsp bovis AF2122/97
cccacggccggccgcugc

SEQ ID NO: 1120624 - RNA, 17 nt, Mycobacterium bovis subsp bovis AF2122/97
cccacggcgaccacgcc

SEQ ID NO: 1120625 - RNA, 18 nt, Mycobacterium bovis subsp bovis AF2122/97
cccacgggccggccgagc

SEQ ID NO: 1120626 - RNA, 19 nt, Mycobacterium bovis subsp bovis AF2122/97
cccagagugaauccggcau

SEQ ID NO: 1120627 - RNA, 16 nt, Mycobacterium bovis subsp bovis AF2122/97
cccagacugucgagcg

SEQ ID NO: 1120628 - RNA, 15 nt, Mycobacterium bovis subsp bovis AF2122/97
cccccucggcgugau

SEQ ID NO: 1120629 - RNA, 14 nt, Mycobacterium bovis subsp bovis AF2122/97
cccccuucacccuc

SEQ ID NO: 1120630 - RNA, 16 nt, Mycobacterium bovis subsp bovis AF2122/97
cccccgucgccaccga

SEQ ID NO: 1120631 - RNA, 19 nt, Mycobacterium bovis subsp bovis AF2122/97
cccccguugccgccguugc

SEQ ID NO: 1120632 - RNA, 16 nt, Mycobacterium bovis subsp bovis AF2122/97
ccccgaagaugaccuc

SEQ ID NO: 1120633 - RNA, 18 nt, Mycobacterium bovis subsp bovis AF2122/97
ccccgaagcucaucaccg

SEQ ID NO: 1120634 - RNA, 19 nt, Mycobacterium bovis subsp bovis AF2122/97
ccccgaacauugcgcccag

SEQ ID NO: 1120635 - RNA, 21 nt, Mycobacterium bovis subsp bovis AF2122/97
ccccgaaguggugaccgacgc

SEQ ID NO: 1120636 - RNA, 17 nt, Mycobacterium bovis subsp bovis AF2122/97
cccccgauagcgaccgc

SEQ ID NO: 1120637 - RNA, 14 nt, Mycobacterium bovis subsp bovis AF2122/97
cccccgcacgcacg

SEQ ID NO: 1120638 - RNA, 14 nt, Mycobacterium bovis subsp bovis AF2122/97
cccccgcacgcucg

SEQ ID NO: 1120639 - RNA, 18 nt, Mycobacterium bovis subsp bovis AF2122/97
cccccgcacgcucggcgu

SEQ ID NO: 1120640 - RNA, 11 nt, Mycobacterium bovis subsp bovis AF2122/97
cccccgcgcga

SEQ ID NO: 1120641 - RNA, 13 nt, Mycobacterium bovis subsp bovis AF2122/97
cccccgccaaccc

SEQ ID NO: 1120642 - RNA, 13 nt, Mycobacterium bovis subsp bovis AF2122/97
cccccggcaccgc

SEQ ID NO: 1120643 - RNA, 17 nt, Mycobacterium bovis subsp bovis AF2122/97
cccccggcaccgccggc

SEQ ID NO: 1120644 - RNA, 12 nt, Mycobacterium bovis subsp bovis AF2122/97
cccccggugccg

SEQ ID NO: 1120645 - RNA, 12 nt, Mycobacterium bovis subsp bovis AF2122/97
ccccgaucggcc

SEQ ID NO: 1120646 - RNA, 18 nt, Mycobacterium bovis subsp bovis AF2122/97
ccccgaucagcaccgacg

SEQ ID NO: 1120647 - RNA, 12 nt, Mycobacterium bovis subsp bovis AF2122/97
ccccgaucaggc

SEQ ID NO: 1120648 - RNA, 14 nt, Mycobacterium bovis subsp bovis AF2122/97
ccccgaucccgagg

SEQ ID NO: 1120649 - RNA, 13 nt, Mycobacterium bovis subsp bovis AF2122/97
ccccgaugaccgc

SEQ ID NO: 1120650 - RNA, 17 nt, Mycobacterium bovis subsp bovis AF2122/97
ccccgcacgaguuaccg

SEQ ID NO: 1120651 - RNA, 13 nt, Mycobacterium bovis subsp bovis AF2122/97
ccccgcacgcggg

SEQ ID NO: 1120652 - RNA, 11 nt, Mycobacterium bovis subsp bovis AF2122/97
ccccgcacgcu

SEQ ID NO: 1120653 - RNA, 14 nt, Mycobacterium bovis subsp bovis AF2122/97
ccccgcacgcucgg

SEQ ID NO: 1120654 - RNA, 20 nt, Mycobacterium bovis subsp bovis AF2122/97
ccccgcagaauccggcaacc

SEQ ID NO: 1120655 - RNA, 19 nt, Mycobacterium bovis subsp bovis AF2122/97
ccccgcagcacucgcccaa

SEQ ID NO: 1120656 - RNA, 12 nt, Mycobacterium bovis subsp bovis AF2122/97
ccccgcagcgcc

SEQ ID NO: 1120657 - RNA, 22 nt, Mycobacterium bovis subsp bovis AF2122/97
ccccgcagcgccuaccagcacc

SEQ ID NO: 1120658 - RNA, 23 nt, Mycobacterium bovis subsp bovis AF2122/97
ccccgagaccucgucgucgaagu

SEQ ID NO: 1120659 - RNA, 20 nt, Mycobacterium bovis subsp bovis AF2122/97
ccccgacggugaaccaccac

SEQ ID NO: 1120660 - RNA, 12 nt, Mycobacterium bovis subsp bovis AF2122/97
ccccgaccgccg

SEQ ID NO: 1120661 - RNA, 22 nt, Mycobacterium bovis subsp bovis AF2122/97
ccccgacggacuccggccggcc

SEQ ID NO: 1120662 - RNA, 14 nt, Mycobacterium bovis subsp bovis AF2122/97
ccccgaccccgacg

SEQ ID NO: 1120663 - RNA, 15 nt, Mycobacterium bovis subsp bovis AF2122/97
ccccgaccgaaccgu

SEQ ID NO: 1120664 - RNA, 19 nt, Mycobacterium bovis subsp bovis AF2122/97
ccccgcccuugccgccagc

SEQ ID NO: 1120665 - RNA, 16 nt, Mycobacterium bovis subsp bovis AF2122/97
ccccgccacgccgaag

SEQ ID NO: 1120666 - RNA, 15 nt, Mycobacterium bovis subsp bovis AF2122/97
ccccgccauugccgc

SEQ ID NO: 1120667 - RNA, 13 nt, Mycobacterium bovis subsp bovis AF2122/97
ccccgcccgcgcg

SEQ ID NO: 1120668 - RNA, 13 nt, Mycobacterium bovis subsp bovis AF2122/97
ccccgcccgcacc

SEQ ID NO: 1120669 - RNA, 13 nt, Mycobacterium bovis subsp bovis AF2122/97
ccccgccgagcgg

SEQ ID NO: 1120670 - RNA, 17 nt, Mycobacterium bovis subsp bovis AF2122/97
ccccgccgagcggugcc

SEQ ID NO: 1120671 - RNA, 15 nt, Mycobacterium bovis subsp bovis AF2122/97
ccccgccgaucaccg

SEQ ID NO: 1120672 - RNA, 13 nt, Mycobacterium bovis subsp bovis AF2122/97
ccccgccgccacg

SEQ ID NO: 1120673 - RNA, 14 nt, Mycobacterium bovis subsp bovis AF2122/97
ccccgccgccggug

SEQ ID NO: 1120674 - RNA, 19 nt, Mycobacterium bovis subsp bovis AF2122/97
ccccgccgaugccgccggc

SEQ ID NO: 1120675 - RNA, 12 nt, Mycobacterium bovis subsp bovis AF2122/97
ccccgccgcacg

SEQ ID NO: 1120676 - RNA, 15 nt, Mycobacterium bovis subsp bovis AF2122/97
ccccgccgucaccgc

SEQ ID NO: 1120677 - RNA, 10 nt, Mycobacterium bovis subsp bovis AF2122/97
ccccgccguu

SEQ ID NO: 1120678 - RNA, 23 nt, Mycobacterium bovis subsp bovis AF2122/97
ccccgccguugccgccgacgccg

SEQ ID NO: 1120679 - RNA, 13 nt, Mycobacterium bovis subsp bovis AF2122/97
ccccgccggccgc

SEQ ID NO: 1120680 - RNA, 16 nt, Mycobacterium bovis subsp bovis AF2122/97
ccccgccggccgcgcc

SEQ ID NO: 1120681 - RNA, 12 nt, Mycobacterium bovis subsp bovis AF2122/97
ccccgccggccu

SEQ ID NO: 1120682 - RNA, 13 nt, Mycobacterium bovis subsp bovis AF2122/97
ccccgccggcgcc

SEQ ID NO: 1120683 - RNA, 12 nt, Mycobacterium bovis subsp bovis AF2122/97
ccccgccggcca

SEQ ID NO: 1120684 - RNA, 19 nt, Mycobacterium bovis subsp bovis AF2122/97
ccccgccauugccgccggc

SEQ ID NO: 1120685 - RNA, 12 nt, Mycobacterium bovis subsp bovis AF2122/97
ccccgccggaca

SEQ ID NO: 1120686 - RNA, 13 nt, Mycobacterium bovis subsp bovis AF2122/97
ccccgccguaccg

SEQ ID NO: 1120687 - RNA, 17 nt, Mycobacterium bovis subsp bovis AF2122/97
ccccgccggcugcggag

SEQ ID NO: 1120688 - RNA, 10 nt, Mycobacterium bovis subsp bovis AF2122/97
ccccgccguc

SEQ ID NO: 1120689 - RNA, 14 nt, Mycobacterium bovis subsp bovis AF2122/97
ccccgccgucaccg

SEQ ID NO: 1120690 - RNA, 12 nt, Mycobacterium bovis subsp bovis AF2122/97
ccccgcgcggug

SEQ ID NO: 1120691 - RNA, 21 nt, Mycobacterium bovis subsp bovis AF2122/97
ccccgcucgaucugcccggug

SEQ ID NO: 1120692 - RNA, 14 nt, Mycobacterium bovis subsp bovis AF2122/97
ccccgcgcgccagc

SEQ ID NO: 1120693 - RNA, 14 nt, Mycobacterium bovis subsp bovis AF2122/97
ccccgcggcgccgc

SEQ ID NO: 1120694 - RNA, 13 nt, Mycobacterium bovis subsp bovis AF2122/97
ccccgcuacgcgc

SEQ ID NO: 1120695 - RNA, 22 nt, Mycobacterium bovis subsp bovis AF2122/97
ccccggauuccagcagccugcg

SEQ ID NO: 1120696 - RNA, 21 nt, Mycobacterium bovis subsp bovis AF2122/97
ccccggauuccucgucaccgc

SEQ ID NO: 1120697 - RNA, 20 nt, Mycobacterium bovis subsp bovis AF2122/97
ccccggacggcaggcuggcg

SEQ ID NO: 1120698 - RNA, 21 nt, Mycobacterium bovis subsp bovis AF2122/97
ccccgcuuggcgagccacggc

SEQ ID NO: 1120699 - RNA, 12 nt, Mycobacterium bovis subsp bovis AF2122/97
ccccggccacca

SEQ ID NO: 1120700 - RNA, 20 nt, Mycobacterium bovis subsp bovis AF2122/97
ccccaguugugcggccaggc

SEQ ID NO: 1120701 - RNA, 19 nt, Mycobacterium bovis subsp bovis AF2122/97
ccccaggugggcagcaggc

SEQ ID NO: 1120702 - RNA, 14 nt, Mycobacterium bovis subsp bovis AF2122/97
ccccagugcacgcu

SEQ ID NO: 1120703 - RNA, 19 nt, Mycobacterium bovis subsp bovis AF2122/97
ccccagugcacgcucggcg

SEQ ID NO: 1120704 - RNA, 16 nt, Mycobacterium bovis subsp bovis AF2122/97
ccccaucaccaccggc

SEQ ID NO: 1120705 - RNA, 16 nt, Mycobacterium bovis subsp bovis AF2122/97
ccccauggccaccgaa

SEQ ID NO: 1120706 - RNA, 22 nt, Mycobacterium bovis subsp bovis AF2122/97
cccccgaaguggugaccgacgc

SEQ ID NO: 1120707 - RNA, 23 nt, Mycobacterium bovis subsp bovis AF2122/97
cccccgaaguggugaccgacgcg

SEQ ID NO: 1120708 - RNA, 14 nt, Mycobacterium bovis subsp bovis AF2122/97
cccccgacacgccg

SEQ ID NO: 1120709 - RNA, 12 nt, Mycobacterium bovis subsp bovis AF2122/97
ccccccgugcgg

SEQ ID NO: 1120710 - RNA, 13 nt, Mycobacterium bovis subsp bovis AF2122/97
ccccccguugccg

SEQ ID NO: 1120711 - RNA, 13 nt, Mycobacterium bovis subsp bovis AF2122/97
ccccccgaccccg

SEQ ID NO: 1120712 - RNA, 15 nt, Mycobacterium bovis subsp bovis AF2122/97
cccccaguucggcgu

SEQ ID NO: 1120713 - RNA, 17 nt, Mycobacterium bovis subsp bovis AF2122/97
ccccagguagugcacac

SEQ ID NO: 1120714 - RNA, 13 nt, Mycobacterium bovis subsp bovis AF2122/97
ccccauugccgcc

SEQ ID NO: 1120715 - RNA, 16 nt, Mycobacterium bovis subsp bovis AF2122/97
ccccaugccgaccggc

SEQ ID NO: 1120716 - RNA, 20 nt, Mycobacterium bovis subsp bovis AF2122/97
ccccaggcgcucagcgcggc

SEQ ID NO: 1120717 - RNA, 18 nt, Mycobacterium bovis subsp bovis AF2122/97
ccccaggcgcugccggug

SEQ ID NO: 1120718 - RNA, 15 nt, Mycobacterium bovis subsp bovis AF2122/97
ccccagcugcagggc

SEQ ID NO: 1120719 - RNA, 17 nt, Mycobacterium bovis subsp bovis AF2122/97
ccccagcugcggucgcg

SEQ ID NO: 1120720 - RNA, 15 nt, Mycobacterium bovis subsp bovis AF2122/97
ccccagcgccaccgu

SEQ ID NO: 1120721 - RNA, 17 nt, Mycobacterium bovis subsp bovis AF2122/97
ccccagccggcagcagc

SEQ ID NO: 1120722 - RNA, 12 nt, Mycobacterium bovis subsp bovis AF2122/97
ccccagcgacgu

SEQ ID NO: 1120723 - RNA, 22 nt, Mycobacterium bovis subsp bovis AF2122/97
ccccagcacccggcuucgccgc

SEQ ID NO: 1120724 - RNA, 21 nt, Mycobacterium bovis subsp bovis AF2122/97
ccccagcaucuuuggcggccg

SEQ ID NO: 1120725 - RNA, 19 nt, Mycobacterium bovis subsp bovis AF2122/97
ccccagcaaaggggugugu

SEQ ID NO: 1120726 - RNA, 14 nt, Mycobacterium bovis subsp bovis AF2122/97
ccccacuugccggg

SEQ ID NO: 1120727 - RNA, 15 nt, Mycobacterium bovis subsp bovis AF2122/97
ccccacuggugcagc

SEQ ID NO: 1120728 - RNA, 12 nt, Mycobacterium bovis subsp bovis AF2122/97
ccccaccggcac

SEQ ID NO: 1120729 - RNA, 18 nt, Mycobacterium bovis subsp bovis AF2122/97
ccccacccuaaucguucc

SEQ ID NO: 1120730 - RNA, 13 nt, Mycobacterium bovis subsp bovis AF2122/97
ccccaccgacagc

SEQ ID NO: 1120731 - RNA, 13 nt, Mycobacterium bovis subsp bovis AF2122/97
ccccacacagucg

SEQ ID NO: 1120732 - RNA, 13 nt, Mycobacterium bovis subsp bovis AF2122/97
ccccaccggcccg

SEQ ID NO: 1120733 - RNA, 16 nt, Mycobacterium bovis subsp bovis AF2122/97
ccccaccgguaccgcc

SEQ ID NO: 1120734 - RNA, 16 nt, Mycobacterium bovis subsp bovis AF2122/97
ccccaccggugccgcc

SEQ ID NO: 1120735 - RNA, 12 nt, Mycobacterium bovis subsp bovis AF2122/97
ccccaccgguua

SEQ ID NO: 1120736 - RNA, 12 nt, Mycobacterium bovis subsp bovis AF2122/97
cccaucgccaca

SEQ ID NO: 1120737 - RNA, 17 nt, Mycobacterium bovis subsp bovis AF2122/97
cccauccggucgauguc

SEQ ID NO: 1120738 - RNA, 21 nt, Mycobacterium bovis subsp bovis AF2122/97
cccauccggccgucgggcagc

SEQ ID NO: 1120739 - RNA, 17 nt, Mycobacterium bovis subsp bovis AF2122/97
cccauccccgcucgauc

SEQ ID NO: 1120740 - RNA, 17 nt, Mycobacterium bovis subsp bovis AF2122/97
cccaucccgauccuggc

SEQ ID NO: 1120741 - RNA, 13 nt, Mycobacterium bovis subsp bovis AF2122/97
cccauuucggcac

SEQ ID NO: 1120742 - RNA, 19 nt, Mycobacterium bovis subsp bovis AF2122/97
cccaucgcccggugcgucg

SEQ ID NO: 1120743 - RNA, 18 nt, Mycobacterium bovis subsp bovis AF2122/97
cccauugccgccgucgcc

SEQ ID NO: 1120744 - RNA, 23 nt, Mycobacterium bovis subsp bovis AF2122/97
cccauuugccuugagccgccccg

SEQ ID NO: 1120745 - RNA, 23 nt, Mycobacterium bovis subsp bovis AF2122/97
ccccaaacuccgaaaucgucagu

SEQ ID NO: 1120746 - RNA, 14 nt, Mycobacterium bovis subsp bovis AF2122/97
ccccaagccaugug

SEQ ID NO: 1120747 - RNA, 21 nt, Mycobacterium bovis subsp bovis AF2122/97
ccccacaaucagcccgacacc

SEQ ID NO: 1120748 - RNA, 20 nt, Mycobacterium bovis subsp bovis AF2122/97
ccccaauccuugggcuucga

SEQ ID NO: 1120749 - RNA, 18 nt, Mycobacterium bovis subsp bovis AF2122/97
ccccaagcgccugagcgg

SEQ ID NO: 1120750 - RNA, 14 nt, Mycobacterium bovis subsp bovis AF2122/97
ccccaagucgacgg

SEQ ID NO: 1120751 - RNA, 12 nt, Mycobacterium bovis subsp bovis AF2122/97
ccaggaucgcgg

SEQ ID NO: 1120752 - RNA, 19 nt, Mycobacterium bovis subsp bovis AF2122/97
ccaggauccgaccccgcgc

SEQ ID NO: 1120753 - RNA, 20 nt, Mycobacterium bovis subsp bovis AF2122/97
ccaggauaaguccggacauc

SEQ ID NO: 1120754 - RNA, 15 nt, Mycobacterium bovis subsp bovis AF2122/97
ccaggauaaguccgg

SEQ ID NO: 1120755 - RNA, 14 nt, Mycobacterium bovis subsp bovis AF2122/97
ccaggagccgauca

SEQ ID NO: 1120756 - RNA, 17 nt, Mycobacterium bovis subsp bovis AF2122/97
ccaggagcgccgucauc

SEQ ID NO: 1120757 - RNA, 18 nt, Mycobacterium bovis subsp bovis AF2122/97
ccaggagcgcggcccgcc

SEQ ID NO: 1120758 - RNA, 15 nt, Mycobacterium bovis subsp bovis AF2122/97
ccaggagugcgggca

SEQ ID NO: 1120759 - RNA, 21 nt, Mycobacterium bovis subsp bovis AF2122/97
ccaggagugcgggcaugccgg

SEQ ID NO: 1120760 - RNA, 24 nt, Mycobacterium bovis subsp bovis AF2122/97
ccaggagugcgggcaugccggcga

SEQ ID NO: 1120761 - RNA, 21 nt, Mycobacterium bovis subsp bovis AF2122/97
ccaggaucucuucucggcuac

SEQ ID NO: 1120762 - RNA, 16 nt, Mycobacterium bovis subsp bovis AF2122/97
ccaggaucgcggcgcc

SEQ ID NO: 1120763 - RNA, 22 nt, Mycobacterium bovis subsp bovis AF2122/97
ccaggaucgcggcgccgucguc

SEQ ID NO: 1120764 - RNA, 22 nt, Mycobacterium bovis subsp bovis AF2122/97
ccaggaucgcguggcgcaccac

SEQ ID NO: 1120765 - RNA, 17 nt, Mycobacterium bovis subsp bovis AF2122/97
ccagggcccuagccggc

SEQ ID NO: 1120766 - RNA, 19 nt, Mycobacterium bovis subsp bovis AF2122/97
ccagggcccuagccggcgc

SEQ ID NO: 1120767 - RNA, 16 nt, Mycobacterium bovis subsp bovis AF2122/97
ccagggccgagcagcu

SEQ ID NO: 1120768 - RNA, 17 nt, Mycobacterium bovis subsp bovis AF2122/97
ccagggccuccacccgc

SEQ ID NO: 1120769 - RNA, 16 nt, Mycobacterium bovis subsp bovis AF2122/97
ccagggccucgaccgc

SEQ ID NO: 1120770 - RNA, 23 nt, Mycobacterium bovis subsp bovis AF2122/97
ccagggccucgaccgccagccgc

SEQ ID NO: 1120771 - RNA, 15 nt, Mycobacterium bovis subsp bovis AF2122/97
ccagggcgcaacgga

SEQ ID NO: 1120772 - RNA, 16 nt, Mycobacterium bovis subsp bovis AF2122/97
ccagggcguuggcggc

SEQ ID NO: 1120773 - RNA, 15 nt, Mycobacterium bovis subsp bovis AF2122/97
ccagggcgugcgcga

SEQ ID NO: 1120774 - RNA, 18 nt, Mycobacterium bovis subsp bovis AF2122/97
ccaggggauugccccgca

SEQ ID NO: 1120775 - RNA, 19 nt, Mycobacterium bovis subsp bovis AF2122/97
ccaggggcaccgagcugag

SEQ ID NO: 1120776 - RNA, 15 nt, Mycobacterium bovis subsp bovis AF2122/97
ccaggggcgcagcgc

SEQ ID NO: 1120777 - RNA, 20 nt, Mycobacterium bovis subsp bovis AF2122/97
ccagggggcgugccgccgca

SEQ ID NO: 1120778 - RNA, 21 nt, Mycobacterium bovis subsp bovis AF2122/97
ccagggcgguggccacccggc

SEQ ID NO: 1120779 - RNA, 17 nt, Mycobacterium bovis subsp bovis AF2122/97
ccaggguggcgacguca

SEQ ID NO: 1120780 - RNA, 13 nt, Mycobacterium bovis subsp bovis AF2122/97
ccagggugccggc

SEQ ID NO: 1120781 - RNA, 16 nt, Mycobacterium bovis subsp bovis AF2122/97
ccagggugccggcggu

SEQ ID NO: 1120782 - RNA, 18 nt, Mycobacterium bovis subsp bovis AF2122/97
ccaggucauugccggcga

SEQ ID NO: 1120783 - RNA, 19 nt, Mycobacterium bovis subsp bovis AF2122/97
ccaggucagccgcgcgggu

SEQ ID NO: 1120784 - RNA, 20 nt, Mycobacterium bovis subsp bovis AF2122/97
ccaggucauauugcggugca

SEQ ID NO: 1120785 - RNA, 13 nt, Mycobacterium bovis subsp bovis AF2122/97
ccaggucggccgc

SEQ ID NO: 1120786 - RNA, 17 nt, Mycobacterium bovis subsp bovis AF2122/97
ccaggucggugggcggc

SEQ ID NO: 1120787 - RNA, 19 nt, Mycobacterium bovis subsp bovis AF2122/97
ccaggucggugggcggcga

SEQ ID NO: 1120788 - RNA, 21 nt, Mycobacterium bovis subsp bovis AF2122/97
ccaggucggugugcaucgccg

SEQ ID NO: 1120789 - RNA, 16 nt, Mycobacterium bovis subsp bovis AF2122/97
ccaggucgugcccggg

SEQ ID NO: 1120790 - RNA, 18 nt, Mycobacterium bovis subsp bovis AF2122/97
ccaggucgugcccgggac

SEQ ID NO: 1120791 - RNA, 22 nt, Mycobacterium bovis subsp bovis AF2122/97
ccaggucggucauccggauggg

SEQ ID NO: 1120792 - RNA, 18 nt, Mycobacterium bovis subsp bovis AF2122/97
ccaggucggcguugaucg

SEQ ID NO: 1120793 - RNA, 20 nt, Mycobacterium bovis subsp bovis AF2122/97
ccaggucggcuucgacaacc

SEQ ID NO: 1120794 - RNA, 19 nt, Mycobacterium bovis subsp bovis AF2122/97
ccagugcacgcucggcgcc

SEQ ID NO: 1120795 - RNA, 15 nt, Mycobacterium bovis subsp bovis AF2122/97
ccagugagcaugcga

SEQ ID NO: 1120796 - RNA, 14 nt, Mycobacterium bovis subsp bovis AF2122/97
ccagugcacgcucg

SEQ ID NO: 1120797 - RNA, 18 nt, Mycobacterium bovis subsp bovis AF2122/97
ccagugacucaccgugaa

SEQ ID NO: 1120798 - RNA, 21 nt, Mycobacterium bovis subsp bovis AF2122/97
ccagugaaucggaccgaccgg

SEQ ID NO: 1120799 - RNA, 19 nt, Mycobacterium bovis subsp bovis AF2122/97
ccagucgaucgcggcccgc

SEQ ID NO: 1120800 - RNA, 17 nt, Mycobacterium bovis subsp bovis AF2122/97
ccagugaaaccaccggc

SEQ ID NO: 1120801 - RNA, 18 nt, Mycobacterium bovis subsp bovis AF2122/97
ccagugaaaccaccggcc

SEQ ID NO: 1120802 - RNA, 19 nt, Mycobacterium bovis subsp bovis AF2122/97
ccagugaaaccaccggccg

SEQ ID NO: 1120803 - RNA, 23 nt, Mycobacterium bovis subsp bovis AF2122/97
ccagucuuguugugcugcaccgu

SEQ ID NO: 1120804 - RNA, 20 nt, Mycobacterium bovis subsp bovis AF2122/97
ccagugucagcacgacgaca

SEQ ID NO: 1120805 - RNA, 22 nt, Mycobacterium bovis subsp bovis AF2122/97
ccaguggccaccaucaccucgc

SEQ ID NO: 1120806 - RNA, 24 nt, Mycobacterium bovis subsp bovis AF2122/97
ccagugggaugaccuuggccgugc

SEQ ID NO: 1120807 - RNA, 18 nt, Mycobacterium bovis subsp bovis AF2122/97
ccagugguaggccgccgg

SEQ ID NO: 1120808 - RNA, 14 nt, Mycobacterium bovis subsp bovis AF2122/97
ccaguugugcggcc

SEQ ID NO: 1120809 - RNA, 19 nt, Mycobacterium bovis subsp bovis AF2122/97
ccaguguugcgcugcggcc

SEQ ID NO: 1120810 - RNA, 18 nt, Mycobacterium bovis subsp bovis AF2122/97
ccaguguggugcggcgcg

SEQ ID NO: 1120811 - RNA, 24 nt, Mycobacterium bovis subsp bovis AF2122/97
ccaguguugcaguggcgacgagca

SEQ ID NO: 1120812 - RNA, 16 nt, Mycobacterium bovis subsp bovis AF2122/97
ccaguguugcgcugcg

SEQ ID NO: 1120813 - RNA, 16 nt, Mycobacterium bovis subsp bovis AF2122/97
ccaggucuucgaccac

SEQ ID NO: 1120814 - RNA, 22 nt, Mycobacterium bovis subsp bovis AF2122/97
ccaggucuucgaccacggucug

SEQ ID NO: 1120815 - RNA, 15 nt, Mycobacterium bovis subsp bovis AF2122/97
ccaggugcagcacca

SEQ ID NO: 1120816 - RNA, 21 nt, Mycobacterium bovis subsp bovis AF2122/97
ccagguucuucuccaccaccg

SEQ ID NO: 1120817 - RNA, 22 nt, Mycobacterium bovis subsp bovis AF2122/97
ccagguuguagacggcaccccc

SEQ ID NO: 1120818 - RNA, 19 nt, Mycobacterium bovis subsp bovis AF2122/97
ccagguugaggugugccga

SEQ ID NO: 1120819 - RNA, 17 nt, Mycobacterium bovis subsp bovis AF2122/97
ccagguugaucguggcg

SEQ ID NO: 1120820 - RNA, 20 nt, Mycobacterium bovis subsp bovis AF2122/97
ccagucgcaggaucggcgga

SEQ ID NO: 1120821 - RNA, 17 nt, Mycobacterium bovis subsp bovis AF2122/97
ccagucgauucggccca

SEQ ID NO: 1120822 - RNA, 16 nt, Mycobacterium bovis subsp bovis AF2122/97
ccagucgcacgacguc

SEQ ID NO: 1120823 - RNA, 21 nt, Mycobacterium bovis subsp bovis AF2122/97
ccagucguacucccaggccgc

SEQ ID NO: 1120824 - RNA, 22 nt, Mycobacterium bovis subsp bovis AF2122/97
ccagucguacucccaggccgcc

SEQ ID NO: 1120825 - RNA, 14 nt, Mycobacterium bovis subsp bovis AF2122/97
ccagucggcgccgc

SEQ ID NO: 1120826 - RNA, 20 nt, Mycobacterium bovis subsp bovis AF2122/97
ccagucggcgccgccgucca

SEQ ID NO: 1120827 - RNA, 17 nt, Mycobacterium bovis subsp bovis AF2122/97
ccagucgcggcguucgg

SEQ ID NO: 1120828 - RNA, 14 nt, Mycobacterium bovis subsp bovis AF2122/97
ccagucgaaucguc

SEQ ID NO: 1120829 - RNA, 20 nt, Mycobacterium bovis subsp bovis AF2122/97
ccagucgaagaagacccgug

SEQ ID NO: 1120830 - RNA, 14 nt, Mycobacterium bovis subsp bovis AF2122/97
ccagucgaucgcgg

SEQ ID NO: 1120831 - RNA, 15 nt, Mycobacterium bovis subsp bovis AF2122/97
ccagucccgcgucgg

SEQ ID NO: 1120832 - RNA, 15 nt, Mycobacterium bovis subsp bovis AF2122/97
ccagguuuugccgcg

SEQ ID NO: 1120833 - RNA, 16 nt, Mycobacterium bovis subsp bovis AF2122/97
ccagguuuugccgcgu

SEQ ID NO: 1120834 - RNA, 14 nt, Mycobacterium bovis subsp bovis AF2122/97
ccaucccggcgccg

SEQ ID NO: 1120835 - RNA, 23 nt, Mycobacterium bovis subsp bovis AF2122/97
ccaucccugaaauaccaguccgg

SEQ ID NO: 1120836 - RNA, 22 nt, Mycobacterium bovis subsp bovis AF2122/97
ccauccucgagcugcuggcgcg

SEQ ID NO: 1120837 - RNA, 20 nt, Mycobacterium bovis subsp bovis AF2122/97
ccauccucgaguuuggccag

SEQ ID NO: 1120838 - RNA, 13 nt, Mycobacterium bovis subsp bovis AF2122/97
ccauccggcggcg

SEQ ID NO: 1120839 - RNA, 12 nt, Mycobacterium bovis subsp bovis AF2122/97
ccauccuggacg

SEQ ID NO: 1120840 - RNA, 16 nt, Mycobacterium bovis subsp bovis AF2122/97
ccaucgccgccgcgcg

SEQ ID NO: 1120841 - RNA, 22 nt, Mycobacterium bovis subsp bovis AF2122/97
ccaucgccgccgcgcguucggc

SEQ ID NO: 1120842 - RNA, 17 nt, Mycobacterium bovis subsp bovis AF2122/97
ccaucgccuccagccgg

SEQ ID NO: 1120843 - RNA, 18 nt, Mycobacterium bovis subsp bovis AF2122/97
ccaucgccuccagccggc

SEQ ID NO: 1120844 - RNA, 14 nt, Mycobacterium bovis subsp bovis AF2122/97
ccaucgccagccgg

SEQ ID NO: 1120845 - RNA, 15 nt, Mycobacterium bovis subsp bovis AF2122/97
ccaucgccagccggc

SEQ ID NO: 1120846 - RNA, 16 nt, Mycobacterium bovis subsp bovis AF2122/97
ccaucgccagccggcg

SEQ ID NO: 1120847 - RNA, 14 nt, Mycobacterium bovis subsp bovis AF2122/97
ccaucgccaccgcg

SEQ ID NO: 1120848 - RNA, 16 nt, Mycobacterium bovis subsp bovis AF2122/97
ccaucgccaccgcguc

SEQ ID NO: 1120849 - RNA, 19 nt, Mycobacterium bovis subsp bovis AF2122/97
ccaucgccaccgcgucacu

SEQ ID NO: 1120850 - RNA, 20 nt, Mycobacterium bovis subsp bovis AF2122/97
ccaucgcccgaugcgccagc

SEQ ID NO: 1120851 - RNA, 12 nt, Mycobacterium bovis subsp bovis AF2122/97
ccaucgcccggu

SEQ ID NO: 1120852 - RNA, 21 nt, Mycobacterium bovis subsp bovis AF2122/97
ccaucccgccgcccgcaucgc

SEQ ID NO: 1120853 - RNA, 17 nt, Mycobacterium bovis subsp bovis AF2122/97
ccaucgacccgaucacg

SEQ ID NO: 1120854 - RNA, 15 nt, Mycobacterium bovis subsp bovis AF2122/97
ccaucgaccgcccgc

SEQ ID NO: 1120855 - RNA, 20 nt, Mycobacterium bovis subsp bovis AF2122/97
ccaucgaccgcccgccagcg

SEQ ID NO: 1120856 - RNA, 19 nt, Mycobacterium bovis subsp bovis AF2122/97
ccaucgaggcgaucaccgc

SEQ ID NO: 1120857 - RNA, 13 nt, Mycobacterium bovis subsp bovis AF2122/97
ccaucgccaccgc

SEQ ID NO: 1120858 - RNA, 22 nt, Mycobacterium bovis subsp bovis AF2122/97
ccaucgaggcgaucaccgcgcc

SEQ ID NO: 1120859 - RNA, 23 nt, Mycobacterium bovis subsp bovis AF2122/97
ccaucgaggcgaucaccgcgccg

SEQ ID NO: 1120860 - RNA, 15 nt, Mycobacterium bovis subsp bovis AF2122/97
ccauacuggcggucc

SEQ ID NO: 1120861 - RNA, 15 nt, Mycobacterium bovis subsp bovis AF2122/97
ccauacgccggccgc

SEQ ID NO: 1120862 - RNA, 20 nt, Mycobacterium bovis subsp bovis AF2122/97
ccauacggaagggcccggug

SEQ ID NO: 1120863 - RNA, 21 nt, Mycobacterium bovis subsp bovis AF2122/97
ccauacggcaauacccgccgc

SEQ ID NO: 1120864 - RNA, 20 nt, Mycobacterium bovis subsp bovis AF2122/97
ccauagaugcccgcgaucau

SEQ ID NO: 1120865 - RNA, 21 nt, Mycobacterium bovis subsp bovis AF2122/97
ccauaccggccgccaucaucg

SEQ ID NO: 1120866 - RNA, 20 nt, Mycobacterium bovis subsp bovis AF2122/97
ccauaccggcuggccaggug

SEQ ID NO: 1120867 - RNA, 14 nt, Mycobacterium bovis subsp bovis AF2122/97
ccauacccgcgcgc

SEQ ID NO: 1120868 - RNA, 22 nt, Mycobacterium bovis subsp bovis AF2122/97
ccaucaucccguauucgaugcc

SEQ ID NO: 1120869 - RNA, 22 nt, Mycobacterium bovis subsp bovis AF2122/97
ccaucaucgccaccaccccguc

SEQ ID NO: 1120870 - RNA, 23 nt, Mycobacterium bovis subsp bovis AF2122/97
ccaucaucgcccugggcgccggc

SEQ ID NO: 1120871 - RNA, 20 nt, Mycobacterium bovis subsp bovis AF2122/97
ccaucauguucuuuugcguc

SEQ ID NO: 1120872 - RNA, 15 nt, Mycobacterium bovis subsp bovis AF2122/97
ccaucccgauccugc

SEQ ID NO: 1120873 - RNA, 19 nt, Mycobacterium bovis subsp bovis AF2122/97
ccaucccgauccuggccac

SEQ ID NO: 1120874 - RNA, 13 nt, Mycobacterium bovis subsp bovis AF2122/97
ccauccccgccgg

SEQ ID NO: 1120875 - RNA, 16 nt, Mycobacterium bovis subsp bovis AF2122/97
ccauccccuggccagc

SEQ ID NO: 1120876 - RNA, 19 nt, Mycobacterium bovis subsp bovis AF2122/97
ccauccaugauggccguca

SEQ ID NO: 1120877 - RNA, 14 nt, Mycobacterium bovis subsp bovis AF2122/97
ccaugcugcgcaac

SEQ ID NO: 1120878 - RNA, 11 nt, Mycobacterium bovis subsp bovis AF2122/97
ccaugcugcgc

SEQ ID NO: 1120879 - RNA, 19 nt, Mycobacterium bovis subsp bovis AF2122/97
ccaugcuccuaucacugga

SEQ ID NO: 1120880 - RNA, 17 nt, Mycobacterium bovis subsp bovis AF2122/97
ccaugccgcucggcaac

SEQ ID NO: 1120881 - RNA, 17 nt, Mycobacterium bovis subsp bovis AF2122/97
ccaugccacaacgccuc

SEQ ID NO: 1120882 - RNA, 16 nt, Mycobacterium bovis subsp bovis AF2122/97
ccaugcagcgcgucgc

SEQ ID NO: 1120883 - RNA, 14 nt, Mycobacterium bovis subsp bovis AF2122/97
ccaugccgacgacg

SEQ ID NO: 1120884 - RNA, 23 nt, Mycobacterium bovis subsp bovis AF2122/97
ccaugccgaucggccugcagcga

SEQ ID NO: 1120885 - RNA, 23 nt, Mycobacterium bovis subsp bovis AF2122/97
ccauucagugucgccuuuggcgu

SEQ ID NO: 1120886 - RNA, 20 nt, Mycobacterium bovis subsp bovis AF2122/97
ccauucccaacacagccguc

SEQ ID NO: 1120887 - RNA, 21 nt, Mycobacterium bovis subsp bovis AF2122/97
ccaugcuaggaccaccagcgc

SEQ ID NO: 1120888 - RNA, 15 nt, Mycobacterium bovis subsp bovis AF2122/97
ccauggacggccagg

SEQ ID NO: 1120889 - RNA, 15 nt, Mycobacterium bovis subsp bovis AF2122/97
ccauggcacugccgg

SEQ ID NO: 1120890 - RNA, 16 nt, Mycobacterium bovis subsp bovis AF2122/97
ccauggcacugccggc

SEQ ID NO: 1120891 - RNA, 16 nt, Mycobacterium bovis subsp bovis AF2122/97
ccauggcagcgccgca

SEQ ID NO: 1120892 - RNA, 14 nt, Mycobacterium bovis subsp bovis AF2122/97
ccauggcgccgcgc

SEQ ID NO: 1120893 - RNA, 15 nt, Mycobacterium bovis subsp bovis AF2122/97
ccauggcgccgcgcc

SEQ ID NO: 1120894 - RNA, 12 nt, Mycobacterium bovis subsp bovis AF2122/97
ccauggccgauu

SEQ ID NO: 1120895 - RNA, 19 nt, Mycobacterium bovis subsp bovis AF2122/97
ccauggccucccacucacc

SEQ ID NO: 1120896 - RNA, 20 nt, Mycobacterium bovis subsp bovis AF2122/97
ccauggccaccgaacgcggc

SEQ ID NO: 1120897 - RNA, 14 nt, Mycobacterium bovis subsp bovis AF2122/97
ccauggccaccagg

SEQ ID NO: 1120898 - RNA, 15 nt, Mycobacterium bovis subsp bovis AF2122/97
ccauggcccguuggc

SEQ ID NO: 1120899 - RNA, 12 nt, Mycobacterium bovis subsp bovis AF2122/97
ccaucgaucgag

SEQ ID NO: 1120900 - RNA, 15 nt, Mycobacterium bovis subsp bovis AF2122/97
ccaucgcuugcgcac

SEQ ID NO: 1120901 - RNA, 13 nt, Mycobacterium bovis subsp bovis AF2122/97
ccaucgcgucggc

SEQ ID NO: 1120902 - RNA, 14 nt, Mycobacterium bovis subsp bovis AF2122/97
ccaucgcgcgccga

SEQ ID NO: 1120903 - RNA, 16 nt, Mycobacterium bovis subsp bovis AF2122/97
ccaucgcgcgccgacc

SEQ ID NO: 1120904 - RNA, 18 nt, Mycobacterium bovis subsp bovis AF2122/97
ccaucgcgcugcggccca

SEQ ID NO: 1120905 - RNA, 20 nt, Mycobacterium bovis subsp bovis AF2122/97
ccaucgcgacuagacgccgc

SEQ ID NO: 1120906 - RNA, 16 nt, Mycobacterium bovis subsp bovis AF2122/97
ccaugaccgggcuggc

SEQ ID NO: 1120907 - RNA, 17 nt, Mycobacterium bovis subsp bovis AF2122/97
ccaugaucacaccgagc

SEQ ID NO: 1120908 - RNA, 18 nt, Mycobacterium bovis subsp bovis AF2122/97
ccaugaucacaccgagcg

SEQ ID NO: 1120909 - RNA, 21 nt, Mycobacterium bovis subsp bovis AF2122/97
ccaugagguaggucgccgccg

SEQ ID NO: 1120910 - RNA, 16 nt, Mycobacterium bovis subsp bovis AF2122/97
ccaugcaccgaugccg

SEQ ID NO: 1120911 - RNA, 21 nt, Mycobacterium bovis subsp bovis AF2122/97
ccaugauugccaggaccgcgc

SEQ ID NO: 1120912 - RNA, 23 nt, Mycobacterium bovis subsp bovis AF2122/97
ccaugauugccaggaccgcgccg

SEQ ID NO: 1120913 - RNA, 20 nt, Mycobacterium bovis subsp bovis AF2122/97
ccaugauggccgucagccag

SEQ ID NO: 1120914 - RNA, 19 nt, Mycobacterium bovis subsp bovis AF2122/97
ccaugauggucacggcguc

SEQ ID NO: 1120915 - RNA, 16 nt, Mycobacterium bovis subsp bovis AF2122/97
ccaugaucccgcugac

SEQ ID NO: 1120916 - RNA, 17 nt, Mycobacterium bovis subsp bovis AF2122/97
ccaugaucacaccgcug

SEQ ID NO: 1120917 - RNA, 14 nt, Mycobacterium bovis subsp bovis AF2122/97
ccaugauggccguc

SEQ ID NO: 1120918 - RNA, 16 nt, Mycobacterium bovis subsp bovis AF2122/97
ccaugauggccgucag

SEQ ID NO: 1120919 - RNA, 14 nt, Mycobacterium bovis subsp bovis AF2122/97
ccaugaugaccggc

SEQ ID NO: 1120920 - RNA, 13 nt, Mycobacterium bovis subsp bovis AF2122/97
ccaugauggacag

SEQ ID NO: 1120921 - RNA, 15 nt, Mycobacterium bovis subsp bovis AF2122/97
ccaugauggacagcu

SEQ ID NO: 1120922 - RNA, 21 nt, Mycobacterium bovis subsp bovis AF2122/97
ccagcaccgugacccugaugg

SEQ ID NO: 1120923 - RNA, 17 nt, Mycobacterium bovis subsp bovis AF2122/97
ccagcaccucgaccgcc

SEQ ID NO: 1120924 - RNA, 21 nt, Mycobacterium bovis subsp bovis AF2122/97
ccagcaccuagucgcggccgu

SEQ ID NO: 1120925 - RNA, 22 nt, Mycobacterium bovis subsp bovis AF2122/97
ccagcaccgggaagucgggguc

SEQ ID NO: 1120926 - RNA, 12 nt, Mycobacterium bovis subsp bovis AF2122/97
ccagcacgcugg

SEQ ID NO: 1120927 - RNA, 15 nt, Mycobacterium bovis subsp bovis AF2122/97
ccagcaccgccgcgc

SEQ ID NO: 1120928 - RNA, 19 nt, Mycobacterium bovis subsp bovis AF2122/97
ccagcaccgccgcgccggc

SEQ ID NO: 1120929 - RNA, 21 nt, Mycobacterium bovis subsp bovis AF2122/97
ccagcaccgccgcgccggcgg

SEQ ID NO: 1120930 - RNA, 13 nt, Mycobacterium bovis subsp bovis AF2122/97
ccagcacccgcgc

SEQ ID NO: 1120931 - RNA, 13 nt, Mycobacterium bovis subsp bovis AF2122/97
ccagcacgcuggc

SEQ ID NO: 1120932 - RNA, 14 nt, Mycobacterium bovis subsp bovis AF2122/97
ccagcacggcgauc

SEQ ID NO: 1120933 - RNA, 13 nt, Mycobacterium bovis subsp bovis AF2122/97
ccagcacgugcca

SEQ ID NO: 1120934 - RNA, 23 nt, Mycobacterium bovis subsp bovis AF2122/97
ccagcagcagugccaccgguuug

SEQ ID NO: 1120935 - RNA, 22 nt, Mycobacterium bovis subsp bovis AF2122/97
ccagcagccagcccagccgcca

SEQ ID NO: 1120936 - RNA, 19 nt, Mycobacterium bovis subsp bovis AF2122/97
ccagcagguuccacggcca

SEQ ID NO: 1120937 - RNA, 20 nt, Mycobacterium bovis subsp bovis AF2122/97
ccagcagguuccacggccag

SEQ ID NO: 1120938 - RNA, 17 nt, Mycobacterium bovis subsp bovis AF2122/97
ccagcaguacaccgccc

SEQ ID NO: 1120939 - RNA, 18 nt, Mycobacterium bovis subsp bovis AF2122/97
ccagcaguacaccgcccg

SEQ ID NO: 1120940 - RNA, 21 nt, Mycobacterium bovis subsp bovis AF2122/97
ccagcaggggacgggcggcca

SEQ ID NO: 1120941 - RNA, 18 nt, Mycobacterium bovis subsp bovis AF2122/97
ccagcaucagcccggcgc

SEQ ID NO: 1120942 - RNA, 16 nt, Mycobacterium bovis subsp bovis AF2122/97
ccagcaucagcgccag

SEQ ID NO: 1120943 - RNA, 17 nt, Mycobacterium bovis subsp bovis AF2122/97
ccagcaucagcgccagc

SEQ ID NO: 1120944 - RNA, 19 nt, Mycobacterium bovis subsp bovis AF2122/97
ccagcaucagcucgaugcc

SEQ ID NO: 1120945 - RNA, 20 nt, Mycobacterium bovis subsp bovis AF2122/97
ccagcaucaguuugacgccg

SEQ ID NO: 1120946 - RNA, 13 nt, Mycobacterium bovis subsp bovis AF2122/97
ccagcagcggcga

SEQ ID NO: 1120947 - RNA, 15 nt, Mycobacterium bovis subsp bovis AF2122/97
ccagcagcgacgcug

SEQ ID NO: 1120948 - RNA, 19 nt, Mycobacterium bovis subsp bovis AF2122/97
ccagcagcgacgcugccgc

SEQ ID NO: 1120949 - RNA, 21 nt, Mycobacterium bovis subsp bovis AF2122/97
ccagcagcgacgcugccgcca

SEQ ID NO: 1120950 - RNA, 15 nt, Mycobacterium bovis subsp bovis AF2122/97
ccagcagcgacgguc

SEQ ID NO: 1120951 - RNA, 14 nt, Mycobacterium bovis subsp bovis AF2122/97
ccagcagccugcgc

SEQ ID NO: 1120952 - RNA, 17 nt, Mycobacterium bovis subsp bovis AF2122/97
ccagcagccugcgccgc

SEQ ID NO: 1120953 - RNA, 18 nt, Mycobacterium bovis subsp bovis AF2122/97
ccagcagcgaaaaccguc

SEQ ID NO: 1120954 - RNA, 13 nt, Mycobacterium bovis subsp bovis AF2122/97
ccagcagccgcga

SEQ ID NO: 1120955 - RNA, 14 nt, Mycobacterium bovis subsp bovis AF2122/97
ccagcagccgcgac

SEQ ID NO: 1120956 - RNA, 23 nt, Mycobacterium bovis subsp bovis AF2122/97
ccagcagcuugacaucggucagc

SEQ ID NO: 1120957 - RNA, 24 nt, Mycobacterium bovis subsp bovis AF2122/97
ccagcagcugaaaauaggccgggc

SEQ ID NO: 1120958 - RNA, 14 nt, Mycobacterium bovis subsp bovis AF2122/97
ccagcagcucggcc

SEQ ID NO: 1120959 - RNA, 16 nt, Mycobacterium bovis subsp bovis AF2122/97
ccagcagcucgccggc

SEQ ID NO: 1120960 - RNA, 17 nt, Mycobacterium bovis subsp bovis AF2122/97
ccagcagcucgccggca

SEQ ID NO: 1120961 - RNA, 14 nt, Mycobacterium bovis subsp bovis AF2122/97
ccagcacccucagg

SEQ ID NO: 1120962 - RNA, 19 nt, Mycobacterium bovis subsp bovis AF2122/97
ccagcacccucaggcaauc

SEQ ID NO: 1120963 - RNA, 19 nt, Mycobacterium bovis subsp bovis AF2122/97
ccagcacccgcagccgcga

SEQ ID NO: 1120964 - RNA, 17 nt, Mycobacterium bovis subsp bovis AF2122/97
ccagcacccgcucggcc

SEQ ID NO: 1120965 - RNA, 14 nt, Mycobacterium bovis subsp bovis AF2122/97
ccagcacccgcugc

SEQ ID NO: 1120966 - RNA, 17 nt, Mycobacterium bovis subsp bovis AF2122/97
ccagcacccgcugcacg

SEQ ID NO: 1120967 - RNA, 22 nt, Mycobacterium bovis subsp bovis AF2122/97
ccagcacccgcugcacgccguc

SEQ ID NO: 1120968 - RNA, 12 nt, Mycobacterium bovis subsp bovis AF2122/97
ccagcacccggc

SEQ ID NO: 1120969 - RNA, 13 nt, Mycobacterium bovis subsp bovis AF2122/97
ccagcacccgagc

SEQ ID NO: 1120970 - RNA, 19 nt, Mycobacterium bovis subsp bovis AF2122/97
ccagcacccccugcaccgu

SEQ ID NO: 1120971 - RNA, 19 nt, Mycobacterium bovis subsp bovis AF2122/97
ccagcaccacaacgucggc

SEQ ID NO: 1120972 - RNA, 17 nt, Mycobacterium bovis subsp bovis AF2122/97
ccagcaccccgaucugg

SEQ ID NO: 1120973 - RNA, 15 nt, Mycobacterium bovis subsp bovis AF2122/97
ccagcaccagcacgg

SEQ ID NO: 1120974 - RNA, 21 nt, Mycobacterium bovis subsp bovis AF2122/97
ccagcaccacgucgacgaugu

SEQ ID NO: 1120975 - RNA, 13 nt, Mycobacterium bovis subsp bovis AF2122/97
ccagcaccacggc

SEQ ID NO: 1120976 - RNA, 15 nt, Mycobacterium bovis subsp bovis AF2122/97
ccagcaccacggcca

SEQ ID NO: 1120977 - RNA, 19 nt, Mycobacterium bovis subsp bovis AF2122/97
ccagcaccacggcgcgcgc

SEQ ID NO: 1120978 - RNA, 22 nt, Mycobacterium bovis subsp bovis AF2122/97
ccagcaccagcgucgcggccac

SEQ ID NO: 1120979 - RNA, 20 nt, Mycobacterium bovis subsp bovis AF2122/97
ccagcacacgccuaccgcga

SEQ ID NO: 1120980 - RNA, 15 nt, Mycobacterium bovis subsp bovis AF2122/97
ccagcacacccagau

SEQ ID NO: 1120981 - RNA, 14 nt, Mycobacterium bovis subsp bovis AF2122/97
ccagcacacccccg

SEQ ID NO: 1120982 - RNA, 14 nt, Mycobacterium bovis subsp bovis AF2122/97
ccagcacacccguc

SEQ ID NO: 1120983 - RNA, 17 nt, Mycobacterium bovis subsp bovis AF2122/97
ccagcacaccgcccgca

SEQ ID NO: 1120984 - RNA, 14 nt, Mycobacterium bovis subsp bovis AF2122/97
ccagcaccaccgcg

SEQ ID NO: 1120985 - RNA, 15 nt, Mycobacterium bovis subsp bovis AF2122/97
ccagcaccaccgcgg

SEQ ID NO: 1120986 - RNA, 17 nt, Mycobacterium bovis subsp bovis AF2122/97
ccagcaccaccgcggug

SEQ ID NO: 1120987 - RNA, 16 nt, Mycobacterium bovis subsp bovis AF2122/97
ccagcaccaccggcuc

SEQ ID NO: 1120988 - RNA, 17 nt, Mycobacterium bovis subsp bovis AF2122/97
ccagcaaaugcggcgcg

SEQ ID NO: 1120989 - RNA, 22 nt, Mycobacterium bovis subsp bovis AF2122/97
ccagcaagucugcccgacugcc

SEQ ID NO: 1120990 - RNA, 17 nt, Mycobacterium bovis subsp bovis AF2122/97
ccagcaauaccugagcg

SEQ ID NO: 1120991 - RNA, 15 nt, Mycobacterium bovis subsp bovis AF2122/97
ccagcaaggccagca

SEQ ID NO: 1120992 - RNA, 19 nt, Mycobacterium bovis subsp bovis AF2122/97
ccagcaaugcccgcaccgc

SEQ ID NO: 1120993 - RNA, 15 nt, Mycobacterium bovis subsp bovis AF2122/97
ccagcaaugccgacu

SEQ ID NO: 1120994 - RNA, 20 nt, Mycobacterium bovis subsp bovis AF2122/97
ccagauugccugggcggccg

SEQ ID NO: 1120995 - RNA, 23 nt, Mycobacterium bovis subsp bovis AF2122/97
ccagcaacagcgagcgguugauc

SEQ ID NO: 1120996 - RNA, 23 nt, Mycobacterium bovis subsp bovis AF2122/97
ccagauugguugauagcguggua

SEQ ID NO: 1120997 - RNA, 15 nt, Mycobacterium bovis subsp bovis AF2122/97
ccagcaaaacccgcu

SEQ ID NO: 1120998 - RNA, 19 nt, Mycobacterium bovis subsp bovis AF2122/97
ccagcaaaccuucgauaac

SEQ ID NO: 1120999 - RNA, 19 nt, Mycobacterium bovis subsp bovis AF2122/97
ccagcaacagcccgaggcc

SEQ ID NO: 1121000 - RNA, 13 nt, Mycobacterium bovis subsp bovis AF2122/97
ccagcaacaccag

SEQ ID NO: 1121001 - RNA, 15 nt, Mycobacterium bovis subsp bovis AF2122/97
ccagcaacccugcgg

SEQ ID NO: 1121002 - RNA, 14 nt, Mycobacterium bovis subsp bovis AF2122/97
ccagcaacugccgc

SEQ ID NO: 1121003 - RNA, 13 nt, Mycobacterium bovis subsp bovis AF2122/97
ccagagcaucagg

SEQ ID NO: 1121004 - RNA, 17 nt, Mycobacterium bovis subsp bovis AF2122/97
ccagagcacgggcucgc

SEQ ID NO: 1121005 - RNA, 16 nt, Mycobacterium bovis subsp bovis AF2122/97
ccagagccgcgcgccg

SEQ ID NO: 1121006 - RNA, 17 nt, Mycobacterium bovis subsp bovis AF2122/97
ccagagccgcgcgccgg

SEQ ID NO: 1121007 - RNA, 19 nt, Mycobacterium bovis subsp bovis AF2122/97
ccagagcgaacccccgccg

SEQ ID NO: 1121008 - RNA, 20 nt, Mycobacterium bovis subsp bovis AF2122/97
ccagagcgaacccccgccgc

SEQ ID NO: 1121009 - RNA, 23 nt, Mycobacterium bovis subsp bovis AF2122/97
ccagagcgaacccccgccgcgca

SEQ ID NO: 1121010 - RNA, 15 nt, Mycobacterium bovis subsp bovis AF2122/97
ccagagccgcugcgg

SEQ ID NO: 1121011 - RNA, 16 nt, Mycobacterium bovis subsp bovis AF2122/97
ccagaggcgugucgac

SEQ ID NO: 1121012 - RNA, 14 nt, Mycobacterium bovis subsp bovis AF2122/97
ccagagucgcccgc

SEQ ID NO: 1121013 - RNA, 18 nt, Mycobacterium bovis subsp bovis AF2122/97
ccagagcuucgccgcgca

SEQ ID NO: 1121014 - RNA, 20 nt, Mycobacterium bovis subsp bovis AF2122/97
ccagagcuucgccgcgcagc

SEQ ID NO: 1121015 - RNA, 19 nt, Mycobacterium bovis subsp bovis AF2122/97
ccagaggaugucgaugggg

SEQ ID NO: 1121016 - RNA, 18 nt, Mycobacterium bovis subsp bovis AF2122/97
ccagaggcgcuucgccac

SEQ ID NO: 1121017 - RNA, 13 nt, Mycobacterium bovis subsp bovis AF2122/97
ccagaggucacgc

SEQ ID NO: 1121018 - RNA, 15 nt, Mycobacterium bovis subsp bovis AF2122/97
ccagaggucgagcgc

SEQ ID NO: 1121019 - RNA, 13 nt, Mycobacterium bovis subsp bovis AF2122/97
ccagagucgcccg

SEQ ID NO: 1121020 - RNA, 22 nt, Mycobacterium bovis subsp bovis AF2122/97
ccacguagcagcgccggcaccg

SEQ ID NO: 1121021 - RNA, 23 nt, Mycobacterium bovis subsp bovis AF2122/97
ccacguagcagcgccggcaccga

SEQ ID NO: 1121022 - RNA, 17 nt, Mycobacterium bovis subsp bovis AF2122/97
ccacguacuccaccgcg

SEQ ID NO: 1121023 - RNA, 18 nt, Mycobacterium bovis subsp bovis AF2122/97
ccacguacuccaccgcgc

SEQ ID NO: 1121024 - RNA, 21 nt, Mycobacterium bovis subsp bovis AF2122/97
ccacguacuccaccgcgccgu

SEQ ID NO: 1121025 - RNA, 14 nt, Mycobacterium bovis subsp bovis AF2122/97
ccacgggccggccg

SEQ ID NO: 1121026 - RNA, 15 nt, Mycobacterium bovis subsp bovis AF2122/97
ccacgggcggccacc

SEQ ID NO: 1121027 - RNA, 19 nt, Mycobacterium bovis subsp bovis AF2122/97
ccacgggcggccaccgcac

SEQ ID NO: 1121028 - RNA, 21 nt, Mycobacterium bovis subsp bovis AF2122/97
ccacggggcgugacagggcgg

SEQ ID NO: 1121029 - RNA, 16 nt, Mycobacterium bovis subsp bovis AF2122/97
ccacggucaagccggc

SEQ ID NO: 1121030 - RNA, 19 nt, Mycobacterium bovis subsp bovis AF2122/97
ccacggucaagccggcgcc

SEQ ID NO: 1121031 - RNA, 16 nt, Mycobacterium bovis subsp bovis AF2122/97
ccacgguucgggcagc

SEQ ID NO: 1121032 - RNA, 19 nt, Mycobacterium bovis subsp bovis AF2122/97
ccacgguugccggcggcga

SEQ ID NO: 1121033 - RNA, 14 nt, Mycobacterium bovis subsp bovis AF2122/97
ccacggccggccgc

SEQ ID NO: 1121034 - RNA, 15 nt, Mycobacterium bovis subsp bovis AF2122/97
ccacggcgaccacgc

SEQ ID NO: 1121035 - RNA, 22 nt, Mycobacterium bovis subsp bovis AF2122/97
ccacggcgaccacgccgccggc

SEQ ID NO: 1121036 - RNA, 19 nt, Mycobacterium bovis subsp bovis AF2122/97
ccacggcgauccggucggc

SEQ ID NO: 1121037 - RNA, 22 nt, Mycobacterium bovis subsp bovis AF2122/97
ccacggcgauccggucggccag

SEQ ID NO: 1121038 - RNA, 23 nt, Mycobacterium bovis subsp bovis AF2122/97
ccacggcgauccggucggccagg

SEQ ID NO: 1121039 - RNA, 17 nt, Mycobacterium bovis subsp bovis AF2122/97
ccacggcgaugcagcca

SEQ ID NO: 1121040 - RNA, 19 nt, Mycobacterium bovis subsp bovis AF2122/97
ccacggcugcccauggugg

SEQ ID NO: 1121041 - RNA, 22 nt, Mycobacterium bovis subsp bovis AF2122/97
ccacggcugcccaugguggcga

SEQ ID NO: 1121042 - RNA, 22 nt, Mycobacterium bovis subsp bovis AF2122/97
ccacgggaguacgggagccggc

SEQ ID NO: 1121043 - RNA, 19 nt, Mycobacterium bovis subsp bovis AF2122/97
ccacggcuucgccgcggga

SEQ ID NO: 1121044 - RNA, 21 nt, Mycobacterium bovis subsp bovis AF2122/97
ccacggcuuugcggcgcgacc

SEQ ID NO: 1121045 - RNA, 21 nt, Mycobacterium bovis subsp bovis AF2122/97
ccacggcacuggguccacgcg

SEQ ID NO: 1121046 - RNA, 22 nt, Mycobacterium bovis subsp bovis AF2122/97
ccacggcacuggguccacgcgc

SEQ ID NO: 1121047 - RNA, 16 nt, Mycobacterium bovis subsp bovis AF2122/97
ccacggcaucggccac

SEQ ID NO: 1121048 - RNA, 15 nt, Mycobacterium bovis subsp bovis AF2122/97
ccacggaucgcggcg

SEQ ID NO: 1121049 - RNA, 16 nt, Mycobacterium bovis subsp bovis AF2122/97
ccacggaucgcggcgg

SEQ ID NO: 1121050 - RNA, 20 nt, Mycobacterium bovis subsp bovis AF2122/97
ccaccgucaccgccguugcc

SEQ ID NO: 1121051 - RNA, 15 nt, Mycobacterium bovis subsp bovis AF2122/97
ccacgcugaccaacg
